United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 53

SEQ ID NO: 2388432 - RNA, 13 nt, Human
ccuuguccccaca

SEQ ID NO: 2388433 - RNA, 14 nt, Human
ccuuguccccacac

SEQ ID NO: 2388434 - RNA, 15 nt, Human
ccuuguccccacacu

SEQ ID NO: 2388435 - RNA, 16 nt, Human
ccuuguccccacacuc

SEQ ID NO: 2388436 - RNA, 17 nt, Human
ccuuguccccacacucc

SEQ ID NO: 2388437 - RNA, 18 nt, Human
ccuuguccccacacuccu

SEQ ID NO: 2388438 - RNA, 19 nt, Human
ccuuguccccacacuccua

SEQ ID NO: 2388439 - RNA, 14 nt, Human
ccuuucucccaggc

SEQ ID NO: 2388440 - RNA, 22 nt, Human
ccuuucuccagccagcaaugau

SEQ ID NO: 2388441 - RNA, 18 nt, Human
ccuuucuccagccagcaa

SEQ ID NO: 2388442 - RNA, 20 nt, Human
ccuuucuccagccagcaaug

SEQ ID NO: 2388443 - RNA, 15 nt, Human
ccuuucuccccugcc

SEQ ID NO: 2388444 - RNA, 18 nt, Human
ccuuucuccccugccccc

SEQ ID NO: 2388445 - RNA, 10 nt, Human
ccuuucucac

SEQ ID NO: 2388446 - RNA, 18 nt, Human
ccuuucuaucauuuuugu

SEQ ID NO: 2388447 - RNA, 13 nt, Human
ccuuucuccagcc

SEQ ID NO: 2388448 - RNA, 14 nt, Human
ccuuucuccagcca

SEQ ID NO: 2388449 - RNA, 15 nt, Human
ccuuucuccagccag

SEQ ID NO: 2388450 - RNA, 16 nt, Human
ccuuucuccagccagc

SEQ ID NO: 2388451 - RNA, 17 nt, Human
ccuuucuccagccagca

SEQ ID NO: 2388452 - RNA, 23 nt, Human
ccuuucuaaacaagauuuuaaag

SEQ ID NO: 2388453 - RNA, 15 nt, Human
ccuuucuaaacaaga

SEQ ID NO: 2388454 - RNA, 22 nt, Human
ccuuucuaguccuauucuauug

SEQ ID NO: 2388455 - RNA, 17 nt, Human
ccuuucucccaggccag

SEQ ID NO: 2388456 - RNA, 19 nt, Human
ccuuucuccccugccccca

SEQ ID NO: 2388457 - RNA, 16 nt, Human
ccuuugaccugccucc

SEQ ID NO: 2388458 - RNA, 15 nt, Human
ccuuugaccugccuc

SEQ ID NO: 2388459 - RNA, 16 nt, Human
ccuuugacgccauccc

SEQ ID NO: 2388460 - RNA, 17 nt, Human
ccuuugacgccauccca

SEQ ID NO: 2388461 - RNA, 18 nt, Human
ccuuugacgccaucccag

SEQ ID NO: 2388462 - RNA, 20 nt, Human
ccuucggacaacucaguccc

SEQ ID NO: 2388463 - RNA, 13 nt, Human
ccuucuaccugcc

SEQ ID NO: 2388464 - RNA, 14 nt, Human
ccuucuaccugcca

SEQ ID NO: 2388465 - RNA, 15 nt, Human
ccuucuaccugccac

SEQ ID NO: 2388466 - RNA, 16 nt, Human
ccuucuaccugccacu

SEQ ID NO: 2388467 - RNA, 17 nt, Human
ccuucuaccugccacuc

SEQ ID NO: 2388468 - RNA, 14 nt, Human
ccuucuaggaagcu

SEQ ID NO: 2388469 - RNA, 15 nt, Human
ccuucuacugagccu

SEQ ID NO: 2388470 - RNA, 14 nt, Human
ccuucuacugagcc

SEQ ID NO: 2388471 - RNA, 18 nt, Human
ccuucuaccugccacuca

SEQ ID NO: 2388472 - RNA, 20 nt, Human
ccuucuaccugccacucaca

SEQ ID NO: 2388473 - RNA, 12 nt, Human
ccuucuaccugc

SEQ ID NO: 2388474 - RNA, 15 nt, Human
ccuucggcgccuuaa

SEQ ID NO: 2388475 - RNA, 15 nt, Human
ccuucuaguuuccca

SEQ ID NO: 2388476 - RNA, 20 nt, Human
ccuucuaggguuauugcauu

SEQ ID NO: 2388477 - RNA, 16 nt, Human
ccuucuaguuucccac

SEQ ID NO: 2388478 - RNA, 17 nt, Human
ccuucuaguuucccaca

SEQ ID NO: 2388479 - RNA, 18 nt, Human
ccuucuaguuucccacaa

SEQ ID NO: 2388480 - RNA, 15 nt, Human
ccuucuccuucaccu

SEQ ID NO: 2388481 - RNA, 19 nt, Human
ccuucuccuucaccuuugu

SEQ ID NO: 2388482 - RNA, 19 nt, Human
ccuucucucaccuccuaaa

SEQ ID NO: 2388483 - RNA, 14 nt, Human
ccuucucucaucuc

SEQ ID NO: 2388484 - RNA, 17 nt, Human
ccuucucucaccuccua

SEQ ID NO: 2388485 - RNA, 18 nt, Human
ccuucucucaccuccuaa

SEQ ID NO: 2388486 - RNA, 16 nt, Human
ccuucucucaccuccu

SEQ ID NO: 2388487 - RNA, 17 nt, Human
ccuucuccucuuguaaa

SEQ ID NO: 2388488 - RNA, 14 nt, Human
ccuucuguggcuca

SEQ ID NO: 2388489 - RNA, 15 nt, Human
ccuucugugaaagua

SEQ ID NO: 2388490 - RNA, 18 nt, Human
ccuucuguccugguguca

SEQ ID NO: 2388491 - RNA, 19 nt, Human
ccuucuguccuggugucac

SEQ ID NO: 2388492 - RNA, 21 nt, Human
ccuucuguccuggugucacuu

SEQ ID NO: 2388493 - RNA, 22 nt, Human
ccuucuguccuggugucacuua

SEQ ID NO: 2388494 - RNA, 22 nt, Human
ccuucuucggggaacuccugga

SEQ ID NO: 2388495 - RNA, 21 nt, Human
ccuucuucggggaacuccugg

SEQ ID NO: 2388496 - RNA, 18 nt, Human
ccuucuucuuuuugcugu

SEQ ID NO: 2388497 - RNA, 19 nt, Human
ccuucuucuuuuugcuguu

SEQ ID NO: 2388498 - RNA, 16 nt, Human
ccuucuuccaucccag

SEQ ID NO: 2388499 - RNA, 18 nt, Human
ccuucuuccaucccagga

SEQ ID NO: 2388500 - RNA, 19 nt, Human
ccuucuuccaucccaggac

SEQ ID NO: 2388501 - RNA, 15 nt, Human
ccuucuucacccagc

SEQ ID NO: 2388502 - RNA, 17 nt, Human
ccuucuucacccagcua

SEQ ID NO: 2388503 - RNA, 19 nt, Human
ccuucuucacccagcuaau

SEQ ID NO: 2388504 - RNA, 14 nt, Human
ccuucuuccauccc

SEQ ID NO: 2388505 - RNA, 22 nt, Human
ccuucuuccaucccaggacacc

SEQ ID NO: 2388506 - RNA, 22 nt, Human
ccuucuuauucucacuccacca

SEQ ID NO: 2388507 - RNA, 14 nt, Human
ccuucuucacccag

SEQ ID NO: 2388508 - RNA, 20 nt, Human
ccuucuuauucucacuccac

SEQ ID NO: 2388509 - RNA, 19 nt, Human
ccuucuuauucucacucca

SEQ ID NO: 2388510 - RNA, 23 nt, Human
ccuucuucacccagcuaaucugu

SEQ ID NO: 2388511 - RNA, 21 nt, Human
ccuucuguggcucacagaacc

SEQ ID NO: 2388512 - RNA, 18 nt, Human
ccuucuuauucucacucc

SEQ ID NO: 2388513 - RNA, 17 nt, Human
ccuucuuauucucacuc

SEQ ID NO: 2388514 - RNA, 21 nt, Human
ccuugagggugcuuguucccu

SEQ ID NO: 2388515 - RNA, 12 nt, Human
ccuugaggucuu

SEQ ID NO: 2388516 - RNA, 13 nt, Human
ccuugaggucuuu

SEQ ID NO: 2388517 - RNA, 23 nt, Human
ccuugaggucuuuugacaugugg

SEQ ID NO: 2388518 - RNA, 20 nt, Human
ccuugaguugauucagcucu

SEQ ID NO: 2388519 - RNA, 20 nt, Human
ccuugacgucaagucuccuu

SEQ ID NO: 2388520 - RNA, 16 nt, Human
ccuugacuuagauucu

SEQ ID NO: 2388521 - RNA, 21 nt, Human
ccuugaggaaacaacagcuuu

SEQ ID NO: 2388522 - RNA, 22 nt, Human
ccuugaggaggggcagguaaac

SEQ ID NO: 2388523 - RNA, 16 nt, Human
ccuugaggagucuugu

SEQ ID NO: 2388524 - RNA, 18 nt, Human
ccuugaggagucuugugu

SEQ ID NO: 2388525 - RNA, 23 nt, Human
ccuugaagauaucuugaaaugaa

SEQ ID NO: 2388526 - RNA, 11 nt, Human
ccuugaagccg

SEQ ID NO: 2388527 - RNA, 21 nt, Human
ccuugaaggguaaagaaguuu

SEQ ID NO: 2388528 - RNA, 21 nt, Human
ccuugaauauccccucccagu

SEQ ID NO: 2388529 - RNA, 23 nt, Human
ccuugaccauucuccaccugcca

SEQ ID NO: 2388530 - RNA, 13 nt, Human
ccuugacucuuuc

SEQ ID NO: 2388531 - RNA, 22 nt, Human
ccuugaccauucuccaccugcc

SEQ ID NO: 2388532 - RNA, 22 nt, Human
ccuugaagccacugaagcuggg

SEQ ID NO: 2388533 - RNA, 19 nt, Human
ccuugaagccacugaagcu

SEQ ID NO: 2388534 - RNA, 14 nt, Human
ccuugaagccacug

SEQ ID NO: 2388535 - RNA, 13 nt, Human
ccuugaagauauc

SEQ ID NO: 2388536 - RNA, 18 nt, Human
ccuugaaccacuucccuc

SEQ ID NO: 2388537 - RNA, 18 nt, Human
ccuugaagaacugcaggc

SEQ ID NO: 2388538 - RNA, 21 nt, Human
ccuugaagaacugcaggcccu

SEQ ID NO: 2388539 - RNA, 22 nt, Human
ccuugaagaacugcaggcccug

SEQ ID NO: 2388540 - RNA, 23 nt, Human
ccuugaagaacugcaggcccugg

SEQ ID NO: 2388541 - RNA, 14 nt, Human
ccuugaacuccugg

SEQ ID NO: 2388542 - RNA, 19 nt, Human
ccuugaaccacuucccuca

SEQ ID NO: 2388543 - RNA, 20 nt, Human
ccuugaacacugggggaggg

SEQ ID NO: 2388544 - RNA, 15 nt, Human
ccuugaaccacuucc

SEQ ID NO: 2388545 - RNA, 16 nt, Human
ccuugaaccacuuccc

SEQ ID NO: 2388546 - RNA, 18 nt, Human
ccuugaagaaccucucac

SEQ ID NO: 2388547 - RNA, 17 nt, Human
ccuugaagaaccucuca

SEQ ID NO: 2388548 - RNA, 13 nt, Human
ccuucuuuccucu

SEQ ID NO: 2388549 - RNA, 12 nt, Human
ccuucuuguagu

SEQ ID NO: 2388550 - RNA, 22 nt, Human
ccuucuucuuuuugcuguuguu

SEQ ID NO: 2388551 - RNA, 13 nt, Human
ccuucuuggugcu

SEQ ID NO: 2388552 - RNA, 20 nt, Human
ccuucuucuuuuugcuguug

SEQ ID NO: 2388553 - RNA, 21 nt, Human
ccuucuucuuuuugcuguugu

SEQ ID NO: 2388554 - RNA, 16 nt, Human
ccuucuugccuucaga

SEQ ID NO: 2388555 - RNA, 20 nt, Human
ccuugaaaacuuuaugcuaa

SEQ ID NO: 2388556 - RNA, 13 nt, Human
ccuugaacacugg

SEQ ID NO: 2388557 - RNA, 15 nt, Human
ccuugaaaauauuuu

SEQ ID NO: 2388558 - RNA, 21 nt, Human
ccuugaaaauaagaauagaaa

SEQ ID NO: 2388559 - RNA, 16 nt, Human
ccuucuuuccucuucc

SEQ ID NO: 2388560 - RNA, 17 nt, Human
ccuucuuuccucuuccc

SEQ ID NO: 2388561 - RNA, 13 nt, Human
ccuugaacuagga

SEQ ID NO: 2388562 - RNA, 15 nt, Human
ccuuaaaaccaaaga

SEQ ID NO: 2388563 - RNA, 16 nt, Human
ccuuaaaaccaaagag

SEQ ID NO: 2388564 - RNA, 17 nt, Human
ccuguuuuucugggugg

SEQ ID NO: 2388565 - RNA, 20 nt, Human
ccuguuuuucacauuuuccu

SEQ ID NO: 2388566 - RNA, 15 nt, Human
ccuguuuuucugggu

SEQ ID NO: 2388567 - RNA, 16 nt, Human
ccuguuuuucugggug

SEQ ID NO: 2388568 - RNA, 16 nt, Human
ccuguuuuucacauuu

SEQ ID NO: 2388569 - RNA, 13 nt, Human
ccuguuuuucaca

SEQ ID NO: 2388570 - RNA, 19 nt, Human
ccuguuuuuaagcuguuuc

SEQ ID NO: 2388571 - RNA, 18 nt, Human
ccuguuuuuaagcuguuu

SEQ ID NO: 2388572 - RNA, 17 nt, Human
ccuguuuuuaagcuguu

SEQ ID NO: 2388573 - RNA, 17 nt, Human
ccuguuuuguuggaagg

SEQ ID NO: 2388574 - RNA, 18 nt, Human
ccuguuuuguuggaaggu

SEQ ID NO: 2388575 - RNA, 17 nt, Human
ccuguuuucugagcccg

SEQ ID NO: 2388576 - RNA, 15 nt, Human
ccuguuuucugagcc

SEQ ID NO: 2388577 - RNA, 16 nt, Human
ccuguuuucugagccc

SEQ ID NO: 2388578 - RNA, 23 nt, Human
ccuuaaaacuuuaaucccacuug

SEQ ID NO: 2388579 - RNA, 17 nt, Human
ccuuaaaaccaaagagg

SEQ ID NO: 2388580 - RNA, 15 nt, Human
ccuuaaacugugugg

SEQ ID NO: 2388581 - RNA, 23 nt, Human
ccuuaaacagggcaucuccagga

SEQ ID NO: 2388582 - RNA, 20 nt, Human
ccuuaaacaaaaauuaaaau

SEQ ID NO: 2388583 - RNA, 12 nt, Human
ccuuaacacuga

SEQ ID NO: 2388584 - RNA, 12 nt, Human
ccuuaaaggaag

SEQ ID NO: 2388585 - RNA, 22 nt, Human
ccuuaaagucaguaacuuaccc

SEQ ID NO: 2388586 - RNA, 23 nt, Human
ccuuaaagaaagucgaauuaaua

SEQ ID NO: 2388587 - RNA, 22 nt, Human
ccuuaaaggcaccaucuaauag

SEQ ID NO: 2388588 - RNA, 14 nt, Human
ccuuaaguaagcaa

SEQ ID NO: 2388589 - RNA, 23 nt, Human
ccuuaaucagguccucagagaau

SEQ ID NO: 2388590 - RNA, 17 nt, Human
ccuuaauucacucccac

SEQ ID NO: 2388591 - RNA, 14 nt, Human
ccuuacacaauggu

SEQ ID NO: 2388592 - RNA, 20 nt, Human
ccuuacacaaugguuuucuu

SEQ ID NO: 2388593 - RNA, 17 nt, Human
ccuuaacuggagcccca

SEQ ID NO: 2388594 - RNA, 23 nt, Human
ccuuaacuggagccccaucagcu

SEQ ID NO: 2388595 - RNA, 14 nt, Human
ccuuaacuggagcc

SEQ ID NO: 2388596 - RNA, 20 nt, Human
ccuuaaggacaaaaaugaac

SEQ ID NO: 2388597 - RNA, 18 nt, Human
ccuuagaagucacacagu

SEQ ID NO: 2388598 - RNA, 17 nt, Human
ccuuagaagucacacag

SEQ ID NO: 2388599 - RNA, 12 nt, Human
ccuuacugcaga

SEQ ID NO: 2388600 - RNA, 22 nt, Human
ccuuacucuucuugaaauuuua

SEQ ID NO: 2388601 - RNA, 19 nt, Human
ccuuacccucauguucuua

SEQ ID NO: 2388602 - RNA, 19 nt, Human
ccuuaccugccaggaagcc

SEQ ID NO: 2388603 - RNA, 17 nt, Human
ccuuacucuucuugaaa

SEQ ID NO: 2388604 - RNA, 16 nt, Human
ccuuacucuucuugaa

SEQ ID NO: 2388605 - RNA, 14 nt, Human
ccuuaccuuuuuau

SEQ ID NO: 2388606 - RNA, 16 nt, Human
ccuuaccccuuagccu

SEQ ID NO: 2388607 - RNA, 15 nt, Human
ccuuaccccuuagcc

SEQ ID NO: 2388608 - RNA, 14 nt, Human
ccuuacccaucugc

SEQ ID NO: 2388609 - RNA, 15 nt, Human
ccuuaccaugugccu

SEQ ID NO: 2388610 - RNA, 21 nt, Human
ccuuaccaugugccugaucca

SEQ ID NO: 2388611 - RNA, 15 nt, Human
ccuuacccucauguu

SEQ ID NO: 2388612 - RNA, 20 nt, Human
ccuuaccacugcucugauga

SEQ ID NO: 2388613 - RNA, 18 nt, Human
ccuuaccaacuuucugua

SEQ ID NO: 2388614 - RNA, 19 nt, Human
ccuuaccaacuuucuguaa

SEQ ID NO: 2388615 - RNA, 20 nt, Human
ccuuaccagcagagcaccuu

SEQ ID NO: 2388616 - RNA, 22 nt, Human
ccuuacacguaccucucaucag

SEQ ID NO: 2388617 - RNA, 13 nt, Human
ccuuacacuuacu

SEQ ID NO: 2388618 - RNA, 22 nt, Human
ccuuacaaguuagaaaacauaa

SEQ ID NO: 2388619 - RNA, 21 nt, Human
ccuuacaguaggagcccagcu

SEQ ID NO: 2388620 - RNA, 17 nt, Human
ccuuacaguaggagccc

SEQ ID NO: 2388621 - RNA, 15 nt, Human
ccuuacacuuacugu

SEQ ID NO: 2388622 - RNA, 16 nt, Human
ccuuacacuuacuguu

SEQ ID NO: 2388623 - RNA, 14 nt, Human
ccuuacagccucug

SEQ ID NO: 2388624 - RNA, 18 nt, Human
ccuuacagccucugacuu

SEQ ID NO: 2388625 - RNA, 17 nt, Human
ccuuaccacugcucuga

SEQ ID NO: 2388626 - RNA, 15 nt, Human
ccuuacauuuccugg

SEQ ID NO: 2388627 - RNA, 15 nt, Human
ccuuaccaacuuucu

SEQ ID NO: 2388628 - RNA, 17 nt, Human
ccuuaccaacuuucugu

SEQ ID NO: 2388629 - RNA, 13 nt, Human
ccuuaccagcaga

SEQ ID NO: 2388630 - RNA, 21 nt, Human
ccuguguguccaaaacugccu

SEQ ID NO: 2388631 - RNA, 20 nt, Human
ccuguguguccaaaacugcc

SEQ ID NO: 2388632 - RNA, 20 nt, Human
ccugugugugcgccuacagg

SEQ ID NO: 2388633 - RNA, 21 nt, Human
ccugugugugcgccuacagga

SEQ ID NO: 2388634 - RNA, 22 nt, Human
ccugugucuugcaauggcagcc

SEQ ID NO: 2388635 - RNA, 14 nt, Human
ccugugugauugac

SEQ ID NO: 2388636 - RNA, 20 nt, Human
ccugugucccaugacccacc

SEQ ID NO: 2388637 - RNA, 21 nt, Human
ccugugucccaugacccaccc

SEQ ID NO: 2388638 - RNA, 22 nt, Human
ccugugucccaugacccacccc

SEQ ID NO: 2388639 - RNA, 23 nt, Human
ccugugucccaugacccaccccu

SEQ ID NO: 2388640 - RNA, 22 nt, Human
ccugugugauugacagcuuugc

SEQ ID NO: 2388641 - RNA, 19 nt, Human
ccugugugauugacagcuu

SEQ ID NO: 2388642 - RNA, 18 nt, Human
ccugugugauugacagcu

SEQ ID NO: 2388643 - RNA, 23 nt, Human
ccugugucuucuccaccacgcug

SEQ ID NO: 2388644 - RNA, 17 nt, Human
ccugugucuugcaaugg

SEQ ID NO: 2388645 - RNA, 11 nt, Human
ccuguguccca

SEQ ID NO: 2388646 - RNA, 19 nt, Human
ccuguguccaugcgcucag

SEQ ID NO: 2388647 - RNA, 13 nt, Human
ccugugucccaug

SEQ ID NO: 2388648 - RNA, 14 nt, Human
ccugugucccauga

SEQ ID NO: 2388649 - RNA, 18 nt, Human
ccugugucccaugaccca

SEQ ID NO: 2388650 - RNA, 19 nt, Human
ccugugucccaugacccac

SEQ ID NO: 2388651 - RNA, 19 nt, Human
ccugugucuugcaauggca

SEQ ID NO: 2388652 - RNA, 21 nt, Human
ccugugucuugcaauggcagc

SEQ ID NO: 2388653 - RNA, 13 nt, Human
ccuguguagcugg

SEQ ID NO: 2388654 - RNA, 19 nt, Human
ccuggugcucucugccacu

SEQ ID NO: 2388655 - RNA, 12 nt, Human
ccuguguacagg

SEQ ID NO: 2388656 - RNA, 13 nt, Human
ccuggugcucucu

SEQ ID NO: 2388657 - RNA, 15 nt, Human
ccuggugcucucugc

SEQ ID NO: 2388658 - RNA, 16 nt, Human
ccuggugcucucugcc

SEQ ID NO: 2388659 - RNA, 17 nt, Human
ccuggugcucucugcca

SEQ ID NO: 2388660 - RNA, 9 nt, Human
ccuggugcu

SEQ ID NO: 2388661 - RNA, 12 nt, Human
ccuggugcucuc

SEQ ID NO: 2388662 - RNA, 13 nt, Human
ccuguguccaugc

SEQ ID NO: 2388663 - RNA, 12 nt, Human
ccuguuuccuga

SEQ ID NO: 2388664 - RNA, 16 nt, Human
ccuguuucugcagcca

SEQ ID NO: 2388665 - RNA, 16 nt, Human
ccuguuuaauauuuaa

SEQ ID NO: 2388666 - RNA, 21 nt, Human
ccuguuuaauauuuaaacagc

SEQ ID NO: 2388667 - RNA, 21 nt, Human
ccuguugguuccaagcccugg

SEQ ID NO: 2388668 - RNA, 22 nt, Human
ccuguugguuccaagcccugga

SEQ ID NO: 2388669 - RNA, 14 nt, Human
ccuguuuaaauauu

SEQ ID NO: 2388670 - RNA, 14 nt, Human
ccuguuuaauauuu

SEQ ID NO: 2388671 - RNA, 15 nt, Human
ccuguuuaauauuua

SEQ ID NO: 2388672 - RNA, 19 nt, Human
ccuguuuuauacuguacuu

SEQ ID NO: 2388673 - RNA, 13 nt, Human
ccuguuuucugag

SEQ ID NO: 2388674 - RNA, 21 nt, Human
ccuguuugggccccucuccca

SEQ ID NO: 2388675 - RNA, 20 nt, Human
ccuguuuuagaagguucucu

SEQ ID NO: 2388676 - RNA, 18 nt, Human
ccuguuuguuucugaaag

SEQ ID NO: 2388677 - RNA, 18 nt, Human
ccuguuugaagccugccc

SEQ ID NO: 2388678 - RNA, 23 nt, Human
ccuguuugaagccugcccuuguc

SEQ ID NO: 2388679 - RNA, 14 nt, Human
ccuguuuguuucug

SEQ ID NO: 2388680 - RNA, 13 nt, Human
ccuguguuucuag

SEQ ID NO: 2388681 - RNA, 15 nt, Human
ccuguuacccagaga

SEQ ID NO: 2388682 - RNA, 13 nt, Human
ccuguugguucca

SEQ ID NO: 2388683 - RNA, 17 nt, Human
ccuguugguuccaagcc

SEQ ID NO: 2388684 - RNA, 23 nt, Human
ccuguugggccaggagccuccug

SEQ ID NO: 2388685 - RNA, 12 nt, Human
ccuguuuaagag

SEQ ID NO: 2388686 - RNA, 15 nt, Human
ccuguuuaagagaca

SEQ ID NO: 2388687 - RNA, 21 nt, Human
ccugugugugaaaggaagcuc

SEQ ID NO: 2388688 - RNA, 16 nt, Human
ccuguguugucucuag

SEQ ID NO: 2388689 - RNA, 20 nt, Human
ccuguguugucucuagagca

SEQ ID NO: 2388690 - RNA, 22 nt, Human
ccuguguugucucuagagcagg

SEQ ID NO: 2388691 - RNA, 21 nt, Human
ccuguuaaaagaugaaaauau

SEQ ID NO: 2388692 - RNA, 20 nt, Human
ccuguuaaaagaugaaaaua

SEQ ID NO: 2388693 - RNA, 12 nt, Human
ccuucagugccu

SEQ ID NO: 2388694 - RNA, 16 nt, Human
ccacuggacuugagcu

SEQ ID NO: 2388695 - RNA, 13 nt, Human
ccacugcguuguc

SEQ ID NO: 2388696 - RNA, 21 nt, Human
ccacuggacuugagcuuggca

SEQ ID NO: 2388697 - RNA, 20 nt, Human
ccacuggacuugagcuuggc

SEQ ID NO: 2388698 - RNA, 22 nt, Human
ccacuggacuugagcuuggcag

SEQ ID NO: 2388699 - RNA, 11 nt, Human
ccacuggccac

SEQ ID NO: 2388700 - RNA, 12 nt, Human
ccacuggccacc

SEQ ID NO: 2388701 - RNA, 11 nt, Human
ccacuggaggu

SEQ ID NO: 2388702 - RNA, 13 nt, Human
ccacuggccacca

SEQ ID NO: 2388703 - RNA, 14 nt, Human
ccacuggccaccag

SEQ ID NO: 2388704 - RNA, 16 nt, Human
ccacuggccaccaggc

SEQ ID NO: 2388705 - RNA, 17 nt, Human
ccacuggccaccaggcu

SEQ ID NO: 2388706 - RNA, 18 nt, Human
ccacuggccaccaggcug

SEQ ID NO: 2388707 - RNA, 19 nt, Human
ccacuggccaccaggcugg

SEQ ID NO: 2388708 - RNA, 20 nt, Human
ccacuggccaccaggcuggc

SEQ ID NO: 2388709 - RNA, 11 nt, Human
ccacuggccau

SEQ ID NO: 2388710 - RNA, 11 nt, Human
ccacugccucu

SEQ ID NO: 2388711 - RNA, 16 nt, Human
ccacugccucagguuc

SEQ ID NO: 2388712 - RNA, 19 nt, Human
ccacugccucagguuccua

SEQ ID NO: 2388713 - RNA, 14 nt, Human
ccacugccuucgcu

SEQ ID NO: 2388714 - RNA, 15 nt, Human
ccacugccuucgcuu

SEQ ID NO: 2388715 - RNA, 16 nt, Human
ccacugccuucgcuuc

SEQ ID NO: 2388716 - RNA, 18 nt, Human
ccacugccuucgcuucuu

SEQ ID NO: 2388717 - RNA, 16 nt, Human
ccacugcgaccacaag

SEQ ID NO: 2388718 - RNA, 22 nt, Human
ccacugccuuugaccugccucc

SEQ ID NO: 2388719 - RNA, 14 nt, Human
ccacugccuuugac

SEQ ID NO: 2388720 - RNA, 22 nt, Human
ccacugccuucgcuucuugccu

SEQ ID NO: 2388721 - RNA, 23 nt, Human
ccacugccuucgcuucuugccuc

SEQ ID NO: 2388722 - RNA, 20 nt, Human
ccacugcacuccagccuggg

SEQ ID NO: 2388723 - RNA, 19 nt, Human
ccacugcacuccagccugg

SEQ ID NO: 2388724 - RNA, 18 nt, Human
ccacugcacuccagccug

SEQ ID NO: 2388725 - RNA, 15 nt, Human
ccacucccugcaacc

SEQ ID NO: 2388726 - RNA, 14 nt, Human
ccacugccuacugc

SEQ ID NO: 2388727 - RNA, 23 nt, Human
ccacugcccgagcuggugcauua

SEQ ID NO: 2388728 - RNA, 22 nt, Human
ccacugcccgagcuggugcauu

SEQ ID NO: 2388729 - RNA, 16 nt, Human
ccacugccuacugcau

SEQ ID NO: 2388730 - RNA, 13 nt, Human
ccacugccucagg

SEQ ID NO: 2388731 - RNA, 14 nt, Human
ccacugccucaggu

SEQ ID NO: 2388732 - RNA, 15 nt, Human
ccacugccucagguu

SEQ ID NO: 2388733 - RNA, 20 nt, Human
ccacugcccgagcuggugca

SEQ ID NO: 2388734 - RNA, 18 nt, Human
ccacugcccgagcuggug

SEQ ID NO: 2388735 - RNA, 17 nt, Human
ccacugcccgagcuggu

SEQ ID NO: 2388736 - RNA, 16 nt, Human
ccacugcccgagcugg

SEQ ID NO: 2388737 - RNA, 15 nt, Human
ccacugcccgagcug

SEQ ID NO: 2388738 - RNA, 21 nt, Human
ccacugcacuccagccugggc

SEQ ID NO: 2388739 - RNA, 15 nt, Human
ccacugcccaccccc

SEQ ID NO: 2388740 - RNA, 16 nt, Human
ccacugcccacccccu

SEQ ID NO: 2388741 - RNA, 19 nt, Human
ccacugcccacccccucaa

SEQ ID NO: 2388742 - RNA, 16 nt, Human
ccacugccauaaaaca

SEQ ID NO: 2388743 - RNA, 20 nt, Human
ccacucaaauuaaucuuucu

SEQ ID NO: 2388744 - RNA, 13 nt, Human
ccacucacacagc

SEQ ID NO: 2388745 - RNA, 17 nt, Human
ccacucaagccaagcag

SEQ ID NO: 2388746 - RNA, 16 nt, Human
ccacucaagccaagca

SEQ ID NO: 2388747 - RNA, 12 nt, Human
ccacucaagcca

SEQ ID NO: 2388748 - RNA, 23 nt, Human
ccacuacggaauaguuggcuagg

SEQ ID NO: 2388749 - RNA, 16 nt, Human
ccacuaagcagaggag

SEQ ID NO: 2388750 - RNA, 14 nt, Human
ccacuaagcagagg

SEQ ID NO: 2388751 - RNA, 16 nt, Human
ccacuacucaaaaauu

SEQ ID NO: 2388752 - RNA, 13 nt, Human
ccacuaagcagag

SEQ ID NO: 2388753 - RNA, 22 nt, Human
ccacuaacuagagcagcccugg

SEQ ID NO: 2388754 - RNA, 21 nt, Human
ccacuaagaauucaaacuggg

SEQ ID NO: 2388755 - RNA, 22 nt, Human
ccacuacggaauaguuggcuag

SEQ ID NO: 2388756 - RNA, 18 nt, Human
ccacuacauucuguuaau

SEQ ID NO: 2388757 - RNA, 17 nt, Human
ccacuccagaccccugg

SEQ ID NO: 2388758 - RNA, 19 nt, Human
ccacuccagaccccuggcu

SEQ ID NO: 2388759 - RNA, 16 nt, Human
ccacuccccaccuuca

SEQ ID NO: 2388760 - RNA, 12 nt, Human
ccacucccugca

SEQ ID NO: 2388761 - RNA, 13 nt, Human
ccacucccugcaa

SEQ ID NO: 2388762 - RNA, 18 nt, Human
ccacucaagccaagcagc

SEQ ID NO: 2388763 - RNA, 14 nt, Human
ccacucacacagcc

SEQ ID NO: 2388764 - RNA, 15 nt, Human
ccacucacacagcca

SEQ ID NO: 2388765 - RNA, 16 nt, Human
ccacucacacagccag

SEQ ID NO: 2388766 - RNA, 17 nt, Human
ccacucacacagccagg

SEQ ID NO: 2388767 - RNA, 18 nt, Human
ccacucacacagccaggu

SEQ ID NO: 2388768 - RNA, 21 nt, Human
ccacucacacagccaggugcc

SEQ ID NO: 2388769 - RNA, 22 nt, Human
ccacucacacagccaggugccu

SEQ ID NO: 2388770 - RNA, 18 nt, Human
ccacucacuaggccccca

SEQ ID NO: 2388771 - RNA, 13 nt, Human
ccacucaccccgg

SEQ ID NO: 2388772 - RNA, 22 nt, Human
ccacucacgaauauuaugccca

SEQ ID NO: 2388773 - RNA, 23 nt, Human
ccacucacacagccaggugccuu

SEQ ID NO: 2388774 - RNA, 16 nt, Human
ccacucaccagugucc

SEQ ID NO: 2388775 - RNA, 11 nt, Human
ccacucacccc

SEQ ID NO: 2388776 - RNA, 12 nt, Human
ccacucaccccg

SEQ ID NO: 2388777 - RNA, 22 nt, Human
ccacucacuaggcccccacuug

SEQ ID NO: 2388778 - RNA, 18 nt, Human
ccacucaguccauagcag

SEQ ID NO: 2388779 - RNA, 21 nt, Human
ccacguuccuuacugcagaau

SEQ ID NO: 2388780 - RNA, 16 nt, Human
ccacguucucacaccc

SEQ ID NO: 2388781 - RNA, 17 nt, Human
ccacguucucacaccca

SEQ ID NO: 2388782 - RNA, 19 nt, Human
ccacguucucacacccacc

SEQ ID NO: 2388783 - RNA, 20 nt, Human
ccacguuccuuacugcagaa

SEQ ID NO: 2388784 - RNA, 15 nt, Human
ccacguuccuuacug

SEQ ID NO: 2388785 - RNA, 13 nt, Human
ccacguuucuaaa

SEQ ID NO: 2388786 - RNA, 22 nt, Human
ccacuaaaagaucgcaguuugc

SEQ ID NO: 2388787 - RNA, 11 nt, Human
ccacuaacuag

SEQ ID NO: 2388788 - RNA, 20 nt, Human
ccacuaacuagagcagcccu

SEQ ID NO: 2388789 - RNA, 21 nt, Human
ccacguuggagaagcccgugu

SEQ ID NO: 2388790 - RNA, 23 nt, Human
ccacguucugcucaucauucucu

SEQ ID NO: 2388791 - RNA, 20 nt, Human
ccacguuggagaagcccgug

SEQ ID NO: 2388792 - RNA, 18 nt, Human
ccacuaagcagaggaggg

SEQ ID NO: 2388793 - RNA, 14 nt, Human
ccacguucaccccu

SEQ ID NO: 2388794 - RNA, 22 nt, Human
ccacguguaacugucagccggg

SEQ ID NO: 2388795 - RNA, 15 nt, Human
ccacguucaccccuc

SEQ ID NO: 2388796 - RNA, 17 nt, Human
ccacguucaccccucca

SEQ ID NO: 2388797 - RNA, 23 nt, Human
ccacgugccaggcccggggcugg

SEQ ID NO: 2388798 - RNA, 16 nt, Human
ccacgugccaggcccg

SEQ ID NO: 2388799 - RNA, 15 nt, Human
ccacgugcuaccccc

SEQ ID NO: 2388800 - RNA, 15 nt, Human
ccacgugccaggccc

SEQ ID NO: 2388801 - RNA, 14 nt, Human
ccacgugccaggcc

SEQ ID NO: 2388802 - RNA, 17 nt, Human
ccacgugacagugccug

SEQ ID NO: 2388803 - RNA, 20 nt, Human
ccacgucugcuaacuuggag

SEQ ID NO: 2388804 - RNA, 15 nt, Human
ccacggccaggccag

SEQ ID NO: 2388805 - RNA, 17 nt, Human
ccacgucugucuucaca

SEQ ID NO: 2388806 - RNA, 22 nt, Human
ccacgucugcgccgccgccgga

SEQ ID NO: 2388807 - RNA, 16 nt, Human
ccacggccacuggcca

SEQ ID NO: 2388808 - RNA, 19 nt, Human
ccacguccugucagugccg

SEQ ID NO: 2388809 - RNA, 12 nt, Human
ccacggccaggc

SEQ ID NO: 2388810 - RNA, 21 nt, Human
ccacggagccacuccucugac

SEQ ID NO: 2388811 - RNA, 20 nt, Human
ccacggagccacuccucuga

SEQ ID NO: 2388812 - RNA, 17 nt, Human
ccacggacuccagucug

SEQ ID NO: 2388813 - RNA, 13 nt, Human
ccacggccacugg

SEQ ID NO: 2388814 - RNA, 13 nt, Human
ccacggccaggcc

SEQ ID NO: 2388815 - RNA, 14 nt, Human
ccacggccaggcca

SEQ ID NO: 2388816 - RNA, 22 nt, Human
ccaccugcccccuucucccaca

SEQ ID NO: 2388817 - RNA, 21 nt, Human
ccaccugcccccuucucccac

SEQ ID NO: 2388818 - RNA, 23 nt, Human
ccaccugcccccuucucccacac

SEQ ID NO: 2388819 - RNA, 15 nt, Human
ccaccugcucccagg

SEQ ID NO: 2388820 - RNA, 14 nt, Human
ccaccugcucccag

SEQ ID NO: 2388821 - RNA, 22 nt, Human
ccaccugcggugcuaucucccc

SEQ ID NO: 2388822 - RNA, 15 nt, Human
ccaccuggccucugc

SEQ ID NO: 2388823 - RNA, 16 nt, Human
ccaccuggccucugca

SEQ ID NO: 2388824 - RNA, 20 nt, Human
ccacgcugucuccagacccc

SEQ ID NO: 2388825 - RNA, 13 nt, Human
ccacgcuucucuu

SEQ ID NO: 2388826 - RNA, 21 nt, Human
ccacgcugucuccagaccccc

SEQ ID NO: 2388827 - RNA, 19 nt, Human
ccacgcugucuccagaccc

SEQ ID NO: 2388828 - RNA, 18 nt, Human
ccacgcugucuccagacc

SEQ ID NO: 2388829 - RNA, 15 nt, Human
ccacgcugucuccag

SEQ ID NO: 2388830 - RNA, 14 nt, Human
ccacgcugucucca

SEQ ID NO: 2388831 - RNA, 15 nt, Human
ccacgcuucucuuug

SEQ ID NO: 2388832 - RNA, 18 nt, Human
ccacggacguuuccauca

SEQ ID NO: 2388833 - RNA, 12 nt, Human
ccacggagccac

SEQ ID NO: 2388834 - RNA, 19 nt, Human
ccacggacguuuccaucag

SEQ ID NO: 2388835 - RNA, 20 nt, Human
ccacggacguuuccaucagg

SEQ ID NO: 2388836 - RNA, 17 nt, Human
ccaccuggccucugcac

SEQ ID NO: 2388837 - RNA, 14 nt, Human
ccaccuggccucug

SEQ ID NO: 2388838 - RNA, 13 nt, Human
ccaccuccccagg

SEQ ID NO: 2388839 - RNA, 15 nt, Human
ccaccuccccagccu

SEQ ID NO: 2388840 - RNA, 23 nt, Human
ccaccuccccacgcccuccccuc

SEQ ID NO: 2388841 - RNA, 16 nt, Human
ccaccuccccaggccg

SEQ ID NO: 2388842 - RNA, 23 nt, Human
ccaccuccccaggccguggcugc

SEQ ID NO: 2388843 - RNA, 17 nt, Human
ccaccuccccuauccac

SEQ ID NO: 2388844 - RNA, 20 nt, Human
ccaccucccccucccccuuc

SEQ ID NO: 2388845 - RNA, 22 nt, Human
ccaccuccccuauccacccagc

SEQ ID NO: 2388846 - RNA, 19 nt, Human
ccaccuccccuauccaccc

SEQ ID NO: 2388847 - RNA, 16 nt, Human
ccaccucagccuugga

SEQ ID NO: 2388848 - RNA, 13 nt, Human
ccaccuccagaaa

SEQ ID NO: 2388849 - RNA, 20 nt, Human
ccaccuccaucuucuuugca

SEQ ID NO: 2388850 - RNA, 12 nt, Human
ccaccuccccac

SEQ ID NO: 2388851 - RNA, 13 nt, Human
ccaccuccccacg

SEQ ID NO: 2388852 - RNA, 17 nt, Human
ccaccuccccacgcccu

SEQ ID NO: 2388853 - RNA, 18 nt, Human
ccaccuccccacgcccuc

SEQ ID NO: 2388854 - RNA, 17 nt, Human
ccaccucccacaaagga

SEQ ID NO: 2388855 - RNA, 14 nt, Human
ccaccugagguggg

SEQ ID NO: 2388856 - RNA, 13 nt, Human
ccaccucccucac

SEQ ID NO: 2388857 - RNA, 16 nt, Human
ccaccugcccaucaca

SEQ ID NO: 2388858 - RNA, 15 nt, Human
ccaccugcccaucac

SEQ ID NO: 2388859 - RNA, 14 nt, Human
ccaccugcccauca

SEQ ID NO: 2388860 - RNA, 14 nt, Human
ccaccugcccaacc

SEQ ID NO: 2388861 - RNA, 21 nt, Human
ccaccugaggugggcccagga

SEQ ID NO: 2388862 - RNA, 22 nt, Human
ccaccugaggugggcccaggac

SEQ ID NO: 2388863 - RNA, 15 nt, Human
ccaccucccucacca

SEQ ID NO: 2388864 - RNA, 15 nt, Human
ccaccugaggugggc

SEQ ID NO: 2388865 - RNA, 16 nt, Human
ccaccugaggugggcc

SEQ ID NO: 2388866 - RNA, 20 nt, Human
ccaccugaggugggcccagg

SEQ ID NO: 2388867 - RNA, 16 nt, Human
ccaccugccagggaca

SEQ ID NO: 2388868 - RNA, 20 nt, Human
ccaccugcccccuucuccca

SEQ ID NO: 2388869 - RNA, 18 nt, Human
ccaccugcccccuucucc

SEQ ID NO: 2388870 - RNA, 12 nt, Human
ccaccugccccc

SEQ ID NO: 2388871 - RNA, 23 nt, Human
ccaccugcccaucacaggguugg

SEQ ID NO: 2388872 - RNA, 20 nt, Human
ccaccugcccaucacagggu

SEQ ID NO: 2388873 - RNA, 17 nt, Human
ccaccugccuguugggc

SEQ ID NO: 2388874 - RNA, 20 nt, Human
ccaccugccuguugggccag

SEQ ID NO: 2388875 - RNA, 15 nt, Human
ccacccuccccucuc

SEQ ID NO: 2388876 - RNA, 21 nt, Human
ccacccuccccucucuugcac

SEQ ID NO: 2388877 - RNA, 17 nt, Human
ccacccucagcaccccu

SEQ ID NO: 2388878 - RNA, 22 nt, Human
ccacccucccagaccugccucu

SEQ ID NO: 2388879 - RNA, 15 nt, Human
ccacccuccacucuc

SEQ ID NO: 2388880 - RNA, 23 nt, Human
ccacccucugagcuuugcauguu

SEQ ID NO: 2388881 - RNA, 20 nt, Human
ccacccucugagcuuugcau

SEQ ID NO: 2388882 - RNA, 13 nt, Human
ccacccucccugg

SEQ ID NO: 2388883 - RNA, 15 nt, Human
ccacccucccuggag

SEQ ID NO: 2388884 - RNA, 19 nt, Human
ccacccguucugcuggccu

SEQ ID NO: 2388885 - RNA, 21 nt, Human
ccacccguucugcuggccugg

SEQ ID NO: 2388886 - RNA, 22 nt, Human
ccacccguucugcuggccugga

SEQ ID NO: 2388887 - RNA, 22 nt, Human
ccacccuaccuguucagugucc

SEQ ID NO: 2388888 - RNA, 12 nt, Human
ccacccuaccug

SEQ ID NO: 2388889 - RNA, 13 nt, Human
ccacccucagcac

SEQ ID NO: 2388890 - RNA, 19 nt, Human
ccacccucagcaccccuuc

SEQ ID NO: 2388891 - RNA, 20 nt, Human
ccaccccgggcucucugcug

SEQ ID NO: 2388892 - RNA, 18 nt, Human
ccaccccgggcucucugc

SEQ ID NO: 2388893 - RNA, 18 nt, Human
ccaccccggggacccugu

SEQ ID NO: 2388894 - RNA, 19 nt, Human
ccaccccggggacccugug

SEQ ID NO: 2388895 - RNA, 20 nt, Human
ccaccccggggacccuguga

SEQ ID NO: 2388896 - RNA, 21 nt, Human
ccaccccggggacccugugac

SEQ ID NO: 2388897 - RNA, 17 nt, Human
ccaccccgggcucucug

SEQ ID NO: 2388898 - RNA, 14 nt, Human
ccaccccgggcucu

SEQ ID NO: 2388899 - RNA, 16 nt, Human
ccaccccgcucugcau

SEQ ID NO: 2388900 - RNA, 15 nt, Human
ccaccccgcucugca

SEQ ID NO: 2388901 - RNA, 19 nt, Human
ccaccccucaacaccucug

SEQ ID NO: 2388902 - RNA, 13 nt, Human
ccacccgaugcug

SEQ ID NO: 2388903 - RNA, 20 nt, Human
ccaccccguagauucccauc

SEQ ID NO: 2388904 - RNA, 15 nt, Human
ccacccguggagaug

SEQ ID NO: 2388905 - RNA, 20 nt, Human
ccaccccuugcucucaaccc

SEQ ID NO: 2388906 - RNA, 14 nt, Human
ccacccgaugcugc

SEQ ID NO: 2388907 - RNA, 16 nt, Human
ccacccgaugcugcuu

SEQ ID NO: 2388908 - RNA, 17 nt, Human
ccacccgaugcugcuuu

SEQ ID NO: 2388909 - RNA, 17 nt, Human
ccacccugaaagcccug

SEQ ID NO: 2388910 - RNA, 16 nt, Human
ccacccugaaagcccu

SEQ ID NO: 2388911 - RNA, 18 nt, Human
ccacccugaaagcccuga

SEQ ID NO: 2388912 - RNA, 12 nt, Human
ccaccucagccu

SEQ ID NO: 2388913 - RNA, 13 nt, Human
ccaccucagccuc

SEQ ID NO: 2388914 - RNA, 14 nt, Human
ccaccucagccucc

SEQ ID NO: 2388915 - RNA, 15 nt, Human
ccaccucagccuugg

SEQ ID NO: 2388916 - RNA, 14 nt, Human
ccaccucagccuug

SEQ ID NO: 2388917 - RNA, 16 nt, Human
ccaccucagccuccug

SEQ ID NO: 2388918 - RNA, 14 nt, Human
ccaccuccagaaac

SEQ ID NO: 2388919 - RNA, 15 nt, Human
ccaccucagccuccc

SEQ ID NO: 2388920 - RNA, 22 nt, Human
ccacccagcccauucucucucc

SEQ ID NO: 2388921 - RNA, 13 nt, Human
ccacccagcccau

SEQ ID NO: 2388922 - RNA, 12 nt, Human
ccacccagccca

SEQ ID NO: 2388923 - RNA, 11 nt, Human
ccacccagccc

SEQ ID NO: 2388924 - RNA, 12 nt, Human
ccacccaggagc

SEQ ID NO: 2388925 - RNA, 23 nt, Human
ccacccccuucucugcuccacca

SEQ ID NO: 2388926 - RNA, 20 nt, Human
ccacccccuucucugcucca

SEQ ID NO: 2388927 - RNA, 16 nt, Human
ccaccccgccugcccu

SEQ ID NO: 2388928 - RNA, 14 nt, Human
ccacccaggagccc

SEQ ID NO: 2388929 - RNA, 14 nt, Human
ccacaucaaagagg

SEQ ID NO: 2388930 - RNA, 23 nt, Human
ccacauagugaugguuccccugu

SEQ ID NO: 2388931 - RNA, 22 nt, Human
ccacaucaauauugucauuccu

SEQ ID NO: 2388932 - RNA, 15 nt, Human
ccacauccacacacg

SEQ ID NO: 2388933 - RNA, 20 nt, Human
ccacauccacacacgcagga

SEQ ID NO: 2388934 - RNA, 19 nt, Human
ccacaucuacguuuuuggu

SEQ ID NO: 2388935 - RNA, 12 nt, Human
ccacaucugccu

SEQ ID NO: 2388936 - RNA, 14 nt, Human
ccacaucuugcucu

SEQ ID NO: 2388937 - RNA, 20 nt, Human
ccacaucuugaucugcucag

SEQ ID NO: 2388938 - RNA, 22 nt, Human
ccacaucuugaucugcucagcc

SEQ ID NO: 2388939 - RNA, 23 nt, Human
ccacaucuugaucugcucagccc

SEQ ID NO: 2388940 - RNA, 13 nt, Human
ccacaucugccuu

SEQ ID NO: 2388941 - RNA, 14 nt, Human
ccacaucugccuua

SEQ ID NO: 2388942 - RNA, 22 nt, Human
ccacaucugccuuaaaaccaaa

SEQ ID NO: 2388943 - RNA, 23 nt, Human
ccacaucugccuuaaaaccaaag

SEQ ID NO: 2388944 - RNA, 13 nt, Human
ccacacuggacuc

SEQ ID NO: 2388945 - RNA, 14 nt, Human
ccacacuggacucc

SEQ ID NO: 2388946 - RNA, 19 nt, Human
ccacauagugaugguuccc

SEQ ID NO: 2388947 - RNA, 21 nt, Human
ccacauagugaugguuccccu

SEQ ID NO: 2388948 - RNA, 22 nt, Human
ccacauagugaugguuccccug

SEQ ID NO: 2388949 - RNA, 23 nt, Human
ccacacugcuaggugggccagcc

SEQ ID NO: 2388950 - RNA, 22 nt, Human
ccacacugauccagcccugagu

SEQ ID NO: 2388951 - RNA, 19 nt, Human
ccacacugauccagcccug

SEQ ID NO: 2388952 - RNA, 14 nt, Human
ccacaccuggcacu

SEQ ID NO: 2388953 - RNA, 16 nt, Human
ccacaucuugcucugc

SEQ ID NO: 2388954 - RNA, 20 nt, Human
ccacaucuugcucugcugac

SEQ ID NO: 2388955 - RNA, 22 nt, Human
ccacaucuugcucugcugacag

SEQ ID NO: 2388956 - RNA, 23 nt, Human
ccacaucuugcucugcugacaga

SEQ ID NO: 2388957 - RNA, 20 nt, Human
ccaccaaaggccagggucac

SEQ ID NO: 2388958 - RNA, 19 nt, Human
ccacaugccaagcacugug

SEQ ID NO: 2388959 - RNA, 22 nt, Human
ccacaugagucccagugggagg

SEQ ID NO: 2388960 - RNA, 23 nt, Human
ccacaugagucccagugggaggc

SEQ ID NO: 2388961 - RNA, 13 nt, Human
ccacaugaguccc

SEQ ID NO: 2388962 - RNA, 17 nt, Human
ccacaugagucccagug

SEQ ID NO: 2388963 - RNA, 19 nt, Human
ccacaugagucccaguggg

SEQ ID NO: 2388964 - RNA, 14 nt, Human
ccaccaacauacuc

SEQ ID NO: 2388965 - RNA, 18 nt, Human
ccaccaacauacucccau

SEQ ID NO: 2388966 - RNA, 14 nt, Human
ccaccacacccagc

SEQ ID NO: 2388967 - RNA, 16 nt, Human
ccaccacacccagccc

SEQ ID NO: 2388968 - RNA, 20 nt, Human
ccaccaacauacucccaucu

SEQ ID NO: 2388969 - RNA, 22 nt, Human
ccaccaagccuggucagcccaa

SEQ ID NO: 2388970 - RNA, 16 nt, Human
ccacccaagggccugg

SEQ ID NO: 2388971 - RNA, 11 nt, Human
ccaccaagguc

SEQ ID NO: 2388972 - RNA, 21 nt, Human
ccacccaagcuuggcagccga

SEQ ID NO: 2388973 - RNA, 11 nt, Human
ccaccaagggc

SEQ ID NO: 2388974 - RNA, 17 nt, Human
ccaccaaggucuucagc

SEQ ID NO: 2388975 - RNA, 17 nt, Human
ccacccaagggccuggc

SEQ ID NO: 2388976 - RNA, 19 nt, Human
ccacccaagggccuggccu

SEQ ID NO: 2388977 - RNA, 15 nt, Human
ccacccaccagggcg

SEQ ID NO: 2388978 - RNA, 17 nt, Human
ccacccaccucccugcc

SEQ ID NO: 2388979 - RNA, 15 nt, Human
ccacccaaugcugau

SEQ ID NO: 2388980 - RNA, 19 nt, Human
ccacccaccucccugccuc

SEQ ID NO: 2388981 - RNA, 15 nt, Human
ccacccacuucccug

SEQ ID NO: 2388982 - RNA, 16 nt, Human
ccacccaccucagccu

SEQ ID NO: 2388983 - RNA, 14 nt, Human
ccacccaccucagc

SEQ ID NO: 2388984 - RNA, 15 nt, Human
ccacccaccucagcc

SEQ ID NO: 2388985 - RNA, 13 nt, Human
ccacccaccucag

SEQ ID NO: 2388986 - RNA, 22 nt, Human
ccacccaagggccuggccugag

SEQ ID NO: 2388987 - RNA, 20 nt, Human
ccacccaagggccuggccug

SEQ ID NO: 2388988 - RNA, 21 nt, Human
ccacccaagggccuggccuga

SEQ ID NO: 2388989 - RNA, 13 nt, Human
ccacacaccccaa

SEQ ID NO: 2388990 - RNA, 15 nt, Human
ccacacacgcaggaa

SEQ ID NO: 2388991 - RNA, 18 nt, Human
ccacacacgcaggaacuc

SEQ ID NO: 2388992 - RNA, 22 nt, Human
ccacacacgcaggaacucccag

SEQ ID NO: 2388993 - RNA, 23 nt, Human
ccacacacgcaggaacucccagc

SEQ ID NO: 2388994 - RNA, 15 nt, Human
ccacacacucgcccg

SEQ ID NO: 2388995 - RNA, 12 nt, Human
ccacacccagcc

SEQ ID NO: 2388996 - RNA, 12 nt, Human
ccacacacccca

SEQ ID NO: 2388997 - RNA, 20 nt, Human
ccacacacagcugggcugug

SEQ ID NO: 2388998 - RNA, 22 nt, Human
ccacacacagaggaagagcagg

SEQ ID NO: 2388999 - RNA, 19 nt, Human
ccacacacagcugggcugu

SEQ ID NO: 2389000 - RNA, 18 nt, Human
ccacacacagaggaagag

SEQ ID NO: 2389001 - RNA, 17 nt, Human
ccacacacagaggaaga

SEQ ID NO: 2389002 - RNA, 16 nt, Human
ccacacacagaggaag

SEQ ID NO: 2389003 - RNA, 12 nt, Human
ccacacacagag

SEQ ID NO: 2389004 - RNA, 16 nt, Human
ccacacacacccacac

SEQ ID NO: 2389005 - RNA, 23 nt, Human
ccacacacacccacacacucgcc

SEQ ID NO: 2389006 - RNA, 23 nt, Human
ccacacacacagaaaauauacug

SEQ ID NO: 2389007 - RNA, 22 nt, Human
ccacacacacagaaaauauacu

SEQ ID NO: 2389008 - RNA, 16 nt, Human
ccaaacccaugaggca

SEQ ID NO: 2389009 - RNA, 20 nt, Human
ccaaaccaccagaagcccag

SEQ ID NO: 2389010 - RNA, 14 nt, Human
ccaaaccaccuucc

SEQ ID NO: 2389011 - RNA, 16 nt, Human
ccaaaccaccuucccu

SEQ ID NO: 2389012 - RNA, 14 nt, Human
ccaaacccugucug

SEQ ID NO: 2389013 - RNA, 17 nt, Human
ccacacacacagaaaau

SEQ ID NO: 2389014 - RNA, 21 nt, Human
ccacacacacagaaaauauac

SEQ ID NO: 2389015 - RNA, 20 nt, Human
ccacacacacagaaaauaua

SEQ ID NO: 2389016 - RNA, 19 nt, Human
ccacacacacagaaaauau

SEQ ID NO: 2389017 - RNA, 18 nt, Human
ccacacacacagaaaaua

SEQ ID NO: 2389018 - RNA, 19 nt, Human
ccacaccucaguucccuug

SEQ ID NO: 2389019 - RNA, 18 nt, Human
ccacaccucaguucccuu

SEQ ID NO: 2389020 - RNA, 15 nt, Human
ccacaccgcagaagc

SEQ ID NO: 2389021 - RNA, 16 nt, Human
ccacaccguguaaacc

SEQ ID NO: 2389022 - RNA, 18 nt, Human
ccacaccguguaaaccaa

SEQ ID NO: 2389023 - RNA, 20 nt, Human
ccacaccguguaaaccaaag

SEQ ID NO: 2389024 - RNA, 14 nt, Human
ccacaccgcagaag

SEQ ID NO: 2389025 - RNA, 23 nt, Human
ccacacccuguacuguucugugu

SEQ ID NO: 2389026 - RNA, 14 nt, Human
ccacacacucgccc

SEQ ID NO: 2389027 - RNA, 13 nt, Human
ccacacccagccc

SEQ ID NO: 2389028 - RNA, 14 nt, Human
ccacacccagccca

SEQ ID NO: 2389029 - RNA, 14 nt, Human
ccacaccucccuga

SEQ ID NO: 2389030 - RNA, 23 nt, Human
ccacaccuccacaguucaguggc

SEQ ID NO: 2389031 - RNA, 15 nt, Human
ccacaccuccacagu

SEQ ID NO: 2389032 - RNA, 17 nt, Human
ccacaccuccacaguuc

SEQ ID NO: 2389033 - RNA, 22 nt, Human
ccacaccucaguucccuuggcc

SEQ ID NO: 2389034 - RNA, 13 nt, Human
ccacaccuccaca

SEQ ID NO: 2389035 - RNA, 14 nt, Human
ccacaccuccacag

SEQ ID NO: 2389036 - RNA, 17 nt, Human
ccacaccucccugaacc

SEQ ID NO: 2389037 - RNA, 16 nt, Human
ccacaccucccugaac

SEQ ID NO: 2389038 - RNA, 14 nt, Human
ccacaccucugcca

SEQ ID NO: 2389039 - RNA, 17 nt, Human
ccacacuccagcuggga

SEQ ID NO: 2389040 - RNA, 14 nt, Human
ccacacuccagcug

SEQ ID NO: 2389041 - RNA, 13 nt, Human
ccacacuccagcu

SEQ ID NO: 2389042 - RNA, 12 nt, Human
ccacaccugagc

SEQ ID NO: 2389043 - RNA, 15 nt, Human
ccacaccucugccag

SEQ ID NO: 2389044 - RNA, 16 nt, Human
ccacaccucugccaga

SEQ ID NO: 2389045 - RNA, 13 nt, Human
ccagaggagacau

SEQ ID NO: 2389046 - RNA, 22 nt, Human
ccagaggagagaggacccccug

SEQ ID NO: 2389047 - RNA, 21 nt, Human
ccagaggagagaggacccccu

SEQ ID NO: 2389048 - RNA, 22 nt, Human
ccagaggaaggggccagaggcu

SEQ ID NO: 2389049 - RNA, 14 nt, Human
ccagaggcccccag

SEQ ID NO: 2389050 - RNA, 15 nt, Human
ccagaggcccccagc

SEQ ID NO: 2389051 - RNA, 18 nt, Human
ccagaggcccccagccca

SEQ ID NO: 2389052 - RNA, 21 nt, Human
ccagaggauugcugccccauc

SEQ ID NO: 2389053 - RNA, 12 nt, Human
ccagaggagggc

SEQ ID NO: 2389054 - RNA, 22 nt, Human
ccagaggagggcagcagaaggg

SEQ ID NO: 2389055 - RNA, 16 nt, Human
ccagagggagugacag

SEQ ID NO: 2389056 - RNA, 17 nt, Human
ccagagggagugacaga

SEQ ID NO: 2389057 - RNA, 11 nt, Human
ccagaggcucg

SEQ ID NO: 2389058 - RNA, 14 nt, Human
ccagaggcugcaga

SEQ ID NO: 2389059 - RNA, 12 nt, Human
ccagaggcuggg

SEQ ID NO: 2389060 - RNA, 15 nt, Human
ccagaggcuggguuc

SEQ ID NO: 2389061 - RNA, 19 nt, Human
ccagaggcuauuauuuuca

SEQ ID NO: 2389062 - RNA, 22 nt, Human
ccagaggcccccagcccagggc

SEQ ID NO: 2389063 - RNA, 19 nt, Human
ccagaggcccccagcccag

SEQ ID NO: 2389064 - RNA, 21 nt, Human
ccagaggcccccagcccaggg

SEQ ID NO: 2389065 - RNA, 18 nt, Human
ccagagggagugacagag

SEQ ID NO: 2389066 - RNA, 19 nt, Human
ccagagggagugacagagg

SEQ ID NO: 2389067 - RNA, 20 nt, Human
ccagagggagugacagaggc

SEQ ID NO: 2389068 - RNA, 21 nt, Human
ccagagggagugacagaggca

SEQ ID NO: 2389069 - RNA, 20 nt, Human
ccagagcuacccgcagaguu

SEQ ID NO: 2389070 - RNA, 21 nt, Human
ccagagcuacccgcagaguuc

SEQ ID NO: 2389071 - RNA, 11 nt, Human
ccagagcugcc

SEQ ID NO: 2389072 - RNA, 12 nt, Human
ccagagcugcca

SEQ ID NO: 2389073 - RNA, 13 nt, Human
ccagagcugccac

SEQ ID NO: 2389074 - RNA, 19 nt, Human
ccagagcacagaucuguuu

SEQ ID NO: 2389075 - RNA, 23 nt, Human
ccagagaugggacugggagggcc

SEQ ID NO: 2389076 - RNA, 13 nt, Human
ccagagcaaaaua

SEQ ID NO: 2389077 - RNA, 22 nt, Human
ccagagcacuggguugcagggg

SEQ ID NO: 2389078 - RNA, 12 nt, Human
ccagagcacugg

SEQ ID NO: 2389079 - RNA, 22 nt, Human
ccagagaugggacugggagggc

SEQ ID NO: 2389080 - RNA, 21 nt, Human
ccagagaugggacugggaggg

SEQ ID NO: 2389081 - RNA, 16 nt, Human
ccagagaugggacugg

SEQ ID NO: 2389082 - RNA, 22 nt, Human
ccagagauggagguucucucgg

SEQ ID NO: 2389083 - RNA, 23 nt, Human
ccagagaugccuccaccgcugcc

SEQ ID NO: 2389084 - RNA, 20 nt, Human
ccagagaugccuccaccgcu

SEQ ID NO: 2389085 - RNA, 18 nt, Human
ccagagaugccuccaccg

SEQ ID NO: 2389086 - RNA, 17 nt, Human
ccagagaugccuccacc

SEQ ID NO: 2389087 - RNA, 16 nt, Human
ccagagaugccuccac

SEQ ID NO: 2389088 - RNA, 15 nt, Human
ccagagaugccucca

SEQ ID NO: 2389089 - RNA, 14 nt, Human
ccagagaugccucc

SEQ ID NO: 2389090 - RNA, 14 nt, Human
ccagagaguccucu

SEQ ID NO: 2389091 - RNA, 17 nt, Human
ccagaccccucuggcca

SEQ ID NO: 2389092 - RNA, 22 nt, Human
ccagacccccagcaacccuccu

SEQ ID NO: 2389093 - RNA, 20 nt, Human
ccagagauccaaaagaagcc

SEQ ID NO: 2389094 - RNA, 24 nt, Human
ccagagcuguuuauggccucagcu

SEQ ID NO: 2389095 - RNA, 14 nt, Human
ccagaggaacuguc

SEQ ID NO: 2389096 - RNA, 19 nt, Human
ccagaggaacuguccagag

SEQ ID NO: 2389097 - RNA, 23 nt, Human
ccagagcuguuuauggccucagc

SEQ ID NO: 2389098 - RNA, 22 nt, Human
ccagagcuguuuauggccucag

SEQ ID NO: 2389099 - RNA, 19 nt, Human
ccagaggaaggggccagag

SEQ ID NO: 2389100 - RNA, 17 nt, Human
ccagaggaaggggccag

SEQ ID NO: 2389101 - RNA, 20 nt, Human
ccagaggaacuguccagaga

SEQ ID NO: 2389102 - RNA, 21 nt, Human
ccagaggaacuguccagagag

SEQ ID NO: 2389103 - RNA, 22 nt, Human
ccagaggaacuguccagagagc

SEQ ID NO: 2389104 - RNA, 23 nt, Human
ccagaggaacuguccagagagca

SEQ ID NO: 2389105 - RNA, 21 nt, Human
ccagagcuguuuauggccuca

SEQ ID NO: 2389106 - RNA, 20 nt, Human
ccagagcuguuuauggccuc

SEQ ID NO: 2389107 - RNA, 19 nt, Human
ccagagcuguuuauggccu

SEQ ID NO: 2389108 - RNA, 21 nt, Human
ccagagcugggaggcauggcc

SEQ ID NO: 2389109 - RNA, 14 nt, Human
ccagagcugggagg

SEQ ID NO: 2389110 - RNA, 14 nt, Human
ccagagcugccacc

SEQ ID NO: 2389111 - RNA, 15 nt, Human
ccagagcugccaccu

SEQ ID NO: 2389112 - RNA, 16 nt, Human
ccagagcugccaccug

SEQ ID NO: 2389113 - RNA, 19 nt, Human
ccagagcugccaccugccu

SEQ ID NO: 2389114 - RNA, 19 nt, Human
ccagacccccagcaacccu

SEQ ID NO: 2389115 - RNA, 14 nt, Human
ccagacccccagca

SEQ ID NO: 2389116 - RNA, 22 nt, Human
ccagacccccaccccuucccca

SEQ ID NO: 2389117 - RNA, 21 nt, Human
ccagacccccaccccuucccc

SEQ ID NO: 2389118 - RNA, 19 nt, Human
ccagacccccaccccuucc

SEQ ID NO: 2389119 - RNA, 16 nt, Human
ccagacccccaccccu

SEQ ID NO: 2389120 - RNA, 15 nt, Human
ccagacccccacccc

SEQ ID NO: 2389121 - RNA, 14 nt, Human
ccagacccccaccc

SEQ ID NO: 2389122 - RNA, 16 nt, Human
ccagacccccuggaga

SEQ ID NO: 2389123 - RNA, 12 nt, Human
ccagacccccug

SEQ ID NO: 2389124 - RNA, 14 nt, Human
ccagacccaguggg

SEQ ID NO: 2389125 - RNA, 12 nt, Human
ccagacccccac

SEQ ID NO: 2389126 - RNA, 20 nt, Human
ccagacaccuugacagggca

SEQ ID NO: 2389127 - RNA, 21 nt, Human
ccagagaggguggugaccucu

SEQ ID NO: 2389128 - RNA, 23 nt, Human
ccagagaggguggugaccucugc

SEQ ID NO: 2389129 - RNA, 18 nt, Human
ccagaccccucuggccag

SEQ ID NO: 2389130 - RNA, 18 nt, Human
ccagacccccuggagacu

SEQ ID NO: 2389131 - RNA, 14 nt, Human
ccagagaggguggu

SEQ ID NO: 2389132 - RNA, 18 nt, Human
ccacuguaaaaugaaauu

SEQ ID NO: 2389133 - RNA, 12 nt, Human
ccacuggggaaa

SEQ ID NO: 2389134 - RNA, 14 nt, Human
ccagacacccagga

SEQ ID NO: 2389135 - RNA, 16 nt, Human
ccagacacccaggacu

SEQ ID NO: 2389136 - RNA, 15 nt, Human
ccagacacccaggac

SEQ ID NO: 2389137 - RNA, 20 nt, Human
ccacuguacuugcucuugau

SEQ ID NO: 2389138 - RNA, 17 nt, Human
ccagacaccuugacagg

SEQ ID NO: 2389139 - RNA, 19 nt, Human
ccagacaccuugacagggc

SEQ ID NO: 2389140 - RNA, 22 nt, Human
ccacuggggaaauaacagcugu

SEQ ID NO: 2389141 - RNA, 11 nt, Human
ccacuggggaa

SEQ ID NO: 2389142 - RNA, 17 nt, Human
ccacuguacuugcucuu

SEQ ID NO: 2389143 - RNA, 18 nt, Human
ccacuguacuugcucuug

SEQ ID NO: 2389144 - RNA, 19 nt, Human
ccacuguacuugcucuuga

SEQ ID NO: 2389145 - RNA, 14 nt, Human
ccacugucacccuc

SEQ ID NO: 2389146 - RNA, 21 nt, Human
ccagauugcaacaggcugggc

SEQ ID NO: 2389147 - RNA, 13 nt, Human
ccagauuuaugca

SEQ ID NO: 2389148 - RNA, 22 nt, Human
ccagauuuaugcauauuauuuu

SEQ ID NO: 2389149 - RNA, 12 nt, Human
ccagauuucacu

SEQ ID NO: 2389150 - RNA, 19 nt, Human
ccagauugcaacaggcugg

SEQ ID NO: 2389151 - RNA, 20 nt, Human
ccagauugcaacaggcuggg

SEQ ID NO: 2389152 - RNA, 23 nt, Human
ccagauucuuuccugaggcuggg

SEQ ID NO: 2389153 - RNA, 19 nt, Human
ccagauguuuuacgucugg

SEQ ID NO: 2389154 - RNA, 21 nt, Human
ccagauguuuuacgucuggga

SEQ ID NO: 2389155 - RNA, 18 nt, Human
ccagaugccuucuccaga

SEQ ID NO: 2389156 - RNA, 18 nt, Human
ccagaugcagggcaguca

SEQ ID NO: 2389157 - RNA, 15 nt, Human
ccagaugcagggcag

SEQ ID NO: 2389158 - RNA, 14 nt, Human
ccagaugcagggca

SEQ ID NO: 2389159 - RNA, 18 nt, Human
ccagagggcccaggcagg

SEQ ID NO: 2389160 - RNA, 15 nt, Human
ccagaggcugcccca

SEQ ID NO: 2389161 - RNA, 23 nt, Human
ccagaugcaccagcccuuagcag

SEQ ID NO: 2389162 - RNA, 15 nt, Human
ccagagggccugcaa

SEQ ID NO: 2389163 - RNA, 16 nt, Human
ccagagggccugcaag

SEQ ID NO: 2389164 - RNA, 17 nt, Human
ccagagggcccaggcag

SEQ ID NO: 2389165 - RNA, 15 nt, Human
ccagagggcccaggc

SEQ ID NO: 2389166 - RNA, 13 nt, Human
ccagagggcccag

SEQ ID NO: 2389167 - RNA, 16 nt, Human
ccagaggcuggguuca

SEQ ID NO: 2389168 - RNA, 13 nt, Human
ccagagggccugc

SEQ ID NO: 2389169 - RNA, 22 nt, Human
ccagagggagugacagaggcag

SEQ ID NO: 2389170 - RNA, 23 nt, Human
ccagagggagugacagaggcagc

SEQ ID NO: 2389171 - RNA, 14 nt, Human
ccagauggggccuc

SEQ ID NO: 2389172 - RNA, 16 nt, Human
ccagaugggggaaagc

SEQ ID NO: 2389173 - RNA, 20 nt, Human
ccagaugggggaaagcacag

SEQ ID NO: 2389174 - RNA, 16 nt, Human
ccagauggacuccagc

SEQ ID NO: 2389175 - RNA, 22 nt, Human
ccagaugcugauguucagugua

SEQ ID NO: 2389176 - RNA, 17 nt, Human
ccagauggacuccagcc

SEQ ID NO: 2389177 - RNA, 15 nt, Human
ccagaugcugauguu

SEQ ID NO: 2389178 - RNA, 19 nt, Human
ccagaugcugauguucagu

SEQ ID NO: 2389179 - RNA, 21 nt, Human
ccagaugcugauguucagugu

SEQ ID NO: 2389180 - RNA, 23 nt, Human
ccagaugcugauguucaguguaa

SEQ ID NO: 2389181 - RNA, 18 nt, Human
ccagauucuuuccugagg

SEQ ID NO: 2389182 - RNA, 23 nt, Human
ccagauguuuccagacuuccuug

SEQ ID NO: 2389183 - RNA, 17 nt, Human
ccagauguuuccagacu

SEQ ID NO: 2389184 - RNA, 19 nt, Human
ccagauucuuuccugaggc

SEQ ID NO: 2389185 - RNA, 20 nt, Human
ccagauucuuuccugaggcu

SEQ ID NO: 2389186 - RNA, 21 nt, Human
ccagauucuuuccugaggcug

SEQ ID NO: 2389187 - RNA, 22 nt, Human
ccagauucuuuccugaggcugg

SEQ ID NO: 2389188 - RNA, 17 nt, Human
ccagccaggccccaggc

SEQ ID NO: 2389189 - RNA, 12 nt, Human
ccagccaggcgg

SEQ ID NO: 2389190 - RNA, 17 nt, Human
ccagccaggcgggcuca

SEQ ID NO: 2389191 - RNA, 21 nt, Human
ccagccaggcgggcucaagga

SEQ ID NO: 2389192 - RNA, 14 nt, Human
ccagccaggcucug

SEQ ID NO: 2389193 - RNA, 15 nt, Human
ccagccaggcucugu

SEQ ID NO: 2389194 - RNA, 17 nt, Human
ccagccaggcucugugc

SEQ ID NO: 2389195 - RNA, 18 nt, Human
ccagccaggcucugugcu

SEQ ID NO: 2389196 - RNA, 19 nt, Human
ccagccaggcucugugcug

SEQ ID NO: 2389197 - RNA, 20 nt, Human
ccagccaggcucugugcuga

SEQ ID NO: 2389198 - RNA, 10 nt, Human
ccagccaggc

SEQ ID NO: 2389199 - RNA, 23 nt, Human
ccagccagcagccagcucucagc

SEQ ID NO: 2389200 - RNA, 19 nt, Human
ccagccagcagccagcucu

SEQ ID NO: 2389201 - RNA, 16 nt, Human
ccagccagcagccagc

SEQ ID NO: 2389202 - RNA, 15 nt, Human
ccagccagcagccag

SEQ ID NO: 2389203 - RNA, 13 nt, Human
ccagccagcagcc

SEQ ID NO: 2389204 - RNA, 18 nt, Human
ccagccagauccucuugg

SEQ ID NO: 2389205 - RNA, 19 nt, Human
ccagccagauccucuuggu

SEQ ID NO: 2389206 - RNA, 21 nt, Human
ccagccagauggacuccagcc

SEQ ID NO: 2389207 - RNA, 22 nt, Human
ccagccagcaaugauguccaga

SEQ ID NO: 2389208 - RNA, 22 nt, Human
ccagccaccccgggcucucugc

SEQ ID NO: 2389209 - RNA, 21 nt, Human
ccagccaccccgggcucucug

SEQ ID NO: 2389210 - RNA, 14 nt, Human
ccagccacguggag

SEQ ID NO: 2389211 - RNA, 20 nt, Human
ccagccacucgggaggcuga

SEQ ID NO: 2389212 - RNA, 21 nt, Human
ccagccacucgggaggcugag

SEQ ID NO: 2389213 - RNA, 22 nt, Human
ccagccacucgggaggcugaga

SEQ ID NO: 2389214 - RNA, 22 nt, Human
ccagccagaacguggcucugcu

SEQ ID NO: 2389215 - RNA, 23 nt, Human
ccagccagaacguggcucugcug

SEQ ID NO: 2389216 - RNA, 19 nt, Human
ccagccagaguuccugcgg

SEQ ID NO: 2389217 - RNA, 13 nt, Human
ccagccagauccu

SEQ ID NO: 2389218 - RNA, 18 nt, Human
ccagccaaccccugugga

SEQ ID NO: 2389219 - RNA, 13 nt, Human
ccagccaaccccu

SEQ ID NO: 2389220 - RNA, 19 nt, Human
ccagccaaacccugucuga

SEQ ID NO: 2389221 - RNA, 18 nt, Human
ccagccaaacccugucug

SEQ ID NO: 2389222 - RNA, 17 nt, Human
ccagccaaacccugucu

SEQ ID NO: 2389223 - RNA, 22 nt, Human
ccagccaacuuuugcauguuuu

SEQ ID NO: 2389224 - RNA, 19 nt, Human
ccagccaaccccuguggag

SEQ ID NO: 2389225 - RNA, 13 nt, Human
ccagccaccccgg

SEQ ID NO: 2389226 - RNA, 19 nt, Human
ccagccaaagccuccucca

SEQ ID NO: 2389227 - RNA, 18 nt, Human
ccagccaaagccuccucc

SEQ ID NO: 2389228 - RNA, 15 nt, Human
ccagccaaagccucc

SEQ ID NO: 2389229 - RNA, 17 nt, Human
ccagcauugcugguucu

SEQ ID NO: 2389230 - RNA, 13 nt, Human
ccagcauugcugg

SEQ ID NO: 2389231 - RNA, 18 nt, Human
ccagcauuuuacugauuc

SEQ ID NO: 2389232 - RNA, 13 nt, Human
ccagcauuccuuu

SEQ ID NO: 2389233 - RNA, 14 nt, Human
ccagcauuccuuuu

SEQ ID NO: 2389234 - RNA, 15 nt, Human
ccagcagguggggag

SEQ ID NO: 2389235 - RNA, 18 nt, Human
ccagcaggugcugacuuc

SEQ ID NO: 2389236 - RNA, 15 nt, Human
ccagcacugucucag

SEQ ID NO: 2389237 - RNA, 14 nt, Human
ccagcacugcccaa

SEQ ID NO: 2389238 - RNA, 15 nt, Human
ccagcaggugcugac

SEQ ID NO: 2389239 - RNA, 22 nt, Human
ccagcacugcuugaggaaaaca

SEQ ID NO: 2389240 - RNA, 19 nt, Human
ccagcacugcuugaggaaa

SEQ ID NO: 2389241 - RNA, 18 nt, Human
ccagcacugcuugaggaa

SEQ ID NO: 2389242 - RNA, 15 nt, Human
ccagcacugcuugag

SEQ ID NO: 2389243 - RNA, 13 nt, Human
ccagcacugccca

SEQ ID NO: 2389244 - RNA, 12 nt, Human
ccagcacugcuu

SEQ ID NO: 2389245 - RNA, 12 nt, Human
ccagcacuaacg

SEQ ID NO: 2389246 - RNA, 24 nt, Human
ccagcacuaaagcaguggacacca

SEQ ID NO: 2389247 - RNA, 12 nt, Human
ccagcacugagg

SEQ ID NO: 2389248 - RNA, 13 nt, Human
ccagcacugagga

SEQ ID NO: 2389249 - RNA, 14 nt, Human
ccagcacugaggaa

SEQ ID NO: 2389250 - RNA, 15 nt, Human
ccagcacugaggaag

SEQ ID NO: 2389251 - RNA, 17 nt, Human
ccagcacugaggaagaa

SEQ ID NO: 2389252 - RNA, 22 nt, Human
ccagcacugaggaagaacgggg

SEQ ID NO: 2389253 - RNA, 19 nt, Human
ccagcauccuuuucugcag

SEQ ID NO: 2389254 - RNA, 15 nt, Human
ccagcaucccuugac

SEQ ID NO: 2389255 - RNA, 18 nt, Human
ccagcaucccuugaccag

SEQ ID NO: 2389256 - RNA, 21 nt, Human
ccagcauccuuuucugcagag

SEQ ID NO: 2389257 - RNA, 21 nt, Human
ccagcaucccuugaccaggcc

SEQ ID NO: 2389258 - RNA, 22 nt, Human
ccagcaguuuucaagucaaauu

SEQ ID NO: 2389259 - RNA, 15 nt, Human
ccagcaguuuucaag

SEQ ID NO: 2389260 - RNA, 15 nt, Human
ccagcaguuugggag

SEQ ID NO: 2389261 - RNA, 22 nt, Human
ccagcaguugaaugacaacaga

SEQ ID NO: 2389262 - RNA, 23 nt, Human
ccagcauaauacuugcuuuggaa

SEQ ID NO: 2389263 - RNA, 14 nt, Human
ccagcauuccagcc

SEQ ID NO: 2389264 - RNA, 15 nt, Human
ccagcauuccagccc

SEQ ID NO: 2389265 - RNA, 16 nt, Human
ccagcauuccagcccc

SEQ ID NO: 2389266 - RNA, 17 nt, Human
ccagcauuccagccccu

SEQ ID NO: 2389267 - RNA, 18 nt, Human
ccagcauuccagccccuc

SEQ ID NO: 2389268 - RNA, 19 nt, Human
ccagcauuccagccccucu

SEQ ID NO: 2389269 - RNA, 20 nt, Human
ccagcauuccagccccucug

SEQ ID NO: 2389270 - RNA, 21 nt, Human
ccagcauuccagccccucugg

SEQ ID NO: 2389271 - RNA, 22 nt, Human
ccagcauuccagccccucuggu

SEQ ID NO: 2389272 - RNA, 19 nt, Human
ccagccucaucucuuuguu

SEQ ID NO: 2389273 - RNA, 21 nt, Human
ccagccuccaagcuccaucuc

SEQ ID NO: 2389274 - RNA, 12 nt, Human
ccagccucaguc

SEQ ID NO: 2389275 - RNA, 15 nt, Human
ccagccucaguccuc

SEQ ID NO: 2389276 - RNA, 19 nt, Human
ccagccucaguccuccccu

SEQ ID NO: 2389277 - RNA, 20 nt, Human
ccagccucaguccuccccuc

SEQ ID NO: 2389278 - RNA, 21 nt, Human
ccagccucaguccuccccuca

SEQ ID NO: 2389279 - RNA, 10 nt, Human
ccagccucag

SEQ ID NO: 2389280 - RNA, 11 nt, Human
ccagccucagu

SEQ ID NO: 2389281 - RNA, 19 nt, Human
ccagccgccaugcuccugg

SEQ ID NO: 2389282 - RNA, 18 nt, Human
ccagccgccaugcuccug

SEQ ID NO: 2389283 - RNA, 20 nt, Human
ccagcccuuugggaggcuga

SEQ ID NO: 2389284 - RNA, 23 nt, Human
ccagccgagauagccaaggccaa

SEQ ID NO: 2389285 - RNA, 14 nt, Human
ccagccgccaugcu

SEQ ID NO: 2389286 - RNA, 16 nt, Human
ccagccuccucuggac

SEQ ID NO: 2389287 - RNA, 20 nt, Human
ccagcccucccuguccuccu

SEQ ID NO: 2389288 - RNA, 19 nt, Human
ccagcccucccuguccucc

SEQ ID NO: 2389289 - RNA, 18 nt, Human
ccagcccucccuguccuc

SEQ ID NO: 2389290 - RNA, 17 nt, Human
ccagcccucccuguccu

SEQ ID NO: 2389291 - RNA, 16 nt, Human
ccagcccucccugucc

SEQ ID NO: 2389292 - RNA, 15 nt, Human
ccagcccucccuguc

SEQ ID NO: 2389293 - RNA, 14 nt, Human
ccagcccucccugu

SEQ ID NO: 2389294 - RNA, 13 nt, Human
ccagcccucccug

SEQ ID NO: 2389295 - RNA, 21 nt, Human
ccagcccuccccauggagcca

SEQ ID NO: 2389296 - RNA, 20 nt, Human
ccagcccuccccauggagcc

SEQ ID NO: 2389297 - RNA, 14 nt, Human
ccagcccuccccau

SEQ ID NO: 2389298 - RNA, 14 nt, Human
ccagcccucauccc

SEQ ID NO: 2389299 - RNA, 16 nt, Human
ccagccccagugccca

SEQ ID NO: 2389300 - RNA, 13 nt, Human
ccagcccucaucc

SEQ ID NO: 2389301 - RNA, 15 nt, Human
ccagcccuauggaug

SEQ ID NO: 2389302 - RNA, 16 nt, Human
ccagcccuauggaugu

SEQ ID NO: 2389303 - RNA, 16 nt, Human
ccagcccuuagcaggg

SEQ ID NO: 2389304 - RNA, 14 nt, Human
ccagcccuguggaa

SEQ ID NO: 2389305 - RNA, 22 nt, Human
ccagcccucccuguccuccucg

SEQ ID NO: 2389306 - RNA, 21 nt, Human
ccagcccucccuguccuccuc

SEQ ID NO: 2389307 - RNA, 21 nt, Human
ccagcccuccuuaucaaagga

SEQ ID NO: 2389308 - RNA, 17 nt, Human
ccagcccuuagcaggga

SEQ ID NO: 2389309 - RNA, 18 nt, Human
ccagcccuguggaaggga

SEQ ID NO: 2389310 - RNA, 15 nt, Human
ccagcccuguggaag

SEQ ID NO: 2389311 - RNA, 20 nt, Human
ccagcccuugagcuccccaa

SEQ ID NO: 2389312 - RNA, 16 nt, Human
ccagccccacccagga

SEQ ID NO: 2389313 - RNA, 15 nt, Human
ccagccccacccagg

SEQ ID NO: 2389314 - RNA, 14 nt, Human
ccagccccacccag

SEQ ID NO: 2389315 - RNA, 19 nt, Human
ccagccccacagcccacgu

SEQ ID NO: 2389316 - RNA, 21 nt, Human
ccagccccacagcccacgucc

SEQ ID NO: 2389317 - RNA, 23 nt, Human
ccagccagugaccugaggaagcg

SEQ ID NO: 2389318 - RNA, 13 nt, Human
ccagccccacagc

SEQ ID NO: 2389319 - RNA, 14 nt, Human
ccagccccacagcc

SEQ ID NO: 2389320 - RNA, 15 nt, Human
ccagccccacagccc

SEQ ID NO: 2389321 - RNA, 21 nt, Human
ccagccauacuuaucucucug

SEQ ID NO: 2389322 - RNA, 22 nt, Human
ccagccagugaccugaggaagc

SEQ ID NO: 2389323 - RNA, 20 nt, Human
ccagccagugaccugaggaa

SEQ ID NO: 2389324 - RNA, 19 nt, Human
ccagccagugaccugagga

SEQ ID NO: 2389325 - RNA, 15 nt, Human
ccagccagggcugcu

SEQ ID NO: 2389326 - RNA, 13 nt, Human
ccagccagggcug

SEQ ID NO: 2389327 - RNA, 14 nt, Human
ccagccagggcugc

SEQ ID NO: 2389328 - RNA, 23 nt, Human
ccagccccaaaacucuccucugc

SEQ ID NO: 2389329 - RNA, 13 nt, Human
ccagccccagugc

SEQ ID NO: 2389330 - RNA, 15 nt, Human
ccagccccagugccc

SEQ ID NO: 2389331 - RNA, 18 nt, Human
ccagccccacccaggagg

SEQ ID NO: 2389332 - RNA, 17 nt, Human
ccagccccacccaggag

SEQ ID NO: 2389333 - RNA, 22 nt, Human
ccagccccacagcccacguccu

SEQ ID NO: 2389334 - RNA, 16 nt, Human
ccagcaagugagagcu

SEQ ID NO: 2389335 - RNA, 20 nt, Human
ccagcaagugagagcugggu

SEQ ID NO: 2389336 - RNA, 21 nt, Human
ccagcaagugagagcugggug

SEQ ID NO: 2389337 - RNA, 22 nt, Human
ccagcaagugagagcugggugu

SEQ ID NO: 2389338 - RNA, 18 nt, Human
ccagcacuaaagcagugg

SEQ ID NO: 2389339 - RNA, 18 nt, Human
ccagcaaugauguccaga

SEQ ID NO: 2389340 - RNA, 21 nt, Human
ccagcaauucuccugccucag

SEQ ID NO: 2389341 - RNA, 20 nt, Human
ccagcaauucuccugccuca

SEQ ID NO: 2389342 - RNA, 19 nt, Human
ccagcaauucuccugccuc

SEQ ID NO: 2389343 - RNA, 18 nt, Human
ccagcaauucuccugccu

SEQ ID NO: 2389344 - RNA, 16 nt, Human
ccagcaauucuccugc

SEQ ID NO: 2389345 - RNA, 23 nt, Human
ccagcaaugacaucucaggggcc

SEQ ID NO: 2389346 - RNA, 17 nt, Human
ccagcaaugauguccag

SEQ ID NO: 2389347 - RNA, 17 nt, Human
ccagcaauauguaaaua

SEQ ID NO: 2389348 - RNA, 12 nt, Human
ccagcaaugaca

SEQ ID NO: 2389349 - RNA, 21 nt, Human
ccagcaaugacaucucagggg

SEQ ID NO: 2389350 - RNA, 22 nt, Human
ccagcaaugacaucucaggggc

SEQ ID NO: 2389351 - RNA, 15 nt, Human
ccagcaacuccaacu

SEQ ID NO: 2389352 - RNA, 11 nt, Human
ccagcaacuga

SEQ ID NO: 2389353 - RNA, 18 nt, Human
ccagcaacccuccuauca

SEQ ID NO: 2389354 - RNA, 13 nt, Human
ccagcaacugaau

SEQ ID NO: 2389355 - RNA, 15 nt, Human
ccagcaacugaauaa

SEQ ID NO: 2389356 - RNA, 17 nt, Human
ccagcaacugaauaaau

SEQ ID NO: 2389357 - RNA, 14 nt, Human
ccagauuucacucu

SEQ ID NO: 2389358 - RNA, 21 nt, Human
ccagcaacuugucuuuuucug

SEQ ID NO: 2389359 - RNA, 16 nt, Human
ccagcaacugaauaaa

SEQ ID NO: 2389360 - RNA, 18 nt, Human
ccagcaacuugucuuuuu

SEQ ID NO: 2389361 - RNA, 15 nt, Human
ccagcaagugagagc

SEQ ID NO: 2389362 - RNA, 19 nt, Human
ccagggagcauuuuccucc

SEQ ID NO: 2389363 - RNA, 20 nt, Human
ccagggagcauuuuccucca

SEQ ID NO: 2389364 - RNA, 21 nt, Human
ccagggagcauuuuccuccau

SEQ ID NO: 2389365 - RNA, 17 nt, Human
ccagggagaggccauga

SEQ ID NO: 2389366 - RNA, 14 nt, Human
ccagggagaggcca

SEQ ID NO: 2389367 - RNA, 22 nt, Human
ccaggcugugggccucaaggac

SEQ ID NO: 2389368 - RNA, 21 nt, Human
ccaggcugugggccucaagga

SEQ ID NO: 2389369 - RNA, 17 nt, Human
ccaggcugugggccuca

SEQ ID NO: 2389370 - RNA, 18 nt, Human
ccaggcgggcucaaggaa

SEQ ID NO: 2389371 - RNA, 22 nt, Human
ccaggcgggcucaaggaaaggg

SEQ ID NO: 2389372 - RNA, 20 nt, Human
ccaggcuuagucacugagac

SEQ ID NO: 2389373 - RNA, 14 nt, Human
ccagggacagaggg

SEQ ID NO: 2389374 - RNA, 15 nt, Human
ccagggacagagggg

SEQ ID NO: 2389375 - RNA, 21 nt, Human
ccagggacagaggggguggcc

SEQ ID NO: 2389376 - RNA, 22 nt, Human
ccagggacagaggggguggccu

SEQ ID NO: 2389377 - RNA, 23 nt, Human
ccagguuuuucaauuaaacggau

SEQ ID NO: 2389378 - RNA, 11 nt, Human
ccaguaaaauu

SEQ ID NO: 2389379 - RNA, 13 nt, Human
ccaguaaaauugc

SEQ ID NO: 2389380 - RNA, 15 nt, Human
ccaguaaaauugcca

SEQ ID NO: 2389381 - RNA, 17 nt, Human
ccagguuuuuggucuga

SEQ ID NO: 2389382 - RNA, 16 nt, Human
ccagguugaaagaccu

SEQ ID NO: 2389383 - RNA, 14 nt, Human
ccagguuuuucaau

SEQ ID NO: 2389384 - RNA, 15 nt, Human
ccagguuuuucaauu

SEQ ID NO: 2389385 - RNA, 16 nt, Human
ccagguuuuucaauua

SEQ ID NO: 2389386 - RNA, 17 nt, Human
ccagguuuuucaauuaa

SEQ ID NO: 2389387 - RNA, 18 nt, Human
ccagguuuuucaauuaaa

SEQ ID NO: 2389388 - RNA, 19 nt, Human
ccagguuuuucaauuaaac

SEQ ID NO: 2389389 - RNA, 20 nt, Human
ccagguuuuucaauuaaacg

SEQ ID NO: 2389390 - RNA, 21 nt, Human
ccagguuuuucaauuaaacgg

SEQ ID NO: 2389391 - RNA, 22 nt, Human
ccagguuuuucaauuaaacgga

SEQ ID NO: 2389392 - RNA, 13 nt, Human
ccagguugaaaga

SEQ ID NO: 2389393 - RNA, 24 nt, Human
ccagguucuccguuagcuccugug

SEQ ID NO: 2389394 - RNA, 22 nt, Human
ccagguucuccguuagcuccug

SEQ ID NO: 2389395 - RNA, 23 nt, Human
ccagguucuccguuagcuccugu

SEQ ID NO: 2389396 - RNA, 19 nt, Human
ccagguaccagcugcgcuu

SEQ ID NO: 2389397 - RNA, 15 nt, Human
ccagguucuauuugg

SEQ ID NO: 2389398 - RNA, 21 nt, Human
ccagguucuccguuagcuccu

SEQ ID NO: 2389399 - RNA, 16 nt, Human
ccagguucuauuugga

SEQ ID NO: 2389400 - RNA, 22 nt, Human
ccagguucuauuuggaauuuau

SEQ ID NO: 2389401 - RNA, 15 nt, Human
ccagguucagcuugu

SEQ ID NO: 2389402 - RNA, 24 nt, Human
ccaggugcacaagcuccaagcucc

SEQ ID NO: 2389403 - RNA, 12 nt, Human
ccagucucuucu

SEQ ID NO: 2389404 - RNA, 13 nt, Human
ccagucugacccu

SEQ ID NO: 2389405 - RNA, 12 nt, Human
ccagucugaccc

SEQ ID NO: 2389406 - RNA, 23 nt, Human
ccagucuccaccaggaaccucuu

SEQ ID NO: 2389407 - RNA, 21 nt, Human
ccagucuccaccaggaaccuc

SEQ ID NO: 2389408 - RNA, 20 nt, Human
ccagucuccaccaggaaccu

SEQ ID NO: 2389409 - RNA, 18 nt, Human
ccagucuggaaugcagug

SEQ ID NO: 2389410 - RNA, 19 nt, Human
ccagucuccaccaggaacc

SEQ ID NO: 2389411 - RNA, 18 nt, Human
ccagucuccaccaggaac

SEQ ID NO: 2389412 - RNA, 16 nt, Human
ccagucuccaccagga

SEQ ID NO: 2389413 - RNA, 16 nt, Human
ccagucuacccagaga

SEQ ID NO: 2389414 - RNA, 20 nt, Human
ccagucgcgcugccugugug

SEQ ID NO: 2389415 - RNA, 21 nt, Human
ccagucgcgcugccugugugg

SEQ ID NO: 2389416 - RNA, 14 nt, Human
ccagucuaaaaaua

SEQ ID NO: 2389417 - RNA, 17 nt, Human
ccaguaaaauugccaua

SEQ ID NO: 2389418 - RNA, 19 nt, Human
ccaguaaaauugccauauu

SEQ ID NO: 2389419 - RNA, 23 nt, Human
ccaguaaaauugccauauugcac

SEQ ID NO: 2389420 - RNA, 12 nt, Human
ccaguaaacaga

SEQ ID NO: 2389421 - RNA, 17 nt, Human
ccaguaaacagaggagu

SEQ ID NO: 2389422 - RNA, 23 nt, Human
ccagucugcugcccuccaucccg

SEQ ID NO: 2389423 - RNA, 16 nt, Human
ccagucugggcugccg

SEQ ID NO: 2389424 - RNA, 18 nt, Human
ccagucugggcugccggg

SEQ ID NO: 2389425 - RNA, 19 nt, Human
ccagucugggcugccgggu

SEQ ID NO: 2389426 - RNA, 22 nt, Human
ccagucugcugcccuccauccc

SEQ ID NO: 2389427 - RNA, 18 nt, Human
ccagucugcugcccucca

SEQ ID NO: 2389428 - RNA, 17 nt, Human
ccagucugcugcccucc

SEQ ID NO: 2389429 - RNA, 16 nt, Human
ccagucugcugcccuc

SEQ ID NO: 2389430 - RNA, 12 nt, Human
ccagucugugga

SEQ ID NO: 2389431 - RNA, 13 nt, Human
ccagucuguggau

SEQ ID NO: 2389432 - RNA, 13 nt, Human
ccagugaggcucu

SEQ ID NO: 2389433 - RNA, 19 nt, Human
ccagucuggaaugcagugg

SEQ ID NO: 2389434 - RNA, 20 nt, Human
ccagucuggaaugcaguggu

SEQ ID NO: 2389435 - RNA, 17 nt, Human
ccagggccagggcccug

SEQ ID NO: 2389436 - RNA, 15 nt, Human
ccagggccagggguc

SEQ ID NO: 2389437 - RNA, 14 nt, Human
ccagggcccagagc

SEQ ID NO: 2389438 - RNA, 13 nt, Human
ccagggcccagag

SEQ ID NO: 2389439 - RNA, 18 nt, Human
ccagggcccagagcccag

SEQ ID NO: 2389440 - RNA, 17 nt, Human
ccagggcccagagccca

SEQ ID NO: 2389441 - RNA, 16 nt, Human
ccagggcccagagccc

SEQ ID NO: 2389442 - RNA, 15 nt, Human
ccagggcccagagcc

SEQ ID NO: 2389443 - RNA, 16 nt, Human
ccagggccagggcccu

SEQ ID NO: 2389444 - RNA, 14 nt, Human
ccagggccagggcc

SEQ ID NO: 2389445 - RNA, 21 nt, Human
ccagggccacucugccucugc

SEQ ID NO: 2389446 - RNA, 12 nt, Human
ccagggccaggg

SEQ ID NO: 2389447 - RNA, 13 nt, Human
ccagggagccuuu

SEQ ID NO: 2389448 - RNA, 12 nt, Human
ccagggagccuu

SEQ ID NO: 2389449 - RNA, 14 nt, Human
ccagggagccuuug

SEQ ID NO: 2389450 - RNA, 18 nt, Human
ccagggagccuuugguuc

SEQ ID NO: 2389451 - RNA, 12 nt, Human
ccagggcuccug

SEQ ID NO: 2389452 - RNA, 13 nt, Human
ccagggcuccugc

SEQ ID NO: 2389453 - RNA, 14 nt, Human
ccagggcuccugca

SEQ ID NO: 2389454 - RNA, 23 nt, Human
ccagggcccagagcccagcucca

SEQ ID NO: 2389455 - RNA, 22 nt, Human
ccagggcccagagcccagcucc

SEQ ID NO: 2389456 - RNA, 21 nt, Human
ccagggcccagagcccagcuc

SEQ ID NO: 2389457 - RNA, 19 nt, Human
ccagggcccagagcccagc

SEQ ID NO: 2389458 - RNA, 21 nt, Human
ccagggcuggaaugauuucag

SEQ ID NO: 2389459 - RNA, 20 nt, Human
ccagggcuccugcacuuacu

SEQ ID NO: 2389460 - RNA, 20 nt, Human
ccagggcugcuagacggagg

SEQ ID NO: 2389461 - RNA, 16 nt, Human
ccagggcucugaccag

SEQ ID NO: 2389462 - RNA, 22 nt, Human
ccaggguucccccagcccugug

SEQ ID NO: 2389463 - RNA, 21 nt, Human
ccaggguucccccagcccugu

SEQ ID NO: 2389464 - RNA, 20 nt, Human
ccaggguucccccagcccug

SEQ ID NO: 2389465 - RNA, 15 nt, Human
ccaggguucccccag

SEQ ID NO: 2389466 - RNA, 14 nt, Human
ccaggguuccccca

SEQ ID NO: 2389467 - RNA, 19 nt, Human
ccagggcuggacugaggcc

SEQ ID NO: 2389468 - RNA, 13 nt, Human
ccagggcuggacu

SEQ ID NO: 2389469 - RNA, 16 nt, Human
ccagggcuggacugag

SEQ ID NO: 2389470 - RNA, 17 nt, Human
ccagggcuggacugagg

SEQ ID NO: 2389471 - RNA, 18 nt, Human
ccagggcuggacugaggc

SEQ ID NO: 2389472 - RNA, 17 nt, Human
ccaggguuucgagaagc

SEQ ID NO: 2389473 - RNA, 23 nt, Human
ccagguaagcaggaggaggugcc

SEQ ID NO: 2389474 - RNA, 16 nt, Human
ccagguaaugagggac

SEQ ID NO: 2389475 - RNA, 18 nt, Human
ccagguaaugagggacug

SEQ ID NO: 2389476 - RNA, 21 nt, Human
ccaggguugaccccagaggau

SEQ ID NO: 2389477 - RNA, 16 nt, Human
ccaggguugaucacac

SEQ ID NO: 2389478 - RNA, 22 nt, Human
ccaggguugaucacacucuggg

SEQ ID NO: 2389479 - RNA, 18 nt, Human
ccaggguugaccccagag

SEQ ID NO: 2389480 - RNA, 16 nt, Human
ccaggguugaccccag

SEQ ID NO: 2389481 - RNA, 19 nt, Human
ccaggugcacaagcuccaa

SEQ ID NO: 2389482 - RNA, 20 nt, Human
ccaggugcacaagcuccaag

SEQ ID NO: 2389483 - RNA, 18 nt, Human
ccaggugcacaagcucca

SEQ ID NO: 2389484 - RNA, 23 nt, Human
ccagguaaugagggacuggaacc

SEQ ID NO: 2389485 - RNA, 15 nt, Human
ccagguaccagcugc

SEQ ID NO: 2389486 - RNA, 17 nt, Human
ccagguaccagcugcgc

SEQ ID NO: 2389487 - RNA, 18 nt, Human
ccagguaccagcugcgcu

SEQ ID NO: 2389488 - RNA, 23 nt, Human
ccagguaccagcugcgcuugcuu

SEQ ID NO: 2389489 - RNA, 15 nt, Human
ccaggccagcugccu

SEQ ID NO: 2389490 - RNA, 23 nt, Human
ccaggagcugggcagaaggccaa

SEQ ID NO: 2389491 - RNA, 12 nt, Human
ccaggccaggcc

SEQ ID NO: 2389492 - RNA, 18 nt, Human
ccaggccaggccaccagg

SEQ ID NO: 2389493 - RNA, 19 nt, Human
ccaggcauuccccaggagg

SEQ ID NO: 2389494 - RNA, 21 nt, Human
ccaggcauuccccaggaggcc

SEQ ID NO: 2389495 - RNA, 23 nt, Human
ccaggagcucuucaggccucccu

SEQ ID NO: 2389496 - RNA, 16 nt, Human
ccaggagcugcccaga

SEQ ID NO: 2389497 - RNA, 17 nt, Human
ccaggagcugcucacua

SEQ ID NO: 2389498 - RNA, 21 nt, Human
ccaggagcucuucaggccucc

SEQ ID NO: 2389499 - RNA, 18 nt, Human
ccaggagcucuucaggcc

SEQ ID NO: 2389500 - RNA, 13 nt, Human
ccaggagcucuuc

SEQ ID NO: 2389501 - RNA, 16 nt, Human
ccaggagcugggcaga

SEQ ID NO: 2389502 - RNA, 21 nt, Human
ccaggagcugggcagaaggcc

SEQ ID NO: 2389503 - RNA, 17 nt, Human
ccaggcauuccccagga

SEQ ID NO: 2389504 - RNA, 18 nt, Human
ccaggcauuccccaggag

SEQ ID NO: 2389505 - RNA, 19 nt, Human
ccaggagagccagcccucc

SEQ ID NO: 2389506 - RNA, 18 nt, Human
ccaggagagccagcccuc

SEQ ID NO: 2389507 - RNA, 17 nt, Human
ccaggagagccagcccu

SEQ ID NO: 2389508 - RNA, 16 nt, Human
ccaggagagccagccc

SEQ ID NO: 2389509 - RNA, 13 nt, Human
ccaggagagccag

SEQ ID NO: 2389510 - RNA, 21 nt, Human
ccaggagagagaaagccaggc

SEQ ID NO: 2389511 - RNA, 16 nt, Human
ccaggagagagaaagc

SEQ ID NO: 2389512 - RNA, 17 nt, Human
ccaggagagagaaagcc

SEQ ID NO: 2389513 - RNA, 12 nt, Human
ccaggagagaga

SEQ ID NO: 2389514 - RNA, 14 nt, Human
ccaggagagagaaa

SEQ ID NO: 2389515 - RNA, 15 nt, Human
ccaggagagagaaag

SEQ ID NO: 2389516 - RNA, 16 nt, Human
ccaggagccccgaggc

SEQ ID NO: 2389517 - RNA, 19 nt, Human
ccaggagccccgaggccuu

SEQ ID NO: 2389518 - RNA, 20 nt, Human
ccaggagagccagcccuccc

SEQ ID NO: 2389519 - RNA, 21 nt, Human
ccaggagaggagcgggaccug

SEQ ID NO: 2389520 - RNA, 23 nt, Human
ccaggagagccagcccucccugu

SEQ ID NO: 2389521 - RNA, 12 nt, Human
ccaggagccucc

SEQ ID NO: 2389522 - RNA, 20 nt, Human
ccaggagccccgaggccuuc

SEQ ID NO: 2389523 - RNA, 12 nt, Human
ccaggagcaaau

SEQ ID NO: 2389524 - RNA, 15 nt, Human
ccaggagcaaauguu

SEQ ID NO: 2389525 - RNA, 17 nt, Human
ccaggagccugugccuc

SEQ ID NO: 2389526 - RNA, 16 nt, Human
ccaggagccugugccu

SEQ ID NO: 2389527 - RNA, 18 nt, Human
ccaggcgcaggggcucac

SEQ ID NO: 2389528 - RNA, 19 nt, Human
ccaggcgccccuucccccu

SEQ ID NO: 2389529 - RNA, 18 nt, Human
ccaggccguggcugccca

SEQ ID NO: 2389530 - RNA, 22 nt, Human
ccaggccguccucccgggcccu

SEQ ID NO: 2389531 - RNA, 18 nt, Human
ccaggcgccccuuccccc

SEQ ID NO: 2389532 - RNA, 14 nt, Human
ccaggccguggcug

SEQ ID NO: 2389533 - RNA, 16 nt, Human
ccaggccguggcugcc

SEQ ID NO: 2389534 - RNA, 22 nt, Human
ccaggccggugugggcuguguc

SEQ ID NO: 2389535 - RNA, 15 nt, Human
ccaggccguccuccc

SEQ ID NO: 2389536 - RNA, 19 nt, Human
ccaggccguccucccgggc

SEQ ID NO: 2389537 - RNA, 18 nt, Human
ccaggccgccccagccuc

SEQ ID NO: 2389538 - RNA, 21 nt, Human
ccaggccgggguggagcaugg

SEQ ID NO: 2389539 - RNA, 16 nt, Human
ccaggccgccccagcc

SEQ ID NO: 2389540 - RNA, 15 nt, Human
ccaggccgccccagc

SEQ ID NO: 2389541 - RNA, 18 nt, Human
ccaggccggcgagcccug

SEQ ID NO: 2389542 - RNA, 24 nt, Human
ccaggcuguaucccaugagccuca

SEQ ID NO: 2389543 - RNA, 17 nt, Human
ccaggcuuagucacuga

SEQ ID NO: 2389544 - RNA, 21 nt, Human
ccaggcgggagcgguggcccu

SEQ ID NO: 2389545 - RNA, 18 nt, Human
ccaggcgaugugcaagug

SEQ ID NO: 2389546 - RNA, 22 nt, Human
ccaggcgggagcgguggcccug

SEQ ID NO: 2389547 - RNA, 14 nt, Human
ccaggcgggcucaa

SEQ ID NO: 2389548 - RNA, 16 nt, Human
ccaggcgggcucaagg

SEQ ID NO: 2389549 - RNA, 17 nt, Human
ccaggcgggcucaagga

SEQ ID NO: 2389550 - RNA, 21 nt, Human
ccaggccauccggcccccaga

SEQ ID NO: 2389551 - RNA, 22 nt, Human
ccaggccauccggcccccagag

SEQ ID NO: 2389552 - RNA, 16 nt, Human
ccaggccaucuuccag

SEQ ID NO: 2389553 - RNA, 18 nt, Human
ccaggccaucuuccaggu

SEQ ID NO: 2389554 - RNA, 19 nt, Human
ccaggccagggggccaguc

SEQ ID NO: 2389555 - RNA, 16 nt, Human
ccaggccauggaggca

SEQ ID NO: 2389556 - RNA, 20 nt, Human
ccaggcccucugcccacucc

SEQ ID NO: 2389557 - RNA, 21 nt, Human
ccaggcccucugcccacuccc

SEQ ID NO: 2389558 - RNA, 21 nt, Human
ccaggccgccccagccucuga

SEQ ID NO: 2389559 - RNA, 16 nt, Human
ccaggccgcagcucuu

SEQ ID NO: 2389560 - RNA, 17 nt, Human
ccaggccgcagcucuug

SEQ ID NO: 2389561 - RNA, 19 nt, Human
ccaggccgcagcucuugcc

SEQ ID NO: 2389562 - RNA, 21 nt, Human
ccaggccgcagcucuugcccu

SEQ ID NO: 2389563 - RNA, 21 nt, Human
ccaggccccaaaaccacagcc

SEQ ID NO: 2389564 - RNA, 18 nt, Human
ccaggccgagaagccagu

SEQ ID NO: 2389565 - RNA, 14 nt, Human
ccaggccgcagcuc

SEQ ID NO: 2389566 - RNA, 20 nt, Human
ccaggccccaaaaccacagc

SEQ ID NO: 2389567 - RNA, 22 nt, Human
ccaggcccucugcccacucccu

SEQ ID NO: 2389568 - RNA, 23 nt, Human
ccaggcccucugcccacucccug

SEQ ID NO: 2389569 - RNA, 19 nt, Human
ccagccuccguauuucaga

SEQ ID NO: 2389570 - RNA, 11 nt, Human
ccagccuccuc

SEQ ID NO: 2389571 - RNA, 12 nt, Human
ccagccuccucu

SEQ ID NO: 2389572 - RNA, 13 nt, Human
ccagccuccucug

SEQ ID NO: 2389573 - RNA, 22 nt, Human
ccagccucaguccuccccucac

SEQ ID NO: 2389574 - RNA, 18 nt, Human
ccagccuccgagagggag

SEQ ID NO: 2389575 - RNA, 19 nt, Human
ccagccuccgagagggaga

SEQ ID NO: 2389576 - RNA, 21 nt, Human
ccagccuccgagagggagaga

SEQ ID NO: 2389577 - RNA, 20 nt, Human
ccaggagaaggccaauuccu

SEQ ID NO: 2389578 - RNA, 14 nt, Human
ccagccuccucugg

SEQ ID NO: 2389579 - RNA, 15 nt, Human
ccagccuccucugga

SEQ ID NO: 2389580 - RNA, 15 nt, Human
ccagccuccaugcug

SEQ ID NO: 2389581 - RNA, 16 nt, Human
ccagccuccaugcugc

SEQ ID NO: 2389582 - RNA, 21 nt, Human
ccagccucccugaagccuuug

SEQ ID NO: 2389583 - RNA, 17 nt, Human
ccagccucccugaagcc

SEQ ID NO: 2389584 - RNA, 15 nt, Human
ccagccucccugaag

SEQ ID NO: 2389585 - RNA, 13 nt, Human
ccagccucccuga

SEQ ID NO: 2389586 - RNA, 13 nt, Human
ccaucuacccucc

SEQ ID NO: 2389587 - RNA, 20 nt, Human
ccagugccgagaaggaagcc

SEQ ID NO: 2389588 - RNA, 22 nt, Human
ccagugguuccuaauccucuag

SEQ ID NO: 2389589 - RNA, 18 nt, Human
ccagugcccccacugacc

SEQ ID NO: 2389590 - RNA, 16 nt, Human
ccagugcccccacuga

SEQ ID NO: 2389591 - RNA, 14 nt, Human
ccagugcccccacu

SEQ ID NO: 2389592 - RNA, 16 nt, Human
ccagugaggcucugcc

SEQ ID NO: 2389593 - RNA, 16 nt, Human
ccagucuguggaucag

SEQ ID NO: 2389594 - RNA, 13 nt, Human
ccagugcccauuc

SEQ ID NO: 2389595 - RNA, 18 nt, Human
ccagugcccauuccucac

SEQ ID NO: 2389596 - RNA, 23 nt, Human
ccagugcccacaggaucagucug

SEQ ID NO: 2389597 - RNA, 14 nt, Human
ccagugaggcucug

SEQ ID NO: 2389598 - RNA, 15 nt, Human
ccagugaggcucugc

SEQ ID NO: 2389599 - RNA, 15 nt, Human
ccagugucugucccg

SEQ ID NO: 2389600 - RNA, 21 nt, Human
ccagugucugucccggggucc

SEQ ID NO: 2389601 - RNA, 16 nt, Human
ccaguguccuuagaac

SEQ ID NO: 2389602 - RNA, 15 nt, Human
ccaguguagccuugc

SEQ ID NO: 2389603 - RNA, 14 nt, Human
ccaguguagccuug

SEQ ID NO: 2389604 - RNA, 14 nt, Human
ccagugguugcugu

SEQ ID NO: 2389605 - RNA, 19 nt, Human
ccagugucaaguugugcuu

SEQ ID NO: 2389606 - RNA, 22 nt, Human
ccagugucaaguugugcuuguu

SEQ ID NO: 2389607 - RNA, 14 nt, Human
ccaguguccccucc

SEQ ID NO: 2389608 - RNA, 16 nt, Human
ccaguguccccuccac

SEQ ID NO: 2389609 - RNA, 22 nt, Human
ccaguguccccuccacugucac

SEQ ID NO: 2389610 - RNA, 18 nt, Human
ccagugucugucccgggg

SEQ ID NO: 2389611 - RNA, 20 nt, Human
ccaguguuagggaagggccu

SEQ ID NO: 2389612 - RNA, 17 nt, Human
ccaguuaaaaaaaauuu

SEQ ID NO: 2389613 - RNA, 17 nt, Human
ccaguguuagggaaggg

SEQ ID NO: 2389614 - RNA, 22 nt, Human
ccaguguuguggauuuaacaga

SEQ ID NO: 2389615 - RNA, 15 nt, Human
ccauagcuuccauga

SEQ ID NO: 2389616 - RNA, 13 nt, Human
ccauaggcccagu

SEQ ID NO: 2389617 - RNA, 12 nt, Human
ccauaggucacc

SEQ ID NO: 2389618 - RNA, 19 nt, Human
ccauaguaccauuuauaca

SEQ ID NO: 2389619 - RNA, 15 nt, Human
ccauaguaccauuua

SEQ ID NO: 2389620 - RNA, 23 nt, Human
ccauauucuguuggccaguguga

SEQ ID NO: 2389621 - RNA, 15 nt, Human
ccauagucacauggc

SEQ ID NO: 2389622 - RNA, 21 nt, Human
ccauaguaugggacuggccuc

SEQ ID NO: 2389623 - RNA, 19 nt, Human
ccauagcuccugcuccaca

SEQ ID NO: 2389624 - RNA, 21 nt, Human
ccaguuauggcuauaggugcu

SEQ ID NO: 2389625 - RNA, 14 nt, Human
ccaguuauggcuau

SEQ ID NO: 2389626 - RNA, 17 nt, Human
ccauucacucuuccaga

SEQ ID NO: 2389627 - RNA, 20 nt, Human
ccauucacuucauaauccag

SEQ ID NO: 2389628 - RNA, 20 nt, Human
ccauucagugauuacuguca

SEQ ID NO: 2389629 - RNA, 19 nt, Human
ccauucacucuuccagaau

SEQ ID NO: 2389630 - RNA, 18 nt, Human
ccauucuccaccugccag

SEQ ID NO: 2389631 - RNA, 14 nt, Human
ccauguuuguaaaa

SEQ ID NO: 2389632 - RNA, 15 nt, Human
ccauguuuguaaaac

SEQ ID NO: 2389633 - RNA, 21 nt, Human
ccauguuugagcucagacccc

SEQ ID NO: 2389634 - RNA, 13 nt, Human
ccauguuuguaaa

SEQ ID NO: 2389635 - RNA, 17 nt, Human
ccauguuugagcucaga

SEQ ID NO: 2389636 - RNA, 16 nt, Human
ccauguuugagcucag

SEQ ID NO: 2389637 - RNA, 14 nt, Human
ccauguuucucugg

SEQ ID NO: 2389638 - RNA, 21 nt, Human
ccauguuucucuggccccaag

SEQ ID NO: 2389639 - RNA, 15 nt, Human
ccauguuucucuggc

SEQ ID NO: 2389640 - RNA, 16 nt, Human
ccauguuucucuggcc

SEQ ID NO: 2389641 - RNA, 17 nt, Human
ccauguuggccaggcug

SEQ ID NO: 2389642 - RNA, 16 nt, Human
ccauguuggccaggcu

SEQ ID NO: 2389643 - RNA, 21 nt, Human
ccauguuggccaggcugcucu

SEQ ID NO: 2389644 - RNA, 18 nt, Human
ccauguuggccaggcugc

SEQ ID NO: 2389645 - RNA, 22 nt, Human
ccaugggagcugguuagaaaug

SEQ ID NO: 2389646 - RNA, 21 nt, Human
ccaugggaagacgaggcccuc

SEQ ID NO: 2389647 - RNA, 21 nt, Human
ccaugggaccaaaccuagccc

SEQ ID NO: 2389648 - RNA, 15 nt, Human
ccaugggaccaaacc

SEQ ID NO: 2389649 - RNA, 20 nt, Human
ccauggcuuccaaggugguc

SEQ ID NO: 2389650 - RNA, 14 nt, Human
ccauggcuuccucc

SEQ ID NO: 2389651 - RNA, 19 nt, Human
ccaugggacagggaggacg

SEQ ID NO: 2389652 - RNA, 16 nt, Human
ccaugggacagggagg

SEQ ID NO: 2389653 - RNA, 12 nt, Human
ccauccuacccu

SEQ ID NO: 2389654 - RNA, 19 nt, Human
ccauauucuguuggccagu

SEQ ID NO: 2389655 - RNA, 14 nt, Human
ccauaguaguauga

SEQ ID NO: 2389656 - RNA, 13 nt, Human
ccauauugcacau

SEQ ID NO: 2389657 - RNA, 18 nt, Human
ccauauugcacaugucuu

SEQ ID NO: 2389658 - RNA, 21 nt, Human
ccauauugcacaugucuuaau

SEQ ID NO: 2389659 - RNA, 23 nt, Human
ccauauugcacaugucuuaauga

SEQ ID NO: 2389660 - RNA, 13 nt, Human
ccauccuccccuu

SEQ ID NO: 2389661 - RNA, 20 nt, Human
ccaucgcuguguguuaguuc

SEQ ID NO: 2389662 - RNA, 14 nt, Human
ccauccuccccuuc

SEQ ID NO: 2389663 - RNA, 14 nt, Human
ccauccuccagcuu

SEQ ID NO: 2389664 - RNA, 15 nt, Human
ccauccuccagcuuc

SEQ ID NO: 2389665 - RNA, 16 nt, Human
ccauccuccagcuucu

SEQ ID NO: 2389666 - RNA, 17 nt, Human
ccauccuccagcuucug

SEQ ID NO: 2389667 - RNA, 14 nt, Human
ccaucuaaacugcc

SEQ ID NO: 2389668 - RNA, 17 nt, Human
ccauccuccagcaggga

SEQ ID NO: 2389669 - RNA, 13 nt, Human
ccauccuccagcu

SEQ ID NO: 2389670 - RNA, 16 nt, Human
ccauccuccagcaggg

SEQ ID NO: 2389671 - RNA, 15 nt, Human
ccauccuccagcagg

SEQ ID NO: 2389672 - RNA, 14 nt, Human
ccauccuccagcag

SEQ ID NO: 2389673 - RNA, 13 nt, Human
ccauccuccagca

SEQ ID NO: 2389674 - RNA, 18 nt, Human
ccauccucaaacacugca

SEQ ID NO: 2389675 - RNA, 23 nt, Human
ccauccuacccucgggcccaccu

SEQ ID NO: 2389676 - RNA, 13 nt, Human
ccauccucaaaca

SEQ ID NO: 2389677 - RNA, 16 nt, Human
ccauccuacccucggg

SEQ ID NO: 2389678 - RNA, 17 nt, Human
ccauccuacccucgggc

SEQ ID NO: 2389679 - RNA, 18 nt, Human
ccauccuacccucgggcc

SEQ ID NO: 2389680 - RNA, 22 nt, Human
ccauccuacccucgggcccacc

SEQ ID NO: 2389681 - RNA, 18 nt, Human
ccauggcuuaaugcuucu

SEQ ID NO: 2389682 - RNA, 21 nt, Human
ccaugggaaaugucaacaagu

SEQ ID NO: 2389683 - RNA, 21 nt, Human
ccauggcgugucccucucgga

SEQ ID NO: 2389684 - RNA, 19 nt, Human
ccauggcgugucccucucg

SEQ ID NO: 2389685 - RNA, 22 nt, Human
ccaucugcgugacaauaaaaca

SEQ ID NO: 2389686 - RNA, 15 nt, Human
ccauggcccucccag

SEQ ID NO: 2389687 - RNA, 20 nt, Human
ccaucugcgugacaauaaaa

SEQ ID NO: 2389688 - RNA, 22 nt, Human
ccaucugcccaggggugccccc

SEQ ID NO: 2389689 - RNA, 23 nt, Human
ccaucugcccaggggugcccccu

SEQ ID NO: 2389690 - RNA, 20 nt, Human
ccaucugcaccccccugggc

SEQ ID NO: 2389691 - RNA, 14 nt, Human
ccaucugcaccccu

SEQ ID NO: 2389692 - RNA, 19 nt, Human
ccaucugcaccccccuggg

SEQ ID NO: 2389693 - RNA, 12 nt, Human
ccaucugcaccc

SEQ ID NO: 2389694 - RNA, 17 nt, Human
ccaucugcaccccuucu

SEQ ID NO: 2389695 - RNA, 20 nt, Human
ccaucugcaccccuucucuc

SEQ ID NO: 2389696 - RNA, 22 nt, Human
ccaucugcaccccuucucuccu

SEQ ID NO: 2389697 - RNA, 23 nt, Human
ccaucugcaccccuucucuccuc

SEQ ID NO: 2389698 - RNA, 12 nt, Human
ccaucugcccag

SEQ ID NO: 2389699 - RNA, 13 nt, Human
ccaucugcccagg

SEQ ID NO: 2389700 - RNA, 15 nt, Human
ccaucugcccaggac

SEQ ID NO: 2389701 - RNA, 16 nt, Human
ccaucugcccaggacg

SEQ ID NO: 2389702 - RNA, 17 nt, Human
ccaucugcccaggggug

SEQ ID NO: 2389703 - RNA, 20 nt, Human
ccaucugcccaggggugccc

SEQ ID NO: 2389704 - RNA, 21 nt, Human
ccaucugcccaggggugcccc

SEQ ID NO: 2389705 - RNA, 23 nt, Human
ccaucgcuguguguuaguuccca

SEQ ID NO: 2389706 - RNA, 20 nt, Human
ccaucuaaauaccugcccug

SEQ ID NO: 2389707 - RNA, 16 nt, Human
ccaucuaaacugcccc

SEQ ID NO: 2389708 - RNA, 15 nt, Human
ccaucuaaacugccc

SEQ ID NO: 2389709 - RNA, 11 nt, Human
ccauucuccca

SEQ ID NO: 2389710 - RNA, 14 nt, Human
ccauucauuccauu

SEQ ID NO: 2389711 - RNA, 13 nt, Human
ccauucauuccau

SEQ ID NO: 2389712 - RNA, 19 nt, Human
ccauuuggcagagcuucuu

SEQ ID NO: 2389713 - RNA, 22 nt, Human
ccauucucccagguaccagcug

SEQ ID NO: 2389714 - RNA, 12 nt, Human
ccauucucccag

SEQ ID NO: 2389715 - RNA, 13 nt, Human
ccauucucccagg

SEQ ID NO: 2389716 - RNA, 14 nt, Human
ccauucucccaggu

SEQ ID NO: 2389717 - RNA, 15 nt, Human
ccauucucccaggua

SEQ ID NO: 2389718 - RNA, 19 nt, Human
ccauucuccaccugccagg

SEQ ID NO: 2389719 - RNA, 20 nt, Human
ccauucuccaccugccaggg

SEQ ID NO: 2389720 - RNA, 14 nt, Human
ccauuugugugugu

SEQ ID NO: 2389721 - RNA, 19 nt, Human
cccaaaacaccggguucca

SEQ ID NO: 2389722 - RNA, 14 nt, Human
ccauuuguguuuau

SEQ ID NO: 2389723 - RNA, 14 nt, Human
cccaaagccagaca

SEQ ID NO: 2389724 - RNA, 15 nt, Human
cccaaaaccacagcc

SEQ ID NO: 2389725 - RNA, 14 nt, Human
cccaaaaccacagc

SEQ ID NO: 2389726 - RNA, 14 nt, Human
cccaaagcuuuccu

SEQ ID NO: 2389727 - RNA, 15 nt, Human
cccaaagcuuuccug

SEQ ID NO: 2389728 - RNA, 20 nt, Human
cccaaaacucuccucugcug

SEQ ID NO: 2389729 - RNA, 21 nt, Human
cccaaaacaccggguuccagc

SEQ ID NO: 2389730 - RNA, 16 nt, Human
cccaaaacucuccucu

SEQ ID NO: 2389731 - RNA, 18 nt, Human
cccaaaacucuccucugc

SEQ ID NO: 2389732 - RNA, 21 nt, Human
cccaaaaccacagcccuguca

SEQ ID NO: 2389733 - RNA, 17 nt, Human
cccaaaggaaaaagcac

SEQ ID NO: 2389734 - RNA, 20 nt, Human
cccaaagcuuuccugcccca

SEQ ID NO: 2389735 - RNA, 16 nt, Human
cccaaagcuuuccugc

SEQ ID NO: 2389736 - RNA, 17 nt, Human
cccaaagcuuuccugcc

SEQ ID NO: 2389737 - RNA, 14 nt, Human
cccaaaggacucca

SEQ ID NO: 2389738 - RNA, 18 nt, Human
cccaaaggacuccaccca

SEQ ID NO: 2389739 - RNA, 13 nt, Human
cccaaagugcugg

SEQ ID NO: 2389740 - RNA, 15 nt, Human
cccaaagugcuggga

SEQ ID NO: 2389741 - RNA, 23 nt, Human
cccaaucccagcuaccucaacca

SEQ ID NO: 2389742 - RNA, 13 nt, Human
cccaagggaucug

SEQ ID NO: 2389743 - RNA, 22 nt, Human
cccaaggcugcgucuggagggg

SEQ ID NO: 2389744 - RNA, 17 nt, Human
cccaagggaaagaaaag

SEQ ID NO: 2389745 - RNA, 21 nt, Human
cccaaucccuuuauuaccccc

SEQ ID NO: 2389746 - RNA, 17 nt, Human
cccaaucccuuuauuac

SEQ ID NO: 2389747 - RNA, 17 nt, Human
cccaaggcucugagcaa

SEQ ID NO: 2389748 - RNA, 15 nt, Human
cccaaggcugcgucu

SEQ ID NO: 2389749 - RNA, 19 nt, Human
cccaaggcugcgucuggag

SEQ ID NO: 2389750 - RNA, 20 nt, Human
cccaaggcugcgucuggagg

SEQ ID NO: 2389751 - RNA, 21 nt, Human
cccaaggcugcgucuggaggg

SEQ ID NO: 2389752 - RNA, 22 nt, Human
cccaaggaggaaaaacagacaa

SEQ ID NO: 2389753 - RNA, 22 nt, Human
cccaaggcguccgcgcgccagc

SEQ ID NO: 2389754 - RNA, 15 nt, Human
cccaaggcggccccu

SEQ ID NO: 2389755 - RNA, 22 nt, Human
cccaaccggggagcccccgccc

SEQ ID NO: 2389756 - RNA, 12 nt, Human
cccaaccucaga

SEQ ID NO: 2389757 - RNA, 17 nt, Human
cccaacccuucccucac

SEQ ID NO: 2389758 - RNA, 16 nt, Human
cccaacccugccccug

SEQ ID NO: 2389759 - RNA, 14 nt, Human
cccaacccugucug

SEQ ID NO: 2389760 - RNA, 15 nt, Human
cccaacccuucccca

SEQ ID NO: 2389761 - RNA, 15 nt, Human
cccaacccuggcacc

SEQ ID NO: 2389762 - RNA, 15 nt, Human
cccaaggaggaaaaa

SEQ ID NO: 2389763 - RNA, 14 nt, Human
cccaaggaggaaaa

SEQ ID NO: 2389764 - RNA, 15 nt, Human
cccaaggacugaggg

SEQ ID NO: 2389765 - RNA, 16 nt, Human
cccaaggacugaggga

SEQ ID NO: 2389766 - RNA, 21 nt, Human
cccaaggacugagggacucug

SEQ ID NO: 2389767 - RNA, 16 nt, Human
cccaaccuccugaccu

SEQ ID NO: 2389768 - RNA, 22 nt, Human
cccaaggaaagccccagcacua

SEQ ID NO: 2389769 - RNA, 20 nt, Human
cccaaagugguauagaaaug

SEQ ID NO: 2389770 - RNA, 16 nt, Human
cccaaagucuguguga

SEQ ID NO: 2389771 - RNA, 23 nt, Human
cccaaaggauacuguaacacuuu

SEQ ID NO: 2389772 - RNA, 16 nt, Human
cccaaagugcugggau

SEQ ID NO: 2389773 - RNA, 21 nt, Human
cccaaagugguauagaaaugc

SEQ ID NO: 2389774 - RNA, 21 nt, Human
cccaaagugcuuccaaggcag

SEQ ID NO: 2389775 - RNA, 17 nt, Human
cccaaauaagaagggau

SEQ ID NO: 2389776 - RNA, 14 nt, Human
cccaaaucaauaca

SEQ ID NO: 2389777 - RNA, 16 nt, Human
cccaaaucaauacacu

SEQ ID NO: 2389778 - RNA, 23 nt, Human
cccaaauccgaaccuccucugug

SEQ ID NO: 2389779 - RNA, 18 nt, Human
cccaaauccgaaccuccu

SEQ ID NO: 2389780 - RNA, 15 nt, Human
cccaaauccgaaccu

SEQ ID NO: 2389781 - RNA, 15 nt, Human
cccaacccugccccu

SEQ ID NO: 2389782 - RNA, 14 nt, Human
cccaacccugcccc

SEQ ID NO: 2389783 - RNA, 13 nt, Human
cccaacccugccc

SEQ ID NO: 2389784 - RNA, 14 nt, Human
cccaaaugagccau

SEQ ID NO: 2389785 - RNA, 18 nt, Human
cccaaauggaaaugggca

SEQ ID NO: 2389786 - RNA, 22 nt, Human
cccaaauggaaaugggcagagc

SEQ ID NO: 2389787 - RNA, 22 nt, Human
cccagaaggcauaucagucucu

SEQ ID NO: 2389788 - RNA, 14 nt, Human
caucucucuuuaau

SEQ ID NO: 2389789 - RNA, 14 nt, Human
caucucucuggccc

SEQ ID NO: 2389790 - RNA, 15 nt, Human
caucucucuggcccu

SEQ ID NO: 2389791 - RNA, 18 nt, Human
caucucucugcccaaccc

SEQ ID NO: 2389792 - RNA, 16 nt, Human
caucucucugcccaac

SEQ ID NO: 2389793 - RNA, 23 nt, Human
caucucucuacuccuaccucagc

SEQ ID NO: 2389794 - RNA, 11 nt, Human
caucucucucc

SEQ ID NO: 2389795 - RNA, 15 nt, Human
caucucucugcccaa

SEQ ID NO: 2389796 - RNA, 13 nt, Human
caucucucugccc

SEQ ID NO: 2389797 - RNA, 21 nt, Human
caucucucuggcccucuaccc

SEQ ID NO: 2389798 - RNA, 15 nt, Human
caucucugcaaucuu

SEQ ID NO: 2389799 - RNA, 11 nt, Human
caucucugcac

SEQ ID NO: 2389800 - RNA, 22 nt, Human
caucucugcaaucuucucagaa

SEQ ID NO: 2389801 - RNA, 12 nt, Human
caucucugcuug

SEQ ID NO: 2389802 - RNA, 20 nt, Human
caucucugcuugagucaggu

SEQ ID NO: 2389803 - RNA, 13 nt, Human
caucucugcuuga

SEQ ID NO: 2389804 - RNA, 21 nt, Human
caucucugcuugagucagguu

SEQ ID NO: 2389805 - RNA, 13 nt, Human
caucucugcuugg

SEQ ID NO: 2389806 - RNA, 14 nt, Human
caucucuggaugcc

SEQ ID NO: 2389807 - RNA, 16 nt, Human
caucucuggaugccug

SEQ ID NO: 2389808 - RNA, 16 nt, Human
caucucucccuccccu

SEQ ID NO: 2389809 - RNA, 15 nt, Human
caucucucccucccc

SEQ ID NO: 2389810 - RNA, 12 nt, Human
caucucucccuc

SEQ ID NO: 2389811 - RNA, 18 nt, Human
caucucucagaagggagg

SEQ ID NO: 2389812 - RNA, 15 nt, Human
caucucucagaaggg

SEQ ID NO: 2389813 - RNA, 23 nt, Human
caucucuaacagcucaggaucuc

SEQ ID NO: 2389814 - RNA, 22 nt, Human
caucucuaacagcucaggaucu

SEQ ID NO: 2389815 - RNA, 19 nt, Human
caucucuaauuggaagaaa

SEQ ID NO: 2389816 - RNA, 22 nt, Human
caucucucuacuccuaccucag

SEQ ID NO: 2389817 - RNA, 21 nt, Human
caucucucuacuccuaccuca

SEQ ID NO: 2389818 - RNA, 23 nt, Human
caucucucccuccccugccauuu

SEQ ID NO: 2389819 - RNA, 20 nt, Human
caucucucccuccccugcca

SEQ ID NO: 2389820 - RNA, 15 nt, Human
caucucuccuccuuu

SEQ ID NO: 2389821 - RNA, 17 nt, Human
caucugccccuccccca

SEQ ID NO: 2389822 - RNA, 16 nt, Human
caucugccccuccccc

SEQ ID NO: 2389823 - RNA, 15 nt, Human
caucugccccucccc

SEQ ID NO: 2389824 - RNA, 14 nt, Human
caucugccccuccc

SEQ ID NO: 2389825 - RNA, 13 nt, Human
caucugccccucc

SEQ ID NO: 2389826 - RNA, 11 nt, Human
caucugccccu

SEQ ID NO: 2389827 - RNA, 13 nt, Human
caucugcccaggg

SEQ ID NO: 2389828 - RNA, 15 nt, Human
caucugcccaggggu

SEQ ID NO: 2389829 - RNA, 16 nt, Human
caucugcccaggggug

SEQ ID NO: 2389830 - RNA, 21 nt, Human
caucugcccaggggugccccc

SEQ ID NO: 2389831 - RNA, 20 nt, Human
caucugcauuuucaccccac

SEQ ID NO: 2389832 - RNA, 16 nt, Human
caucugcacccucgau

SEQ ID NO: 2389833 - RNA, 11 nt, Human
caucugcccag

SEQ ID NO: 2389834 - RNA, 12 nt, Human
caucugcccagg

SEQ ID NO: 2389835 - RNA, 13 nt, Human
caucugcccagga

SEQ ID NO: 2389836 - RNA, 14 nt, Human
caucugcccaggac

SEQ ID NO: 2389837 - RNA, 22 nt, Human
caucugcccaggacggggccgg

SEQ ID NO: 2389838 - RNA, 19 nt, Human
caucugcauuuucacccca

SEQ ID NO: 2389839 - RNA, 12 nt, Human
caucugacucac

SEQ ID NO: 2389840 - RNA, 18 nt, Human
caucugacucacaagaag

SEQ ID NO: 2389841 - RNA, 23 nt, Human
caucugcacccucgaugaagccc

SEQ ID NO: 2389842 - RNA, 14 nt, Human
caucugaaagccac

SEQ ID NO: 2389843 - RNA, 16 nt, Human
caucugaaagccacgu

SEQ ID NO: 2389844 - RNA, 13 nt, Human
caucugaaagcca

SEQ ID NO: 2389845 - RNA, 12 nt, Human
caucugaaagcc

SEQ ID NO: 2389846 - RNA, 19 nt, Human
caucucuuugaauuuucug

SEQ ID NO: 2389847 - RNA, 22 nt, Human
caucucuuugaauuuucugugu

SEQ ID NO: 2389848 - RNA, 13 nt, Human
caucucuuugaau

SEQ ID NO: 2389849 - RNA, 15 nt, Human
caucucuuugaauuu

SEQ ID NO: 2389850 - RNA, 15 nt, Human
caucugaagagcaga

SEQ ID NO: 2389851 - RNA, 15 nt, Human
caucugaccacgugc

SEQ ID NO: 2389852 - RNA, 15 nt, Human
caucugaccagcagc

SEQ ID NO: 2389853 - RNA, 14 nt, Human
caucugaccagcag

SEQ ID NO: 2389854 - RNA, 21 nt, Human
caucugaccagcagcgccuuu

SEQ ID NO: 2389855 - RNA, 19 nt, Human
caucugaccagcagcgccu

SEQ ID NO: 2389856 - RNA, 17 nt, Human
caucugaccagcagcgc

SEQ ID NO: 2389857 - RNA, 16 nt, Human
caucucuacaaaaagc

SEQ ID NO: 2389858 - RNA, 21 nt, Human
caucucuaacagcucaggauc

SEQ ID NO: 2389859 - RNA, 20 nt, Human
caucucuaacagcucaggau

SEQ ID NO: 2389860 - RNA, 19 nt, Human
caucucuaacagcucagga

SEQ ID NO: 2389861 - RNA, 18 nt, Human
caucucuaacagcucagg

SEQ ID NO: 2389862 - RNA, 16 nt, Human
caucucuaacagcuca

SEQ ID NO: 2389863 - RNA, 19 nt, Human
caucuccugugcaugggug

SEQ ID NO: 2389864 - RNA, 15 nt, Human
caucuccugugcaug

SEQ ID NO: 2389865 - RNA, 13 nt, Human
caucuccugugca

SEQ ID NO: 2389866 - RNA, 22 nt, Human
caucuccugccuuccuccuggg

SEQ ID NO: 2389867 - RNA, 19 nt, Human
caucuccugccuuccuccu

SEQ ID NO: 2389868 - RNA, 22 nt, Human
caucucgccaccccuccuuccu

SEQ ID NO: 2389869 - RNA, 21 nt, Human
caucucgccaccccuccuucc

SEQ ID NO: 2389870 - RNA, 20 nt, Human
caucuccugugcauggguga

SEQ ID NO: 2389871 - RNA, 15 nt, Human
caucucccucccaca

SEQ ID NO: 2389872 - RNA, 20 nt, Human
caucuccuccauacucagga

SEQ ID NO: 2389873 - RNA, 16 nt, Human
caucuccugccuuccu

SEQ ID NO: 2389874 - RNA, 16 nt, Human
cauccggcagccugga

SEQ ID NO: 2389875 - RNA, 15 nt, Human
cauccggcagccugg

SEQ ID NO: 2389876 - RNA, 14 nt, Human
cauccgccagggcc

SEQ ID NO: 2389877 - RNA, 15 nt, Human
cauccgccagggccc

SEQ ID NO: 2389878 - RNA, 18 nt, Human
cauccuacaagacacagu

SEQ ID NO: 2389879 - RNA, 18 nt, Human
cauccuaccaaugcaugc

SEQ ID NO: 2389880 - RNA, 19 nt, Human
cauccuaccaaugcaugca

SEQ ID NO: 2389881 - RNA, 19 nt, Human
cauccuacaagacacagug

SEQ ID NO: 2389882 - RNA, 17 nt, Human
cauccuacaagacacag

SEQ ID NO: 2389883 - RNA, 14 nt, Human
cauccuaccaaugc

SEQ ID NO: 2389884 - RNA, 15 nt, Human
cauccuaccaaugca

SEQ ID NO: 2389885 - RNA, 23 nt, Human
caucuuucuucuauuuuauuccc

SEQ ID NO: 2389886 - RNA, 19 nt, Human
caucuugcucugcugacag

SEQ ID NO: 2389887 - RNA, 15 nt, Human
caucuugcucugcug

SEQ ID NO: 2389888 - RNA, 16 nt, Human
caucuugcucugcuga

SEQ ID NO: 2389889 - RNA, 17 nt, Human
caucuugcucugcugac

SEQ ID NO: 2389890 - RNA, 18 nt, Human
caucugccccucccccaa

SEQ ID NO: 2389891 - RNA, 23 nt, Human
caucugcccaggggugcccccuc

SEQ ID NO: 2389892 - RNA, 17 nt, Human
caucuucugccuuaguc

SEQ ID NO: 2389893 - RNA, 14 nt, Human
caucuucuucacca

SEQ ID NO: 2389894 - RNA, 13 nt, Human
caucuucuggagu

SEQ ID NO: 2389895 - RNA, 19 nt, Human
caucuucuggagucuccag

SEQ ID NO: 2389896 - RNA, 22 nt, Human
caucuucuuuuugaaaucagca

SEQ ID NO: 2389897 - RNA, 19 nt, Human
caucuucuucaccauuugg

SEQ ID NO: 2389898 - RNA, 22 nt, Human
caucuucuggagucuccagugg

SEQ ID NO: 2389899 - RNA, 21 nt, Human
caucuucuuugcagccugggu

SEQ ID NO: 2389900 - RNA, 16 nt, Human
caucuugaauuguaag

SEQ ID NO: 2389901 - RNA, 21 nt, Human
caucuugaauuguaaggaaug

SEQ ID NO: 2389902 - RNA, 14 nt, Human
caugauaugucagg

SEQ ID NO: 2389903 - RNA, 22 nt, Human
caugaguuuuuucucuugggcu

SEQ ID NO: 2389904 - RNA, 19 nt, Human
caugaguuuuuucucuugg

SEQ ID NO: 2389905 - RNA, 22 nt, Human
caugaguuugcccugguuucac

SEQ ID NO: 2389906 - RNA, 16 nt, Human
caugaguuugcccugg

SEQ ID NO: 2389907 - RNA, 15 nt, Human
caugaguuugcccug

SEQ ID NO: 2389908 - RNA, 19 nt, Human
caugaguuggcugggaaua

SEQ ID NO: 2389909 - RNA, 23 nt, Human
caugaguuggggucuggcagccu

SEQ ID NO: 2389910 - RNA, 21 nt, Human
caugaguuggggucuggcagc

SEQ ID NO: 2389911 - RNA, 18 nt, Human
caugagugcgugcucagu

SEQ ID NO: 2389912 - RNA, 16 nt, Human
caugcacucagcucuu

SEQ ID NO: 2389913 - RNA, 15 nt, Human
caugcacucagcucu

SEQ ID NO: 2389914 - RNA, 21 nt, Human
caugaucuugugacauauuau

SEQ ID NO: 2389915 - RNA, 15 nt, Human
caugaugagcuccuc

SEQ ID NO: 2389916 - RNA, 19 nt, Human
caugaugagcuccucuucc

SEQ ID NO: 2389917 - RNA, 18 nt, Human
caugaugagcuccucuuc

SEQ ID NO: 2389918 - RNA, 21 nt, Human
caugaucucccugccgccuca

SEQ ID NO: 2389919 - RNA, 20 nt, Human
caugaucucccugccgccuc

SEQ ID NO: 2389920 - RNA, 15 nt, Human
caugaucucggcuua

SEQ ID NO: 2389921 - RNA, 15 nt, Human
caugaucuugagcaa

SEQ ID NO: 2389922 - RNA, 19 nt, Human
caugaucucccugccgccu

SEQ ID NO: 2389923 - RNA, 18 nt, Human
caugaucucccugccgcc

SEQ ID NO: 2389924 - RNA, 17 nt, Human
caugaucucccugccgc

SEQ ID NO: 2389925 - RNA, 16 nt, Human
caugaucucccugccg

SEQ ID NO: 2389926 - RNA, 13 nt, Human
caugaucucccug

SEQ ID NO: 2389927 - RNA, 15 nt, Human
caugaucucccugcc

SEQ ID NO: 2389928 - RNA, 21 nt, Human
caugaucccuguguugucucu

SEQ ID NO: 2389929 - RNA, 22 nt, Human
caugaucccuguguugucucua

SEQ ID NO: 2389930 - RNA, 20 nt, Human
caugaggggcccgagcagaa

SEQ ID NO: 2389931 - RNA, 19 nt, Human
caugagguacugagaguga

SEQ ID NO: 2389932 - RNA, 13 nt, Human
caugaguccccug

SEQ ID NO: 2389933 - RNA, 12 nt, Human
caugagucccag

SEQ ID NO: 2389934 - RNA, 14 nt, Human
caugagucccagug

SEQ ID NO: 2389935 - RNA, 15 nt, Human
caugagucccagugg

SEQ ID NO: 2389936 - RNA, 16 nt, Human
caugagucccaguggg

SEQ ID NO: 2389937 - RNA, 17 nt, Human
caugagucccaguggga

SEQ ID NO: 2389938 - RNA, 18 nt, Human
caugagucccagugggag

SEQ ID NO: 2389939 - RNA, 19 nt, Human
caugagucccagugggagg

SEQ ID NO: 2389940 - RNA, 23 nt, Human
caugaguccccuguuuguuucug

SEQ ID NO: 2389941 - RNA, 14 nt, Human
caugagugaauaaa

SEQ ID NO: 2389942 - RNA, 21 nt, Human
caugaguccuugaaaauauuu

SEQ ID NO: 2389943 - RNA, 14 nt, Human
caugagugcgugcu

SEQ ID NO: 2389944 - RNA, 17 nt, Human
caugaguccuugaaaau

SEQ ID NO: 2389945 - RNA, 18 nt, Human
caugaguccuugaaaaua

SEQ ID NO: 2389946 - RNA, 19 nt, Human
caugaguccuugaaaauau

SEQ ID NO: 2389947 - RNA, 20 nt, Human
caugaguccuugaaaauauu

SEQ ID NO: 2389948 - RNA, 14 nt, Human
caugaguccccugu

SEQ ID NO: 2389949 - RNA, 15 nt, Human
caugaguccccuguu

SEQ ID NO: 2389950 - RNA, 23 nt, Human
caugagcuccagacccccagcaa

SEQ ID NO: 2389951 - RNA, 21 nt, Human
caugagcuccagacccccagc

SEQ ID NO: 2389952 - RNA, 19 nt, Human
caugagcuccagaccccca

SEQ ID NO: 2389953 - RNA, 17 nt, Human
caugagcuccagacccc

SEQ ID NO: 2389954 - RNA, 16 nt, Human
caugagcuccagaccc

SEQ ID NO: 2389955 - RNA, 15 nt, Human
caugagcuccagacc

SEQ ID NO: 2389956 - RNA, 14 nt, Human
caugagcuccagac

SEQ ID NO: 2389957 - RNA, 13 nt, Human
caugagcuccaga

SEQ ID NO: 2389958 - RNA, 19 nt, Human
caugagcuacgccugccuc

SEQ ID NO: 2389959 - RNA, 20 nt, Human
caugagcuacgccugccucc

SEQ ID NO: 2389960 - RNA, 16 nt, Human
caugagcuauuuccau

SEQ ID NO: 2389961 - RNA, 22 nt, Human
caugagcuauuuccauuccaga

SEQ ID NO: 2389962 - RNA, 23 nt, Human
caugagcuauuuccauuccagaa

SEQ ID NO: 2389963 - RNA, 22 nt, Human
caugagccucagcauccuggca

SEQ ID NO: 2389964 - RNA, 23 nt, Human
caugagccucagcauccuggcac

SEQ ID NO: 2389965 - RNA, 16 nt, Human
caugaggaacaaggca

SEQ ID NO: 2389966 - RNA, 17 nt, Human
caugaggaacaaggcaa

SEQ ID NO: 2389967 - RNA, 20 nt, Human
caugaggaacaaggcaaggc

SEQ ID NO: 2389968 - RNA, 21 nt, Human
caugaggaacaaggcaaggcu

SEQ ID NO: 2389969 - RNA, 22 nt, Human
caugaggacaugauggagcgca

SEQ ID NO: 2389970 - RNA, 21 nt, Human
caugaggacaugauggagcgc

SEQ ID NO: 2389971 - RNA, 20 nt, Human
caugaggacaugauggagcg

SEQ ID NO: 2389972 - RNA, 23 nt, Human
caugaggaacaaggcaaggcugu

SEQ ID NO: 2389973 - RNA, 14 nt, Human
caugagcuuuuaua

SEQ ID NO: 2389974 - RNA, 12 nt, Human
caugaggaacua

SEQ ID NO: 2389975 - RNA, 20 nt, Human
caugagggaucacagggccc

SEQ ID NO: 2389976 - RNA, 19 nt, Human
caugagggaucacagggcc

SEQ ID NO: 2389977 - RNA, 16 nt, Human
caugaggggcccgagc

SEQ ID NO: 2389978 - RNA, 18 nt, Human
caugagggaucacagggc

SEQ ID NO: 2389979 - RNA, 17 nt, Human
caugagggaucacaggg

SEQ ID NO: 2389980 - RNA, 16 nt, Human
caugagguacugagag

SEQ ID NO: 2389981 - RNA, 23 nt, Human
caugaggcaaugucaggaacaga

SEQ ID NO: 2389982 - RNA, 22 nt, Human
caugaggcaaugucaggaacag

SEQ ID NO: 2389983 - RNA, 15 nt, Human
caugaggaguugcug

SEQ ID NO: 2389984 - RNA, 16 nt, Human
caugaggaguugcugu

SEQ ID NO: 2389985 - RNA, 16 nt, Human
caugaggccacugcug

SEQ ID NO: 2389986 - RNA, 24 nt, Human
caugaggcaaugucaggaacagaa

SEQ ID NO: 2389987 - RNA, 21 nt, Human
caugaggccucaguggacuuu

SEQ ID NO: 2389988 - RNA, 22 nt, Human
caugaggccacugcugcuucuc

SEQ ID NO: 2389989 - RNA, 18 nt, Human
caugaagagauuuuucau

SEQ ID NO: 2389990 - RNA, 18 nt, Human
caugaagauguagaggag

SEQ ID NO: 2389991 - RNA, 18 nt, Human
caugaagauucuuuccca

SEQ ID NO: 2389992 - RNA, 17 nt, Human
caugaagauauuuuucc

SEQ ID NO: 2389993 - RNA, 19 nt, Human
caugaagauguagaggaga

SEQ ID NO: 2389994 - RNA, 18 nt, Human
caugaccugugaccagca

SEQ ID NO: 2389995 - RNA, 17 nt, Human
caugaccugugaccagc

SEQ ID NO: 2389996 - RNA, 21 nt, Human
caugaccuuacauuuccuggg

SEQ ID NO: 2389997 - RNA, 16 nt, Human
caugaccugugaccag

SEQ ID NO: 2389998 - RNA, 14 nt, Human
caugaccugugacc

SEQ ID NO: 2389999 - RNA, 19 nt, Human
caugaccuaguuuuccaug

SEQ ID NO: 2390000 - RNA, 23 nt, Human
caugacucguauaugucucaggu

SEQ ID NO: 2390001 - RNA, 20 nt, Human
caugacucguauaugucuca

SEQ ID NO: 2390002 - RNA, 17 nt, Human
caugacucggggguggg

SEQ ID NO: 2390003 - RNA, 22 nt, Human
caugacuugagaaacaaauaau

SEQ ID NO: 2390004 - RNA, 15 nt, Human
caugacuuuuccaug

SEQ ID NO: 2390005 - RNA, 14 nt, Human
caugagaagagggc

SEQ ID NO: 2390006 - RNA, 16 nt, Human
caugagaacaaacaga

SEQ ID NO: 2390007 - RNA, 21 nt, Human
caugacuuuuccauguaucua

SEQ ID NO: 2390008 - RNA, 19 nt, Human
caugagacacaucuccucc

SEQ ID NO: 2390009 - RNA, 14 nt, Human
caugagacacaucu

SEQ ID NO: 2390010 - RNA, 20 nt, Human
caugagaauaagagaaagaa

SEQ ID NO: 2390011 - RNA, 19 nt, Human
caugagaaucuauauuuaa

SEQ ID NO: 2390012 - RNA, 12 nt, Human
caugagaaucua

SEQ ID NO: 2390013 - RNA, 22 nt, Human
caugagaagagggccuguggga

SEQ ID NO: 2390014 - RNA, 22 nt, Human
caugagaaguugauauagaaca

SEQ ID NO: 2390015 - RNA, 15 nt, Human
caugagaagagggcc

SEQ ID NO: 2390016 - RNA, 16 nt, Human
caugagaagagggccu

SEQ ID NO: 2390017 - RNA, 17 nt, Human
caugagaagagggccug

SEQ ID NO: 2390018 - RNA, 18 nt, Human
caugagaagagggccugu

SEQ ID NO: 2390019 - RNA, 20 nt, Human
caugagaucuaggugaggau

SEQ ID NO: 2390020 - RNA, 22 nt, Human
caugagaugauacauccaaagc

SEQ ID NO: 2390021 - RNA, 16 nt, Human
caugagcaauucuccu

SEQ ID NO: 2390022 - RNA, 13 nt, Human
caugagcaucagg

SEQ ID NO: 2390023 - RNA, 23 nt, Human
caugagagaauuguaucauuuga

SEQ ID NO: 2390024 - RNA, 17 nt, Human
caugagaggcucugugc

SEQ ID NO: 2390025 - RNA, 18 nt, Human
caugagauaauaugcaga

SEQ ID NO: 2390026 - RNA, 17 nt, Human
caugagaccacuguuau

SEQ ID NO: 2390027 - RNA, 19 nt, Human
caugagaccacuguuauca

SEQ ID NO: 2390028 - RNA, 12 nt, Human
caugagccucag

SEQ ID NO: 2390029 - RNA, 16 nt, Human
caugagcaccccaagg

SEQ ID NO: 2390030 - RNA, 21 nt, Human
caugagcaccccaaggcugcg

SEQ ID NO: 2390031 - RNA, 15 nt, Human
caugagccucagcau

SEQ ID NO: 2390032 - RNA, 17 nt, Human
caugagccucagcaucc

SEQ ID NO: 2390033 - RNA, 18 nt, Human
caugagccucagcauccu

SEQ ID NO: 2390034 - RNA, 19 nt, Human
caugagccucagcauccug

SEQ ID NO: 2390035 - RNA, 20 nt, Human
caugagccucagcauccugg

SEQ ID NO: 2390036 - RNA, 21 nt, Human
caugagccucagcauccuggc

SEQ ID NO: 2390037 - RNA, 15 nt, Human
caugagcaucaggcc

SEQ ID NO: 2390038 - RNA, 16 nt, Human
caugagcaucaggcca

SEQ ID NO: 2390039 - RNA, 17 nt, Human
caugagcaucaggccag

SEQ ID NO: 2390040 - RNA, 18 nt, Human
caugagcaucaggccagg

SEQ ID NO: 2390041 - RNA, 20 nt, Human
caugagcaucaggccaggcc

SEQ ID NO: 2390042 - RNA, 21 nt, Human
caugagcaucaggccaggccc

SEQ ID NO: 2390043 - RNA, 22 nt, Human
caugagcaucaggccaggcccu

SEQ ID NO: 2390044 - RNA, 23 nt, Human
caugagcaucaggccaggcccuc

SEQ ID NO: 2390045 - RNA, 13 nt, Human
caugaaaaugcaa

SEQ ID NO: 2390046 - RNA, 15 nt, Human
caugaaaaugcaaca

SEQ ID NO: 2390047 - RNA, 22 nt, Human
caugaaaaugcaacaacaugua

SEQ ID NO: 2390048 - RNA, 13 nt, Human
caugaaacaaagc

SEQ ID NO: 2390049 - RNA, 15 nt, Human
caugaaacagaaaca

SEQ ID NO: 2390050 - RNA, 13 nt, Human
caugaaacagaaa

SEQ ID NO: 2390051 - RNA, 22 nt, Human
caugaaaccuuauuuuuuccca

SEQ ID NO: 2390052 - RNA, 19 nt, Human
caugaaacagaaacaaaaa

SEQ ID NO: 2390053 - RNA, 14 nt, Human
caugaaacuccacc

SEQ ID NO: 2390054 - RNA, 15 nt, Human
caugaaacuccaccu

SEQ ID NO: 2390055 - RNA, 22 nt, Human
caugaaauauagaucaguuaua

SEQ ID NO: 2390056 - RNA, 13 nt, Human
caugaaaacguuu

SEQ ID NO: 2390057 - RNA, 19 nt, Human
caugaaaaagcagcuacca

SEQ ID NO: 2390058 - RNA, 18 nt, Human
caugaaaaagcagcuacc

SEQ ID NO: 2390059 - RNA, 15 nt, Human
caugaaaaagcagcu

SEQ ID NO: 2390060 - RNA, 13 nt, Human
caugaaaaagcag

SEQ ID NO: 2390061 - RNA, 12 nt, Human
caugaaaaagca

SEQ ID NO: 2390062 - RNA, 18 nt, Human
caugaaaaaaggacaauu

SEQ ID NO: 2390063 - RNA, 19 nt, Human
caugaaaacguuuuauugu

SEQ ID NO: 2390064 - RNA, 17 nt, Human
caugaaaacguuuuauu

SEQ ID NO: 2390065 - RNA, 16 nt, Human
caugaaaacguuuuau

SEQ ID NO: 2390066 - RNA, 23 nt, Human
caugaaaaagcagcuaccaggug

SEQ ID NO: 2390067 - RNA, 22 nt, Human
caugaaaacguuuuauuguguu

SEQ ID NO: 2390068 - RNA, 21 nt, Human
caugaaaacguuuuauugugu

SEQ ID NO: 2390069 - RNA, 21 nt, Human
caugaaaacacauuuuucuua

SEQ ID NO: 2390070 - RNA, 19 nt, Human
caugaaaacacauuuuucu

SEQ ID NO: 2390071 - RNA, 17 nt, Human
caugaagacaggacagu

SEQ ID NO: 2390072 - RNA, 16 nt, Human
caugaagacaggacag

SEQ ID NO: 2390073 - RNA, 15 nt, Human
caugaagacaggaca

SEQ ID NO: 2390074 - RNA, 14 nt, Human
caugaagacaggac

SEQ ID NO: 2390075 - RNA, 17 nt, Human
caugaagaccacaucca

SEQ ID NO: 2390076 - RNA, 14 nt, Human
caugaagacaggau

SEQ ID NO: 2390077 - RNA, 13 nt, Human
caugaagaccaca

SEQ ID NO: 2390078 - RNA, 12 nt, Human
caugaagacaga

SEQ ID NO: 2390079 - RNA, 20 nt, Human
caugaaccucaagcugcauc

SEQ ID NO: 2390080 - RNA, 16 nt, Human
caugaacauguuccug

SEQ ID NO: 2390081 - RNA, 21 nt, Human
caugaacuucgcaucaaaaga

SEQ ID NO: 2390082 - RNA, 23 nt, Human
caugaacuucgcaucaaaagaca

SEQ ID NO: 2390083 - RNA, 24 nt, Human
caugaaauugucuagcagagcagg

SEQ ID NO: 2390084 - RNA, 14 nt, Human
caugaaauuacuua

SEQ ID NO: 2390085 - RNA, 16 nt, Human
caugaacacacugugu

SEQ ID NO: 2390086 - RNA, 17 nt, Human
caugaacacacuguguc

SEQ ID NO: 2390087 - RNA, 18 nt, Human
caugaacacacugugucc

SEQ ID NO: 2390088 - RNA, 20 nt, Human
caugaacacacuguguccug

SEQ ID NO: 2390089 - RNA, 22 nt, Human
caugaacagaaaacauucugau

SEQ ID NO: 2390090 - RNA, 23 nt, Human
caugaacagaaaacauucugauu

SEQ ID NO: 2390091 - RNA, 19 nt, Human
caugaaccucaagcugcau

SEQ ID NO: 2390092 - RNA, 13 nt, Human
caugaacauguac

SEQ ID NO: 2390093 - RNA, 15 nt, Human
caugaacauguacug

SEQ ID NO: 2390094 - RNA, 13 nt, Human
caugaaauaugca

SEQ ID NO: 2390095 - RNA, 14 nt, Human
caugaaauaugcau

SEQ ID NO: 2390096 - RNA, 15 nt, Human
caugaaauaugcauc

SEQ ID NO: 2390097 - RNA, 13 nt, Human
caucuuuuacauu

SEQ ID NO: 2390098 - RNA, 14 nt, Human
caucuuuucuugcc

SEQ ID NO: 2390099 - RNA, 16 nt, Human
caucuuuucuugccuc

SEQ ID NO: 2390100 - RNA, 21 nt, Human
caucuuuucuugccucugucc

SEQ ID NO: 2390101 - RNA, 14 nt, Human
caucuuuugugaga

SEQ ID NO: 2390102 - RNA, 21 nt, Human
caucuuuugugagauguaauu

SEQ ID NO: 2390103 - RNA, 16 nt, Human
caucuuuugugagaug

SEQ ID NO: 2390104 - RNA, 13 nt, Human
caugaaaacacau

SEQ ID NO: 2390105 - RNA, 17 nt, Human
caugaaaacacauuuuu

SEQ ID NO: 2390106 - RNA, 16 nt, Human
caugaaaacacauuuu

SEQ ID NO: 2390107 - RNA, 15 nt, Human
caugaaaacacauuu

SEQ ID NO: 2390108 - RNA, 14 nt, Human
caugaaaacacauu

SEQ ID NO: 2390109 - RNA, 21 nt, Human
caucuuuccugauggcaggau

SEQ ID NO: 2390110 - RNA, 21 nt, Human
caucuuucuucuauuuuauuc

SEQ ID NO: 2390111 - RNA, 16 nt, Human
caucuuucuucuauuu

SEQ ID NO: 2390112 - RNA, 22 nt, Human
caucuuugccuugggcugcucc

SEQ ID NO: 2390113 - RNA, 23 nt, Human
caucuuugccuugggcugcuccu

SEQ ID NO: 2390114 - RNA, 17 nt, Human
caucuuugccuugggcu

SEQ ID NO: 2390115 - RNA, 15 nt, Human
caucuuugccuuggg

SEQ ID NO: 2390116 - RNA, 17 nt, Human
caucuuugcagguugcu

SEQ ID NO: 2390117 - RNA, 14 nt, Human
caucuuucacacuu

SEQ ID NO: 2390118 - RNA, 17 nt, Human
caucuuucaucaaucau

SEQ ID NO: 2390119 - RNA, 13 nt, Human
caucuuucacauu

SEQ ID NO: 2390120 - RNA, 21 nt, Human
caucuuucaucaaucauugua

SEQ ID NO: 2390121 - RNA, 22 nt, Human
caucuuucaucaaucauuguac

SEQ ID NO: 2390122 - RNA, 12 nt, Human
caucuuucacau

SEQ ID NO: 2390123 - RNA, 17 nt, Human
caucuuuaucuguucuu

SEQ ID NO: 2390124 - RNA, 22 nt, Human
caucuuuacaaaacuacaugag

SEQ ID NO: 2390125 - RNA, 22 nt, Human
caucuucuuugcagccugggug

SEQ ID NO: 2390126 - RNA, 16 nt, Human
caucuuuaucuguucu

SEQ ID NO: 2390127 - RNA, 19 nt, Human
caucuuuccugauggcagg

SEQ ID NO: 2390128 - RNA, 13 nt, Human
caucuuuccuguc

SEQ ID NO: 2390129 - RNA, 19 nt, Human
cagugcuugauugcgugga

SEQ ID NO: 2390130 - RNA, 20 nt, Human
cagugcuugaguuuggggaa

SEQ ID NO: 2390131 - RNA, 14 nt, Human
cagugcuugccaca

SEQ ID NO: 2390132 - RNA, 17 nt, Human
cagugcuucucuacaga

SEQ ID NO: 2390133 - RNA, 12 nt, Human
cagugcuucuca

SEQ ID NO: 2390134 - RNA, 15 nt, Human
cagugcuugccacag

SEQ ID NO: 2390135 - RNA, 17 nt, Human
cagugcuugccacagag

SEQ ID NO: 2390136 - RNA, 18 nt, Human
cagugcuugccacagagc

SEQ ID NO: 2390137 - RNA, 20 nt, Human
cagugcuucagccugaggcu

SEQ ID NO: 2390138 - RNA, 19 nt, Human
cagugcuucagccugaggc

SEQ ID NO: 2390139 - RNA, 18 nt, Human
cagugcuucagccugagg

SEQ ID NO: 2390140 - RNA, 17 nt, Human
cagugcuucagccugag

SEQ ID NO: 2390141 - RNA, 16 nt, Human
cagugcuucagccuga

SEQ ID NO: 2390142 - RNA, 15 nt, Human
cagugcuucagccug

SEQ ID NO: 2390143 - RNA, 14 nt, Human
cagugcuucagccu

SEQ ID NO: 2390144 - RNA, 19 nt, Human
cagugcuguggccugggca

SEQ ID NO: 2390145 - RNA, 20 nt, Human
cagugcuguggccugggcaa

SEQ ID NO: 2390146 - RNA, 18 nt, Human
cagugcuguggccugggc

SEQ ID NO: 2390147 - RNA, 15 nt, Human
cagugcuguggccug

SEQ ID NO: 2390148 - RNA, 13 nt, Human
cagugcuguggcc

SEQ ID NO: 2390149 - RNA, 12 nt, Human
cagugcuguggc

SEQ ID NO: 2390150 - RNA, 22 nt, Human
cagugcugucugaucugugcuu

SEQ ID NO: 2390151 - RNA, 15 nt, Human
cagugcuguacuuga

SEQ ID NO: 2390152 - RNA, 19 nt, Human
cagugcugucugaucugug

SEQ ID NO: 2390153 - RNA, 21 nt, Human
cauaguacucuuuguagcaaa

SEQ ID NO: 2390154 - RNA, 20 nt, Human
cauaguaccauuuauacaaa

SEQ ID NO: 2390155 - RNA, 19 nt, Human
cauaguaccauuuauacaa

SEQ ID NO: 2390156 - RNA, 16 nt, Human
cauaguaccauuuaua

SEQ ID NO: 2390157 - RNA, 22 nt, Human
cauaguaccaaucauuuuaauu

SEQ ID NO: 2390158 - RNA, 15 nt, Human
cauaguaugguggcu

SEQ ID NO: 2390159 - RNA, 22 nt, Human
cauaguaacuucuuauggaauu

SEQ ID NO: 2390160 - RNA, 21 nt, Human
cauaguaacuucuuauggaau

SEQ ID NO: 2390161 - RNA, 24 nt, Human
cauaguaacuucuuauggaauuga

SEQ ID NO: 2390162 - RNA, 23 nt, Human
cauaguaacuucuuauggaauug

SEQ ID NO: 2390163 - RNA, 16 nt, Human
cauaguaccaaucauu

SEQ ID NO: 2390164 - RNA, 18 nt, Human
cauaguaccaaucauuuu

SEQ ID NO: 2390165 - RNA, 16 nt, Human
cauaguaugguggcug

SEQ ID NO: 2390166 - RNA, 17 nt, Human
cauaguaugguggcugg

SEQ ID NO: 2390167 - RNA, 23 nt, Human
cauagucauguaagcugaaaaua

SEQ ID NO: 2390168 - RNA, 21 nt, Human
cauaguauuccauugugugag

SEQ ID NO: 2390169 - RNA, 22 nt, Human
cauaguaccauuuauacaaauu

SEQ ID NO: 2390170 - RNA, 13 nt, Human
cauagucacaugg

SEQ ID NO: 2390171 - RNA, 18 nt, Human
cauaguauuccauugugu

SEQ ID NO: 2390172 - RNA, 20 nt, Human
cauaguaguaugaugauaca

SEQ ID NO: 2390173 - RNA, 11 nt, Human
cauauccugcc

SEQ ID NO: 2390174 - RNA, 12 nt, Human
cauauccugccu

SEQ ID NO: 2390175 - RNA, 13 nt, Human
cauauccugccuc

SEQ ID NO: 2390176 - RNA, 14 nt, Human
cauauccugccuca

SEQ ID NO: 2390177 - RNA, 15 nt, Human
cauauccugccucag

SEQ ID NO: 2390178 - RNA, 23 nt, Human
cauauauauguuuuaagaggcag

SEQ ID NO: 2390179 - RNA, 20 nt, Human
cauauauaacaaugcuguau

SEQ ID NO: 2390180 - RNA, 15 nt, Human
cauauauaacaaugc

SEQ ID NO: 2390181 - RNA, 21 nt, Human
cauauauggggggccaacacc

SEQ ID NO: 2390182 - RNA, 22 nt, Human
cauauauggggggccaacacca

SEQ ID NO: 2390183 - RNA, 17 nt, Human
cauauaugaggacuugu

SEQ ID NO: 2390184 - RNA, 23 nt, Human
cauauaagauucauauuuacuuc

SEQ ID NO: 2390185 - RNA, 16 nt, Human
cauauaagugauugcu

SEQ ID NO: 2390186 - RNA, 14 nt, Human
cauauaaguuugaa

SEQ ID NO: 2390187 - RNA, 13 nt, Human
cauauauaacaau

SEQ ID NO: 2390188 - RNA, 18 nt, Human
cauagugaugguuccccu

SEQ ID NO: 2390189 - RNA, 19 nt, Human
cauagugaugguuccccug

SEQ ID NO: 2390190 - RNA, 18 nt, Human
cauagugaccggcugcuu

SEQ ID NO: 2390191 - RNA, 22 nt, Human
cauagugaccggcugcuuuucc

SEQ ID NO: 2390192 - RNA, 23 nt, Human
cauauaacuuauauuguaagaaa

SEQ ID NO: 2390193 - RNA, 22 nt, Human
cauauaacuuauauuguaagaa

SEQ ID NO: 2390194 - RNA, 20 nt, Human
cauauaacuuauauuguaag

SEQ ID NO: 2390195 - RNA, 11 nt, Human
cauauuguaca

SEQ ID NO: 2390196 - RNA, 12 nt, Human
cauauuguacac

SEQ ID NO: 2390197 - RNA, 13 nt, Human
cauauuguacacu

SEQ ID NO: 2390198 - RNA, 14 nt, Human
cauauuguacacuu

SEQ ID NO: 2390199 - RNA, 15 nt, Human
cauauuguacacuuu

SEQ ID NO: 2390200 - RNA, 20 nt, Human
cauauugugauucugccuuu

SEQ ID NO: 2390201 - RNA, 13 nt, Human
cauauugugccaa

SEQ ID NO: 2390202 - RNA, 20 nt, Human
cauauugugccaauauguau

SEQ ID NO: 2390203 - RNA, 18 nt, Human
cauauugugauucugccu

SEQ ID NO: 2390204 - RNA, 20 nt, Human
cauauuguacacuuuuuugg

SEQ ID NO: 2390205 - RNA, 23 nt, Human
cauauuguacacuuuuuugggga

SEQ ID NO: 2390206 - RNA, 23 nt, Human
cauauugcugagagaaauaugga

SEQ ID NO: 2390207 - RNA, 14 nt, Human
cauauugguauuca

SEQ ID NO: 2390208 - RNA, 16 nt, Human
cauauugguauucacu

SEQ ID NO: 2390209 - RNA, 21 nt, Human
cauauugcugagagaaauaug

SEQ ID NO: 2390210 - RNA, 17 nt, Human
cauauugcugagagaaa

SEQ ID NO: 2390211 - RNA, 19 nt, Human
cauauugcuuuuucuaaug

SEQ ID NO: 2390212 - RNA, 16 nt, Human
cauauugcugagagaa

SEQ ID NO: 2390213 - RNA, 21 nt, Human
cauauugauuuccguuaaaau

SEQ ID NO: 2390214 - RNA, 14 nt, Human
cauauugcacaugu

SEQ ID NO: 2390215 - RNA, 15 nt, Human
cauauugcacauguc

SEQ ID NO: 2390216 - RNA, 16 nt, Human
cauauugcacaugucu

SEQ ID NO: 2390217 - RNA, 17 nt, Human
cauauugcacaugucuu

SEQ ID NO: 2390218 - RNA, 18 nt, Human
cauauugcacaugucuua

SEQ ID NO: 2390219 - RNA, 19 nt, Human
cauauugcacaugucuuaa

SEQ ID NO: 2390220 - RNA, 20 nt, Human
cauauugcacaugucuuaau

SEQ ID NO: 2390221 - RNA, 21 nt, Human
cauauugcacaugucuuaaug

SEQ ID NO: 2390222 - RNA, 23 nt, Human
cauauugcacaugucuuaaugaa

SEQ ID NO: 2390223 - RNA, 22 nt, Human
cauauugcacaugucuuaauga

SEQ ID NO: 2390224 - RNA, 11 nt, Human
cauaucugccu

SEQ ID NO: 2390225 - RNA, 12 nt, Human
cauaucugccuu

SEQ ID NO: 2390226 - RNA, 13 nt, Human
cauaucugccuuu

SEQ ID NO: 2390227 - RNA, 15 nt, Human
cauaucugccuuuau

SEQ ID NO: 2390228 - RNA, 18 nt, Human
cauaucugccuuuauugu

SEQ ID NO: 2390229 - RNA, 18 nt, Human
cauaugaaaauacaacuu

SEQ ID NO: 2390230 - RNA, 17 nt, Human
cauaucuuuauuaauca

SEQ ID NO: 2390231 - RNA, 11 nt, Human
cauaugaaaaa

SEQ ID NO: 2390232 - RNA, 22 nt, Human
cauaugaaaaaaaugcauuuua

SEQ ID NO: 2390233 - RNA, 16 nt, Human
cauaucuuuauuaauc

SEQ ID NO: 2390234 - RNA, 15 nt, Human
cauaucuuuauuaau

SEQ ID NO: 2390235 - RNA, 14 nt, Human
cauaucuuuauuaa

SEQ ID NO: 2390236 - RNA, 20 nt, Human
cauaucugccuuuauugugu

SEQ ID NO: 2390237 - RNA, 22 nt, Human
cauauucuguuggccaguguga

SEQ ID NO: 2390238 - RNA, 17 nt, Human
cauaugaaauuuaauau

SEQ ID NO: 2390239 - RNA, 19 nt, Human
cauaugacauucaugccug

SEQ ID NO: 2390240 - RNA, 21 nt, Human
cauaugacauucaugccuggc

SEQ ID NO: 2390241 - RNA, 17 nt, Human
cauauugauuuccguua

SEQ ID NO: 2390242 - RNA, 22 nt, Human
cauaugacauucaugccuggcu

SEQ ID NO: 2390243 - RNA, 16 nt, Human
cauaugaccucaugca

SEQ ID NO: 2390244 - RNA, 18 nt, Human
cauaugaccucaugcauc

SEQ ID NO: 2390245 - RNA, 16 nt, Human
cauauugaauguuucc

SEQ ID NO: 2390246 - RNA, 21 nt, Human
cauauugagcacuugcuguau

SEQ ID NO: 2390247 - RNA, 14 nt, Human
cauauuguuauuau

SEQ ID NO: 2390248 - RNA, 16 nt, Human
cauauuguugaaaggu

SEQ ID NO: 2390249 - RNA, 13 nt, Human
cauauuguugaaa

SEQ ID NO: 2390250 - RNA, 17 nt, Human
cauauuugcauauguau

SEQ ID NO: 2390251 - RNA, 15 nt, Human
cauauuugcauaugu

SEQ ID NO: 2390252 - RNA, 19 nt, Human
cauauuugcauauguauga

SEQ ID NO: 2390253 - RNA, 20 nt, Human
cauauuuguuaaauauuuac

SEQ ID NO: 2390254 - RNA, 19 nt, Human
cauauuuguuaaauauuua

SEQ ID NO: 2390255 - RNA, 14 nt, Human
cauauuuguuaaau

SEQ ID NO: 2390256 - RNA, 14 nt, Human
cauauuuguggaau

SEQ ID NO: 2390257 - RNA, 18 nt, Human
cauauuuguauaguugcu

SEQ ID NO: 2390258 - RNA, 22 nt, Human
cauauuuguauaguugcuugcc

SEQ ID NO: 2390259 - RNA, 13 nt, Human
cauauuguuacug

SEQ ID NO: 2390260 - RNA, 14 nt, Human
cauauuguguguaa

SEQ ID NO: 2390261 - RNA, 17 nt, Human
cauauuguggcacaagc

SEQ ID NO: 2390262 - RNA, 18 nt, Human
cauauuguggcacaagca

SEQ ID NO: 2390263 - RNA, 21 nt, Human
cauauugugccaauauguauu

SEQ ID NO: 2390264 - RNA, 22 nt, Human
cauauugugccaauauguauug

SEQ ID NO: 2390265 - RNA, 19 nt, Human
cauauuguuacugguacca

SEQ ID NO: 2390266 - RNA, 14 nt, Human
cauauuuaaagaca

SEQ ID NO: 2390267 - RNA, 14 nt, Human
caucaacaucuugg

SEQ ID NO: 2390268 - RNA, 12 nt, Human
caucaacugaau

SEQ ID NO: 2390269 - RNA, 10 nt, Human
caucaacuga

SEQ ID NO: 2390270 - RNA, 21 nt, Human
cauauuuguuaaauauuuaca

SEQ ID NO: 2390271 - RNA, 15 nt, Human
caucaacaaaaauug

SEQ ID NO: 2390272 - RNA, 13 nt, Human
caucaacaaaaau

SEQ ID NO: 2390273 - RNA, 15 nt, Human
caucaaauggaagac

SEQ ID NO: 2390274 - RNA, 16 nt, Human
caucaaauggaagaca

SEQ ID NO: 2390275 - RNA, 17 nt, Human
caucaaauggaagacac

SEQ ID NO: 2390276 - RNA, 19 nt, Human
caucaaauggaagacacau

SEQ ID NO: 2390277 - RNA, 14 nt, Human
caucauucucuguc

SEQ ID NO: 2390278 - RNA, 12 nt, Human
caucauucucug

SEQ ID NO: 2390279 - RNA, 22 nt, Human
caucauuccuugagaaaaacaa

SEQ ID NO: 2390280 - RNA, 17 nt, Human
caucauuccuugagaaa

SEQ ID NO: 2390281 - RNA, 10 nt, Human
caucauuaga

SEQ ID NO: 2390282 - RNA, 13 nt, Human
caucauuagaaca

SEQ ID NO: 2390283 - RNA, 17 nt, Human
caucauuauaaacguga

SEQ ID NO: 2390284 - RNA, 14 nt, Human
caucauuagaacaa

SEQ ID NO: 2390285 - RNA, 21 nt, Human
caucauuauuugcagagacag

SEQ ID NO: 2390286 - RNA, 18 nt, Human
caucauucaugcuacugc

SEQ ID NO: 2390287 - RNA, 17 nt, Human
cauccacucuacccucc

SEQ ID NO: 2390288 - RNA, 17 nt, Human
caucauucucugucuca

SEQ ID NO: 2390289 - RNA, 16 nt, Human
caucauucucugucuc

SEQ ID NO: 2390290 - RNA, 15 nt, Human
caucauucucugucu

SEQ ID NO: 2390291 - RNA, 14 nt, Human
cauccacugugcca

SEQ ID NO: 2390292 - RNA, 17 nt, Human
cauccacugugccaugu

SEQ ID NO: 2390293 - RNA, 23 nt, Human
cauccacugugccaugugccagg

SEQ ID NO: 2390294 - RNA, 17 nt, Human
cauccagguucagcuug

SEQ ID NO: 2390295 - RNA, 19 nt, Human
cauccacucuacccuccca

SEQ ID NO: 2390296 - RNA, 18 nt, Human
cauccacucuacccuccc

SEQ ID NO: 2390297 - RNA, 22 nt, Human
cauccacucuacccucccaccc

SEQ ID NO: 2390298 - RNA, 23 nt, Human
cauccagucucccaacuuguauu

SEQ ID NO: 2390299 - RNA, 13 nt, Human
cauccaguucaug

SEQ ID NO: 2390300 - RNA, 22 nt, Human
cauccagugucucacagcccug

SEQ ID NO: 2390301 - RNA, 14 nt, Human
cauccauaaagaag

SEQ ID NO: 2390302 - RNA, 17 nt, Human
cauccauaaagaagcaa

SEQ ID NO: 2390303 - RNA, 12 nt, Human
cauccauccagg

SEQ ID NO: 2390304 - RNA, 13 nt, Human
cauccaucaucau

SEQ ID NO: 2390305 - RNA, 16 nt, Human
cauccauaaagaagca

SEQ ID NO: 2390306 - RNA, 16 nt, Human
cauccauaguaguaug

SEQ ID NO: 2390307 - RNA, 14 nt, Human
cauccaucaucaug

SEQ ID NO: 2390308 - RNA, 18 nt, Human
cauccauaguaguaugau

SEQ ID NO: 2390309 - RNA, 21 nt, Human
caucccugccagcucuucugc

SEQ ID NO: 2390310 - RNA, 13 nt, Human
caucccugccugg

SEQ ID NO: 2390311 - RNA, 14 nt, Human
caucccugccuggu

SEQ ID NO: 2390312 - RNA, 15 nt, Human
caucccugccugguc

SEQ ID NO: 2390313 - RNA, 15 nt, Human
caucccugccagcuc

SEQ ID NO: 2390314 - RNA, 18 nt, Human
caucccugaggagccagg

SEQ ID NO: 2390315 - RNA, 19 nt, Human
caucccugauuccuguugu

SEQ ID NO: 2390316 - RNA, 15 nt, Human
caucccuggaaggug

SEQ ID NO: 2390317 - RNA, 16 nt, Human
caucccugccugguca

SEQ ID NO: 2390318 - RNA, 14 nt, Human
caucccuggaaggu

SEQ ID NO: 2390319 - RNA, 15 nt, Human
caucccucuggggcu

SEQ ID NO: 2390320 - RNA, 17 nt, Human
caucccugaggagccag

SEQ ID NO: 2390321 - RNA, 13 nt, Human
caucccuccuggg

SEQ ID NO: 2390322 - RNA, 22 nt, Human
cauccgaggcagggucaggaga

SEQ ID NO: 2390323 - RNA, 16 nt, Human
cauccgaggcaggguc

SEQ ID NO: 2390324 - RNA, 23 nt, Human
cauccgaggcagggucaggagag

SEQ ID NO: 2390325 - RNA, 15 nt, Human
cauccgaggcagggu

SEQ ID NO: 2390326 - RNA, 14 nt, Human
cauccgaggcaggg

SEQ ID NO: 2390327 - RNA, 13 nt, Human
cauccgaggcagg

SEQ ID NO: 2390328 - RNA, 16 nt, Human
cauccggcccccagag

SEQ ID NO: 2390329 - RNA, 19 nt, Human
caucccuugaccaggccug

SEQ ID NO: 2390330 - RNA, 18 nt, Human
caucccuuaccugggaaa

SEQ ID NO: 2390331 - RNA, 16 nt, Human
caucccuuugcccaga

SEQ ID NO: 2390332 - RNA, 13 nt, Human
caucccuuuuuga

SEQ ID NO: 2390333 - RNA, 16 nt, Human
caucccuuuuugaagu

SEQ ID NO: 2390334 - RNA, 17 nt, Human
caucccuuuuugaagug

SEQ ID NO: 2390335 - RNA, 18 nt, Human
caucccuuuuugaagugu

SEQ ID NO: 2390336 - RNA, 20 nt, Human
caucccuuuuugaaguguag

SEQ ID NO: 2390337 - RNA, 23 nt, Human
caucccuugaccaggccugggcc

SEQ ID NO: 2390338 - RNA, 20 nt, Human
caucccuugaccaggccugg

SEQ ID NO: 2390339 - RNA, 19 nt, Human
caucccuuugaaacaagau

SEQ ID NO: 2390340 - RNA, 21 nt, Human
caucaucuccugccuuccucc

SEQ ID NO: 2390341 - RNA, 20 nt, Human
caucaucuccugccuuccuc

SEQ ID NO: 2390342 - RNA, 13 nt, Human
caucaucuccugc

SEQ ID NO: 2390343 - RNA, 16 nt, Human
caucauccuaagcuau

SEQ ID NO: 2390344 - RNA, 13 nt, Human
caucaucccagcu

SEQ ID NO: 2390345 - RNA, 15 nt, Human
caucaucccagcugc

SEQ ID NO: 2390346 - RNA, 20 nt, Human
caucauaaaauaaaguauau

SEQ ID NO: 2390347 - RNA, 18 nt, Human
caucauaaaauaaaguau

SEQ ID NO: 2390348 - RNA, 14 nt, Human
caucauaaaauaaa

SEQ ID NO: 2390349 - RNA, 13 nt, Human
caucauaaaauaa

SEQ ID NO: 2390350 - RNA, 23 nt, Human
caucauaaaauaaaguauauaua

SEQ ID NO: 2390351 - RNA, 22 nt, Human
caucauaaaauaaaguauauau

SEQ ID NO: 2390352 - RNA, 15 nt, Human
caucauacacuuccu

SEQ ID NO: 2390353 - RNA, 17 nt, Human
caucauaggaagggacc

SEQ ID NO: 2390354 - RNA, 22 nt, Human
caucauaggaagggaccaaggc

SEQ ID NO: 2390355 - RNA, 16 nt, Human
caucauauuauacaga

SEQ ID NO: 2390356 - RNA, 14 nt, Human
caucauauuauaca

SEQ ID NO: 2390357 - RNA, 23 nt, Human
caucauaggaagggaccaaggca

SEQ ID NO: 2390358 - RNA, 13 nt, Human
caucaucaaggca

SEQ ID NO: 2390359 - RNA, 19 nt, Human
caucaucaaggcacugccu

SEQ ID NO: 2390360 - RNA, 20 nt, Human
caucaucaaggcacugccug

SEQ ID NO: 2390361 - RNA, 21 nt, Human
caucaucaaggcacugccuga

SEQ ID NO: 2390362 - RNA, 17 nt, Human
caucaucaguggagcca

SEQ ID NO: 2390363 - RNA, 16 nt, Human
caucaugcaucuuacu

SEQ ID NO: 2390364 - RNA, 13 nt, Human
caucaugucuggc

SEQ ID NO: 2390365 - RNA, 15 nt, Human
caucauggcuaucug

SEQ ID NO: 2390366 - RNA, 21 nt, Human
caucaugcuuacaaaaaagaa

SEQ ID NO: 2390367 - RNA, 21 nt, Human
caucauggauucauuacagcu

SEQ ID NO: 2390368 - RNA, 21 nt, Human
caucauguccccaaaccugca

SEQ ID NO: 2390369 - RNA, 22 nt, Human
caucauguccccaaaccugcaa

SEQ ID NO: 2390370 - RNA, 13 nt, Human
caucauguuuaca

SEQ ID NO: 2390371 - RNA, 21 nt, Human
caucauguuuacagaggacag

SEQ ID NO: 2390372 - RNA, 19 nt, Human
caucauguuuacagaggac

SEQ ID NO: 2390373 - RNA, 14 nt, Human
caucaugucuggcu

SEQ ID NO: 2390374 - RNA, 15 nt, Human
caucaugucuggcua

SEQ ID NO: 2390375 - RNA, 18 nt, Human
caucaccucaggccaggu

SEQ ID NO: 2390376 - RNA, 15 nt, Human
caucaccucaggcca

SEQ ID NO: 2390377 - RNA, 13 nt, Human
caucaccuccacc

SEQ ID NO: 2390378 - RNA, 14 nt, Human
caucaccuccacca

SEQ ID NO: 2390379 - RNA, 13 nt, Human
caucaccucaggc

SEQ ID NO: 2390380 - RNA, 12 nt, Human
caucaccucagg

SEQ ID NO: 2390381 - RNA, 15 nt, Human
caucacgccugugca

SEQ ID NO: 2390382 - RNA, 14 nt, Human
caucacgccugugc

SEQ ID NO: 2390383 - RNA, 23 nt, Human
caucaccuuaggcagggaagugu

SEQ ID NO: 2390384 - RNA, 22 nt, Human
caucaccuuaggcagggaagug

SEQ ID NO: 2390385 - RNA, 20 nt, Human
caucaccuuaggcagggaag

SEQ ID NO: 2390386 - RNA, 19 nt, Human
caucaccuuaggcagggaa

SEQ ID NO: 2390387 - RNA, 18 nt, Human
caucaccuuaggcaggga

SEQ ID NO: 2390388 - RNA, 17 nt, Human
caucaccuuaggcaggg

SEQ ID NO: 2390389 - RNA, 16 nt, Human
caucaccuuaggcagg

SEQ ID NO: 2390390 - RNA, 20 nt, Human
caucaccaacgucugugcca

SEQ ID NO: 2390391 - RNA, 19 nt, Human
caucaagaagguagcuuga

SEQ ID NO: 2390392 - RNA, 14 nt, Human
caucaacugaauga

SEQ ID NO: 2390393 - RNA, 22 nt, Human
caucaagaauggggaucacaga

SEQ ID NO: 2390394 - RNA, 13 nt, Human
caucaagacugga

SEQ ID NO: 2390395 - RNA, 12 nt, Human
caucacccgcua

SEQ ID NO: 2390396 - RNA, 13 nt, Human
caucaccacaguu

SEQ ID NO: 2390397 - RNA, 22 nt, Human
caucaccgacgcgucuccuguu

SEQ ID NO: 2390398 - RNA, 20 nt, Human
caucacccuuaccaugugcc

SEQ ID NO: 2390399 - RNA, 19 nt, Human
caucaccgacgcgucuccu

SEQ ID NO: 2390400 - RNA, 12 nt, Human
caucauaaaaua

SEQ ID NO: 2390401 - RNA, 20 nt, Human
caucaguuagagcugacaca

SEQ ID NO: 2390402 - RNA, 24 nt, Human
caucaguguacccccgcccaggcu

SEQ ID NO: 2390403 - RNA, 15 nt, Human
caucaguuagagcug

SEQ ID NO: 2390404 - RNA, 16 nt, Human
caucaguuagagcuga

SEQ ID NO: 2390405 - RNA, 18 nt, Human
caucaguuagagcugaca

SEQ ID NO: 2390406 - RNA, 22 nt, Human
caucaguuacucugaagggcau

SEQ ID NO: 2390407 - RNA, 22 nt, Human
caucaguggcauggcuccaguc

SEQ ID NO: 2390408 - RNA, 21 nt, Human
caucaguguacccccgcccag

SEQ ID NO: 2390409 - RNA, 22 nt, Human
caucaguguacccccgcccagg

SEQ ID NO: 2390410 - RNA, 23 nt, Human
caucaguguacccccgcccaggc

SEQ ID NO: 2390411 - RNA, 18 nt, Human
caucaguggcauggcucc

SEQ ID NO: 2390412 - RNA, 16 nt, Human
caucaguggcauggcu

SEQ ID NO: 2390413 - RNA, 14 nt, Human
caucaguggagcca

SEQ ID NO: 2390414 - RNA, 24 nt, Human
caucagugcucccucacaugucag

SEQ ID NO: 2390415 - RNA, 16 nt, Human
caucagugcucccuca

SEQ ID NO: 2390416 - RNA, 15 nt, Human
caucagugcucccuc

SEQ ID NO: 2390417 - RNA, 15 nt, Human
caucagucccuaugu

SEQ ID NO: 2390418 - RNA, 17 nt, Human
caucagucccuauguau

SEQ ID NO: 2390419 - RNA, 22 nt, Human
caucaguauugaagcauuuuau

SEQ ID NO: 2390420 - RNA, 20 nt, Human
caucaguauugaagcauuuu

SEQ ID NO: 2390421 - RNA, 16 nt, Human
caucagguuccauccc

SEQ ID NO: 2390422 - RNA, 17 nt, Human
caucagguuccaucccg

SEQ ID NO: 2390423 - RNA, 16 nt, Human
caucaguauugaagca

SEQ ID NO: 2390424 - RNA, 18 nt, Human
caucagggacaggaugac

SEQ ID NO: 2390425 - RNA, 14 nt, Human
caucagggacagga

SEQ ID NO: 2390426 - RNA, 12 nt, Human
caucagggacag

SEQ ID NO: 2390427 - RNA, 15 nt, Human
caucacuccccucca

SEQ ID NO: 2390428 - RNA, 16 nt, Human
caucacucugcugcuu

SEQ ID NO: 2390429 - RNA, 13 nt, Human
caucacuccccuc

SEQ ID NO: 2390430 - RNA, 14 nt, Human
caucacuccccucc

SEQ ID NO: 2390431 - RNA, 19 nt, Human
cauucagugauuacuguca

SEQ ID NO: 2390432 - RNA, 21 nt, Human
cauucagugauuacugucaag

SEQ ID NO: 2390433 - RNA, 20 nt, Human
cauucagugauuacugucaa

SEQ ID NO: 2390434 - RNA, 15 nt, Human
cauucauaacuuuca

SEQ ID NO: 2390435 - RNA, 13 nt, Human
cauucaucucauu

SEQ ID NO: 2390436 - RNA, 17 nt, Human
cauucaggaagaugaaa

SEQ ID NO: 2390437 - RNA, 23 nt, Human
cauucaggaaaacugacagagga

SEQ ID NO: 2390438 - RNA, 20 nt, Human
cauucaggaaaacugacaga

SEQ ID NO: 2390439 - RNA, 13 nt, Human
cauucaggaaaac

SEQ ID NO: 2390440 - RNA, 15 nt, Human
cauucagcaagacaa

SEQ ID NO: 2390441 - RNA, 15 nt, Human
cauucagagagcagc

SEQ ID NO: 2390442 - RNA, 15 nt, Human
cauucacuugcauuu

SEQ ID NO: 2390443 - RNA, 15 nt, Human
cauucacuucauaau

SEQ ID NO: 2390444 - RNA, 14 nt, Human
cauucacuucauaa

SEQ ID NO: 2390445 - RNA, 12 nt, Human
cauucagagagc

SEQ ID NO: 2390446 - RNA, 18 nt, Human
cauucacuugcauuucuu

SEQ ID NO: 2390447 - RNA, 13 nt, Human
cauucagaaaaaa

SEQ ID NO: 2390448 - RNA, 20 nt, Human
cauucacccagacagcuccc

SEQ ID NO: 2390449 - RNA, 13 nt, Human
cauucacucuucc

SEQ ID NO: 2390450 - RNA, 19 nt, Human
cauucaccugccccaacuc

SEQ ID NO: 2390451 - RNA, 16 nt, Human
cauucaccugccccaa

SEQ ID NO: 2390452 - RNA, 15 nt, Human
cauucaccugcccca

SEQ ID NO: 2390453 - RNA, 20 nt, Human
cauucacucuuccagaaucc

SEQ ID NO: 2390454 - RNA, 11 nt, Human
cauucacuuca

SEQ ID NO: 2390455 - RNA, 14 nt, Human
cauucacucuucca

SEQ ID NO: 2390456 - RNA, 16 nt, Human
cauucacucuuccaga

SEQ ID NO: 2390457 - RNA, 23 nt, Human
cauuccaacagcucaagucuucc

SEQ ID NO: 2390458 - RNA, 16 nt, Human
cauuccaacagugagu

SEQ ID NO: 2390459 - RNA, 14 nt, Human
cauuccaacaaagg

SEQ ID NO: 2390460 - RNA, 18 nt, Human
cauuccaacaaaggguuu

SEQ ID NO: 2390461 - RNA, 13 nt, Human
cauuccaagacag

SEQ ID NO: 2390462 - RNA, 14 nt, Human
cauuccaagacagu

SEQ ID NO: 2390463 - RNA, 22 nt, Human
cauuccaacuaucucauuucca

SEQ ID NO: 2390464 - RNA, 22 nt, Human
cauuccaccuucccaugcccug

SEQ ID NO: 2390465 - RNA, 13 nt, Human
cauuccagaggaa

SEQ ID NO: 2390466 - RNA, 17 nt, Human
cauuccaccuucccaug

SEQ ID NO: 2390467 - RNA, 15 nt, Human
cauuccaagacagua

SEQ ID NO: 2390468 - RNA, 23 nt, Human
cauuccaagacaguauacagucc

SEQ ID NO: 2390469 - RNA, 15 nt, Human
cauucauucuuagcu

SEQ ID NO: 2390470 - RNA, 12 nt, Human
cauuccaacaaa

SEQ ID NO: 2390471 - RNA, 19 nt, Human
cauucauuuucuggguguu

SEQ ID NO: 2390472 - RNA, 18 nt, Human
cauucaucuuguguuuua

SEQ ID NO: 2390473 - RNA, 16 nt, Human
cauucaugccuggcuu

SEQ ID NO: 2390474 - RNA, 15 nt, Human
cauucauuccauucu

SEQ ID NO: 2390475 - RNA, 14 nt, Human
cauucaugccuggc

SEQ ID NO: 2390476 - RNA, 20 nt, Human
cauucauuuagcuaaacgga

SEQ ID NO: 2390477 - RNA, 17 nt, Human
cauucauuccauucugg

SEQ ID NO: 2390478 - RNA, 16 nt, Human
cauucauuccauucug

SEQ ID NO: 2390479 - RNA, 22 nt, Human
cauuccgacaaccgaugcucca

SEQ ID NO: 2390480 - RNA, 21 nt, Human
cauucccugagucaccaggaa

SEQ ID NO: 2390481 - RNA, 20 nt, Human
cauucccugagucaccagga

SEQ ID NO: 2390482 - RNA, 18 nt, Human
cauucccugagucaccag

SEQ ID NO: 2390483 - RNA, 23 nt, Human
cauuccuaacacagcauguguau

SEQ ID NO: 2390484 - RNA, 13 nt, Human
cauuccucaccuu

SEQ ID NO: 2390485 - RNA, 13 nt, Human
cauuccuauuucu

SEQ ID NO: 2390486 - RNA, 21 nt, Human
cauuccuaacacagcaugugu

SEQ ID NO: 2390487 - RNA, 20 nt, Human
cauuccuaacacagcaugug

SEQ ID NO: 2390488 - RNA, 18 nt, Human
cauuccuaaacuaucuuu

SEQ ID NO: 2390489 - RNA, 17 nt, Human
cauucccugagucacca

SEQ ID NO: 2390490 - RNA, 11 nt, Human
cauucccugag

SEQ ID NO: 2390491 - RNA, 17 nt, Human
cauuccccgucucuggu

SEQ ID NO: 2390492 - RNA, 23 nt, Human
cauuccccagguggcugacccag

SEQ ID NO: 2390493 - RNA, 17 nt, Human
cauuccccagguggcug

SEQ ID NO: 2390494 - RNA, 13 nt, Human
cauuccccaggug

SEQ ID NO: 2390495 - RNA, 13 nt, Human
cauuccccauggg

SEQ ID NO: 2390496 - RNA, 20 nt, Human
cauuccccaggaggccagcc

SEQ ID NO: 2390497 - RNA, 18 nt, Human
cauuccccaggaggccag

SEQ ID NO: 2390498 - RNA, 19 nt, Human
cauuccccaggaggccagc

SEQ ID NO: 2390499 - RNA, 14 nt, Human
cauuccaagccuga

SEQ ID NO: 2390500 - RNA, 14 nt, Human
cauuccagaggaag

SEQ ID NO: 2390501 - RNA, 13 nt, Human
cauuccagccccu

SEQ ID NO: 2390502 - RNA, 15 nt, Human
cauuccagccccucu

SEQ ID NO: 2390503 - RNA, 18 nt, Human
cauuccagccccucuggu

SEQ ID NO: 2390504 - RNA, 19 nt, Human
cauuccagccccucugguc

SEQ ID NO: 2390505 - RNA, 14 nt, Human
cauuccauccuuga

SEQ ID NO: 2390506 - RNA, 12 nt, Human
cauuccauccuu

SEQ ID NO: 2390507 - RNA, 22 nt, Human
cauuccagccccucuggucgcu

SEQ ID NO: 2390508 - RNA, 14 nt, Human
cauuccauucugga

SEQ ID NO: 2390509 - RNA, 15 nt, Human
cauuccauucuggaa

SEQ ID NO: 2390510 - RNA, 13 nt, Human
cauuccccaggag

SEQ ID NO: 2390511 - RNA, 15 nt, Human
cauuccccaggaggc

SEQ ID NO: 2390512 - RNA, 17 nt, Human
cauuccccaggaggcca

SEQ ID NO: 2390513 - RNA, 16 nt, Human
cauuaagccuuccaca

SEQ ID NO: 2390514 - RNA, 20 nt, Human
cauuaagcccucuuccauca

SEQ ID NO: 2390515 - RNA, 16 nt, Human
cauuaagcccucuucc

SEQ ID NO: 2390516 - RNA, 15 nt, Human
cauuaagaaaaucau

SEQ ID NO: 2390517 - RNA, 17 nt, Human
cauuaagcccucuucca

SEQ ID NO: 2390518 - RNA, 17 nt, Human
cauuaacuuagcaugug

SEQ ID NO: 2390519 - RNA, 16 nt, Human
cauuaacuucucugga

SEQ ID NO: 2390520 - RNA, 11 nt, Human
cauuaagaaaa

SEQ ID NO: 2390521 - RNA, 12 nt, Human
cauuaagaaaau

SEQ ID NO: 2390522 - RNA, 13 nt, Human
cauuaagaaaauc

SEQ ID NO: 2390523 - RNA, 14 nt, Human
cauuaagaaaauca

SEQ ID NO: 2390524 - RNA, 17 nt, Human
cauuaagaaaaucauau

SEQ ID NO: 2390525 - RNA, 23 nt, Human
cauuaacaguuuuccaugaaaac

SEQ ID NO: 2390526 - RNA, 18 nt, Human
cauuaacuaaucuauugg

SEQ ID NO: 2390527 - RNA, 16 nt, Human
cauuaacuaaucuauu

SEQ ID NO: 2390528 - RNA, 22 nt, Human
cauuaacaguuuuccaugaaaa

SEQ ID NO: 2390529 - RNA, 21 nt, Human
cauuaacaguuuuccaugaaa

SEQ ID NO: 2390530 - RNA, 16 nt, Human
cauuacagcuuaauca

SEQ ID NO: 2390531 - RNA, 24 nt, Human
cauuacagggaaugccugagugcc

SEQ ID NO: 2390532 - RNA, 21 nt, Human
cauuacagagaggagaaacac

SEQ ID NO: 2390533 - RNA, 14 nt, Human
cauuacagcuuaau

SEQ ID NO: 2390534 - RNA, 22 nt, Human
cauuacagagaggagaaacaca

SEQ ID NO: 2390535 - RNA, 21 nt, Human
cauuacagugggugccccccu

SEQ ID NO: 2390536 - RNA, 12 nt, Human
cauuaccacuca

SEQ ID NO: 2390537 - RNA, 13 nt, Human
cauuaccacucag

SEQ ID NO: 2390538 - RNA, 14 nt, Human
cauuaccacucagg

SEQ ID NO: 2390539 - RNA, 15 nt, Human
cauuaccacucaggc

SEQ ID NO: 2390540 - RNA, 16 nt, Human
cauuacaaauugcuua

SEQ ID NO: 2390541 - RNA, 12 nt, Human
cauuaauucuau

SEQ ID NO: 2390542 - RNA, 20 nt, Human
cauuacagagaggagaaaca

SEQ ID NO: 2390543 - RNA, 18 nt, Human
cauuacagagaggagaaa

SEQ ID NO: 2390544 - RNA, 15 nt, Human
cauuacagagaggag

SEQ ID NO: 2390545 - RNA, 13 nt, Human
cauuacagagagg

SEQ ID NO: 2390546 - RNA, 16 nt, Human
cauucaauacaagugu

SEQ ID NO: 2390547 - RNA, 21 nt, Human
cauucaauaagcaucaaacuc

SEQ ID NO: 2390548 - RNA, 22 nt, Human
cauucaaguguaaaauauuuug

SEQ ID NO: 2390549 - RNA, 23 nt, Human
cauucaaguguaaaauauuuuga

SEQ ID NO: 2390550 - RNA, 18 nt, Human
cauucaaguguaaaauau

SEQ ID NO: 2390551 - RNA, 19 nt, Human
cauucaaguguaaaauauu

SEQ ID NO: 2390552 - RNA, 20 nt, Human
cauucaaguguaaaauauuu

SEQ ID NO: 2390553 - RNA, 21 nt, Human
cauucaaguguaaaauauuuu

SEQ ID NO: 2390554 - RNA, 14 nt, Human
cauucacccagaca

SEQ ID NO: 2390555 - RNA, 13 nt, Human
cauucacccagac

SEQ ID NO: 2390556 - RNA, 13 nt, Human
cauucaccugccc

SEQ ID NO: 2390557 - RNA, 23 nt, Human
cauucacaguucuuugggccaga

SEQ ID NO: 2390558 - RNA, 20 nt, Human
cauucaauuuauucaagaaa

SEQ ID NO: 2390559 - RNA, 22 nt, Human
cauucaauaagcaucaaacucu

SEQ ID NO: 2390560 - RNA, 13 nt, Human
cauucaauguuua

SEQ ID NO: 2390561 - RNA, 21 nt, Human
cauucaauuuauucaagaaaa

SEQ ID NO: 2390562 - RNA, 22 nt, Human
cauucacaguucuuugggccag

SEQ ID NO: 2390563 - RNA, 17 nt, Human
cauucaacccuggagag

SEQ ID NO: 2390564 - RNA, 17 nt, Human
cauucaaguguaaaaua

SEQ ID NO: 2390565 - RNA, 18 nt, Human
cauucaaaaguugaaauu

SEQ ID NO: 2390566 - RNA, 12 nt, Human
cauucaaauuaa

SEQ ID NO: 2390567 - RNA, 12 nt, Human
cauucaacaaga

SEQ ID NO: 2390568 - RNA, 23 nt, Human
cauucaaauuaaggguuaagaaa

SEQ ID NO: 2390569 - RNA, 23 nt, Human
cauuauuggaauuaaccuggugc

SEQ ID NO: 2390570 - RNA, 20 nt, Human
cauuauuuuuccacuuuguu

SEQ ID NO: 2390571 - RNA, 22 nt, Human
cauuauuuuuccacuuuguucu

SEQ ID NO: 2390572 - RNA, 17 nt, Human
cauucaaaaguugaaau

SEQ ID NO: 2390573 - RNA, 16 nt, Human
cauucaaaaguugaaa

SEQ ID NO: 2390574 - RNA, 12 nt, Human
cauuauuggaau

SEQ ID NO: 2390575 - RNA, 14 nt, Human
cauuauuggaauua

SEQ ID NO: 2390576 - RNA, 22 nt, Human
cauuauuggaauuaaccuggug

SEQ ID NO: 2390577 - RNA, 20 nt, Human
cauuauuggaauuaaccugg

SEQ ID NO: 2390578 - RNA, 18 nt, Human
cauuauuggaauuaaccu

SEQ ID NO: 2390579 - RNA, 17 nt, Human
cauuauuggaauuaacc

SEQ ID NO: 2390580 - RNA, 18 nt, Human
cauuagaaauuagcugug

SEQ ID NO: 2390581 - RNA, 22 nt, Human
cauuagaagauauuagucuugg

SEQ ID NO: 2390582 - RNA, 14 nt, Human
cauuagaauuauuu

SEQ ID NO: 2390583 - RNA, 19 nt, Human
cauuagaauuauuuaaaca

SEQ ID NO: 2390584 - RNA, 17 nt, Human
cauuagaaauagacagu

SEQ ID NO: 2390585 - RNA, 23 nt, Human
cauuacuuuaccacccccacacc

SEQ ID NO: 2390586 - RNA, 21 nt, Human
cauuacuuuaccacccccaca

SEQ ID NO: 2390587 - RNA, 18 nt, Human
cauuaccagacgguucac

SEQ ID NO: 2390588 - RNA, 16 nt, Human
cauuaccacucaggca

SEQ ID NO: 2390589 - RNA, 23 nt, Human
cauuacucaauugauaaacauuu

SEQ ID NO: 2390590 - RNA, 23 nt, Human
cauuacugcaugcacuucuuaca

SEQ ID NO: 2390591 - RNA, 16 nt, Human
cauuacugcaugcacu

SEQ ID NO: 2390592 - RNA, 13 nt, Human
cauuacugcaugc

SEQ ID NO: 2390593 - RNA, 15 nt, Human
cauucugucuugaag

SEQ ID NO: 2390594 - RNA, 22 nt, Human
cauucugucgccuuagcauguu

SEQ ID NO: 2390595 - RNA, 17 nt, Human
cauucuguuaaucauua

SEQ ID NO: 2390596 - RNA, 14 nt, Human
cauucuuagcucuu

SEQ ID NO: 2390597 - RNA, 17 nt, Human
cauucuuagcucuuaau

SEQ ID NO: 2390598 - RNA, 14 nt, Human
cauucuuauaaaua

SEQ ID NO: 2390599 - RNA, 15 nt, Human
cauucuuauaaauau

SEQ ID NO: 2390600 - RNA, 16 nt, Human
cauucuuauaaauaug

SEQ ID NO: 2390601 - RNA, 21 nt, Human
cauucuuauuucaugaaaauu

SEQ ID NO: 2390602 - RNA, 17 nt, Human
cauucuuauaaauauga

SEQ ID NO: 2390603 - RNA, 22 nt, Human
cauucuuauaaauaugaagcuc

SEQ ID NO: 2390604 - RNA, 20 nt, Human
cauucugcuuucaucuuggu

SEQ ID NO: 2390605 - RNA, 12 nt, Human
cauucuggaagu

SEQ ID NO: 2390606 - RNA, 16 nt, Human
cauucuggaagugacu

SEQ ID NO: 2390607 - RNA, 21 nt, Human
cauucugucgccuuagcaugu

SEQ ID NO: 2390608 - RNA, 13 nt, Human
cauucuggaauaa

SEQ ID NO: 2390609 - RNA, 12 nt, Human
cauucugccugc

SEQ ID NO: 2390610 - RNA, 13 nt, Human
cauucugccugcc

SEQ ID NO: 2390611 - RNA, 15 nt, Human
cauucugccugccca

SEQ ID NO: 2390612 - RNA, 16 nt, Human
cauucugccugcccag

SEQ ID NO: 2390613 - RNA, 17 nt, Human
cauucugccugcccagg

SEQ ID NO: 2390614 - RNA, 18 nt, Human
cauucugccugcccaggc

SEQ ID NO: 2390615 - RNA, 19 nt, Human
cauucugccugcccaggcc

SEQ ID NO: 2390616 - RNA, 20 nt, Human
cauucugccugcccaggccc

SEQ ID NO: 2390617 - RNA, 23 nt, Human
cauuccucagggacagagacacc

SEQ ID NO: 2390618 - RNA, 16 nt, Human
cauuccucagggacag

SEQ ID NO: 2390619 - RNA, 13 nt, Human
cauuccucaggga

SEQ ID NO: 2390620 - RNA, 23 nt, Human
cauuccucaccuuuucccgggga

SEQ ID NO: 2390621 - RNA, 13 nt, Human
cauuccugaaaga

SEQ ID NO: 2390622 - RNA, 19 nt, Human
cauuccugaaagaaacagu

SEQ ID NO: 2390623 - RNA, 21 nt, Human
cauuccugauaugauuuaaaa

SEQ ID NO: 2390624 - RNA, 21 nt, Human
cauuccugaagaaccaguccc

SEQ ID NO: 2390625 - RNA, 20 nt, Human
cauuccugaagaaccagucc

SEQ ID NO: 2390626 - RNA, 17 nt, Human
cauuccugaagaaccag

SEQ ID NO: 2390627 - RNA, 16 nt, Human
cauuccugaagaacca

SEQ ID NO: 2390628 - RNA, 13 nt, Human
cauuccugaagaa

SEQ ID NO: 2390629 - RNA, 14 nt, Human
cauuccugaugcuu

SEQ ID NO: 2390630 - RNA, 16 nt, Human
cauuccugaugcuucu

SEQ ID NO: 2390631 - RNA, 19 nt, Human
cauuccugaugcuucuuca

SEQ ID NO: 2390632 - RNA, 22 nt, Human
cauuccugaugcuucuucagag

SEQ ID NO: 2390633 - RNA, 17 nt, Human
cauuccuggaaaccaca

SEQ ID NO: 2390634 - RNA, 19 nt, Human
cauuccuggaaaccacagu

SEQ ID NO: 2390635 - RNA, 16 nt, Human
cauuccugccugucuc

SEQ ID NO: 2390636 - RNA, 15 nt, Human
cauuccugccugucu

SEQ ID NO: 2390637 - RNA, 14 nt, Human
cauuccugccuguc

SEQ ID NO: 2390638 - RNA, 13 nt, Human
cauuccugccugu

SEQ ID NO: 2390639 - RNA, 23 nt, Human
cauuccugaugcuucuucagaga

SEQ ID NO: 2390640 - RNA, 21 nt, Human
cauuccugggaaauauucccu

SEQ ID NO: 2390641 - RNA, 21 nt, Human
cauuccuggaaaccacagucc

SEQ ID NO: 2390642 - RNA, 14 nt, Human
cauuccugggcaca

SEQ ID NO: 2390643 - RNA, 16 nt, Human
cauuccugggcacagu

SEQ ID NO: 2390644 - RNA, 15 nt, Human
cauuccugguaccca

SEQ ID NO: 2390645 - RNA, 17 nt, Human
cauuccugguacccagc

SEQ ID NO: 2390646 - RNA, 18 nt, Human
cauuccugguacccagcc

SEQ ID NO: 2390647 - RNA, 18 nt, Human
cauuccuguauucacccg

SEQ ID NO: 2390648 - RNA, 24 nt, Human
cauuccugguacccagccaucugc

SEQ ID NO: 2390649 - RNA, 13 nt, Human
cauuccuguauuc

SEQ ID NO: 2390650 - RNA, 19 nt, Human
cauuccugguacccagcca

SEQ ID NO: 2390651 - RNA, 20 nt, Human
cauuccugguacccagccau

SEQ ID NO: 2390652 - RNA, 21 nt, Human
cauuccugguacccagccauc

SEQ ID NO: 2390653 - RNA, 23 nt, Human
cauuccugguacccagccaucug

SEQ ID NO: 2390654 - RNA, 22 nt, Human
cauucugccaggcccccaagcc

SEQ ID NO: 2390655 - RNA, 20 nt, Human
cauucugauuuggaaaaaga

SEQ ID NO: 2390656 - RNA, 23 nt, Human
cauucugacucgguuucuccaaa

SEQ ID NO: 2390657 - RNA, 17 nt, Human
cauucugaccauuucag

SEQ ID NO: 2390658 - RNA, 16 nt, Human
cauucugaccauuuca

SEQ ID NO: 2390659 - RNA, 15 nt, Human
cauucugacucauau

SEQ ID NO: 2390660 - RNA, 12 nt, Human
cauucugacucg

SEQ ID NO: 2390661 - RNA, 16 nt, Human
cauucugacucgguuu

SEQ ID NO: 2390662 - RNA, 19 nt, Human
cauucugacucgguuucuc

SEQ ID NO: 2390663 - RNA, 21 nt, Human
cauucugacucgguuucucca

SEQ ID NO: 2390664 - RNA, 14 nt, Human
cauucuuuuguaau

SEQ ID NO: 2390665 - RNA, 15 nt, Human
cauucuuuuguaauu

SEQ ID NO: 2390666 - RNA, 16 nt, Human
cauucuuuuguaauuu

SEQ ID NO: 2390667 - RNA, 18 nt, Human
cauucuuuuguaauuuaa

SEQ ID NO: 2390668 - RNA, 12 nt, Human
cauucuuuugua

SEQ ID NO: 2390669 - RNA, 19 nt, Human
cauucuuuuaaaagacaag

SEQ ID NO: 2390670 - RNA, 16 nt, Human
cauucuuuuaaaagac

SEQ ID NO: 2390671 - RNA, 18 nt, Human
cauucuuuaucuugacau

SEQ ID NO: 2390672 - RNA, 17 nt, Human
cauucuuucugauaacu

SEQ ID NO: 2390673 - RNA, 16 nt, Human
cauucuugguuggcug

SEQ ID NO: 2390674 - RNA, 17 nt, Human
cauucuugguuggcugg

SEQ ID NO: 2390675 - RNA, 21 nt, Human
cauucuugguuggcuggccuu

SEQ ID NO: 2390676 - RNA, 17 nt, Human
cauucuugaaagcugug

SEQ ID NO: 2390677 - RNA, 23 nt, Human
cauucuucuguacgucugacagg

SEQ ID NO: 2390678 - RNA, 20 nt, Human
cauucuucucuagcuggugg

SEQ ID NO: 2390679 - RNA, 21 nt, Human
cauucuuccuaguuuucuccu

SEQ ID NO: 2390680 - RNA, 18 nt, Human
cauucuucucuagcuggu

SEQ ID NO: 2390681 - RNA, 19 nt, Human
cauucuucucuagcuggug

SEQ ID NO: 2390682 - RNA, 18 nt, Human
cauucuuccuaguuuucu

SEQ ID NO: 2390683 - RNA, 13 nt, Human
cauucuuccuagu

SEQ ID NO: 2390684 - RNA, 20 nt, Human
cauuuuagaagacucuacca

SEQ ID NO: 2390685 - RNA, 17 nt, Human
cauuuucaccccacccu

SEQ ID NO: 2390686 - RNA, 15 nt, Human
cauuuuccccccacu

SEQ ID NO: 2390687 - RNA, 14 nt, Human
cauuuuccccccac

SEQ ID NO: 2390688 - RNA, 12 nt, Human
cauuuucccaga

SEQ ID NO: 2390689 - RNA, 22 nt, Human
cauuuuccccccacucucccca

SEQ ID NO: 2390690 - RNA, 21 nt, Human
cauuuuccccccacucucccc

SEQ ID NO: 2390691 - RNA, 20 nt, Human
cauuuuccccccacucuccc

SEQ ID NO: 2390692 - RNA, 17 nt, Human
cauuuuccccccacucu

SEQ ID NO: 2390693 - RNA, 11 nt, Human
cauuuucugca

SEQ ID NO: 2390694 - RNA, 12 nt, Human
cauuuucugcaa

SEQ ID NO: 2390695 - RNA, 14 nt, Human
cauuuucugcaagc

SEQ ID NO: 2390696 - RNA, 21 nt, Human
cauuuuuaagugcugcauuua

SEQ ID NO: 2390697 - RNA, 19 nt, Human
cauuuuuaaucaugaaauu

SEQ ID NO: 2390698 - RNA, 18 nt, Human
cauuuucugcaagccugc

SEQ ID NO: 2390699 - RNA, 15 nt, Human
cauuuucugcaagcc

SEQ ID NO: 2390700 - RNA, 17 nt, Human
cauuuucugcaagccug

SEQ ID NO: 2390701 - RNA, 22 nt, Human
ccaaaaugcucuagugccuucu

SEQ ID NO: 2390702 - RNA, 23 nt, Human
ccaaaauguaggcuuaguuugug

SEQ ID NO: 2390703 - RNA, 17 nt, Human
cauuuuuaguagagaca

SEQ ID NO: 2390704 - RNA, 17 nt, Human
cauuuuuacaauaaaua

SEQ ID NO: 2390705 - RNA, 15 nt, Human
cauuuuuaaucauga

SEQ ID NO: 2390706 - RNA, 15 nt, Human
cauuuuuacaauaaa

SEQ ID NO: 2390707 - RNA, 16 nt, Human
ccaaacaaauaugcaa

SEQ ID NO: 2390708 - RNA, 20 nt, Human
ccaaaauuguuuugagcuuu

SEQ ID NO: 2390709 - RNA, 16 nt, Human
ccaaaauuauuucaga

SEQ ID NO: 2390710 - RNA, 21 nt, Human
ccaaaauguuggucauuuuau

SEQ ID NO: 2390711 - RNA, 20 nt, Human
ccaaaauguuggucauuuua

SEQ ID NO: 2390712 - RNA, 19 nt, Human
ccaaacaccuuccagcucc

SEQ ID NO: 2390713 - RNA, 15 nt, Human
ccaaacaccuuccag

SEQ ID NO: 2390714 - RNA, 17 nt, Human
ccaaaccaccagaagcc

SEQ ID NO: 2390715 - RNA, 16 nt, Human
ccaaacccuucagugc

SEQ ID NO: 2390716 - RNA, 20 nt, Human
cauuuuacccacacacagau

SEQ ID NO: 2390717 - RNA, 17 nt, Human
cauuuuacuuuuuccug

SEQ ID NO: 2390718 - RNA, 20 nt, Human
cauuuuacuuuuuccuggcu

SEQ ID NO: 2390719 - RNA, 22 nt, Human
cauuuuacuuuuuccuggcuca

SEQ ID NO: 2390720 - RNA, 16 nt, Human
cauuuucaccccaccc

SEQ ID NO: 2390721 - RNA, 22 nt, Human
cauuuuauuuuauuaugcauga

SEQ ID NO: 2390722 - RNA, 23 nt, Human
cauuuuauuuuauuaugcaugaa

SEQ ID NO: 2390723 - RNA, 23 nt, Human
cauuuuaccuuugacaaagguaa

SEQ ID NO: 2390724 - RNA, 16 nt, Human
cauuugcuuuuucacc

SEQ ID NO: 2390725 - RNA, 13 nt, Human
cauuugcuuuuug

SEQ ID NO: 2390726 - RNA, 17 nt, Human
cauuugcacccuccgcc

SEQ ID NO: 2390727 - RNA, 15 nt, Human
cauuugcacccuccg

SEQ ID NO: 2390728 - RNA, 20 nt, Human
cauuugcacuggaguucuau

SEQ ID NO: 2390729 - RNA, 21 nt, Human
cauuugcacuggaguucuaug

SEQ ID NO: 2390730 - RNA, 18 nt, Human
cauuugcagaguccugca

SEQ ID NO: 2390731 - RNA, 19 nt, Human
cauuugcagaguccugcac

SEQ ID NO: 2390732 - RNA, 15 nt, Human
cauuugauucugugu

SEQ ID NO: 2390733 - RNA, 16 nt, Human
cauuugaugcuaaaua

SEQ ID NO: 2390734 - RNA, 22 nt, Human
cauuugcaagggaaaagucucu

SEQ ID NO: 2390735 - RNA, 13 nt, Human
cauuugcugaaua

SEQ ID NO: 2390736 - RNA, 15 nt, Human
cauuugaugcuaaau

SEQ ID NO: 2390737 - RNA, 14 nt, Human
cauuugaugcuaaa

SEQ ID NO: 2390738 - RNA, 22 nt, Human
cauuugaguuauuuuaauuauc

SEQ ID NO: 2390739 - RNA, 18 nt, Human
cauuucuugggcccuccu

SEQ ID NO: 2390740 - RNA, 17 nt, Human
cauuucuugggcccucc

SEQ ID NO: 2390741 - RNA, 14 nt, Human
cauugauggggaag

SEQ ID NO: 2390742 - RNA, 22 nt, Human
cauugauaugaaaaauaugaua

SEQ ID NO: 2390743 - RNA, 19 nt, Human
cauugauaugaaaaauaug

SEQ ID NO: 2390744 - RNA, 18 nt, Human
cauugauaugaaaaauau

SEQ ID NO: 2390745 - RNA, 17 nt, Human
cauugauaugaaaaaua

SEQ ID NO: 2390746 - RNA, 18 nt, Human
cauugaccugaggcccuu

SEQ ID NO: 2390747 - RNA, 15 nt, Human
cauugaguaauauag

SEQ ID NO: 2390748 - RNA, 16 nt, Human
cauugacaagaacuga

SEQ ID NO: 2390749 - RNA, 14 nt, Human
cauugaccugaggc

SEQ ID NO: 2390750 - RNA, 23 nt, Human
cauugaauucuugguugaggaaa

SEQ ID NO: 2390751 - RNA, 22 nt, Human
cauugaauucuugguugaggaa

SEQ ID NO: 2390752 - RNA, 21 nt, Human
cauugaauucuugguugagga

SEQ ID NO: 2390753 - RNA, 15 nt, Human
cauugaccugaggcc

SEQ ID NO: 2390754 - RNA, 17 nt, Human
cauugaccugaggcccu

SEQ ID NO: 2390755 - RNA, 19 nt, Human
cauucuuuuguaauuuaaa

SEQ ID NO: 2390756 - RNA, 18 nt, Human
cauucuuuuaaaagacaa

SEQ ID NO: 2390757 - RNA, 18 nt, Human
cauugaaguaaugaauuu

SEQ ID NO: 2390758 - RNA, 19 nt, Human
cauugaaucuguauggcua

SEQ ID NO: 2390759 - RNA, 14 nt, Human
cauugaauuagaaa

SEQ ID NO: 2390760 - RNA, 19 nt, Human
cauugaaguaaugaauuuu

SEQ ID NO: 2390761 - RNA, 16 nt, Human
cauugaagucagaugu

SEQ ID NO: 2390762 - RNA, 15 nt, Human
cauugaaucuguaug

SEQ ID NO: 2390763 - RNA, 22 nt, Human
cauugaacacaaacuguaaaua

SEQ ID NO: 2390764 - RNA, 22 nt, Human
cauugugggauguucagcacug

SEQ ID NO: 2390765 - RNA, 21 nt, Human
cauugugggauguucagcacu

SEQ ID NO: 2390766 - RNA, 22 nt, Human
cauuguacaguuuguuuacaca

SEQ ID NO: 2390767 - RNA, 15 nt, Human
cauugugggaagggg

SEQ ID NO: 2390768 - RNA, 13 nt, Human
cauugugggaagg

SEQ ID NO: 2390769 - RNA, 18 nt, Human
cauugauugucagcuacu

SEQ ID NO: 2390770 - RNA, 17 nt, Human
cauugauugucagcuac

SEQ ID NO: 2390771 - RNA, 16 nt, Human
cauugauggggaagga

SEQ ID NO: 2390772 - RNA, 16 nt, Human
cauugauugucagcua

SEQ ID NO: 2390773 - RNA, 19 nt, Human
cauugauggggaaggaggc

SEQ ID NO: 2390774 - RNA, 21 nt, Human
cauuguaaaugugcuuuuaaa

SEQ ID NO: 2390775 - RNA, 16 nt, Human
cauuguaauguuacug

SEQ ID NO: 2390776 - RNA, 15 nt, Human
cauuguaauguuacu

SEQ ID NO: 2390777 - RNA, 15 nt, Human
cauuguaacuuggau

SEQ ID NO: 2390778 - RNA, 18 nt, Human
cauuguaauguuacugau

SEQ ID NO: 2390779 - RNA, 17 nt, Human
cauuguaauguuacuga

SEQ ID NO: 2390780 - RNA, 21 nt, Human
cauuguaauguuacugaucau

SEQ ID NO: 2390781 - RNA, 13 nt, Human
cauuguacaguuu

SEQ ID NO: 2390782 - RNA, 14 nt, Human
cauuguacaguuug

SEQ ID NO: 2390783 - RNA, 19 nt, Human
cauuguacaguuuguuuac

SEQ ID NO: 2390784 - RNA, 20 nt, Human
cauuguacaguuuguuuaca

SEQ ID NO: 2390785 - RNA, 21 nt, Human
cauuguacaguuuguuuacac

SEQ ID NO: 2390786 - RNA, 15 nt, Human
cauuuaaaaaaaauc

SEQ ID NO: 2390787 - RNA, 23 nt, Human
cauuuaaaacagacacuggcaug

SEQ ID NO: 2390788 - RNA, 18 nt, Human
cauuuaaaacagacacug

SEQ ID NO: 2390789 - RNA, 17 nt, Human
cauuuaaaacagacacu

SEQ ID NO: 2390790 - RNA, 13 nt, Human
cauuuaaaacaga

SEQ ID NO: 2390791 - RNA, 21 nt, Human
cauuuaaaaaaaaaauuuguu

SEQ ID NO: 2390792 - RNA, 12 nt, Human
cauuuaaaaaaa

SEQ ID NO: 2390793 - RNA, 14 nt, Human
cauuguuuugccaa

SEQ ID NO: 2390794 - RNA, 16 nt, Human
cauuguuuugccaaca

SEQ ID NO: 2390795 - RNA, 20 nt, Human
cauuguuuugccaacauugc

SEQ ID NO: 2390796 - RNA, 16 nt, Human
cauuguucaauuagaa

SEQ ID NO: 2390797 - RNA, 23 nt, Human
cauuguuuuaaaaagaaacaaga

SEQ ID NO: 2390798 - RNA, 17 nt, Human
cauuuaaauacagucuu

SEQ ID NO: 2390799 - RNA, 18 nt, Human
cauuuaaauacagucuuc

SEQ ID NO: 2390800 - RNA, 20 nt, Human
cauuuaaauacagucuucca

SEQ ID NO: 2390801 - RNA, 18 nt, Human
cauuuaaauuuuuuuccu

SEQ ID NO: 2390802 - RNA, 23 nt, Human
cauuuaaauuuuacccuuuagac

SEQ ID NO: 2390803 - RNA, 12 nt, Human
cauuuaauaaua

SEQ ID NO: 2390804 - RNA, 19 nt, Human
cauuuaagagacagucacc

SEQ ID NO: 2390805 - RNA, 23 nt, Human
cauuuaagagacagucaccccag

SEQ ID NO: 2390806 - RNA, 13 nt, Human
cauuuaauaauau

SEQ ID NO: 2390807 - RNA, 14 nt, Human
cauuuaauaauaua

SEQ ID NO: 2390808 - RNA, 17 nt, Human
cauuuaagagacaguca

SEQ ID NO: 2390809 - RNA, 24 nt, Human
cauuuaauguagccaugggaccaa

SEQ ID NO: 2390810 - RNA, 21 nt, Human
cauuuaauguagccaugggac

SEQ ID NO: 2390811 - RNA, 22 nt, Human
cauuuaauguagccaugggacc

SEQ ID NO: 2390812 - RNA, 20 nt, Human
cauuuaauguagccauggga

SEQ ID NO: 2390813 - RNA, 22 nt, Human
cauuuaauaauauacuugugga

SEQ ID NO: 2390814 - RNA, 17 nt, Human
cauuuaauaauauacuu

SEQ ID NO: 2390815 - RNA, 20 nt, Human
cauuuaauaauauacuugug

SEQ ID NO: 2390816 - RNA, 12 nt, Human
cauuuacaugua

SEQ ID NO: 2390817 - RNA, 20 nt, Human
cauuuacauguauuauuuca

SEQ ID NO: 2390818 - RNA, 22 nt, Human
cauuuacccuucuuuucugacu

SEQ ID NO: 2390819 - RNA, 16 nt, Human
cauuucuugggcccuc

SEQ ID NO: 2390820 - RNA, 15 nt, Human
cauuucuugggcccu

SEQ ID NO: 2390821 - RNA, 14 nt, Human
cauuucuugggccc

SEQ ID NO: 2390822 - RNA, 12 nt, Human
cauuucuugggc

SEQ ID NO: 2390823 - RNA, 18 nt, Human
cauuucuuugugcuuugg

SEQ ID NO: 2390824 - RNA, 12 nt, Human
cauuuacugugg

SEQ ID NO: 2390825 - RNA, 13 nt, Human
cauuuacuguggc

SEQ ID NO: 2390826 - RNA, 14 nt, Human
cauuuacuguggcu

SEQ ID NO: 2390827 - RNA, 15 nt, Human
cauuuacuguggcuu

SEQ ID NO: 2390828 - RNA, 19 nt, Human
cauuugaaaauuuugaugu

SEQ ID NO: 2390829 - RNA, 17 nt, Human
cauuugaaaauuuugau

SEQ ID NO: 2390830 - RNA, 13 nt, Human
caugggcacugcu

SEQ ID NO: 2390831 - RNA, 14 nt, Human
caugggcacugcug

SEQ ID NO: 2390832 - RNA, 15 nt, Human
caugggcacugcugg

SEQ ID NO: 2390833 - RNA, 14 nt, Human
caugggaggcucac

SEQ ID NO: 2390834 - RNA, 14 nt, Human
caugggagggggcu

SEQ ID NO: 2390835 - RNA, 22 nt, Human
caugggagggggcuugaagcca

SEQ ID NO: 2390836 - RNA, 18 nt, Human
caugggccuccugugugu

SEQ ID NO: 2390837 - RNA, 17 nt, Human
caugggcagagcccaag

SEQ ID NO: 2390838 - RNA, 15 nt, Human
caugggcagagccca

SEQ ID NO: 2390839 - RNA, 16 nt, Human
caugggcacugcuggg

SEQ ID NO: 2390840 - RNA, 17 nt, Human
caugggcacugcugggu

SEQ ID NO: 2390841 - RNA, 18 nt, Human
caugggcacugcugggug

SEQ ID NO: 2390842 - RNA, 19 nt, Human
caugggcacugcugggugg

SEQ ID NO: 2390843 - RNA, 23 nt, Human
caugggcacugcuggguggccca

SEQ ID NO: 2390844 - RNA, 13 nt, Human
caugggccuggcc

SEQ ID NO: 2390845 - RNA, 23 nt, Human
caugggccuggccaccucucucc

SEQ ID NO: 2390846 - RNA, 13 nt, Human
caugggcucugac

SEQ ID NO: 2390847 - RNA, 24 nt, Human
caugggccuggccaccucucuccu

SEQ ID NO: 2390848 - RNA, 12 nt, Human
caugggcuucac

SEQ ID NO: 2390849 - RNA, 13 nt, Human
caugggcuucacu

SEQ ID NO: 2390850 - RNA, 14 nt, Human
caugggcuucacug

SEQ ID NO: 2390851 - RNA, 15 nt, Human
caugggcuucacugu

SEQ ID NO: 2390852 - RNA, 16 nt, Human
caugggcuucacugua

SEQ ID NO: 2390853 - RNA, 22 nt, Human
caugggagccgggucugccucu

SEQ ID NO: 2390854 - RNA, 13 nt, Human
caugggagccggg

SEQ ID NO: 2390855 - RNA, 18 nt, Human
cauggcaucaccuccacc

SEQ ID NO: 2390856 - RNA, 21 nt, Human
caugggagcugguuagaaaug

SEQ ID NO: 2390857 - RNA, 23 nt, Human
caugggacagggaggacgcucuc

SEQ ID NO: 2390858 - RNA, 16 nt, Human
cauggaggcacacagc

SEQ ID NO: 2390859 - RNA, 19 nt, Human
cauggaggcacacagcugc

SEQ ID NO: 2390860 - RNA, 20 nt, Human
cauggaggcacacagcugca

SEQ ID NO: 2390861 - RNA, 22 nt, Human
cauggaggagcuugggggauga

SEQ ID NO: 2390862 - RNA, 17 nt, Human
cauggcagaguuugugu

SEQ ID NO: 2390863 - RNA, 18 nt, Human
cauggcagaguuugugug

SEQ ID NO: 2390864 - RNA, 19 nt, Human
caugggguuggcugggccc

SEQ ID NO: 2390865 - RNA, 21 nt, Human
cauggggugggguagggcuga

SEQ ID NO: 2390866 - RNA, 22 nt, Human
caugggguuggcugggcccaga

SEQ ID NO: 2390867 - RNA, 20 nt, Human
caugggguuggcugggccca

SEQ ID NO: 2390868 - RNA, 21 nt, Human
caugggcuucacuguauaaau

SEQ ID NO: 2390869 - RNA, 16 nt, Human
cauggggaagggauau

SEQ ID NO: 2390870 - RNA, 17 nt, Human
caugggcuucacuguau

SEQ ID NO: 2390871 - RNA, 20 nt, Human
caugggcuucacuguauaaa

SEQ ID NO: 2390872 - RNA, 23 nt, Human
caugggcuucacuguauaaauag

SEQ ID NO: 2390873 - RNA, 18 nt, Human
caugguacccccuucugg

SEQ ID NO: 2390874 - RNA, 19 nt, Human
caugguacccccuucuggg

SEQ ID NO: 2390875 - RNA, 23 nt, Human
caugggugaagggagagccagcu

SEQ ID NO: 2390876 - RNA, 22 nt, Human
caugggugaagggagagccagc

SEQ ID NO: 2390877 - RNA, 19 nt, Human
caugggugaagggagagcc

SEQ ID NO: 2390878 - RNA, 16 nt, Human
cauggucacacacuga

SEQ ID NO: 2390879 - RNA, 21 nt, Human
caugcgggcugggcagcuguu

SEQ ID NO: 2390880 - RNA, 17 nt, Human
caugcgggcuuccuccu

SEQ ID NO: 2390881 - RNA, 19 nt, Human
caugcuggguucugcacag

SEQ ID NO: 2390882 - RNA, 15 nt, Human
caugcgggcugggca

SEQ ID NO: 2390883 - RNA, 18 nt, Human
caugcgggcugggcagcu

SEQ ID NO: 2390884 - RNA, 19 nt, Human
caugcgggcugggcagcug

SEQ ID NO: 2390885 - RNA, 20 nt, Human
caugcgggcugggcagcugu

SEQ ID NO: 2390886 - RNA, 16 nt, Human
caugcggcccaggaug

SEQ ID NO: 2390887 - RNA, 21 nt, Human
caugcggcccagcccggcucc

SEQ ID NO: 2390888 - RNA, 22 nt, Human
caugcggcccagcccggcuccc

SEQ ID NO: 2390889 - RNA, 15 nt, Human
caugcggcccagccc

SEQ ID NO: 2390890 - RNA, 16 nt, Human
caugcggcccagcccg

SEQ ID NO: 2390891 - RNA, 18 nt, Human
caugcggcccagcccggc

SEQ ID NO: 2390892 - RNA, 19 nt, Human
caugcggcccagcccggcu

SEQ ID NO: 2390893 - RNA, 17 nt, Human
caugcugucccuuacgu

SEQ ID NO: 2390894 - RNA, 14 nt, Human
caugcugugugacu

SEQ ID NO: 2390895 - RNA, 21 nt, Human
caugcugugugacucaaacca

SEQ ID NO: 2390896 - RNA, 17 nt, Human
caugcugugugacucaa

SEQ ID NO: 2390897 - RNA, 13 nt, Human
caugcugucccuu

SEQ ID NO: 2390898 - RNA, 15 nt, Human
caugcugucccuuac

SEQ ID NO: 2390899 - RNA, 17 nt, Human
caugcacuuggcugcau

SEQ ID NO: 2390900 - RNA, 13 nt, Human
caugcagagcgcc

SEQ ID NO: 2390901 - RNA, 19 nt, Human
caugcagacaugagugcgu

SEQ ID NO: 2390902 - RNA, 22 nt, Human
caugcacugugaaggacccuug

SEQ ID NO: 2390903 - RNA, 19 nt, Human
caugcacuguucccccugu

SEQ ID NO: 2390904 - RNA, 23 nt, Human
caugcacuguucccccugugcag

SEQ ID NO: 2390905 - RNA, 20 nt, Human
caugcacugugaaggacccu

SEQ ID NO: 2390906 - RNA, 18 nt, Human
caugcacugugaaggacc

SEQ ID NO: 2390907 - RNA, 17 nt, Human
caugcacugugaaggac

SEQ ID NO: 2390908 - RNA, 16 nt, Human
caugcacugugaagga

SEQ ID NO: 2390909 - RNA, 14 nt, Human
caugcacugugaag

SEQ ID NO: 2390910 - RNA, 13 nt, Human
caugcacugugaa

SEQ ID NO: 2390911 - RNA, 10 nt, Human
caugcacugu

SEQ ID NO: 2390912 - RNA, 23 nt, Human
caugcagcccaugcccaccugcc

SEQ ID NO: 2390913 - RNA, 22 nt, Human
caugcagcccaugcccaccugc

SEQ ID NO: 2390914 - RNA, 22 nt, Human
caugcgcucagggccaugcuga

SEQ ID NO: 2390915 - RNA, 15 nt, Human
caugcagccgugauc

SEQ ID NO: 2390916 - RNA, 17 nt, Human
caugcagccgugaucaa

SEQ ID NO: 2390917 - RNA, 23 nt, Human
caugcgcucagggccaugcugag

SEQ ID NO: 2390918 - RNA, 21 nt, Human
caugcagccgugaucaaggga

SEQ ID NO: 2390919 - RNA, 14 nt, Human
caugcggagaacaa

SEQ ID NO: 2390920 - RNA, 16 nt, Human
caugcggagaacaaau

SEQ ID NO: 2390921 - RNA, 23 nt, Human
caugcggagaacaaaugugaagg

SEQ ID NO: 2390922 - RNA, 13 nt, Human
caugcggcccagc

SEQ ID NO: 2390923 - RNA, 14 nt, Human
caugcggcccagcc

SEQ ID NO: 2390924 - RNA, 14 nt, Human
caugcagcaucuaa

SEQ ID NO: 2390925 - RNA, 19 nt, Human
caugcagauggggcucccg

SEQ ID NO: 2390926 - RNA, 20 nt, Human
caugcagcccaugcccaccu

SEQ ID NO: 2390927 - RNA, 19 nt, Human
caugcagcccaugcccacc

SEQ ID NO: 2390928 - RNA, 16 nt, Human
caugcagcccaugccc

SEQ ID NO: 2390929 - RNA, 17 nt, Human
caugcagccacugugcu

SEQ ID NO: 2390930 - RNA, 13 nt, Human
cauggaggcacac

SEQ ID NO: 2390931 - RNA, 14 nt, Human
cauggaggagcuug

SEQ ID NO: 2390932 - RNA, 14 nt, Human
cauggagcuggccg

SEQ ID NO: 2390933 - RNA, 18 nt, Human
cauggagccccagccccc

SEQ ID NO: 2390934 - RNA, 13 nt, Human
cauggagcuggcc

SEQ ID NO: 2390935 - RNA, 17 nt, Human
cauggagccagcucccu

SEQ ID NO: 2390936 - RNA, 14 nt, Human
cauggagccccagc

SEQ ID NO: 2390937 - RNA, 15 nt, Human
cauggagccccagcc

SEQ ID NO: 2390938 - RNA, 12 nt, Human
cauggagcuggc

SEQ ID NO: 2390939 - RNA, 16 nt, Human
cauggagccccagccc

SEQ ID NO: 2390940 - RNA, 17 nt, Human
cauggagccccagcccc

SEQ ID NO: 2390941 - RNA, 15 nt, Human
cauggacuuccacug

SEQ ID NO: 2390942 - RNA, 22 nt, Human
cauggacuucugccagcauaau

SEQ ID NO: 2390943 - RNA, 14 nt, Human
cauggagccagcuc

SEQ ID NO: 2390944 - RNA, 15 nt, Human
cauggacuucacaua

SEQ ID NO: 2390945 - RNA, 21 nt, Human
cauggacucuacacugugaac

SEQ ID NO: 2390946 - RNA, 15 nt, Human
cauggacccggagcu

SEQ ID NO: 2390947 - RNA, 19 nt, Human
cauggacguucggggcaug

SEQ ID NO: 2390948 - RNA, 14 nt, Human
cauggacuucacau

SEQ ID NO: 2390949 - RNA, 12 nt, Human
cauggacccgga

SEQ ID NO: 2390950 - RNA, 23 nt, Human
cauggacaccccuuauccaggac

SEQ ID NO: 2390951 - RNA, 14 nt, Human
cauggacaccccuu

SEQ ID NO: 2390952 - RNA, 21 nt, Human
cauggacaccccuuauccagg

SEQ ID NO: 2390953 - RNA, 22 nt, Human
cauggacaccccuuauccagga

SEQ ID NO: 2390954 - RNA, 21 nt, Human
cauggaaauucccuucaucug

SEQ ID NO: 2390955 - RNA, 18 nt, Human
cauggaaaccugaaaaaa

SEQ ID NO: 2390956 - RNA, 20 nt, Human
cauggaauuggagcucgugg

SEQ ID NO: 2390957 - RNA, 16 nt, Human
cauggaauuuguaagu

SEQ ID NO: 2390958 - RNA, 19 nt, Human
cauggaauuuguaaguuua

SEQ ID NO: 2390959 - RNA, 16 nt, Human
caugcuucuuccuuac

SEQ ID NO: 2390960 - RNA, 13 nt, Human
caugcuuguguua

SEQ ID NO: 2390961 - RNA, 17 nt, Human
caugcuuugugaacaag

SEQ ID NO: 2390962 - RNA, 17 nt, Human
cauggaaaccugaaaaa

SEQ ID NO: 2390963 - RNA, 22 nt, Human
caugcugugugacucaaaccaa

SEQ ID NO: 2390964 - RNA, 14 nt, Human
caugcuucuuccuu

SEQ ID NO: 2390965 - RNA, 20 nt, Human
cauguacaugaagaagcuaa

SEQ ID NO: 2390966 - RNA, 19 nt, Human
cauguacccuaaggucauu

SEQ ID NO: 2390967 - RNA, 19 nt, Human
cauguaccauuugcauggc

SEQ ID NO: 2390968 - RNA, 16 nt, Human
cauguaaaagagucau

SEQ ID NO: 2390969 - RNA, 14 nt, Human
cauguaaaagaguc

SEQ ID NO: 2390970 - RNA, 18 nt, Human
cauguaaacaaaauuuag

SEQ ID NO: 2390971 - RNA, 21 nt, Human
cauguaaacaaaauuuaguuu

SEQ ID NO: 2390972 - RNA, 16 nt, Human
cauguaaacugugcac

SEQ ID NO: 2390973 - RNA, 22 nt, Human
cauguaaacacgccugcaaacg

SEQ ID NO: 2390974 - RNA, 15 nt, Human
cauguaaacugugca

SEQ ID NO: 2390975 - RNA, 13 nt, Human
cauguacuguagu

SEQ ID NO: 2390976 - RNA, 23 nt, Human
cauguacugagccuuguaauucu

SEQ ID NO: 2390977 - RNA, 13 nt, Human
cauguaccccaau

SEQ ID NO: 2390978 - RNA, 19 nt, Human
cauguacugagccuuguaa

SEQ ID NO: 2390979 - RNA, 22 nt, Human
cauguacugagccuuguaauuc

SEQ ID NO: 2390980 - RNA, 14 nt, Human
cauguacuguaguu

SEQ ID NO: 2390981 - RNA, 13 nt, Human
caugucggccucu

SEQ ID NO: 2390982 - RNA, 22 nt, Human
cauguacuguaguuuuucuuca

SEQ ID NO: 2390983 - RNA, 22 nt, Human
caugucuauaaucccagcacuu

SEQ ID NO: 2390984 - RNA, 14 nt, Human
caugucggccucua

SEQ ID NO: 2390985 - RNA, 14 nt, Human
caugucgugaccaa

SEQ ID NO: 2390986 - RNA, 16 nt, Human
caugucuccuauccug

SEQ ID NO: 2390987 - RNA, 17 nt, Human
caugucuauucagcuuc

SEQ ID NO: 2390988 - RNA, 16 nt, Human
caugucuauucagcuu

SEQ ID NO: 2390989 - RNA, 23 nt, Human
caugguggcaccagcgaagggag

SEQ ID NO: 2390990 - RNA, 22 nt, Human
cauggugccugagaggcaggca

SEQ ID NO: 2390991 - RNA, 18 nt, Human
cauggugaaaauguacug

SEQ ID NO: 2390992 - RNA, 19 nt, Human
cauggugaaaauguacuga

SEQ ID NO: 2390993 - RNA, 21 nt, Human
cauggugaaaauguacugaga

SEQ ID NO: 2390994 - RNA, 18 nt, Human
cauggugccugagaggca

SEQ ID NO: 2390995 - RNA, 19 nt, Human
cauggugccugagaggcag

SEQ ID NO: 2390996 - RNA, 21 nt, Human
cauggugccugagaggcaggc

SEQ ID NO: 2390997 - RNA, 23 nt, Human
cauggucggaaaacaugcuacac

SEQ ID NO: 2390998 - RNA, 15 nt, Human
cauggucacacacug

SEQ ID NO: 2390999 - RNA, 14 nt, Human
cauggucacacacu

SEQ ID NO: 2391000 - RNA, 21 nt, Human
caugguacccccuucugggca

SEQ ID NO: 2391001 - RNA, 11 nt, Human
cauggugaaaa

SEQ ID NO: 2391002 - RNA, 19 nt, Human
caugguggguucaggggac

SEQ ID NO: 2391003 - RNA, 22 nt, Human
caugguggguccaugggcagag

SEQ ID NO: 2391004 - RNA, 21 nt, Human
caugguggguccaugggcaga

SEQ ID NO: 2391005 - RNA, 18 nt, Human
caugguggcgcaagccug

SEQ ID NO: 2391006 - RNA, 17 nt, Human
caugguggcgcaagccu

SEQ ID NO: 2391007 - RNA, 12 nt, Human
caugguggcgca

SEQ ID NO: 2391008 - RNA, 20 nt, Human
caugguggcgcaagccugua

SEQ ID NO: 2391009 - RNA, 14 nt, Human
caugguguaauaag

SEQ ID NO: 2391010 - RNA, 13 nt, Human
caugguguaauaa

SEQ ID NO: 2391011 - RNA, 19 nt, Human
cauggucggaaaacaugcu

SEQ ID NO: 2391012 - RNA, 17 nt, Human
cauggucggaaaacaug

SEQ ID NO: 2391013 - RNA, 18 nt, Human
cauguguaaucaauaaac

SEQ ID NO: 2391014 - RNA, 22 nt, Human
cauguguaaucaauaaacgauu

SEQ ID NO: 2391015 - RNA, 23 nt, Human
cauguguaaucaauaaacgauuu

SEQ ID NO: 2391016 - RNA, 20 nt, Human
caugugcuaguaauuggaaa

SEQ ID NO: 2391017 - RNA, 12 nt, Human
cauguguauguu

SEQ ID NO: 2391018 - RNA, 18 nt, Human
cauguguaugggcaaaaa

SEQ ID NO: 2391019 - RNA, 14 nt, Human
cauguguagccugu

SEQ ID NO: 2391020 - RNA, 20 nt, Human
cauguguacuuaauuucuuu

SEQ ID NO: 2391021 - RNA, 16 nt, Human
cauguguagccugugc

SEQ ID NO: 2391022 - RNA, 18 nt, Human
cauguguagccugugcau

SEQ ID NO: 2391023 - RNA, 22 nt, Human
caugugccagguuuuuggucug

SEQ ID NO: 2391024 - RNA, 14 nt, Human
caugugcacaugca

SEQ ID NO: 2391025 - RNA, 14 nt, Human
caugugccugaucc

SEQ ID NO: 2391026 - RNA, 15 nt, Human
caugugccugaucca

SEQ ID NO: 2391027 - RNA, 19 nt, Human
caugugccugauccagccu

SEQ ID NO: 2391028 - RNA, 20 nt, Human
caugugccugauccagccuc

SEQ ID NO: 2391029 - RNA, 17 nt, Human
caugugcccccucuacc

SEQ ID NO: 2391030 - RNA, 16 nt, Human
caugugccgaaugugc

SEQ ID NO: 2391031 - RNA, 17 nt, Human
caugugugagugugugc

SEQ ID NO: 2391032 - RNA, 16 nt, Human
cauguguuaaguauuu

SEQ ID NO: 2391033 - RNA, 15 nt, Human
caugugugagugugu

SEQ ID NO: 2391034 - RNA, 21 nt, Human
cauguguccugguucccguuu

SEQ ID NO: 2391035 - RNA, 15 nt, Human
cauguguccugguuc

SEQ ID NO: 2391036 - RNA, 19 nt, Human
cauguguuugguucugggg

SEQ ID NO: 2391037 - RNA, 20 nt, Human
cauguguuuuaauuccaaua

SEQ ID NO: 2391038 - RNA, 18 nt, Human
cauguguuggcagccucu

SEQ ID NO: 2391039 - RNA, 18 nt, Human
cauguguuuacuuuaugu

SEQ ID NO: 2391040 - RNA, 10 nt, Human
cauguuucuu

SEQ ID NO: 2391041 - RNA, 21 nt, Human
cauguuuccucuaguucuuug

SEQ ID NO: 2391042 - RNA, 13 nt, Human
cauguuuccucua

SEQ ID NO: 2391043 - RNA, 22 nt, Human
cauguuucauguuuugugacua

SEQ ID NO: 2391044 - RNA, 16 nt, Human
cauguuucauguuuug

SEQ ID NO: 2391045 - RNA, 17 nt, Human
cauguuucauguuuugu

SEQ ID NO: 2391046 - RNA, 14 nt, Human
cauguguugaaaaa

SEQ ID NO: 2391047 - RNA, 13 nt, Human
cauguuucauguu

SEQ ID NO: 2391048 - RNA, 17 nt, Human
caugucucucagaauuc

SEQ ID NO: 2391049 - RNA, 17 nt, Human
caugucuccuauccugg

SEQ ID NO: 2391050 - RNA, 14 nt, Human
caugucugcauuuc

SEQ ID NO: 2391051 - RNA, 14 nt, Human
caugucucgacuca

SEQ ID NO: 2391052 - RNA, 12 nt, Human
caugucuggcua

SEQ ID NO: 2391053 - RNA, 23 nt, Human
caugucugcauuucgguggcuag

SEQ ID NO: 2391054 - RNA, 15 nt, Human
caugucugcauuucg

SEQ ID NO: 2391055 - RNA, 13 nt, Human
caugucuuaauga

SEQ ID NO: 2391056 - RNA, 14 nt, Human
caugucuuaaugaa

SEQ ID NO: 2391057 - RNA, 15 nt, Human
caugucuuaaugaag

SEQ ID NO: 2391058 - RNA, 16 nt, Human
caugucuuaaugaagu

SEQ ID NO: 2391059 - RNA, 17 nt, Human
caugucuuaaugaaguu

SEQ ID NO: 2391060 - RNA, 18 nt, Human
caugucuuaaugaaguuu

SEQ ID NO: 2391061 - RNA, 20 nt, Human
caugucuuaaugaaguuuga

SEQ ID NO: 2391062 - RNA, 23 nt, Human
caugucuuaaugaaguuugaaug

SEQ ID NO: 2391063 - RNA, 21 nt, Human
caugucuuaaugaaguuugaa

SEQ ID NO: 2391064 - RNA, 22 nt, Human
caugucuuaaugaaguuugaau

SEQ ID NO: 2391065 - RNA, 13 nt, Human
caugucuuguaca

SEQ ID NO: 2391066 - RNA, 14 nt, Human
caugucuuguacau

SEQ ID NO: 2391067 - RNA, 15 nt, Human
caugucuuguacaug

SEQ ID NO: 2391068 - RNA, 17 nt, Human
caugucuuguacaugug

SEQ ID NO: 2391069 - RNA, 16 nt, Human
caugugacucugaagc

SEQ ID NO: 2391070 - RNA, 13 nt, Human
caugugacucuga

SEQ ID NO: 2391071 - RNA, 17 nt, Human
caugugacucugaagcu

SEQ ID NO: 2391072 - RNA, 15 nt, Human
caugugaugagagga

SEQ ID NO: 2391073 - RNA, 16 nt, Human
caugugaugagaggaa

SEQ ID NO: 2391074 - RNA, 17 nt, Human
caugugaugagaggaaa

SEQ ID NO: 2391075 - RNA, 18 nt, Human
caugugaugagaggaaau

SEQ ID NO: 2391076 - RNA, 20 nt, Human
caugugaugagaggaaauca

SEQ ID NO: 2391077 - RNA, 22 nt, Human
caugugauccuuuuauguuauu

SEQ ID NO: 2391078 - RNA, 12 nt, Human
caugugauccuu

SEQ ID NO: 2391079 - RNA, 16 nt, Human
caugugauccuuuuau

SEQ ID NO: 2391080 - RNA, 18 nt, Human
caugugauccuuuuaugu

SEQ ID NO: 2391081 - RNA, 19 nt, Human
caugugauccuuuuauguu

SEQ ID NO: 2391082 - RNA, 21 nt, Human
caugugaugagaggaaaucac

SEQ ID NO: 2391083 - RNA, 22 nt, Human
cauuaaaaaaaaaaaaaaaagu

SEQ ID NO: 2391084 - RNA, 13 nt, Human
cauguuuguaaaa

SEQ ID NO: 2391085 - RNA, 17 nt, Human
cauguuuuuguuuucuu

SEQ ID NO: 2391086 - RNA, 20 nt, Human
cauguuuuucuucucccuca

SEQ ID NO: 2391087 - RNA, 19 nt, Human
cauguuuuucuucucccuc

SEQ ID NO: 2391088 - RNA, 13 nt, Human
cauguuucuucau

SEQ ID NO: 2391089 - RNA, 21 nt, Human
cauguuucucuggccccaagg

SEQ ID NO: 2391090 - RNA, 16 nt, Human
cauguuugcugaacac

SEQ ID NO: 2391091 - RNA, 14 nt, Human
cauguuugcuucau

SEQ ID NO: 2391092 - RNA, 14 nt, Human
cauguuugugauug

SEQ ID NO: 2391093 - RNA, 12 nt, Human
cauguuugugau

SEQ ID NO: 2391094 - RNA, 22 nt, Human
cauuaaaacaauauuguuucua

SEQ ID NO: 2391095 - RNA, 21 nt, Human
cauuaaaacaauauuguuucu

SEQ ID NO: 2391096 - RNA, 19 nt, Human
cauuaaaacugaagucuga

SEQ ID NO: 2391097 - RNA, 22 nt, Human
cauuaaaacugaagucugaaau

SEQ ID NO: 2391098 - RNA, 12 nt, Human
cauuaaaacaau

SEQ ID NO: 2391099 - RNA, 23 nt, Human
cauguuuuuguuuucuuugaaug

SEQ ID NO: 2391100 - RNA, 22 nt, Human
cauuaaaaaugcauauacuuua

SEQ ID NO: 2391101 - RNA, 17 nt, Human
cauuaaaagaaaauaaa

SEQ ID NO: 2391102 - RNA, 14 nt, Human
cauuaaaagaaaau

SEQ ID NO: 2391103 - RNA, 13 nt, Human
cauuaaaagaaaa

SEQ ID NO: 2391104 - RNA, 12 nt, Human
cauuaaaagaaa

SEQ ID NO: 2391105 - RNA, 20 nt, Human
cauuaaaagaaaauaaaaaa

SEQ ID NO: 2391106 - RNA, 21 nt, Human
cauuaaaacugaagucugaaa

SEQ ID NO: 2391107 - RNA, 23 nt, Human
cagggaauuucaggaacuagaga

SEQ ID NO: 2391108 - RNA, 15 nt, Human
cagggacaccagcca

SEQ ID NO: 2391109 - RNA, 16 nt, Human
cagggacaccagccag

SEQ ID NO: 2391110 - RNA, 17 nt, Human
cagggacaccagccagg

SEQ ID NO: 2391111 - RNA, 19 nt, Human
cagggacaccagccaggcu

SEQ ID NO: 2391112 - RNA, 20 nt, Human
cagggacaccagccaggcuc

SEQ ID NO: 2391113 - RNA, 21 nt, Human
cagggacaccagccaggcucu

SEQ ID NO: 2391114 - RNA, 22 nt, Human
cagggacaccagccaggcucug

SEQ ID NO: 2391115 - RNA, 23 nt, Human
cagggacaccagccaggcucugu

SEQ ID NO: 2391116 - RNA, 23 nt, Human
cagggacagagacaccugcaccu

SEQ ID NO: 2391117 - RNA, 22 nt, Human
cagggacagagacaccugcacc

SEQ ID NO: 2391118 - RNA, 13 nt, Human
cagggacagagcc

SEQ ID NO: 2391119 - RNA, 14 nt, Human
cagggacagagcca

SEQ ID NO: 2391120 - RNA, 21 nt, Human
cagggacagagacaccugcac

SEQ ID NO: 2391121 - RNA, 20 nt, Human
cagggacagagacaccugca

SEQ ID NO: 2391122 - RNA, 19 nt, Human
cagggacagagacaccugc

SEQ ID NO: 2391123 - RNA, 18 nt, Human
cagggacagagacaccug

SEQ ID NO: 2391124 - RNA, 17 nt, Human
cagggacagagacaccu

SEQ ID NO: 2391125 - RNA, 14 nt, Human
cagggacagagaca

SEQ ID NO: 2391126 - RNA, 13 nt, Human
cagggacagaggg

SEQ ID NO: 2391127 - RNA, 18 nt, Human
cagggacagaggccccag

SEQ ID NO: 2391128 - RNA, 16 nt, Human
cagggacagaggcccc

SEQ ID NO: 2391129 - RNA, 14 nt, Human
cagggacagaggcc

SEQ ID NO: 2391130 - RNA, 15 nt, Human
cagggacagagccau

SEQ ID NO: 2391131 - RNA, 16 nt, Human
cagggacagagccaug

SEQ ID NO: 2391132 - RNA, 14 nt, Human
cagggacagagggg

SEQ ID NO: 2391133 - RNA, 20 nt, Human
cagggacagaggggguggcc

SEQ ID NO: 2391134 - RNA, 13 nt, Human
cagggaagcuggc

SEQ ID NO: 2391135 - RNA, 22 nt, Human
cagggaagcuacagguuacaac

SEQ ID NO: 2391136 - RNA, 24 nt, Human
cagggaagcuacagguuacaacag

SEQ ID NO: 2391137 - RNA, 18 nt, Human
cagggaagcuacagguua

SEQ ID NO: 2391138 - RNA, 19 nt, Human
cagggaagcuacagguuac

SEQ ID NO: 2391139 - RNA, 20 nt, Human
cagggaagcuacagguuaca

SEQ ID NO: 2391140 - RNA, 21 nt, Human
cagggaagcuacagguuacaa

SEQ ID NO: 2391141 - RNA, 17 nt, Human
cagggaagcuggccgag

SEQ ID NO: 2391142 - RNA, 14 nt, Human
cagggaagcuggcc

SEQ ID NO: 2391143 - RNA, 23 nt, Human
cagggaaguccccaggccccagg

SEQ ID NO: 2391144 - RNA, 23 nt, Human
cagggaaugccugagugccuggc

SEQ ID NO: 2391145 - RNA, 21 nt, Human
cagggaaguguaagaaacaca

SEQ ID NO: 2391146 - RNA, 17 nt, Human
cagggaagugcucugau

SEQ ID NO: 2391147 - RNA, 18 nt, Human
cagggaaguccccaggcc

SEQ ID NO: 2391148 - RNA, 17 nt, Human
cagggaaguccccaggc

SEQ ID NO: 2391149 - RNA, 16 nt, Human
cagggaaguccccagg

SEQ ID NO: 2391150 - RNA, 14 nt, Human
cagggaagucccca

SEQ ID NO: 2391151 - RNA, 19 nt, Human
cagggaaggggaggcagcc

SEQ ID NO: 2391152 - RNA, 17 nt, Human
cagggaaggggacaagg

SEQ ID NO: 2391153 - RNA, 15 nt, Human
cagggaaggggacaa

SEQ ID NO: 2391154 - RNA, 21 nt, Human
cagggaaaagcagcucucccc

SEQ ID NO: 2391155 - RNA, 20 nt, Human
cagggaaaagcagcucuccc

SEQ ID NO: 2391156 - RNA, 19 nt, Human
cagggaaaagcagcucucc

SEQ ID NO: 2391157 - RNA, 17 nt, Human
cagggaaaagcagcucu

SEQ ID NO: 2391158 - RNA, 16 nt, Human
cagggaaacagcuaau

SEQ ID NO: 2391159 - RNA, 15 nt, Human
cagggaaaauauaua

SEQ ID NO: 2391160 - RNA, 22 nt, Human
cagggaaacagcuaaugggaca

SEQ ID NO: 2391161 - RNA, 23 nt, Human
cagggaaaggcucugaaagccag

SEQ ID NO: 2391162 - RNA, 14 nt, Human
cagggaaaggcucu

SEQ ID NO: 2391163 - RNA, 15 nt, Human
cagggaaaggccagu

SEQ ID NO: 2391164 - RNA, 20 nt, Human
cagggaaaaugcagcaggga

SEQ ID NO: 2391165 - RNA, 20 nt, Human
cagggaaaauuauuugcaua

SEQ ID NO: 2391166 - RNA, 22 nt, Human
cagggaaccguuauuauaauug

SEQ ID NO: 2391167 - RNA, 23 nt, Human
cagggaaccguuauuauaauugu

SEQ ID NO: 2391168 - RNA, 19 nt, Human
cagggaacccugcuugcac

SEQ ID NO: 2391169 - RNA, 22 nt, Human
cagggaacccugcuugcacuuu

SEQ ID NO: 2391170 - RNA, 14 nt, Human
cagggaagcuacag

SEQ ID NO: 2391171 - RNA, 15 nt, Human
cagggaagcuacagg

SEQ ID NO: 2391172 - RNA, 17 nt, Human
cagggaagcuacagguu

SEQ ID NO: 2391173 - RNA, 22 nt, Human
cagggaagagcagaacggagcc

SEQ ID NO: 2391174 - RNA, 16 nt, Human
cagggaagagaaagug

SEQ ID NO: 2391175 - RNA, 15 nt, Human
cagggaagagcagaa

SEQ ID NO: 2391176 - RNA, 17 nt, Human
cagggaagagcagaacg

SEQ ID NO: 2391177 - RNA, 11 nt, Human
cagggcacugc

SEQ ID NO: 2391178 - RNA, 15 nt, Human
cagggcacugcugcu

SEQ ID NO: 2391179 - RNA, 14 nt, Human
cagggcacuucaca

SEQ ID NO: 2391180 - RNA, 17 nt, Human
cagggcacuucacagag

SEQ ID NO: 2391181 - RNA, 18 nt, Human
cagggcacuucacagagu

SEQ ID NO: 2391182 - RNA, 15 nt, Human
cagggcagagccggg

SEQ ID NO: 2391183 - RNA, 12 nt, Human
cagggcagagcc

SEQ ID NO: 2391184 - RNA, 16 nt, Human
cagggcagagccggga

SEQ ID NO: 2391185 - RNA, 13 nt, Human
cagggcagaguga

SEQ ID NO: 2391186 - RNA, 20 nt, Human
cagggcacuucacagagugu

SEQ ID NO: 2391187 - RNA, 19 nt, Human
cagggcagagugagaccca

SEQ ID NO: 2391188 - RNA, 13 nt, Human
cagggcagcgcca

SEQ ID NO: 2391189 - RNA, 15 nt, Human
cagggcagcgccagg

SEQ ID NO: 2391190 - RNA, 14 nt, Human
cagggcagcgccag

SEQ ID NO: 2391191 - RNA, 22 nt, Human
cagggcagcgccaggcugacca

SEQ ID NO: 2391192 - RNA, 14 nt, Human
cagggcagcugggc

SEQ ID NO: 2391193 - RNA, 15 nt, Human
cagggcagcugggcc

SEQ ID NO: 2391194 - RNA, 16 nt, Human
cagggcagcugggccc

SEQ ID NO: 2391195 - RNA, 17 nt, Human
cagggcagcugggccca

SEQ ID NO: 2391196 - RNA, 18 nt, Human
cagggcagcugggcccaa

SEQ ID NO: 2391197 - RNA, 20 nt, Human
cagggcagcugggcccaacc

SEQ ID NO: 2391198 - RNA, 19 nt, Human
cagggcagcgccaggcuga

SEQ ID NO: 2391199 - RNA, 18 nt, Human
cagggcagcgccaggcug

SEQ ID NO: 2391200 - RNA, 17 nt, Human
cagggcagcgccaggcu

SEQ ID NO: 2391201 - RNA, 16 nt, Human
cagggcagcgccaggc

SEQ ID NO: 2391202 - RNA, 22 nt, Human
cagggcacaccgggcacucaga

SEQ ID NO: 2391203 - RNA, 23 nt, Human
cagggcacaccgggcacucagaa

SEQ ID NO: 2391204 - RNA, 15 nt, Human
cagggcacaccgggc

SEQ ID NO: 2391205 - RNA, 17 nt, Human
cagggcacaccgggcac

SEQ ID NO: 2391206 - RNA, 19 nt, Human
cagggcacaccgggcacuc

SEQ ID NO: 2391207 - RNA, 21 nt, Human
cagggcacaccgggcacucag

SEQ ID NO: 2391208 - RNA, 13 nt, Human
cagggauuugagg

SEQ ID NO: 2391209 - RNA, 16 nt, Human
cagggauugcugccac

SEQ ID NO: 2391210 - RNA, 14 nt, Human
cagggauuugagga

SEQ ID NO: 2391211 - RNA, 20 nt, Human
cagggauuaaccucugcacu

SEQ ID NO: 2391212 - RNA, 18 nt, Human
cagggauuaaccucugca

SEQ ID NO: 2391213 - RNA, 19 nt, Human
cagggauuaaccucugcac

SEQ ID NO: 2391214 - RNA, 18 nt, Human
cagggauguacaaggcga

SEQ ID NO: 2391215 - RNA, 17 nt, Human
cagggauuaaccucugc

SEQ ID NO: 2391216 - RNA, 12 nt, Human
cagggagaagcu

SEQ ID NO: 2391217 - RNA, 15 nt, Human
cagggacuugaaguu

SEQ ID NO: 2391218 - RNA, 19 nt, Human
cagggacuugaaguuguua

SEQ ID NO: 2391219 - RNA, 14 nt, Human
cagggacuugaagu

SEQ ID NO: 2391220 - RNA, 18 nt, Human
cagggacuguuccugucu

SEQ ID NO: 2391221 - RNA, 23 nt, Human
cagggacuguuccugucucagca

SEQ ID NO: 2391222 - RNA, 18 nt, Human
cagggcaaugaugaauga

SEQ ID NO: 2391223 - RNA, 14 nt, Human
cagggcacaccggg

SEQ ID NO: 2391224 - RNA, 21 nt, Human
cagggaccuuuggagaccauu

SEQ ID NO: 2391225 - RNA, 21 nt, Human
cagggacuaugaaugggcaaa

SEQ ID NO: 2391226 - RNA, 23 nt, Human
cagggacugaaaaccucuccuca

SEQ ID NO: 2391227 - RNA, 21 nt, Human
cagggacugaaaaccucuccu

SEQ ID NO: 2391228 - RNA, 20 nt, Human
cagggacugaaaaccucucc

SEQ ID NO: 2391229 - RNA, 19 nt, Human
cagggaccaaggaccccuc

SEQ ID NO: 2391230 - RNA, 13 nt, Human
cagggaccacagc

SEQ ID NO: 2391231 - RNA, 14 nt, Human
cagggaccacagca

SEQ ID NO: 2391232 - RNA, 15 nt, Human
cagggaccacagcaa

SEQ ID NO: 2391233 - RNA, 22 nt, Human
cagggacccacuucacacacag

SEQ ID NO: 2391234 - RNA, 17 nt, Human
cagggaccacagcaagg

SEQ ID NO: 2391235 - RNA, 20 nt, Human
cagggaccacagcaaggcac

SEQ ID NO: 2391236 - RNA, 16 nt, Human
cagggaccccugcccu

SEQ ID NO: 2391237 - RNA, 15 nt, Human
cagggaccccugccc

SEQ ID NO: 2391238 - RNA, 14 nt, Human
cagggaccccugcc

SEQ ID NO: 2391239 - RNA, 18 nt, Human
cagggaccaaggaccccu

SEQ ID NO: 2391240 - RNA, 15 nt, Human
cagggaccaaggacc

SEQ ID NO: 2391241 - RNA, 14 nt, Human
cagggaccaaggac

SEQ ID NO: 2391242 - RNA, 17 nt, Human
cagggacagagccaugc

SEQ ID NO: 2391243 - RNA, 16 nt, Human
cagggaccacacccug

SEQ ID NO: 2391244 - RNA, 22 nt, Human
cagggaccacacccuguacugu

SEQ ID NO: 2391245 - RNA, 18 nt, Human
cagggacaggauaagagg

SEQ ID NO: 2391246 - RNA, 23 nt, Human
cagggacagaggggguggccucc

SEQ ID NO: 2391247 - RNA, 23 nt, Human
cagggacagaggccccagccucc

SEQ ID NO: 2391248 - RNA, 12 nt, Human
cagggacaggau

SEQ ID NO: 2391249 - RNA, 21 nt, Human
cagggacagaggccccagccu

SEQ ID NO: 2391250 - RNA, 19 nt, Human
cagggacagaggccccagc

SEQ ID NO: 2391251 - RNA, 14 nt, Human
cagggcccugcaga

SEQ ID NO: 2391252 - RNA, 13 nt, Human
cagggcccugcag

SEQ ID NO: 2391253 - RNA, 21 nt, Human
cagggcccugagcucggugga

SEQ ID NO: 2391254 - RNA, 15 nt, Human
cagggcccugagcuc

SEQ ID NO: 2391255 - RNA, 18 nt, Human
cagggcccugcagagggg

SEQ ID NO: 2391256 - RNA, 15 nt, Human
cagggcccugcagag

SEQ ID NO: 2391257 - RNA, 12 nt, Human
cagggccuggaa

SEQ ID NO: 2391258 - RNA, 22 nt, Human
cagggccugcaggaccugccug

SEQ ID NO: 2391259 - RNA, 22 nt, Human
cagggccugagccuggccagcc

SEQ ID NO: 2391260 - RNA, 21 nt, Human
cagggccugagccuggccagc

SEQ ID NO: 2391261 - RNA, 20 nt, Human
cagggccugagccuggccag

SEQ ID NO: 2391262 - RNA, 19 nt, Human
cagggccugagccuggcca

SEQ ID NO: 2391263 - RNA, 18 nt, Human
cagggccugagccuggcc

SEQ ID NO: 2391264 - RNA, 17 nt, Human
cagggccugagccuggc

SEQ ID NO: 2391265 - RNA, 16 nt, Human
cagggccugagccugg

SEQ ID NO: 2391266 - RNA, 19 nt, Human
cagggccuagcugcuacaa

SEQ ID NO: 2391267 - RNA, 20 nt, Human
cagggccuagcugcuacaaa

SEQ ID NO: 2391268 - RNA, 21 nt, Human
cagggccuagcugcuacaaag

SEQ ID NO: 2391269 - RNA, 22 nt, Human
cagggccuagcugcuacaaaga

SEQ ID NO: 2391270 - RNA, 23 nt, Human
cagggccuagcugcuacaaagaa

SEQ ID NO: 2391271 - RNA, 16 nt, Human
cagggccucacacggu

SEQ ID NO: 2391272 - RNA, 21 nt, Human
cagggccccagaaggcaggga

SEQ ID NO: 2391273 - RNA, 21 nt, Human
cagggccccucacccugccuu

SEQ ID NO: 2391274 - RNA, 22 nt, Human
cagggccccucacccugccuua

SEQ ID NO: 2391275 - RNA, 21 nt, Human
cagggcccccaucucaugccc

SEQ ID NO: 2391276 - RNA, 18 nt, Human
cagggccccucacccugc

SEQ ID NO: 2391277 - RNA, 16 nt, Human
cagggcccccaucuca

SEQ ID NO: 2391278 - RNA, 15 nt, Human
cagggcccccaucuc

SEQ ID NO: 2391279 - RNA, 15 nt, Human
cagggccccagcacu

SEQ ID NO: 2391280 - RNA, 14 nt, Human
cagggccccagcac

SEQ ID NO: 2391281 - RNA, 17 nt, Human
cagggccccagaaggca

SEQ ID NO: 2391282 - RNA, 15 nt, Human
cagggccccagaagg

SEQ ID NO: 2391283 - RNA, 13 nt, Human
cagggccccagaa

SEQ ID NO: 2391284 - RNA, 17 nt, Human
cagggcccacacccccu

SEQ ID NO: 2391285 - RNA, 22 nt, Human
cagggccccagcacuaaagcag

SEQ ID NO: 2391286 - RNA, 16 nt, Human
cagggccccagcacua

SEQ ID NO: 2391287 - RNA, 21 nt, Human
cagggcccccagcgagagucc

SEQ ID NO: 2391288 - RNA, 20 nt, Human
cagggccccaggcauugcca

SEQ ID NO: 2391289 - RNA, 22 nt, Human
cagggcccagagcccagcucca

SEQ ID NO: 2391290 - RNA, 21 nt, Human
cagggcccagagcccagcucc

SEQ ID NO: 2391291 - RNA, 19 nt, Human
cagggcccagagcccagcu

SEQ ID NO: 2391292 - RNA, 18 nt, Human
cagggcccagagcccagc

SEQ ID NO: 2391293 - RNA, 16 nt, Human
cagggcccagagccca

SEQ ID NO: 2391294 - RNA, 15 nt, Human
cagggcccagagccc

SEQ ID NO: 2391295 - RNA, 14 nt, Human
cagggcccagagcc

SEQ ID NO: 2391296 - RNA, 13 nt, Human
cagggcccagagc

SEQ ID NO: 2391297 - RNA, 12 nt, Human
cagggcccagag

SEQ ID NO: 2391298 - RNA, 17 nt, Human
cagggcccaagucccug

SEQ ID NO: 2391299 - RNA, 18 nt, Human
cagggcccaagucccugu

SEQ ID NO: 2391300 - RNA, 19 nt, Human
cagggcccaagucccuguu

SEQ ID NO: 2391301 - RNA, 14 nt, Human
cagggcccacaccc

SEQ ID NO: 2391302 - RNA, 23 nt, Human
cagggccaugcugaggccugggc

SEQ ID NO: 2391303 - RNA, 22 nt, Human
cagggccaugcugaggccuggg

SEQ ID NO: 2391304 - RNA, 13 nt, Human
cagggccaacccu

SEQ ID NO: 2391305 - RNA, 22 nt, Human
cagggcaugccccggccaccuc

SEQ ID NO: 2391306 - RNA, 23 nt, Human
cagggcaugccccggccaccucu

SEQ ID NO: 2391307 - RNA, 20 nt, Human
cagggcauggccagguggcc

SEQ ID NO: 2391308 - RNA, 17 nt, Human
cagggcauggcugggaa

SEQ ID NO: 2391309 - RNA, 19 nt, Human
cagggcaugcauuuugcag

SEQ ID NO: 2391310 - RNA, 15 nt, Human
cagggcaugccacgu

SEQ ID NO: 2391311 - RNA, 18 nt, Human
cagggcaugccccggcca

SEQ ID NO: 2391312 - RNA, 21 nt, Human
cagggcaugccccggccaccu

SEQ ID NO: 2391313 - RNA, 14 nt, Human
cagggcaucuccug

SEQ ID NO: 2391314 - RNA, 13 nt, Human
cagggcaucuccu

SEQ ID NO: 2391315 - RNA, 15 nt, Human
cagggcaucuccugu

SEQ ID NO: 2391316 - RNA, 16 nt, Human
cagggcaucuccagga

SEQ ID NO: 2391317 - RNA, 17 nt, Human
cagggcaucuccaggaa

SEQ ID NO: 2391318 - RNA, 18 nt, Human
cagggcaucuccaggaag

SEQ ID NO: 2391319 - RNA, 21 nt, Human
cagggcaucuccaggaaggcg

SEQ ID NO: 2391320 - RNA, 17 nt, Human
cagggcagggcucugau

SEQ ID NO: 2391321 - RNA, 21 nt, Human
cagggcagucauuggcugucu

SEQ ID NO: 2391322 - RNA, 15 nt, Human
cagggcaucuccagg

SEQ ID NO: 2391323 - RNA, 19 nt, Human
cagggcagggcucugauau

SEQ ID NO: 2391324 - RNA, 16 nt, Human
cagggcagggcucuga

SEQ ID NO: 2391325 - RNA, 15 nt, Human
cagggcagggcucug

SEQ ID NO: 2391326 - RNA, 13 nt, Human
cagggcagggcca

SEQ ID NO: 2391327 - RNA, 13 nt, Human
cagggcagggccc

SEQ ID NO: 2391328 - RNA, 21 nt, Human
cagggcagcugggcccaaccc

SEQ ID NO: 2391329 - RNA, 22 nt, Human
cagggcagcugggcccaacccu

SEQ ID NO: 2391330 - RNA, 18 nt, Human
cagggccaacccuucucc

SEQ ID NO: 2391331 - RNA, 17 nt, Human
cagggccaacuugaggg

SEQ ID NO: 2391332 - RNA, 19 nt, Human
cagggccaacuugagggcc

SEQ ID NO: 2391333 - RNA, 22 nt, Human
cagggccaacuugagggcccag

SEQ ID NO: 2391334 - RNA, 17 nt, Human
cagggccacgugccagg

SEQ ID NO: 2391335 - RNA, 16 nt, Human
cagggccacgugccag

SEQ ID NO: 2391336 - RNA, 15 nt, Human
cagggccacgugcca

SEQ ID NO: 2391337 - RNA, 17 nt, Human
cagggccacucugccuc

SEQ ID NO: 2391338 - RNA, 16 nt, Human
cagggccacucugccu

SEQ ID NO: 2391339 - RNA, 12 nt, Human
cagggccacucu

SEQ ID NO: 2391340 - RNA, 19 nt, Human
cagggccacucccggcacu

SEQ ID NO: 2391341 - RNA, 21 nt, Human
cagggccacgugccaggcccg

SEQ ID NO: 2391342 - RNA, 13 nt, Human
cagggccacuccc

SEQ ID NO: 2391343 - RNA, 20 nt, Human
cagggccacgugccaggccc

SEQ ID NO: 2391344 - RNA, 18 nt, Human
cagggccacgugccaggc

SEQ ID NO: 2391345 - RNA, 20 nt, Human
cagggccacucugccucugc

SEQ ID NO: 2391346 - RNA, 18 nt, Human
cagggccacucugccucu

SEQ ID NO: 2391347 - RNA, 12 nt, Human
cagggccaggac

SEQ ID NO: 2391348 - RNA, 13 nt, Human
cagggccaggacu

SEQ ID NO: 2391349 - RNA, 19 nt, Human
cagggccagggcccugcag

SEQ ID NO: 2391350 - RNA, 18 nt, Human
cagggccagggcccugca

SEQ ID NO: 2391351 - RNA, 16 nt, Human
cagggccagggcccug

SEQ ID NO: 2391352 - RNA, 15 nt, Human
cagggccagggcccu

SEQ ID NO: 2391353 - RNA, 13 nt, Human
cagggccagggcc

SEQ ID NO: 2391354 - RNA, 12 nt, Human
cagggccagggc

SEQ ID NO: 2391355 - RNA, 14 nt, Human
cagggccaggacug

SEQ ID NO: 2391356 - RNA, 15 nt, Human
cagggccaggacuga

SEQ ID NO: 2391357 - RNA, 18 nt, Human
cagggccaggacugagcc

SEQ ID NO: 2391358 - RNA, 20 nt, Human
cagggccaggacugagcccc

SEQ ID NO: 2391359 - RNA, 14 nt, Human
cagggccaugcuga

SEQ ID NO: 2391360 - RNA, 16 nt, Human
cagggccaugccugcc

SEQ ID NO: 2391361 - RNA, 17 nt, Human
cagggccaugccugccc

SEQ ID NO: 2391362 - RNA, 16 nt, Human
cagggccaugcugagg

SEQ ID NO: 2391363 - RNA, 17 nt, Human
cagggccaugcugaggc

SEQ ID NO: 2391364 - RNA, 18 nt, Human
cagggccaugcugaggcc

SEQ ID NO: 2391365 - RNA, 21 nt, Human
cagggccaugcugaggccugg

SEQ ID NO: 2391366 - RNA, 14 nt, Human
caggggccagagga

SEQ ID NO: 2391367 - RNA, 21 nt, Human
caggggcauguauuggccugg

SEQ ID NO: 2391368 - RNA, 22 nt, Human
caggggcauguauuggccugga

SEQ ID NO: 2391369 - RNA, 23 nt, Human
caggggcauguauuggccuggag

SEQ ID NO: 2391370 - RNA, 15 nt, Human
caggggccagaggaa

SEQ ID NO: 2391371 - RNA, 20 nt, Human
caggggcccaaggcggcccc

SEQ ID NO: 2391372 - RNA, 21 nt, Human
caggggcccaaggcggccccu

SEQ ID NO: 2391373 - RNA, 13 nt, Human
caggggcaggcac

SEQ ID NO: 2391374 - RNA, 14 nt, Human
caggggcaggcaca

SEQ ID NO: 2391375 - RNA, 15 nt, Human
caggggcaggcacag

SEQ ID NO: 2391376 - RNA, 16 nt, Human
caggggcaggcacagc

SEQ ID NO: 2391377 - RNA, 17 nt, Human
caggggcaggcacagca

SEQ ID NO: 2391378 - RNA, 22 nt, Human
caggggcaggcacagcacaggg

SEQ ID NO: 2391379 - RNA, 20 nt, Human
caggggcauguauuggccug

SEQ ID NO: 2391380 - RNA, 19 nt, Human
caggggccccuccagcuug

SEQ ID NO: 2391381 - RNA, 20 nt, Human
caggggccccuccagcuugu

SEQ ID NO: 2391382 - RNA, 22 nt, Human
caggggcccaaggcggccccuc

SEQ ID NO: 2391383 - RNA, 16 nt, Human
caggggcccacaggga

SEQ ID NO: 2391384 - RNA, 11 nt, Human
caggggccccg

SEQ ID NO: 2391385 - RNA, 13 nt, Human
caggggccccucc

SEQ ID NO: 2391386 - RNA, 15 nt, Human
caggggccccuccag

SEQ ID NO: 2391387 - RNA, 16 nt, Human
caggggccccuccagc

SEQ ID NO: 2391388 - RNA, 17 nt, Human
caggggccccuccagcu

SEQ ID NO: 2391389 - RNA, 18 nt, Human
caggggccccuccagcuu

SEQ ID NO: 2391390 - RNA, 19 nt, Human
caggggaggguagagcgga

SEQ ID NO: 2391391 - RNA, 20 nt, Human
caggggauugaagcccucca

SEQ ID NO: 2391392 - RNA, 14 nt, Human
caggggcaggagga

SEQ ID NO: 2391393 - RNA, 18 nt, Human
caggggagucccgucagg

SEQ ID NO: 2391394 - RNA, 16 nt, Human
caggggauggcguggu

SEQ ID NO: 2391395 - RNA, 22 nt, Human
caggggauggcguggucaagca

SEQ ID NO: 2391396 - RNA, 14 nt, Human
caggggauugaagc

SEQ ID NO: 2391397 - RNA, 17 nt, Human
caggggauugaagcccu

SEQ ID NO: 2391398 - RNA, 19 nt, Human
caggggcuggcuucaggag

SEQ ID NO: 2391399 - RNA, 15 nt, Human
caggggcuggcuuca

SEQ ID NO: 2391400 - RNA, 17 nt, Human
caggggcuggcuucagg

SEQ ID NO: 2391401 - RNA, 22 nt, Human
caggggcugcuuccuccuggaa

SEQ ID NO: 2391402 - RNA, 12 nt, Human
caggggcuggcu

SEQ ID NO: 2391403 - RNA, 13 nt, Human
caggggcuggcuu

SEQ ID NO: 2391404 - RNA, 16 nt, Human
caggggcugcuuccuc

SEQ ID NO: 2391405 - RNA, 18 nt, Human
caggggcugcuuccuccu

SEQ ID NO: 2391406 - RNA, 19 nt, Human
caggggcugcuuccuccug

SEQ ID NO: 2391407 - RNA, 20 nt, Human
caggggcugcuuccuccugg

SEQ ID NO: 2391408 - RNA, 13 nt, Human
caggggcugcuuc

SEQ ID NO: 2391409 - RNA, 19 nt, Human
caggggcugcccgcuccca

SEQ ID NO: 2391410 - RNA, 20 nt, Human
caggggcugcccgcucccag

SEQ ID NO: 2391411 - RNA, 13 nt, Human
caggggcugcccg

SEQ ID NO: 2391412 - RNA, 14 nt, Human
caggggcugcccgc

SEQ ID NO: 2391413 - RNA, 16 nt, Human
caggggcugcccgcuc

SEQ ID NO: 2391414 - RNA, 18 nt, Human
caggggcugcccgcuccc

SEQ ID NO: 2391415 - RNA, 15 nt, Human
caggggcucuggaga

SEQ ID NO: 2391416 - RNA, 16 nt, Human
caggggcucuggagag

SEQ ID NO: 2391417 - RNA, 17 nt, Human
caggggcucuggagaga

SEQ ID NO: 2391418 - RNA, 18 nt, Human
caggggcucuggagagaa

SEQ ID NO: 2391419 - RNA, 20 nt, Human
caggggcucuggagagaaac

SEQ ID NO: 2391420 - RNA, 19 nt, Human
caggggcucuggagagaaa

SEQ ID NO: 2391421 - RNA, 12 nt, Human
caggggcugccc

SEQ ID NO: 2391422 - RNA, 18 nt, Human
caggggcguguggcucac

SEQ ID NO: 2391423 - RNA, 15 nt, Human
caggggcguggaggg

SEQ ID NO: 2391424 - RNA, 17 nt, Human
caggggcuacaagaggg

SEQ ID NO: 2391425 - RNA, 18 nt, Human
caggggcuacaagaggga

SEQ ID NO: 2391426 - RNA, 23 nt, Human
caggggccuggagauccuccugc

SEQ ID NO: 2391427 - RNA, 19 nt, Human
caggggcuacaagagggaa

SEQ ID NO: 2391428 - RNA, 13 nt, Human
caggggcucugga

SEQ ID NO: 2391429 - RNA, 14 nt, Human
caggggcucuggag

SEQ ID NO: 2391430 - RNA, 12 nt, Human
caggggccugga

SEQ ID NO: 2391431 - RNA, 13 nt, Human
caggggccuggag

SEQ ID NO: 2391432 - RNA, 14 nt, Human
caggggccuggaga

SEQ ID NO: 2391433 - RNA, 15 nt, Human
caggggccuggagau

SEQ ID NO: 2391434 - RNA, 22 nt, Human
caggggccuggagauccuccug

SEQ ID NO: 2391435 - RNA, 14 nt, Human
cagggccuugccca

SEQ ID NO: 2391436 - RNA, 13 nt, Human
cagggccuugccc

SEQ ID NO: 2391437 - RNA, 22 nt, Human
cagggccuggggagauggagga

SEQ ID NO: 2391438 - RNA, 16 nt, Human
cagggccuggcucagg

SEQ ID NO: 2391439 - RNA, 19 nt, Human
cagggccuggcucaggugg

SEQ ID NO: 2391440 - RNA, 17 nt, Human
cagggccuggaagacag

SEQ ID NO: 2391441 - RNA, 18 nt, Human
cagggccuggaagacaga

SEQ ID NO: 2391442 - RNA, 19 nt, Human
cagggccuggaagacagag

SEQ ID NO: 2391443 - RNA, 13 nt, Human
cagggccuggcuc

SEQ ID NO: 2391444 - RNA, 14 nt, Human
cagggccuggcuca

SEQ ID NO: 2391445 - RNA, 15 nt, Human
cagggccuggcucag

SEQ ID NO: 2391446 - RNA, 24 nt, Human
cagggccuugcccagagaugccuc

SEQ ID NO: 2391447 - RNA, 20 nt, Human
cagggccuugcccagagaug

SEQ ID NO: 2391448 - RNA, 19 nt, Human
cagggccuugcccagagau

SEQ ID NO: 2391449 - RNA, 18 nt, Human
cagggccuugcccagaga

SEQ ID NO: 2391450 - RNA, 17 nt, Human
cagggccuugcccagag

SEQ ID NO: 2391451 - RNA, 16 nt, Human
cagggccuugcccaga

SEQ ID NO: 2391452 - RNA, 15 nt, Human
cagggccuugcccag

SEQ ID NO: 2391453 - RNA, 13 nt, Human
cagggcgagacuc

SEQ ID NO: 2391454 - RNA, 11 nt, Human
caggggacagg

SEQ ID NO: 2391455 - RNA, 16 nt, Human
caggggacaggauggu

SEQ ID NO: 2391456 - RNA, 21 nt, Human
caggggacucagcccugaggu

SEQ ID NO: 2391457 - RNA, 20 nt, Human
caggggacucagcccugagg

SEQ ID NO: 2391458 - RNA, 18 nt, Human
caggggacucagcccuga

SEQ ID NO: 2391459 - RNA, 17 nt, Human
caggggacucagcccug

SEQ ID NO: 2391460 - RNA, 15 nt, Human
caggggacucagccc

SEQ ID NO: 2391461 - RNA, 17 nt, Human
caggggaccacaccucc

SEQ ID NO: 2391462 - RNA, 15 nt, Human
caggggaccacaccu

SEQ ID NO: 2391463 - RNA, 16 nt, Human
caggggacaggagucc

SEQ ID NO: 2391464 - RNA, 22 nt, Human
caggggacaggaguccacuuug

SEQ ID NO: 2391465 - RNA, 21 nt, Human
caggggagagggucuggagaa

SEQ ID NO: 2391466 - RNA, 20 nt, Human
caggggagagggucuggaga

SEQ ID NO: 2391467 - RNA, 23 nt, Human
caggggacucagcccugagguga

SEQ ID NO: 2391468 - RNA, 17 nt, Human
caggggagagggucugg

SEQ ID NO: 2391469 - RNA, 21 nt, Human
caggggagcccuccacgccgg

SEQ ID NO: 2391470 - RNA, 13 nt, Human
caggggagcccuc

SEQ ID NO: 2391471 - RNA, 15 nt, Human
caggggagcccucca

SEQ ID NO: 2391472 - RNA, 12 nt, Human
caggggagcccu

SEQ ID NO: 2391473 - RNA, 13 nt, Human
cagggggccaggu

SEQ ID NO: 2391474 - RNA, 16 nt, Human
cagggggccaggugca

SEQ ID NO: 2391475 - RNA, 22 nt, Human
cagggggccagucccugaggca

SEQ ID NO: 2391476 - RNA, 11 nt, Human
cagggggccag

SEQ ID NO: 2391477 - RNA, 18 nt, Human
cagggggacuagccccug

SEQ ID NO: 2391478 - RNA, 19 nt, Human
cagggggaagguggggucc

SEQ ID NO: 2391479 - RNA, 12 nt, Human
caggggcuguuu

SEQ ID NO: 2391480 - RNA, 15 nt, Human
caggggcuguuugag

SEQ ID NO: 2391481 - RNA, 19 nt, Human
cagggggccaggugcacag

SEQ ID NO: 2391482 - RNA, 20 nt, Human
cagggggcccaccagagcug

SEQ ID NO: 2391483 - RNA, 21 nt, Human
cagggggcccaccagagcugu

SEQ ID NO: 2391484 - RNA, 15 nt, Human
caggggggugaggag

SEQ ID NO: 2391485 - RNA, 19 nt, Human
caggggggugaggagcugg

SEQ ID NO: 2391486 - RNA, 18 nt, Human
caggggggugaggagcug

SEQ ID NO: 2391487 - RNA, 19 nt, Human
cagggggguugugaggccu

SEQ ID NO: 2391488 - RNA, 20 nt, Human
cagggggguugugaggccug

SEQ ID NO: 2391489 - RNA, 20 nt, Human
caggggugcccccuccucuc

SEQ ID NO: 2391490 - RNA, 14 nt, Human
caggcucucaacag

SEQ ID NO: 2391491 - RNA, 13 nt, Human
caggcucucaaca

SEQ ID NO: 2391492 - RNA, 23 nt, Human
caggcucugcccugcccuagcuc

SEQ ID NO: 2391493 - RNA, 22 nt, Human
caggcucugcccugcccuagcu

SEQ ID NO: 2391494 - RNA, 21 nt, Human
caggcucugcccugcccuagc

SEQ ID NO: 2391495 - RNA, 15 nt, Human
caggcucugcccugc

SEQ ID NO: 2391496 - RNA, 13 nt, Human
caggcucugcccu

SEQ ID NO: 2391497 - RNA, 14 nt, Human
caggcucugcccug

SEQ ID NO: 2391498 - RNA, 21 nt, Human
caggcucucaggccagcugcu

SEQ ID NO: 2391499 - RNA, 23 nt, Human
caggcucucaggccagcugcuug

SEQ ID NO: 2391500 - RNA, 17 nt, Human
caggcucucaggccagc

SEQ ID NO: 2391501 - RNA, 18 nt, Human
caggcucucaggccagcu

SEQ ID NO: 2391502 - RNA, 19 nt, Human
caggcucucaggccagcug

SEQ ID NO: 2391503 - RNA, 20 nt, Human
caggcucucaggccagcugc

SEQ ID NO: 2391504 - RNA, 20 nt, Human
caggcuccuuccugucuucc

SEQ ID NO: 2391505 - RNA, 18 nt, Human
caggcuccuuccugucuu

SEQ ID NO: 2391506 - RNA, 21 nt, Human
caggcuccuuccugucuuccu

SEQ ID NO: 2391507 - RNA, 21 nt, Human
caggcuccuuuagcgcccagu

SEQ ID NO: 2391508 - RNA, 20 nt, Human
caggcucgggcuccccagcc

SEQ ID NO: 2391509 - RNA, 12 nt, Human
caggcucucagg

SEQ ID NO: 2391510 - RNA, 13 nt, Human
caggcucucaggc

SEQ ID NO: 2391511 - RNA, 14 nt, Human
caggcucucaggcc

SEQ ID NO: 2391512 - RNA, 15 nt, Human
caggcucucaggcca

SEQ ID NO: 2391513 - RNA, 16 nt, Human
caggcucucaggccag

SEQ ID NO: 2391514 - RNA, 23 nt, Human
caggccgccccagccucugagcc

SEQ ID NO: 2391515 - RNA, 14 nt, Human
caggccgcccugcg

SEQ ID NO: 2391516 - RNA, 14 nt, Human
caggcuacugucag

SEQ ID NO: 2391517 - RNA, 13 nt, Human
caggcuagaugua

SEQ ID NO: 2391518 - RNA, 19 nt, Human
caggcuagauguauguacu

SEQ ID NO: 2391519 - RNA, 15 nt, Human
caggcuagaaccugg

SEQ ID NO: 2391520 - RNA, 19 nt, Human
caggccggcgagcccugug

SEQ ID NO: 2391521 - RNA, 16 nt, Human
caggcuagagugcagu

SEQ ID NO: 2391522 - RNA, 13 nt, Human
caggcucacugcc

SEQ ID NO: 2391523 - RNA, 14 nt, Human
caggcucacugcca

SEQ ID NO: 2391524 - RNA, 15 nt, Human
caggcucacugccag

SEQ ID NO: 2391525 - RNA, 16 nt, Human
caggcucacugccagg

SEQ ID NO: 2391526 - RNA, 23 nt, Human
caggcucacugccaggccagccu

SEQ ID NO: 2391527 - RNA, 18 nt, Human
caggcucacugccaggcc

SEQ ID NO: 2391528 - RNA, 20 nt, Human
caggcucacugccaggccag

SEQ ID NO: 2391529 - RNA, 21 nt, Human
caggcucacugccaggccagc

SEQ ID NO: 2391530 - RNA, 22 nt, Human
caggcucacugccaggccagcc

SEQ ID NO: 2391531 - RNA, 14 nt, Human
caggcuccuuuagc

SEQ ID NO: 2391532 - RNA, 17 nt, Human
caggcuccuuccugucu

SEQ ID NO: 2391533 - RNA, 14 nt, Human
caggcuccuuccug

SEQ ID NO: 2391534 - RNA, 13 nt, Human
caggcuccuuccu

SEQ ID NO: 2391535 - RNA, 12 nt, Human
caggcuccuucc

SEQ ID NO: 2391536 - RNA, 18 nt, Human
caggcuccugccaccacg

SEQ ID NO: 2391537 - RNA, 19 nt, Human
caggcuccuuuagcgccca

SEQ ID NO: 2391538 - RNA, 20 nt, Human
caggcuccuuuagcgcccag

SEQ ID NO: 2391539 - RNA, 22 nt, Human
caggcucauagggaagaccugc

SEQ ID NO: 2391540 - RNA, 16 nt, Human
caggcuccugccacca

SEQ ID NO: 2391541 - RNA, 15 nt, Human
caggcuccugccacc

SEQ ID NO: 2391542 - RNA, 14 nt, Human
caggcuccugccac

SEQ ID NO: 2391543 - RNA, 13 nt, Human
caggcuccugcca

SEQ ID NO: 2391544 - RNA, 21 nt, Human
caggccgccccagccucugag

SEQ ID NO: 2391545 - RNA, 20 nt, Human
caggccgccccagccucuga

SEQ ID NO: 2391546 - RNA, 18 nt, Human
caggccgccccagccucu

SEQ ID NO: 2391547 - RNA, 16 nt, Human
caggccgccccagccu

SEQ ID NO: 2391548 - RNA, 14 nt, Human
caggccgccccagc

SEQ ID NO: 2391549 - RNA, 22 nt, Human
caggccgcagcucuugcccuuc

SEQ ID NO: 2391550 - RNA, 15 nt, Human
caggccgcagcucuu

SEQ ID NO: 2391551 - RNA, 18 nt, Human
caggccgcagcucuugcc

SEQ ID NO: 2391552 - RNA, 22 nt, Human
caggcccugcacuguccugcuc

SEQ ID NO: 2391553 - RNA, 17 nt, Human
caggcccuuuccucagg

SEQ ID NO: 2391554 - RNA, 16 nt, Human
caggcccuuuccucag

SEQ ID NO: 2391555 - RNA, 18 nt, Human
caggccgagaagccagug

SEQ ID NO: 2391556 - RNA, 13 nt, Human
caggccgcagcuc

SEQ ID NO: 2391557 - RNA, 14 nt, Human
caggccgcagcucu

SEQ ID NO: 2391558 - RNA, 19 nt, Human
caggcccuuccucuccacu

SEQ ID NO: 2391559 - RNA, 20 nt, Human
caggcccuuccucuccacug

SEQ ID NO: 2391560 - RNA, 21 nt, Human
caggcccuuccucuccacugc

SEQ ID NO: 2391561 - RNA, 23 nt, Human
caggcccuuccucuccacugccu

SEQ ID NO: 2391562 - RNA, 16 nt, Human
caggcccuuccucucc

SEQ ID NO: 2391563 - RNA, 17 nt, Human
caggcccuuccucucca

SEQ ID NO: 2391564 - RNA, 15 nt, Human
caggcccuuccucuc

SEQ ID NO: 2391565 - RNA, 21 nt, Human
caggcccuuauuuucaagaaa

SEQ ID NO: 2391566 - RNA, 22 nt, Human
caggcccuggccuccccugcca

SEQ ID NO: 2391567 - RNA, 14 nt, Human
caggcccuggccuc

SEQ ID NO: 2391568 - RNA, 19 nt, Human
caggcccugcacuguccug

SEQ ID NO: 2391569 - RNA, 20 nt, Human
caggcccugcacuguccugc

SEQ ID NO: 2391570 - RNA, 15 nt, Human
caggcccugcacugu

SEQ ID NO: 2391571 - RNA, 16 nt, Human
caggcccugcacuguc

SEQ ID NO: 2391572 - RNA, 17 nt, Human
caggcccugcacugucc

SEQ ID NO: 2391573 - RNA, 18 nt, Human
caggcccugcacuguccu

SEQ ID NO: 2391574 - RNA, 15 nt, Human
caggcccuggccucc

SEQ ID NO: 2391575 - RNA, 17 nt, Human
caggcccuggccucccc

SEQ ID NO: 2391576 - RNA, 18 nt, Human
caggcccuggccuccccu

SEQ ID NO: 2391577 - RNA, 20 nt, Human
caggcccuggccuccccugc

SEQ ID NO: 2391578 - RNA, 16 nt, Human
caggcccucugcccac

SEQ ID NO: 2391579 - RNA, 17 nt, Human
caggcccucugcccacu

SEQ ID NO: 2391580 - RNA, 19 nt, Human
caggcccucugcccacucc

SEQ ID NO: 2391581 - RNA, 20 nt, Human
caggcccucugcccacuccc

SEQ ID NO: 2391582 - RNA, 11 nt, Human
caggcccugca

SEQ ID NO: 2391583 - RNA, 12 nt, Human
caggcccugcac

SEQ ID NO: 2391584 - RNA, 13 nt, Human
caggcccugcacu

SEQ ID NO: 2391585 - RNA, 14 nt, Human
caggcccugcacug

SEQ ID NO: 2391586 - RNA, 23 nt, Human
caggcccugcacuguccugcucc

SEQ ID NO: 2391587 - RNA, 21 nt, Human
caggcccucugcccacucccu

SEQ ID NO: 2391588 - RNA, 22 nt, Human
caggcccucugcccacucccug

SEQ ID NO: 2391589 - RNA, 14 nt, Human
caggcccggggcug

SEQ ID NO: 2391590 - RNA, 19 nt, Human
caggcccggcgcgguggcu

SEQ ID NO: 2391591 - RNA, 22 nt, Human
caggcccucccuguuccccaga

SEQ ID NO: 2391592 - RNA, 15 nt, Human
caggcccggggcugg

SEQ ID NO: 2391593 - RNA, 23 nt, Human
caggcccucccuguuccccagag

SEQ ID NO: 2391594 - RNA, 13 nt, Human
caggcccucugcc

SEQ ID NO: 2391595 - RNA, 14 nt, Human
caggcccucugccc

SEQ ID NO: 2391596 - RNA, 15 nt, Human
caggcccucugccca

SEQ ID NO: 2391597 - RNA, 22 nt, Human
caggcccggcuccaggcuccuu

SEQ ID NO: 2391598 - RNA, 16 nt, Human
caggcccggggcuggc

SEQ ID NO: 2391599 - RNA, 18 nt, Human
caggcccggcgcgguggc

SEQ ID NO: 2391600 - RNA, 20 nt, Human
caggcccggcuccaggcucc

SEQ ID NO: 2391601 - RNA, 21 nt, Human
caggcccggcuccaggcuccu

SEQ ID NO: 2391602 - RNA, 17 nt, Human
caggcccggcuccaggc

SEQ ID NO: 2391603 - RNA, 16 nt, Human
caggcccggcuccagg

SEQ ID NO: 2391604 - RNA, 18 nt, Human
caggcccggcuccaggcu

SEQ ID NO: 2391605 - RNA, 19 nt, Human
caggcccggcuccaggcuc

SEQ ID NO: 2391606 - RNA, 15 nt, Human
cagggaaaagcagcu

SEQ ID NO: 2391607 - RNA, 23 nt, Human
caggcuuuguuuauagcuugcgc

SEQ ID NO: 2391608 - RNA, 23 nt, Human
caggcuuuuuuaucaugugaaau

SEQ ID NO: 2391609 - RNA, 15 nt, Human
caggcuugccugcag

SEQ ID NO: 2391610 - RNA, 16 nt, Human
caggcuugccugcagg

SEQ ID NO: 2391611 - RNA, 17 nt, Human
caggcuugccugcaggc

SEQ ID NO: 2391612 - RNA, 18 nt, Human
caggcuugccugcaggca

SEQ ID NO: 2391613 - RNA, 14 nt, Human
caggcuuccuuggc

SEQ ID NO: 2391614 - RNA, 15 nt, Human
caggcuucacccuga

SEQ ID NO: 2391615 - RNA, 22 nt, Human
caggcuucacccugaaugguuc

SEQ ID NO: 2391616 - RNA, 22 nt, Human
caggcuuagucacugagacagc

SEQ ID NO: 2391617 - RNA, 23 nt, Human
caggcuuagucacugagacagcc

SEQ ID NO: 2391618 - RNA, 23 nt, Human
caggcuggucucaaacuccugac

SEQ ID NO: 2391619 - RNA, 13 nt, Human
caggcuggucuca

SEQ ID NO: 2391620 - RNA, 12 nt, Human
caggcuggucuc

SEQ ID NO: 2391621 - RNA, 19 nt, Human
caggcuggucucaaacucu

SEQ ID NO: 2391622 - RNA, 22 nt, Human
caggcuggucucgaacuccuga

SEQ ID NO: 2391623 - RNA, 20 nt, Human
caggcuggucucgaacuccu

SEQ ID NO: 2391624 - RNA, 14 nt, Human
caggcuguauccca

SEQ ID NO: 2391625 - RNA, 23 nt, Human
caggcuggucucgaacuccugac

SEQ ID NO: 2391626 - RNA, 18 nt, Human
caggcuggugggaggggc

SEQ ID NO: 2391627 - RNA, 15 nt, Human
caggcuggugggagg

SEQ ID NO: 2391628 - RNA, 20 nt, Human
caggcuguaucccaugagcc

SEQ ID NO: 2391629 - RNA, 21 nt, Human
caggcuguaucccaugagccu

SEQ ID NO: 2391630 - RNA, 22 nt, Human
caggcuguaucccaugagccuc

SEQ ID NO: 2391631 - RNA, 23 nt, Human
caggcuguaucccaugagccuca

SEQ ID NO: 2391632 - RNA, 17 nt, Human
caggcugugggccucaa

SEQ ID NO: 2391633 - RNA, 16 nt, Human
caggcugugggccuca

SEQ ID NO: 2391634 - RNA, 22 nt, Human
caggcugugcgcugacaaccac

SEQ ID NO: 2391635 - RNA, 19 nt, Human
caggcugugcgcugacaac

SEQ ID NO: 2391636 - RNA, 16 nt, Human
caggcugucuggccag

SEQ ID NO: 2391637 - RNA, 17 nt, Human
caggcugucuggccagg

SEQ ID NO: 2391638 - RNA, 14 nt, Human
caggcugugaguuu

SEQ ID NO: 2391639 - RNA, 16 nt, Human
caggcuuagucacuga

SEQ ID NO: 2391640 - RNA, 17 nt, Human
caggcuuagucacugag

SEQ ID NO: 2391641 - RNA, 20 nt, Human
caggcuuagucacugagaca

SEQ ID NO: 2391642 - RNA, 21 nt, Human
caggcuuagucacugagacag

SEQ ID NO: 2391643 - RNA, 18 nt, Human
caggcucuucuccuuuca

SEQ ID NO: 2391644 - RNA, 22 nt, Human
caggcucuucuccuuucacaac

SEQ ID NO: 2391645 - RNA, 14 nt, Human
caggcugaccacag

SEQ ID NO: 2391646 - RNA, 22 nt, Human
caggcucuuuggggucagccag

SEQ ID NO: 2391647 - RNA, 14 nt, Human
caggcugacaucug

SEQ ID NO: 2391648 - RNA, 18 nt, Human
caggcugaagcagguucc

SEQ ID NO: 2391649 - RNA, 23 nt, Human
caggcucuuuggggucagccagg

SEQ ID NO: 2391650 - RNA, 12 nt, Human
caggcugagccu

SEQ ID NO: 2391651 - RNA, 22 nt, Human
caggcugaccacagcacagcca

SEQ ID NO: 2391652 - RNA, 21 nt, Human
caggcugaccacagcacagcc

SEQ ID NO: 2391653 - RNA, 20 nt, Human
caggcugaccacagcacagc

SEQ ID NO: 2391654 - RNA, 17 nt, Human
caggcugaccacagcac

SEQ ID NO: 2391655 - RNA, 15 nt, Human
caggcugaccacagc

SEQ ID NO: 2391656 - RNA, 14 nt, Human
caggcucuucuccu

SEQ ID NO: 2391657 - RNA, 15 nt, Human
caggcucuucuccuu

SEQ ID NO: 2391658 - RNA, 12 nt, Human
caggcucuucuc

SEQ ID NO: 2391659 - RNA, 21 nt, Human
caggcucuuagcagcuuccag

SEQ ID NO: 2391660 - RNA, 22 nt, Human
caggcucuuagcagcuuccaga

SEQ ID NO: 2391661 - RNA, 12 nt, Human
caggcucuuagc

SEQ ID NO: 2391662 - RNA, 23 nt, Human
caggcucugugcugacccuccug

SEQ ID NO: 2391663 - RNA, 24 nt, Human
caggcucugugcugacccuccugu

SEQ ID NO: 2391664 - RNA, 15 nt, Human
caggcucuuagcagc

SEQ ID NO: 2391665 - RNA, 18 nt, Human
caggcucuuagcagcuuc

SEQ ID NO: 2391666 - RNA, 17 nt, Human
caggcucugccucaccu

SEQ ID NO: 2391667 - RNA, 13 nt, Human
caggcucugugcu

SEQ ID NO: 2391668 - RNA, 14 nt, Human
caggcucugugcug

SEQ ID NO: 2391669 - RNA, 15 nt, Human
caggcucugugcuga

SEQ ID NO: 2391670 - RNA, 18 nt, Human
caggcucugugcugaccc

SEQ ID NO: 2391671 - RNA, 19 nt, Human
caggcucugugcugacccu

SEQ ID NO: 2391672 - RNA, 21 nt, Human
caggcucugugcugacccucc

SEQ ID NO: 2391673 - RNA, 22 nt, Human
caggcucugugcugacccuccu

SEQ ID NO: 2391674 - RNA, 16 nt, Human
caggcugccguggggc

SEQ ID NO: 2391675 - RNA, 21 nt, Human
caggcugccaaggccagagug

SEQ ID NO: 2391676 - RNA, 22 nt, Human
caggcugccaaggccagagugg

SEQ ID NO: 2391677 - RNA, 11 nt, Human
caggcugaggu

SEQ ID NO: 2391678 - RNA, 16 nt, Human
caggcugacaucugug

SEQ ID NO: 2391679 - RNA, 21 nt, Human
caggcugagccucagucuccc

SEQ ID NO: 2391680 - RNA, 17 nt, Human
caggcugagccucaguc

SEQ ID NO: 2391681 - RNA, 16 nt, Human
caggcugagccucagu

SEQ ID NO: 2391682 - RNA, 15 nt, Human
caggcugagccucag

SEQ ID NO: 2391683 - RNA, 14 nt, Human
caggcugagccuca

SEQ ID NO: 2391684 - RNA, 13 nt, Human
caggcugagccuc

SEQ ID NO: 2391685 - RNA, 23 nt, Human
caggcugggcuucaguggcagcu

SEQ ID NO: 2391686 - RNA, 21 nt, Human
caggcugggucgcccuggacu

SEQ ID NO: 2391687 - RNA, 23 nt, Human
caggcugggucgcccuggacugu

SEQ ID NO: 2391688 - RNA, 21 nt, Human
caggcuggccaguccaggcug

SEQ ID NO: 2391689 - RNA, 13 nt, Human
caggcuggggcug

SEQ ID NO: 2391690 - RNA, 18 nt, Human
caggcuggggcugaccuu

SEQ ID NO: 2391691 - RNA, 16 nt, Human
caggcuggcccugccc

SEQ ID NO: 2391692 - RNA, 15 nt, Human
caggcuggcccugcc

SEQ ID NO: 2391693 - RNA, 14 nt, Human
caggcuggcccugc

SEQ ID NO: 2391694 - RNA, 12 nt, Human
caggcuggcccu

SEQ ID NO: 2391695 - RNA, 14 nt, Human
caggcuggccaguc

SEQ ID NO: 2391696 - RNA, 16 nt, Human
caggcuggccagucca

SEQ ID NO: 2391697 - RNA, 18 nt, Human
caggcuggccaguccagg

SEQ ID NO: 2391698 - RNA, 19 nt, Human
caggcuggccaguccaggc

SEQ ID NO: 2391699 - RNA, 16 nt, Human
caggcuggccagcccc

SEQ ID NO: 2391700 - RNA, 17 nt, Human
caggcuggccagcccca

SEQ ID NO: 2391701 - RNA, 18 nt, Human
caggcuggccagccccac

SEQ ID NO: 2391702 - RNA, 19 nt, Human
caggcuggccagccccaca

SEQ ID NO: 2391703 - RNA, 20 nt, Human
caggcuggccagccccacag

SEQ ID NO: 2391704 - RNA, 21 nt, Human
caggcuggccagccccacagc

SEQ ID NO: 2391705 - RNA, 23 nt, Human
caggcuggccagccccacagccc

SEQ ID NO: 2391706 - RNA, 21 nt, Human
caggcuggcaccgccuucucu

SEQ ID NO: 2391707 - RNA, 13 nt, Human
caggcuggcagcu

SEQ ID NO: 2391708 - RNA, 20 nt, Human
caggcuggcaccgccuucuc

SEQ ID NO: 2391709 - RNA, 21 nt, Human
caggcuggagguaaggccuuu

SEQ ID NO: 2391710 - RNA, 15 nt, Human
caggcuggcagcucu

SEQ ID NO: 2391711 - RNA, 16 nt, Human
caggcuggcagcucuc

SEQ ID NO: 2391712 - RNA, 17 nt, Human
caggcuggcagcucucc

SEQ ID NO: 2391713 - RNA, 18 nt, Human
caggcuggcagcucucca

SEQ ID NO: 2391714 - RNA, 12 nt, Human
caggcuggccag

SEQ ID NO: 2391715 - RNA, 19 nt, Human
caggcuggcagcucuccag

SEQ ID NO: 2391716 - RNA, 20 nt, Human
caggcuggcagcucuccagu

SEQ ID NO: 2391717 - RNA, 11 nt, Human
caggcuggcca

SEQ ID NO: 2391718 - RNA, 13 nt, Human
caggcuggccagc

SEQ ID NO: 2391719 - RNA, 14 nt, Human
caggcuggccagcc

SEQ ID NO: 2391720 - RNA, 15 nt, Human
caggcuggccagccc

SEQ ID NO: 2391721 - RNA, 15 nt, Human
caggcugcuugggau

SEQ ID NO: 2391722 - RNA, 12 nt, Human
caggcugcuugg

SEQ ID NO: 2391723 - RNA, 14 nt, Human
caggcuggacgugg

SEQ ID NO: 2391724 - RNA, 21 nt, Human
caggcugcuggcgccucugca

SEQ ID NO: 2391725 - RNA, 20 nt, Human
caggcuggagguaaggccuu

SEQ ID NO: 2391726 - RNA, 16 nt, Human
caggcugcuggaggaa

SEQ ID NO: 2391727 - RNA, 12 nt, Human
caggcugcuggc

SEQ ID NO: 2391728 - RNA, 13 nt, Human
caggcugcuggcg

SEQ ID NO: 2391729 - RNA, 16 nt, Human
caggcugcuggcgccu

SEQ ID NO: 2391730 - RNA, 18 nt, Human
caggcugcuggcgccucu

SEQ ID NO: 2391731 - RNA, 20 nt, Human
caggcugcuggcgccucugc

SEQ ID NO: 2391732 - RNA, 22 nt, Human
caggcugcuggcgccucugcaa

SEQ ID NO: 2391733 - RNA, 15 nt, Human
caggcugcuggagga

SEQ ID NO: 2391734 - RNA, 14 nt, Human
caggcugcuggagg

SEQ ID NO: 2391735 - RNA, 12 nt, Human
caggcugcugga

SEQ ID NO: 2391736 - RNA, 11 nt, Human
caggcugcugg

SEQ ID NO: 2391737 - RNA, 23 nt, Human
caggcugcucuugaacuccugac

SEQ ID NO: 2391738 - RNA, 17 nt, Human
caggcugcucagggcug

SEQ ID NO: 2391739 - RNA, 18 nt, Human
caggcugcucagggcugg

SEQ ID NO: 2391740 - RNA, 20 nt, Human
caggcugcucuugaacuccu

SEQ ID NO: 2391741 - RNA, 12 nt, Human
caggcugcucuu

SEQ ID NO: 2391742 - RNA, 18 nt, Human
caggccccaggcagggcc

SEQ ID NO: 2391743 - RNA, 17 nt, Human
caggccccaggaagccg

SEQ ID NO: 2391744 - RNA, 16 nt, Human
caggccccaggaagcc

SEQ ID NO: 2391745 - RNA, 15 nt, Human
caggccccaggaagc

SEQ ID NO: 2391746 - RNA, 14 nt, Human
caggccccaggaag

SEQ ID NO: 2391747 - RNA, 13 nt, Human
caggccccaggaa

SEQ ID NO: 2391748 - RNA, 13 nt, Human
caggccccagcaa

SEQ ID NO: 2391749 - RNA, 13 nt, Human
caggcccccaagc

SEQ ID NO: 2391750 - RNA, 23 nt, Human
caggccccaaaaccacagcccug

SEQ ID NO: 2391751 - RNA, 22 nt, Human
caggccccaaaaccacagcccu

SEQ ID NO: 2391752 - RNA, 19 nt, Human
caggccccaaaaccacagc

SEQ ID NO: 2391753 - RNA, 17 nt, Human
caggccccaaaaccaca

SEQ ID NO: 2391754 - RNA, 15 nt, Human
caggccccaggaaag

SEQ ID NO: 2391755 - RNA, 22 nt, Human
caggcccagcauugcugguucu

SEQ ID NO: 2391756 - RNA, 18 nt, Human
caggccauggaggcagaa

SEQ ID NO: 2391757 - RNA, 21 nt, Human
caggccauuccccgucucugg

SEQ ID NO: 2391758 - RNA, 19 nt, Human
caggcccaagagaugaaga

SEQ ID NO: 2391759 - RNA, 18 nt, Human
caggcccaagagaugaag

SEQ ID NO: 2391760 - RNA, 13 nt, Human
caggcccacagua

SEQ ID NO: 2391761 - RNA, 10 nt, Human
caggcccagc

SEQ ID NO: 2391762 - RNA, 11 nt, Human
caggcccagca

SEQ ID NO: 2391763 - RNA, 12 nt, Human
caggcccagcau

SEQ ID NO: 2391764 - RNA, 19 nt, Human
caggcccagcauugcuggu

SEQ ID NO: 2391765 - RNA, 20 nt, Human
caggcccagcauugcugguu

SEQ ID NO: 2391766 - RNA, 21 nt, Human
caggcccagcauugcugguuc

SEQ ID NO: 2391767 - RNA, 15 nt, Human
caggcccccaccacu

SEQ ID NO: 2391768 - RNA, 17 nt, Human
caggcccccaagccugc

SEQ ID NO: 2391769 - RNA, 15 nt, Human
caggcccccaagccu

SEQ ID NO: 2391770 - RNA, 19 nt, Human
caggcccccaagccugcag

SEQ ID NO: 2391771 - RNA, 18 nt, Human
caggcccccaagccugca

SEQ ID NO: 2391772 - RNA, 21 nt, Human
caggcccccagaaccccuggc

SEQ ID NO: 2391773 - RNA, 19 nt, Human
caggcccccaggugccagu

SEQ ID NO: 2391774 - RNA, 14 nt, Human
caggcccccaggug

SEQ ID NO: 2391775 - RNA, 23 nt, Human
caggccccgcuuguccagcgccu

SEQ ID NO: 2391776 - RNA, 22 nt, Human
caggccccgcuuguccagcgcc

SEQ ID NO: 2391777 - RNA, 19 nt, Human
caggccccgcuuguccagc

SEQ ID NO: 2391778 - RNA, 18 nt, Human
caggccccgcuuguccag

SEQ ID NO: 2391779 - RNA, 17 nt, Human
caggccccgcuugucca

SEQ ID NO: 2391780 - RNA, 23 nt, Human
caggccccgaggacccagaccca

SEQ ID NO: 2391781 - RNA, 21 nt, Human
caggccccgaggacccagacc

SEQ ID NO: 2391782 - RNA, 22 nt, Human
caggccccgaggacccagaccc

SEQ ID NO: 2391783 - RNA, 13 nt, Human
caggccccugcca

SEQ ID NO: 2391784 - RNA, 17 nt, Human
caggccccgaggaccca

SEQ ID NO: 2391785 - RNA, 18 nt, Human
caggccccgaggacccag

SEQ ID NO: 2391786 - RNA, 20 nt, Human
caggccccgaggacccagac

SEQ ID NO: 2391787 - RNA, 20 nt, Human
caggcccccaggugccaguu

SEQ ID NO: 2391788 - RNA, 23 nt, Human
caggccacauggggcugggcagc

SEQ ID NO: 2391789 - RNA, 13 nt, Human
caggccaccagga

SEQ ID NO: 2391790 - RNA, 15 nt, Human
caggccaccaggaug

SEQ ID NO: 2391791 - RNA, 16 nt, Human
caggccaccaggaugg

SEQ ID NO: 2391792 - RNA, 20 nt, Human
caggccacaagacccuugug

SEQ ID NO: 2391793 - RNA, 21 nt, Human
caggccaggcccucugcccac

SEQ ID NO: 2391794 - RNA, 22 nt, Human
caggccaggcccucugcccacu

SEQ ID NO: 2391795 - RNA, 21 nt, Human
caggccaggcuccuuccuguc

SEQ ID NO: 2391796 - RNA, 16 nt, Human
caggccaguaagggaa

SEQ ID NO: 2391797 - RNA, 16 nt, Human
caggccaggugcagug

SEQ ID NO: 2391798 - RNA, 18 nt, Human
caggccaggcuccuuccu

SEQ ID NO: 2391799 - RNA, 12 nt, Human
caggccaggcuc

SEQ ID NO: 2391800 - RNA, 15 nt, Human
caggccaggugcagu

SEQ ID NO: 2391801 - RNA, 23 nt, Human
caggccaccauauucagugcugu

SEQ ID NO: 2391802 - RNA, 21 nt, Human
caggccagggggccagucccu

SEQ ID NO: 2391803 - RNA, 21 nt, Human
caggccaucaucaguggagcc

SEQ ID NO: 2391804 - RNA, 21 nt, Human
caggccaguaagggaaauaga

SEQ ID NO: 2391805 - RNA, 22 nt, Human
caggccaguaagggaaauagaa

SEQ ID NO: 2391806 - RNA, 23 nt, Human
caggccaguaagggaaauagaaa

SEQ ID NO: 2391807 - RNA, 18 nt, Human
caggccauccggccccca

SEQ ID NO: 2391808 - RNA, 13 nt, Human
caggccaucuucc

SEQ ID NO: 2391809 - RNA, 14 nt, Human
caggccaucuucca

SEQ ID NO: 2391810 - RNA, 18 nt, Human
caggccauuccccgucuc

SEQ ID NO: 2391811 - RNA, 15 nt, Human
caggccaucuuccag

SEQ ID NO: 2391812 - RNA, 16 nt, Human
caggccaucuuccagg

SEQ ID NO: 2391813 - RNA, 19 nt, Human
caggccaucuuccaggugg

SEQ ID NO: 2391814 - RNA, 15 nt, Human
caggccauggaggca

SEQ ID NO: 2391815 - RNA, 23 nt, Human
caggccaagagcagaggcagcga

SEQ ID NO: 2391816 - RNA, 19 nt, Human
caggccaaggccuucuccu

SEQ ID NO: 2391817 - RNA, 21 nt, Human
caggccaagagcagaggcagc

SEQ ID NO: 2391818 - RNA, 19 nt, Human
caggccaagagcagaggca

SEQ ID NO: 2391819 - RNA, 13 nt, Human
caggccacaagac

SEQ ID NO: 2391820 - RNA, 17 nt, Human
caggccacaagacccuu

SEQ ID NO: 2391821 - RNA, 18 nt, Human
caggccacaagacccuug

SEQ ID NO: 2391822 - RNA, 18 nt, Human
caggccaagagcagaggc

SEQ ID NO: 2391823 - RNA, 17 nt, Human
caggccaagaaacgucu

SEQ ID NO: 2391824 - RNA, 23 nt, Human
caggccaaacucaccugccccuc

SEQ ID NO: 2391825 - RNA, 21 nt, Human
caggcauuugacugaagaugc

SEQ ID NO: 2391826 - RNA, 23 nt, Human
caggcauuugacugaagaugcag

SEQ ID NO: 2391827 - RNA, 18 nt, Human
caggcauuugacugaaga

SEQ ID NO: 2391828 - RNA, 18 nt, Human
caggccaaacucaccugc

SEQ ID NO: 2391829 - RNA, 13 nt, Human
caggcccggcucc

SEQ ID NO: 2391830 - RNA, 21 nt, Human
caggccccgugaggcaauggg

SEQ ID NO: 2391831 - RNA, 22 nt, Human
caggccccuuuucacucccucc

SEQ ID NO: 2391832 - RNA, 14 nt, Human
caggcccggcucca

SEQ ID NO: 2391833 - RNA, 15 nt, Human
caggcccggcuccag

SEQ ID NO: 2391834 - RNA, 15 nt, Human
caggccccugccacc

SEQ ID NO: 2391835 - RNA, 17 nt, Human
caggccccugccacccu

SEQ ID NO: 2391836 - RNA, 19 nt, Human
caggccccugccacccugg

SEQ ID NO: 2391837 - RNA, 20 nt, Human
caggccccugccacccuggg

SEQ ID NO: 2391838 - RNA, 20 nt, Human
caggcagggccaacccuucu

SEQ ID NO: 2391839 - RNA, 22 nt, Human
caggcagggccaacccuucucc

SEQ ID NO: 2391840 - RNA, 19 nt, Human
caggcaggaagggcaggaa

SEQ ID NO: 2391841 - RNA, 20 nt, Human
caggcaggcuaaggcgugga

SEQ ID NO: 2391842 - RNA, 23 nt, Human
caggcaggcuaaggcguggagcu

SEQ ID NO: 2391843 - RNA, 21 nt, Human
caggcaggccaaggccuucuc

SEQ ID NO: 2391844 - RNA, 12 nt, Human
caggcaggcugu

SEQ ID NO: 2391845 - RNA, 13 nt, Human
caggcaggcugug

SEQ ID NO: 2391846 - RNA, 19 nt, Human
caggcaggcugugcgcuga

SEQ ID NO: 2391847 - RNA, 13 nt, Human
caggcagguccag

SEQ ID NO: 2391848 - RNA, 12 nt, Human
caggcaggggug

SEQ ID NO: 2391849 - RNA, 13 nt, Human
caggcaggggugg

SEQ ID NO: 2391850 - RNA, 17 nt, Human
caggcaggggugggggu

SEQ ID NO: 2391851 - RNA, 21 nt, Human
caggcagggguggggguggag

SEQ ID NO: 2391852 - RNA, 22 nt, Human
caggcagggguggggguggagg

SEQ ID NO: 2391853 - RNA, 23 nt, Human
caggcagggguggggguggaggc

SEQ ID NO: 2391854 - RNA, 17 nt, Human
caggcagggcugacucu

SEQ ID NO: 2391855 - RNA, 23 nt, Human
caggcagggcugacucuaggugc

SEQ ID NO: 2391856 - RNA, 15 nt, Human
caggcagcuggauga

SEQ ID NO: 2391857 - RNA, 18 nt, Human
caggcagcuggaugagac

SEQ ID NO: 2391858 - RNA, 20 nt, Human
caggcagcuuuaaccauuaa

SEQ ID NO: 2391859 - RNA, 13 nt, Human
caggcagccugga

SEQ ID NO: 2391860 - RNA, 12 nt, Human
caggcagcgaug

SEQ ID NO: 2391861 - RNA, 21 nt, Human
caggcagcgauggucucagaa

SEQ ID NO: 2391862 - RNA, 18 nt, Human
caggcagcgauggucuca

SEQ ID NO: 2391863 - RNA, 14 nt, Human
caggcagcgccaag

SEQ ID NO: 2391864 - RNA, 15 nt, Human
caggcagcgccaagc

SEQ ID NO: 2391865 - RNA, 19 nt, Human
caggcagcuuuuucucucc

SEQ ID NO: 2391866 - RNA, 22 nt, Human
caggcagcuuuuucucucccac

SEQ ID NO: 2391867 - RNA, 18 nt, Human
caggcaggaagggcagga

SEQ ID NO: 2391868 - RNA, 20 nt, Human
caggcaggaaggcugagagg

SEQ ID NO: 2391869 - RNA, 16 nt, Human
caggcagccaggccac

SEQ ID NO: 2391870 - RNA, 17 nt, Human
caggcagccaggccaca

SEQ ID NO: 2391871 - RNA, 12 nt, Human
caggcagcccua

SEQ ID NO: 2391872 - RNA, 22 nt, Human
caggcaacugaggcagacagca

SEQ ID NO: 2391873 - RNA, 20 nt, Human
caggcaacugaggcagacag

SEQ ID NO: 2391874 - RNA, 17 nt, Human
caggcaaggucuggccu

SEQ ID NO: 2391875 - RNA, 22 nt, Human
caggcaaggucuggccucaggu

SEQ ID NO: 2391876 - RNA, 18 nt, Human
caggcaagugaagaaaag

SEQ ID NO: 2391877 - RNA, 14 nt, Human
caggcagccaggcc

SEQ ID NO: 2391878 - RNA, 15 nt, Human
caggcagccaggcca

SEQ ID NO: 2391879 - RNA, 14 nt, Human
caggcaagcaccuc

SEQ ID NO: 2391880 - RNA, 15 nt, Human
caggcaagcaccucc

SEQ ID NO: 2391881 - RNA, 16 nt, Human
caggcaagcaccuccu

SEQ ID NO: 2391882 - RNA, 21 nt, Human
caggcaagcaccuccugccuc

SEQ ID NO: 2391883 - RNA, 20 nt, Human
caggauucuuccucccuccc

SEQ ID NO: 2391884 - RNA, 13 nt, Human
caggauugaagag

SEQ ID NO: 2391885 - RNA, 15 nt, Human
caggauugaagagca

SEQ ID NO: 2391886 - RNA, 22 nt, Human
caggauuugaacucagaucugu

SEQ ID NO: 2391887 - RNA, 21 nt, Human
caggauuucgugggucuguuu

SEQ ID NO: 2391888 - RNA, 21 nt, Human
caggauuugaacucagaucug

SEQ ID NO: 2391889 - RNA, 19 nt, Human
caggcaacugaggcagaca

SEQ ID NO: 2391890 - RNA, 18 nt, Human
caggcaacugaggcagac

SEQ ID NO: 2391891 - RNA, 17 nt, Human
caggcaacugaggcaga

SEQ ID NO: 2391892 - RNA, 16 nt, Human
caggcaacugaggcag

SEQ ID NO: 2391893 - RNA, 15 nt, Human
caggcaacugaggca

SEQ ID NO: 2391894 - RNA, 16 nt, Human
caggcaaagcaaguga

SEQ ID NO: 2391895 - RNA, 11 nt, Human
caggcaaauca

SEQ ID NO: 2391896 - RNA, 13 nt, Human
caggcaaaucagu

SEQ ID NO: 2391897 - RNA, 22 nt, Human
caggauuuuaacaaaagcaaga

SEQ ID NO: 2391898 - RNA, 18 nt, Human
caggcaaaauccuugcuu

SEQ ID NO: 2391899 - RNA, 14 nt, Human
caggcaaaauccuu

SEQ ID NO: 2391900 - RNA, 16 nt, Human
caggauuuuaaucuuu

SEQ ID NO: 2391901 - RNA, 15 nt, Human
caggcauguucucug

SEQ ID NO: 2391902 - RNA, 18 nt, Human
caggcauguucucugagg

SEQ ID NO: 2391903 - RNA, 19 nt, Human
caggcauguucucugagga

SEQ ID NO: 2391904 - RNA, 20 nt, Human
caggcauguucucugaggac

SEQ ID NO: 2391905 - RNA, 13 nt, Human
caggcauucccca

SEQ ID NO: 2391906 - RNA, 15 nt, Human
caggcauuccccagg

SEQ ID NO: 2391907 - RNA, 16 nt, Human
caggcauuccccagga

SEQ ID NO: 2391908 - RNA, 17 nt, Human
caggcauuccccaggag

SEQ ID NO: 2391909 - RNA, 24 nt, Human
caggcauuccccaggaggccagcc

SEQ ID NO: 2391910 - RNA, 19 nt, Human
caggcauugccaagggcuu

SEQ ID NO: 2391911 - RNA, 22 nt, Human
caggcauuccccaggaggccag

SEQ ID NO: 2391912 - RNA, 23 nt, Human
caggcauuccccaggaggccagc

SEQ ID NO: 2391913 - RNA, 18 nt, Human
caggcauuccccaggagg

SEQ ID NO: 2391914 - RNA, 19 nt, Human
caggcauuccccaggaggc

SEQ ID NO: 2391915 - RNA, 20 nt, Human
caggcauuccccaggaggcc

SEQ ID NO: 2391916 - RNA, 21 nt, Human
caggcauuccccaggaggcca

SEQ ID NO: 2391917 - RNA, 14 nt, Human
caggcagguccagg

SEQ ID NO: 2391918 - RNA, 15 nt, Human
caggcagguccaggg

SEQ ID NO: 2391919 - RNA, 19 nt, Human
caggcagguccaggguuug

SEQ ID NO: 2391920 - RNA, 12 nt, Human
caggcaggucuu

SEQ ID NO: 2391921 - RNA, 13 nt, Human
caggcaggucuug

SEQ ID NO: 2391922 - RNA, 22 nt, Human
caggcaggucuugaacuccugg

SEQ ID NO: 2391923 - RNA, 15 nt, Human
caggcaggugggaug

SEQ ID NO: 2391924 - RNA, 23 nt, Human
caggcaggucuugaacuccuggc

SEQ ID NO: 2391925 - RNA, 19 nt, Human
caggcauaggccugggugc

SEQ ID NO: 2391926 - RNA, 18 nt, Human
caggcauaggccugggug

SEQ ID NO: 2391927 - RNA, 14 nt, Human
caggcaucacagcu

SEQ ID NO: 2391928 - RNA, 15 nt, Human
caggcaucacagcua

SEQ ID NO: 2391929 - RNA, 17 nt, Human
caggcauaggccugggu

SEQ ID NO: 2391930 - RNA, 16 nt, Human
caggcauaggccuggg

SEQ ID NO: 2391931 - RNA, 15 nt, Human
caggcauaggccugg

SEQ ID NO: 2391932 - RNA, 14 nt, Human
caggcauaggccug

SEQ ID NO: 2391933 - RNA, 17 nt, Human
caggcaguuggccagag

SEQ ID NO: 2391934 - RNA, 14 nt, Human
caggcauagaggcu

SEQ ID NO: 2391935 - RNA, 17 nt, Human
caggcauagaggcuucu

SEQ ID NO: 2391936 - RNA, 18 nt, Human
caggcauagaggcuucuc

SEQ ID NO: 2391937 - RNA, 19 nt, Human
caggcauagaggcuucucc

SEQ ID NO: 2391938 - RNA, 21 nt, Human
caggcauagaggcuucuccgc

SEQ ID NO: 2391939 - RNA, 23 nt, Human
caggcauagaggcuucuccgcca

SEQ ID NO: 2391940 - RNA, 22 nt, Human
caggcagugaugcuggaugcuc

SEQ ID NO: 2391941 - RNA, 20 nt, Human
caggcagugaugcuggaugc

SEQ ID NO: 2391942 - RNA, 23 nt, Human
caggcagucgggggcuggccuag

SEQ ID NO: 2391943 - RNA, 24 nt, Human
caggcagucgggggcuggccuagg

SEQ ID NO: 2391944 - RNA, 19 nt, Human
caggcagucgggggcuggc

SEQ ID NO: 2391945 - RNA, 20 nt, Human
caggcagucgggggcuggcc

SEQ ID NO: 2391946 - RNA, 21 nt, Human
caggcagucgggggcuggccu

SEQ ID NO: 2391947 - RNA, 22 nt, Human
caggcagucgggggcuggccua

SEQ ID NO: 2391948 - RNA, 15 nt, Human
caggcagggugcagu

SEQ ID NO: 2391949 - RNA, 20 nt, Human
caggcagguagccaggggga

SEQ ID NO: 2391950 - RNA, 14 nt, Human
caggcaggugccug

SEQ ID NO: 2391951 - RNA, 16 nt, Human
caggcaggugccugga

SEQ ID NO: 2391952 - RNA, 16 nt, Human
caggcagucgggggcu

SEQ ID NO: 2391953 - RNA, 18 nt, Human
caggcagucgggggcugg

SEQ ID NO: 2391954 - RNA, 14 nt, Human
caggcaugccugug

SEQ ID NO: 2391955 - RNA, 17 nt, Human
caggcaugcaugugcuu

SEQ ID NO: 2391956 - RNA, 12 nt, Human
caggcaugaagu

SEQ ID NO: 2391957 - RNA, 20 nt, Human
caggcaugaacauguacugu

SEQ ID NO: 2391958 - RNA, 12 nt, Human
caggcauccucc

SEQ ID NO: 2391959 - RNA, 17 nt, Human
caggcaugguggcccac

SEQ ID NO: 2391960 - RNA, 16 nt, Human
caggcaugccugugug

SEQ ID NO: 2391961 - RNA, 15 nt, Human
caggcaugccugugu

SEQ ID NO: 2391962 - RNA, 16 nt, Human
caggaugaacccagga

SEQ ID NO: 2391963 - RNA, 17 nt, Human
caggaugaacccaggac

SEQ ID NO: 2391964 - RNA, 23 nt, Human
caggaucucuuagcauuuuaauu

SEQ ID NO: 2391965 - RNA, 15 nt, Human
caggaugaacccagg

SEQ ID NO: 2391966 - RNA, 18 nt, Human
caggaucucuuagcauuu

SEQ ID NO: 2391967 - RNA, 15 nt, Human
caggaugacccugcg

SEQ ID NO: 2391968 - RNA, 16 nt, Human
caggaugaccuggaua

SEQ ID NO: 2391969 - RNA, 17 nt, Human
caggaugaccuggauaa

SEQ ID NO: 2391970 - RNA, 20 nt, Human
caggaugacgguauuaugcu

SEQ ID NO: 2391971 - RNA, 21 nt, Human
caggaugacgguauuaugcuu

SEQ ID NO: 2391972 - RNA, 18 nt, Human
caggaugaugacuaugga

SEQ ID NO: 2391973 - RNA, 20 nt, Human
caggaugaugacuauggaaa

SEQ ID NO: 2391974 - RNA, 24 nt, Human
caggaugcccagggccacucugcc

SEQ ID NO: 2391975 - RNA, 22 nt, Human
caggaugcccagggccacucug

SEQ ID NO: 2391976 - RNA, 19 nt, Human
caggaugcccagggccacu

SEQ ID NO: 2391977 - RNA, 23 nt, Human
caggauggaggggugguccugac

SEQ ID NO: 2391978 - RNA, 22 nt, Human
caggauggaggggugguccuga

SEQ ID NO: 2391979 - RNA, 21 nt, Human
caggauggaggggugguccug

SEQ ID NO: 2391980 - RNA, 15 nt, Human
caggauggaggggug

SEQ ID NO: 2391981 - RNA, 23 nt, Human
caggauggccgggcgcgguggcu

SEQ ID NO: 2391982 - RNA, 17 nt, Human
caggaugcccagggcca

SEQ ID NO: 2391983 - RNA, 14 nt, Human
caggaugcccaggg

SEQ ID NO: 2391984 - RNA, 13 nt, Human
caggaugcccagg

SEQ ID NO: 2391985 - RNA, 23 nt, Human
caggaugcuaacaucuaaaaaua

SEQ ID NO: 2391986 - RNA, 22 nt, Human
caggaugaugacuauggaaaga

SEQ ID NO: 2391987 - RNA, 21 nt, Human
caggaugggggcuggccucug

SEQ ID NO: 2391988 - RNA, 19 nt, Human
caggauguacaaggacagc

SEQ ID NO: 2391989 - RNA, 18 nt, Human
caggauucuuccucccuc

SEQ ID NO: 2391990 - RNA, 17 nt, Human
caggauucuuccucccu

SEQ ID NO: 2391991 - RNA, 19 nt, Human
caggaugggggcuggccuc

SEQ ID NO: 2391992 - RNA, 23 nt, Human
caggauggcccuucccacuggag

SEQ ID NO: 2391993 - RNA, 15 nt, Human
caggauggccuggcc

SEQ ID NO: 2391994 - RNA, 16 nt, Human
caggauggccuggcca

SEQ ID NO: 2391995 - RNA, 18 nt, Human
caggaugggggcuggccu

SEQ ID NO: 2391996 - RNA, 17 nt, Human
caggauggccuggccag

SEQ ID NO: 2391997 - RNA, 24 nt, Human
caggauggccuggccagggccugg

SEQ ID NO: 2391998 - RNA, 21 nt, Human
caggaugguucccuugaugaa

SEQ ID NO: 2391999 - RNA, 23 nt, Human
caggaugguucccuugaugaaga

SEQ ID NO: 2392000 - RNA, 13 nt, Human
caggaucagucug

SEQ ID NO: 2392001 - RNA, 14 nt, Human
caggaucagucuga

SEQ ID NO: 2392002 - RNA, 23 nt, Human
caggaucagauugcaugugacuc

SEQ ID NO: 2392003 - RNA, 20 nt, Human
caggaucagauugcauguga

SEQ ID NO: 2392004 - RNA, 24 nt, Human
caggaucagauugcaugugacucu

SEQ ID NO: 2392005 - RNA, 16 nt, Human
caggaucccaggggcc

SEQ ID NO: 2392006 - RNA, 23 nt, Human
caggaucaugguguaauaagaca

SEQ ID NO: 2392007 - RNA, 21 nt, Human
caggaucccaggggcccaagg

SEQ ID NO: 2392008 - RNA, 15 nt, Human
caggaucauggugua

SEQ ID NO: 2392009 - RNA, 16 nt, Human
caggaucaugguguaa

SEQ ID NO: 2392010 - RNA, 18 nt, Human
caggaucaugguguaaua

SEQ ID NO: 2392011 - RNA, 19 nt, Human
caggaucaugguguaauaa

SEQ ID NO: 2392012 - RNA, 21 nt, Human
caggaucaugguguaauaaga

SEQ ID NO: 2392013 - RNA, 22 nt, Human
caggaucaugguguaauaagac

SEQ ID NO: 2392014 - RNA, 19 nt, Human
caggauccuauucucacca

SEQ ID NO: 2392015 - RNA, 22 nt, Human
caggaucccaggggcccaaggc

SEQ ID NO: 2392016 - RNA, 20 nt, Human
caggauccuauucucaccag

SEQ ID NO: 2392017 - RNA, 23 nt, Human
caggaucgcaagagccauguaga

SEQ ID NO: 2392018 - RNA, 21 nt, Human
caggauccuauucucaccagg

SEQ ID NO: 2392019 - RNA, 22 nt, Human
caggauccuauucucaccagga

SEQ ID NO: 2392020 - RNA, 15 nt, Human
caggagcacaggcag

SEQ ID NO: 2392021 - RNA, 16 nt, Human
caggagcacaggcagc

SEQ ID NO: 2392022 - RNA, 17 nt, Human
caggagcacaggcagcu

SEQ ID NO: 2392023 - RNA, 18 nt, Human
caggagcacaggcagcug

SEQ ID NO: 2392024 - RNA, 23 nt, Human
caggagcacaggcagcuggauga

SEQ ID NO: 2392025 - RNA, 19 nt, Human
caggagcaaauguuucugc

SEQ ID NO: 2392026 - RNA, 22 nt, Human
caggagcaaauguuucugcagu

SEQ ID NO: 2392027 - RNA, 20 nt, Human
caggagauggaaguugcagu

SEQ ID NO: 2392028 - RNA, 12 nt, Human
caggagagggaa

SEQ ID NO: 2392029 - RNA, 16 nt, Human
caggagauugagaagg

SEQ ID NO: 2392030 - RNA, 17 nt, Human
caggagauugagaagga

SEQ ID NO: 2392031 - RNA, 19 nt, Human
caggagauugagaaggaga

SEQ ID NO: 2392032 - RNA, 20 nt, Human
caggagauugagaaggagag

SEQ ID NO: 2392033 - RNA, 21 nt, Human
caggagauugagaaggagaga

SEQ ID NO: 2392034 - RNA, 22 nt, Human
caggagauugagaaggagagaa

SEQ ID NO: 2392035 - RNA, 23 nt, Human
caggagauugagaaggagagaaa

SEQ ID NO: 2392036 - RNA, 18 nt, Human
caggagcaaauguuucug

SEQ ID NO: 2392037 - RNA, 23 nt, Human
caggagagccagcccucccuguc

SEQ ID NO: 2392038 - RNA, 21 nt, Human
caggagagccagcccucccug

SEQ ID NO: 2392039 - RNA, 19 nt, Human
caggagagccagcccuccc

SEQ ID NO: 2392040 - RNA, 14 nt, Human
caggagaggagagc

SEQ ID NO: 2392041 - RNA, 15 nt, Human
caggagaggagagcc

SEQ ID NO: 2392042 - RNA, 16 nt, Human
caggagaggagagcca

SEQ ID NO: 2392043 - RNA, 17 nt, Human
caggagaggagagccag

SEQ ID NO: 2392044 - RNA, 18 nt, Human
caggagagccagcccucc

SEQ ID NO: 2392045 - RNA, 17 nt, Human
caggagagccagcccuc

SEQ ID NO: 2392046 - RNA, 16 nt, Human
caggagagccagcccu

SEQ ID NO: 2392047 - RNA, 15 nt, Human
caggagagccagccc

SEQ ID NO: 2392048 - RNA, 13 nt, Human
caggagagccagc

SEQ ID NO: 2392049 - RNA, 22 nt, Human
caggagagcagcggggcgaagc

SEQ ID NO: 2392050 - RNA, 23 nt, Human
caggagagagaaagccaggcagg

SEQ ID NO: 2392051 - RNA, 12 nt, Human
caggagagcagc

SEQ ID NO: 2392052 - RNA, 17 nt, Human
caggagaggggcagaac

SEQ ID NO: 2392053 - RNA, 15 nt, Human
caggagaggggcaga

SEQ ID NO: 2392054 - RNA, 12 nt, Human
caggagaguaga

SEQ ID NO: 2392055 - RNA, 20 nt, Human
caggagaggagcgggaccug

SEQ ID NO: 2392056 - RNA, 22 nt, Human
caggagaggagagccagagaag

SEQ ID NO: 2392057 - RNA, 12 nt, Human
caggagaggagc

SEQ ID NO: 2392058 - RNA, 18 nt, Human
caggagaggagagccaga

SEQ ID NO: 2392059 - RNA, 19 nt, Human
caggagaggagagccagag

SEQ ID NO: 2392060 - RNA, 20 nt, Human
caggagaggagagccagaga

SEQ ID NO: 2392061 - RNA, 21 nt, Human
caggagaggagagccagagaa

SEQ ID NO: 2392062 - RNA, 16 nt, Human
caggagacccacaggu

SEQ ID NO: 2392063 - RNA, 14 nt, Human
caggagagaaaggg

SEQ ID NO: 2392064 - RNA, 15 nt, Human
caggagacaggaagg

SEQ ID NO: 2392065 - RNA, 19 nt, Human
caggagagaguugaaccua

SEQ ID NO: 2392066 - RNA, 19 nt, Human
caggagagagaaagccagg

SEQ ID NO: 2392067 - RNA, 20 nt, Human
caggagagagaaagccaggc

SEQ ID NO: 2392068 - RNA, 12 nt, Human
caggagagagaa

SEQ ID NO: 2392069 - RNA, 13 nt, Human
caggagagagaaa

SEQ ID NO: 2392070 - RNA, 14 nt, Human
caggagagagaaag

SEQ ID NO: 2392071 - RNA, 18 nt, Human
caggagagagaaagccag

SEQ ID NO: 2392072 - RNA, 12 nt, Human
caggagacaucc

SEQ ID NO: 2392073 - RNA, 14 nt, Human
caggagacaggaag

SEQ ID NO: 2392074 - RNA, 22 nt, Human
caggagaaggccaauuccuaua

SEQ ID NO: 2392075 - RNA, 21 nt, Human
caggagaaggccaauuccuau

SEQ ID NO: 2392076 - RNA, 19 nt, Human
caggagaaggccaauuccu

SEQ ID NO: 2392077 - RNA, 17 nt, Human
caggagaaccacuacau

SEQ ID NO: 2392078 - RNA, 19 nt, Human
caggacuuaacggcuccag

SEQ ID NO: 2392079 - RNA, 20 nt, Human
caggacuuaacggcuccagg

SEQ ID NO: 2392080 - RNA, 21 nt, Human
caggacuuaacggcuccagga

SEQ ID NO: 2392081 - RNA, 23 nt, Human
caggacuuaacggcuccaggauu

SEQ ID NO: 2392082 - RNA, 11 nt, Human
caggagaacca

SEQ ID NO: 2392083 - RNA, 23 nt, Human
caggagaaaugcauccauuccuc

SEQ ID NO: 2392084 - RNA, 20 nt, Human
caggacuuggucugauuuca

SEQ ID NO: 2392085 - RNA, 23 nt, Human
caggacuuggucugauuucagga

SEQ ID NO: 2392086 - RNA, 24 nt, Human
caggacggggccggccaggugggc

SEQ ID NO: 2392087 - RNA, 22 nt, Human
caggacggggccggccaggugg

SEQ ID NO: 2392088 - RNA, 23 nt, Human
caggacggggccggccagguggg

SEQ ID NO: 2392089 - RNA, 16 nt, Human
caggacuauagcccag

SEQ ID NO: 2392090 - RNA, 17 nt, Human
caggacuauagcccagg

SEQ ID NO: 2392091 - RNA, 18 nt, Human
caggacuauagcccaggu

SEQ ID NO: 2392092 - RNA, 20 nt, Human
caggacuauauuugggccug

SEQ ID NO: 2392093 - RNA, 16 nt, Human
caggacucagaagccu

SEQ ID NO: 2392094 - RNA, 19 nt, Human
caggacucagaagccucug

SEQ ID NO: 2392095 - RNA, 18 nt, Human
caggacucagaagccucu

SEQ ID NO: 2392096 - RNA, 21 nt, Human
caggacucagaagccucuggg

SEQ ID NO: 2392097 - RNA, 20 nt, Human
caggacucagaagccucugg

SEQ ID NO: 2392098 - RNA, 21 nt, Human
caggacuauagcccagguccu

SEQ ID NO: 2392099 - RNA, 14 nt, Human
caggacucagcucc

SEQ ID NO: 2392100 - RNA, 17 nt, Human
caggacucagcucccca

SEQ ID NO: 2392101 - RNA, 18 nt, Human
caggacucagcuccccag

SEQ ID NO: 2392102 - RNA, 21 nt, Human
caggacucccuccucaccucu

SEQ ID NO: 2392103 - RNA, 20 nt, Human
caggacucccuccucaccuc

SEQ ID NO: 2392104 - RNA, 19 nt, Human
caggacucccuccucaccu

SEQ ID NO: 2392105 - RNA, 17 nt, Human
caggacucccuccucac

SEQ ID NO: 2392106 - RNA, 16 nt, Human
caggacucccuccuca

SEQ ID NO: 2392107 - RNA, 15 nt, Human
caggacucccuccuc

SEQ ID NO: 2392108 - RNA, 14 nt, Human
caggacucccuccu

SEQ ID NO: 2392109 - RNA, 13 nt, Human
caggacucccucc

SEQ ID NO: 2392110 - RNA, 19 nt, Human
caggacucagcuccccaga

SEQ ID NO: 2392111 - RNA, 20 nt, Human
caggacucagcuccccagag

SEQ ID NO: 2392112 - RNA, 21 nt, Human
caggacucagcuccccagagu

SEQ ID NO: 2392113 - RNA, 15 nt, Human
caggacuccccaggc

SEQ ID NO: 2392114 - RNA, 16 nt, Human
caggacuccccaggcc

SEQ ID NO: 2392115 - RNA, 17 nt, Human
caggacuccccaggcca

SEQ ID NO: 2392116 - RNA, 18 nt, Human
caggacuccccaggccag

SEQ ID NO: 2392117 - RNA, 19 nt, Human
caggacuccccaggccagg

SEQ ID NO: 2392118 - RNA, 20 nt, Human
caggacuccccaggccaggc

SEQ ID NO: 2392119 - RNA, 21 nt, Human
caggacugaauuguccccagu

SEQ ID NO: 2392120 - RNA, 20 nt, Human
caggacugaauuguccccag

SEQ ID NO: 2392121 - RNA, 14 nt, Human
caggacugagcccc

SEQ ID NO: 2392122 - RNA, 17 nt, Human
caggacugagccccgca

SEQ ID NO: 2392123 - RNA, 19 nt, Human
caggacugaauugucccca

SEQ ID NO: 2392124 - RNA, 18 nt, Human
caggacugaauugucccc

SEQ ID NO: 2392125 - RNA, 20 nt, Human
caggacucugcccagaccac

SEQ ID NO: 2392126 - RNA, 18 nt, Human
caggacucuugugaaaag

SEQ ID NO: 2392127 - RNA, 18 nt, Human
caggacugagccccgcag

SEQ ID NO: 2392128 - RNA, 20 nt, Human
caggacugagccccgcagac

SEQ ID NO: 2392129 - RNA, 19 nt, Human
caggacugcaacaggcuug

SEQ ID NO: 2392130 - RNA, 13 nt, Human
caggacugcacag

SEQ ID NO: 2392131 - RNA, 20 nt, Human
caggacugggccacuucugg

SEQ ID NO: 2392132 - RNA, 14 nt, Human
caggacugugacuc

SEQ ID NO: 2392133 - RNA, 15 nt, Human
caggacugggccacu

SEQ ID NO: 2392134 - RNA, 16 nt, Human
caggacugggccacuu

SEQ ID NO: 2392135 - RNA, 12 nt, Human
caggacugggcc

SEQ ID NO: 2392136 - RNA, 13 nt, Human
caggacugggcca

SEQ ID NO: 2392137 - RNA, 23 nt, Human
caggacucccuccucaccucugg

SEQ ID NO: 2392138 - RNA, 22 nt, Human
caggacucccuccucaccucug

SEQ ID NO: 2392139 - RNA, 12 nt, Human
caggacucugcc

SEQ ID NO: 2392140 - RNA, 13 nt, Human
caggacucugccu

SEQ ID NO: 2392141 - RNA, 15 nt, Human
caggacucugccucc

SEQ ID NO: 2392142 - RNA, 16 nt, Human
caggacucugccuccu

SEQ ID NO: 2392143 - RNA, 23 nt, Human
caggagccccgaggccuucucug

SEQ ID NO: 2392144 - RNA, 11 nt, Human
caggagcccug

SEQ ID NO: 2392145 - RNA, 20 nt, Human
caggagccccgaggccuucu

SEQ ID NO: 2392146 - RNA, 22 nt, Human
caggagccccgaggccuucucu

SEQ ID NO: 2392147 - RNA, 14 nt, Human
caggagcccuggga

SEQ ID NO: 2392148 - RNA, 16 nt, Human
caggagcccugggagg

SEQ ID NO: 2392149 - RNA, 18 nt, Human
caggagcccugggaggcu

SEQ ID NO: 2392150 - RNA, 19 nt, Human
caggagcccugggaggcuc

SEQ ID NO: 2392151 - RNA, 15 nt, Human
caggagccccgaggc

SEQ ID NO: 2392152 - RNA, 20 nt, Human
caggagcaguaucaugaagc

SEQ ID NO: 2392153 - RNA, 16 nt, Human
caggagcaguaucaug

SEQ ID NO: 2392154 - RNA, 15 nt, Human
caggagcagccucag

SEQ ID NO: 2392155 - RNA, 20 nt, Human
caggagcagccucagaacaa

SEQ ID NO: 2392156 - RNA, 23 nt, Human
caggagcagccucagaacaaagu

SEQ ID NO: 2392157 - RNA, 16 nt, Human
caggagccccgaggcc

SEQ ID NO: 2392158 - RNA, 18 nt, Human
caggagccccgaggccuu

SEQ ID NO: 2392159 - RNA, 12 nt, Human
caggagcagcca

SEQ ID NO: 2392160 - RNA, 13 nt, Human
caggagcagccac

SEQ ID NO: 2392161 - RNA, 14 nt, Human
caggagcagccaca

SEQ ID NO: 2392162 - RNA, 19 nt, Human
caggagcagccacauuccu

SEQ ID NO: 2392163 - RNA, 15 nt, Human
caggagccugugccu

SEQ ID NO: 2392164 - RNA, 16 nt, Human
caggagccugugccuc

SEQ ID NO: 2392165 - RNA, 20 nt, Human
caggagccuccugcccuuac

SEQ ID NO: 2392166 - RNA, 12 nt, Human
caggagccuggc

SEQ ID NO: 2392167 - RNA, 11 nt, Human
caggagccugg

SEQ ID NO: 2392168 - RNA, 14 nt, Human
caggagccuccugc

SEQ ID NO: 2392169 - RNA, 17 nt, Human
caggagccuccugcccu

SEQ ID NO: 2392170 - RNA, 22 nt, Human
caggagcauccaccuccuucuc

SEQ ID NO: 2392171 - RNA, 20 nt, Human
caggagcauccaccuccuuc

SEQ ID NO: 2392172 - RNA, 21 nt, Human
caggagcccugggaggcucug

SEQ ID NO: 2392173 - RNA, 21 nt, Human
caggagucccaaggaaagccc

SEQ ID NO: 2392174 - RNA, 19 nt, Human
caggagucccaaggaaagc

SEQ ID NO: 2392175 - RNA, 14 nt, Human
caggagucccugcc

SEQ ID NO: 2392176 - RNA, 21 nt, Human
caggagucccugccaucaugu

SEQ ID NO: 2392177 - RNA, 15 nt, Human
caggagucccugcca

SEQ ID NO: 2392178 - RNA, 15 nt, Human
caggagucccuggua

SEQ ID NO: 2392179 - RNA, 14 nt, Human
caggagucccuggu

SEQ ID NO: 2392180 - RNA, 13 nt, Human
caggagucccugg

SEQ ID NO: 2392181 - RNA, 24 nt, Human
caggagucccaaggaaagccccag

SEQ ID NO: 2392182 - RNA, 12 nt, Human
caggagugagca

SEQ ID NO: 2392183 - RNA, 18 nt, Human
caggagucccaaggaaag

SEQ ID NO: 2392184 - RNA, 17 nt, Human
caggagucccaaggaaa

SEQ ID NO: 2392185 - RNA, 16 nt, Human
caggagucccaaggaa

SEQ ID NO: 2392186 - RNA, 15 nt, Human
caggagucccaagga

SEQ ID NO: 2392187 - RNA, 14 nt, Human
caggaguccacuuu

SEQ ID NO: 2392188 - RNA, 18 nt, Human
caggaguccacuuuguuu

SEQ ID NO: 2392189 - RNA, 16 nt, Human
caggaguuggaagugu

SEQ ID NO: 2392190 - RNA, 19 nt, Human
caggaguucgaggcugcag

SEQ ID NO: 2392191 - RNA, 23 nt, Human
caggaguucgagaccagccuggc

SEQ ID NO: 2392192 - RNA, 18 nt, Human
caggaguucgaggcugca

SEQ ID NO: 2392193 - RNA, 21 nt, Human
caggaguuugagaccaaccug

SEQ ID NO: 2392194 - RNA, 19 nt, Human
caggaguuucguuuucaaa

SEQ ID NO: 2392195 - RNA, 21 nt, Human
caggaguucgagaccagccug

SEQ ID NO: 2392196 - RNA, 23 nt, Human
caggaguucaauaaaugucuguu

SEQ ID NO: 2392197 - RNA, 22 nt, Human
caggaguuagaggccagccugg

SEQ ID NO: 2392198 - RNA, 21 nt, Human
caggaguucaauaaaugucug

SEQ ID NO: 2392199 - RNA, 21 nt, Human
caggaguuagaggccagccug

SEQ ID NO: 2392200 - RNA, 20 nt, Human
caggaguuagaggccagccu

SEQ ID NO: 2392201 - RNA, 19 nt, Human
caggaguuagaggccagcc

SEQ ID NO: 2392202 - RNA, 18 nt, Human
caggaguuagaggccagc

SEQ ID NO: 2392203 - RNA, 17 nt, Human
caggaguuagaggccag

SEQ ID NO: 2392204 - RNA, 16 nt, Human
caggaguuagaggcca

SEQ ID NO: 2392205 - RNA, 19 nt, Human
caggaguuaaaaagggcag

SEQ ID NO: 2392206 - RNA, 17 nt, Human
caggaguggguugauuu

SEQ ID NO: 2392207 - RNA, 22 nt, Human
caggagugggaaaacacugcca

SEQ ID NO: 2392208 - RNA, 22 nt, Human
caggaguuugaggcugcagcga

SEQ ID NO: 2392209 - RNA, 21 nt, Human
caggaguuugaggcugcagcg

SEQ ID NO: 2392210 - RNA, 20 nt, Human
caggaguuugaggcugcagc

SEQ ID NO: 2392211 - RNA, 18 nt, Human
caggaguuugaggcugca

SEQ ID NO: 2392212 - RNA, 23 nt, Human
caggaguuugagaccaaccuggg

SEQ ID NO: 2392213 - RNA, 22 nt, Human
caggaguuugagaccaaccugg

SEQ ID NO: 2392214 - RNA, 17 nt, Human
caggauacucugucaga

SEQ ID NO: 2392215 - RNA, 14 nt, Human
caggauacaugugc

SEQ ID NO: 2392216 - RNA, 18 nt, Human
caggauaauaaaguguuu

SEQ ID NO: 2392217 - RNA, 20 nt, Human
caggauacucugucagaugg

SEQ ID NO: 2392218 - RNA, 18 nt, Human
caggauacucugucagau

SEQ ID NO: 2392219 - RNA, 23 nt, Human
caggauacucugucagaugggaa

SEQ ID NO: 2392220 - RNA, 15 nt, Human
caggauaguugcucc

SEQ ID NO: 2392221 - RNA, 13 nt, Human
caggauagacuuu

SEQ ID NO: 2392222 - RNA, 14 nt, Human
caggugacauguga

SEQ ID NO: 2392223 - RNA, 16 nt, Human
caggugacaugugaaa

SEQ ID NO: 2392224 - RNA, 17 nt, Human
caggugacaugugaaac

SEQ ID NO: 2392225 - RNA, 17 nt, Human
caggugaccuucuggga

SEQ ID NO: 2392226 - RNA, 23 nt, Human
caggugaccaaaauccccuucuc

SEQ ID NO: 2392227 - RNA, 18 nt, Human
caggugacaugugaaacc

SEQ ID NO: 2392228 - RNA, 21 nt, Human
caggugacaugugaaaccuuu

SEQ ID NO: 2392229 - RNA, 12 nt, Human
caggugacaugu

SEQ ID NO: 2392230 - RNA, 20 nt, Human
caggugaagcaccaagcuca

SEQ ID NO: 2392231 - RNA, 21 nt, Human
caggucuuuccuaaggcugca

SEQ ID NO: 2392232 - RNA, 19 nt, Human
caggucuuuccuaaggcug

SEQ ID NO: 2392233 - RNA, 14 nt, Human
caggucuuuccuaa

SEQ ID NO: 2392234 - RNA, 22 nt, Human
caggucuccucuuaaaaaauaa

SEQ ID NO: 2392235 - RNA, 19 nt, Human
caggucuuggagcugagcc

SEQ ID NO: 2392236 - RNA, 20 nt, Human
caggucuucaucgaaucuac

SEQ ID NO: 2392237 - RNA, 13 nt, Human
caggucuuuccua

SEQ ID NO: 2392238 - RNA, 23 nt, Human
caggucuuggagcugagccucuc

SEQ ID NO: 2392239 - RNA, 20 nt, Human
caggucuuggagcugagccu

SEQ ID NO: 2392240 - RNA, 21 nt, Human
caggucuuggagcugagccuc

SEQ ID NO: 2392241 - RNA, 20 nt, Human
caggugagaagcagaggaag

SEQ ID NO: 2392242 - RNA, 13 nt, Human
caggugagaagca

SEQ ID NO: 2392243 - RNA, 18 nt, Human
caggugaccuucugggaa

SEQ ID NO: 2392244 - RNA, 21 nt, Human
caggugagcaaccaguuggcu

SEQ ID NO: 2392245 - RNA, 21 nt, Human
caggugcugcuacccucccug

SEQ ID NO: 2392246 - RNA, 15 nt, Human
caggugagcccaugg

SEQ ID NO: 2392247 - RNA, 17 nt, Human
caggugagcccauggcc

SEQ ID NO: 2392248 - RNA, 21 nt, Human
caggugagaagcagaggaagg

SEQ ID NO: 2392249 - RNA, 19 nt, Human
cagguggccaugccucagc

SEQ ID NO: 2392250 - RNA, 22 nt, Human
cagguggcucugaggugccugu

SEQ ID NO: 2392251 - RNA, 13 nt, Human
cagguggccaugc

SEQ ID NO: 2392252 - RNA, 15 nt, Human
cagguggccaugccu

SEQ ID NO: 2392253 - RNA, 23 nt, Human
cagguggcugacccagucccugg

SEQ ID NO: 2392254 - RNA, 20 nt, Human
cagguggcugacccaguccc

SEQ ID NO: 2392255 - RNA, 19 nt, Human
cagguggcugacccagucc

SEQ ID NO: 2392256 - RNA, 16 nt, Human
cagguggcugacccag

SEQ ID NO: 2392257 - RNA, 15 nt, Human
cagguggcugaccca

SEQ ID NO: 2392258 - RNA, 14 nt, Human
cagguggcugaccc

SEQ ID NO: 2392259 - RNA, 16 nt, Human
cagguggccacuccag

SEQ ID NO: 2392260 - RNA, 19 nt, Human
cagguggccacuccagacc

SEQ ID NO: 2392261 - RNA, 21 nt, Human
cagguggccacuccagacccc

SEQ ID NO: 2392262 - RNA, 19 nt, Human
cagguggccagccuggauc

SEQ ID NO: 2392263 - RNA, 15 nt, Human
cagguggccacucca

SEQ ID NO: 2392264 - RNA, 21 nt, Human
cagguggcaggaccaggacua

SEQ ID NO: 2392265 - RNA, 18 nt, Human
cagguggcaggaccagga

SEQ ID NO: 2392266 - RNA, 20 nt, Human
cagguggcaggaccaggacu

SEQ ID NO: 2392267 - RNA, 21 nt, Human
cagguggaggugucaggcugc

SEQ ID NO: 2392268 - RNA, 23 nt, Human
cagguggaggugucaggcugcug

SEQ ID NO: 2392269 - RNA, 15 nt, Human
cagguggcaggacca

SEQ ID NO: 2392270 - RNA, 16 nt, Human
cagguggcaggaccag

SEQ ID NO: 2392271 - RNA, 17 nt, Human
cagguggcaggaccagg

SEQ ID NO: 2392272 - RNA, 20 nt, Human
caggugagcccauggcccuc

SEQ ID NO: 2392273 - RNA, 22 nt, Human
caggugcugcuacccucccugc

SEQ ID NO: 2392274 - RNA, 23 nt, Human
caggugcugcuacccucccugcu

SEQ ID NO: 2392275 - RNA, 13 nt, Human
caggugcugcugc

SEQ ID NO: 2392276 - RNA, 21 nt, Human
cagguccugcagucuggcuga

SEQ ID NO: 2392277 - RNA, 21 nt, Human
cagguccucugauacccagag

SEQ ID NO: 2392278 - RNA, 22 nt, Human
cagguccucugauacccagagc

SEQ ID NO: 2392279 - RNA, 20 nt, Human
cagguccucagagaauuucu

SEQ ID NO: 2392280 - RNA, 15 nt, Human
cagguccucagagaa

SEQ ID NO: 2392281 - RNA, 19 nt, Human
caggucccuaauaaagcug

SEQ ID NO: 2392282 - RNA, 20 nt, Human
caggucccuaauaaagcugu

SEQ ID NO: 2392283 - RNA, 21 nt, Human
caggucccuaauaaagcugug

SEQ ID NO: 2392284 - RNA, 22 nt, Human
caggucccuaauaaagcugugu

SEQ ID NO: 2392285 - RNA, 11 nt, Human
caggucuccuc

SEQ ID NO: 2392286 - RNA, 19 nt, Human
caggucucccacgugggag

SEQ ID NO: 2392287 - RNA, 20 nt, Human
caggucucccacgugggaga

SEQ ID NO: 2392288 - RNA, 12 nt, Human
caggucucccac

SEQ ID NO: 2392289 - RNA, 14 nt, Human
caggucucacgggc

SEQ ID NO: 2392290 - RNA, 13 nt, Human
caggucucccacg

SEQ ID NO: 2392291 - RNA, 14 nt, Human
caggucuccucuua

SEQ ID NO: 2392292 - RNA, 13 nt, Human
caggucuccucuu

SEQ ID NO: 2392293 - RNA, 22 nt, Human
caggucucccacgugggagaca

SEQ ID NO: 2392294 - RNA, 19 nt, Human
caggucuccuccaccgcca

SEQ ID NO: 2392295 - RNA, 17 nt, Human
caggucuccucuuaaaa

SEQ ID NO: 2392296 - RNA, 15 nt, Human
caggucuccucuuaa

SEQ ID NO: 2392297 - RNA, 18 nt, Human
caggucuugaacuccugg

SEQ ID NO: 2392298 - RNA, 19 nt, Human
caggucuugaacuccuggc

SEQ ID NO: 2392299 - RNA, 20 nt, Human
caggucuugaacuccuggcc

SEQ ID NO: 2392300 - RNA, 21 nt, Human
caggucuugaacuccuggccu

SEQ ID NO: 2392301 - RNA, 22 nt, Human
caggucuugaacuccuggccuc

SEQ ID NO: 2392302 - RNA, 23 nt, Human
caggucuugaacuccuggccuca

SEQ ID NO: 2392303 - RNA, 22 nt, Human
caggucaauacaguacaggcag

SEQ ID NO: 2392304 - RNA, 23 nt, Human
caggucaauacaguacaggcagc

SEQ ID NO: 2392305 - RNA, 17 nt, Human
caggucacacgaggggc

SEQ ID NO: 2392306 - RNA, 16 nt, Human
cagguauguugccuuu

SEQ ID NO: 2392307 - RNA, 20 nt, Human
cagguauguugccuuuaugg

SEQ ID NO: 2392308 - RNA, 23 nt, Human
cagguauggaaggguuuguggcu

SEQ ID NO: 2392309 - RNA, 14 nt, Human
cagguauguugccu

SEQ ID NO: 2392310 - RNA, 15 nt, Human
cagguauguugccuu

SEQ ID NO: 2392311 - RNA, 20 nt, Human
caggucaggaguucgagacc

SEQ ID NO: 2392312 - RNA, 16 nt, Human
caggucagggugagga

SEQ ID NO: 2392313 - RNA, 12 nt, Human
cagguccccaga

SEQ ID NO: 2392314 - RNA, 23 nt, Human
cagguccagcucuggaggggagg

SEQ ID NO: 2392315 - RNA, 18 nt, Human
cagguccccagcuuuggc

SEQ ID NO: 2392316 - RNA, 13 nt, Human
cagguccccagac

SEQ ID NO: 2392317 - RNA, 22 nt, Human
cagguccacggucuguucuuga

SEQ ID NO: 2392318 - RNA, 13 nt, Human
cagguccagcucu

SEQ ID NO: 2392319 - RNA, 14 nt, Human
cagguccagcucug

SEQ ID NO: 2392320 - RNA, 16 nt, Human
cagguccagcucugga

SEQ ID NO: 2392321 - RNA, 17 nt, Human
cagguccagcucuggag

SEQ ID NO: 2392322 - RNA, 19 nt, Human
cagguccagcucuggaggg

SEQ ID NO: 2392323 - RNA, 11 nt, Human
caggucccuaa

SEQ ID NO: 2392324 - RNA, 12 nt, Human
caggucccuaau

SEQ ID NO: 2392325 - RNA, 13 nt, Human
caggucccuaaua

SEQ ID NO: 2392326 - RNA, 14 nt, Human
caggucccuaauaa

SEQ ID NO: 2392327 - RNA, 15 nt, Human
caggucccuaauaaa

SEQ ID NO: 2392328 - RNA, 16 nt, Human
caggucccuaauaaag

SEQ ID NO: 2392329 - RNA, 17 nt, Human
caggucccuaauaaagc

SEQ ID NO: 2392330 - RNA, 18 nt, Human
caggucccuaauaaagcu

SEQ ID NO: 2392331 - RNA, 20 nt, Human
cagguaugaccuucuaggaa

SEQ ID NO: 2392332 - RNA, 18 nt, Human
cagguaucuccaggauug

SEQ ID NO: 2392333 - RNA, 22 nt, Human
cagguaucuccaggauugaaga

SEQ ID NO: 2392334 - RNA, 14 nt, Human
cagguaucuccagg

SEQ ID NO: 2392335 - RNA, 15 nt, Human
cagguaucuccagga

SEQ ID NO: 2392336 - RNA, 16 nt, Human
cagguaucuccaggau

SEQ ID NO: 2392337 - RNA, 17 nt, Human
cagguauagacuccuga

SEQ ID NO: 2392338 - RNA, 23 nt, Human
cagguaguugcaauugaauuaaa

SEQ ID NO: 2392339 - RNA, 18 nt, Human
cagguaguugcaauugaa

SEQ ID NO: 2392340 - RNA, 23 nt, Human
cagguaggaggcaaauaucuuga

SEQ ID NO: 2392341 - RNA, 14 nt, Human
cagguaggaggcaa

SEQ ID NO: 2392342 - RNA, 19 nt, Human
cagguagaacacaagguca

SEQ ID NO: 2392343 - RNA, 19 nt, Human
cagguagcugccccuggcu

SEQ ID NO: 2392344 - RNA, 18 nt, Human
cagguagcugccccuggc

SEQ ID NO: 2392345 - RNA, 16 nt, Human
cagguagcugccccug

SEQ ID NO: 2392346 - RNA, 15 nt, Human
cagguagcugccccu

SEQ ID NO: 2392347 - RNA, 14 nt, Human
cagguagcugcccc

SEQ ID NO: 2392348 - RNA, 12 nt, Human
cagguagccagg

SEQ ID NO: 2392349 - RNA, 23 nt, Human
cagguagcugccccuggcucuga

SEQ ID NO: 2392350 - RNA, 21 nt, Human
cagguagcugccccuggcucu

SEQ ID NO: 2392351 - RNA, 20 nt, Human
cagguagcugccccuggcuc

SEQ ID NO: 2392352 - RNA, 22 nt, Human
cagguagcugccccuggcucug

SEQ ID NO: 2392353 - RNA, 20 nt, Human
cagguaacaggcagauacag

SEQ ID NO: 2392354 - RNA, 21 nt, Human
cagguaacaggcagauacagg

SEQ ID NO: 2392355 - RNA, 20 nt, Human
cagguaaucgaccugccucg

SEQ ID NO: 2392356 - RNA, 19 nt, Human
cagguaaucgaccugccuc

SEQ ID NO: 2392357 - RNA, 18 nt, Human
cagguaaucgaccugccu

SEQ ID NO: 2392358 - RNA, 17 nt, Human
cagguaaucgaccugcc

SEQ ID NO: 2392359 - RNA, 13 nt, Human
cagguaccagcug

SEQ ID NO: 2392360 - RNA, 14 nt, Human
cagguaccagcugc

SEQ ID NO: 2392361 - RNA, 15 nt, Human
cagguaccagcugcg

SEQ ID NO: 2392362 - RNA, 19 nt, Human
cagguaaugugaauaaauu

SEQ ID NO: 2392363 - RNA, 13 nt, Human
cagguaaugugaa

SEQ ID NO: 2392364 - RNA, 17 nt, Human
cagguaaauuaagacau

SEQ ID NO: 2392365 - RNA, 15 nt, Human
cagguaaugagggac

SEQ ID NO: 2392366 - RNA, 17 nt, Human
cagguaaugagggacug

SEQ ID NO: 2392367 - RNA, 20 nt, Human
cagguaaugagggacuggaa

SEQ ID NO: 2392368 - RNA, 22 nt, Human
cagguaaugagggacuggaacc

SEQ ID NO: 2392369 - RNA, 23 nt, Human
cagguaaugagggacuggaacca

SEQ ID NO: 2392370 - RNA, 21 nt, Human
cagguaccagcugcgcuugcu

SEQ ID NO: 2392371 - RNA, 16 nt, Human
cagguaccagcugcgc

SEQ ID NO: 2392372 - RNA, 17 nt, Human
cagguaccagcugcgcu

SEQ ID NO: 2392373 - RNA, 18 nt, Human
cagguaccagcugcgcuu

SEQ ID NO: 2392374 - RNA, 19 nt, Human
cagguaccagcugcgcuug

SEQ ID NO: 2392375 - RNA, 12 nt, Human
cagggucccugg

SEQ ID NO: 2392376 - RNA, 14 nt, Human
cagggucccuggug

SEQ ID NO: 2392377 - RNA, 14 nt, Human
cagggucaggagag

SEQ ID NO: 2392378 - RNA, 22 nt, Human
caggguccacaggaagugaaga

SEQ ID NO: 2392379 - RNA, 21 nt, Human
cagggucacugaaggccuggc

SEQ ID NO: 2392380 - RNA, 17 nt, Human
cagggucccauuucuca

SEQ ID NO: 2392381 - RNA, 13 nt, Human
cagggucccucug

SEQ ID NO: 2392382 - RNA, 15 nt, Human
cagggucccuggugg

SEQ ID NO: 2392383 - RNA, 18 nt, Human
cagggucccugguggcag

SEQ ID NO: 2392384 - RNA, 19 nt, Human
cagggucccugguggcagc

SEQ ID NO: 2392385 - RNA, 22 nt, Human
cagggucccugguggcagcuca

SEQ ID NO: 2392386 - RNA, 20 nt, Human
cagggucacugaaggccugg

SEQ ID NO: 2392387 - RNA, 21 nt, Human
caggguauuccagagugggga

SEQ ID NO: 2392388 - RNA, 20 nt, Human
caggguauuccagagugggg

SEQ ID NO: 2392389 - RNA, 21 nt, Human
caggguagcccgccugccagu

SEQ ID NO: 2392390 - RNA, 18 nt, Human
caggguauggacuaucug

SEQ ID NO: 2392391 - RNA, 23 nt, Human
caggguauggacuaucugucugg

SEQ ID NO: 2392392 - RNA, 16 nt, Human
caggguagcagguacc

SEQ ID NO: 2392393 - RNA, 13 nt, Human
caggguagcaggu

SEQ ID NO: 2392394 - RNA, 23 nt, Human
caggguagauaaccuguacuuca

SEQ ID NO: 2392395 - RNA, 13 nt, Human
caggguagcccgc

SEQ ID NO: 2392396 - RNA, 15 nt, Human
caggguagcccgccu

SEQ ID NO: 2392397 - RNA, 16 nt, Human
caggguagcccgccug

SEQ ID NO: 2392398 - RNA, 20 nt, Human
caggguagcccgccugccag

SEQ ID NO: 2392399 - RNA, 22 nt, Human
cagggguugcagugagcggaga

SEQ ID NO: 2392400 - RNA, 13 nt, Human
cagggguucgaga

SEQ ID NO: 2392401 - RNA, 17 nt, Human
cagggguucgagaccag

SEQ ID NO: 2392402 - RNA, 21 nt, Human
cagggguucgagaccagucug

SEQ ID NO: 2392403 - RNA, 13 nt, Human
cagggguuucucg

SEQ ID NO: 2392404 - RNA, 13 nt, Human
cagggguugcagu

SEQ ID NO: 2392405 - RNA, 15 nt, Human
cagggguugcaguga

SEQ ID NO: 2392406 - RNA, 22 nt, Human
cagggguggcugccucauuuag

SEQ ID NO: 2392407 - RNA, 12 nt, Human
cagggguggggg

SEQ ID NO: 2392408 - RNA, 20 nt, Human
cagggguggggguggaggcu

SEQ ID NO: 2392409 - RNA, 22 nt, Human
cagggguggggguggaggcuuc

SEQ ID NO: 2392410 - RNA, 15 nt, Human
cagguaaacuccugu

SEQ ID NO: 2392411 - RNA, 16 nt, Human
caggguuuugccaugu

SEQ ID NO: 2392412 - RNA, 16 nt, Human
cagggucucacucugu

SEQ ID NO: 2392413 - RNA, 14 nt, Human
cagguaacaggcag

SEQ ID NO: 2392414 - RNA, 15 nt, Human
cagguaacaggcaga

SEQ ID NO: 2392415 - RNA, 16 nt, Human
cagguaacaggcagau

SEQ ID NO: 2392416 - RNA, 17 nt, Human
cagguaacaggcagaua

SEQ ID NO: 2392417 - RNA, 18 nt, Human
caggguccuguagcccua

SEQ ID NO: 2392418 - RNA, 15 nt, Human
cagggucccugcugu

SEQ ID NO: 2392419 - RNA, 21 nt, Human
cagggucccauuucucacuga

SEQ ID NO: 2392420 - RNA, 13 nt, Human
cagggucccugcu

SEQ ID NO: 2392421 - RNA, 15 nt, Human
cagggucccucugug

SEQ ID NO: 2392422 - RNA, 16 nt, Human
cagggucccucugugu

SEQ ID NO: 2392423 - RNA, 23 nt, Human
cagggucccugguggcagcucac

SEQ ID NO: 2392424 - RNA, 21 nt, Human
cagggucucacuauguugccc

SEQ ID NO: 2392425 - RNA, 22 nt, Human
cagggucucacuauguugccca

SEQ ID NO: 2392426 - RNA, 23 nt, Human
cagggucucacuauguugcccag

SEQ ID NO: 2392427 - RNA, 15 nt, Human
cagggucucacucug

SEQ ID NO: 2392428 - RNA, 22 nt, Human
caggggugcccccuccucuccc

SEQ ID NO: 2392429 - RNA, 23 nt, Human
caggggugcccccuccucuccca

SEQ ID NO: 2392430 - RNA, 13 nt, Human
caggggugccccc

SEQ ID NO: 2392431 - RNA, 15 nt, Human
caggggugcccccuc

SEQ ID NO: 2392432 - RNA, 16 nt, Human
caggggugcccccucc

SEQ ID NO: 2392433 - RNA, 17 nt, Human
caggggugcccccuccu

SEQ ID NO: 2392434 - RNA, 16 nt, Human
caggggucucccugga

SEQ ID NO: 2392435 - RNA, 20 nt, Human
caggggugauuucagagagg

SEQ ID NO: 2392436 - RNA, 21 nt, Human
caggggucgucaccaccucuc

SEQ ID NO: 2392437 - RNA, 18 nt, Human
caggggucgucaccaccu

SEQ ID NO: 2392438 - RNA, 17 nt, Human
caggggucucccuggag

SEQ ID NO: 2392439 - RNA, 20 nt, Human
caggggucccagccaccccg

SEQ ID NO: 2392440 - RNA, 18 nt, Human
caggggucccagccaccc

SEQ ID NO: 2392441 - RNA, 16 nt, Human
cagggggugugucugc

SEQ ID NO: 2392442 - RNA, 14 nt, Human
caggggugggacac

SEQ ID NO: 2392443 - RNA, 15 nt, Human
caggggugggacacc

SEQ ID NO: 2392444 - RNA, 20 nt, Human
caggggugggacacccugug

SEQ ID NO: 2392445 - RNA, 21 nt, Human
caggggugggacacccuguga

SEQ ID NO: 2392446 - RNA, 22 nt, Human
cagguggcugacccagucccug

SEQ ID NO: 2392447 - RNA, 21 nt, Human
caggugggcgggcagcacagc

SEQ ID NO: 2392448 - RNA, 22 nt, Human
caggugggcgggcagcacagca

SEQ ID NO: 2392449 - RNA, 17 nt, Human
caggugggcguggucac

SEQ ID NO: 2392450 - RNA, 23 nt, Human
caggugggcguggucacugcugu

SEQ ID NO: 2392451 - RNA, 21 nt, Human
caggugggcguggucacugcu

SEQ ID NO: 2392452 - RNA, 16 nt, Human
caggugggcuucccag

SEQ ID NO: 2392453 - RNA, 22 nt, Human
cagguggggagacugggcugag

SEQ ID NO: 2392454 - RNA, 20 nt, Human
cagguggggagacugggcug

SEQ ID NO: 2392455 - RNA, 19 nt, Human
cagguggggagacugggcu

SEQ ID NO: 2392456 - RNA, 19 nt, Human
caggugggcuucccagugg

SEQ ID NO: 2392457 - RNA, 22 nt, Human
caggugggcuucccaguggcug

SEQ ID NO: 2392458 - RNA, 13 nt, Human
cagguggggcagc

SEQ ID NO: 2392459 - RNA, 14 nt, Human
cagguggggcagcu

SEQ ID NO: 2392460 - RNA, 15 nt, Human
cagguggggcagcuu

SEQ ID NO: 2392461 - RNA, 16 nt, Human
cagguggggcagcuug

SEQ ID NO: 2392462 - RNA, 17 nt, Human
cagguggggcagcuuga

SEQ ID NO: 2392463 - RNA, 18 nt, Human
cagguggggucacucugg

SEQ ID NO: 2392464 - RNA, 12 nt, Human
cagguggggagg

SEQ ID NO: 2392465 - RNA, 23 nt, Human
caggugggcuucccaguggcugc

SEQ ID NO: 2392466 - RNA, 23 nt, Human
cagguggggagacugggcugagg

SEQ ID NO: 2392467 - RNA, 23 nt, Human
cagguggggagucagggaccccu

SEQ ID NO: 2392468 - RNA, 15 nt, Human
cagguggggaggggg

SEQ ID NO: 2392469 - RNA, 17 nt, Human
cagguggggugaggcag

SEQ ID NO: 2392470 - RNA, 23 nt, Human
cagguggggucacucuggcagcu

SEQ ID NO: 2392471 - RNA, 18 nt, Human
caggugguuauggagagg

SEQ ID NO: 2392472 - RNA, 22 nt, Human
cagguggggugaggcagugggu

SEQ ID NO: 2392473 - RNA, 16 nt, Human
caggugguccugagac

SEQ ID NO: 2392474 - RNA, 20 nt, Human
caggugguccugagaccuga

SEQ ID NO: 2392475 - RNA, 15 nt, Human
caggugguggcacug

SEQ ID NO: 2392476 - RNA, 19 nt, Human
caggugguggcacugagcc

SEQ ID NO: 2392477 - RNA, 20 nt, Human
caggugguggcacugagccc

SEQ ID NO: 2392478 - RNA, 19 nt, Human
cagguggggucacucuggc

SEQ ID NO: 2392479 - RNA, 20 nt, Human
cagguggggucacucuggca

SEQ ID NO: 2392480 - RNA, 21 nt, Human
cagguggggucacucuggcag

SEQ ID NO: 2392481 - RNA, 22 nt, Human
cagguggggucacucuggcagc

SEQ ID NO: 2392482 - RNA, 21 nt, Human
caggugguggcacugagcccc

SEQ ID NO: 2392483 - RNA, 22 nt, Human
caggugguggcacugagccccc

SEQ ID NO: 2392484 - RNA, 21 nt, Human
caggugguggcugcaaggugg

SEQ ID NO: 2392485 - RNA, 20 nt, Human
caggugguuauggagagggu

SEQ ID NO: 2392486 - RNA, 11 nt, Human
caggugucccu

SEQ ID NO: 2392487 - RNA, 14 nt, Human
caggugucccugca

SEQ ID NO: 2392488 - RNA, 13 nt, Human
caguaauaacucu

SEQ ID NO: 2392489 - RNA, 12 nt, Human
caguaauaacuc

SEQ ID NO: 2392490 - RNA, 13 nt, Human
caguaaguuccua

SEQ ID NO: 2392491 - RNA, 14 nt, Human
caguaagucuuuuu

SEQ ID NO: 2392492 - RNA, 18 nt, Human
caguaaguaucuggagga

SEQ ID NO: 2392493 - RNA, 15 nt, Human
caguaagccacugcc

SEQ ID NO: 2392494 - RNA, 19 nt, Human
caguaagcugcucuauugu

SEQ ID NO: 2392495 - RNA, 13 nt, Human
caguaaggcaggg

SEQ ID NO: 2392496 - RNA, 15 nt, Human
caguaagggaaauag

SEQ ID NO: 2392497 - RNA, 18 nt, Human
caguaagggaaauagaaa

SEQ ID NO: 2392498 - RNA, 20 nt, Human
caguacaggcagcacagaga

SEQ ID NO: 2392499 - RNA, 19 nt, Human
caguacaggcagcacagag

SEQ ID NO: 2392500 - RNA, 16 nt, Human
caguacaggcagcaca

SEQ ID NO: 2392501 - RNA, 14 nt, Human
caguacaggcagca

SEQ ID NO: 2392502 - RNA, 13 nt, Human
caguacaggcagc

SEQ ID NO: 2392503 - RNA, 12 nt, Human
caguacaggcag

SEQ ID NO: 2392504 - RNA, 17 nt, Human
caguaauuugaggacaa

SEQ ID NO: 2392505 - RNA, 16 nt, Human
caguaauugugaaaau

SEQ ID NO: 2392506 - RNA, 21 nt, Human
caguaauugguccgaucuuug

SEQ ID NO: 2392507 - RNA, 14 nt, Human
caguaauugugaaa

SEQ ID NO: 2392508 - RNA, 20 nt, Human
caguaauauuuauauauuua

SEQ ID NO: 2392509 - RNA, 13 nt, Human
caguaauauuuau

SEQ ID NO: 2392510 - RNA, 14 nt, Human
caguacccucucag

SEQ ID NO: 2392511 - RNA, 15 nt, Human
caguacccucucagc

SEQ ID NO: 2392512 - RNA, 16 nt, Human
caguacccucucagcu

SEQ ID NO: 2392513 - RNA, 19 nt, Human
caguacccucucagcucca

SEQ ID NO: 2392514 - RNA, 20 nt, Human
caguacccucucagcuccag

SEQ ID NO: 2392515 - RNA, 22 nt, Human
caguacccucucagcuccaggu

SEQ ID NO: 2392516 - RNA, 24 nt, Human
caguacccucucagcuccaggugg

SEQ ID NO: 2392517 - RNA, 16 nt, Human
caguaccuuugucaca

SEQ ID NO: 2392518 - RNA, 15 nt, Human
caguaccuuugucac

SEQ ID NO: 2392519 - RNA, 17 nt, Human
caguaccuuugucacaa

SEQ ID NO: 2392520 - RNA, 21 nt, Human
caguaccuggaggaggagcag

SEQ ID NO: 2392521 - RNA, 23 nt, Human
caguaccuucaaacuagggccaa

SEQ ID NO: 2392522 - RNA, 20 nt, Human
caguaccuauaaaguaaagc

SEQ ID NO: 2392523 - RNA, 20 nt, Human
caguaccuccugucucuggc

SEQ ID NO: 2392524 - RNA, 22 nt, Human
caguaccuauaaaguaaagcua

SEQ ID NO: 2392525 - RNA, 12 nt, Human
caguaccuccug

SEQ ID NO: 2392526 - RNA, 12 nt, Human
caguaccuggag

SEQ ID NO: 2392527 - RNA, 13 nt, Human
caguaccuggagg

SEQ ID NO: 2392528 - RNA, 14 nt, Human
caguaccuggagga

SEQ ID NO: 2392529 - RNA, 15 nt, Human
caguaccuggaggag

SEQ ID NO: 2392530 - RNA, 12 nt, Human
cagguucagcuu

SEQ ID NO: 2392531 - RNA, 24 nt, Human
cagguuaucgaaauaacaauguua

SEQ ID NO: 2392532 - RNA, 14 nt, Human
cagguuauuuuagu

SEQ ID NO: 2392533 - RNA, 16 nt, Human
cagguuauuuuaguuu

SEQ ID NO: 2392534 - RNA, 21 nt, Human
cagguuauuuuaguuucuguu

SEQ ID NO: 2392535 - RNA, 20 nt, Human
cagguucacaggcgaggccu

SEQ ID NO: 2392536 - RNA, 22 nt, Human
cagguucacaggcgaggccugg

SEQ ID NO: 2392537 - RNA, 19 nt, Human
cagguuaucgaaauaacaa

SEQ ID NO: 2392538 - RNA, 20 nt, Human
cagguuaucgaaauaacaau

SEQ ID NO: 2392539 - RNA, 23 nt, Human
cagguuaucgaaauaacaauguu

SEQ ID NO: 2392540 - RNA, 16 nt, Human
cagguuaucugggcau

SEQ ID NO: 2392541 - RNA, 19 nt, Human
cagguuagaaccuagaagg

SEQ ID NO: 2392542 - RNA, 22 nt, Human
cagguuacaacagauuugugaa

SEQ ID NO: 2392543 - RNA, 23 nt, Human
cagguuacaacagauuugugaac

SEQ ID NO: 2392544 - RNA, 23 nt, Human
cagguuagaaccuagaagggcua

SEQ ID NO: 2392545 - RNA, 13 nt, Human
cagguucagcuug

SEQ ID NO: 2392546 - RNA, 14 nt, Human
cagguucccaagcu

SEQ ID NO: 2392547 - RNA, 17 nt, Human
cagguucccaagcucag

SEQ ID NO: 2392548 - RNA, 15 nt, Human
cagguucccaagcuc

SEQ ID NO: 2392549 - RNA, 14 nt, Human
cagguuccaucccg

SEQ ID NO: 2392550 - RNA, 17 nt, Human
cagguuccuauggcugg

SEQ ID NO: 2392551 - RNA, 15 nt, Human
cagguucuauuugga

SEQ ID NO: 2392552 - RNA, 20 nt, Human
cagguucuccguuagcuccu

SEQ ID NO: 2392553 - RNA, 22 nt, Human
caguaaaugggggugcauuuga

SEQ ID NO: 2392554 - RNA, 20 nt, Human
caguaaaugggggugcauuu

SEQ ID NO: 2392555 - RNA, 16 nt, Human
cagguucuauuuggaa

SEQ ID NO: 2392556 - RNA, 17 nt, Human
cagguucuauuuggaau

SEQ ID NO: 2392557 - RNA, 19 nt, Human
cagguucuauuuggaauuu

SEQ ID NO: 2392558 - RNA, 21 nt, Human
cagguucuauuuggaauuuau

SEQ ID NO: 2392559 - RNA, 21 nt, Human
caguaaaugggggugcauuug

SEQ ID NO: 2392560 - RNA, 14 nt, Human
caguaacuuuaugu

SEQ ID NO: 2392561 - RNA, 16 nt, Human
caguaacuuuaugugu

SEQ ID NO: 2392562 - RNA, 17 nt, Human
caguaacuuuaugugua

SEQ ID NO: 2392563 - RNA, 18 nt, Human
caguaacuuuauguguaa

SEQ ID NO: 2392564 - RNA, 19 nt, Human
caguaacuuuauguguaaa

SEQ ID NO: 2392565 - RNA, 20 nt, Human
caguaacuuuauguguaaau

SEQ ID NO: 2392566 - RNA, 18 nt, Human
caguaacgcgucuuccug

SEQ ID NO: 2392567 - RNA, 19 nt, Human
caguaacgcgucuuccuga

SEQ ID NO: 2392568 - RNA, 20 nt, Human
caguaacgcgucuuccugag

SEQ ID NO: 2392569 - RNA, 18 nt, Human
caguaacgcaggggaaac

SEQ ID NO: 2392570 - RNA, 21 nt, Human
caguaacgcgucuuccugagu

SEQ ID NO: 2392571 - RNA, 16 nt, Human
caguaacucaucuguc

SEQ ID NO: 2392572 - RNA, 14 nt, Human
caguaacucaucug

SEQ ID NO: 2392573 - RNA, 15 nt, Human
caggugucccugcac

SEQ ID NO: 2392574 - RNA, 16 nt, Human
caggugucccugcacu

SEQ ID NO: 2392575 - RNA, 18 nt, Human
caggugucccugcacuug

SEQ ID NO: 2392576 - RNA, 19 nt, Human
caggugucccugcacuugc

SEQ ID NO: 2392577 - RNA, 12 nt, Human
caggugugaacc

SEQ ID NO: 2392578 - RNA, 16 nt, Human
cagguguuuaguugca

SEQ ID NO: 2392579 - RNA, 20 nt, Human
cagguguucuacacucaucu

SEQ ID NO: 2392580 - RNA, 13 nt, Human
cagguguugccaa

SEQ ID NO: 2392581 - RNA, 14 nt, Human
cagguguugccaaa

SEQ ID NO: 2392582 - RNA, 12 nt, Human
cagguguucuuc

SEQ ID NO: 2392583 - RNA, 22 nt, Human
cagguguuacuguaauuccuca

SEQ ID NO: 2392584 - RNA, 11 nt, Human
cagguuacaac

SEQ ID NO: 2392585 - RNA, 12 nt, Human
cagguuacaaca

SEQ ID NO: 2392586 - RNA, 13 nt, Human
cagguuacaacag

SEQ ID NO: 2392587 - RNA, 14 nt, Human
cagguuacaacaga

SEQ ID NO: 2392588 - RNA, 15 nt, Human
cagguuacaacagau

SEQ ID NO: 2392589 - RNA, 16 nt, Human
cagguuacaacagauu

SEQ ID NO: 2392590 - RNA, 17 nt, Human
cagguuacaacagauuu

SEQ ID NO: 2392591 - RNA, 19 nt, Human
cagguuacaacagauuugu

SEQ ID NO: 2392592 - RNA, 21 nt, Human
cagguuacaacagauuuguga

SEQ ID NO: 2392593 - RNA, 22 nt, Human
caggugugagucaccaagccca

SEQ ID NO: 2392594 - RNA, 23 nt, Human
caggugugagucaccaagcccag

SEQ ID NO: 2392595 - RNA, 13 nt, Human
caggugugcacgu

SEQ ID NO: 2392596 - RNA, 15 nt, Human
caggugugcacgugg

SEQ ID NO: 2392597 - RNA, 21 nt, Human
caggugugagccaccacgccc

SEQ ID NO: 2392598 - RNA, 20 nt, Human
cagguguguccaccugggca

SEQ ID NO: 2392599 - RNA, 21 nt, Human
cagguguguccaccugggcau

SEQ ID NO: 2392600 - RNA, 23 nt, Human
caggugugcacguggcauguggc

SEQ ID NO: 2392601 - RNA, 18 nt, Human
caggugugccgacagaag

SEQ ID NO: 2392602 - RNA, 19 nt, Human
caggugugccgacagaagg

SEQ ID NO: 2392603 - RNA, 16 nt, Human
caggugugaaccacca

SEQ ID NO: 2392604 - RNA, 19 nt, Human
caggugugaaccaccacac

SEQ ID NO: 2392605 - RNA, 22 nt, Human
caggugugaaccaccacaccca

SEQ ID NO: 2392606 - RNA, 23 nt, Human
caggugugaaccaccacacccag

SEQ ID NO: 2392607 - RNA, 20 nt, Human
caggugugagucaccaagcc

SEQ ID NO: 2392608 - RNA, 21 nt, Human
caggugugagucaccaagccc

SEQ ID NO: 2392609 - RNA, 16 nt, Human
caggugugagucacca

SEQ ID NO: 2392610 - RNA, 21 nt, Human
caggugucauauauggggggc

SEQ ID NO: 2392611 - RNA, 18 nt, Human
caggugugagccaccacg

SEQ ID NO: 2392612 - RNA, 21 nt, Human
cagucauuuuuguuucuaccu

SEQ ID NO: 2392613 - RNA, 17 nt, Human
caguccaaauguccucc

SEQ ID NO: 2392614 - RNA, 21 nt, Human
caguccaaauguccuccagaa

SEQ ID NO: 2392615 - RNA, 18 nt, Human
caguccaaauguccucca

SEQ ID NO: 2392616 - RNA, 23 nt, Human
caguccaaauguccuccagaagc

SEQ ID NO: 2392617 - RNA, 22 nt, Human
caguccaaauguccuccagaag

SEQ ID NO: 2392618 - RNA, 23 nt, Human
cagucauuuuuguuucuaccucc

SEQ ID NO: 2392619 - RNA, 19 nt, Human
caguccaaggaaaccacag

SEQ ID NO: 2392620 - RNA, 22 nt, Human
caguccaaggaaaccacagcug

SEQ ID NO: 2392621 - RNA, 23 nt, Human
caguccaaggaaaccacagcugc

SEQ ID NO: 2392622 - RNA, 20 nt, Human
caguccaccugagcugccau

SEQ ID NO: 2392623 - RNA, 18 nt, Human
caguccaccugagcugcc

SEQ ID NO: 2392624 - RNA, 16 nt, Human
caguccaccugagcug

SEQ ID NO: 2392625 - RNA, 15 nt, Human
caguccaccugagcu

SEQ ID NO: 2392626 - RNA, 24 nt, Human
caguccaaggaaaccacagcugcu

SEQ ID NO: 2392627 - RNA, 13 nt, Human
caguccacaaaau

SEQ ID NO: 2392628 - RNA, 13 nt, Human
caguccagccugg

SEQ ID NO: 2392629 - RNA, 14 nt, Human
caguccagccugga

SEQ ID NO: 2392630 - RNA, 15 nt, Human
caguccagccuggag

SEQ ID NO: 2392631 - RNA, 12 nt, Human
cagucauuuaaa

SEQ ID NO: 2392632 - RNA, 22 nt, Human
cagucauuagacuccuccucca

SEQ ID NO: 2392633 - RNA, 11 nt, Human
cagucauuuaa

SEQ ID NO: 2392634 - RNA, 21 nt, Human
cagucauuggcugucuccuag

SEQ ID NO: 2392635 - RNA, 17 nt, Human
cagucauuggcugucuc

SEQ ID NO: 2392636 - RNA, 13 nt, Human
cagucauuggcug

SEQ ID NO: 2392637 - RNA, 24 nt, Human
cagucauggcaccaaagccaccag

SEQ ID NO: 2392638 - RNA, 18 nt, Human
cagucauuagacuccucc

SEQ ID NO: 2392639 - RNA, 19 nt, Human
cagucaugcauaaauaugc

SEQ ID NO: 2392640 - RNA, 20 nt, Human
cagucaugcauaaauaugca

SEQ ID NO: 2392641 - RNA, 23 nt, Human
cagucaugcauaaauaugcagug

SEQ ID NO: 2392642 - RNA, 23 nt, Human
cagucauuaugagaggcaaugau

SEQ ID NO: 2392643 - RNA, 13 nt, Human
cagucauuaugag

SEQ ID NO: 2392644 - RNA, 16 nt, Human
caguccauagcagaga

SEQ ID NO: 2392645 - RNA, 23 nt, Human
caguccaggaugcuaacaucuaa

SEQ ID NO: 2392646 - RNA, 17 nt, Human
caguccagccuggagau

SEQ ID NO: 2392647 - RNA, 15 nt, Human
caguccaggcugccg

SEQ ID NO: 2392648 - RNA, 18 nt, Human
caguccaggcugccgugg

SEQ ID NO: 2392649 - RNA, 14 nt, Human
caguccauugaaag

SEQ ID NO: 2392650 - RNA, 13 nt, Human
caguccaugaaga

SEQ ID NO: 2392651 - RNA, 19 nt, Human
cagucccaucagagagcga

SEQ ID NO: 2392652 - RNA, 13 nt, Human
cagucccaggggc

SEQ ID NO: 2392653 - RNA, 12 nt, Human
caguccccaccc

SEQ ID NO: 2392654 - RNA, 13 nt, Human
caguccccacccc

SEQ ID NO: 2392655 - RNA, 14 nt, Human
caguccccaccccu

SEQ ID NO: 2392656 - RNA, 15 nt, Human
caguccccaccccug

SEQ ID NO: 2392657 - RNA, 16 nt, Human
caguccccaccccugc

SEQ ID NO: 2392658 - RNA, 17 nt, Human
caguccccaccccugcc

SEQ ID NO: 2392659 - RNA, 18 nt, Human
caguccccaccccugccc

SEQ ID NO: 2392660 - RNA, 16 nt, Human
caguccagccuggaga

SEQ ID NO: 2392661 - RNA, 13 nt, Human
caguauguuguca

SEQ ID NO: 2392662 - RNA, 18 nt, Human
caguauguugucaaagag

SEQ ID NO: 2392663 - RNA, 23 nt, Human
caguauggguuagggaaaacauu

SEQ ID NO: 2392664 - RNA, 16 nt, Human
caguaugucccauagg

SEQ ID NO: 2392665 - RNA, 16 nt, Human
caguauuacuucugcu

SEQ ID NO: 2392666 - RNA, 12 nt, Human
caguauguggaa

SEQ ID NO: 2392667 - RNA, 21 nt, Human
caguauggguuagggaaaaca

SEQ ID NO: 2392668 - RNA, 16 nt, Human
caguauggguuaggga

SEQ ID NO: 2392669 - RNA, 18 nt, Human
caguauuacuucugcuac

SEQ ID NO: 2392670 - RNA, 17 nt, Human
cagucacugaauuccau

SEQ ID NO: 2392671 - RNA, 19 nt, Human
caguauuacuucugcuaca

SEQ ID NO: 2392672 - RNA, 23 nt, Human
cagucagauuuccagucuccacc

SEQ ID NO: 2392673 - RNA, 20 nt, Human
cagucagauuuccagucucc

SEQ ID NO: 2392674 - RNA, 12 nt, Human
cagucagccucu

SEQ ID NO: 2392675 - RNA, 13 nt, Human
cagucagccucuc

SEQ ID NO: 2392676 - RNA, 14 nt, Human
cagucagccucucu

SEQ ID NO: 2392677 - RNA, 17 nt, Human
cagucagccucucuccc

SEQ ID NO: 2392678 - RNA, 18 nt, Human
cagucagccucucuccca

SEQ ID NO: 2392679 - RNA, 21 nt, Human
cagucagccucucucccaguc

SEQ ID NO: 2392680 - RNA, 17 nt, Human
cagucagauuuccaguc

SEQ ID NO: 2392681 - RNA, 21 nt, Human
cagucacugucccucaaauga

SEQ ID NO: 2392682 - RNA, 22 nt, Human
cagucacugucccucaaaugac

SEQ ID NO: 2392683 - RNA, 14 nt, Human
cagucacuggaggu

SEQ ID NO: 2392684 - RNA, 15 nt, Human
caguauguugucaaa

SEQ ID NO: 2392685 - RNA, 23 nt, Human
cagucacuggagguugaagccaa

SEQ ID NO: 2392686 - RNA, 21 nt, Human
cagucagguaguugcaauuga

SEQ ID NO: 2392687 - RNA, 12 nt, Human
cagucaggggca

SEQ ID NO: 2392688 - RNA, 17 nt, Human
cagucaggggcagcuga

SEQ ID NO: 2392689 - RNA, 15 nt, Human
cagucauaacuaaau

SEQ ID NO: 2392690 - RNA, 24 nt, Human
cagucaucuugaccaagcaggaag

SEQ ID NO: 2392691 - RNA, 13 nt, Human
cagucaugcauaa

SEQ ID NO: 2392692 - RNA, 22 nt, Human
cagucaucuugaccaagcagga

SEQ ID NO: 2392693 - RNA, 21 nt, Human
cagucaucuugaccaagcagg

SEQ ID NO: 2392694 - RNA, 14 nt, Human
cagucaugcauaaa

SEQ ID NO: 2392695 - RNA, 16 nt, Human
cagucaugcauaaaua

SEQ ID NO: 2392696 - RNA, 17 nt, Human
cagucaugcauaaauau

SEQ ID NO: 2392697 - RNA, 18 nt, Human
cagucaugcauaaauaug

SEQ ID NO: 2392698 - RNA, 16 nt, Human
cagucaguaauugcca

SEQ ID NO: 2392699 - RNA, 15 nt, Human
cagucaguauuguuu

SEQ ID NO: 2392700 - RNA, 17 nt, Human
cagucagugcaaauguc

SEQ ID NO: 2392701 - RNA, 18 nt, Human
cagucaucuugaccaagc

SEQ ID NO: 2392702 - RNA, 18 nt, Human
cagucagugcaaauguca

SEQ ID NO: 2392703 - RNA, 12 nt, Human
cagucaggauga

SEQ ID NO: 2392704 - RNA, 21 nt, Human
cagucaggaaaggaaucauuu

SEQ ID NO: 2392705 - RNA, 22 nt, Human
cagucagccucucucccagucu

SEQ ID NO: 2392706 - RNA, 22 nt, Human
cagucaggaaagagaacuucca

SEQ ID NO: 2392707 - RNA, 15 nt, Human
cagucaggaaagaga

SEQ ID NO: 2392708 - RNA, 18 nt, Human
cagucaggaaagagaacu

SEQ ID NO: 2392709 - RNA, 18 nt, Human
caguagcaguagaugcau

SEQ ID NO: 2392710 - RNA, 19 nt, Human
caguagauuuucuuuaaaa

SEQ ID NO: 2392711 - RNA, 23 nt, Human
caguagauuuucuuuaaaagaau

SEQ ID NO: 2392712 - RNA, 16 nt, Human
caguagauuuuccaaa

SEQ ID NO: 2392713 - RNA, 18 nt, Human
caguagauuuuccaaaug

SEQ ID NO: 2392714 - RNA, 13 nt, Human
caguagauuuucu

SEQ ID NO: 2392715 - RNA, 14 nt, Human
caguagauuuucuu

SEQ ID NO: 2392716 - RNA, 20 nt, Human
caguagcuguggugaggugg

SEQ ID NO: 2392717 - RNA, 21 nt, Human
caguaggagcccagcucugaa

SEQ ID NO: 2392718 - RNA, 15 nt, Human
caguaggagcccagc

SEQ ID NO: 2392719 - RNA, 14 nt, Human
caguaggagcccag

SEQ ID NO: 2392720 - RNA, 12 nt, Human
caguaggagccc

SEQ ID NO: 2392721 - RNA, 19 nt, Human
caguagaaauaauaugcau

SEQ ID NO: 2392722 - RNA, 12 nt, Human
caguagacaagc

SEQ ID NO: 2392723 - RNA, 18 nt, Human
caguagaaauaauaugca

SEQ ID NO: 2392724 - RNA, 19 nt, Human
caguacuuuggaggccccu

SEQ ID NO: 2392725 - RNA, 16 nt, Human
caguacuuuggaggcc

SEQ ID NO: 2392726 - RNA, 20 nt, Human
caguacuuuggaggccccua

SEQ ID NO: 2392727 - RNA, 16 nt, Human
caguagagucaucucc

SEQ ID NO: 2392728 - RNA, 15 nt, Human
caguagagucaucuc

SEQ ID NO: 2392729 - RNA, 17 nt, Human
caguagagucaucucca

SEQ ID NO: 2392730 - RNA, 23 nt, Human
caguagaggcuauggacagggca

SEQ ID NO: 2392731 - RNA, 20 nt, Human
caguagaaggucggaggcuu

SEQ ID NO: 2392732 - RNA, 20 nt, Human
caguagaccuuguuacuucu

SEQ ID NO: 2392733 - RNA, 23 nt, Human
caguagaaggucggaggcuuggg

SEQ ID NO: 2392734 - RNA, 22 nt, Human
caguaguagccuccagguuucc

SEQ ID NO: 2392735 - RNA, 14 nt, Human
caguaguaccaaau

SEQ ID NO: 2392736 - RNA, 16 nt, Human
caguagucucugugcu

SEQ ID NO: 2392737 - RNA, 15 nt, Human
caguagguuggcagu

SEQ ID NO: 2392738 - RNA, 18 nt, Human
caguaggcucaacuaggg

SEQ ID NO: 2392739 - RNA, 22 nt, Human
caguaggagcccagcucugaaa

SEQ ID NO: 2392740 - RNA, 22 nt, Human
caguaggugcccagaauaaguu

SEQ ID NO: 2392741 - RNA, 23 nt, Human
caguagucuugaugaccaaaguc

SEQ ID NO: 2392742 - RNA, 17 nt, Human
caguagucucugugcuu

SEQ ID NO: 2392743 - RNA, 23 nt, Human
caguagucucugugcuuugacuc

SEQ ID NO: 2392744 - RNA, 12 nt, Human
caguagugauag

SEQ ID NO: 2392745 - RNA, 12 nt, Human
caguauaauucu

SEQ ID NO: 2392746 - RNA, 14 nt, Human
caguauaauucugu

SEQ ID NO: 2392747 - RNA, 14 nt, Human
caguauaaacaaag

SEQ ID NO: 2392748 - RNA, 19 nt, Human
caguauaaacaaaguuacu

SEQ ID NO: 2392749 - RNA, 15 nt, Human
caguaucucagggcc

SEQ ID NO: 2392750 - RNA, 12 nt, Human
caguaucuugaa

SEQ ID NO: 2392751 - RNA, 18 nt, Human
caguaucuugaagacuuu

SEQ ID NO: 2392752 - RNA, 21 nt, Human
caguaucuugaagacuuuucu

SEQ ID NO: 2392753 - RNA, 13 nt, Human
caguaugaaaaua

SEQ ID NO: 2392754 - RNA, 23 nt, Human
caguaucuauauauguguaugua

SEQ ID NO: 2392755 - RNA, 12 nt, Human
caguauggcagc

SEQ ID NO: 2392756 - RNA, 14 nt, Human
caguaugaaaauaa

SEQ ID NO: 2392757 - RNA, 20 nt, Human
caguaugagucaaugugcag

SEQ ID NO: 2392758 - RNA, 21 nt, Human
caguaugagucaaugugcagu

SEQ ID NO: 2392759 - RNA, 23 nt, Human
caguaugagucaaugugcagugu

SEQ ID NO: 2392760 - RNA, 22 nt, Human
caguauauuuauagucacaaga

SEQ ID NO: 2392761 - RNA, 13 nt, Human
caguauauuuaua

SEQ ID NO: 2392762 - RNA, 14 nt, Human
caguauacaguccu

SEQ ID NO: 2392763 - RNA, 22 nt, Human
caguauaauucuguacugauuu

SEQ ID NO: 2392764 - RNA, 23 nt, Human
caguauaauugaguuuucagugg

SEQ ID NO: 2392765 - RNA, 19 nt, Human
caguauaauucuguacuga

SEQ ID NO: 2392766 - RNA, 20 nt, Human
caguauaauucuguacugau

SEQ ID NO: 2392767 - RNA, 24 nt, Human
caguaucaggccugccagacggca

SEQ ID NO: 2392768 - RNA, 20 nt, Human
caguaucaggccugccagac

SEQ ID NO: 2392769 - RNA, 17 nt, Human
caguaucaggccugcca

SEQ ID NO: 2392770 - RNA, 14 nt, Human
caguaucaggccug

SEQ ID NO: 2392771 - RNA, 15 nt, Human
caguauauuuauagu

SEQ ID NO: 2392772 - RNA, 14 nt, Human
caguauauuuauag

SEQ ID NO: 2392773 - RNA, 22 nt, Human
caguaucacugucuuuccuaga

SEQ ID NO: 2392774 - RNA, 14 nt, Human
caguaucacugucu

SEQ ID NO: 2392775 - RNA, 15 nt, Human
caguaucaugaagcc

SEQ ID NO: 2392776 - RNA, 14 nt, Human
caguaucaugaagc

SEQ ID NO: 2392777 - RNA, 16 nt, Human
caguaucaugcccugu

SEQ ID NO: 2392778 - RNA, 13 nt, Human
caguaucaugccc

SEQ ID NO: 2392779 - RNA, 13 nt, Human
caguaucucaggg

SEQ ID NO: 2392780 - RNA, 18 nt, Human
caguaucuauauaugugu

SEQ ID NO: 2392781 - RNA, 16 nt, Human
caguaucuauauaugu

SEQ ID NO: 2392782 - RNA, 19 nt, Human
caguaucuauauaugugua

SEQ ID NO: 2392783 - RNA, 20 nt, Human
caguaucuauauauguguau

SEQ ID NO: 2392784 - RNA, 21 nt, Human
caguaucuauauauguguaug

SEQ ID NO: 2392785 - RNA, 22 nt, Human
caguaucuauauauguguaugu

SEQ ID NO: 2392786 - RNA, 19 nt, Human
caguaucaugcccugugca

SEQ ID NO: 2392787 - RNA, 17 nt, Human
caguaucaugcccugug

SEQ ID NO: 2392788 - RNA, 20 nt, Human
caguaucaugcccugugcaa

SEQ ID NO: 2392789 - RNA, 16 nt, Human
caguauccacuuugca

SEQ ID NO: 2392790 - RNA, 22 nt, Human
cagucccugggggaagcccugg

SEQ ID NO: 2392791 - RNA, 21 nt, Human
cagucccugggggaagcccug

SEQ ID NO: 2392792 - RNA, 20 nt, Human
cagucccugggggaagcccu

SEQ ID NO: 2392793 - RNA, 12 nt, Human
cagucccugggg

SEQ ID NO: 2392794 - RNA, 15 nt, Human
cagucccuauguauu

SEQ ID NO: 2392795 - RNA, 17 nt, Human
cagucccugccaaugga

SEQ ID NO: 2392796 - RNA, 15 nt, Human
caguccuaagaaaga

SEQ ID NO: 2392797 - RNA, 19 nt, Human
caguccuaagaaagaggag

SEQ ID NO: 2392798 - RNA, 13 nt, Human
caguccuagcugc

SEQ ID NO: 2392799 - RNA, 17 nt, Human
caguccuagcugcacag

SEQ ID NO: 2392800 - RNA, 18 nt, Human
caguccuagcugcacagg

SEQ ID NO: 2392801 - RNA, 23 nt, Human
caguccuagcugcacagggcagc

SEQ ID NO: 2392802 - RNA, 12 nt, Human
caguccucccau

SEQ ID NO: 2392803 - RNA, 13 nt, Human
caguccucccauc

SEQ ID NO: 2392804 - RNA, 14 nt, Human
caguccucccaucu

SEQ ID NO: 2392805 - RNA, 15 nt, Human
caguccucccaucuc

SEQ ID NO: 2392806 - RNA, 12 nt, Human
cagucccugcca

SEQ ID NO: 2392807 - RNA, 23 nt, Human
cagucccugaggcagguccccag

SEQ ID NO: 2392808 - RNA, 20 nt, Human
cagucccugaggcagguccc

SEQ ID NO: 2392809 - RNA, 19 nt, Human
caguccccucccaucuggg

SEQ ID NO: 2392810 - RNA, 22 nt, Human
caguccccucccaucugggagu

SEQ ID NO: 2392811 - RNA, 14 nt, Human
caguccccucccau

SEQ ID NO: 2392812 - RNA, 15 nt, Human
caguccccucccauc

SEQ ID NO: 2392813 - RNA, 16 nt, Human
caguccccucccaucu

SEQ ID NO: 2392814 - RNA, 17 nt, Human
caguccccucccaucug

SEQ ID NO: 2392815 - RNA, 14 nt, Human
cagucccuaaagaa

SEQ ID NO: 2392816 - RNA, 14 nt, Human
cagucccugaggca

SEQ ID NO: 2392817 - RNA, 13 nt, Human
cagucccugccaa

SEQ ID NO: 2392818 - RNA, 14 nt, Human
cagucccugccaau

SEQ ID NO: 2392819 - RNA, 15 nt, Human
cagucccugccaaug

SEQ ID NO: 2392820 - RNA, 16 nt, Human
cagucccugccaaugg

SEQ ID NO: 2392821 - RNA, 23 nt, Human
caguccccgugaaggagagcccu

SEQ ID NO: 2392822 - RNA, 18 nt, Human
cagucccccaaccccagc

SEQ ID NO: 2392823 - RNA, 18 nt, Human
caguccccgugccccgcc

SEQ ID NO: 2392824 - RNA, 12 nt, Human
caguccccuccc

SEQ ID NO: 2392825 - RNA, 13 nt, Human
caguccccuccca

SEQ ID NO: 2392826 - RNA, 16 nt, Human
cagucccccugcccca

SEQ ID NO: 2392827 - RNA, 17 nt, Human
cagucccccugccccag

SEQ ID NO: 2392828 - RNA, 21 nt, Human
caguccccaccccugccccca

SEQ ID NO: 2392829 - RNA, 19 nt, Human
caguccccaccccugcccc

SEQ ID NO: 2392830 - RNA, 20 nt, Human
caguccccaccccugccccc

SEQ ID NO: 2392831 - RNA, 20 nt, Human
caguccccccacccucauuc

SEQ ID NO: 2392832 - RNA, 14 nt, Human
caguccccccaccc

SEQ ID NO: 2392833 - RNA, 16 nt, Human
cagucccccaacccca

SEQ ID NO: 2392834 - RNA, 12 nt, Human
cagugagccuga

SEQ ID NO: 2392835 - RNA, 23 nt, Human
cagugagccaagaucgcgccacu

SEQ ID NO: 2392836 - RNA, 13 nt, Human
cagugagccaaga

SEQ ID NO: 2392837 - RNA, 24 nt, Human
cagugagccgagauugcaccacug

SEQ ID NO: 2392838 - RNA, 22 nt, Human
cagugagcuuggaaaggaccag

SEQ ID NO: 2392839 - RNA, 13 nt, Human
cagugaggcccag

SEQ ID NO: 2392840 - RNA, 19 nt, Human
cagugagccgcaucuucuc

SEQ ID NO: 2392841 - RNA, 17 nt, Human
cagugagcggagaucgc

SEQ ID NO: 2392842 - RNA, 13 nt, Human
cagugagcugaga

SEQ ID NO: 2392843 - RNA, 12 nt, Human
cagugaggcucu

SEQ ID NO: 2392844 - RNA, 13 nt, Human
cagugaggcucug

SEQ ID NO: 2392845 - RNA, 14 nt, Human
cagugaggcucugc

SEQ ID NO: 2392846 - RNA, 15 nt, Human
cagugaggcucugcc

SEQ ID NO: 2392847 - RNA, 16 nt, Human
cagugaggcucugccc

SEQ ID NO: 2392848 - RNA, 17 nt, Human
cagugaggcccagggag

SEQ ID NO: 2392849 - RNA, 16 nt, Human
cagugaggcccaggga

SEQ ID NO: 2392850 - RNA, 21 nt, Human
cagugagggagggcugucauc

SEQ ID NO: 2392851 - RNA, 21 nt, Human
cagugaggcccagggagaggc

SEQ ID NO: 2392852 - RNA, 21 nt, Human
cagugaggcucugcccuuggu

SEQ ID NO: 2392853 - RNA, 17 nt, Human
cagugagucgaggacag

SEQ ID NO: 2392854 - RNA, 18 nt, Human
cagugagucgaggacagg

SEQ ID NO: 2392855 - RNA, 17 nt, Human
cagugaggcucugcccu

SEQ ID NO: 2392856 - RNA, 18 nt, Human
cagugaggcucugcccuu

SEQ ID NO: 2392857 - RNA, 19 nt, Human
cagugaggcucugcccuug

SEQ ID NO: 2392858 - RNA, 20 nt, Human
cagugaggcucugcccuugg

SEQ ID NO: 2392859 - RNA, 13 nt, Human
cagugaaagcauc

SEQ ID NO: 2392860 - RNA, 14 nt, Human
cagugaaagcauca

SEQ ID NO: 2392861 - RNA, 21 nt, Human
cagugaaaauguaagcuguuu

SEQ ID NO: 2392862 - RNA, 14 nt, Human
cagugaaccaaaga

SEQ ID NO: 2392863 - RNA, 20 nt, Human
cagugaaccaaagagacugg

SEQ ID NO: 2392864 - RNA, 21 nt, Human
cagugaaccaaagagacugga

SEQ ID NO: 2392865 - RNA, 20 nt, Human
cagugaaaacaagugcuggc

SEQ ID NO: 2392866 - RNA, 21 nt, Human
cagugaaaacaagugcuggca

SEQ ID NO: 2392867 - RNA, 12 nt, Human
cagugaaaaugu

SEQ ID NO: 2392868 - RNA, 15 nt, Human
cagugaaaauguaag

SEQ ID NO: 2392869 - RNA, 18 nt, Human
cagugaaaauguaagcug

SEQ ID NO: 2392870 - RNA, 17 nt, Human
cagugaaugauucagug

SEQ ID NO: 2392871 - RNA, 23 nt, Human
cagugaaccaaagagacuggagc

SEQ ID NO: 2392872 - RNA, 20 nt, Human
cagugacagaguucacuaua

SEQ ID NO: 2392873 - RNA, 18 nt, Human
cagugacagaguucacua

SEQ ID NO: 2392874 - RNA, 16 nt, Human
cagugacagaguucac

SEQ ID NO: 2392875 - RNA, 23 nt, Human
cagugacacuucagagagcuggu

SEQ ID NO: 2392876 - RNA, 17 nt, Human
cagugacagacaggcuc

SEQ ID NO: 2392877 - RNA, 18 nt, Human
cagugacagacaggcucu

SEQ ID NO: 2392878 - RNA, 22 nt, Human
cagugacacuucagagagcugg

SEQ ID NO: 2392879 - RNA, 19 nt, Human
cagugacacuucagagagc

SEQ ID NO: 2392880 - RNA, 18 nt, Human
cagugacacuucagagag

SEQ ID NO: 2392881 - RNA, 17 nt, Human
cagugacacuucagaga

SEQ ID NO: 2392882 - RNA, 15 nt, Human
cagugacagacaggc

SEQ ID NO: 2392883 - RNA, 16 nt, Human
cagugacagacaggcu

SEQ ID NO: 2392884 - RNA, 16 nt, Human
cagugacacuucagag

SEQ ID NO: 2392885 - RNA, 20 nt, Human
cagugaaugauucaguguua

SEQ ID NO: 2392886 - RNA, 18 nt, Human
cagugaaugauucagugu

SEQ ID NO: 2392887 - RNA, 12 nt, Human
cagugaauucuu

SEQ ID NO: 2392888 - RNA, 20 nt, Human
cagugacucgggcuccugug

SEQ ID NO: 2392889 - RNA, 21 nt, Human
cagugacucgggcuccugugc

SEQ ID NO: 2392890 - RNA, 22 nt, Human
cagugacucgggcuccugugcc

SEQ ID NO: 2392891 - RNA, 23 nt, Human
cagugacucgggcuccugugccc

SEQ ID NO: 2392892 - RNA, 15 nt, Human
cagugagacagcucu

SEQ ID NO: 2392893 - RNA, 18 nt, Human
cagugagauuacagagga

SEQ ID NO: 2392894 - RNA, 19 nt, Human
cagugagauuacagaggaa

SEQ ID NO: 2392895 - RNA, 20 nt, Human
cagugagauuacagaggaag

SEQ ID NO: 2392896 - RNA, 16 nt, Human
cagugagcacucccaa

SEQ ID NO: 2392897 - RNA, 21 nt, Human
cagugagaaaaagcuccuguc

SEQ ID NO: 2392898 - RNA, 22 nt, Human
cagugagaaaaagcuccugucc

SEQ ID NO: 2392899 - RNA, 14 nt, Human
cagugagaaaaagc

SEQ ID NO: 2392900 - RNA, 19 nt, Human
cagugagaaaaagcuccug

SEQ ID NO: 2392901 - RNA, 20 nt, Human
cagugagaaaaagcuccugu

SEQ ID NO: 2392902 - RNA, 22 nt, Human
cagugacgugcaccuguacuca

SEQ ID NO: 2392903 - RNA, 13 nt, Human
cagugacuccagg

SEQ ID NO: 2392904 - RNA, 14 nt, Human
cagugacuccagga

SEQ ID NO: 2392905 - RNA, 18 nt, Human
cagugacgugcaccugua

SEQ ID NO: 2392906 - RNA, 17 nt, Human
cagugacgugcaccugu

SEQ ID NO: 2392907 - RNA, 15 nt, Human
cagugacuccaggag

SEQ ID NO: 2392908 - RNA, 16 nt, Human
cagugacuccaggaga

SEQ ID NO: 2392909 - RNA, 17 nt, Human
cagugacuccaggagag

SEQ ID NO: 2392910 - RNA, 21 nt, Human
cagugacuccaggagaggagc

SEQ ID NO: 2392911 - RNA, 16 nt, Human
cagugacucgggcucc

SEQ ID NO: 2392912 - RNA, 17 nt, Human
cagugacucgggcuccu

SEQ ID NO: 2392913 - RNA, 18 nt, Human
cagugacucgggcuccug

SEQ ID NO: 2392914 - RNA, 19 nt, Human
cagugacucgggcuccugu

SEQ ID NO: 2392915 - RNA, 16 nt, Human
cagugaccugaggaag

SEQ ID NO: 2392916 - RNA, 14 nt, Human
cagugaccugagga

SEQ ID NO: 2392917 - RNA, 19 nt, Human
cagugaccugaggaagcgu

SEQ ID NO: 2392918 - RNA, 19 nt, Human
cagugaccugcuggguaaa

SEQ ID NO: 2392919 - RNA, 18 nt, Human
cagugaccugaggaagcg

SEQ ID NO: 2392920 - RNA, 17 nt, Human
cagugaccugaggaagc

SEQ ID NO: 2392921 - RNA, 16 nt, Human
cagugacgugcaccug

SEQ ID NO: 2392922 - RNA, 12 nt, Human
caguccuuccac

SEQ ID NO: 2392923 - RNA, 18 nt, Human
cagucuggaggggcaugg

SEQ ID NO: 2392924 - RNA, 16 nt, Human
cagucuggaggggcau

SEQ ID NO: 2392925 - RNA, 13 nt, Human
cagucuggagggg

SEQ ID NO: 2392926 - RNA, 12 nt, Human
cagucuggaggg

SEQ ID NO: 2392927 - RNA, 19 nt, Human
cagucuggaaugcaguggu

SEQ ID NO: 2392928 - RNA, 21 nt, Human
cagucuguuccccauggccac

SEQ ID NO: 2392929 - RNA, 23 nt, Human
cagucugucaugaacauguuccu

SEQ ID NO: 2392930 - RNA, 15 nt, Human
cagucuguggaucag

SEQ ID NO: 2392931 - RNA, 21 nt, Human
cagucuggaggggcauggcca

SEQ ID NO: 2392932 - RNA, 18 nt, Human
cagucuggcugagcccug

SEQ ID NO: 2392933 - RNA, 20 nt, Human
cagucuggcugagcccugcu

SEQ ID NO: 2392934 - RNA, 12 nt, Human
cagucugucaug

SEQ ID NO: 2392935 - RNA, 24 nt, Human
cagucugucaugaacauguuccug

SEQ ID NO: 2392936 - RNA, 23 nt, Human
cagucuugaauuucuaaaaaaca

SEQ ID NO: 2392937 - RNA, 22 nt, Human
cagucuugaauuucuaaaaaac

SEQ ID NO: 2392938 - RNA, 15 nt, Human
cagucuugaauuucu

SEQ ID NO: 2392939 - RNA, 21 nt, Human
cagucuuccugacacuuuaau

SEQ ID NO: 2392940 - RNA, 18 nt, Human
cagucuuccugacacuuu

SEQ ID NO: 2392941 - RNA, 17 nt, Human
cagucuuccugacacuu

SEQ ID NO: 2392942 - RNA, 16 nt, Human
cagucuuccugacacu

SEQ ID NO: 2392943 - RNA, 13 nt, Human
cagucuuccugac

SEQ ID NO: 2392944 - RNA, 21 nt, Human
cagucuuccauuugcaaggga

SEQ ID NO: 2392945 - RNA, 18 nt, Human
cagucuuccauuugcaag

SEQ ID NO: 2392946 - RNA, 17 nt, Human
cagucuuccauuugcaa

SEQ ID NO: 2392947 - RNA, 15 nt, Human
cagucuuccauuugc

SEQ ID NO: 2392948 - RNA, 18 nt, Human
cagucuugacgaguguga

SEQ ID NO: 2392949 - RNA, 15 nt, Human
cagucuugcagcagg

SEQ ID NO: 2392950 - RNA, 16 nt, Human
cagucuuggcucacug

SEQ ID NO: 2392951 - RNA, 17 nt, Human
cagucuuguauuaaguu

SEQ ID NO: 2392952 - RNA, 13 nt, Human
cagucuugugcuu

SEQ ID NO: 2392953 - RNA, 14 nt, Human
cagucuugcagcag

SEQ ID NO: 2392954 - RNA, 22 nt, Human
cagucuuuaaucugagaggcca

SEQ ID NO: 2392955 - RNA, 17 nt, Human
cagugaaaaacuauuaa

SEQ ID NO: 2392956 - RNA, 16 nt, Human
cagugaaaacaagugc

SEQ ID NO: 2392957 - RNA, 18 nt, Human
cagugaaaacaagugcug

SEQ ID NO: 2392958 - RNA, 14 nt, Human
cagugaaaaacuau

SEQ ID NO: 2392959 - RNA, 22 nt, Human
cagucuuuuuggugaggguaac

SEQ ID NO: 2392960 - RNA, 20 nt, Human
cagugaaagaaaauaacaau

SEQ ID NO: 2392961 - RNA, 16 nt, Human
cagugaaagaaaauaa

SEQ ID NO: 2392962 - RNA, 18 nt, Human
cagucuggaaugcagugg

SEQ ID NO: 2392963 - RNA, 21 nt, Human
caguccuuaccagcagagcac

SEQ ID NO: 2392964 - RNA, 19 nt, Human
caguccuuaccagcagagc

SEQ ID NO: 2392965 - RNA, 20 nt, Human
caguccuuaccagcagagca

SEQ ID NO: 2392966 - RNA, 23 nt, Human
caguccugggagaaccucaggcu

SEQ ID NO: 2392967 - RNA, 22 nt, Human
caguccugggagaaccucaggc

SEQ ID NO: 2392968 - RNA, 21 nt, Human
caguccugggagaaccucagg

SEQ ID NO: 2392969 - RNA, 13 nt, Human
caguccugggaga

SEQ ID NO: 2392970 - RNA, 12 nt, Human
caguccugggag

SEQ ID NO: 2392971 - RNA, 11 nt, Human
caguccuggcc

SEQ ID NO: 2392972 - RNA, 13 nt, Human
caguccuggccug

SEQ ID NO: 2392973 - RNA, 19 nt, Human
caguccuggccuggcuucu

SEQ ID NO: 2392974 - RNA, 15 nt, Human
caguccuuaccagca

SEQ ID NO: 2392975 - RNA, 18 nt, Human
caguccuuaccagcagag

SEQ ID NO: 2392976 - RNA, 21 nt, Human
caguccugccuggccaggcag

SEQ ID NO: 2392977 - RNA, 17 nt, Human
caguccugccuggccag

SEQ ID NO: 2392978 - RNA, 16 nt, Human
caguccugccuggcca

SEQ ID NO: 2392979 - RNA, 18 nt, Human
caguccugccuggccagg

SEQ ID NO: 2392980 - RNA, 22 nt, Human
caguccuggaagccagcuuucc

SEQ ID NO: 2392981 - RNA, 17 nt, Human
caguccuggaagccagc

SEQ ID NO: 2392982 - RNA, 15 nt, Human
caguccugccuggcc

SEQ ID NO: 2392983 - RNA, 14 nt, Human
caguccugccuggc

SEQ ID NO: 2392984 - RNA, 13 nt, Human
caguccugccugg

SEQ ID NO: 2392985 - RNA, 12 nt, Human
caguccugccug

SEQ ID NO: 2392986 - RNA, 19 nt, Human
caguccugccucagccucc

SEQ ID NO: 2392987 - RNA, 17 nt, Human
caguccugccucagccu

SEQ ID NO: 2392988 - RNA, 22 nt, Human
caguccugaucagagccguggu

SEQ ID NO: 2392989 - RNA, 13 nt, Human
caguccucuuuca

SEQ ID NO: 2392990 - RNA, 20 nt, Human
caguccucuccaccuagugg

SEQ ID NO: 2392991 - RNA, 22 nt, Human
caguccucuccaccuaguggcu

SEQ ID NO: 2392992 - RNA, 23 nt, Human
caguccuccccucacagccucug

SEQ ID NO: 2392993 - RNA, 22 nt, Human
caguccuccccucacagccucu

SEQ ID NO: 2392994 - RNA, 13 nt, Human
caguccucuccac

SEQ ID NO: 2392995 - RNA, 12 nt, Human
caguccuccccu

SEQ ID NO: 2392996 - RNA, 13 nt, Human
caguccuccccuc

SEQ ID NO: 2392997 - RNA, 14 nt, Human
caguccuccccuca

SEQ ID NO: 2392998 - RNA, 15 nt, Human
caguccuccccucac

SEQ ID NO: 2392999 - RNA, 18 nt, Human
caguccuccccucacagc

SEQ ID NO: 2393000 - RNA, 19 nt, Human
caguccuccccucacagcc

SEQ ID NO: 2393001 - RNA, 20 nt, Human
caguccuccccucacagccu

SEQ ID NO: 2393002 - RNA, 21 nt, Human
caguccuccccucacagccuc

SEQ ID NO: 2393003 - RNA, 16 nt, Human
caguccucccaucuca

SEQ ID NO: 2393004 - RNA, 17 nt, Human
caguccucccaucucac

SEQ ID NO: 2393005 - RNA, 17 nt, Human
cagugcuguggccuggg

SEQ ID NO: 2393006 - RNA, 23 nt, Human
cagugccuuaccuccugcccagg

SEQ ID NO: 2393007 - RNA, 22 nt, Human
cagugccuuaccuccugcccag

SEQ ID NO: 2393008 - RNA, 21 nt, Human
cagugccuuaccuccugccca

SEQ ID NO: 2393009 - RNA, 20 nt, Human
cagugccuuaccuccugccc

SEQ ID NO: 2393010 - RNA, 19 nt, Human
cagugccuuaccuccugcc

SEQ ID NO: 2393011 - RNA, 18 nt, Human
cagugccuuaccuccugc

SEQ ID NO: 2393012 - RNA, 17 nt, Human
cagugccuuaccuccug

SEQ ID NO: 2393013 - RNA, 18 nt, Human
cagugccugggaauguau

SEQ ID NO: 2393014 - RNA, 20 nt, Human
cagugccugggaauguauua

SEQ ID NO: 2393015 - RNA, 14 nt, Human
cagugccugggaau

SEQ ID NO: 2393016 - RNA, 12 nt, Human
cagugccugcug

SEQ ID NO: 2393017 - RNA, 13 nt, Human
cagugccugcuga

SEQ ID NO: 2393018 - RNA, 11 nt, Human
cagugccugcu

SEQ ID NO: 2393019 - RNA, 10 nt, Human
cagugccugc

SEQ ID NO: 2393020 - RNA, 11 nt, Human
cagugccuuau

SEQ ID NO: 2393021 - RNA, 13 nt, Human
cagugccuuaugg

SEQ ID NO: 2393022 - RNA, 18 nt, Human
cagugccgagaaggaagc

SEQ ID NO: 2393023 - RNA, 15 nt, Human
cagugccgagaagga

SEQ ID NO: 2393024 - RNA, 17 nt, Human
cagugccgccgccucgc

SEQ ID NO: 2393025 - RNA, 18 nt, Human
cagugccgccgccucgcc

SEQ ID NO: 2393026 - RNA, 19 nt, Human
cagugccgccgccucgccc

SEQ ID NO: 2393027 - RNA, 20 nt, Human
cagugccgccgccucgccca

SEQ ID NO: 2393028 - RNA, 22 nt, Human
cagugccgccgccucgcccacc

SEQ ID NO: 2393029 - RNA, 23 nt, Human
cagugccgccgccucgcccaccg

SEQ ID NO: 2393030 - RNA, 15 nt, Human
cagugccuuauggaa

SEQ ID NO: 2393031 - RNA, 16 nt, Human
cagugccuuauggaac

SEQ ID NO: 2393032 - RNA, 17 nt, Human
cagugccuuauggaaca

SEQ ID NO: 2393033 - RNA, 18 nt, Human
cagugccuuauggaacac

SEQ ID NO: 2393034 - RNA, 19 nt, Human
cagugccuuauggaacacu

SEQ ID NO: 2393035 - RNA, 20 nt, Human
cagugccuuauggaacacuc

SEQ ID NO: 2393036 - RNA, 21 nt, Human
cagugccuuauggaacacucu

SEQ ID NO: 2393037 - RNA, 22 nt, Human
cagugccuuauggaacacucug

SEQ ID NO: 2393038 - RNA, 19 nt, Human
cagugagucgaggacaggg

SEQ ID NO: 2393039 - RNA, 20 nt, Human
cagugagucgaggacaggga

SEQ ID NO: 2393040 - RNA, 22 nt, Human
cagugagucgaggacagggagg

SEQ ID NO: 2393041 - RNA, 23 nt, Human
cagugagucgaggacagggaggu

SEQ ID NO: 2393042 - RNA, 18 nt, Human
cagugagucucuucagaa

SEQ ID NO: 2393043 - RNA, 14 nt, Human
cagugagugagccu

SEQ ID NO: 2393044 - RNA, 17 nt, Human
cagugagucucuucaga

SEQ ID NO: 2393045 - RNA, 15 nt, Human
cagugagucucuuca

SEQ ID NO: 2393046 - RNA, 15 nt, Human
cagugagugagccug

SEQ ID NO: 2393047 - RNA, 16 nt, Human
cagugagugagccugg

SEQ ID NO: 2393048 - RNA, 17 nt, Human
cagugagugagccuggc

SEQ ID NO: 2393049 - RNA, 18 nt, Human
cagugagugagccuggcu

SEQ ID NO: 2393050 - RNA, 16 nt, Human
cagugaggugcccagc

SEQ ID NO: 2393051 - RNA, 23 nt, Human
cagugagggucuucuuacaugca

SEQ ID NO: 2393052 - RNA, 16 nt, Human
cagugagggucuucuu

SEQ ID NO: 2393053 - RNA, 15 nt, Human
cagugaggugcccag

SEQ ID NO: 2393054 - RNA, 20 nt, Human
cagugauauggcagaagaca

SEQ ID NO: 2393055 - RNA, 21 nt, Human
cagugauauggcagaagacac

SEQ ID NO: 2393056 - RNA, 22 nt, Human
cagugauauggcagaagacacc

SEQ ID NO: 2393057 - RNA, 23 nt, Human
cagugauauggcagaagacacca

SEQ ID NO: 2393058 - RNA, 19 nt, Human
cagugagugagccuggcuc

SEQ ID NO: 2393059 - RNA, 20 nt, Human
cagugagugagccuggcucu

SEQ ID NO: 2393060 - RNA, 21 nt, Human
cagugagugagccuggcucuu

SEQ ID NO: 2393061 - RNA, 18 nt, Human
cagugaguuacagcgaga

SEQ ID NO: 2393062 - RNA, 22 nt, Human
cagugaguuacagcgagaggca

SEQ ID NO: 2393063 - RNA, 23 nt, Human
cagugaguuacagcgagaggcag

SEQ ID NO: 2393064 - RNA, 15 nt, Human
cagugauauggcaga

SEQ ID NO: 2393065 - RNA, 18 nt, Human
cagugauauggcagaaga

SEQ ID NO: 2393066 - RNA, 20 nt, Human
cagugaugcuggaugcuccu

SEQ ID NO: 2393067 - RNA, 18 nt, Human
cagugaugcuggaugcuc

SEQ ID NO: 2393068 - RNA, 21 nt, Human
cagugaucuccauauguuaca

SEQ ID NO: 2393069 - RNA, 16 nt, Human
cagugaucuccauaug

SEQ ID NO: 2393070 - RNA, 15 nt, Human
cagugaucuccauau

SEQ ID NO: 2393071 - RNA, 13 nt, Human
cagugaucuccau

SEQ ID NO: 2393072 - RNA, 17 nt, Human
cagugaucaaaguccga

SEQ ID NO: 2393073 - RNA, 17 nt, Human
cagugauuaccagggac

SEQ ID NO: 2393074 - RNA, 18 nt, Human
cagugcccauuccucacc

SEQ ID NO: 2393075 - RNA, 14 nt, Human
cagugcccauuccu

SEQ ID NO: 2393076 - RNA, 23 nt, Human
cagugauguaccaugaaacaaag

SEQ ID NO: 2393077 - RNA, 17 nt, Human
cagugaugggagaguag

SEQ ID NO: 2393078 - RNA, 18 nt, Human
cagugauuaccagggacu

SEQ ID NO: 2393079 - RNA, 15 nt, Human
cagugcccuccagga

SEQ ID NO: 2393080 - RNA, 19 nt, Human
cagugcccucauuuuaugu

SEQ ID NO: 2393081 - RNA, 17 nt, Human
cagugcccucauuuuau

SEQ ID NO: 2393082 - RNA, 14 nt, Human
cagugccccuagcu

SEQ ID NO: 2393083 - RNA, 19 nt, Human
cagugcccauuccucaccu

SEQ ID NO: 2393084 - RNA, 23 nt, Human
cagugcccccacugaccagaacu

SEQ ID NO: 2393085 - RNA, 22 nt, Human
cagugcccccacugaccagaac

SEQ ID NO: 2393086 - RNA, 21 nt, Human
cagugcccccacugaccagaa

SEQ ID NO: 2393087 - RNA, 20 nt, Human
cagugcccccacugaccaga

SEQ ID NO: 2393088 - RNA, 17 nt, Human
cagugcccccacugacc

SEQ ID NO: 2393089 - RNA, 15 nt, Human
cagugcccccacuga

SEQ ID NO: 2393090 - RNA, 12 nt, Human
cagugcccccac

SEQ ID NO: 2393091 - RNA, 23 nt, Human
cagugccuuccauaauuaugaca

SEQ ID NO: 2393092 - RNA, 17 nt, Human
cagugccuuccauaauu

SEQ ID NO: 2393093 - RNA, 16 nt, Human
cagugccuuccauaau

SEQ ID NO: 2393094 - RNA, 15 nt, Human
cagugccuuccauaa

SEQ ID NO: 2393095 - RNA, 14 nt, Human
cagugccuuccaua

SEQ ID NO: 2393096 - RNA, 18 nt, Human
cagugccuucaauaaaug

SEQ ID NO: 2393097 - RNA, 15 nt, Human
cagugccuucaauaa

SEQ ID NO: 2393098 - RNA, 16 nt, Human
cagugccuucaauaaa

SEQ ID NO: 2393099 - RNA, 23 nt, Human
cagugccuuauggaacacucuga

SEQ ID NO: 2393100 - RNA, 24 nt, Human
cagugcgcgugcacguggagagcu

SEQ ID NO: 2393101 - RNA, 18 nt, Human
cagugcgauucuggauaa

SEQ ID NO: 2393102 - RNA, 22 nt, Human
cagugccuuccuguuuuucaca

SEQ ID NO: 2393103 - RNA, 14 nt, Human
cagugccuugggga

SEQ ID NO: 2393104 - RNA, 21 nt, Human
cagugccuuggggaauuuccu

SEQ ID NO: 2393105 - RNA, 22 nt, Human
cagugccuuggggaauuuccuc

SEQ ID NO: 2393106 - RNA, 14 nt, Human
cagugcuaaaaaug

SEQ ID NO: 2393107 - RNA, 15 nt, Human
cagugcuaaaaaugg

SEQ ID NO: 2393108 - RNA, 16 nt, Human
cagugcuaaaaauggg

SEQ ID NO: 2393109 - RNA, 17 nt, Human
cagugcuaaaaauggga

SEQ ID NO: 2393110 - RNA, 19 nt, Human
cagugcuaaaaaugggacu

SEQ ID NO: 2393111 - RNA, 20 nt, Human
cagugcuaaaaaugggacuu

SEQ ID NO: 2393112 - RNA, 22 nt, Human
cagugcuaaaaaugggacuucu

SEQ ID NO: 2393113 - RNA, 23 nt, Human
cagugcuauuuugugcccacugu

SEQ ID NO: 2393114 - RNA, 14 nt, Human
cagugcucccucac

SEQ ID NO: 2393115 - RNA, 14 nt, Human
cagugcucgcuguu

SEQ ID NO: 2393116 - RNA, 15 nt, Human
cagugcucgcuguug

SEQ ID NO: 2393117 - RNA, 16 nt, Human
cagugcucgcuguugc

SEQ ID NO: 2393118 - RNA, 17 nt, Human
cagugcucgcuguugcu

SEQ ID NO: 2393119 - RNA, 18 nt, Human
cagugcucgcuguugcug

SEQ ID NO: 2393120 - RNA, 19 nt, Human
cagugcucgcuguugcuga

SEQ ID NO: 2393121 - RNA, 20 nt, Human
cagugcucgcuguugcugaa

SEQ ID NO: 2393122 - RNA, 21 nt, Human
cagugcucgcuguugcugaau

SEQ ID NO: 2393123 - RNA, 22 nt, Human
cagugcucgcuguugcugaaua

SEQ ID NO: 2393124 - RNA, 15 nt, Human
cagcaagucaggguu

SEQ ID NO: 2393125 - RNA, 14 nt, Human
cagcaagucucuuu

SEQ ID NO: 2393126 - RNA, 12 nt, Human
cagcaagugaga

SEQ ID NO: 2393127 - RNA, 23 nt, Human
cagcaagggugaugggaaagcau

SEQ ID NO: 2393128 - RNA, 22 nt, Human
cagcaagggugaugggaaagca

SEQ ID NO: 2393129 - RNA, 14 nt, Human
cagcaagugagagc

SEQ ID NO: 2393130 - RNA, 15 nt, Human
cagcaagugagagcu

SEQ ID NO: 2393131 - RNA, 16 nt, Human
cagcaagugagagcug

SEQ ID NO: 2393132 - RNA, 17 nt, Human
cagcaagugagagcugg

SEQ ID NO: 2393133 - RNA, 20 nt, Human
cagcaacuugucuuuuucug

SEQ ID NO: 2393134 - RNA, 22 nt, Human
cagcaagaagauccuaaaacaa

SEQ ID NO: 2393135 - RNA, 17 nt, Human
cagcaaggagauuuaca

SEQ ID NO: 2393136 - RNA, 18 nt, Human
cagcaaggagauuuacaa

SEQ ID NO: 2393137 - RNA, 18 nt, Human
cagcaaggaggcuggcug

SEQ ID NO: 2393138 - RNA, 19 nt, Human
cagcaaggaggcuggcugg

SEQ ID NO: 2393139 - RNA, 20 nt, Human
cagcaaggaggcuggcuggg

SEQ ID NO: 2393140 - RNA, 21 nt, Human
cagcaaggaggcuggcugggg

SEQ ID NO: 2393141 - RNA, 22 nt, Human
cagcaaggaggcuggcuggggc

SEQ ID NO: 2393142 - RNA, 15 nt, Human
cagcaaggcaccugc

SEQ ID NO: 2393143 - RNA, 16 nt, Human
cagcaaggcaccugca

SEQ ID NO: 2393144 - RNA, 17 nt, Human
cagcaaggcaccugcag

SEQ ID NO: 2393145 - RNA, 19 nt, Human
cagcaagggugaugggaaa

SEQ ID NO: 2393146 - RNA, 23 nt, Human
cagcaaggcaccugcagguuggg

SEQ ID NO: 2393147 - RNA, 14 nt, Human
cagcacugucucag

SEQ ID NO: 2393148 - RNA, 20 nt, Human
cagcacugucccuugccuca

SEQ ID NO: 2393149 - RNA, 16 nt, Human
cagcacugucccuugc

SEQ ID NO: 2393150 - RNA, 18 nt, Human
cagcacugucccuugccu

SEQ ID NO: 2393151 - RNA, 15 nt, Human
cagcacacagggcag

SEQ ID NO: 2393152 - RNA, 12 nt, Human
cagcacuguccc

SEQ ID NO: 2393153 - RNA, 13 nt, Human
cagcacugucccu

SEQ ID NO: 2393154 - RNA, 14 nt, Human
cagcacugucccuu

SEQ ID NO: 2393155 - RNA, 14 nt, Human
cagcacacagggca

SEQ ID NO: 2393156 - RNA, 13 nt, Human
cagcacacagggc

SEQ ID NO: 2393157 - RNA, 16 nt, Human
cagcacaaggccaucu

SEQ ID NO: 2393158 - RNA, 13 nt, Human
cagcacaaggcca

SEQ ID NO: 2393159 - RNA, 20 nt, Human
cagcaauucuccugccucag

SEQ ID NO: 2393160 - RNA, 19 nt, Human
cagcaauucuccugccuca

SEQ ID NO: 2393161 - RNA, 18 nt, Human
cagcaauucuccugccuc

SEQ ID NO: 2393162 - RNA, 17 nt, Human
cagcaauucuccugccu

SEQ ID NO: 2393163 - RNA, 16 nt, Human
cagcaauucuccugcc

SEQ ID NO: 2393164 - RNA, 15 nt, Human
cagcaauucuccugc

SEQ ID NO: 2393165 - RNA, 18 nt, Human
cagcaaugacaucucagg

SEQ ID NO: 2393166 - RNA, 16 nt, Human
cagcaauauguaaaua

SEQ ID NO: 2393167 - RNA, 19 nt, Human
cagcaaugacaucucaggg

SEQ ID NO: 2393168 - RNA, 15 nt, Human
cagcaauauguaaau

SEQ ID NO: 2393169 - RNA, 22 nt, Human
cagcaaugauguccagaagaau

SEQ ID NO: 2393170 - RNA, 20 nt, Human
cagcaaugacaucucagggg

SEQ ID NO: 2393171 - RNA, 21 nt, Human
cagcaaugacaucucaggggc

SEQ ID NO: 2393172 - RNA, 18 nt, Human
cagcaaugauguccagaa

SEQ ID NO: 2393173 - RNA, 20 nt, Human
cagcaaugauguccagaaga

SEQ ID NO: 2393174 - RNA, 22 nt, Human
cagcaauaaagcagcguuucua

SEQ ID NO: 2393175 - RNA, 19 nt, Human
cagcaagugagagcugggu

SEQ ID NO: 2393176 - RNA, 21 nt, Human
cagcaagugagagcugggugu

SEQ ID NO: 2393177 - RNA, 21 nt, Human
cagcaauaaagcagcguuucu

SEQ ID NO: 2393178 - RNA, 13 nt, Human
cagcaauaaagca

SEQ ID NO: 2393179 - RNA, 18 nt, Human
cagcagagacuugggaca

SEQ ID NO: 2393180 - RNA, 19 nt, Human
cagcagagacuugggacau

SEQ ID NO: 2393181 - RNA, 21 nt, Human
cagcagagacuugggacauug

SEQ ID NO: 2393182 - RNA, 14 nt, Human
cagcagacuaugaa

SEQ ID NO: 2393183 - RNA, 17 nt, Human
cagcagacauugucagc

SEQ ID NO: 2393184 - RNA, 13 nt, Human
cagcagacauugu

SEQ ID NO: 2393185 - RNA, 14 nt, Human
cagcagacauuguc

SEQ ID NO: 2393186 - RNA, 16 nt, Human
cagcagacauugucag

SEQ ID NO: 2393187 - RNA, 11 nt, Human
cagcagagcac

SEQ ID NO: 2393188 - RNA, 13 nt, Human
cagcagagcaccu

SEQ ID NO: 2393189 - RNA, 18 nt, Human
cagcacuuugggaggccu

SEQ ID NO: 2393190 - RNA, 13 nt, Human
cagcagaaggggg

SEQ ID NO: 2393191 - RNA, 17 nt, Human
cagcagaaggggguggu

SEQ ID NO: 2393192 - RNA, 22 nt, Human
cagcagaaaugccuuacccuca

SEQ ID NO: 2393193 - RNA, 19 nt, Human
cagcagaaaugccuuaccc

SEQ ID NO: 2393194 - RNA, 23 nt, Human
cagcacugucucaguuucacuuu

SEQ ID NO: 2393195 - RNA, 15 nt, Human
cagcacugucucagu

SEQ ID NO: 2393196 - RNA, 13 nt, Human
cagcacuuauuua

SEQ ID NO: 2393197 - RNA, 19 nt, Human
cagcacuuggagaggcuga

SEQ ID NO: 2393198 - RNA, 17 nt, Human
cagcacuuguccagcug

SEQ ID NO: 2393199 - RNA, 15 nt, Human
cagcacuuguccagc

SEQ ID NO: 2393200 - RNA, 13 nt, Human
cagcacuuguaua

SEQ ID NO: 2393201 - RNA, 18 nt, Human
cagcacuuugggaggcca

SEQ ID NO: 2393202 - RNA, 16 nt, Human
cagcacuuugggaggc

SEQ ID NO: 2393203 - RNA, 15 nt, Human
cagcacuuugggagg

SEQ ID NO: 2393204 - RNA, 19 nt, Human
cagcacuuguccagcugag

SEQ ID NO: 2393205 - RNA, 18 nt, Human
cagcacuuguccagcuga

SEQ ID NO: 2393206 - RNA, 23 nt, Human
cagcacuuugggaggcugaggcg

SEQ ID NO: 2393207 - RNA, 22 nt, Human
cagcacuuugggaggcugaggc

SEQ ID NO: 2393208 - RNA, 20 nt, Human
cagcacuuugggaggcugag

SEQ ID NO: 2393209 - RNA, 19 nt, Human
cagcacuuugggaggcuga

SEQ ID NO: 2393210 - RNA, 18 nt, Human
cagcacuuugggaggcug

SEQ ID NO: 2393211 - RNA, 22 nt, Human
cagcacuuugggaggccuaggc

SEQ ID NO: 2393212 - RNA, 23 nt, Human
cagcacuuugggaggccaaggag

SEQ ID NO: 2393213 - RNA, 22 nt, Human
cagcacuuugggaggccaagga

SEQ ID NO: 2393214 - RNA, 20 nt, Human
cagcacuuugggaggccaag

SEQ ID NO: 2393215 - RNA, 17 nt, Human
cagcagaaaugccuuac

SEQ ID NO: 2393216 - RNA, 15 nt, Human
cagcagaaaugccuu

SEQ ID NO: 2393217 - RNA, 19 nt, Human
cagcagccagcucucagcc

SEQ ID NO: 2393218 - RNA, 18 nt, Human
cagcagccagcucucagc

SEQ ID NO: 2393219 - RNA, 17 nt, Human
cagcagccagcucucag

SEQ ID NO: 2393220 - RNA, 15 nt, Human
cagcagccagcucuc

SEQ ID NO: 2393221 - RNA, 14 nt, Human
cagcagccagcucu

SEQ ID NO: 2393222 - RNA, 13 nt, Human
cagcagccagcuc

SEQ ID NO: 2393223 - RNA, 21 nt, Human
cagcagccagcucucagccaa

SEQ ID NO: 2393224 - RNA, 20 nt, Human
cagcagccagcucucagcca

SEQ ID NO: 2393225 - RNA, 18 nt, Human
cagcagccaucauaggaa

SEQ ID NO: 2393226 - RNA, 21 nt, Human
cagcagccaucauaggaaggg

SEQ ID NO: 2393227 - RNA, 22 nt, Human
cagcagccaucauaggaaggga

SEQ ID NO: 2393228 - RNA, 19 nt, Human
cagcagcccuccucacccc

SEQ ID NO: 2393229 - RNA, 17 nt, Human
cagcagcccuccucacc

SEQ ID NO: 2393230 - RNA, 15 nt, Human
cagcagcccuccuca

SEQ ID NO: 2393231 - RNA, 14 nt, Human
cagcagcccuccuc

SEQ ID NO: 2393232 - RNA, 12 nt, Human
cagcagcccucc

SEQ ID NO: 2393233 - RNA, 11 nt, Human
cagcagcccuc

SEQ ID NO: 2393234 - RNA, 24 nt, Human
cagcagcccuaaggaucucucagg

SEQ ID NO: 2393235 - RNA, 18 nt, Human
cagcagcccuccucaccc

SEQ ID NO: 2393236 - RNA, 13 nt, Human
cagcagccccugc

SEQ ID NO: 2393237 - RNA, 16 nt, Human
cagcagccccugcaca

SEQ ID NO: 2393238 - RNA, 23 nt, Human
cagcagccccugcacaaagcccu

SEQ ID NO: 2393239 - RNA, 11 nt, Human
cagcagcccua

SEQ ID NO: 2393240 - RNA, 16 nt, Human
cagcagcccuaaggau

SEQ ID NO: 2393241 - RNA, 20 nt, Human
cagcagcccuaaggaucucu

SEQ ID NO: 2393242 - RNA, 23 nt, Human
cagcagcccuaaggaucucucag

SEQ ID NO: 2393243 - RNA, 16 nt, Human
cagcagaucccagcuc

SEQ ID NO: 2393244 - RNA, 15 nt, Human
cagcagaucccagcu

SEQ ID NO: 2393245 - RNA, 13 nt, Human
cagcagagugugg

SEQ ID NO: 2393246 - RNA, 15 nt, Human
cagcagaggcacugg

SEQ ID NO: 2393247 - RNA, 16 nt, Human
cagcagaggcacuggg

SEQ ID NO: 2393248 - RNA, 21 nt, Human
cagcagaucccagcucacguc

SEQ ID NO: 2393249 - RNA, 18 nt, Human
cagcagaucccagcucac

SEQ ID NO: 2393250 - RNA, 17 nt, Human
cagcagaucccagcuca

SEQ ID NO: 2393251 - RNA, 13 nt, Human
cagcagauuuuag

SEQ ID NO: 2393252 - RNA, 14 nt, Human
cagauuuuuacaaa

SEQ ID NO: 2393253 - RNA, 15 nt, Human
cagauuuuuacaaau

SEQ ID NO: 2393254 - RNA, 22 nt, Human
cagauuuuuuacagcugccugc

SEQ ID NO: 2393255 - RNA, 13 nt, Human
cagcaaaaagcaa

SEQ ID NO: 2393256 - RNA, 14 nt, Human
cagcaaaaagcaaa

SEQ ID NO: 2393257 - RNA, 20 nt, Human
cagcaaaaagcaaaaucauu

SEQ ID NO: 2393258 - RNA, 19 nt, Human
cagauuuuuuacagcugcc

SEQ ID NO: 2393259 - RNA, 16 nt, Human
cagauuuuuacacaug

SEQ ID NO: 2393260 - RNA, 20 nt, Human
cagauuuugggguuguguug

SEQ ID NO: 2393261 - RNA, 23 nt, Human
cagauuuugcuguauauuuguga

SEQ ID NO: 2393262 - RNA, 19 nt, Human
cagauuuugcuguauauuu

SEQ ID NO: 2393263 - RNA, 21 nt, Human
cagauuuugggguuguguugu

SEQ ID NO: 2393264 - RNA, 23 nt, Human
cagauuuugggguuguguuguca

SEQ ID NO: 2393265 - RNA, 16 nt, Human
cagauuuugauagcaa

SEQ ID NO: 2393266 - RNA, 22 nt, Human
cagauuuucagcaaacucuuuu

SEQ ID NO: 2393267 - RNA, 19 nt, Human
cagauuuucagcaaacucu

SEQ ID NO: 2393268 - RNA, 17 nt, Human
cagauuuugcuguauau

SEQ ID NO: 2393269 - RNA, 16 nt, Human
cagauuuugcuguaua

SEQ ID NO: 2393270 - RNA, 20 nt, Human
cagauuuugauagcaaagcg

SEQ ID NO: 2393271 - RNA, 18 nt, Human
cagauuuugauagcaaag

SEQ ID NO: 2393272 - RNA, 19 nt, Human
cagauuuugauagcaaagc

SEQ ID NO: 2393273 - RNA, 14 nt, Human
cagauuuuccugaa

SEQ ID NO: 2393274 - RNA, 15 nt, Human
cagauuuuccugaaa

SEQ ID NO: 2393275 - RNA, 15 nt, Human
cagauuuuaauuuug

SEQ ID NO: 2393276 - RNA, 23 nt, Human
cagauuuuaauuuugaauaaaua

SEQ ID NO: 2393277 - RNA, 24 nt, Human
cagauuugugaacucagccaagca

SEQ ID NO: 2393278 - RNA, 14 nt, Human
cagauuuguguuau

SEQ ID NO: 2393279 - RNA, 22 nt, Human
cagauuuuaaaaagucuucacu

SEQ ID NO: 2393280 - RNA, 18 nt, Human
cagauuuuaggaaaugaa

SEQ ID NO: 2393281 - RNA, 14 nt, Human
cagauucuuuccug

SEQ ID NO: 2393282 - RNA, 12 nt, Human
cagauuugugaa

SEQ ID NO: 2393283 - RNA, 14 nt, Human
cagauuugugaacu

SEQ ID NO: 2393284 - RNA, 15 nt, Human
cagauuugugaacuc

SEQ ID NO: 2393285 - RNA, 16 nt, Human
cagauuugugaacuca

SEQ ID NO: 2393286 - RNA, 17 nt, Human
cagauuugugaacucag

SEQ ID NO: 2393287 - RNA, 23 nt, Human
cagauuugugaacucagccaagc

SEQ ID NO: 2393288 - RNA, 15 nt, Human
cagauuuucagcaaa

SEQ ID NO: 2393289 - RNA, 13 nt, Human
cagauuuucagca

SEQ ID NO: 2393290 - RNA, 17 nt, Human
cagcaacacaagcugga

SEQ ID NO: 2393291 - RNA, 21 nt, Human
cagcaacacaagcuggaagca

SEQ ID NO: 2393292 - RNA, 12 nt, Human
cagcaaccccag

SEQ ID NO: 2393293 - RNA, 14 nt, Human
cagcaacccuccua

SEQ ID NO: 2393294 - RNA, 17 nt, Human
cagcaaccccaggcuga

SEQ ID NO: 2393295 - RNA, 16 nt, Human
cagcaaccccaggcug

SEQ ID NO: 2393296 - RNA, 13 nt, Human
cagcaaccccagg

SEQ ID NO: 2393297 - RNA, 23 nt, Human
cagcaacgcaggcccccaggugc

SEQ ID NO: 2393298 - RNA, 22 nt, Human
cagcaacuugucuuuuucugga

SEQ ID NO: 2393299 - RNA, 19 nt, Human
cagcaacuugucuuuuucu

SEQ ID NO: 2393300 - RNA, 18 nt, Human
cagcaacuugucuuuuuc

SEQ ID NO: 2393301 - RNA, 15 nt, Human
cagcaacuugucuuu

SEQ ID NO: 2393302 - RNA, 20 nt, Human
cagcaacugaauaaauaccu

SEQ ID NO: 2393303 - RNA, 14 nt, Human
cagcaacugaauaa

SEQ ID NO: 2393304 - RNA, 15 nt, Human
cagcaacugaauaaa

SEQ ID NO: 2393305 - RNA, 21 nt, Human
cagcaacugaauaaauaccuc

SEQ ID NO: 2393306 - RNA, 14 nt, Human
cagcaacuccaacu

SEQ ID NO: 2393307 - RNA, 12 nt, Human
cagcaacugaau

SEQ ID NO: 2393308 - RNA, 13 nt, Human
cagcaacugaaua

SEQ ID NO: 2393309 - RNA, 20 nt, Human
cagcaacggggaggccaagu

SEQ ID NO: 2393310 - RNA, 19 nt, Human
cagcaaauuaauuggcagc

SEQ ID NO: 2393311 - RNA, 22 nt, Human
cagcaaauuaauuggcagcaga

SEQ ID NO: 2393312 - RNA, 23 nt, Human
cagcaaauuaauuggcagcagau

SEQ ID NO: 2393313 - RNA, 16 nt, Human
cagcaacacaagcugg

SEQ ID NO: 2393314 - RNA, 17 nt, Human
cagcaaauuaauuggca

SEQ ID NO: 2393315 - RNA, 22 nt, Human
cagcaaagccccaugcuggagc

SEQ ID NO: 2393316 - RNA, 23 nt, Human
cagcaaagccccaugcuggagcc

SEQ ID NO: 2393317 - RNA, 15 nt, Human
cagcaaaacuccauc

SEQ ID NO: 2393318 - RNA, 18 nt, Human
cagcaaaagaugcuucuc

SEQ ID NO: 2393319 - RNA, 15 nt, Human
cagcaaaaagcaaaa

SEQ ID NO: 2393320 - RNA, 16 nt, Human
cagcaaaccggggccu

SEQ ID NO: 2393321 - RNA, 14 nt, Human
cagcaaaccggggc

SEQ ID NO: 2393322 - RNA, 22 nt, Human
cagcaaaaugugaaugggaaaa

SEQ ID NO: 2393323 - RNA, 20 nt, Human
cagcaaacucuuuucccacu

SEQ ID NO: 2393324 - RNA, 19 nt, Human
cagcaaagagugggcugca

SEQ ID NO: 2393325 - RNA, 12 nt, Human
cagcaaagcccc

SEQ ID NO: 2393326 - RNA, 13 nt, Human
cagcaaagcccca

SEQ ID NO: 2393327 - RNA, 14 nt, Human
cagcaaagccccau

SEQ ID NO: 2393328 - RNA, 21 nt, Human
cagcaaagccccaugcuggag

SEQ ID NO: 2393329 - RNA, 14 nt, Human
cagauuacugccca

SEQ ID NO: 2393330 - RNA, 17 nt, Human
cagauguuuuacgucug

SEQ ID NO: 2393331 - RNA, 18 nt, Human
cagauguuuuacgucugg

SEQ ID NO: 2393332 - RNA, 22 nt, Human
cagauguuuuacgucugggaga

SEQ ID NO: 2393333 - RNA, 14 nt, Human
cagauguuucuuuu

SEQ ID NO: 2393334 - RNA, 19 nt, Human
cagauguuucuuuuguaug

SEQ ID NO: 2393335 - RNA, 22 nt, Human
cagauguuucuuuuguauguaa

SEQ ID NO: 2393336 - RNA, 23 nt, Human
cagauguuuccagacuuccuuga

SEQ ID NO: 2393337 - RNA, 18 nt, Human
cagauguuuccagacuuc

SEQ ID NO: 2393338 - RNA, 14 nt, Human
cagauucacacugu

SEQ ID NO: 2393339 - RNA, 19 nt, Human
cagauucacacugucuggu

SEQ ID NO: 2393340 - RNA, 21 nt, Human
cagauucccagagcaaaauaa

SEQ ID NO: 2393341 - RNA, 19 nt, Human
cagauucccagagcaaaau

SEQ ID NO: 2393342 - RNA, 18 nt, Human
cagauucccagagcaaaa

SEQ ID NO: 2393343 - RNA, 23 nt, Human
cagauuccaggcgaugugcaagu

SEQ ID NO: 2393344 - RNA, 21 nt, Human
cagauuccaggcgaugugcaa

SEQ ID NO: 2393345 - RNA, 15 nt, Human
cagauucauuuuucu

SEQ ID NO: 2393346 - RNA, 17 nt, Human
cagauucccagagcaaa

SEQ ID NO: 2393347 - RNA, 14 nt, Human
cagauucccagagc

SEQ ID NO: 2393348 - RNA, 23 nt, Human
cagauguugaaugcccacaggca

SEQ ID NO: 2393349 - RNA, 19 nt, Human
cagauguucucucccaggg

SEQ ID NO: 2393350 - RNA, 14 nt, Human
cagauguuuccaga

SEQ ID NO: 2393351 - RNA, 16 nt, Human
cagauguuuccagacu

SEQ ID NO: 2393352 - RNA, 15 nt, Human
cagauguuuccagac

SEQ ID NO: 2393353 - RNA, 22 nt, Human
cagaugucuucugccuguuaua

SEQ ID NO: 2393354 - RNA, 17 nt, Human
cagaugucuucugccug

SEQ ID NO: 2393355 - RNA, 18 nt, Human
cagaugucuucugccugu

SEQ ID NO: 2393356 - RNA, 20 nt, Human
cagaugugguaacuguuaaa

SEQ ID NO: 2393357 - RNA, 13 nt, Human
cagaugucuucug

SEQ ID NO: 2393358 - RNA, 15 nt, Human
cagaugucuucugcc

SEQ ID NO: 2393359 - RNA, 16 nt, Human
cagaugucuucugccu

SEQ ID NO: 2393360 - RNA, 23 nt, Human
cagaugggugcuuggaggaagga

SEQ ID NO: 2393361 - RNA, 15 nt, Human
cagauggggccucug

SEQ ID NO: 2393362 - RNA, 21 nt, Human
cagauggggcucccgcccgug

SEQ ID NO: 2393363 - RNA, 14 nt, Human
cagaugggggaaag

SEQ ID NO: 2393364 - RNA, 19 nt, Human
cagaugggggaaagcacag

SEQ ID NO: 2393365 - RNA, 22 nt, Human
cagaugguuuuauaaucugauu

SEQ ID NO: 2393366 - RNA, 14 nt, Human
cagaugcuuuucug

SEQ ID NO: 2393367 - RNA, 20 nt, Human
cagauggaaccgcaggaagc

SEQ ID NO: 2393368 - RNA, 19 nt, Human
cagauggaaccgcaggaag

SEQ ID NO: 2393369 - RNA, 18 nt, Human
cagauggaaccgcaggaa

SEQ ID NO: 2393370 - RNA, 14 nt, Human
cagauggaaccgca

SEQ ID NO: 2393371 - RNA, 14 nt, Human
cagaugcuuuccug

SEQ ID NO: 2393372 - RNA, 21 nt, Human
cagaugcuuuccugcacauua

SEQ ID NO: 2393373 - RNA, 16 nt, Human
cagauggaaugcugug

SEQ ID NO: 2393374 - RNA, 17 nt, Human
cagauggaaugcugugu

SEQ ID NO: 2393375 - RNA, 19 nt, Human
cagauggaaugcuguguua

SEQ ID NO: 2393376 - RNA, 21 nt, Human
cagauggaaugcuguguuaaa

SEQ ID NO: 2393377 - RNA, 21 nt, Human
cagauggauuugccugugcca

SEQ ID NO: 2393378 - RNA, 15 nt, Human
cagauggauuugccu

SEQ ID NO: 2393379 - RNA, 22 nt, Human
cagauggauugauaauugcauu

SEQ ID NO: 2393380 - RNA, 23 nt, Human
cagauggauugauaauugcauuc

SEQ ID NO: 2393381 - RNA, 22 nt, Human
cagauggaaccgcaggaagcug

SEQ ID NO: 2393382 - RNA, 21 nt, Human
cagauggaaccgcaggaagcu

SEQ ID NO: 2393383 - RNA, 18 nt, Human
cagauggacuccagccug

SEQ ID NO: 2393384 - RNA, 19 nt, Human
cagauggacuccagccugc

SEQ ID NO: 2393385 - RNA, 22 nt, Human
cagauggauuugccugugccac

SEQ ID NO: 2393386 - RNA, 12 nt, Human
cagauggcacuu

SEQ ID NO: 2393387 - RNA, 16 nt, Human
cagauggcauguguuu

SEQ ID NO: 2393388 - RNA, 18 nt, Human
cagaugggugcuuggagg

SEQ ID NO: 2393389 - RNA, 22 nt, Human
cagauggcauguguuuacuuua

SEQ ID NO: 2393390 - RNA, 14 nt, Human
cagauggggccucu

SEQ ID NO: 2393391 - RNA, 16 nt, Human
cagaugccccagagcu

SEQ ID NO: 2393392 - RNA, 13 nt, Human
cagaugccccaga

SEQ ID NO: 2393393 - RNA, 22 nt, Human
cagaugcccagagggcccaggc

SEQ ID NO: 2393394 - RNA, 20 nt, Human
cagaugcccagagggcccag

SEQ ID NO: 2393395 - RNA, 19 nt, Human
cagaugcccagagggccca

SEQ ID NO: 2393396 - RNA, 15 nt, Human
cagaugcccagaggg

SEQ ID NO: 2393397 - RNA, 17 nt, Human
cagaugcagggcaguca

SEQ ID NO: 2393398 - RNA, 18 nt, Human
cagaugccccagagcugu

SEQ ID NO: 2393399 - RNA, 14 nt, Human
cagaugccuccacc

SEQ ID NO: 2393400 - RNA, 22 nt, Human
cagaugccuccaccccccagaa

SEQ ID NO: 2393401 - RNA, 17 nt, Human
cagaugcuucugggaga

SEQ ID NO: 2393402 - RNA, 13 nt, Human
cagaugcuucugg

SEQ ID NO: 2393403 - RNA, 12 nt, Human
cagaugcuucug

SEQ ID NO: 2393404 - RNA, 15 nt, Human
cagaugcugugcaaa

SEQ ID NO: 2393405 - RNA, 15 nt, Human
cagaugcugauguuc

SEQ ID NO: 2393406 - RNA, 16 nt, Human
cagaugcugauguuca

SEQ ID NO: 2393407 - RNA, 17 nt, Human
cagaugcugauguucag

SEQ ID NO: 2393408 - RNA, 18 nt, Human
cagaugcugauguucagu

SEQ ID NO: 2393409 - RNA, 20 nt, Human
cagaugcugauguucagugu

SEQ ID NO: 2393410 - RNA, 21 nt, Human
cagaugcugauguucagugua

SEQ ID NO: 2393411 - RNA, 22 nt, Human
cagaugcugauguucaguguaa

SEQ ID NO: 2393412 - RNA, 18 nt, Human
cagaugcuggucaugugu

SEQ ID NO: 2393413 - RNA, 13 nt, Human
cagaugcugaugu

SEQ ID NO: 2393414 - RNA, 14 nt, Human
cagaugcugauguu

SEQ ID NO: 2393415 - RNA, 17 nt, Human
cagcccaaagaaggaaa

SEQ ID NO: 2393416 - RNA, 23 nt, Human
cagcccaaaccaccagaagccca

SEQ ID NO: 2393417 - RNA, 21 nt, Human
cagcccaaaccaccagaagcc

SEQ ID NO: 2393418 - RNA, 20 nt, Human
cagcccaaaccaccagaagc

SEQ ID NO: 2393419 - RNA, 20 nt, Human
cagccauuaccauggagaca

SEQ ID NO: 2393420 - RNA, 19 nt, Human
cagccauucacugccccca

SEQ ID NO: 2393421 - RNA, 19 nt, Human
cagccauuggcuauuuaaa

SEQ ID NO: 2393422 - RNA, 20 nt, Human
cagccauuggcuauuuaaaa

SEQ ID NO: 2393423 - RNA, 19 nt, Human
cagcccaaaccaccagaag

SEQ ID NO: 2393424 - RNA, 16 nt, Human
cagcccaaaccaccag

SEQ ID NO: 2393425 - RNA, 22 nt, Human
cagccaugaggaguugcuguuu

SEQ ID NO: 2393426 - RNA, 15 nt, Human
cagccaucugcccag

SEQ ID NO: 2393427 - RNA, 16 nt, Human
cagccaucugcccagg

SEQ ID NO: 2393428 - RNA, 17 nt, Human
cagccaucugcccaggg

SEQ ID NO: 2393429 - RNA, 18 nt, Human
cagccaucugcccagggg

SEQ ID NO: 2393430 - RNA, 16 nt, Human
cagccauuaccaugga

SEQ ID NO: 2393431 - RNA, 13 nt, Human
cagccaugugcug

SEQ ID NO: 2393432 - RNA, 17 nt, Human
cagccaugugcugcgug

SEQ ID NO: 2393433 - RNA, 18 nt, Human
cagccaugaggaguugcu

SEQ ID NO: 2393434 - RNA, 17 nt, Human
cagccaugucugcauuu

SEQ ID NO: 2393435 - RNA, 19 nt, Human
cagccaucugcccaggggu

SEQ ID NO: 2393436 - RNA, 21 nt, Human
cagccaucugcccaggggugc

SEQ ID NO: 2393437 - RNA, 17 nt, Human
cagccaucaaaaugcuu

SEQ ID NO: 2393438 - RNA, 16 nt, Human
cagccaucaaaaugcu

SEQ ID NO: 2393439 - RNA, 13 nt, Human
cagccaucugccc

SEQ ID NO: 2393440 - RNA, 19 nt, Human
cagccaucauaggaaggga

SEQ ID NO: 2393441 - RNA, 17 nt, Human
cagccaucccagccuug

SEQ ID NO: 2393442 - RNA, 18 nt, Human
cagccaucauaggaaggg

SEQ ID NO: 2393443 - RNA, 15 nt, Human
cagcccaccccucaa

SEQ ID NO: 2393444 - RNA, 19 nt, Human
cagcccaccccccucauuu

SEQ ID NO: 2393445 - RNA, 17 nt, Human
cagcccaccccccucau

SEQ ID NO: 2393446 - RNA, 16 nt, Human
cagcccaccccccuca

SEQ ID NO: 2393447 - RNA, 14 nt, Human
cagcccaccccccu

SEQ ID NO: 2393448 - RNA, 19 nt, Human
cagcccacauagugauggu

SEQ ID NO: 2393449 - RNA, 12 nt, Human
cagcccaccccc

SEQ ID NO: 2393450 - RNA, 11 nt, Human
cagcccacccc

SEQ ID NO: 2393451 - RNA, 21 nt, Human
cagccaugugcugcgugccug

SEQ ID NO: 2393452 - RNA, 22 nt, Human
cagccauuggcuauuuaaaacu

SEQ ID NO: 2393453 - RNA, 10 nt, Human
cagcccaagu

SEQ ID NO: 2393454 - RNA, 15 nt, Human
cagcccacuucugcc

SEQ ID NO: 2393455 - RNA, 15 nt, Human
cagcccacguccugu

SEQ ID NO: 2393456 - RNA, 16 nt, Human
cagcccacguccuguc

SEQ ID NO: 2393457 - RNA, 18 nt, Human
cagcccacguccugucag

SEQ ID NO: 2393458 - RNA, 19 nt, Human
cagcccacguccugucagu

SEQ ID NO: 2393459 - RNA, 16 nt, Human
cagcccaccuggcuuu

SEQ ID NO: 2393460 - RNA, 21 nt, Human
cagcccacccuccugucuucc

SEQ ID NO: 2393461 - RNA, 22 nt, Human
cagcccacccuccugucuuccc

SEQ ID NO: 2393462 - RNA, 24 nt, Human
cagcccacccuccugucuucccag

SEQ ID NO: 2393463 - RNA, 12 nt, Human
cagcccacccuc

SEQ ID NO: 2393464 - RNA, 13 nt, Human
cagcccacccucc

SEQ ID NO: 2393465 - RNA, 15 nt, Human
cagcccacccuccug

SEQ ID NO: 2393466 - RNA, 16 nt, Human
cagcccacccuccugu

SEQ ID NO: 2393467 - RNA, 17 nt, Human
cagcccacccuccuguc

SEQ ID NO: 2393468 - RNA, 18 nt, Human
cagcccacccuccugucu

SEQ ID NO: 2393469 - RNA, 22 nt, Human
cagcccauucucucuccugucc

SEQ ID NO: 2393470 - RNA, 21 nt, Human
cagcccauucucucuccuguc

SEQ ID NO: 2393471 - RNA, 20 nt, Human
cagcccauucucucuccugu

SEQ ID NO: 2393472 - RNA, 18 nt, Human
cagcccauucucucuccu

SEQ ID NO: 2393473 - RNA, 21 nt, Human
cagcccaugcccaccugccca

SEQ ID NO: 2393474 - RNA, 19 nt, Human
cagcccaugcccaccugcc

SEQ ID NO: 2393475 - RNA, 24 nt, Human
cagcccaugcccaccugcccauca

SEQ ID NO: 2393476 - RNA, 17 nt, Human
cagcccaugcccaccug

SEQ ID NO: 2393477 - RNA, 16 nt, Human
cagcccaugcccaccu

SEQ ID NO: 2393478 - RNA, 15 nt, Human
cagcccaugcccacc

SEQ ID NO: 2393479 - RNA, 19 nt, Human
cagcccaggguucccccag

SEQ ID NO: 2393480 - RNA, 18 nt, Human
cagcccaggguuccccca

SEQ ID NO: 2393481 - RNA, 17 nt, Human
cagcccaggguuccccc

SEQ ID NO: 2393482 - RNA, 11 nt, Human
cagcccagggu

SEQ ID NO: 2393483 - RNA, 22 nt, Human
cagccccaaaacucuccucugc

SEQ ID NO: 2393484 - RNA, 20 nt, Human
cagccccaaaacucuccucu

SEQ ID NO: 2393485 - RNA, 21 nt, Human
cagccccaaaacucuccucug

SEQ ID NO: 2393486 - RNA, 20 nt, Human
cagcccacguccugucagug

SEQ ID NO: 2393487 - RNA, 12 nt, Human
cagcccagagac

SEQ ID NO: 2393488 - RNA, 11 nt, Human
cagcccagaga

SEQ ID NO: 2393489 - RNA, 18 nt, Human
cagcccacuucugccaua

SEQ ID NO: 2393490 - RNA, 22 nt, Human
cagcccagagacauacuugaag

SEQ ID NO: 2393491 - RNA, 21 nt, Human
cagcccagagacauacuugaa

SEQ ID NO: 2393492 - RNA, 13 nt, Human
cagcccagagaca

SEQ ID NO: 2393493 - RNA, 12 nt, Human
cagcccagggac

SEQ ID NO: 2393494 - RNA, 16 nt, Human
cagcccagggcuccug

SEQ ID NO: 2393495 - RNA, 23 nt, Human
cagcccaggccgggguggagcau

SEQ ID NO: 2393496 - RNA, 17 nt, Human
cagcccagggcuccugc

SEQ ID NO: 2393497 - RNA, 18 nt, Human
cagcccagggcuccugca

SEQ ID NO: 2393498 - RNA, 19 nt, Human
cagcccagggcuccugcac

SEQ ID NO: 2393499 - RNA, 21 nt, Human
cagcccagggcuccugcacuu

SEQ ID NO: 2393500 - RNA, 17 nt, Human
cagcccagcccagcugg

SEQ ID NO: 2393501 - RNA, 15 nt, Human
cagcccagcccagcu

SEQ ID NO: 2393502 - RNA, 13 nt, Human
cagcccagcccag

SEQ ID NO: 2393503 - RNA, 22 nt, Human
cagccagugaccugaggaagcg

SEQ ID NO: 2393504 - RNA, 21 nt, Human
cagccagugaccugaggaagc

SEQ ID NO: 2393505 - RNA, 20 nt, Human
cagccagugaccugaggaag

SEQ ID NO: 2393506 - RNA, 23 nt, Human
cagccauacuuaucucucugugc

SEQ ID NO: 2393507 - RNA, 20 nt, Human
cagccauacuuaucucucug

SEQ ID NO: 2393508 - RNA, 21 nt, Human
cagccauacuuaucucucugu

SEQ ID NO: 2393509 - RNA, 13 nt, Human
cagccaucaaaau

SEQ ID NO: 2393510 - RNA, 19 nt, Human
cagccagugaccugaggaa

SEQ ID NO: 2393511 - RNA, 16 nt, Human
cagccagugaccugag

SEQ ID NO: 2393512 - RNA, 22 nt, Human
cagccagucccguuucauuuag

SEQ ID NO: 2393513 - RNA, 13 nt, Human
cagccaguaaaug

SEQ ID NO: 2393514 - RNA, 22 nt, Human
cagccaguaaaugggggugcau

SEQ ID NO: 2393515 - RNA, 23 nt, Human
cagccacggccaggccagaggga

SEQ ID NO: 2393516 - RNA, 14 nt, Human
cagccacucgggag

SEQ ID NO: 2393517 - RNA, 21 nt, Human
cagccacucgggaggcugaga

SEQ ID NO: 2393518 - RNA, 17 nt, Human
cagccagaacguggcuc

SEQ ID NO: 2393519 - RNA, 23 nt, Human
cagccacucgggaggcugagaca

SEQ ID NO: 2393520 - RNA, 23 nt, Human
cagccagaacguggcucugcugg

SEQ ID NO: 2393521 - RNA, 20 nt, Human
cagccagaacguggcucugc

SEQ ID NO: 2393522 - RNA, 21 nt, Human
cagccagaacguggcucugcu

SEQ ID NO: 2393523 - RNA, 22 nt, Human
cagccagaacguggcucugcug

SEQ ID NO: 2393524 - RNA, 14 nt, Human
cagccacggccagg

SEQ ID NO: 2393525 - RNA, 15 nt, Human
cagccacggccaggc

SEQ ID NO: 2393526 - RNA, 16 nt, Human
cagccacggccaggcc

SEQ ID NO: 2393527 - RNA, 17 nt, Human
cagccacggccaggcca

SEQ ID NO: 2393528 - RNA, 18 nt, Human
cagccacggccaggccag

SEQ ID NO: 2393529 - RNA, 19 nt, Human
cagccacggccaggccaga

SEQ ID NO: 2393530 - RNA, 21 nt, Human
cagccacggccaggccagagg

SEQ ID NO: 2393531 - RNA, 22 nt, Human
cagccacggccaggccagaggg

SEQ ID NO: 2393532 - RNA, 12 nt, Human
cagccacacugu

SEQ ID NO: 2393533 - RNA, 23 nt, Human
cagccacacacacagaaaauaua

SEQ ID NO: 2393534 - RNA, 14 nt, Human
cagccacauuccug

SEQ ID NO: 2393535 - RNA, 22 nt, Human
cagccacacacacagaaaauau

SEQ ID NO: 2393536 - RNA, 21 nt, Human
cagccacacacacagaaaaua

SEQ ID NO: 2393537 - RNA, 20 nt, Human
cagccacacacacagaaaau

SEQ ID NO: 2393538 - RNA, 19 nt, Human
cagccacacacacagaaaa

SEQ ID NO: 2393539 - RNA, 18 nt, Human
cagccacacacacagaaa

SEQ ID NO: 2393540 - RNA, 17 nt, Human
cagccacacacacagaa

SEQ ID NO: 2393541 - RNA, 16 nt, Human
cagccacacacacaga

SEQ ID NO: 2393542 - RNA, 15 nt, Human
cagccacacacacag

SEQ ID NO: 2393543 - RNA, 23 nt, Human
cagccaagguuuuauaaggcuga

SEQ ID NO: 2393544 - RNA, 21 nt, Human
cagccaaggccgaagcucugg

SEQ ID NO: 2393545 - RNA, 22 nt, Human
cagccaaggccgaagcucuggc

SEQ ID NO: 2393546 - RNA, 23 nt, Human
cagccaaggccgaagcucuggcu

SEQ ID NO: 2393547 - RNA, 20 nt, Human
cagccaagggaugaaagaga

SEQ ID NO: 2393548 - RNA, 19 nt, Human
cagccaagcacaguggugg

SEQ ID NO: 2393549 - RNA, 23 nt, Human
cagccaagcacagugguggcagg

SEQ ID NO: 2393550 - RNA, 13 nt, Human
cagccaagcacag

SEQ ID NO: 2393551 - RNA, 14 nt, Human
cagccaagcacagu

SEQ ID NO: 2393552 - RNA, 16 nt, Human
cagccaagcacagugg

SEQ ID NO: 2393553 - RNA, 17 nt, Human
cagccaagcacaguggu

SEQ ID NO: 2393554 - RNA, 17 nt, Human
cagccaauuauguuaaa

SEQ ID NO: 2393555 - RNA, 18 nt, Human
cagccaauuauguuaaac

SEQ ID NO: 2393556 - RNA, 9 nt, Human
cagccacac

SEQ ID NO: 2393557 - RNA, 14 nt, Human
cagccacacacaca

SEQ ID NO: 2393558 - RNA, 13 nt, Human
cagccacacacac

SEQ ID NO: 2393559 - RNA, 12 nt, Human
cagccacacaca

SEQ ID NO: 2393560 - RNA, 11 nt, Human
cagccacacac

SEQ ID NO: 2393561 - RNA, 11 nt, Human
cagccaccccg

SEQ ID NO: 2393562 - RNA, 19 nt, Human
cagccacauuccugaugcu

SEQ ID NO: 2393563 - RNA, 15 nt, Human
cagccacauuccuga

SEQ ID NO: 2393564 - RNA, 17 nt, Human
cagccacauuccugaug

SEQ ID NO: 2393565 - RNA, 21 nt, Human
cagccaccccgggcucucugc

SEQ ID NO: 2393566 - RNA, 20 nt, Human
cagccaccccgggcucucug

SEQ ID NO: 2393567 - RNA, 17 nt, Human
cagccaccccgggcucu

SEQ ID NO: 2393568 - RNA, 23 nt, Human
cagccacaguuuccucaucuguc

SEQ ID NO: 2393569 - RNA, 12 nt, Human
cagccaccagcg

SEQ ID NO: 2393570 - RNA, 22 nt, Human
cagccaccccgggcucucugcu

SEQ ID NO: 2393571 - RNA, 16 nt, Human
cagccaccucucuuuu

SEQ ID NO: 2393572 - RNA, 15 nt, Human
cagccaccucucuuu

SEQ ID NO: 2393573 - RNA, 18 nt, Human
cagccacgaggugcaaca

SEQ ID NO: 2393574 - RNA, 21 nt, Human
cagccaccgaagccgccugug

SEQ ID NO: 2393575 - RNA, 23 nt, Human
cagcaucucccucacugaaacca

SEQ ID NO: 2393576 - RNA, 17 nt, Human
cagcagggccucaaagu

SEQ ID NO: 2393577 - RNA, 17 nt, Human
cagcagggcugcuguga

SEQ ID NO: 2393578 - RNA, 20 nt, Human
cagcaggguagucugguuuc

SEQ ID NO: 2393579 - RNA, 23 nt, Human
cagcauccuuuucugcagagggg

SEQ ID NO: 2393580 - RNA, 18 nt, Human
cagcagggucuuuucauc

SEQ ID NO: 2393581 - RNA, 18 nt, Human
cagcagggcugcugugaa

SEQ ID NO: 2393582 - RNA, 21 nt, Human
cagcauccuggcacccggccc

SEQ ID NO: 2393583 - RNA, 19 nt, Human
cagcauccuggcacccggc

SEQ ID NO: 2393584 - RNA, 20 nt, Human
cagcauccuggcacccggcc

SEQ ID NO: 2393585 - RNA, 15 nt, Human
cagcauucucacucc

SEQ ID NO: 2393586 - RNA, 14 nt, Human
cagcauucucacuc

SEQ ID NO: 2393587 - RNA, 14 nt, Human
cagcauuccagccc

SEQ ID NO: 2393588 - RNA, 16 nt, Human
cagcauuccagccccu

SEQ ID NO: 2393589 - RNA, 20 nt, Human
cagcauuccagccccucugg

SEQ ID NO: 2393590 - RNA, 21 nt, Human
cagcauuccagccccucuggu

SEQ ID NO: 2393591 - RNA, 23 nt, Human
cagcaugaccugugaccagcacu

SEQ ID NO: 2393592 - RNA, 17 nt, Human
cagcaugaggaacuagc

SEQ ID NO: 2393593 - RNA, 20 nt, Human
cagcaugggcccaggaaugc

SEQ ID NO: 2393594 - RNA, 21 nt, Human
cagcaugaccugugaccagca

SEQ ID NO: 2393595 - RNA, 22 nt, Human
cagcauguguauuuccagugca

SEQ ID NO: 2393596 - RNA, 17 nt, Human
cagcauguugcugagga

SEQ ID NO: 2393597 - RNA, 18 nt, Human
cagcauguugcugaggag

SEQ ID NO: 2393598 - RNA, 18 nt, Human
cagcauuacaaauugcuu

SEQ ID NO: 2393599 - RNA, 18 nt, Human
cagcaugucuauucagcu

SEQ ID NO: 2393600 - RNA, 17 nt, Human
cagccaaacccaugagg

SEQ ID NO: 2393601 - RNA, 16 nt, Human
cagccaaacccaugag

SEQ ID NO: 2393602 - RNA, 17 nt, Human
cagccaaacccugucug

SEQ ID NO: 2393603 - RNA, 16 nt, Human
cagccaaacccugucu

SEQ ID NO: 2393604 - RNA, 15 nt, Human
cagccaaacccuguc

SEQ ID NO: 2393605 - RNA, 19 nt, Human
cagccaaacccaugaggca

SEQ ID NO: 2393606 - RNA, 16 nt, Human
cagccaaagccuccuc

SEQ ID NO: 2393607 - RNA, 15 nt, Human
cagccaaagccuccu

SEQ ID NO: 2393608 - RNA, 18 nt, Human
cagcauuuuacugauuca

SEQ ID NO: 2393609 - RNA, 23 nt, Human
cagcauuuccacaccaagcagca

SEQ ID NO: 2393610 - RNA, 15 nt, Human
cagcauuucugaagu

SEQ ID NO: 2393611 - RNA, 16 nt, Human
cagcauuucugaagug

SEQ ID NO: 2393612 - RNA, 14 nt, Human
cagcauugcugguu

SEQ ID NO: 2393613 - RNA, 15 nt, Human
cagcauugcugguuc

SEQ ID NO: 2393614 - RNA, 13 nt, Human
cagcauugcuuuc

SEQ ID NO: 2393615 - RNA, 12 nt, Human
cagcauugcuuu

SEQ ID NO: 2393616 - RNA, 16 nt, Human
cagcauugcugguucu

SEQ ID NO: 2393617 - RNA, 17 nt, Human
cagcauugcugguucua

SEQ ID NO: 2393618 - RNA, 16 nt, Human
cagcauugcuuucuga

SEQ ID NO: 2393619 - RNA, 14 nt, Human
cagcauugcuuucu

SEQ ID NO: 2393620 - RNA, 21 nt, Human
cagcauuuccacaccaagcag

SEQ ID NO: 2393621 - RNA, 20 nt, Human
cagcauuuccacaccaagca

SEQ ID NO: 2393622 - RNA, 21 nt, Human
cagccaacgaguaauuuauug

SEQ ID NO: 2393623 - RNA, 18 nt, Human
cagccaaccccuguggag

SEQ ID NO: 2393624 - RNA, 16 nt, Human
cagccaaccccugugg

SEQ ID NO: 2393625 - RNA, 21 nt, Human
cagccaaccccuguggagccc

SEQ ID NO: 2393626 - RNA, 15 nt, Human
cagccaaccccugug

SEQ ID NO: 2393627 - RNA, 14 nt, Human
cagccaaccccugu

SEQ ID NO: 2393628 - RNA, 12 nt, Human
cagccaaccccu

SEQ ID NO: 2393629 - RNA, 23 nt, Human
cagccaacagguggcaggaccag

SEQ ID NO: 2393630 - RNA, 18 nt, Human
cagccaacagguggcagg

SEQ ID NO: 2393631 - RNA, 19 nt, Human
cagccaacagguggcagga

SEQ ID NO: 2393632 - RNA, 22 nt, Human
cagccaacagguggcaggacca

SEQ ID NO: 2393633 - RNA, 18 nt, Human
cagccaacuauggccugu

SEQ ID NO: 2393634 - RNA, 13 nt, Human
cagccaacucauu

SEQ ID NO: 2393635 - RNA, 11 nt, Human
cagccaagcac

SEQ ID NO: 2393636 - RNA, 22 nt, Human
cagccaaauguaauugaauaaa

SEQ ID NO: 2393637 - RNA, 19 nt, Human
cagccaacacgcaccugcc

SEQ ID NO: 2393638 - RNA, 20 nt, Human
cagccaaagauaaucucuca

SEQ ID NO: 2393639 - RNA, 17 nt, Human
cagccaaagauaaucuc

SEQ ID NO: 2393640 - RNA, 23 nt, Human
cagccaacacgcaccugccucag

SEQ ID NO: 2393641 - RNA, 22 nt, Human
cagccaacacgcaccugccuca

SEQ ID NO: 2393642 - RNA, 20 nt, Human
cagccaacacgcaccugccu

SEQ ID NO: 2393643 - RNA, 21 nt, Human
cagccaaagccuccuccagcc

SEQ ID NO: 2393644 - RNA, 18 nt, Human
cagccaaagccuccucca

SEQ ID NO: 2393645 - RNA, 18 nt, Human
cagcagggagggcuucug

SEQ ID NO: 2393646 - RNA, 20 nt, Human
cagcaggcucucaggccagc

SEQ ID NO: 2393647 - RNA, 22 nt, Human
cagcaggcucucaggccagcug

SEQ ID NO: 2393648 - RNA, 16 nt, Human
cagcaggcucucaggc

SEQ ID NO: 2393649 - RNA, 17 nt, Human
cagcaggcucucaggcc

SEQ ID NO: 2393650 - RNA, 18 nt, Human
cagcaggcucucaggcca

SEQ ID NO: 2393651 - RNA, 19 nt, Human
cagcaggcucucaggccag

SEQ ID NO: 2393652 - RNA, 15 nt, Human
cagcagggccucaaa

SEQ ID NO: 2393653 - RNA, 14 nt, Human
cagcagggccucaa

SEQ ID NO: 2393654 - RNA, 11 nt, Human
cagcagggcua

SEQ ID NO: 2393655 - RNA, 21 nt, Human
cagcagggcuacccugagcug

SEQ ID NO: 2393656 - RNA, 19 nt, Human
cagcagggcuacccugagc

SEQ ID NO: 2393657 - RNA, 16 nt, Human
cagcagggccacuccc

SEQ ID NO: 2393658 - RNA, 17 nt, Human
cagcagggccacucccg

SEQ ID NO: 2393659 - RNA, 22 nt, Human
cagcagggaugcccuggaggug

SEQ ID NO: 2393660 - RNA, 21 nt, Human
cagcagggaugcccuggaggu

SEQ ID NO: 2393661 - RNA, 18 nt, Human
cagcagggaugcccugga

SEQ ID NO: 2393662 - RNA, 16 nt, Human
cagcagggaugcccug

SEQ ID NO: 2393663 - RNA, 20 nt, Human
cagcagggagggcuucugcc

SEQ ID NO: 2393664 - RNA, 24 nt, Human
cagcagggaaaaugcagcagggau

SEQ ID NO: 2393665 - RNA, 15 nt, Human
cagcagggaugcccu

SEQ ID NO: 2393666 - RNA, 23 nt, Human
cagcagggaaaaugcagcaggga

SEQ ID NO: 2393667 - RNA, 22 nt, Human
cagcagggaaaaugcagcaggg

SEQ ID NO: 2393668 - RNA, 14 nt, Human
cagcauccuggcac

SEQ ID NO: 2393669 - RNA, 15 nt, Human
cagcauccuggcacc

SEQ ID NO: 2393670 - RNA, 16 nt, Human
cagcauccuggcaccc

SEQ ID NO: 2393671 - RNA, 17 nt, Human
cagcauccuggcacccg

SEQ ID NO: 2393672 - RNA, 18 nt, Human
cagcagccuggacccugu

SEQ ID NO: 2393673 - RNA, 15 nt, Human
cagcagccuggaccc

SEQ ID NO: 2393674 - RNA, 14 nt, Human
cagcagccuggacc

SEQ ID NO: 2393675 - RNA, 12 nt, Human
cagcagccugga

SEQ ID NO: 2393676 - RNA, 13 nt, Human
cagcagcucaggc

SEQ ID NO: 2393677 - RNA, 12 nt, Human
cagcagcucagg

SEQ ID NO: 2393678 - RNA, 17 nt, Human
cagcagcgccuuuccca

SEQ ID NO: 2393679 - RNA, 21 nt, Human
cagcagcgaccaccccugccu

SEQ ID NO: 2393680 - RNA, 17 nt, Human
cagcagcggaaccgccc

SEQ ID NO: 2393681 - RNA, 15 nt, Human
cagcagcgguggccu

SEQ ID NO: 2393682 - RNA, 17 nt, Human
cagcagccuuuaaugca

SEQ ID NO: 2393683 - RNA, 20 nt, Human
cagcagcgaccaccccugcc

SEQ ID NO: 2393684 - RNA, 21 nt, Human
cagcagccuggggcuggccuc

SEQ ID NO: 2393685 - RNA, 20 nt, Human
cagcagccuggggcuggccu

SEQ ID NO: 2393686 - RNA, 22 nt, Human
cagcagccuggacccuguggau

SEQ ID NO: 2393687 - RNA, 19 nt, Human
cagcagccuggacccugug

SEQ ID NO: 2393688 - RNA, 16 nt, Human
cagcagcucaggcaca

SEQ ID NO: 2393689 - RNA, 16 nt, Human
cagcagcgguggccuc

SEQ ID NO: 2393690 - RNA, 18 nt, Human
cagcagcugaacagccaa

SEQ ID NO: 2393691 - RNA, 15 nt, Human
cagcagcucaggcac

SEQ ID NO: 2393692 - RNA, 14 nt, Human
cagcagcucaggca

SEQ ID NO: 2393693 - RNA, 17 nt, Human
cagcagcuuuuaauaca

SEQ ID NO: 2393694 - RNA, 17 nt, Human
cagcagcuucaccagag

SEQ ID NO: 2393695 - RNA, 18 nt, Human
cagcagcuucaccagagc

SEQ ID NO: 2393696 - RNA, 20 nt, Human
cagcagcugaacagccaaau

SEQ ID NO: 2393697 - RNA, 12 nt, Human
cagcagcuucac

SEQ ID NO: 2393698 - RNA, 16 nt, Human
cagcagcuucaccaga

SEQ ID NO: 2393699 - RNA, 18 nt, Human
cagcaggaggccaggccg

SEQ ID NO: 2393700 - RNA, 15 nt, Human
cagcaggaggccagg

SEQ ID NO: 2393701 - RNA, 14 nt, Human
cagcaggaggccag

SEQ ID NO: 2393702 - RNA, 12 nt, Human
cagcaggcucuc

SEQ ID NO: 2393703 - RNA, 14 nt, Human
cagcaggcucucag

SEQ ID NO: 2393704 - RNA, 15 nt, Human
cagcaggcucucagg

SEQ ID NO: 2393705 - RNA, 23 nt, Human
cagcccauucucucuccugucca

SEQ ID NO: 2393706 - RNA, 14 nt, Human
cagcucaccagccc

SEQ ID NO: 2393707 - RNA, 18 nt, Human
cagccuccaugcugccuc

SEQ ID NO: 2393708 - RNA, 21 nt, Human
caggaaaaaaaaaaaaaagac

SEQ ID NO: 2393709 - RNA, 18 nt, Human
caggaacagaaggaugaa

SEQ ID NO: 2393710 - RNA, 15 nt, Human
caggaacagaaggau

SEQ ID NO: 2393711 - RNA, 20 nt, Human
caggaaaacugacagaggag

SEQ ID NO: 2393712 - RNA, 14 nt, Human
caggaacagaagga

SEQ ID NO: 2393713 - RNA, 19 nt, Human
caggaaaacugacagagga

SEQ ID NO: 2393714 - RNA, 23 nt, Human
caggaaaacgggaccggccaggc

SEQ ID NO: 2393715 - RNA, 23 nt, Human
caggaacagcuaugggagcccca

SEQ ID NO: 2393716 - RNA, 22 nt, Human
caggaacagcuaugggagcccc

SEQ ID NO: 2393717 - RNA, 20 nt, Human
caggaacagcuaugggagcc

SEQ ID NO: 2393718 - RNA, 14 nt, Human
caggaacagcuaug

SEQ ID NO: 2393719 - RNA, 18 nt, Human
caggaaccacaagacugc

SEQ ID NO: 2393720 - RNA, 19 nt, Human
cagcuuugugacuguauau

SEQ ID NO: 2393721 - RNA, 14 nt, Human
cagcuuugcugcug

SEQ ID NO: 2393722 - RNA, 18 nt, Human
cagcuuugugacuguaua

SEQ ID NO: 2393723 - RNA, 20 nt, Human
cagcuuuucccaaaagccca

SEQ ID NO: 2393724 - RNA, 18 nt, Human
cagcuuuucccaaaagcc

SEQ ID NO: 2393725 - RNA, 19 nt, Human
cagcuuuuugucuuuucug

SEQ ID NO: 2393726 - RNA, 19 nt, Human
cagcuuuuuuuuccccccu

SEQ ID NO: 2393727 - RNA, 16 nt, Human
cagcuuuuugucuuuu

SEQ ID NO: 2393728 - RNA, 13 nt, Human
cagcuuuuugucu

SEQ ID NO: 2393729 - RNA, 16 nt, Human
cagcuuuuccucccuu

SEQ ID NO: 2393730 - RNA, 15 nt, Human
cagcuuuugcuucau

SEQ ID NO: 2393731 - RNA, 19 nt, Human
cagcuuuuuaaaguggguu

SEQ ID NO: 2393732 - RNA, 17 nt, Human
cagcuuuuuaccaaguu

SEQ ID NO: 2393733 - RNA, 14 nt, Human
cagcuuugccuucc

SEQ ID NO: 2393734 - RNA, 23 nt, Human
cagcuuugcccaacaccagcccc

SEQ ID NO: 2393735 - RNA, 22 nt, Human
cagcuuugcccaacaccagccc

SEQ ID NO: 2393736 - RNA, 16 nt, Human
cagcuuugccuuccac

SEQ ID NO: 2393737 - RNA, 15 nt, Human
cagcuuugccuucca

SEQ ID NO: 2393738 - RNA, 11 nt, Human
cagcuuugcua

SEQ ID NO: 2393739 - RNA, 18 nt, Human
cagcuuugccuuccacgc

SEQ ID NO: 2393740 - RNA, 22 nt, Human
cagcuuugcuaccaaagcaccu

SEQ ID NO: 2393741 - RNA, 12 nt, Human
cagcuuugcugc

SEQ ID NO: 2393742 - RNA, 13 nt, Human
cagcuuugcugcu

SEQ ID NO: 2393743 - RNA, 14 nt, Human
cagcuuugauauuu

SEQ ID NO: 2393744 - RNA, 20 nt, Human
cagcuuugaucccugacauc

SEQ ID NO: 2393745 - RNA, 17 nt, Human
cagcuuugaucccugac

SEQ ID NO: 2393746 - RNA, 16 nt, Human
cagcuuugaucccuga

SEQ ID NO: 2393747 - RNA, 23 nt, Human
cagcuuuguuuguugucagcuga

SEQ ID NO: 2393748 - RNA, 22 nt, Human
cagcuuuguuuguugucagcug

SEQ ID NO: 2393749 - RNA, 21 nt, Human
cagcuuuguuuguugucagcu

SEQ ID NO: 2393750 - RNA, 12 nt, Human
cagcuuuguuug

SEQ ID NO: 2393751 - RNA, 16 nt, Human
cagcuuucaugauuag

SEQ ID NO: 2393752 - RNA, 20 nt, Human
cagcuuucaugauuagcaag

SEQ ID NO: 2393753 - RNA, 17 nt, Human
cagcuuucaugauuagc

SEQ ID NO: 2393754 - RNA, 23 nt, Human
cagcuuuccccaugucucgacuc

SEQ ID NO: 2393755 - RNA, 23 nt, Human
cagcuuuccucaaaacuucagac

SEQ ID NO: 2393756 - RNA, 19 nt, Human
cagcuuucccugccucuca

SEQ ID NO: 2393757 - RNA, 17 nt, Human
cagcuuucccugccucu

SEQ ID NO: 2393758 - RNA, 17 nt, Human
cagcuuguuauuuauaa

SEQ ID NO: 2393759 - RNA, 15 nt, Human
cagcuuguguuguca

SEQ ID NO: 2393760 - RNA, 22 nt, Human
cagcuuuaaaaaauuaaucugg

SEQ ID NO: 2393761 - RNA, 19 nt, Human
cagcuuuacaugcaauuua

SEQ ID NO: 2393762 - RNA, 21 nt, Human
cagcuuuacaugcaauuuauu

SEQ ID NO: 2393763 - RNA, 22 nt, Human
cagcuuuaaacucagggacaga

SEQ ID NO: 2393764 - RNA, 15 nt, Human
cagcuuuaaccauua

SEQ ID NO: 2393765 - RNA, 20 nt, Human
cagcuuuaaccauuaaaacu

SEQ ID NO: 2393766 - RNA, 15 nt, Human
cagcuuuacaugcaa

SEQ ID NO: 2393767 - RNA, 13 nt, Human
cagcuuuaaacaa

SEQ ID NO: 2393768 - RNA, 15 nt, Human
cagcuuuaaacaaau

SEQ ID NO: 2393769 - RNA, 17 nt, Human
cagcuuuaaacucaggg

SEQ ID NO: 2393770 - RNA, 18 nt, Human
cagcuuuaaacucaggga

SEQ ID NO: 2393771 - RNA, 19 nt, Human
cagcuuuaaacucagggac

SEQ ID NO: 2393772 - RNA, 20 nt, Human
cagcuuuaaacucagggaca

SEQ ID NO: 2393773 - RNA, 21 nt, Human
cagcuuuaaacucagggacag

SEQ ID NO: 2393774 - RNA, 21 nt, Human
cagcuuguaaauagcucaggu

SEQ ID NO: 2393775 - RNA, 22 nt, Human
cagcuuguaaauagcucaggug

SEQ ID NO: 2393776 - RNA, 13 nt, Human
cagcuuguauuuu

SEQ ID NO: 2393777 - RNA, 14 nt, Human
cagcuugugcacaa

SEQ ID NO: 2393778 - RNA, 15 nt, Human
cagcuugugcacaau

SEQ ID NO: 2393779 - RNA, 15 nt, Human
cagcuuguggagccc

SEQ ID NO: 2393780 - RNA, 17 nt, Human
cagcuuguggagcccca

SEQ ID NO: 2393781 - RNA, 18 nt, Human
cagcuuguggagccccac

SEQ ID NO: 2393782 - RNA, 21 nt, Human
cagcuuguggagccccacacu

SEQ ID NO: 2393783 - RNA, 18 nt, Human
cagcuuguaaauagcuca

SEQ ID NO: 2393784 - RNA, 18 nt, Human
cagcuugggcccagcugg

SEQ ID NO: 2393785 - RNA, 19 nt, Human
cagcuugggcccagcuggg

SEQ ID NO: 2393786 - RNA, 20 nt, Human
cagcuugggcccagcugggc

SEQ ID NO: 2393787 - RNA, 21 nt, Human
cagcuugggcccagcugggcu

SEQ ID NO: 2393788 - RNA, 23 nt, Human
cagcuugggcccagcugggcucu

SEQ ID NO: 2393789 - RNA, 22 nt, Human
cagcuugggcccagcugggcuc

SEQ ID NO: 2393790 - RNA, 19 nt, Human
cagcuuguaaauagcucag

SEQ ID NO: 2393791 - RNA, 20 nt, Human
cagcuuguaaauagcucagg

SEQ ID NO: 2393792 - RNA, 19 nt, Human
cagcuugaucaaaggcaca

SEQ ID NO: 2393793 - RNA, 23 nt, Human
cagcuugaucaaaggcacacagc

SEQ ID NO: 2393794 - RNA, 15 nt, Human
cagcuucuucaucuu

SEQ ID NO: 2393795 - RNA, 14 nt, Human
cagcuugagccggg

SEQ ID NO: 2393796 - RNA, 21 nt, Human
cagcuugagccgggccccugg

SEQ ID NO: 2393797 - RNA, 22 nt, Human
cagcuugagccgggccccuggg

SEQ ID NO: 2393798 - RNA, 22 nt, Human
cagcuugcguuagaaugaggag

SEQ ID NO: 2393799 - RNA, 13 nt, Human
cagcuugccccgg

SEQ ID NO: 2393800 - RNA, 16 nt, Human
cagcuugccccggccc

SEQ ID NO: 2393801 - RNA, 12 nt, Human
cagcuugccccg

SEQ ID NO: 2393802 - RNA, 14 nt, Human
cagcuugcugcccu

SEQ ID NO: 2393803 - RNA, 23 nt, Human
cagcuugcucuucagugggagaa

SEQ ID NO: 2393804 - RNA, 15 nt, Human
cagcuugcucuucag

SEQ ID NO: 2393805 - RNA, 19 nt, Human
cagcuugcugcccuaggcu

SEQ ID NO: 2393806 - RNA, 17 nt, Human
cagcuugcugcccuagg

SEQ ID NO: 2393807 - RNA, 13 nt, Human
cagcuugggccca

SEQ ID NO: 2393808 - RNA, 14 nt, Human
cagcuugggcccag

SEQ ID NO: 2393809 - RNA, 16 nt, Human
cagcuugggcccagcu

SEQ ID NO: 2393810 - RNA, 17 nt, Human
cagcuugggcccagcug

SEQ ID NO: 2393811 - RNA, 18 nt, Human
cagcuugaggguugggcu

SEQ ID NO: 2393812 - RNA, 19 nt, Human
cagcuugaggguugggcug

SEQ ID NO: 2393813 - RNA, 20 nt, Human
cagcuugaggguugggcugg

SEQ ID NO: 2393814 - RNA, 21 nt, Human
cagcuugaggguugggcuggu

SEQ ID NO: 2393815 - RNA, 14 nt, Human
cagcuugaggguug

SEQ ID NO: 2393816 - RNA, 15 nt, Human
cagcuugaggguugg

SEQ ID NO: 2393817 - RNA, 15 nt, Human
cagcuugaccugagg

SEQ ID NO: 2393818 - RNA, 16 nt, Human
cagcuugaccugaggc

SEQ ID NO: 2393819 - RNA, 17 nt, Human
cagcuugaccugaggcu

SEQ ID NO: 2393820 - RNA, 19 nt, Human
cagcuugaccugaggcugu

SEQ ID NO: 2393821 - RNA, 20 nt, Human
cagcuugaccugaggcugug

SEQ ID NO: 2393822 - RNA, 21 nt, Human
cagcuugaccugaggcugugg

SEQ ID NO: 2393823 - RNA, 22 nt, Human
cagcuugaccugaggcuguggu

SEQ ID NO: 2393824 - RNA, 23 nt, Human
cagcuugaccugaggcugugguc

SEQ ID NO: 2393825 - RNA, 18 nt, Human
cagcuugaccgugaggcc

SEQ ID NO: 2393826 - RNA, 19 nt, Human
cagcuugaccgugaggcca

SEQ ID NO: 2393827 - RNA, 20 nt, Human
cagcuugaccgugaggccag

SEQ ID NO: 2393828 - RNA, 21 nt, Human
cagcuugaccgugaggccaga

SEQ ID NO: 2393829 - RNA, 21 nt, Human
cagcuucucauccugcaggca

SEQ ID NO: 2393830 - RNA, 19 nt, Human
cagcuucuauuagccaguc

SEQ ID NO: 2393831 - RNA, 12 nt, Human
cagcuucuccag

SEQ ID NO: 2393832 - RNA, 13 nt, Human
cagcuucuccagg

SEQ ID NO: 2393833 - RNA, 14 nt, Human
cagcuucugccacu

SEQ ID NO: 2393834 - RNA, 13 nt, Human
cagcuucugccac

SEQ ID NO: 2393835 - RNA, 11 nt, Human
cagcuucugcc

SEQ ID NO: 2393836 - RNA, 12 nt, Human
cagcuucugcca

SEQ ID NO: 2393837 - RNA, 16 nt, Human
cagcuucuccugugug

SEQ ID NO: 2393838 - RNA, 15 nt, Human
cagcuucuccugugu

SEQ ID NO: 2393839 - RNA, 14 nt, Human
cagcuucuccaggc

SEQ ID NO: 2393840 - RNA, 15 nt, Human
cagcuucuccaggcu

SEQ ID NO: 2393841 - RNA, 19 nt, Human
cagcuucucauccugcagg

SEQ ID NO: 2393842 - RNA, 20 nt, Human
cagcuucucauccugcaggc

SEQ ID NO: 2393843 - RNA, 18 nt, Human
cagcuucucauccugcag

SEQ ID NO: 2393844 - RNA, 18 nt, Human
cagcuucuauccuugacu

SEQ ID NO: 2393845 - RNA, 22 nt, Human
cagcuucguuuauuuucaagaa

SEQ ID NO: 2393846 - RNA, 22 nt, Human
cagcuucuuaauauaacugccu

SEQ ID NO: 2393847 - RNA, 23 nt, Human
cagcuucugguacucuccuagag

SEQ ID NO: 2393848 - RNA, 14 nt, Human
cagcuucuucaucu

SEQ ID NO: 2393849 - RNA, 19 nt, Human
cagcuucugguacucuccu

SEQ ID NO: 2393850 - RNA, 20 nt, Human
cagcuucugguacucuccua

SEQ ID NO: 2393851 - RNA, 21 nt, Human
cagcuucugguacucuccuag

SEQ ID NO: 2393852 - RNA, 22 nt, Human
cagcuucugguacucuccuaga

SEQ ID NO: 2393853 - RNA, 18 nt, Human
cagcuugaaacugagaug

SEQ ID NO: 2393854 - RNA, 20 nt, Human
cagcuucugccacuucccag

SEQ ID NO: 2393855 - RNA, 23 nt, Human
cagcuucugccacuucccaggua

SEQ ID NO: 2393856 - RNA, 15 nt, Human
cagcuucugccacuu

SEQ ID NO: 2393857 - RNA, 17 nt, Human
cagcuucugccacuucc

SEQ ID NO: 2393858 - RNA, 18 nt, Human
cagcuucugccacuuccc

SEQ ID NO: 2393859 - RNA, 19 nt, Human
cagcuucugccacuuccca

SEQ ID NO: 2393860 - RNA, 14 nt, Human
cagcuucugcuggg

SEQ ID NO: 2393861 - RNA, 15 nt, Human
cagcuucugcugggc

SEQ ID NO: 2393862 - RNA, 16 nt, Human
cagcuucugcugggcu

SEQ ID NO: 2393863 - RNA, 17 nt, Human
cagcuucugcugggcug

SEQ ID NO: 2393864 - RNA, 18 nt, Human
cagcuucugcugggcugg

SEQ ID NO: 2393865 - RNA, 14 nt, Human
cagcuucugguacu

SEQ ID NO: 2393866 - RNA, 19 nt, Human
cagcuucauuuccuguguc

SEQ ID NO: 2393867 - RNA, 22 nt, Human
cagcuguaagaagagacuggga

SEQ ID NO: 2393868 - RNA, 21 nt, Human
cagcuguaagaagagacuggg

SEQ ID NO: 2393869 - RNA, 16 nt, Human
cagcuguaaucuauga

SEQ ID NO: 2393870 - RNA, 19 nt, Human
cagcuguaugauucccagc

SEQ ID NO: 2393871 - RNA, 20 nt, Human
cagcuucauuuccugugucu

SEQ ID NO: 2393872 - RNA, 21 nt, Human
cagcuucauuuccugugucuu

SEQ ID NO: 2393873 - RNA, 23 nt, Human
cagcuuccccucucuccuccugc

SEQ ID NO: 2393874 - RNA, 14 nt, Human
cagcuuccuaccca

SEQ ID NO: 2393875 - RNA, 19 nt, Human
cagcuuccuacccacaccu

SEQ ID NO: 2393876 - RNA, 20 nt, Human
cagcuuccuacccacaccuc

SEQ ID NO: 2393877 - RNA, 22 nt, Human
cagcuuccuacccacaccucug

SEQ ID NO: 2393878 - RNA, 20 nt, Human
cagcuucguuuauuuucaag

SEQ ID NO: 2393879 - RNA, 22 nt, Human
cagcuuccccucucuccuccug

SEQ ID NO: 2393880 - RNA, 18 nt, Human
cagcuuccccucucuccu

SEQ ID NO: 2393881 - RNA, 17 nt, Human
cagcuucauuuguguca

SEQ ID NO: 2393882 - RNA, 17 nt, Human
cagcuguacuucgucuu

SEQ ID NO: 2393883 - RNA, 13 nt, Human
cagcuucauuugu

SEQ ID NO: 2393884 - RNA, 15 nt, Human
cagcuucauuugugu

SEQ ID NO: 2393885 - RNA, 22 nt, Human
caggaagaaaucacagaaucau

SEQ ID NO: 2393886 - RNA, 22 nt, Human
caggaagaaaggagucugcaca

SEQ ID NO: 2393887 - RNA, 14 nt, Human
caggaagaaaucac

SEQ ID NO: 2393888 - RNA, 21 nt, Human
caggaagaaaucacagaauca

SEQ ID NO: 2393889 - RNA, 14 nt, Human
caggaagagagcau

SEQ ID NO: 2393890 - RNA, 21 nt, Human
caggaagaugaaagaggaggu

SEQ ID NO: 2393891 - RNA, 18 nt, Human
caggaagaucuuaaauuu

SEQ ID NO: 2393892 - RNA, 15 nt, Human
caggaagcaccccau

SEQ ID NO: 2393893 - RNA, 14 nt, Human
caggaagcacccca

SEQ ID NO: 2393894 - RNA, 17 nt, Human
caggaagcaccccaugc

SEQ ID NO: 2393895 - RNA, 16 nt, Human
caggaagcaccccaug

SEQ ID NO: 2393896 - RNA, 14 nt, Human
caggaagcagcuuu

SEQ ID NO: 2393897 - RNA, 15 nt, Human
caggaacuauaaaaa

SEQ ID NO: 2393898 - RNA, 17 nt, Human
caggaacuauaaaaaca

SEQ ID NO: 2393899 - RNA, 19 nt, Human
caggaaccacaccacaucu

SEQ ID NO: 2393900 - RNA, 16 nt, Human
caggaaccacaccaca

SEQ ID NO: 2393901 - RNA, 13 nt, Human
caggaacugggcc

SEQ ID NO: 2393902 - RNA, 12 nt, Human
caggaacugggc

SEQ ID NO: 2393903 - RNA, 14 nt, Human
caggaacucccagc

SEQ ID NO: 2393904 - RNA, 15 nt, Human
caggaacucccagca

SEQ ID NO: 2393905 - RNA, 16 nt, Human
caggaacucccagcaa

SEQ ID NO: 2393906 - RNA, 17 nt, Human
caggaacucccagcaac

SEQ ID NO: 2393907 - RNA, 22 nt, Human
caggaagccagcaggcucucag

SEQ ID NO: 2393908 - RNA, 22 nt, Human
caggaagcauucagagagcagc

SEQ ID NO: 2393909 - RNA, 23 nt, Human
caggaagcaaacuaagcccccgc

SEQ ID NO: 2393910 - RNA, 18 nt, Human
caggaagcauucagagag

SEQ ID NO: 2393911 - RNA, 19 nt, Human
caggaagcauucagagagc

SEQ ID NO: 2393912 - RNA, 20 nt, Human
caggaagcauucagagagca

SEQ ID NO: 2393913 - RNA, 19 nt, Human
caggaagccagcaggcucu

SEQ ID NO: 2393914 - RNA, 21 nt, Human
caggaagccagcaggcucuca

SEQ ID NO: 2393915 - RNA, 14 nt, Human
caggaagccagcag

SEQ ID NO: 2393916 - RNA, 16 nt, Human
caggaagccagcaggc

SEQ ID NO: 2393917 - RNA, 17 nt, Human
caggaagccagcaggcu

SEQ ID NO: 2393918 - RNA, 18 nt, Human
caggaagccagcaggcuc

SEQ ID NO: 2393919 - RNA, 17 nt, Human
caggaagcugcuccgug

SEQ ID NO: 2393920 - RNA, 15 nt, Human
caggaagcugcuccg

SEQ ID NO: 2393921 - RNA, 18 nt, Human
caggaagcugcuccgugc

SEQ ID NO: 2393922 - RNA, 16 nt, Human
caggaaggagagccug

SEQ ID NO: 2393923 - RNA, 15 nt, Human
caggaaggagagccu

SEQ ID NO: 2393924 - RNA, 14 nt, Human
caggaaggagagcc

SEQ ID NO: 2393925 - RNA, 13 nt, Human
caggaaggagagc

SEQ ID NO: 2393926 - RNA, 14 nt, Human
caggaaggaaguca

SEQ ID NO: 2393927 - RNA, 12 nt, Human
caggaaggagag

SEQ ID NO: 2393928 - RNA, 17 nt, Human
caggaagcucagacugg

SEQ ID NO: 2393929 - RNA, 21 nt, Human
caggaagccgugcccugcccc

SEQ ID NO: 2393930 - RNA, 12 nt, Human
caggaagcucag

SEQ ID NO: 2393931 - RNA, 21 nt, Human
caggaagccugcaguccugga

SEQ ID NO: 2393932 - RNA, 23 nt, Human
caggaagcucagggccuggcuca

SEQ ID NO: 2393933 - RNA, 20 nt, Human
caggaagcucagggccuggc

SEQ ID NO: 2393934 - RNA, 21 nt, Human
caggaagcucagggccuggcu

SEQ ID NO: 2393935 - RNA, 13 nt, Human
caggaagcucagg

SEQ ID NO: 2393936 - RNA, 13 nt, Human
caggaagccccca

SEQ ID NO: 2393937 - RNA, 19 nt, Human
caggaagcccccaaguuga

SEQ ID NO: 2393938 - RNA, 13 nt, Human
caggaagccugca

SEQ ID NO: 2393939 - RNA, 19 nt, Human
caggaagccugcaguccug

SEQ ID NO: 2393940 - RNA, 14 nt, Human
caggaagcucaggg

SEQ ID NO: 2393941 - RNA, 15 nt, Human
caggaagcucagggc

SEQ ID NO: 2393942 - RNA, 16 nt, Human
caggaagcucagggcc

SEQ ID NO: 2393943 - RNA, 17 nt, Human
caggaagcucagggccu

SEQ ID NO: 2393944 - RNA, 18 nt, Human
caggaagcucagggccug

SEQ ID NO: 2393945 - RNA, 19 nt, Human
caggaagcucagggccugg

SEQ ID NO: 2393946 - RNA, 17 nt, Human
caggaccuguggccaag

SEQ ID NO: 2393947 - RNA, 20 nt, Human
caggaccuucgggcugugcc

SEQ ID NO: 2393948 - RNA, 22 nt, Human
caggaccuucgggcugugcccg

SEQ ID NO: 2393949 - RNA, 21 nt, Human
caggaccuucgggcugugccc

SEQ ID NO: 2393950 - RNA, 13 nt, Human
caggaccuuuuga

SEQ ID NO: 2393951 - RNA, 20 nt, Human
caggaccuuuugaaguaguu

SEQ ID NO: 2393952 - RNA, 14 nt, Human
caggacgcuucuga

SEQ ID NO: 2393953 - RNA, 15 nt, Human
caggacgcuucugaa

SEQ ID NO: 2393954 - RNA, 16 nt, Human
caggacgcuucugaau

SEQ ID NO: 2393955 - RNA, 21 nt, Human
caggacgcuucugaaugcugc

SEQ ID NO: 2393956 - RNA, 22 nt, Human
caggacgcuucugaaugcugcu

SEQ ID NO: 2393957 - RNA, 16 nt, Human
caggacggggccggcc

SEQ ID NO: 2393958 - RNA, 19 nt, Human
caggacggggccggccagg

SEQ ID NO: 2393959 - RNA, 20 nt, Human
caggacggggccggccaggu

SEQ ID NO: 2393960 - RNA, 13 nt, Human
caggaccugacua

SEQ ID NO: 2393961 - RNA, 13 nt, Human
caggaccugccug

SEQ ID NO: 2393962 - RNA, 21 nt, Human
caggaccucugaaacccugga

SEQ ID NO: 2393963 - RNA, 15 nt, Human
caggacacagucaga

SEQ ID NO: 2393964 - RNA, 14 nt, Human
caggacaccacacc

SEQ ID NO: 2393965 - RNA, 13 nt, Human
caggacacaguca

SEQ ID NO: 2393966 - RNA, 17 nt, Human
caggacaccacacccag

SEQ ID NO: 2393967 - RNA, 19 nt, Human
caggacaccacacccagcc

SEQ ID NO: 2393968 - RNA, 20 nt, Human
caggacaccacacccagccu

SEQ ID NO: 2393969 - RNA, 21 nt, Human
caggacaccacacccagccuc

SEQ ID NO: 2393970 - RNA, 18 nt, Human
caggaccuggcugccaua

SEQ ID NO: 2393971 - RNA, 22 nt, Human
caggacaccacacccagccuca

SEQ ID NO: 2393972 - RNA, 20 nt, Human
caggaccugggaccuccccu

SEQ ID NO: 2393973 - RNA, 17 nt, Human
caggaccuggcugccau

SEQ ID NO: 2393974 - RNA, 16 nt, Human
caggaccuggcugcca

SEQ ID NO: 2393975 - RNA, 14 nt, Human
caggaccuggcugc

SEQ ID NO: 2393976 - RNA, 19 nt, Human
caggaccugccuguagccc

SEQ ID NO: 2393977 - RNA, 15 nt, Human
caggaccugccugua

SEQ ID NO: 2393978 - RNA, 14 nt, Human
caggaccugccugu

SEQ ID NO: 2393979 - RNA, 17 nt, Human
caggaauguguggcaga

SEQ ID NO: 2393980 - RNA, 13 nt, Human
caggaaugggcug

SEQ ID NO: 2393981 - RNA, 14 nt, Human
caggaaugaucucu

SEQ ID NO: 2393982 - RNA, 21 nt, Human
caggaaugccaaggagacauc

SEQ ID NO: 2393983 - RNA, 17 nt, Human
caggaauguguggccug

SEQ ID NO: 2393984 - RNA, 16 nt, Human
caggaauguguggccu

SEQ ID NO: 2393985 - RNA, 19 nt, Human
caggaauguuaaagucagu

SEQ ID NO: 2393986 - RNA, 18 nt, Human
caggaauguuaaagucag

SEQ ID NO: 2393987 - RNA, 23 nt, Human
caggaauguguggccugcacagu

SEQ ID NO: 2393988 - RNA, 21 nt, Human
caggaauguguggccugcaca

SEQ ID NO: 2393989 - RNA, 19 nt, Human
caggaauguguggccugca

SEQ ID NO: 2393990 - RNA, 20 nt, Human
caggaaugaagccuuagcca

SEQ ID NO: 2393991 - RNA, 19 nt, Human
caggacaacgaggaagccc

SEQ ID NO: 2393992 - RNA, 17 nt, Human
caggacaaugucugaac

SEQ ID NO: 2393993 - RNA, 18 nt, Human
caggacaacgaggaagcc

SEQ ID NO: 2393994 - RNA, 16 nt, Human
caggacaacgaggaag

SEQ ID NO: 2393995 - RNA, 15 nt, Human
caggacaacgaggaa

SEQ ID NO: 2393996 - RNA, 21 nt, Human
caggaauuucccaggacccug

SEQ ID NO: 2393997 - RNA, 20 nt, Human
caggaauuucccaggacccu

SEQ ID NO: 2393998 - RNA, 19 nt, Human
caggaauuucccaggaccc

SEQ ID NO: 2393999 - RNA, 18 nt, Human
caggaauuucccaggacc

SEQ ID NO: 2394000 - RNA, 17 nt, Human
caggaauuucccaggac

SEQ ID NO: 2394001 - RNA, 16 nt, Human
caggaauuucccagga

SEQ ID NO: 2394002 - RNA, 18 nt, Human
caggaaggaugagcauuu

SEQ ID NO: 2394003 - RNA, 18 nt, Human
caggaaggagagccugcu

SEQ ID NO: 2394004 - RNA, 17 nt, Human
caggaaggagagccugc

SEQ ID NO: 2394005 - RNA, 19 nt, Human
caggaaggcugagaggaga

SEQ ID NO: 2394006 - RNA, 15 nt, Human
caggaaggcuaaagg

SEQ ID NO: 2394007 - RNA, 18 nt, Human
caggaaggggguccaccc

SEQ ID NO: 2394008 - RNA, 22 nt, Human
caggaagggccuacagcccauu

SEQ ID NO: 2394009 - RNA, 21 nt, Human
caggaagggcaggaaggagag

SEQ ID NO: 2394010 - RNA, 12 nt, Human
caggaaguacug

SEQ ID NO: 2394011 - RNA, 14 nt, Human
caggaaguacugga

SEQ ID NO: 2394012 - RNA, 16 nt, Human
caggaaguacuggaga

SEQ ID NO: 2394013 - RNA, 21 nt, Human
caggaaggggguccacccagc

SEQ ID NO: 2394014 - RNA, 23 nt, Human
caggaaggggguccacccagcaa

SEQ ID NO: 2394015 - RNA, 16 nt, Human
caggaaguagaggagg

SEQ ID NO: 2394016 - RNA, 23 nt, Human
caggaauaaggccuuaauauguu

SEQ ID NO: 2394017 - RNA, 17 nt, Human
caggaauauuuuccaaa

SEQ ID NO: 2394018 - RNA, 16 nt, Human
caggaaucaagagcug

SEQ ID NO: 2394019 - RNA, 17 nt, Human
caggaaucaagagcugc

SEQ ID NO: 2394020 - RNA, 18 nt, Human
caggaaucaagagcugcc

SEQ ID NO: 2394021 - RNA, 23 nt, Human
caggaaucaagagcugcccuccu

SEQ ID NO: 2394022 - RNA, 12 nt, Human
caggaauaaggc

SEQ ID NO: 2394023 - RNA, 10 nt, Human
caggaaguga

SEQ ID NO: 2394024 - RNA, 16 nt, Human
caggaagucuucaggg

SEQ ID NO: 2394025 - RNA, 17 nt, Human
caggaaguacuggagaa

SEQ ID NO: 2394026 - RNA, 18 nt, Human
caggaaguacuggagaaa

SEQ ID NO: 2394027 - RNA, 20 nt, Human
caggaaguacuggagaaaau

SEQ ID NO: 2394028 - RNA, 15 nt, Human
caggaaguagaggag

SEQ ID NO: 2394029 - RNA, 10 nt, Human
cagcucagga

SEQ ID NO: 2394030 - RNA, 18 nt, Human
cagcucagcgccagccug

SEQ ID NO: 2394031 - RNA, 12 nt, Human
cagcucaggaca

SEQ ID NO: 2394032 - RNA, 11 nt, Human
cagcucagcgc

SEQ ID NO: 2394033 - RNA, 13 nt, Human
cagcucagcgcca

SEQ ID NO: 2394034 - RNA, 17 nt, Human
cagcucagcgccagccu

SEQ ID NO: 2394035 - RNA, 21 nt, Human
cagcucaggcacacuucuucu

SEQ ID NO: 2394036 - RNA, 12 nt, Human
cagcucaggcac

SEQ ID NO: 2394037 - RNA, 13 nt, Human
cagcucaggaucu

SEQ ID NO: 2394038 - RNA, 11 nt, Human
cagcucaggau

SEQ ID NO: 2394039 - RNA, 22 nt, Human
cagcucaggacagaugccacac

SEQ ID NO: 2394040 - RNA, 19 nt, Human
cagcucaggacagaugcca

SEQ ID NO: 2394041 - RNA, 18 nt, Human
cagcucaggacagaugcc

SEQ ID NO: 2394042 - RNA, 16 nt, Human
cagcucaggacagaug

SEQ ID NO: 2394043 - RNA, 13 nt, Human
cagcucaggacag

SEQ ID NO: 2394044 - RNA, 13 nt, Human
cagcucagagagg

SEQ ID NO: 2394045 - RNA, 17 nt, Human
cagcucagagagggugg

SEQ ID NO: 2394046 - RNA, 19 nt, Human
cagcucagagaggguggga

SEQ ID NO: 2394047 - RNA, 20 nt, Human
cagcucagagagggugggag

SEQ ID NO: 2394048 - RNA, 23 nt, Human
cagcucaguucuagucucucugg

SEQ ID NO: 2394049 - RNA, 15 nt, Human
cagcucaucucuguc

SEQ ID NO: 2394050 - RNA, 17 nt, Human
cagcucaugcccccuuu

SEQ ID NO: 2394051 - RNA, 18 nt, Human
cagcucagucccaucaga

SEQ ID NO: 2394052 - RNA, 12 nt, Human
cagcucaguccc

SEQ ID NO: 2394053 - RNA, 23 nt, Human
cagcucaggcacacuucuucuug

SEQ ID NO: 2394054 - RNA, 15 nt, Human
cagcuccuguaacau

SEQ ID NO: 2394055 - RNA, 16 nt, Human
cagcuccuucuguccu

SEQ ID NO: 2394056 - RNA, 17 nt, Human
cagcuccuucuguccua

SEQ ID NO: 2394057 - RNA, 21 nt, Human
cagcuccuucuguccuacucu

SEQ ID NO: 2394058 - RNA, 23 nt, Human
cagcuccuucuguccuacucugu

SEQ ID NO: 2394059 - RNA, 12 nt, Human
cagcucuccccu

SEQ ID NO: 2394060 - RNA, 14 nt, Human
cagcucucccucug

SEQ ID NO: 2394061 - RNA, 12 nt, Human
cagcucucccuc

SEQ ID NO: 2394062 - RNA, 18 nt, Human
cagcucucccucuggccc

SEQ ID NO: 2394063 - RNA, 17 nt, Human
cagcucucccucuggcc

SEQ ID NO: 2394064 - RNA, 16 nt, Human
cagcucucccucuggc

SEQ ID NO: 2394065 - RNA, 15 nt, Human
cagcucucccucugg

SEQ ID NO: 2394066 - RNA, 11 nt, Human
cagcucuccag

SEQ ID NO: 2394067 - RNA, 12 nt, Human
cagcucuccagu

SEQ ID NO: 2394068 - RNA, 13 nt, Human
cagcucuccaguc

SEQ ID NO: 2394069 - RNA, 14 nt, Human
cagcucuccaguca

SEQ ID NO: 2394070 - RNA, 20 nt, Human
cagcucuagacaacccugca

SEQ ID NO: 2394071 - RNA, 17 nt, Human
cagcucuagacaacccu

SEQ ID NO: 2394072 - RNA, 15 nt, Human
cagcucuacuggucu

SEQ ID NO: 2394073 - RNA, 12 nt, Human
cagcucucagcc

SEQ ID NO: 2394074 - RNA, 20 nt, Human
cagcucuagacacugccaca

SEQ ID NO: 2394075 - RNA, 13 nt, Human
cagcucucagcca

SEQ ID NO: 2394076 - RNA, 21 nt, Human
cagcucuagacaacccugcaa

SEQ ID NO: 2394077 - RNA, 22 nt, Human
cagcuccuugggaggaagcaga

SEQ ID NO: 2394078 - RNA, 23 nt, Human
cagcuccuugggaggaagcagaa

SEQ ID NO: 2394079 - RNA, 17 nt, Human
cagcuccuugggaggaa

SEQ ID NO: 2394080 - RNA, 18 nt, Human
cagcuccuugggaggaag

SEQ ID NO: 2394081 - RNA, 20 nt, Human
cagcuccuugggaggaagca

SEQ ID NO: 2394082 - RNA, 21 nt, Human
cagcuccuugggaggaagcag

SEQ ID NO: 2394083 - RNA, 16 nt, Human
cagcuccuuccuggag

SEQ ID NO: 2394084 - RNA, 12 nt, Human
cagcuccuuggg

SEQ ID NO: 2394085 - RNA, 16 nt, Human
cagcuccuugggagga

SEQ ID NO: 2394086 - RNA, 14 nt, Human
cagcuccuuccugg

SEQ ID NO: 2394087 - RNA, 13 nt, Human
cagcuccuuccug

SEQ ID NO: 2394088 - RNA, 17 nt, Human
cagcucuggacagcccc

SEQ ID NO: 2394089 - RNA, 23 nt, Human
cagcucuggacagccccacccug

SEQ ID NO: 2394090 - RNA, 11 nt, Human
cagcucuggag

SEQ ID NO: 2394091 - RNA, 21 nt, Human
cagcucuggacagccccaccc

SEQ ID NO: 2394092 - RNA, 18 nt, Human
cagcucuggacagcccca

SEQ ID NO: 2394093 - RNA, 21 nt, Human
cagcucugcaagaauugaagc

SEQ ID NO: 2394094 - RNA, 20 nt, Human
cagcucugcauacucauuag

SEQ ID NO: 2394095 - RNA, 23 nt, Human
cagcucucccucuggcccugccu

SEQ ID NO: 2394096 - RNA, 21 nt, Human
cagcucucccucuggcccugc

SEQ ID NO: 2394097 - RNA, 20 nt, Human
cagcucucccucuggcccug

SEQ ID NO: 2394098 - RNA, 19 nt, Human
cagcucucccucuggcccu

SEQ ID NO: 2394099 - RNA, 19 nt, Human
cagcucugaaaccaguguu

SEQ ID NO: 2394100 - RNA, 18 nt, Human
cagcucugaaaccagugu

SEQ ID NO: 2394101 - RNA, 16 nt, Human
cagcucugcaagaauu

SEQ ID NO: 2394102 - RNA, 15 nt, Human
cagcucugcaagaau

SEQ ID NO: 2394103 - RNA, 14 nt, Human
cagcucuggcuucc

SEQ ID NO: 2394104 - RNA, 14 nt, Human
cagcucugggagag

SEQ ID NO: 2394105 - RNA, 19 nt, Human
cagcucugggccauucucc

SEQ ID NO: 2394106 - RNA, 12 nt, Human
cagcucugggcc

SEQ ID NO: 2394107 - RNA, 12 nt, Human
cagcucuggcuu

SEQ ID NO: 2394108 - RNA, 16 nt, Human
cagcucuggagggggu

SEQ ID NO: 2394109 - RNA, 18 nt, Human
cagcucuggaggggaggg

SEQ ID NO: 2394110 - RNA, 14 nt, Human
cagcucuggagggg

SEQ ID NO: 2394111 - RNA, 10 nt, Human
cagcucuggu

SEQ ID NO: 2394112 - RNA, 13 nt, Human
cagcucuggucca

SEQ ID NO: 2394113 - RNA, 16 nt, Human
cagcucugguccauag

SEQ ID NO: 2394114 - RNA, 17 nt, Human
cagcucugguccauaga

SEQ ID NO: 2394115 - RNA, 18 nt, Human
cagcucugguccauagag

SEQ ID NO: 2394116 - RNA, 21 nt, Human
cagcucugguccauagagagc

SEQ ID NO: 2394117 - RNA, 12 nt, Human
cagcucuguccu

SEQ ID NO: 2394118 - RNA, 13 nt, Human
cagcucuguccug

SEQ ID NO: 2394119 - RNA, 22 nt, Human
cagcucugguccauagagagca

SEQ ID NO: 2394120 - RNA, 23 nt, Human
cagcucugguccauagagagcaa

SEQ ID NO: 2394121 - RNA, 14 nt, Human
cagcucuguccugg

SEQ ID NO: 2394122 - RNA, 16 nt, Human
cagcucuguccuggga

SEQ ID NO: 2394123 - RNA, 17 nt, Human
cagcucuguccugggag

SEQ ID NO: 2394124 - RNA, 18 nt, Human
cagcucuguccugggagu

SEQ ID NO: 2394125 - RNA, 21 nt, Human
cagcucuguguugccaugugu

SEQ ID NO: 2394126 - RNA, 17 nt, Human
cagcucuguguugccau

SEQ ID NO: 2394127 - RNA, 23 nt, Human
cagcucugggccauucuccacag

SEQ ID NO: 2394128 - RNA, 22 nt, Human
cagcucugggccauucuccaca

SEQ ID NO: 2394129 - RNA, 23 nt, Human
cagcucuguccugggagugagcu

SEQ ID NO: 2394130 - RNA, 10 nt, Human
cagcucuuau

SEQ ID NO: 2394131 - RNA, 21 nt, Human
cagcucuuauauugccauuuc

SEQ ID NO: 2394132 - RNA, 13 nt, Human
cagcucuucucca

SEQ ID NO: 2394133 - RNA, 15 nt, Human
cagcucugggagagg

SEQ ID NO: 2394134 - RNA, 14 nt, Human
cagcucuucuccag

SEQ ID NO: 2394135 - RNA, 15 nt, Human
cagcucuucuccagg

SEQ ID NO: 2394136 - RNA, 16 nt, Human
cagcucuucuccaggc

SEQ ID NO: 2394137 - RNA, 17 nt, Human
cagcucuucuccaggcu

SEQ ID NO: 2394138 - RNA, 18 nt, Human
cagcucuucuccaggcug

SEQ ID NO: 2394139 - RNA, 19 nt, Human
cagcucuucuccaggcugu

SEQ ID NO: 2394140 - RNA, 23 nt, Human
cagcucuucugccggcccugggg

SEQ ID NO: 2394141 - RNA, 15 nt, Human
cagcucuugcccuuc

SEQ ID NO: 2394142 - RNA, 22 nt, Human
cagcucuucugccggcccuggg

SEQ ID NO: 2394143 - RNA, 13 nt, Human
cagcucuucugcc

SEQ ID NO: 2394144 - RNA, 16 nt, Human
cagcucuugcccuucc

SEQ ID NO: 2394145 - RNA, 17 nt, Human
cagcucuugcccuuccc

SEQ ID NO: 2394146 - RNA, 18 nt, Human
cagcucuugcccuucccu

SEQ ID NO: 2394147 - RNA, 19 nt, Human
cagcucuugcccuucccug

SEQ ID NO: 2394148 - RNA, 20 nt, Human
cagcucuugcccuucccugu

SEQ ID NO: 2394149 - RNA, 21 nt, Human
cagcucuugcccuucccuguc

SEQ ID NO: 2394150 - RNA, 23 nt, Human
cagcucuugcccuucccuguccc

SEQ ID NO: 2394151 - RNA, 14 nt, Human
cagcucuugcuaau

SEQ ID NO: 2394152 - RNA, 20 nt, Human
cagcucuugcuaaucagugu

SEQ ID NO: 2394153 - RNA, 21 nt, Human
cagcucuugcuaaucaguguc

SEQ ID NO: 2394154 - RNA, 22 nt, Human
cagcucuugcuaaucagugucu

SEQ ID NO: 2394155 - RNA, 23 nt, Human
cagcucuugcuaaucagugucuc

SEQ ID NO: 2394156 - RNA, 23 nt, Human
cagcucuucuccaggcuguaucc

SEQ ID NO: 2394157 - RNA, 18 nt, Human
cagcucuucuccccaggu

SEQ ID NO: 2394158 - RNA, 18 nt, Human
cagcucuuggcuccacug

SEQ ID NO: 2394159 - RNA, 13 nt, Human
cagcucuuuccuc

SEQ ID NO: 2394160 - RNA, 24 nt, Human
cagcucuugcuaaucagugucuca

SEQ ID NO: 2394161 - RNA, 17 nt, Human
cagcucuuggcuccacu

SEQ ID NO: 2394162 - RNA, 16 nt, Human
cagcucuuggcuccac

SEQ ID NO: 2394163 - RNA, 22 nt, Human
cagcucuuugaaauagucugug

SEQ ID NO: 2394164 - RNA, 21 nt, Human
cagcucuuuccuccuuccaug

SEQ ID NO: 2394165 - RNA, 19 nt, Human
cagcucuuuccuccuucca

SEQ ID NO: 2394166 - RNA, 18 nt, Human
cagcucuuuccuccuucc

SEQ ID NO: 2394167 - RNA, 17 nt, Human
cagcucuuuccuccuuc

SEQ ID NO: 2394168 - RNA, 16 nt, Human
cagcucuuuccuccuu

SEQ ID NO: 2394169 - RNA, 14 nt, Human
cagcucuuuccucc

SEQ ID NO: 2394170 - RNA, 21 nt, Human
cagcugaaauaugcuggcugg

SEQ ID NO: 2394171 - RNA, 22 nt, Human
cagcugaaauaugcuggcugga

SEQ ID NO: 2394172 - RNA, 19 nt, Human
cagcugaaauaugcuggcu

SEQ ID NO: 2394173 - RNA, 15 nt, Human
cagcugaaauacuga

SEQ ID NO: 2394174 - RNA, 22 nt, Human
cagcucuuuccuccuuccaugg

SEQ ID NO: 2394175 - RNA, 16 nt, Human
cagcugaauuaucuau

SEQ ID NO: 2394176 - RNA, 15 nt, Human
cagcugaacagccaa

SEQ ID NO: 2394177 - RNA, 16 nt, Human
cagcugaccuuuguca

SEQ ID NO: 2394178 - RNA, 17 nt, Human
cagcugaccucuguugu

SEQ ID NO: 2394179 - RNA, 18 nt, Human
cagcugaccucuguuguc

SEQ ID NO: 2394180 - RNA, 14 nt, Human
cagcugacaguccu

SEQ ID NO: 2394181 - RNA, 15 nt, Human
cagcugacaguccuc

SEQ ID NO: 2394182 - RNA, 16 nt, Human
cagcugacaguccucu

SEQ ID NO: 2394183 - RNA, 18 nt, Human
cagcugacaguccucucc

SEQ ID NO: 2394184 - RNA, 21 nt, Human
cagcugacaguccucuccacc

SEQ ID NO: 2394185 - RNA, 17 nt, Human
cagcugaccauggaaga

SEQ ID NO: 2394186 - RNA, 13 nt, Human
cagcugaccucug

SEQ ID NO: 2394187 - RNA, 18 nt, Human
cagcugccugggaucccu

SEQ ID NO: 2394188 - RNA, 23 nt, Human
cagcugccugggaucccucaucc

SEQ ID NO: 2394189 - RNA, 18 nt, Human
cagcugcgguccacccag

SEQ ID NO: 2394190 - RNA, 15 nt, Human
cagcugccugggauc

SEQ ID NO: 2394191 - RNA, 19 nt, Human
cagcugcgguccacccagg

SEQ ID NO: 2394192 - RNA, 20 nt, Human
cagcugcgguccacccagga

SEQ ID NO: 2394193 - RNA, 21 nt, Human
cagcugcgguccacccaggag

SEQ ID NO: 2394194 - RNA, 22 nt, Human
cagcugcgguccacccaggagc

SEQ ID NO: 2394195 - RNA, 23 nt, Human
cagcugcgguccacccaggagcc

SEQ ID NO: 2394196 - RNA, 24 nt, Human
cagcugcgguccacccaggagccc

SEQ ID NO: 2394197 - RNA, 21 nt, Human
cagcugcuccccucccuccuc

SEQ ID NO: 2394198 - RNA, 20 nt, Human
cagcugcuccccucccuccu

SEQ ID NO: 2394199 - RNA, 23 nt, Human
cagcugcuccuagagggaggggc

SEQ ID NO: 2394200 - RNA, 19 nt, Human
cagcugcuccuagagggag

SEQ ID NO: 2394201 - RNA, 18 nt, Human
cagcugcuccuagaggga

SEQ ID NO: 2394202 - RNA, 12 nt, Human
cagcugcuccua

SEQ ID NO: 2394203 - RNA, 18 nt, Human
cagcugcuccccucccuc

SEQ ID NO: 2394204 - RNA, 17 nt, Human
cagcugcuccccucccu

SEQ ID NO: 2394205 - RNA, 16 nt, Human
cagcugcuccccuccc

SEQ ID NO: 2394206 - RNA, 15 nt, Human
cagcugcuccccucc

SEQ ID NO: 2394207 - RNA, 13 nt, Human
cagcugcuccccu

SEQ ID NO: 2394208 - RNA, 19 nt, Human
cagcugcgcuugcuuuucu

SEQ ID NO: 2394209 - RNA, 17 nt, Human
cagcugcuacuacuccu

SEQ ID NO: 2394210 - RNA, 17 nt, Human
cagcugcgcuugcuuuu

SEQ ID NO: 2394211 - RNA, 21 nt, Human
cagcugcucaauaaaguacaa

SEQ ID NO: 2394212 - RNA, 14 nt, Human
cagcugcuggagac

SEQ ID NO: 2394213 - RNA, 15 nt, Human
cagcugcuggagacu

SEQ ID NO: 2394214 - RNA, 21 nt, Human
cagcugcugaaacaacaaaua

SEQ ID NO: 2394215 - RNA, 20 nt, Human
cagcugcugaaacaacaaau

SEQ ID NO: 2394216 - RNA, 13 nt, Human
cagcugcuugggc

SEQ ID NO: 2394217 - RNA, 14 nt, Human
cagcugcuugggcu

SEQ ID NO: 2394218 - RNA, 15 nt, Human
cagcugcuugggcuu

SEQ ID NO: 2394219 - RNA, 16 nt, Human
cagcugcuugggcuuc

SEQ ID NO: 2394220 - RNA, 18 nt, Human
cagcugcuugggcuucau

SEQ ID NO: 2394221 - RNA, 19 nt, Human
cagcugcuugggcuucauc

SEQ ID NO: 2394222 - RNA, 21 nt, Human
cagcugcuugggcuucauccu

SEQ ID NO: 2394223 - RNA, 22 nt, Human
cagcugcuugggcuucauccuc

SEQ ID NO: 2394224 - RNA, 19 nt, Human
cagcuggugguaucugagu

SEQ ID NO: 2394225 - RNA, 22 nt, Human
cagcuggugggaagcgucuguc

SEQ ID NO: 2394226 - RNA, 20 nt, Human
cagcuggugggaagcgucug

SEQ ID NO: 2394227 - RNA, 18 nt, Human
cagcugguugagguuuca

SEQ ID NO: 2394228 - RNA, 20 nt, Human
cagcuguaagaagagacugg

SEQ ID NO: 2394229 - RNA, 19 nt, Human
cagcuguaagaagagacug

SEQ ID NO: 2394230 - RNA, 18 nt, Human
cagcuguaacacagcuga

SEQ ID NO: 2394231 - RNA, 20 nt, Human
cagcuguaacacagcugaga

SEQ ID NO: 2394232 - RNA, 18 nt, Human
cagcuguaugauucccag

SEQ ID NO: 2394233 - RNA, 16 nt, Human
cagcuggguuggaaaa

SEQ ID NO: 2394234 - RNA, 19 nt, Human
cagcuggguggcacugcca

SEQ ID NO: 2394235 - RNA, 20 nt, Human
cagcuggguggcacugccau

SEQ ID NO: 2394236 - RNA, 21 nt, Human
cagcuggguggcacugccaug

SEQ ID NO: 2394237 - RNA, 22 nt, Human
cagcuggguggcacugccaugc

SEQ ID NO: 2394238 - RNA, 17 nt, Human
cagcuggguuggaaaac

SEQ ID NO: 2394239 - RNA, 21 nt, Human
cagcuggggccaggcuggguc

SEQ ID NO: 2394240 - RNA, 22 nt, Human
cagcuggggccaggcugggucg

SEQ ID NO: 2394241 - RNA, 21 nt, Human
cagcugggguggggaccucag

SEQ ID NO: 2394242 - RNA, 18 nt, Human
cagcuggggcguggggag

SEQ ID NO: 2394243 - RNA, 19 nt, Human
cagcuggggcguggggagg

SEQ ID NO: 2394244 - RNA, 20 nt, Human
cagcuggggcguggggaggg

SEQ ID NO: 2394245 - RNA, 21 nt, Human
cagcuggggcguggggagggc

SEQ ID NO: 2394246 - RNA, 22 nt, Human
cagcugggguggggaccucagg

SEQ ID NO: 2394247 - RNA, 23 nt, Human
cagcugggguggggaccucaggc

SEQ ID NO: 2394248 - RNA, 20 nt, Human
cagcugggucaggcagggug

SEQ ID NO: 2394249 - RNA, 18 nt, Human
cagcugggucaggcaggg

SEQ ID NO: 2394250 - RNA, 16 nt, Human
cagcuggguggcacug

SEQ ID NO: 2394251 - RNA, 17 nt, Human
cagcuggguggcacugc

SEQ ID NO: 2394252 - RNA, 18 nt, Human
cagcuggguggcacugcc

SEQ ID NO: 2394253 - RNA, 16 nt, Human
cagcugggucaggcag

SEQ ID NO: 2394254 - RNA, 15 nt, Human
cagcugggucaggca

SEQ ID NO: 2394255 - RNA, 14 nt, Human
cagcugggucaggc

SEQ ID NO: 2394256 - RNA, 18 nt, Human
cagcuggagaaauauggu

SEQ ID NO: 2394257 - RNA, 16 nt, Human
cagcuggagaagaccc

SEQ ID NO: 2394258 - RNA, 14 nt, Human
cagcuggcagcaga

SEQ ID NO: 2394259 - RNA, 19 nt, Human
cagcuggauuggguuauga

SEQ ID NO: 2394260 - RNA, 21 nt, Human
cagcuggaugagacuuccaaa

SEQ ID NO: 2394261 - RNA, 15 nt, Human
cagcuggauuggguu

SEQ ID NO: 2394262 - RNA, 18 nt, Human
cagcuggaugauggucuu

SEQ ID NO: 2394263 - RNA, 23 nt, Human
cagcuggaugagaauuugagugc

SEQ ID NO: 2394264 - RNA, 18 nt, Human
cagcuggcagcagagugu

SEQ ID NO: 2394265 - RNA, 15 nt, Human
cagcuggcagcagag

SEQ ID NO: 2394266 - RNA, 17 nt, Human
cagcuggcccgugacag

SEQ ID NO: 2394267 - RNA, 18 nt, Human
cagcuggcccgugacaga

SEQ ID NO: 2394268 - RNA, 19 nt, Human
cagcuggccgggagccuga

SEQ ID NO: 2394269 - RNA, 23 nt, Human
cagcugcuuuugucuaugggacu

SEQ ID NO: 2394270 - RNA, 16 nt, Human
cagcugcuuguguccc

SEQ ID NO: 2394271 - RNA, 22 nt, Human
cagcugcuugugucccuccugg

SEQ ID NO: 2394272 - RNA, 23 nt, Human
cagcugcuugugucccuccuggg

SEQ ID NO: 2394273 - RNA, 22 nt, Human
cagcuggaaaagggucuuggga

SEQ ID NO: 2394274 - RNA, 12 nt, Human
cagcugcuucuc

SEQ ID NO: 2394275 - RNA, 15 nt, Human
cagcugcuucuccca

SEQ ID NO: 2394276 - RNA, 14 nt, Human
cagcugcuuguguc

SEQ ID NO: 2394277 - RNA, 15 nt, Human
cagcugcuugugucc

SEQ ID NO: 2394278 - RNA, 18 nt, Human
cagcugcuggagacuccu

SEQ ID NO: 2394279 - RNA, 19 nt, Human
cagcugcuggagacuccua

SEQ ID NO: 2394280 - RNA, 23 nt, Human
cagcugcuggagacuccuaggca

SEQ ID NO: 2394281 - RNA, 22 nt, Human
cagcugcuuuugucuaugggac

SEQ ID NO: 2394282 - RNA, 12 nt, Human
cagcugggaggc

SEQ ID NO: 2394283 - RNA, 13 nt, Human
cagcugggaggca

SEQ ID NO: 2394284 - RNA, 14 nt, Human
cagcugggaggcaa

SEQ ID NO: 2394285 - RNA, 22 nt, Human
cagcugggaggcaagaggggug

SEQ ID NO: 2394286 - RNA, 17 nt, Human
cagcuggccgucacuug

SEQ ID NO: 2394287 - RNA, 19 nt, Human
cagcuggcccgugacagac

SEQ ID NO: 2394288 - RNA, 14 nt, Human
cagcugggcccaac

SEQ ID NO: 2394289 - RNA, 23 nt, Human
cagcugggaggcaagaggggugg

SEQ ID NO: 2394290 - RNA, 15 nt, Human
cagcugggcccaacc

SEQ ID NO: 2394291 - RNA, 23 nt, Human
cagcugggaucacauguggacuu

SEQ ID NO: 2394292 - RNA, 15 nt, Human
cagcugggcucugca

SEQ ID NO: 2394293 - RNA, 16 nt, Human
cagcugggcucugcaa

SEQ ID NO: 2394294 - RNA, 21 nt, Human
cagcugggcccaacccugucu

SEQ ID NO: 2394295 - RNA, 17 nt, Human
cagcugggcccaacccu

SEQ ID NO: 2394296 - RNA, 11 nt, Human
cagcugggcuc

SEQ ID NO: 2394297 - RNA, 18 nt, Human
cagcuggggccaggcugg

SEQ ID NO: 2394298 - RNA, 17 nt, Human
cagcugggcucugcaau

SEQ ID NO: 2394299 - RNA, 14 nt, Human
cagcugggcucugc

SEQ ID NO: 2394300 - RNA, 15 nt, Human
cagcugggcucugcc

SEQ ID NO: 2394301 - RNA, 16 nt, Human
cagcugggcucugcca

SEQ ID NO: 2394302 - RNA, 18 nt, Human
cagcugggcucugccacc

SEQ ID NO: 2394303 - RNA, 12 nt, Human
cagcugggcugu

SEQ ID NO: 2394304 - RNA, 14 nt, Human
cagcugggcugugg

SEQ ID NO: 2394305 - RNA, 19 nt, Human
cagcuggggccaggcuggg

SEQ ID NO: 2394306 - RNA, 20 nt, Human
cagcuggggccaggcugggu

SEQ ID NO: 2394307 - RNA, 22 nt, Human
caggaagcucagggccuggcuc

SEQ ID NO: 2394308 - RNA, 13 nt, Human
cagcccugacccu

SEQ ID NO: 2394309 - RNA, 16 nt, Human
cagcccugacccugug

SEQ ID NO: 2394310 - RNA, 22 nt, Human
cagcccugaggugaaagggagc

SEQ ID NO: 2394311 - RNA, 12 nt, Human
cagcccugaggu

SEQ ID NO: 2394312 - RNA, 22 nt, Human
cagcccuccucaccccgucugg

SEQ ID NO: 2394313 - RNA, 21 nt, Human
cagcccugaguuccuagccac

SEQ ID NO: 2394314 - RNA, 19 nt, Human
cagcccugaguuccuagcc

SEQ ID NO: 2394315 - RNA, 18 nt, Human
cagcccugaguuccuagc

SEQ ID NO: 2394316 - RNA, 16 nt, Human
cagcccuccucacccc

SEQ ID NO: 2394317 - RNA, 14 nt, Human
cagcccuccucacc

SEQ ID NO: 2394318 - RNA, 13 nt, Human
cagcccuccucac

SEQ ID NO: 2394319 - RNA, 12 nt, Human
cagcccuccuca

SEQ ID NO: 2394320 - RNA, 22 nt, Human
cagcccucccuguccuccucgg

SEQ ID NO: 2394321 - RNA, 21 nt, Human
cagcccucccuguccuccucg

SEQ ID NO: 2394322 - RNA, 20 nt, Human
cagcccucccuguccuccuc

SEQ ID NO: 2394323 - RNA, 19 nt, Human
cagcccucccuguccuccu

SEQ ID NO: 2394324 - RNA, 18 nt, Human
cagcccucccuguccucc

SEQ ID NO: 2394325 - RNA, 16 nt, Human
cagcccucccuguccu

SEQ ID NO: 2394326 - RNA, 15 nt, Human
cagcccucccugucc

SEQ ID NO: 2394327 - RNA, 14 nt, Human
cagcccucccuguc

SEQ ID NO: 2394328 - RNA, 13 nt, Human
cagcccucccugu

SEQ ID NO: 2394329 - RNA, 20 nt, Human
cagcccucccgccccuuccc

SEQ ID NO: 2394330 - RNA, 21 nt, Human
cagcccuccccauggagccag

SEQ ID NO: 2394331 - RNA, 16 nt, Human
cagcccucccugcccc

SEQ ID NO: 2394332 - RNA, 17 nt, Human
cagcccucccugccccu

SEQ ID NO: 2394333 - RNA, 18 nt, Human
cagcccucccugccccuc

SEQ ID NO: 2394334 - RNA, 22 nt, Human
cagcccucccugccccucccuu

SEQ ID NO: 2394335 - RNA, 18 nt, Human
cagcccugcagagggcac

SEQ ID NO: 2394336 - RNA, 20 nt, Human
cagcccugcagagggcacag

SEQ ID NO: 2394337 - RNA, 13 nt, Human
cagcccugcuggc

SEQ ID NO: 2394338 - RNA, 14 nt, Human
cagcccugcuggcc

SEQ ID NO: 2394339 - RNA, 16 nt, Human
cagcccugcuggccgc

SEQ ID NO: 2394340 - RNA, 18 nt, Human
cagcccugcuggccgccu

SEQ ID NO: 2394341 - RNA, 20 nt, Human
cagcccugcuggccgccuca

SEQ ID NO: 2394342 - RNA, 13 nt, Human
cagcccugcagag

SEQ ID NO: 2394343 - RNA, 14 nt, Human
cagcccugcagagg

SEQ ID NO: 2394344 - RNA, 15 nt, Human
cagcccugcagaggg

SEQ ID NO: 2394345 - RNA, 16 nt, Human
cagcccugcagagggc

SEQ ID NO: 2394346 - RNA, 22 nt, Human
cagccuagccgaccucagccuu

SEQ ID NO: 2394347 - RNA, 21 nt, Human
cagccuagccgaccucagccu

SEQ ID NO: 2394348 - RNA, 20 nt, Human
cagccuagccgaccucagcc

SEQ ID NO: 2394349 - RNA, 19 nt, Human
cagccuagccgaccucagc

SEQ ID NO: 2394350 - RNA, 18 nt, Human
cagccuagccgaccucag

SEQ ID NO: 2394351 - RNA, 17 nt, Human
cagccuagccgaccuca

SEQ ID NO: 2394352 - RNA, 15 nt, Human
cagccuagccgaccu

SEQ ID NO: 2394353 - RNA, 21 nt, Human
cagccguguaaccauggaccc

SEQ ID NO: 2394354 - RNA, 16 nt, Human
cagccuaagaugaaga

SEQ ID NO: 2394355 - RNA, 19 nt, Human
cagccgucagccaaaugua

SEQ ID NO: 2394356 - RNA, 21 nt, Human
cagccgguaccugggaagggg

SEQ ID NO: 2394357 - RNA, 16 nt, Human
cagccgugaugcucag

SEQ ID NO: 2394358 - RNA, 18 nt, Human
cagccgucagccaaaugu

SEQ ID NO: 2394359 - RNA, 17 nt, Human
cagccgguaccugggaa

SEQ ID NO: 2394360 - RNA, 19 nt, Human
cagccgguaccugggaagg

SEQ ID NO: 2394361 - RNA, 9 nt, Human
cagccgugc

SEQ ID NO: 2394362 - RNA, 14 nt, Human
cagccgugccuuca

SEQ ID NO: 2394363 - RNA, 16 nt, Human
cagccgugccuucagc

SEQ ID NO: 2394364 - RNA, 18 nt, Human
cagccgugccuucagcuc

SEQ ID NO: 2394365 - RNA, 20 nt, Human
cagccgugccuucagcucua

SEQ ID NO: 2394366 - RNA, 17 nt, Human
cagccgugaugcucagg

SEQ ID NO: 2394367 - RNA, 19 nt, Human
cagccgugaugcucaggcu

SEQ ID NO: 2394368 - RNA, 11 nt, Human
cagcccugggc

SEQ ID NO: 2394369 - RNA, 20 nt, Human
cagcccuggcugaaggacug

SEQ ID NO: 2394370 - RNA, 16 nt, Human
cagcccuggcugaagg

SEQ ID NO: 2394371 - RNA, 17 nt, Human
cagcccuggcugaagga

SEQ ID NO: 2394372 - RNA, 15 nt, Human
cagcccuggcucugc

SEQ ID NO: 2394373 - RNA, 16 nt, Human
cagcccuggcucugca

SEQ ID NO: 2394374 - RNA, 13 nt, Human
cagcccuggcuga

SEQ ID NO: 2394375 - RNA, 15 nt, Human
cagcccuggcugaag

SEQ ID NO: 2394376 - RNA, 17 nt, Human
cagcccuggaggugcca

SEQ ID NO: 2394377 - RNA, 18 nt, Human
cagcccuggaggugccag

SEQ ID NO: 2394378 - RNA, 19 nt, Human
cagcccuggaggugccagc

SEQ ID NO: 2394379 - RNA, 22 nt, Human
cagcccuggaggugccagcaaa

SEQ ID NO: 2394380 - RNA, 20 nt, Human
cagcccuggagucaugccaa

SEQ ID NO: 2394381 - RNA, 14 nt, Human
cagcccuggaguca

SEQ ID NO: 2394382 - RNA, 12 nt, Human
cagcccuggcuc

SEQ ID NO: 2394383 - RNA, 22 nt, Human
cagcccugggccccaccaccua

SEQ ID NO: 2394384 - RNA, 21 nt, Human
cagcccugggccccaccaccu

SEQ ID NO: 2394385 - RNA, 20 nt, Human
cagcccugggccccaccacc

SEQ ID NO: 2394386 - RNA, 19 nt, Human
cagcccugggccccaccac

SEQ ID NO: 2394387 - RNA, 18 nt, Human
cagcccugggccccacca

SEQ ID NO: 2394388 - RNA, 17 nt, Human
cagcccugggccccacc

SEQ ID NO: 2394389 - RNA, 13 nt, Human
cagcccugggccc

SEQ ID NO: 2394390 - RNA, 12 nt, Human
cagcccugggcc

SEQ ID NO: 2394391 - RNA, 23 nt, Human
cagcccugggccccaccaccuag

SEQ ID NO: 2394392 - RNA, 15 nt, Human
cagccgguaccuggg

SEQ ID NO: 2394393 - RNA, 11 nt, Human
cagcccugcuu

SEQ ID NO: 2394394 - RNA, 13 nt, Human
cagcccugcuuug

SEQ ID NO: 2394395 - RNA, 19 nt, Human
cagcccugcuuugggcugc

SEQ ID NO: 2394396 - RNA, 20 nt, Human
cagcccugcuuugggcugcc

SEQ ID NO: 2394397 - RNA, 21 nt, Human
cagcccugcuuugggcugccc

SEQ ID NO: 2394398 - RNA, 22 nt, Human
cagcccugcuuugggcugcccu

SEQ ID NO: 2394399 - RNA, 23 nt, Human
cagcccugcuuugggcugcccug

SEQ ID NO: 2394400 - RNA, 23 nt, Human
cagcccugcuggccgccucaccc

SEQ ID NO: 2394401 - RNA, 21 nt, Human
cagcccugcuggccgccucac

SEQ ID NO: 2394402 - RNA, 12 nt, Human
cagcccuggagg

SEQ ID NO: 2394403 - RNA, 19 nt, Human
cagccucccaaagugcugg

SEQ ID NO: 2394404 - RNA, 20 nt, Human
cagccucccaaagugcuggg

SEQ ID NO: 2394405 - RNA, 21 nt, Human
cagccucccaaagugcuggga

SEQ ID NO: 2394406 - RNA, 23 nt, Human
cagccucccaaagugcugggauu

SEQ ID NO: 2394407 - RNA, 15 nt, Human
cagccuccaugcugc

SEQ ID NO: 2394408 - RNA, 17 nt, Human
cagccuccaugcugccu

SEQ ID NO: 2394409 - RNA, 20 nt, Human
cagccuccaugcugccucca

SEQ ID NO: 2394410 - RNA, 17 nt, Human
cagccuccagccucugu

SEQ ID NO: 2394411 - RNA, 14 nt, Human
cagccuccaugcug

SEQ ID NO: 2394412 - RNA, 13 nt, Human
cagccuccagccu

SEQ ID NO: 2394413 - RNA, 14 nt, Human
cagccuccagccuc

SEQ ID NO: 2394414 - RNA, 15 nt, Human
cagccuccagccucu

SEQ ID NO: 2394415 - RNA, 16 nt, Human
cagccuccagccucug

SEQ ID NO: 2394416 - RNA, 23 nt, Human
cagccucccauccagggccccca

SEQ ID NO: 2394417 - RNA, 17 nt, Human
cagccuccccugccagg

SEQ ID NO: 2394418 - RNA, 16 nt, Human
cagccuccccugccag

SEQ ID NO: 2394419 - RNA, 20 nt, Human
cagccucccauccagggccc

SEQ ID NO: 2394420 - RNA, 19 nt, Human
cagccucccauccagggcc

SEQ ID NO: 2394421 - RNA, 18 nt, Human
cagccucccauccagggc

SEQ ID NO: 2394422 - RNA, 16 nt, Human
cagccucccauccagg

SEQ ID NO: 2394423 - RNA, 18 nt, Human
cagccucccacccccauc

SEQ ID NO: 2394424 - RNA, 16 nt, Human
cagccucccaccccca

SEQ ID NO: 2394425 - RNA, 19 nt, Human
cagccucccacccccaucu

SEQ ID NO: 2394426 - RNA, 14 nt, Human
cagccucccaucca

SEQ ID NO: 2394427 - RNA, 14 nt, Human
cagccucccacccc

SEQ ID NO: 2394428 - RNA, 19 nt, Human
cagccucccaaguagcugg

SEQ ID NO: 2394429 - RNA, 20 nt, Human
cagccucccgaauagcuggg

SEQ ID NO: 2394430 - RNA, 22 nt, Human
cagccuccccugccagggcagg

SEQ ID NO: 2394431 - RNA, 20 nt, Human
cagccuccccugccagggca

SEQ ID NO: 2394432 - RNA, 19 nt, Human
cagccuccccugccagggc

SEQ ID NO: 2394433 - RNA, 18 nt, Human
cagccuccccugccaggg

SEQ ID NO: 2394434 - RNA, 21 nt, Human
cagccucccgaauagcuggga

SEQ ID NO: 2394435 - RNA, 22 nt, Human
cagccucccgaauagcugggac

SEQ ID NO: 2394436 - RNA, 14 nt, Human
cagccucacagaag

SEQ ID NO: 2394437 - RNA, 13 nt, Human
cagccucacagaa

SEQ ID NO: 2394438 - RNA, 12 nt, Human
cagccucacaga

SEQ ID NO: 2394439 - RNA, 20 nt, Human
cagccucaauaagccuuguc

SEQ ID NO: 2394440 - RNA, 21 nt, Human
cagccucaauaagccuugucg

SEQ ID NO: 2394441 - RNA, 20 nt, Human
cagccucacaguccuuacca

SEQ ID NO: 2394442 - RNA, 14 nt, Human
cagccucacagucc

SEQ ID NO: 2394443 - RNA, 15 nt, Human
cagccucacaguccu

SEQ ID NO: 2394444 - RNA, 14 nt, Human
cagccuccaagcuc

SEQ ID NO: 2394445 - RNA, 19 nt, Human
cagccucaguccuccccuc

SEQ ID NO: 2394446 - RNA, 21 nt, Human
cagccucaguccuccccucac

SEQ ID NO: 2394447 - RNA, 22 nt, Human
cagccucaguccuccccucaca

SEQ ID NO: 2394448 - RNA, 23 nt, Human
cagccucaguccuccccucacag

SEQ ID NO: 2394449 - RNA, 12 nt, Human
cagccuccagcc

SEQ ID NO: 2394450 - RNA, 20 nt, Human
cagccuccaagcuccaucuc

SEQ ID NO: 2394451 - RNA, 22 nt, Human
cagccucagggacgacucugac

SEQ ID NO: 2394452 - RNA, 15 nt, Human
cagccucaguccucc

SEQ ID NO: 2394453 - RNA, 16 nt, Human
cagccucaguccuccc

SEQ ID NO: 2394454 - RNA, 19 nt, Human
cagccucaaccuccugggc

SEQ ID NO: 2394455 - RNA, 20 nt, Human
cagccucaaccuccugggcu

SEQ ID NO: 2394456 - RNA, 21 nt, Human
cagccucaaccuccugggcua

SEQ ID NO: 2394457 - RNA, 19 nt, Human
cagccucaagucacuccca

SEQ ID NO: 2394458 - RNA, 21 nt, Human
cagccucaagucacucccaag

SEQ ID NO: 2394459 - RNA, 18 nt, Human
cagccucaauaagccuug

SEQ ID NO: 2394460 - RNA, 19 nt, Human
cagccucaauaagccuugu

SEQ ID NO: 2394461 - RNA, 17 nt, Human
cagccucaaccuccugg

SEQ ID NO: 2394462 - RNA, 18 nt, Human
cagccucaaccuccuggg

SEQ ID NO: 2394463 - RNA, 18 nt, Human
cagccuaggggucaggga

SEQ ID NO: 2394464 - RNA, 15 nt, Human
cagccuaccaugaga

SEQ ID NO: 2394465 - RNA, 21 nt, Human
cagccuagggcugagcugggg

SEQ ID NO: 2394466 - RNA, 19 nt, Human
cagccuaggggucagggac

SEQ ID NO: 2394467 - RNA, 16 nt, Human
cagccuaguugaucag

SEQ ID NO: 2394468 - RNA, 16 nt, Human
cagcccgcugagugga

SEQ ID NO: 2394469 - RNA, 17 nt, Human
cagcccgcugaguggac

SEQ ID NO: 2394470 - RNA, 15 nt, Human
cagcccggaccuugg

SEQ ID NO: 2394471 - RNA, 18 nt, Human
cagcccggaccuuggcag

SEQ ID NO: 2394472 - RNA, 12 nt, Human
cagcccggccug

SEQ ID NO: 2394473 - RNA, 14 nt, Human
cagcccggccugcu

SEQ ID NO: 2394474 - RNA, 20 nt, Human
cagcccggccugcucccagc

SEQ ID NO: 2394475 - RNA, 21 nt, Human
cagcccggccugcucccagca

SEQ ID NO: 2394476 - RNA, 23 nt, Human
cagcccggccugcucccagcagc

SEQ ID NO: 2394477 - RNA, 15 nt, Human
cagcccggcgccacc

SEQ ID NO: 2394478 - RNA, 21 nt, Human
cagcccggcgccaccauccug

SEQ ID NO: 2394479 - RNA, 15 nt, Human
cagcccggcucccac

SEQ ID NO: 2394480 - RNA, 13 nt, Human
cagcccgggcucu

SEQ ID NO: 2394481 - RNA, 14 nt, Human
cagcccgggcucug

SEQ ID NO: 2394482 - RNA, 15 nt, Human
cagcccgggcucugc

SEQ ID NO: 2394483 - RNA, 16 nt, Human
cagcccgggcucugcc

SEQ ID NO: 2394484 - RNA, 18 nt, Human
cagccccuugagaaaccu

SEQ ID NO: 2394485 - RNA, 17 nt, Human
cagccccuugagaaacc

SEQ ID NO: 2394486 - RNA, 20 nt, Human
cagccccuucucagaaucua

SEQ ID NO: 2394487 - RNA, 22 nt, Human
cagccccuucucagaaucuacc

SEQ ID NO: 2394488 - RNA, 24 nt, Human
cagccccuucugacccaugcugcc

SEQ ID NO: 2394489 - RNA, 22 nt, Human
cagccccuucugacccaugcug

SEQ ID NO: 2394490 - RNA, 23 nt, Human
cagccccuucugacccaugcugc

SEQ ID NO: 2394491 - RNA, 16 nt, Human
cagccccuucugaccc

SEQ ID NO: 2394492 - RNA, 17 nt, Human
cagccccuucugaccca

SEQ ID NO: 2394493 - RNA, 19 nt, Human
cagccccuucugacccaug

SEQ ID NO: 2394494 - RNA, 21 nt, Human
cagccccuucugacccaugcu

SEQ ID NO: 2394495 - RNA, 15 nt, Human
cagcccguguggccc

SEQ ID NO: 2394496 - RNA, 19 nt, Human
cagcccggcugguuuugua

SEQ ID NO: 2394497 - RNA, 13 nt, Human
cagcccggcuggu

SEQ ID NO: 2394498 - RNA, 14 nt, Human
cagcccggcugguu

SEQ ID NO: 2394499 - RNA, 22 nt, Human
cagcccggcugguuuuguaaga

SEQ ID NO: 2394500 - RNA, 21 nt, Human
cagcccguguggccccuucac

SEQ ID NO: 2394501 - RNA, 20 nt, Human
cagcccguguggccccuuca

SEQ ID NO: 2394502 - RNA, 18 nt, Human
cagcccguguggccccuu

SEQ ID NO: 2394503 - RNA, 17 nt, Human
cagcccguguggccccu

SEQ ID NO: 2394504 - RNA, 17 nt, Human
cagcccuaaggaucucu

SEQ ID NO: 2394505 - RNA, 21 nt, Human
cagcccuaaaucuagacucaa

SEQ ID NO: 2394506 - RNA, 21 nt, Human
cagcccgggcucugccuccca

SEQ ID NO: 2394507 - RNA, 22 nt, Human
cagcccgggcucugccucccau

SEQ ID NO: 2394508 - RNA, 17 nt, Human
cagcccgggcucugccu

SEQ ID NO: 2394509 - RNA, 18 nt, Human
cagcccgggcucugccuc

SEQ ID NO: 2394510 - RNA, 19 nt, Human
cagcccgggcucugccucc

SEQ ID NO: 2394511 - RNA, 20 nt, Human
cagcccgggcucugccuccc

SEQ ID NO: 2394512 - RNA, 13 nt, Human
cagcccucccugc

SEQ ID NO: 2394513 - RNA, 15 nt, Human
cagcccucccugccc

SEQ ID NO: 2394514 - RNA, 23 nt, Human
cagcccuccaucuaaacugcccc

SEQ ID NO: 2394515 - RNA, 20 nt, Human
cagcccuccccauggagcca

SEQ ID NO: 2394516 - RNA, 17 nt, Human
cagcccucaucccgagc

SEQ ID NO: 2394517 - RNA, 14 nt, Human
cagcccucaucccg

SEQ ID NO: 2394518 - RNA, 13 nt, Human
cagcccucauccc

SEQ ID NO: 2394519 - RNA, 22 nt, Human
cagcccuccaucuaaacugccc

SEQ ID NO: 2394520 - RNA, 18 nt, Human
cagcccucauuggcucuu

SEQ ID NO: 2394521 - RNA, 13 nt, Human
cagcccucacccc

SEQ ID NO: 2394522 - RNA, 14 nt, Human
cagcccucaccccu

SEQ ID NO: 2394523 - RNA, 15 nt, Human
cagcccucaccccug

SEQ ID NO: 2394524 - RNA, 18 nt, Human
cagcccucaccccugguu

SEQ ID NO: 2394525 - RNA, 14 nt, Human
cagcccuauggaug

SEQ ID NO: 2394526 - RNA, 15 nt, Human
cagcccuauggaugu

SEQ ID NO: 2394527 - RNA, 20 nt, Human
cagcccuauggauguggggu

SEQ ID NO: 2394528 - RNA, 18 nt, Human
cagcccuaggguggagag

SEQ ID NO: 2394529 - RNA, 23 nt, Human
cagcccuagagccugccuggagc

SEQ ID NO: 2394530 - RNA, 18 nt, Human
cagcccuagagccugccu

SEQ ID NO: 2394531 - RNA, 20 nt, Human
cagcccuagagccugccugg

SEQ ID NO: 2394532 - RNA, 21 nt, Human
cagcccuagagccugccugga

SEQ ID NO: 2394533 - RNA, 22 nt, Human
cagcccuagagccugccuggag

SEQ ID NO: 2394534 - RNA, 18 nt, Human
cagcccuaaggaucucuc

SEQ ID NO: 2394535 - RNA, 19 nt, Human
cagcccuaaggaucucuca

SEQ ID NO: 2394536 - RNA, 20 nt, Human
cagcccuaaggaucucucag

SEQ ID NO: 2394537 - RNA, 21 nt, Human
cagcccuaaggaucucucagg

SEQ ID NO: 2394538 - RNA, 22 nt, Human
cagcccuaaggaucucucagga

SEQ ID NO: 2394539 - RNA, 12 nt, Human
cagcccuagagc

SEQ ID NO: 2394540 - RNA, 15 nt, Human
cagcccuagagccug

SEQ ID NO: 2394541 - RNA, 16 nt, Human
cagcccuagagccugc

SEQ ID NO: 2394542 - RNA, 13 nt, Human
cagccccagugcc

SEQ ID NO: 2394543 - RNA, 14 nt, Human
cagccccagugccc

SEQ ID NO: 2394544 - RNA, 15 nt, Human
cagccccagugccca

SEQ ID NO: 2394545 - RNA, 16 nt, Human
cagccccagugcccac

SEQ ID NO: 2394546 - RNA, 17 nt, Human
cagccccagugcccaca

SEQ ID NO: 2394547 - RNA, 18 nt, Human
cagccccagugcccacag

SEQ ID NO: 2394548 - RNA, 11 nt, Human
cagccccaucc

SEQ ID NO: 2394549 - RNA, 21 nt, Human
cagccccaucccaaacccuuc

SEQ ID NO: 2394550 - RNA, 22 nt, Human
cagccccacccaggagggaggg

SEQ ID NO: 2394551 - RNA, 21 nt, Human
cagccccacccaggagggagg

SEQ ID NO: 2394552 - RNA, 16 nt, Human
cagccccacccaggag

SEQ ID NO: 2394553 - RNA, 15 nt, Human
cagccccacccagga

SEQ ID NO: 2394554 - RNA, 20 nt, Human
cagccccacagcccacgucc

SEQ ID NO: 2394555 - RNA, 14 nt, Human
cagccccacccagg

SEQ ID NO: 2394556 - RNA, 13 nt, Human
cagccccacccag

SEQ ID NO: 2394557 - RNA, 12 nt, Human
cagccccaccca

SEQ ID NO: 2394558 - RNA, 11 nt, Human
cagccccaccc

SEQ ID NO: 2394559 - RNA, 12 nt, Human
cagccccacagc

SEQ ID NO: 2394560 - RNA, 13 nt, Human
cagccccacagcc

SEQ ID NO: 2394561 - RNA, 14 nt, Human
cagccccacagccc

SEQ ID NO: 2394562 - RNA, 15 nt, Human
cagccccacagccca

SEQ ID NO: 2394563 - RNA, 16 nt, Human
cagccccacagcccac

SEQ ID NO: 2394564 - RNA, 18 nt, Human
cagccccacagcccacgu

SEQ ID NO: 2394565 - RNA, 15 nt, Human
cagccccagagcagg

SEQ ID NO: 2394566 - RNA, 16 nt, Human
cagccccauucugccu

SEQ ID NO: 2394567 - RNA, 17 nt, Human
cagccccauucugccug

SEQ ID NO: 2394568 - RNA, 18 nt, Human
cagccccauucugccugc

SEQ ID NO: 2394569 - RNA, 23 nt, Human
cagccccuggaugcagccucaca

SEQ ID NO: 2394570 - RNA, 20 nt, Human
cagccccuguucuggcagag

SEQ ID NO: 2394571 - RNA, 21 nt, Human
cagccccuggccccaggaccu

SEQ ID NO: 2394572 - RNA, 13 nt, Human
cagccccuggccc

SEQ ID NO: 2394573 - RNA, 21 nt, Human
cagccccuguucuggcagagu

SEQ ID NO: 2394574 - RNA, 20 nt, Human
cagccccuguauggcacugg

SEQ ID NO: 2394575 - RNA, 15 nt, Human
cagccccuucucaga

SEQ ID NO: 2394576 - RNA, 16 nt, Human
cagccccuucucagaa

SEQ ID NO: 2394577 - RNA, 13 nt, Human
cagccccauucug

SEQ ID NO: 2394578 - RNA, 14 nt, Human
cagccccauucugc

SEQ ID NO: 2394579 - RNA, 16 nt, Human
cagccccauccucugu

SEQ ID NO: 2394580 - RNA, 22 nt, Human
cagccccauccucuguacagag

SEQ ID NO: 2394581 - RNA, 22 nt, Human
cagccccaucccaaacccuuca

SEQ ID NO: 2394582 - RNA, 12 nt, Human
cagccccauccu

SEQ ID NO: 2394583 - RNA, 13 nt, Human
cagccccauccuc

SEQ ID NO: 2394584 - RNA, 14 nt, Human
cagccccauccucu

SEQ ID NO: 2394585 - RNA, 21 nt, Human
cagcuaccucaaccaaugcca

SEQ ID NO: 2394586 - RNA, 17 nt, Human
cagcuacuaaugauguu

SEQ ID NO: 2394587 - RNA, 21 nt, Human
cagcuacccuuuuucuccagc

SEQ ID NO: 2394588 - RNA, 24 nt, Human
cagcuacccuuuuucuccagcugg

SEQ ID NO: 2394589 - RNA, 18 nt, Human
cagcuacaccuuucuccu

SEQ ID NO: 2394590 - RNA, 18 nt, Human
cagcuaccagguguucua

SEQ ID NO: 2394591 - RNA, 21 nt, Human
cagcuaaucuguagggcugga

SEQ ID NO: 2394592 - RNA, 21 nt, Human
cagcuacucagaagccugagg

SEQ ID NO: 2394593 - RNA, 20 nt, Human
cagcuacucagaagccugag

SEQ ID NO: 2394594 - RNA, 19 nt, Human
cagcuacucagaagccuga

SEQ ID NO: 2394595 - RNA, 16 nt, Human
cagcuacucagaagcc

SEQ ID NO: 2394596 - RNA, 15 nt, Human
cagcuacucagaagc

SEQ ID NO: 2394597 - RNA, 14 nt, Human
cagcuacucagaag

SEQ ID NO: 2394598 - RNA, 23 nt, Human
cagcuacucaagaggcugaggca

SEQ ID NO: 2394599 - RNA, 20 nt, Human
cagcuacucaagaggcugag

SEQ ID NO: 2394600 - RNA, 19 nt, Human
cagcuacucaagaggcuga

SEQ ID NO: 2394601 - RNA, 19 nt, Human
cagcuacuaaugauguuuu

SEQ ID NO: 2394602 - RNA, 18 nt, Human
cagcuacucaggaggcug

SEQ ID NO: 2394603 - RNA, 16 nt, Human
cagcuacucaggaggc

SEQ ID NO: 2394604 - RNA, 13 nt, Human
cagcuacucagga

SEQ ID NO: 2394605 - RNA, 12 nt, Human
cagcuacucagg

SEQ ID NO: 2394606 - RNA, 23 nt, Human
cagcuacucagaagccugaggcu

SEQ ID NO: 2394607 - RNA, 22 nt, Human
cagcuacucagaagccugaggc

SEQ ID NO: 2394608 - RNA, 16 nt, Human
cagcuacugauuuuug

SEQ ID NO: 2394609 - RNA, 19 nt, Human
cagcuacuugggaggcuga

SEQ ID NO: 2394610 - RNA, 15 nt, Human
cagcuacuuccuccu

SEQ ID NO: 2394611 - RNA, 19 nt, Human
cagcuacugauuuuuguga

SEQ ID NO: 2394612 - RNA, 17 nt, Human
cagcuacuuccuccucc

SEQ ID NO: 2394613 - RNA, 21 nt, Human
cagcuacuuccuccuccccac

SEQ ID NO: 2394614 - RNA, 15 nt, Human
cagcuaaugggacac

SEQ ID NO: 2394615 - RNA, 16 nt, Human
cagcuaaugggacacu

SEQ ID NO: 2394616 - RNA, 19 nt, Human
cagcuaaggacauuuccca

SEQ ID NO: 2394617 - RNA, 19 nt, Human
cagcuaaucagcauucuca

SEQ ID NO: 2394618 - RNA, 12 nt, Human
cagcuaaucugu

SEQ ID NO: 2394619 - RNA, 14 nt, Human
cagcuaaucuguag

SEQ ID NO: 2394620 - RNA, 16 nt, Human
cagcuaaucuguaggg

SEQ ID NO: 2394621 - RNA, 17 nt, Human
cagcuaaucuguagggc

SEQ ID NO: 2394622 - RNA, 19 nt, Human
cagcuaaucuguagggcug

SEQ ID NO: 2394623 - RNA, 20 nt, Human
cagcuaacauggaaguacua

SEQ ID NO: 2394624 - RNA, 23 nt, Human
cagcuaagaaaagauuuuaauca

SEQ ID NO: 2394625 - RNA, 12 nt, Human
cagcuaagaaaa

SEQ ID NO: 2394626 - RNA, 13 nt, Human
cagcuaagaaccu

SEQ ID NO: 2394627 - RNA, 14 nt, Human
cagcgccagccugu

SEQ ID NO: 2394628 - RNA, 22 nt, Human
cagcgccaagcaaccugggucc

SEQ ID NO: 2394629 - RNA, 19 nt, Human
cagcuaagaaccuggaacu

SEQ ID NO: 2394630 - RNA, 18 nt, Human
cagcuaagaaccuggaac

SEQ ID NO: 2394631 - RNA, 16 nt, Human
cagcuaagaaccugga

SEQ ID NO: 2394632 - RNA, 14 nt, Human
cagcuaagaaccug

SEQ ID NO: 2394633 - RNA, 23 nt, Human
cagcuaagaaccuggaacuuggg

SEQ ID NO: 2394634 - RNA, 15 nt, Human
cagcuaagcuaggaa

SEQ ID NO: 2394635 - RNA, 18 nt, Human
cagcuaagcuaggaauga

SEQ ID NO: 2394636 - RNA, 19 nt, Human
cagcgacauagcccauccc

SEQ ID NO: 2394637 - RNA, 14 nt, Human
cagcgaagggagug

SEQ ID NO: 2394638 - RNA, 20 nt, Human
cagcgacauagcccaucccu

SEQ ID NO: 2394639 - RNA, 14 nt, Human
cagcgaccaccccu

SEQ ID NO: 2394640 - RNA, 16 nt, Human
cagcgaccaccccugc

SEQ ID NO: 2394641 - RNA, 16 nt, Human
cagcgaccgcccccuc

SEQ ID NO: 2394642 - RNA, 20 nt, Human
cagcgaccaccccugccucc

SEQ ID NO: 2394643 - RNA, 21 nt, Human
cagcgaccaccccugccucca

SEQ ID NO: 2394644 - RNA, 17 nt, Human
cagcgaccgcccccucc

SEQ ID NO: 2394645 - RNA, 18 nt, Human
cagcgaccgcccccuccu

SEQ ID NO: 2394646 - RNA, 13 nt, Human
cagcgagcccugg

SEQ ID NO: 2394647 - RNA, 18 nt, Human
cagcgaccuuccucaucc

SEQ ID NO: 2394648 - RNA, 17 nt, Human
cagcgacuccguuggcc

SEQ ID NO: 2394649 - RNA, 21 nt, Human
cagcgacuccguuggccacuc

SEQ ID NO: 2394650 - RNA, 22 nt, Human
cagcgacuccguuggccacucc

SEQ ID NO: 2394651 - RNA, 16 nt, Human
cagcgagcccuggugg

SEQ ID NO: 2394652 - RNA, 17 nt, Human
cagcgagcccugguggc

SEQ ID NO: 2394653 - RNA, 19 nt, Human
cagcgagcccugguggcag

SEQ ID NO: 2394654 - RNA, 20 nt, Human
cagcgagcccugguggcagu

SEQ ID NO: 2394655 - RNA, 21 nt, Human
cagcgagcccugguggcagug

SEQ ID NO: 2394656 - RNA, 13 nt, Human
cagcgagaggcag

SEQ ID NO: 2394657 - RNA, 18 nt, Human
cagcgagaggcagagaaa

SEQ ID NO: 2394658 - RNA, 20 nt, Human
cagcgagaggcagagaaaga

SEQ ID NO: 2394659 - RNA, 22 nt, Human
cagcgaguuguggaaagccucu

SEQ ID NO: 2394660 - RNA, 18 nt, Human
cagcgaggaggcuccaga

SEQ ID NO: 2394661 - RNA, 17 nt, Human
cagcgaggaggcuccag

SEQ ID NO: 2394662 - RNA, 16 nt, Human
cagcgaggaggcucca

SEQ ID NO: 2394663 - RNA, 14 nt, Human
cagcgccaagcaac

SEQ ID NO: 2394664 - RNA, 16 nt, Human
cagcgccaagcaaccu

SEQ ID NO: 2394665 - RNA, 17 nt, Human
cagcgccaagcaaccug

SEQ ID NO: 2394666 - RNA, 19 nt, Human
cagcgccaagcaaccuggg

SEQ ID NO: 2394667 - RNA, 23 nt, Human
cagcgccaagcaaccugggucca

SEQ ID NO: 2394668 - RNA, 23 nt, Human
cagcgauguaugcagcuaucugg

SEQ ID NO: 2394669 - RNA, 18 nt, Human
cagcgauguaugcagcua

SEQ ID NO: 2394670 - RNA, 22 nt, Human
cagcgauguaugcagcuaucug

SEQ ID NO: 2394671 - RNA, 19 nt, Human
cagcuaacauggaaguacu

SEQ ID NO: 2394672 - RNA, 18 nt, Human
cagcuaacauggaaguac

SEQ ID NO: 2394673 - RNA, 13 nt, Human
cagcuauuuuuau

SEQ ID NO: 2394674 - RNA, 16 nt, Human
cagcuauuuuuacuag

SEQ ID NO: 2394675 - RNA, 15 nt, Human
cagcucaaaggcaca

SEQ ID NO: 2394676 - RNA, 18 nt, Human
cagcuauuuuuacuagaa

SEQ ID NO: 2394677 - RNA, 19 nt, Human
cagcucaaaggcacaguga

SEQ ID NO: 2394678 - RNA, 18 nt, Human
cagcuauugauauaaaua

SEQ ID NO: 2394679 - RNA, 13 nt, Human
cagcuaugcuggu

SEQ ID NO: 2394680 - RNA, 21 nt, Human
cagcuauguuauauugaaaaa

SEQ ID NO: 2394681 - RNA, 20 nt, Human
cagcuauguuauauugaaaa

SEQ ID NO: 2394682 - RNA, 19 nt, Human
cagcucaagucuucccuga

SEQ ID NO: 2394683 - RNA, 13 nt, Human
cagcucaagucuu

SEQ ID NO: 2394684 - RNA, 16 nt, Human
cagcucaauggacugg

SEQ ID NO: 2394685 - RNA, 20 nt, Human
cagcucaaggaaaggccuga

SEQ ID NO: 2394686 - RNA, 19 nt, Human
cagcucaaggaaaggccug

SEQ ID NO: 2394687 - RNA, 13 nt, Human
cagcucaccagcc

SEQ ID NO: 2394688 - RNA, 15 nt, Human
cagcucaccagcccc

SEQ ID NO: 2394689 - RNA, 16 nt, Human
cagcucaccagcccca

SEQ ID NO: 2394690 - RNA, 17 nt, Human
cagcucaccagccccag

SEQ ID NO: 2394691 - RNA, 19 nt, Human
cagcucaccagccccagug

SEQ ID NO: 2394692 - RNA, 19 nt, Human
cagcuagguggggccuaga

SEQ ID NO: 2394693 - RNA, 16 nt, Human
cagcuauaccugugcc

SEQ ID NO: 2394694 - RNA, 15 nt, Human
cagcuauaccugugc

SEQ ID NO: 2394695 - RNA, 18 nt, Human
cagcuauaacaguaggga

SEQ ID NO: 2394696 - RNA, 15 nt, Human
cagcuacuugggagg

SEQ ID NO: 2394697 - RNA, 15 nt, Human
cagcuacuugggaag

SEQ ID NO: 2394698 - RNA, 16 nt, Human
cagcuacuugggaagc

SEQ ID NO: 2394699 - RNA, 16 nt, Human
cagcuacuugggaggc

SEQ ID NO: 2394700 - RNA, 17 nt, Human
cagcuacuuuaacacca

SEQ ID NO: 2394701 - RNA, 23 nt, Human
cagcuagaaauaagcccaacaga

SEQ ID NO: 2394702 - RNA, 23 nt, Human
cagcuaugggagccccagggucu

SEQ ID NO: 2394703 - RNA, 22 nt, Human
cagcuaugggagccccaggguc

SEQ ID NO: 2394704 - RNA, 21 nt, Human
cagcuaugggagccccagggu

SEQ ID NO: 2394705 - RNA, 20 nt, Human
cagcuaugggagccccaggg

SEQ ID NO: 2394706 - RNA, 18 nt, Human
cagcuaugggagccccag

SEQ ID NO: 2394707 - RNA, 17 nt, Human
cagcuaugggagcccca

SEQ ID NO: 2394708 - RNA, 15 nt, Human
cagcuaugggagccc

SEQ ID NO: 2394709 - RNA, 13 nt, Human
cagcuaugggagc

SEQ ID NO: 2394710 - RNA, 17 nt, Human
cagcuaucucucaguga

SEQ ID NO: 2394711 - RNA, 20 nt, Human
cagcuauaacaguagggaug

SEQ ID NO: 2394712 - RNA, 23 nt, Human
cagcuauaccugugccucggcuu

SEQ ID NO: 2394713 - RNA, 18 nt, Human
cagcuaucucucagugaa

SEQ ID NO: 2394714 - RNA, 23 nt, Human
cagcuaucuggucaaccuccugg

SEQ ID NO: 2394715 - RNA, 22 nt, Human
cagcuauaccugugccucggcu

SEQ ID NO: 2394716 - RNA, 21 nt, Human
cagcuauaccugugccucggc

SEQ ID NO: 2394717 - RNA, 19 nt, Human
cagcuauaccugugccucg

SEQ ID NO: 2394718 - RNA, 17 nt, Human
cagcuauaccugugccu

SEQ ID NO: 2394719 - RNA, 17 nt, Human
cagcucacgucacacuu

SEQ ID NO: 2394720 - RNA, 14 nt, Human
cagcucacugcaac

SEQ ID NO: 2394721 - RNA, 12 nt, Human
cagcucacugca

SEQ ID NO: 2394722 - RNA, 19 nt, Human
cagcucaccccccacacuc

SEQ ID NO: 2394723 - RNA, 20 nt, Human
cagcucaccccccacacuca

SEQ ID NO: 2394724 - RNA, 22 nt, Human
cagcucaccccccacacucacu

SEQ ID NO: 2394725 - RNA, 14 nt, Human
cagcucaccccugg

SEQ ID NO: 2394726 - RNA, 19 nt, Human
cagcucaccucucccuugg

SEQ ID NO: 2394727 - RNA, 20 nt, Human
cagcucaccucucccuugga

SEQ ID NO: 2394728 - RNA, 15 nt, Human
cagcucacugcaacc

SEQ ID NO: 2394729 - RNA, 21 nt, Human
cagcucacugcaaccuucgcc

SEQ ID NO: 2394730 - RNA, 12 nt, Human
cagcucagagag

SEQ ID NO: 2394731 - RNA, 22 nt, Human
cagcucagaaguuucuucuuua

SEQ ID NO: 2394732 - RNA, 21 nt, Human
cagcucagaaguuucuucuuu

SEQ ID NO: 2394733 - RNA, 22 nt, Human
cagcucaagucuucccugauca

SEQ ID NO: 2394734 - RNA, 20 nt, Human
cagcucacccagccccaggg

SEQ ID NO: 2394735 - RNA, 12 nt, Human
cagcucaccccc

SEQ ID NO: 2394736 - RNA, 18 nt, Human
cagcucaccccccacacu

SEQ ID NO: 2394737 - RNA, 20 nt, Human
cagcucaauggacuggaagg

SEQ ID NO: 2394738 - RNA, 22 nt, Human
cagcucaccagccccagugccc

SEQ ID NO: 2394739 - RNA, 20 nt, Human
cagcucaccagccccagugc

SEQ ID NO: 2394740 - RNA, 21 nt, Human
cagcucaccagccccagugcc

SEQ ID NO: 2394741 - RNA, 13 nt, Human
cagcucaccucuc

SEQ ID NO: 2394742 - RNA, 15 nt, Human
cagcucaccucuccc

SEQ ID NO: 2394743 - RNA, 16 nt, Human
cagcucaccucucccu

SEQ ID NO: 2394744 - RNA, 17 nt, Human
cagcucaccucucccuu

SEQ ID NO: 2394745 - RNA, 17 nt, Human
cagccuguaucuugggg

SEQ ID NO: 2394746 - RNA, 23 nt, Human
cagccuggugggccuccucuguc

SEQ ID NO: 2394747 - RNA, 19 nt, Human
cagccugucccauggacac

SEQ ID NO: 2394748 - RNA, 21 nt, Human
cagccugucccauggacacuc

SEQ ID NO: 2394749 - RNA, 22 nt, Human
cagccugucccauggacacucc

SEQ ID NO: 2394750 - RNA, 12 nt, Human
cagccuguccug

SEQ ID NO: 2394751 - RNA, 15 nt, Human
cagccuguccugggc

SEQ ID NO: 2394752 - RNA, 19 nt, Human
cagccuguccugggcuggu

SEQ ID NO: 2394753 - RNA, 15 nt, Human
cagccugucucuucc

SEQ ID NO: 2394754 - RNA, 12 nt, Human
cagccuguggcg

SEQ ID NO: 2394755 - RNA, 19 nt, Human
cagccugucucuuccauau

SEQ ID NO: 2394756 - RNA, 21 nt, Human
cagccuguggcaucuuugccu

SEQ ID NO: 2394757 - RNA, 19 nt, Human
cagccuguggcaucuuugc

SEQ ID NO: 2394758 - RNA, 15 nt, Human
cagccuguggcaucu

SEQ ID NO: 2394759 - RNA, 12 nt, Human
cagccuguggca

SEQ ID NO: 2394760 - RNA, 16 nt, Human
cagccugugcugcccg

SEQ ID NO: 2394761 - RNA, 14 nt, Human
cagccugugcugcc

SEQ ID NO: 2394762 - RNA, 16 nt, Human
cagccugucucuucca

SEQ ID NO: 2394763 - RNA, 17 nt, Human
cagccugucucuuccau

SEQ ID NO: 2394764 - RNA, 18 nt, Human
cagccuggugggccuccu

SEQ ID NO: 2394765 - RNA, 17 nt, Human
cagccuggugggccucc

SEQ ID NO: 2394766 - RNA, 16 nt, Human
cagccuggugggccuc

SEQ ID NO: 2394767 - RNA, 15 nt, Human
cagccuggugggccu

SEQ ID NO: 2394768 - RNA, 20 nt, Human
cagccuggucaacaugguga

SEQ ID NO: 2394769 - RNA, 19 nt, Human
cagccuggggucuggaguu

SEQ ID NO: 2394770 - RNA, 20 nt, Human
cagccugggugacagaguga

SEQ ID NO: 2394771 - RNA, 15 nt, Human
cagccuggggucugg

SEQ ID NO: 2394772 - RNA, 21 nt, Human
cagccuggggcuggccuccca

SEQ ID NO: 2394773 - RNA, 18 nt, Human
cagccuggggcuggccuc

SEQ ID NO: 2394774 - RNA, 17 nt, Human
cagccuggggcuggccu

SEQ ID NO: 2394775 - RNA, 21 nt, Human
cagccugggcagccaggcugc

SEQ ID NO: 2394776 - RNA, 20 nt, Human
cagccugggcagccaggcug

SEQ ID NO: 2394777 - RNA, 19 nt, Human
cagccugggcagccaggcu

SEQ ID NO: 2394778 - RNA, 18 nt, Human
cagccugggcagccaggc

SEQ ID NO: 2394779 - RNA, 17 nt, Human
cagccugggcagccagg

SEQ ID NO: 2394780 - RNA, 20 nt, Human
cagccugggcagcauagcaa

SEQ ID NO: 2394781 - RNA, 15 nt, Human
cagccugggcgacag

SEQ ID NO: 2394782 - RNA, 11 nt, Human
cagccugggcg

SEQ ID NO: 2394783 - RNA, 19 nt, Human
cagccugggcaaugugaua

SEQ ID NO: 2394784 - RNA, 16 nt, Human
cagccugggcaaugug

SEQ ID NO: 2394785 - RNA, 21 nt, Human
cagccuggcuucuggagcccu

SEQ ID NO: 2394786 - RNA, 20 nt, Human
cagccuggcuucuggagccc

SEQ ID NO: 2394787 - RNA, 20 nt, Human
cagccugggcaacagagcaa

SEQ ID NO: 2394788 - RNA, 19 nt, Human
cagccugggcaacagagca

SEQ ID NO: 2394789 - RNA, 20 nt, Human
cagccugggcaacacagcga

SEQ ID NO: 2394790 - RNA, 21 nt, Human
cagccuuccccuugcccaggg

SEQ ID NO: 2394791 - RNA, 16 nt, Human
cagccuuccccuugcc

SEQ ID NO: 2394792 - RNA, 21 nt, Human
cagccuucccccucccagggc

SEQ ID NO: 2394793 - RNA, 20 nt, Human
cagccuucccccucccaggg

SEQ ID NO: 2394794 - RNA, 23 nt, Human
cagccuuccccuugcccagggcu

SEQ ID NO: 2394795 - RNA, 14 nt, Human
cagccuuccucugc

SEQ ID NO: 2394796 - RNA, 15 nt, Human
cagccuuccucugca

SEQ ID NO: 2394797 - RNA, 18 nt, Human
cagccuuccucugcagcu

SEQ ID NO: 2394798 - RNA, 19 nt, Human
cagccuuccucugcagcug

SEQ ID NO: 2394799 - RNA, 20 nt, Human
cagccuuccucugcagcuga

SEQ ID NO: 2394800 - RNA, 21 nt, Human
cagccuguggcggugccuggg

SEQ ID NO: 2394801 - RNA, 20 nt, Human
cagccuguggcggugccugg

SEQ ID NO: 2394802 - RNA, 19 nt, Human
cagccuguggcggugccug

SEQ ID NO: 2394803 - RNA, 18 nt, Human
cagccuguggcggugccu

SEQ ID NO: 2394804 - RNA, 16 nt, Human
cagccuguuggacccg

SEQ ID NO: 2394805 - RNA, 14 nt, Human
cagccuucccccuc

SEQ ID NO: 2394806 - RNA, 23 nt, Human
cagccuucagacagagaggacug

SEQ ID NO: 2394807 - RNA, 22 nt, Human
cagccuguggcggugccugggu

SEQ ID NO: 2394808 - RNA, 17 nt, Human
cagccuugaccauucuc

SEQ ID NO: 2394809 - RNA, 16 nt, Human
cagccuucuuccaucc

SEQ ID NO: 2394810 - RNA, 21 nt, Human
cagccuuccucugcagcugac

SEQ ID NO: 2394811 - RNA, 22 nt, Human
cagccuuccucugcagcugacc

SEQ ID NO: 2394812 - RNA, 23 nt, Human
cagccuuccucugcagcugaccu

SEQ ID NO: 2394813 - RNA, 18 nt, Human
cagccuucuuccauccca

SEQ ID NO: 2394814 - RNA, 20 nt, Human
cagccuugaccauucuccac

SEQ ID NO: 2394815 - RNA, 21 nt, Human
cagccuugaccauucuccacc

SEQ ID NO: 2394816 - RNA, 21 nt, Human
cagcgaaaggauguaaacagu

SEQ ID NO: 2394817 - RNA, 17 nt, Human
cagccuuugccuccccg

SEQ ID NO: 2394818 - RNA, 23 nt, Human
cagccuuugaucagguggggagu

SEQ ID NO: 2394819 - RNA, 22 nt, Human
cagccuuugaucagguggggag

SEQ ID NO: 2394820 - RNA, 19 nt, Human
cagccuuugaucagguggg

SEQ ID NO: 2394821 - RNA, 23 nt, Human
cagccuuucucccaggccaggcu

SEQ ID NO: 2394822 - RNA, 20 nt, Human
cagccuuucucccaggccag

SEQ ID NO: 2394823 - RNA, 19 nt, Human
cagccuuucucccaggcca

SEQ ID NO: 2394824 - RNA, 18 nt, Human
cagccuuucucccaggcc

SEQ ID NO: 2394825 - RNA, 17 nt, Human
cagccuuucucccaggc

SEQ ID NO: 2394826 - RNA, 17 nt, Human
cagccuuggcaucuaga

SEQ ID NO: 2394827 - RNA, 21 nt, Human
cagccuuggauaaugcuguug

SEQ ID NO: 2394828 - RNA, 21 nt, Human
cagccuucuuugcuugccucu

SEQ ID NO: 2394829 - RNA, 16 nt, Human
cagccuugccagagau

SEQ ID NO: 2394830 - RNA, 15 nt, Human
cagccuugccagaga

SEQ ID NO: 2394831 - RNA, 14 nt, Human
cagccuugccagag

SEQ ID NO: 2394832 - RNA, 13 nt, Human
cagccuugccaga

SEQ ID NO: 2394833 - RNA, 22 nt, Human
cagccuugaccauucuccaccu

SEQ ID NO: 2394834 - RNA, 23 nt, Human
cagccuugaccauucuccaccug

SEQ ID NO: 2394835 - RNA, 21 nt, Human
cagccuucuuccaucccagga

SEQ ID NO: 2394836 - RNA, 23 nt, Human
cagccuucuuccaucccaggaca

SEQ ID NO: 2394837 - RNA, 14 nt, Human
cagccuucuuugcu

SEQ ID NO: 2394838 - RNA, 17 nt, Human
cagccuucuuugcuugc

SEQ ID NO: 2394839 - RNA, 24 nt, Human
cagccuugaccauucuccaccugc

SEQ ID NO: 2394840 - RNA, 20 nt, Human
cagccuccugaguagcugga

SEQ ID NO: 2394841 - RNA, 15 nt, Human
cagccuccugaguag

SEQ ID NO: 2394842 - RNA, 23 nt, Human
cagccuccucugucugcccuuca

SEQ ID NO: 2394843 - RNA, 20 nt, Human
cagccugcuccagcuguuca

SEQ ID NO: 2394844 - RNA, 14 nt, Human
cagccucuagggac

SEQ ID NO: 2394845 - RNA, 15 nt, Human
cagccucuagggacc

SEQ ID NO: 2394846 - RNA, 19 nt, Human
cagccucuagggaccccuc

SEQ ID NO: 2394847 - RNA, 20 nt, Human
cagccucuagggaccccucc

SEQ ID NO: 2394848 - RNA, 19 nt, Human
cagccuccguauuucagac

SEQ ID NO: 2394849 - RNA, 18 nt, Human
cagccuccguauuucaga

SEQ ID NO: 2394850 - RNA, 16 nt, Human
cagccuccucaucugg

SEQ ID NO: 2394851 - RNA, 17 nt, Human
cagccuccucaucuggg

SEQ ID NO: 2394852 - RNA, 23 nt, Human
cagccuccucaucugggggagug

SEQ ID NO: 2394853 - RNA, 13 nt, Human
cagccuccuccug

SEQ ID NO: 2394854 - RNA, 15 nt, Human
cagccuccuccugac

SEQ ID NO: 2394855 - RNA, 12 nt, Human
cagccuccucug

SEQ ID NO: 2394856 - RNA, 14 nt, Human
cagccuccucugga

SEQ ID NO: 2394857 - RNA, 17 nt, Human
cagccuccucuggacgg

SEQ ID NO: 2394858 - RNA, 21 nt, Human
cagccuccucuggacggcagg

SEQ ID NO: 2394859 - RNA, 22 nt, Human
cagccuccucuggacggcaggc

SEQ ID NO: 2394860 - RNA, 23 nt, Human
cagccuccucuggacggcaggcu

SEQ ID NO: 2394861 - RNA, 17 nt, Human
cagccuccucugucugc

SEQ ID NO: 2394862 - RNA, 19 nt, Human
cagccuccgagagggagag

SEQ ID NO: 2394863 - RNA, 20 nt, Human
cagccuccgagagggagaga

SEQ ID NO: 2394864 - RNA, 18 nt, Human
cagccucccugaagccuu

SEQ ID NO: 2394865 - RNA, 21 nt, Human
cagccucccugucggccuggu

SEQ ID NO: 2394866 - RNA, 17 nt, Human
cagccuccgagagggag

SEQ ID NO: 2394867 - RNA, 17 nt, Human
cagccucccugaagccu

SEQ ID NO: 2394868 - RNA, 16 nt, Human
cagccucccugaagcc

SEQ ID NO: 2394869 - RNA, 14 nt, Human
cagccucccugaag

SEQ ID NO: 2394870 - RNA, 12 nt, Human
cagccucccuga

SEQ ID NO: 2394871 - RNA, 23 nt, Human
cagccucccgaauagcugggacu

SEQ ID NO: 2394872 - RNA, 19 nt, Human
cagccucccgaguagcugg

SEQ ID NO: 2394873 - RNA, 20 nt, Human
cagccucccgaguagcuggg

SEQ ID NO: 2394874 - RNA, 21 nt, Human
cagccucccgaguagcuggga

SEQ ID NO: 2394875 - RNA, 22 nt, Human
cagccucccgaguagcugggac

SEQ ID NO: 2394876 - RNA, 23 nt, Human
cagccucccgaguagcugggacu

SEQ ID NO: 2394877 - RNA, 23 nt, Human
cagccucccucugaccugcaggc

SEQ ID NO: 2394878 - RNA, 22 nt, Human
cagccucccucugaccugcagg

SEQ ID NO: 2394879 - RNA, 21 nt, Human
cagccucccucugaccugcag

SEQ ID NO: 2394880 - RNA, 15 nt, Human
cagccucccucugac

SEQ ID NO: 2394881 - RNA, 14 nt, Human
cagccucccucuga

SEQ ID NO: 2394882 - RNA, 13 nt, Human
cagccucccucug

SEQ ID NO: 2394883 - RNA, 21 nt, Human
cagccucccuauuuuuuuucu

SEQ ID NO: 2394884 - RNA, 19 nt, Human
cagccuggacccuguggau

SEQ ID NO: 2394885 - RNA, 15 nt, Human
cagccuggacccugu

SEQ ID NO: 2394886 - RNA, 22 nt, Human
cagccugcuccuucccaggagu

SEQ ID NO: 2394887 - RNA, 16 nt, Human
cagccuggacauagag

SEQ ID NO: 2394888 - RNA, 13 nt, Human
cagccuggacccc

SEQ ID NO: 2394889 - RNA, 15 nt, Human
cagccuggaccccca

SEQ ID NO: 2394890 - RNA, 16 nt, Human
cagccuggacccccag

SEQ ID NO: 2394891 - RNA, 21 nt, Human
cagccucuagggaccccuccu

SEQ ID NO: 2394892 - RNA, 20 nt, Human
cagccugcuccuucccagga

SEQ ID NO: 2394893 - RNA, 21 nt, Human
cagccugcuccuucccaggag

SEQ ID NO: 2394894 - RNA, 21 nt, Human
cagccuggcacagggcagugg

SEQ ID NO: 2394895 - RNA, 13 nt, Human
cagccuggcacag

SEQ ID NO: 2394896 - RNA, 20 nt, Human
cagccuggcacagggcagug

SEQ ID NO: 2394897 - RNA, 12 nt, Human
cagccuggaggc

SEQ ID NO: 2394898 - RNA, 17 nt, Human
cagccuggaucuccuca

SEQ ID NO: 2394899 - RNA, 17 nt, Human
cagccuggacccccagc

SEQ ID NO: 2394900 - RNA, 18 nt, Human
cagccuggacccccagcu

SEQ ID NO: 2394901 - RNA, 16 nt, Human
cagccuggagaugaaa

SEQ ID NO: 2394902 - RNA, 13 nt, Human
cagccuggaggcc

SEQ ID NO: 2394903 - RNA, 10 nt, Human
cagccuggca

SEQ ID NO: 2394904 - RNA, 23 nt, Human
cagccuggcgaaaccccaucucu

SEQ ID NO: 2394905 - RNA, 12 nt, Human
cagccuggcucc

SEQ ID NO: 2394906 - RNA, 21 nt, Human
cagccuggcucccacaggcag

SEQ ID NO: 2394907 - RNA, 22 nt, Human
cagccuggcucccacaggcagc

SEQ ID NO: 2394908 - RNA, 23 nt, Human
cagccuggcucccacaggcagcu

SEQ ID NO: 2394909 - RNA, 19 nt, Human
cagccuggcuucuggagcc

SEQ ID NO: 2394910 - RNA, 17 nt, Human
cagccuggcuucuggag

SEQ ID NO: 2394911 - RNA, 16 nt, Human
cagccuggcuucugga

SEQ ID NO: 2394912 - RNA, 15 nt, Human
cagccuggcuucugg

SEQ ID NO: 2394913 - RNA, 14 nt, Human
cagccuggcuucug

SEQ ID NO: 2394914 - RNA, 20 nt, Human
cagccuggccagacacaggc

SEQ ID NO: 2394915 - RNA, 18 nt, Human
cagccuggccagacacag

SEQ ID NO: 2394916 - RNA, 17 nt, Human
cagccuggccagacaca

SEQ ID NO: 2394917 - RNA, 15 nt, Human
cagccuggccagaca

SEQ ID NO: 2394918 - RNA, 14 nt, Human
cagccuggccagac

SEQ ID NO: 2394919 - RNA, 13 nt, Human
cagccuggccaga

SEQ ID NO: 2394920 - RNA, 12 nt, Human
cagccuggccca

SEQ ID NO: 2394921 - RNA, 13 nt, Human
cagccuggcccag

SEQ ID NO: 2394922 - RNA, 11 nt, Human
cagccuggccc

SEQ ID NO: 2394923 - RNA, 14 nt, Human
cagccuggcccagc

SEQ ID NO: 2394924 - RNA, 15 nt, Human
cagccuggcccagcu

SEQ ID NO: 2394925 - RNA, 16 nt, Human
cagccuggcccagcuc

SEQ ID NO: 2394926 - RNA, 17 nt, Human
cagccuggcccagcucc

SEQ ID NO: 2394927 - RNA, 18 nt, Human
cagccuggcccagcuccc

SEQ ID NO: 2394928 - RNA, 19 nt, Human
cagccuggcccagcucccc

SEQ ID NO: 2394929 - RNA, 20 nt, Human
cagccuggcccagcuccccc

SEQ ID NO: 2394930 - RNA, 18 nt, Human
cagaauggggugcaugaa

SEQ ID NO: 2394931 - RNA, 21 nt, Human
cagaaugcuguacaucuauuu

SEQ ID NO: 2394932 - RNA, 18 nt, Human
cagaaugcuguacaucua

SEQ ID NO: 2394933 - RNA, 17 nt, Human
cagaaugcuguacaucu

SEQ ID NO: 2394934 - RNA, 16 nt, Human
cagaaugcuguacauc

SEQ ID NO: 2394935 - RNA, 11 nt, Human
cagaaugcugu

SEQ ID NO: 2394936 - RNA, 14 nt, Human
cagaaugugauuuc

SEQ ID NO: 2394937 - RNA, 16 nt, Human
cagaauguuuuacugu

SEQ ID NO: 2394938 - RNA, 20 nt, Human
cagaauguuuuacugugaaa

SEQ ID NO: 2394939 - RNA, 17 nt, Human
cagaauguuuuuaaaau

SEQ ID NO: 2394940 - RNA, 18 nt, Human
cagaaucuacccaaagga

SEQ ID NO: 2394941 - RNA, 15 nt, Human
cagaaucucgcucug

SEQ ID NO: 2394942 - RNA, 15 nt, Human
cagaaugaggcugcu

SEQ ID NO: 2394943 - RNA, 14 nt, Human
cagaaugaggcugc

SEQ ID NO: 2394944 - RNA, 18 nt, Human
cagaaugcugcaggacuu

SEQ ID NO: 2394945 - RNA, 17 nt, Human
cagaaugcuagcucuga

SEQ ID NO: 2394946 - RNA, 21 nt, Human
cagaaugcuagcucugagcca

SEQ ID NO: 2394947 - RNA, 18 nt, Human
cagaaugaggaauaauaa

SEQ ID NO: 2394948 - RNA, 16 nt, Human
cagaaugagugcuuca

SEQ ID NO: 2394949 - RNA, 11 nt, Human
cagaauucuca

SEQ ID NO: 2394950 - RNA, 15 nt, Human
cagaauuaacuccau

SEQ ID NO: 2394951 - RNA, 18 nt, Human
cagaauucucuaguuuga

SEQ ID NO: 2394952 - RNA, 15 nt, Human
cagaauucucuaguu

SEQ ID NO: 2394953 - RNA, 14 nt, Human
cagaauucugcuac

SEQ ID NO: 2394954 - RNA, 13 nt, Human
cagaauucugcua

SEQ ID NO: 2394955 - RNA, 15 nt, Human
cagaauuccuuuucu

SEQ ID NO: 2394956 - RNA, 23 nt, Human
cagaauucugcuaccucacuggg

SEQ ID NO: 2394957 - RNA, 21 nt, Human
cagaauucugcuaccucacug

SEQ ID NO: 2394958 - RNA, 13 nt, Human
cagaauugaucau

SEQ ID NO: 2394959 - RNA, 14 nt, Human
cagaauuucccaaa

SEQ ID NO: 2394960 - RNA, 16 nt, Human
cagaauugugucugca

SEQ ID NO: 2394961 - RNA, 17 nt, Human
cagaauugugucugcag

SEQ ID NO: 2394962 - RNA, 18 nt, Human
cagaauugugucugcagg

SEQ ID NO: 2394963 - RNA, 23 nt, Human
cagaauuggauacauacaccagc

SEQ ID NO: 2394964 - RNA, 21 nt, Human
cagacaaaaacagccucacag

SEQ ID NO: 2394965 - RNA, 20 nt, Human
cagacaaaaacagccucaca

SEQ ID NO: 2394966 - RNA, 19 nt, Human
cagacaaaaacagccucac

SEQ ID NO: 2394967 - RNA, 18 nt, Human
cagacaaaaacagccuca

SEQ ID NO: 2394968 - RNA, 12 nt, Human
cagacaaagcgu

SEQ ID NO: 2394969 - RNA, 24 nt, Human
cagaauuucccaaagcagugcaug

SEQ ID NO: 2394970 - RNA, 19 nt, Human
cagaauuuggguucugccu

SEQ ID NO: 2394971 - RNA, 17 nt, Human
cagaauuucccaaagca

SEQ ID NO: 2394972 - RNA, 18 nt, Human
cagaauuucccaaagcag

SEQ ID NO: 2394973 - RNA, 19 nt, Human
cagaauuucccaaagcagu

SEQ ID NO: 2394974 - RNA, 20 nt, Human
cagaauuucccaaagcagug

SEQ ID NO: 2394975 - RNA, 16 nt, Human
cagacaacagaaguca

SEQ ID NO: 2394976 - RNA, 15 nt, Human
cagacaacagaaguc

SEQ ID NO: 2394977 - RNA, 14 nt, Human
cagacaacagaagu

SEQ ID NO: 2394978 - RNA, 13 nt, Human
cagacaacagaag

SEQ ID NO: 2394979 - RNA, 20 nt, Human
cagacaacaaaccuguuucu

SEQ ID NO: 2394980 - RNA, 22 nt, Human
cagacaaaaacagccucacaga

SEQ ID NO: 2394981 - RNA, 17 nt, Human
cagacaaaccagaagca

SEQ ID NO: 2394982 - RNA, 22 nt, Human
cagacaaaugugguuacacacu

SEQ ID NO: 2394983 - RNA, 22 nt, Human
cagacaaagcgugguggacaug

SEQ ID NO: 2394984 - RNA, 22 nt, Human
cagacaacagaagucaugaagc

SEQ ID NO: 2394985 - RNA, 17 nt, Human
cagacaacagaagucau

SEQ ID NO: 2394986 - RNA, 21 nt, Human
cagacaaaguaauuccucuca

SEQ ID NO: 2394987 - RNA, 19 nt, Human
cagacaagcaacagguuuu

SEQ ID NO: 2394988 - RNA, 23 nt, Human
cagacaagcaacagguuuuauaa

SEQ ID NO: 2394989 - RNA, 23 nt, Human
cagacaagguagcccuggccaga

SEQ ID NO: 2394990 - RNA, 16 nt, Human
cagacaagguagcccu

SEQ ID NO: 2394991 - RNA, 12 nt, Human
cagacacacaca

SEQ ID NO: 2394992 - RNA, 14 nt, Human
cagacacacacaca

SEQ ID NO: 2394993 - RNA, 11 nt, Human
cagacacacac

SEQ ID NO: 2394994 - RNA, 13 nt, Human
cagacacacacac

SEQ ID NO: 2394995 - RNA, 14 nt, Human
cagacacacacacg

SEQ ID NO: 2394996 - RNA, 15 nt, Human
cagacacacacacgc

SEQ ID NO: 2394997 - RNA, 16 nt, Human
cagacacacacacgca

SEQ ID NO: 2394998 - RNA, 17 nt, Human
cagacacacacacgcac

SEQ ID NO: 2394999 - RNA, 18 nt, Human
cagacacacacacgcacg

SEQ ID NO: 2395000 - RNA, 21 nt, Human
cagacacacacacgcacgcac

SEQ ID NO: 2395001 - RNA, 22 nt, Human
cagacacacacacgcacgcaca

SEQ ID NO: 2395002 - RNA, 18 nt, Human
cagacacacgcacacaca

SEQ ID NO: 2395003 - RNA, 14 nt, Human
cagacacagaagag

SEQ ID NO: 2395004 - RNA, 14 nt, Human
cagacacaggcccu

SEQ ID NO: 2395005 - RNA, 18 nt, Human
cagacacaggcccucccu

SEQ ID NO: 2395006 - RNA, 15 nt, Human
cagacacaggcccuc

SEQ ID NO: 2395007 - RNA, 14 nt, Human
cagacacaugucca

SEQ ID NO: 2395008 - RNA, 17 nt, Human
cagacacauguccaaga

SEQ ID NO: 2395009 - RNA, 21 nt, Human
cagacacauguccaagaagcc

SEQ ID NO: 2395010 - RNA, 22 nt, Human
cagacacauguccaagaagccc

SEQ ID NO: 2395011 - RNA, 23 nt, Human
cagacacauguccaagaagccca

SEQ ID NO: 2395012 - RNA, 17 nt, Human
cagacacccaggacuua

SEQ ID NO: 2395013 - RNA, 15 nt, Human
cagacacccaggacu

SEQ ID NO: 2395014 - RNA, 14 nt, Human
cagacacccaggac

SEQ ID NO: 2395015 - RNA, 13 nt, Human
cagacacccagga

SEQ ID NO: 2395016 - RNA, 12 nt, Human
cagacacccagg

SEQ ID NO: 2395017 - RNA, 22 nt, Human
cagacacagggacuugaaguug

SEQ ID NO: 2395018 - RNA, 13 nt, Human
cagacacccaccc

SEQ ID NO: 2395019 - RNA, 17 nt, Human
cagacacagggacuuga

SEQ ID NO: 2395020 - RNA, 18 nt, Human
cagacacagggacuugaa

SEQ ID NO: 2395021 - RNA, 20 nt, Human
cagacacagggacuugaagu

SEQ ID NO: 2395022 - RNA, 21 nt, Human
cagacacagggacuugaaguu

SEQ ID NO: 2395023 - RNA, 13 nt, Human
cagacacaggccc

SEQ ID NO: 2395024 - RNA, 14 nt, Human
cagacacaggcccg

SEQ ID NO: 2395025 - RNA, 15 nt, Human
cagacacaggcccgg

SEQ ID NO: 2395026 - RNA, 17 nt, Human
cagacacaggcccggcu

SEQ ID NO: 2395027 - RNA, 18 nt, Human
cagacacaggcccggcuc

SEQ ID NO: 2395028 - RNA, 21 nt, Human
cagacacaggcccggcuccag

SEQ ID NO: 2395029 - RNA, 22 nt, Human
cagacacaggcccggcuccagg

SEQ ID NO: 2395030 - RNA, 23 nt, Human
cagacacaggcccggcuccaggc

SEQ ID NO: 2395031 - RNA, 21 nt, Human
cagacauucugccaggccccc

SEQ ID NO: 2395032 - RNA, 16 nt, Human
cagacauucugccagg

SEQ ID NO: 2395033 - RNA, 13 nt, Human
cagacauucugcc

SEQ ID NO: 2395034 - RNA, 22 nt, Human
cagacauguuuuccgugaaaac

SEQ ID NO: 2395035 - RNA, 18 nt, Human
cagacauguuuuccguga

SEQ ID NO: 2395036 - RNA, 22 nt, Human
cagacauguggugggacaggga

SEQ ID NO: 2395037 - RNA, 12 nt, Human
cagacauguuuu

SEQ ID NO: 2395038 - RNA, 18 nt, Human
cagacauguggugggaca

SEQ ID NO: 2395039 - RNA, 18 nt, Human
cagacaugccacaaggac

SEQ ID NO: 2395040 - RNA, 22 nt, Human
cagacauccauguuuguaaaac

SEQ ID NO: 2395041 - RNA, 23 nt, Human
cagacauccauguuuguaaaacu

SEQ ID NO: 2395042 - RNA, 15 nt, Human
cagacaucucugcac

SEQ ID NO: 2395043 - RNA, 17 nt, Human
cagacaucucugcaccc

SEQ ID NO: 2395044 - RNA, 19 nt, Human
cagacauccauguuuguaa

SEQ ID NO: 2395045 - RNA, 21 nt, Human
cagacacugaccauccacucu

SEQ ID NO: 2395046 - RNA, 19 nt, Human
cagacauacuaaccagcag

SEQ ID NO: 2395047 - RNA, 19 nt, Human
cagacauagaauuaacaca

SEQ ID NO: 2395048 - RNA, 17 nt, Human
cagacauagaauuaaca

SEQ ID NO: 2395049 - RNA, 21 nt, Human
cagacacuuuuuugaguggau

SEQ ID NO: 2395050 - RNA, 19 nt, Human
cagacacucugcucugccc

SEQ ID NO: 2395051 - RNA, 20 nt, Human
cagacacucugcucugcccu

SEQ ID NO: 2395052 - RNA, 13 nt, Human
cagacacucuggc

SEQ ID NO: 2395053 - RNA, 14 nt, Human
cagacacucuggcu

SEQ ID NO: 2395054 - RNA, 20 nt, Human
cagacaguuaagagaaauga

SEQ ID NO: 2395055 - RNA, 18 nt, Human
cagacaccuuggacaucc

SEQ ID NO: 2395056 - RNA, 14 nt, Human
cagacaccuuggac

SEQ ID NO: 2395057 - RNA, 17 nt, Human
cagacacggaucugaga

SEQ ID NO: 2395058 - RNA, 22 nt, Human
cagacacggaucugagaaucuu

SEQ ID NO: 2395059 - RNA, 11 nt, Human
cagacacuaag

SEQ ID NO: 2395060 - RNA, 12 nt, Human
cagacacuaagu

SEQ ID NO: 2395061 - RNA, 18 nt, Human
cagacacuaaguuauagu

SEQ ID NO: 2395062 - RNA, 21 nt, Human
cagacacuaaguuauaguaua

SEQ ID NO: 2395063 - RNA, 12 nt, Human
cagacacucugc

SEQ ID NO: 2395064 - RNA, 13 nt, Human
cagacacucugcu

SEQ ID NO: 2395065 - RNA, 14 nt, Human
cagacacucugcuc

SEQ ID NO: 2395066 - RNA, 16 nt, Human
cagacacucugcucug

SEQ ID NO: 2395067 - RNA, 19 nt, Human
cagacaccuugacagggca

SEQ ID NO: 2395068 - RNA, 15 nt, Human
cagacaccgccacau

SEQ ID NO: 2395069 - RNA, 21 nt, Human
cagacacccucaaccucuucu

SEQ ID NO: 2395070 - RNA, 15 nt, Human
cagacacccucaacc

SEQ ID NO: 2395071 - RNA, 14 nt, Human
cagacacccucaac

SEQ ID NO: 2395072 - RNA, 20 nt, Human
cagacaccuugacagggcac

SEQ ID NO: 2395073 - RNA, 22 nt, Human
cagacaccuugacagggcacac

SEQ ID NO: 2395074 - RNA, 13 nt, Human
cagaccagcucuu

SEQ ID NO: 2395075 - RNA, 16 nt, Human
cagaccauaauguuac

SEQ ID NO: 2395076 - RNA, 13 nt, Human
cagaccacggcuc

SEQ ID NO: 2395077 - RNA, 23 nt, Human
cagaccacgcccguccugccugu

SEQ ID NO: 2395078 - RNA, 24 nt, Human
cagaccacgcccguccugccugug

SEQ ID NO: 2395079 - RNA, 20 nt, Human
cagaccacaucuuuaucugu

SEQ ID NO: 2395080 - RNA, 20 nt, Human
cagacauuguuuugccaaca

SEQ ID NO: 2395081 - RNA, 22 nt, Human
cagacauuguuuugccaacauu

SEQ ID NO: 2395082 - RNA, 13 nt, Human
cagaccaccccgc

SEQ ID NO: 2395083 - RNA, 15 nt, Human
cagaccaccccgccu

SEQ ID NO: 2395084 - RNA, 19 nt, Human
cagaccaccccgccugccc

SEQ ID NO: 2395085 - RNA, 22 nt, Human
cagaccaccccgccugcccuca

SEQ ID NO: 2395086 - RNA, 22 nt, Human
cagaccacgcccguccugccug

SEQ ID NO: 2395087 - RNA, 20 nt, Human
cagaccacaaaacuuuucua

SEQ ID NO: 2395088 - RNA, 14 nt, Human
cagaccacaaaacu

SEQ ID NO: 2395089 - RNA, 14 nt, Human
cagacauuggcacc

SEQ ID NO: 2395090 - RNA, 11 nt, Human
cagacauuguc

SEQ ID NO: 2395091 - RNA, 14 nt, Human
cagacauugucagc

SEQ ID NO: 2395092 - RNA, 11 nt, Human
cagacauuguu

SEQ ID NO: 2395093 - RNA, 15 nt, Human
cagacauugucagca

SEQ ID NO: 2395094 - RNA, 17 nt, Human
cagacauugucagcaaa

SEQ ID NO: 2395095 - RNA, 21 nt, Human
cagacauugucagcaaauuaa

SEQ ID NO: 2395096 - RNA, 13 nt, Human
cagacauuguuuu

SEQ ID NO: 2395097 - RNA, 15 nt, Human
cagacauuguuuugc

SEQ ID NO: 2395098 - RNA, 19 nt, Human
cagacauuguuuugccaac

SEQ ID NO: 2395099 - RNA, 17 nt, Human
cagacccccagcaaccc

SEQ ID NO: 2395100 - RNA, 13 nt, Human
cagacccccagca

SEQ ID NO: 2395101 - RNA, 16 nt, Human
cagacccccacucuca

SEQ ID NO: 2395102 - RNA, 14 nt, Human
cagacccccacucu

SEQ ID NO: 2395103 - RNA, 13 nt, Human
cagacccccacuc

SEQ ID NO: 2395104 - RNA, 23 nt, Human
cagacccccaccccuuccccacu

SEQ ID NO: 2395105 - RNA, 22 nt, Human
cagacccccaccccuuccccac

SEQ ID NO: 2395106 - RNA, 21 nt, Human
cagacccccaccccuucccca

SEQ ID NO: 2395107 - RNA, 20 nt, Human
cagacccccaccccuucccc

SEQ ID NO: 2395108 - RNA, 19 nt, Human
cagacccccaccccuuccc

SEQ ID NO: 2395109 - RNA, 18 nt, Human
cagacccccaccccuucc

SEQ ID NO: 2395110 - RNA, 17 nt, Human
cagacccccaccccuuc

SEQ ID NO: 2395111 - RNA, 15 nt, Human
cagacccccaccccu

SEQ ID NO: 2395112 - RNA, 14 nt, Human
cagacccccacccc

SEQ ID NO: 2395113 - RNA, 13 nt, Human
cagacccccaccc

SEQ ID NO: 2395114 - RNA, 15 nt, Human
cagaccccagcggcu

SEQ ID NO: 2395115 - RNA, 16 nt, Human
cagaccccagcggcug

SEQ ID NO: 2395116 - RNA, 14 nt, Human
cagaccccagcggc

SEQ ID NO: 2395117 - RNA, 12 nt, Human
cagaccccagcg

SEQ ID NO: 2395118 - RNA, 12 nt, Human
cagacccagugg

SEQ ID NO: 2395119 - RNA, 16 nt, Human
cagaccccucuggcca

SEQ ID NO: 2395120 - RNA, 13 nt, Human
cagaccccucugg

SEQ ID NO: 2395121 - RNA, 18 nt, Human
cagacccccagcaacccu

SEQ ID NO: 2395122 - RNA, 15 nt, Human
cagacccccuggaga

SEQ ID NO: 2395123 - RNA, 21 nt, Human
cagaccccucuggccaggaug

SEQ ID NO: 2395124 - RNA, 20 nt, Human
cagaccccucuggccaggau

SEQ ID NO: 2395125 - RNA, 18 nt, Human
cagaccccucuggccagg

SEQ ID NO: 2395126 - RNA, 17 nt, Human
cagaccccucuggccag

SEQ ID NO: 2395127 - RNA, 13 nt, Human
cagaccccuggcu

SEQ ID NO: 2395128 - RNA, 14 nt, Human
cagaccccuggcuu

SEQ ID NO: 2395129 - RNA, 15 nt, Human
cagaccccuggcuuu

SEQ ID NO: 2395130 - RNA, 16 nt, Human
cagaccccuggcuuuu

SEQ ID NO: 2395131 - RNA, 18 nt, Human
cagaccccuggcuuuuca

SEQ ID NO: 2395132 - RNA, 16 nt, Human
cagacccggcugcgug

SEQ ID NO: 2395133 - RNA, 12 nt, Human
cagacccugccc

SEQ ID NO: 2395134 - RNA, 13 nt, Human
cagacccugcccu

SEQ ID NO: 2395135 - RNA, 14 nt, Human
cagacccugcccug

SEQ ID NO: 2395136 - RNA, 12 nt, Human
cagacccggcug

SEQ ID NO: 2395137 - RNA, 14 nt, Human
cagacccggcugcg

SEQ ID NO: 2395138 - RNA, 22 nt, Human
cagaccccucuggccaggaugg

SEQ ID NO: 2395139 - RNA, 16 nt, Human
cagaccccuucagcca

SEQ ID NO: 2395140 - RNA, 23 nt, Human
cagaccccuggcuuuucacugcu

SEQ ID NO: 2395141 - RNA, 21 nt, Human
cagaccccuggcuuuucacug

SEQ ID NO: 2395142 - RNA, 22 nt, Human
cagaccccuggcuuuucacugc

SEQ ID NO: 2395143 - RNA, 17 nt, Human
cagacccuaccccacca

SEQ ID NO: 2395144 - RNA, 16 nt, Human
cagacccuaccccacc

SEQ ID NO: 2395145 - RNA, 15 nt, Human
cagacccuaccccac

SEQ ID NO: 2395146 - RNA, 18 nt, Human
cagacccuaccccaccac

SEQ ID NO: 2395147 - RNA, 22 nt, Human
cagacccugcccugugggcccc

SEQ ID NO: 2395148 - RNA, 21 nt, Human
cagaccgaacuguuguauaaa

SEQ ID NO: 2395149 - RNA, 18 nt, Human
cagaccuaaugcuccuug

SEQ ID NO: 2395150 - RNA, 17 nt, Human
cagaccuaaugcuccuu

SEQ ID NO: 2395151 - RNA, 16 nt, Human
cagaccuaaugcuccu

SEQ ID NO: 2395152 - RNA, 15 nt, Human
cagaccuaaugcucc

SEQ ID NO: 2395153 - RNA, 22 nt, Human
cagaccuaggauuucaugauuu

SEQ ID NO: 2395154 - RNA, 18 nt, Human
cagaccuauuccuccugg

SEQ ID NO: 2395155 - RNA, 19 nt, Human
cagaccuauuccuccuggg

SEQ ID NO: 2395156 - RNA, 15 nt, Human
cagacccugcccugu

SEQ ID NO: 2395157 - RNA, 16 nt, Human
cagacccugcccugug

SEQ ID NO: 2395158 - RNA, 17 nt, Human
cagacccugcccugugg

SEQ ID NO: 2395159 - RNA, 21 nt, Human
cagacccugcccugugggccc

SEQ ID NO: 2395160 - RNA, 18 nt, Human
cagagaaaggggagccca

SEQ ID NO: 2395161 - RNA, 18 nt, Human
cagagaaagaggaagcuu

SEQ ID NO: 2395162 - RNA, 19 nt, Human
cagagaaagaagagacagg

SEQ ID NO: 2395163 - RNA, 20 nt, Human
cagagaaagaagagacagga

SEQ ID NO: 2395164 - RNA, 21 nt, Human
cagagaaagaagagacaggag

SEQ ID NO: 2395165 - RNA, 22 nt, Human
cagagaaagaagagacaggagg

SEQ ID NO: 2395166 - RNA, 23 nt, Human
cagagaaagaagagacaggaggg

SEQ ID NO: 2395167 - RNA, 13 nt, Human
cagagaaagagga

SEQ ID NO: 2395168 - RNA, 15 nt, Human
cagagaaagaggaag

SEQ ID NO: 2395169 - RNA, 17 nt, Human
cagagaaagaggaagcu

SEQ ID NO: 2395170 - RNA, 19 nt, Human
cagagaaaguacuucucca

SEQ ID NO: 2395171 - RNA, 23 nt, Human
cagagaaaguacuucuccacccu

SEQ ID NO: 2395172 - RNA, 20 nt, Human
cagacuuuuuuuaaauagua

SEQ ID NO: 2395173 - RNA, 15 nt, Human
cagagaaagaagaga

SEQ ID NO: 2395174 - RNA, 18 nt, Human
cagagaaagaagagacag

SEQ ID NO: 2395175 - RNA, 14 nt, Human
cagacucccauucc

SEQ ID NO: 2395176 - RNA, 18 nt, Human
cagacucccauuccugaa

SEQ ID NO: 2395177 - RNA, 17 nt, Human
cagacucccauuccuga

SEQ ID NO: 2395178 - RNA, 20 nt, Human
cagacucacaaccugaaccu

SEQ ID NO: 2395179 - RNA, 21 nt, Human
cagacucacaaccugaaccua

SEQ ID NO: 2395180 - RNA, 14 nt, Human
cagacucagacauu

SEQ ID NO: 2395181 - RNA, 18 nt, Human
cagacucaguuugucaga

SEQ ID NO: 2395182 - RNA, 17 nt, Human
cagacucaguuugucag

SEQ ID NO: 2395183 - RNA, 14 nt, Human
cagacucaauaaaa

SEQ ID NO: 2395184 - RNA, 16 nt, Human
cagacucaguuuguca

SEQ ID NO: 2395185 - RNA, 15 nt, Human
cagacuucacacugc

SEQ ID NO: 2395186 - RNA, 21 nt, Human
cagacuucccugaauguauug

SEQ ID NO: 2395187 - RNA, 15 nt, Human
cagacuuccuugaga

SEQ ID NO: 2395188 - RNA, 16 nt, Human
cagacuucuccagacc

SEQ ID NO: 2395189 - RNA, 15 nt, Human
cagacuucuccagac

SEQ ID NO: 2395190 - RNA, 14 nt, Human
cagacuucuccaga

SEQ ID NO: 2395191 - RNA, 13 nt, Human
cagacuucuccag

SEQ ID NO: 2395192 - RNA, 24 nt, Human
cagacuuccuugagacacggagcc

SEQ ID NO: 2395193 - RNA, 15 nt, Human
cagacuuuaaagaau

SEQ ID NO: 2395194 - RNA, 20 nt, Human
cagacuucuccagacccacc

SEQ ID NO: 2395195 - RNA, 23 nt, Human
cagacuuuggaaaaugcauugua

SEQ ID NO: 2395196 - RNA, 22 nt, Human
cagacuuuggaaaaugcauugu

SEQ ID NO: 2395197 - RNA, 19 nt, Human
cagacuuuggaaaaugcau

SEQ ID NO: 2395198 - RNA, 20 nt, Human
cagacuuuacaugacacagc

SEQ ID NO: 2395199 - RNA, 21 nt, Human
cagacuuuacaugacacagcu

SEQ ID NO: 2395200 - RNA, 20 nt, Human
cagacuuugcuucccauugu

SEQ ID NO: 2395201 - RNA, 13 nt, Human
cagaccugccucu

SEQ ID NO: 2395202 - RNA, 16 nt, Human
cagaccugccucuucc

SEQ ID NO: 2395203 - RNA, 22 nt, Human
cagaccugagcuccccaccacc

SEQ ID NO: 2395204 - RNA, 13 nt, Human
cagaccuggagcc

SEQ ID NO: 2395205 - RNA, 14 nt, Human
cagaccuggagccc

SEQ ID NO: 2395206 - RNA, 23 nt, Human
cagaccugauccuggaggcccag

SEQ ID NO: 2395207 - RNA, 22 nt, Human
cagaccugauccuggaggccca

SEQ ID NO: 2395208 - RNA, 20 nt, Human
cagaccugauccuggaggcc

SEQ ID NO: 2395209 - RNA, 17 nt, Human
cagaccugauccuggag

SEQ ID NO: 2395210 - RNA, 17 nt, Human
cagaccugagcucccca

SEQ ID NO: 2395211 - RNA, 12 nt, Human
cagaccugagcu

SEQ ID NO: 2395212 - RNA, 23 nt, Human
cagaccuccccagccccuagccc

SEQ ID NO: 2395213 - RNA, 14 nt, Human
cagaccugauccug

SEQ ID NO: 2395214 - RNA, 13 nt, Human
cagaccugauccu

SEQ ID NO: 2395215 - RNA, 12 nt, Human
cagaccucccca

SEQ ID NO: 2395216 - RNA, 14 nt, Human
cagaccuccccagc

SEQ ID NO: 2395217 - RNA, 15 nt, Human
cagaccuccccagcc

SEQ ID NO: 2395218 - RNA, 16 nt, Human
cagaccuccccagccc

SEQ ID NO: 2395219 - RNA, 18 nt, Human
cagaccuccccagccccu

SEQ ID NO: 2395220 - RNA, 19 nt, Human
cagaccuccccagccccua

SEQ ID NO: 2395221 - RNA, 21 nt, Human
cagaccuccccagccccuagc

SEQ ID NO: 2395222 - RNA, 22 nt, Human
cagaccuccccagccccuagcc

SEQ ID NO: 2395223 - RNA, 23 nt, Human
cagacgccggggacagaggccug

SEQ ID NO: 2395224 - RNA, 13 nt, Human
cagaccuuuuauc

SEQ ID NO: 2395225 - RNA, 16 nt, Human
cagacgccugaggaac

SEQ ID NO: 2395226 - RNA, 15 nt, Human
cagaccuuugaggau

SEQ ID NO: 2395227 - RNA, 21 nt, Human
cagaccuucuaggacgccacc

SEQ ID NO: 2395228 - RNA, 19 nt, Human
cagaccuuguucacacucu

SEQ ID NO: 2395229 - RNA, 17 nt, Human
cagacgcacgugggucu

SEQ ID NO: 2395230 - RNA, 20 nt, Human
cagaccuguuagcagacagg

SEQ ID NO: 2395231 - RNA, 19 nt, Human
cagaccuguuagcagacag

SEQ ID NO: 2395232 - RNA, 23 nt, Human
cagaccuggagccccuggguggg

SEQ ID NO: 2395233 - RNA, 12 nt, Human
cagaccuguccu

SEQ ID NO: 2395234 - RNA, 13 nt, Human
cagaccuguccuc

SEQ ID NO: 2395235 - RNA, 17 nt, Human
cagaccuguccuccugg

SEQ ID NO: 2395236 - RNA, 15 nt, Human
cagaccuggagcccc

SEQ ID NO: 2395237 - RNA, 16 nt, Human
cagaccuggagccccu

SEQ ID NO: 2395238 - RNA, 17 nt, Human
cagaccuggagccccug

SEQ ID NO: 2395239 - RNA, 18 nt, Human
cagaccuggagccccugg

SEQ ID NO: 2395240 - RNA, 19 nt, Human
cagaccuggagccccuggg

SEQ ID NO: 2395241 - RNA, 20 nt, Human
cagaccuggagccccugggu

SEQ ID NO: 2395242 - RNA, 21 nt, Human
cagaccuggagccccugggug

SEQ ID NO: 2395243 - RNA, 22 nt, Human
cagaccuggagccccugggugg

SEQ ID NO: 2395244 - RNA, 19 nt, Human
cagacucacaaccugaacc

SEQ ID NO: 2395245 - RNA, 23 nt, Human
cagacucaaaugcucagaccagc

SEQ ID NO: 2395246 - RNA, 22 nt, Human
cagacucaaaugcucagaccag

SEQ ID NO: 2395247 - RNA, 19 nt, Human
cagacuauuuaacuugagg

SEQ ID NO: 2395248 - RNA, 22 nt, Human
cagacuaguuuaguuaaaugag

SEQ ID NO: 2395249 - RNA, 18 nt, Human
cagacuauuuaacuugag

SEQ ID NO: 2395250 - RNA, 22 nt, Human
cagacuagaauucuagugcugc

SEQ ID NO: 2395251 - RNA, 23 nt, Human
cagacuagaauucuagugcugcu

SEQ ID NO: 2395252 - RNA, 15 nt, Human
cagacgucccuccac

SEQ ID NO: 2395253 - RNA, 20 nt, Human
cagacguaugcuuauuuuaa

SEQ ID NO: 2395254 - RNA, 19 nt, Human
cagacgguucaccagccuc

SEQ ID NO: 2395255 - RNA, 17 nt, Human
cagacguaggggagggg

SEQ ID NO: 2395256 - RNA, 17 nt, Human
cagacgguucaccagcc

SEQ ID NO: 2395257 - RNA, 17 nt, Human
cagacggcacccaccca

SEQ ID NO: 2395258 - RNA, 16 nt, Human
cagacggcacccaccc

SEQ ID NO: 2395259 - RNA, 15 nt, Human
cagacggcacccacc

SEQ ID NO: 2395260 - RNA, 15 nt, Human
cagaagggagaagga

SEQ ID NO: 2395261 - RNA, 19 nt, Human
cagaagggacuucacgaag

SEQ ID NO: 2395262 - RNA, 17 nt, Human
cagaaggcucuucugac

SEQ ID NO: 2395263 - RNA, 10 nt, Human
cagaagggag

SEQ ID NO: 2395264 - RNA, 12 nt, Human
cagaaggcucuu

SEQ ID NO: 2395265 - RNA, 14 nt, Human
cagaaggcucuucu

SEQ ID NO: 2395266 - RNA, 12 nt, Human
cagaagggaggc

SEQ ID NO: 2395267 - RNA, 15 nt, Human
cagaagggaggcugg

SEQ ID NO: 2395268 - RNA, 16 nt, Human
cagaagggggccauga

SEQ ID NO: 2395269 - RNA, 15 nt, Human
cagaagggggccaug

SEQ ID NO: 2395270 - RNA, 14 nt, Human
cagaagggggccau

SEQ ID NO: 2395271 - RNA, 17 nt, Human
cagaagggggagaccaa

SEQ ID NO: 2395272 - RNA, 18 nt, Human
cagaagggggccaugagg

SEQ ID NO: 2395273 - RNA, 14 nt, Human
cagaaggggguggu

SEQ ID NO: 2395274 - RNA, 20 nt, Human
cagaaggggaggggagacag

SEQ ID NO: 2395275 - RNA, 15 nt, Human
cagaaggggagggga

SEQ ID NO: 2395276 - RNA, 16 nt, Human
cagaagguugugauga

SEQ ID NO: 2395277 - RNA, 23 nt, Human
cagaagguugcucuagauugaga

SEQ ID NO: 2395278 - RNA, 15 nt, Human
cagaagguauuccuu

SEQ ID NO: 2395279 - RNA, 19 nt, Human
cagaaggggguggugucuc

SEQ ID NO: 2395280 - RNA, 20 nt, Human
cagaaggggguggugucucc

SEQ ID NO: 2395281 - RNA, 21 nt, Human
cagaaggggguggugucucca

SEQ ID NO: 2395282 - RNA, 20 nt, Human
cagaagggguuuggucuggg

SEQ ID NO: 2395283 - RNA, 22 nt, Human
cagaagggguuuggucugggac

SEQ ID NO: 2395284 - RNA, 18 nt, Human
cagaagucaugaagccca

SEQ ID NO: 2395285 - RNA, 17 nt, Human
cagaagucaugaagccc

SEQ ID NO: 2395286 - RNA, 16 nt, Human
cagaagucaugaagcc

SEQ ID NO: 2395287 - RNA, 17 nt, Human
cagaaucuaaagccagu

SEQ ID NO: 2395288 - RNA, 15 nt, Human
cagaaucuaaagcca

SEQ ID NO: 2395289 - RNA, 16 nt, Human
cagaaucuaaagccag

SEQ ID NO: 2395290 - RNA, 18 nt, Human
cagaaucucaaauaacua

SEQ ID NO: 2395291 - RNA, 17 nt, Human
cagaaucucaaauaacu

SEQ ID NO: 2395292 - RNA, 16 nt, Human
cagaagucaagcccag

SEQ ID NO: 2395293 - RNA, 14 nt, Human
cagaaggaggagga

SEQ ID NO: 2395294 - RNA, 13 nt, Human
cagaaggaggagg

SEQ ID NO: 2395295 - RNA, 17 nt, Human
cagaaggaugaaugagg

SEQ ID NO: 2395296 - RNA, 18 nt, Human
cagaaggcaaacccauca

SEQ ID NO: 2395297 - RNA, 19 nt, Human
cagaaggcaaaugacuuug

SEQ ID NO: 2395298 - RNA, 18 nt, Human
cagaaggcaaaugacuuu

SEQ ID NO: 2395299 - RNA, 13 nt, Human
cagaaggccaaga

SEQ ID NO: 2395300 - RNA, 14 nt, Human
cagaaggccaagaa

SEQ ID NO: 2395301 - RNA, 18 nt, Human
cagaaggccaagaaucaa

SEQ ID NO: 2395302 - RNA, 13 nt, Human
cagaaggcaggga

SEQ ID NO: 2395303 - RNA, 23 nt, Human
cagaaggcauaucagucucugag

SEQ ID NO: 2395304 - RNA, 20 nt, Human
cagaaggcaaaugacuuugg

SEQ ID NO: 2395305 - RNA, 14 nt, Human
cagaaggccaagag

SEQ ID NO: 2395306 - RNA, 18 nt, Human
cagaaggccaagaggcug

SEQ ID NO: 2395307 - RNA, 20 nt, Human
cagaaggagaaggaaggaga

SEQ ID NO: 2395308 - RNA, 18 nt, Human
cagaaggagaaggaagga

SEQ ID NO: 2395309 - RNA, 14 nt, Human
cagaaggagaagga

SEQ ID NO: 2395310 - RNA, 14 nt, Human
cagaaggaccuccu

SEQ ID NO: 2395311 - RNA, 21 nt, Human
cagaaggaagggcauccuucu

SEQ ID NO: 2395312 - RNA, 19 nt, Human
cagaaggaagacuucaucc

SEQ ID NO: 2395313 - RNA, 16 nt, Human
cagaagcuucugccca

SEQ ID NO: 2395314 - RNA, 14 nt, Human
cagaagcuucagaa

SEQ ID NO: 2395315 - RNA, 17 nt, Human
cagaaggaaaaaugugu

SEQ ID NO: 2395316 - RNA, 19 nt, Human
cagaaggaaaaauguguaa

SEQ ID NO: 2395317 - RNA, 20 nt, Human
cagaaggaaaaauguguaau

SEQ ID NO: 2395318 - RNA, 18 nt, Human
cagaagcgggacgagacc

SEQ ID NO: 2395319 - RNA, 15 nt, Human
cagaagccucuggcu

SEQ ID NO: 2395320 - RNA, 14 nt, Human
cagaagccucuggc

SEQ ID NO: 2395321 - RNA, 19 nt, Human
cagaagccucuggcuagag

SEQ ID NO: 2395322 - RNA, 16 nt, Human
cagaagccucuggguc

SEQ ID NO: 2395323 - RNA, 15 nt, Human
cagaagccugaggcu

SEQ ID NO: 2395324 - RNA, 14 nt, Human
cagaagccugaggc

SEQ ID NO: 2395325 - RNA, 19 nt, Human
cagaagccugaggcuggga

SEQ ID NO: 2395326 - RNA, 18 nt, Human
cagaagccugaugcugac

SEQ ID NO: 2395327 - RNA, 16 nt, Human
cagaagcugagcacca

SEQ ID NO: 2395328 - RNA, 21 nt, Human
cagaagcugagcaccagggga

SEQ ID NO: 2395329 - RNA, 19 nt, Human
cagaagcugagcaccaggg

SEQ ID NO: 2395330 - RNA, 12 nt, Human
cagaagcuucca

SEQ ID NO: 2395331 - RNA, 16 nt, Human
cagaaggaagacuuca

SEQ ID NO: 2395332 - RNA, 17 nt, Human
cagaaggaagacuucau

SEQ ID NO: 2395333 - RNA, 18 nt, Human
cagaaggaagacuucauc

SEQ ID NO: 2395334 - RNA, 20 nt, Human
cagaagauagcuucacccca

SEQ ID NO: 2395335 - RNA, 20 nt, Human
cagaagagaugggcuuguuu

SEQ ID NO: 2395336 - RNA, 15 nt, Human
cagaagauaacuuga

SEQ ID NO: 2395337 - RNA, 22 nt, Human
cagaagauaacuugagcaccgu

SEQ ID NO: 2395338 - RNA, 15 nt, Human
cagaagauccccuca

SEQ ID NO: 2395339 - RNA, 18 nt, Human
cagaagauccccucagga

SEQ ID NO: 2395340 - RNA, 19 nt, Human
cagaagauccccucaggac

SEQ ID NO: 2395341 - RNA, 21 nt, Human
cagaagagaugggcuuguuuu

SEQ ID NO: 2395342 - RNA, 19 nt, Human
cagaagacacugcaaaggc

SEQ ID NO: 2395343 - RNA, 20 nt, Human
cagaagacaccagagcagau

SEQ ID NO: 2395344 - RNA, 21 nt, Human
cagaagacaccagagcagaug

SEQ ID NO: 2395345 - RNA, 21 nt, Human
cagaagaccacaaaaauugac

SEQ ID NO: 2395346 - RNA, 22 nt, Human
cagaagaauugaacccaggagg

SEQ ID NO: 2395347 - RNA, 14 nt, Human
cagaagacaccaga

SEQ ID NO: 2395348 - RNA, 15 nt, Human
cagaagacaccagag

SEQ ID NO: 2395349 - RNA, 16 nt, Human
cagaagacaccagagc

SEQ ID NO: 2395350 - RNA, 17 nt, Human
cagaagacaccagagca

SEQ ID NO: 2395351 - RNA, 18 nt, Human
cagaagacaccagagcag

SEQ ID NO: 2395352 - RNA, 19 nt, Human
cagaagacaccagagcaga

SEQ ID NO: 2395353 - RNA, 21 nt, Human
cagaagacacugaugggcaac

SEQ ID NO: 2395354 - RNA, 15 nt, Human
cagaagaaggcagca

SEQ ID NO: 2395355 - RNA, 18 nt, Human
cagaagaauaugacagcu

SEQ ID NO: 2395356 - RNA, 12 nt, Human
cagaagaauauu

SEQ ID NO: 2395357 - RNA, 14 nt, Human
cagaagaauauuca

SEQ ID NO: 2395358 - RNA, 15 nt, Human
cagaagaauauucag

SEQ ID NO: 2395359 - RNA, 16 nt, Human
cagaagaauauucagg

SEQ ID NO: 2395360 - RNA, 21 nt, Human
cagaagaauugaacccaggag

SEQ ID NO: 2395361 - RNA, 20 nt, Human
cagaagaauugaacccagga

SEQ ID NO: 2395362 - RNA, 19 nt, Human
cagaagaauugaacccagg

SEQ ID NO: 2395363 - RNA, 17 nt, Human
cagaagaauugaaccca

SEQ ID NO: 2395364 - RNA, 17 nt, Human
cagaagaauauucagga

SEQ ID NO: 2395365 - RNA, 18 nt, Human
cagaagaauauucaggac

SEQ ID NO: 2395366 - RNA, 19 nt, Human
cagaagaauauucaggacu

SEQ ID NO: 2395367 - RNA, 20 nt, Human
cagaagaauauucaggacuu

SEQ ID NO: 2395368 - RNA, 14 nt, Human
cagaagaaggcagc

SEQ ID NO: 2395369 - RNA, 11 nt, Human
cagaagaaaga

SEQ ID NO: 2395370 - RNA, 23 nt, Human
cagaagauccccucaggacugca

SEQ ID NO: 2395371 - RNA, 13 nt, Human
cagaagcagcucu

SEQ ID NO: 2395372 - RNA, 14 nt, Human
cagaagcaggauag

SEQ ID NO: 2395373 - RNA, 14 nt, Human
cagaagcaggcugg

SEQ ID NO: 2395374 - RNA, 14 nt, Human
cagaagcagcucuu

SEQ ID NO: 2395375 - RNA, 20 nt, Human
cagaagcaacccaaauguuc

SEQ ID NO: 2395376 - RNA, 19 nt, Human
cagaagcaacccaaauguu

SEQ ID NO: 2395377 - RNA, 13 nt, Human
cagaagccucugg

SEQ ID NO: 2395378 - RNA, 18 nt, Human
cagaagccuccccagcuc

SEQ ID NO: 2395379 - RNA, 22 nt, Human
cagaagccuccccagcucaccc

SEQ ID NO: 2395380 - RNA, 20 nt, Human
cagaagccucacugcaagca

SEQ ID NO: 2395381 - RNA, 19 nt, Human
cagaagccaggagcaaaug

SEQ ID NO: 2395382 - RNA, 14 nt, Human
cagaagcccagaau

SEQ ID NO: 2395383 - RNA, 12 nt, Human
cagaagcccaga

SEQ ID NO: 2395384 - RNA, 23 nt, Human
cagaagcaguugagucgucauca

SEQ ID NO: 2395385 - RNA, 15 nt, Human
cagaagcaggcugga

SEQ ID NO: 2395386 - RNA, 16 nt, Human
cagaagcaggcuggag

SEQ ID NO: 2395387 - RNA, 14 nt, Human
cagaagcauuaacu

SEQ ID NO: 2395388 - RNA, 15 nt, Human
cagaagccaggagca

SEQ ID NO: 2395389 - RNA, 16 nt, Human
cagaagccaggagcaa

SEQ ID NO: 2395390 - RNA, 17 nt, Human
cagaagccaggagcaaa

SEQ ID NO: 2395391 - RNA, 11 nt, Human
cagaagcccag

SEQ ID NO: 2395392 - RNA, 18 nt, Human
cagaacuggacucaggau

SEQ ID NO: 2395393 - RNA, 13 nt, Human
cagaacuggacuc

SEQ ID NO: 2395394 - RNA, 24 nt, Human
cagaacugagcuccucugggcagg

SEQ ID NO: 2395395 - RNA, 23 nt, Human
cagaacugagcuccucugggcag

SEQ ID NO: 2395396 - RNA, 20 nt, Human
cagaacugagcuccucuggg

SEQ ID NO: 2395397 - RNA, 17 nt, Human
cagaacugagcuccucu

SEQ ID NO: 2395398 - RNA, 16 nt, Human
cagaacugagcuccuc

SEQ ID NO: 2395399 - RNA, 15 nt, Human
cagaacugagcuccu

SEQ ID NO: 2395400 - RNA, 13 nt, Human
cagaacugagcuc

SEQ ID NO: 2395401 - RNA, 22 nt, Human
cagaacugaaccggcuuuacca

SEQ ID NO: 2395402 - RNA, 21 nt, Human
cagaacugaaccggcuuuacc

SEQ ID NO: 2395403 - RNA, 16 nt, Human
cagaacucuuucaaaa

SEQ ID NO: 2395404 - RNA, 15 nt, Human
cagaacucuuucaaa

SEQ ID NO: 2395405 - RNA, 14 nt, Human
cagaacucuuucaa

SEQ ID NO: 2395406 - RNA, 18 nt, Human
cagaacucacuggggccu

SEQ ID NO: 2395407 - RNA, 15 nt, Human
cagaacucacugggg

SEQ ID NO: 2395408 - RNA, 22 nt, Human
cagaacucaaauggggccagau

SEQ ID NO: 2395409 - RNA, 21 nt, Human
cagaacucaaauggggccaga

SEQ ID NO: 2395410 - RNA, 20 nt, Human
cagaacucaaauggggccag

SEQ ID NO: 2395411 - RNA, 15 nt, Human
cagaacuagaauuug

SEQ ID NO: 2395412 - RNA, 14 nt, Human
cagaaccuguccuu

SEQ ID NO: 2395413 - RNA, 21 nt, Human
cagaaccuggagggcuagaac

SEQ ID NO: 2395414 - RNA, 13 nt, Human
cagaaccuggagg

SEQ ID NO: 2395415 - RNA, 20 nt, Human
cagaaccuggagggcuagaa

SEQ ID NO: 2395416 - RNA, 21 nt, Human
cagaaccucuuccccagaaag

SEQ ID NO: 2395417 - RNA, 12 nt, Human
cagaaccuggag

SEQ ID NO: 2395418 - RNA, 21 nt, Human
cagaacggagccccaggccuc

SEQ ID NO: 2395419 - RNA, 13 nt, Human
cagaacguggcuc

SEQ ID NO: 2395420 - RNA, 15 nt, Human
cagaacguggcucug

SEQ ID NO: 2395421 - RNA, 21 nt, Human
cagaaccuuguuauuucucag

SEQ ID NO: 2395422 - RNA, 18 nt, Human
cagaaccuuguuauuucu

SEQ ID NO: 2395423 - RNA, 17 nt, Human
cagaaccuuguuauuuc

SEQ ID NO: 2395424 - RNA, 16 nt, Human
cagaaccuuguuauuu

SEQ ID NO: 2395425 - RNA, 18 nt, Human
cagaacuaaacucauuua

SEQ ID NO: 2395426 - RNA, 17 nt, Human
cagaacuaaacucauuu

SEQ ID NO: 2395427 - RNA, 18 nt, Human
cagaacguggcucugcug

SEQ ID NO: 2395428 - RNA, 19 nt, Human
cagaacguggcucugcugg

SEQ ID NO: 2395429 - RNA, 20 nt, Human
cagaacuaaacucauuuaua

SEQ ID NO: 2395430 - RNA, 19 nt, Human
cagaacuaaacucauuuau

SEQ ID NO: 2395431 - RNA, 13 nt, Human
cagaacuagaauu

SEQ ID NO: 2395432 - RNA, 19 nt, Human
cagaacuagaauuugauua

SEQ ID NO: 2395433 - RNA, 22 nt, Human
cagaacccuuggagccaaugga

SEQ ID NO: 2395434 - RNA, 23 nt, Human
cagaaccccuggcuccaggccag

SEQ ID NO: 2395435 - RNA, 10 nt, Human
cagaaccagg

SEQ ID NO: 2395436 - RNA, 23 nt, Human
cagaaccccuacaugaaacagaa

SEQ ID NO: 2395437 - RNA, 15 nt, Human
cagaaccauccauag

SEQ ID NO: 2395438 - RNA, 18 nt, Human
cagaaccucuuccccaga

SEQ ID NO: 2395439 - RNA, 16 nt, Human
cagaaccucuucccca

SEQ ID NO: 2395440 - RNA, 15 nt, Human
cagaaccucuucccc

SEQ ID NO: 2395441 - RNA, 14 nt, Human
cagaaccucuuccc

SEQ ID NO: 2395442 - RNA, 12 nt, Human
cagaaccucuuc

SEQ ID NO: 2395443 - RNA, 19 nt, Human
cagaacccuuggcuugccc

SEQ ID NO: 2395444 - RNA, 14 nt, Human
cagaacccuuggcu

SEQ ID NO: 2395445 - RNA, 19 nt, Human
cacuuucucaguuuucaua

SEQ ID NO: 2395446 - RNA, 15 nt, Human
cacuuugaaaugugu

SEQ ID NO: 2395447 - RNA, 17 nt, Human
cacuuugaaauguguuu

SEQ ID NO: 2395448 - RNA, 19 nt, Human
cacuuugaaauguguuucu

SEQ ID NO: 2395449 - RNA, 20 nt, Human
cacuuugaaauguguuucug

SEQ ID NO: 2395450 - RNA, 16 nt, Human
cacuugggucuucccu

SEQ ID NO: 2395451 - RNA, 16 nt, Human
cacuuucuauagcaga

SEQ ID NO: 2395452 - RNA, 20 nt, Human
cacuuucuauccucuguaaa

SEQ ID NO: 2395453 - RNA, 22 nt, Human
cacuuucuagccagaggagaga

SEQ ID NO: 2395454 - RNA, 13 nt, Human
cacuuugcucugg

SEQ ID NO: 2395455 - RNA, 12 nt, Human
cacuuugcucug

SEQ ID NO: 2395456 - RNA, 19 nt, Human
cacuuugcucuggguggaa

SEQ ID NO: 2395457 - RNA, 22 nt, Human
cacuuugcacugauauaucaug

SEQ ID NO: 2395458 - RNA, 12 nt, Human
cacuuugcauaa

SEQ ID NO: 2395459 - RNA, 14 nt, Human
cacuuugcacagcu

SEQ ID NO: 2395460 - RNA, 19 nt, Human
cacuuugcacugauauauc

SEQ ID NO: 2395461 - RNA, 17 nt, Human
cacuuugcacagcucuc

SEQ ID NO: 2395462 - RNA, 23 nt, Human
cacuuugggaggccaaggagggc

SEQ ID NO: 2395463 - RNA, 14 nt, Human
cacuuugggaggcc

SEQ ID NO: 2395464 - RNA, 20 nt, Human
cacuuugguacauggccagu

SEQ ID NO: 2395465 - RNA, 19 nt, Human
cacuuugguacauggccag

SEQ ID NO: 2395466 - RNA, 16 nt, Human
cacuuugggaggccaa

SEQ ID NO: 2395467 - RNA, 13 nt, Human
cacuuugggaggc

SEQ ID NO: 2395468 - RNA, 12 nt, Human
cacuuugggagg

SEQ ID NO: 2395469 - RNA, 13 nt, Human
cacuuuguucugg

SEQ ID NO: 2395470 - RNA, 14 nt, Human
cacuuuguucuggc

SEQ ID NO: 2395471 - RNA, 16 nt, Human
cacuuuguucuggcuc

SEQ ID NO: 2395472 - RNA, 23 nt, Human
cacuuuguucuggcucuuccagg

SEQ ID NO: 2395473 - RNA, 23 nt, Human
cacuuuuuuuuuccaaaaaaaua

SEQ ID NO: 2395474 - RNA, 14 nt, Human
cacuuuuuuuuucc

SEQ ID NO: 2395475 - RNA, 16 nt, Human
cacuuuuuuuuuccaa

SEQ ID NO: 2395476 - RNA, 21 nt, Human
cacuuuuuugaguggaugaug

SEQ ID NO: 2395477 - RNA, 21 nt, Human
cacuuuuuuggggauaugcuu

SEQ ID NO: 2395478 - RNA, 12 nt, Human
cacuuuuuucca

SEQ ID NO: 2395479 - RNA, 14 nt, Human
cacuuuuuuccaca

SEQ ID NO: 2395480 - RNA, 19 nt, Human
cagaaaacgguuaaaacug

SEQ ID NO: 2395481 - RNA, 14 nt, Human
cagaaaaccccagc

SEQ ID NO: 2395482 - RNA, 16 nt, Human
cagaaaacauguuucc

SEQ ID NO: 2395483 - RNA, 11 nt, Human
cagaaaacauu

SEQ ID NO: 2395484 - RNA, 12 nt, Human
cagaaaacauug

SEQ ID NO: 2395485 - RNA, 13 nt, Human
cagaaaacauugu

SEQ ID NO: 2395486 - RNA, 14 nt, Human
cagaaaacauuguu

SEQ ID NO: 2395487 - RNA, 16 nt, Human
cagaaaacauuguucc

SEQ ID NO: 2395488 - RNA, 18 nt, Human
cagaaaacauuguuccag

SEQ ID NO: 2395489 - RNA, 19 nt, Human
cagaaaaacucugggaaau

SEQ ID NO: 2395490 - RNA, 19 nt, Human
cagaaaaacguguugccuu

SEQ ID NO: 2395491 - RNA, 16 nt, Human
cagaaaaacucuggga

SEQ ID NO: 2395492 - RNA, 21 nt, Human
cagaaaaauaacuucaagcaa

SEQ ID NO: 2395493 - RNA, 19 nt, Human
cacuuugggaggccaagga

SEQ ID NO: 2395494 - RNA, 12 nt, Human
cacuuuguucuu

SEQ ID NO: 2395495 - RNA, 18 nt, Human
cacuuuguucuuuaggag

SEQ ID NO: 2395496 - RNA, 20 nt, Human
cacuuugucgcccaggcugg

SEQ ID NO: 2395497 - RNA, 14 nt, Human
cacuuuguucuuua

SEQ ID NO: 2395498 - RNA, 17 nt, Human
cacuuuuaauaaacuuu

SEQ ID NO: 2395499 - RNA, 20 nt, Human
cacuuuguuucguggggagg

SEQ ID NO: 2395500 - RNA, 21 nt, Human
cacuuuguuucguggggaggu

SEQ ID NO: 2395501 - RNA, 13 nt, Human
cacuuuucaguga

SEQ ID NO: 2395502 - RNA, 18 nt, Human
cacuuuuauuuagcacca

SEQ ID NO: 2395503 - RNA, 12 nt, Human
cacuuuucucca

SEQ ID NO: 2395504 - RNA, 18 nt, Human
cacuuuugacaaaggcaa

SEQ ID NO: 2395505 - RNA, 17 nt, Human
cacuuuugacaaaggca

SEQ ID NO: 2395506 - RNA, 16 nt, Human
cacuuuuccucccuca

SEQ ID NO: 2395507 - RNA, 14 nt, Human
cacuuuuguucuug

SEQ ID NO: 2395508 - RNA, 19 nt, Human
cacuuuuucauuugccuau

SEQ ID NO: 2395509 - RNA, 20 nt, Human
cacuuuuucauuugccuauu

SEQ ID NO: 2395510 - RNA, 22 nt, Human
cacuuuugguuaagucuguuuu

SEQ ID NO: 2395511 - RNA, 22 nt, Human
cacuuuuguucuugguuuguaa

SEQ ID NO: 2395512 - RNA, 22 nt, Human
cagaaacaucaguuacucugaa

SEQ ID NO: 2395513 - RNA, 19 nt, Human
cagaaacaucaguuacucu

SEQ ID NO: 2395514 - RNA, 17 nt, Human
cagaaacaucaguuacu

SEQ ID NO: 2395515 - RNA, 22 nt, Human
cagaaacaggugcaucugggga

SEQ ID NO: 2395516 - RNA, 18 nt, Human
cagaaacaggugcaucug

SEQ ID NO: 2395517 - RNA, 23 nt, Human
cagaaacacccucacacugggac

SEQ ID NO: 2395518 - RNA, 22 nt, Human
cagaaacacccucacacuggga

SEQ ID NO: 2395519 - RNA, 18 nt, Human
cagaaacacccucacacu

SEQ ID NO: 2395520 - RNA, 21 nt, Human
cagaaacacccucacacuggg

SEQ ID NO: 2395521 - RNA, 20 nt, Human
cagaaacacccucacacugg

SEQ ID NO: 2395522 - RNA, 19 nt, Human
cagaaacuguucccaccug

SEQ ID NO: 2395523 - RNA, 14 nt, Human
cagaaaccaguuau

SEQ ID NO: 2395524 - RNA, 20 nt, Human
cagaaacgaaguagaaaggg

SEQ ID NO: 2395525 - RNA, 20 nt, Human
cagaaacuugugaaguggaa

SEQ ID NO: 2395526 - RNA, 13 nt, Human
cagaaaccaguua

SEQ ID NO: 2395527 - RNA, 15 nt, Human
cagaaacagugaguu

SEQ ID NO: 2395528 - RNA, 23 nt, Human
cagaaacaucaguuacucugaag

SEQ ID NO: 2395529 - RNA, 15 nt, Human
cagaaaccaguuaug

SEQ ID NO: 2395530 - RNA, 24 nt, Human
cagaaagaaguggggacagagcag

SEQ ID NO: 2395531 - RNA, 19 nt, Human
cagaaagauggaugugcuu

SEQ ID NO: 2395532 - RNA, 20 nt, Human
cagaaagacugagcucaagg

SEQ ID NO: 2395533 - RNA, 18 nt, Human
cagaaagcagaacaguga

SEQ ID NO: 2395534 - RNA, 16 nt, Human
cagaacaguuuguaca

SEQ ID NO: 2395535 - RNA, 23 nt, Human
cagaacagugauuaccagggacu

SEQ ID NO: 2395536 - RNA, 16 nt, Human
cagaacaucauuagaa

SEQ ID NO: 2395537 - RNA, 15 nt, Human
cagaacaucauuaga

SEQ ID NO: 2395538 - RNA, 17 nt, Human
cagaacaucauuagaac

SEQ ID NO: 2395539 - RNA, 18 nt, Human
cagaacaucauuagaaca

SEQ ID NO: 2395540 - RNA, 18 nt, Human
cagaaccagaugaguaaa

SEQ ID NO: 2395541 - RNA, 14 nt, Human
cagaaagccuauca

SEQ ID NO: 2395542 - RNA, 16 nt, Human
cagaaagccuaucaaa

SEQ ID NO: 2395543 - RNA, 22 nt, Human
cagaaagccuaucaaagaccuu

SEQ ID NO: 2395544 - RNA, 15 nt, Human
cagaaagcugccugg

SEQ ID NO: 2395545 - RNA, 14 nt, Human
cagaaagcugccug

SEQ ID NO: 2395546 - RNA, 19 nt, Human
cagaaagccugggugacau

SEQ ID NO: 2395547 - RNA, 22 nt, Human
cagaaagccugggugacauuug

SEQ ID NO: 2395548 - RNA, 21 nt, Human
cagaaagauggaugugcuuug

SEQ ID NO: 2395549 - RNA, 18 nt, Human
cagaaagcauaaaauucu

SEQ ID NO: 2395550 - RNA, 16 nt, Human
cagaaagcauuacauu

SEQ ID NO: 2395551 - RNA, 19 nt, Human
cagaaagcagaacagugau

SEQ ID NO: 2395552 - RNA, 20 nt, Human
cagaaaacgguuaaaacugu

SEQ ID NO: 2395553 - RNA, 14 nt, Human
cagaaaagcaccug

SEQ ID NO: 2395554 - RNA, 19 nt, Human
cagaaaagcaccugccgac

SEQ ID NO: 2395555 - RNA, 17 nt, Human
cagaaaagcaccugccg

SEQ ID NO: 2395556 - RNA, 16 nt, Human
cagaaaagcaccugcc

SEQ ID NO: 2395557 - RNA, 15 nt, Human
cagaaaagcaccugc

SEQ ID NO: 2395558 - RNA, 13 nt, Human
cagaaaaggacag

SEQ ID NO: 2395559 - RNA, 14 nt, Human
cagaaaaggacaga

SEQ ID NO: 2395560 - RNA, 17 nt, Human
cagaaaagggaaguugu

SEQ ID NO: 2395561 - RNA, 18 nt, Human
cagaaaagggaaguugug

SEQ ID NO: 2395562 - RNA, 21 nt, Human
cagaaaauauacuguaaagaa

SEQ ID NO: 2395563 - RNA, 20 nt, Human
cagaaaauauacuguaaaga

SEQ ID NO: 2395564 - RNA, 19 nt, Human
cagaaaauauacuguaaag

SEQ ID NO: 2395565 - RNA, 18 nt, Human
cagaaaauauacuguaaa

SEQ ID NO: 2395566 - RNA, 11 nt, Human
cagaaaauaua

SEQ ID NO: 2395567 - RNA, 13 nt, Human
cagaaaauauacu

SEQ ID NO: 2395568 - RNA, 12 nt, Human
cagaaaauauac

SEQ ID NO: 2395569 - RNA, 17 nt, Human
cagaaaauauacuguaa

SEQ ID NO: 2395570 - RNA, 16 nt, Human
cagaaaauauacugua

SEQ ID NO: 2395571 - RNA, 15 nt, Human
cagaaaauauacugu

SEQ ID NO: 2395572 - RNA, 14 nt, Human
cagaaaauauacug

SEQ ID NO: 2395573 - RNA, 16 nt, Human
cagaaaauggaagaca

SEQ ID NO: 2395574 - RNA, 20 nt, Human
cagaaaauggaagacagcuc

SEQ ID NO: 2395575 - RNA, 21 nt, Human
cagaaaauggaagacagcucu

SEQ ID NO: 2395576 - RNA, 22 nt, Human
cagaaaauggaagacagcucuu

SEQ ID NO: 2395577 - RNA, 23 nt, Human
cagaaaauggaagacagcucuua

SEQ ID NO: 2395578 - RNA, 14 nt, Human
cagaaaauguugag

SEQ ID NO: 2395579 - RNA, 19 nt, Human
cagaaaauauuauguguuu

SEQ ID NO: 2395580 - RNA, 20 nt, Human
cagaaacaaaaacacuaaaa

SEQ ID NO: 2395581 - RNA, 18 nt, Human
cagaaacaaaaacacuaa

SEQ ID NO: 2395582 - RNA, 16 nt, Human
cagaaaauugcacaau

SEQ ID NO: 2395583 - RNA, 23 nt, Human
cagaaaauguugagaaucccaaa

SEQ ID NO: 2395584 - RNA, 18 nt, Human
cagaaaauguugagaauc

SEQ ID NO: 2395585 - RNA, 16 nt, Human
cagacaacaaaccugu

SEQ ID NO: 2395586 - RNA, 20 nt, Human
cagaggagagucccagagca

SEQ ID NO: 2395587 - RNA, 22 nt, Human
cagaggagagucccagagcagg

SEQ ID NO: 2395588 - RNA, 20 nt, Human
cagaggagagaggacccccu

SEQ ID NO: 2395589 - RNA, 14 nt, Human
cagaggagggcagc

SEQ ID NO: 2395590 - RNA, 18 nt, Human
cagaggagggcagcagaa

SEQ ID NO: 2395591 - RNA, 23 nt, Human
cagaggagagucccagagcagga

SEQ ID NO: 2395592 - RNA, 11 nt, Human
cagaggcagcc

SEQ ID NO: 2395593 - RNA, 23 nt, Human
cagaggaugagcucuacccaggg

SEQ ID NO: 2395594 - RNA, 21 nt, Human
cagaggaguacaggugaagca

SEQ ID NO: 2395595 - RNA, 13 nt, Human
cagaggauggcca

SEQ ID NO: 2395596 - RNA, 15 nt, Human
cagaggauggccagu

SEQ ID NO: 2395597 - RNA, 16 nt, Human
cagaggauggccagug

SEQ ID NO: 2395598 - RNA, 17 nt, Human
cagaggauggccagugu

SEQ ID NO: 2395599 - RNA, 18 nt, Human
cagaggauggccaguguc

SEQ ID NO: 2395600 - RNA, 13 nt, Human
cagaggaggggcc

SEQ ID NO: 2395601 - RNA, 22 nt, Human
cagaggagggcagcagaagggg

SEQ ID NO: 2395602 - RNA, 20 nt, Human
cagaggaggggccgcugcca

SEQ ID NO: 2395603 - RNA, 17 nt, Human
cagaggaguacagguga

SEQ ID NO: 2395604 - RNA, 19 nt, Human
cagaggaggggccgcugcc

SEQ ID NO: 2395605 - RNA, 14 nt, Human
cagaggaggggccg

SEQ ID NO: 2395606 - RNA, 21 nt, Human
cagaggaugagcucuacccag

SEQ ID NO: 2395607 - RNA, 19 nt, Human
cagaggaugagcucuaccc

SEQ ID NO: 2395608 - RNA, 17 nt, Human
cagaggaugagcucuac

SEQ ID NO: 2395609 - RNA, 15 nt, Human
cagaggaugagcucu

SEQ ID NO: 2395610 - RNA, 22 nt, Human
cagaggacucacuugcccacac

SEQ ID NO: 2395611 - RNA, 13 nt, Human
cagaggagagagg

SEQ ID NO: 2395612 - RNA, 15 nt, Human
cagaggagagaggac

SEQ ID NO: 2395613 - RNA, 19 nt, Human
cagaggagagaggaccccc

SEQ ID NO: 2395614 - RNA, 16 nt, Human
cagaggaagagcaggc

SEQ ID NO: 2395615 - RNA, 18 nt, Human
cagaggaaucacucuugu

SEQ ID NO: 2395616 - RNA, 23 nt, Human
cagaggaaucacucuuguggaug

SEQ ID NO: 2395617 - RNA, 21 nt, Human
cagaggaaggggccagaggcu

SEQ ID NO: 2395618 - RNA, 20 nt, Human
cagaggaaggggccagaggc

SEQ ID NO: 2395619 - RNA, 19 nt, Human
cagaggaaggggccagagg

SEQ ID NO: 2395620 - RNA, 18 nt, Human
cagaggaaggggccagag

SEQ ID NO: 2395621 - RNA, 13 nt, Human
cagaggacagauc

SEQ ID NO: 2395622 - RNA, 23 nt, Human
cagaggacagaucaauggcgcag

SEQ ID NO: 2395623 - RNA, 22 nt, Human
cagaggacaguauuugugggga

SEQ ID NO: 2395624 - RNA, 20 nt, Human
cagagccccacacggaggca

SEQ ID NO: 2395625 - RNA, 23 nt, Human
cagagccccacacggaggcaucu

SEQ ID NO: 2395626 - RNA, 16 nt, Human
cagagccccacacgga

SEQ ID NO: 2395627 - RNA, 13 nt, Human
cagagccccacac

SEQ ID NO: 2395628 - RNA, 14 nt, Human
cagagcccagcucc

SEQ ID NO: 2395629 - RNA, 23 nt, Human
cagagcccacgcccccacuggug

SEQ ID NO: 2395630 - RNA, 13 nt, Human
cagagcccagcuc

SEQ ID NO: 2395631 - RNA, 11 nt, Human
cagagcccagc

SEQ ID NO: 2395632 - RNA, 17 nt, Human
cagagcccacgccccca

SEQ ID NO: 2395633 - RNA, 19 nt, Human
cagagcccacgcccccacu

SEQ ID NO: 2395634 - RNA, 20 nt, Human
cagagcccacgcccccacug

SEQ ID NO: 2395635 - RNA, 21 nt, Human
cagagcccacgcccccacugg

SEQ ID NO: 2395636 - RNA, 12 nt, Human
cagagccugcag

SEQ ID NO: 2395637 - RNA, 20 nt, Human
cagagccgugguccuuuggg

SEQ ID NO: 2395638 - RNA, 19 nt, Human
cagagccgugguccuuugg

SEQ ID NO: 2395639 - RNA, 12 nt, Human
cagaggaagagc

SEQ ID NO: 2395640 - RNA, 22 nt, Human
cagaggaacuguccagagagca

SEQ ID NO: 2395641 - RNA, 20 nt, Human
cagaggaacuguccagagag

SEQ ID NO: 2395642 - RNA, 21 nt, Human
cagaggaacuguccagagagc

SEQ ID NO: 2395643 - RNA, 15 nt, Human
cagaggaagagcagg

SEQ ID NO: 2395644 - RNA, 14 nt, Human
cagaggaagagcag

SEQ ID NO: 2395645 - RNA, 16 nt, Human
cagaggaaggggccag

SEQ ID NO: 2395646 - RNA, 13 nt, Human
cagaggaaggaga

SEQ ID NO: 2395647 - RNA, 13 nt, Human
cagagccugcagu

SEQ ID NO: 2395648 - RNA, 17 nt, Human
cagaggaacuguccaga

SEQ ID NO: 2395649 - RNA, 19 nt, Human
cagaggaacuguccagaga

SEQ ID NO: 2395650 - RNA, 20 nt, Human
cagaggaaagcaaaggagau

SEQ ID NO: 2395651 - RNA, 20 nt, Human
cagagcacuggguugcaggg

SEQ ID NO: 2395652 - RNA, 23 nt, Human
cagagcaccuuagacagucccug

SEQ ID NO: 2395653 - RNA, 11 nt, Human
cagagcagaga

SEQ ID NO: 2395654 - RNA, 12 nt, Human
cagagcagagac

SEQ ID NO: 2395655 - RNA, 18 nt, Human
cagagcaccuuagacagu

SEQ ID NO: 2395656 - RNA, 19 nt, Human
cagagcaccuuagacaguc

SEQ ID NO: 2395657 - RNA, 21 nt, Human
cagagcaccuuagacaguccc

SEQ ID NO: 2395658 - RNA, 22 nt, Human
cagagcaccuuagacagucccu

SEQ ID NO: 2395659 - RNA, 13 nt, Human
cagagcagagacc

SEQ ID NO: 2395660 - RNA, 14 nt, Human
cagagcagagacca

SEQ ID NO: 2395661 - RNA, 15 nt, Human
cagagcagagaccau

SEQ ID NO: 2395662 - RNA, 17 nt, Human
cagagcagagaccaucc

SEQ ID NO: 2395663 - RNA, 18 nt, Human
cagagcagagaccauccc

SEQ ID NO: 2395664 - RNA, 19 nt, Human
cagagcagagaccaucccu

SEQ ID NO: 2395665 - RNA, 21 nt, Human
cagagcagagaccaucccuga

SEQ ID NO: 2395666 - RNA, 13 nt, Human
cagagcagaugca

SEQ ID NO: 2395667 - RNA, 14 nt, Human
cagagcagaugcag

SEQ ID NO: 2395668 - RNA, 15 nt, Human
cagagcagaugcaga

SEQ ID NO: 2395669 - RNA, 16 nt, Human
cagagcagaugcagag

SEQ ID NO: 2395670 - RNA, 19 nt, Human
cagagcagaugcagagagc

SEQ ID NO: 2395671 - RNA, 20 nt, Human
cagagcagaugcagagagcc

SEQ ID NO: 2395672 - RNA, 21 nt, Human
cagagcagaugcagagagcca

SEQ ID NO: 2395673 - RNA, 13 nt, Human
cagagcagcagug

SEQ ID NO: 2395674 - RNA, 15 nt, Human
cagagcaggggcagg

SEQ ID NO: 2395675 - RNA, 14 nt, Human
cagagcaggggcag

SEQ ID NO: 2395676 - RNA, 17 nt, Human
cagagcaggaggccccu

SEQ ID NO: 2395677 - RNA, 18 nt, Human
cagagcaggaggccccug

SEQ ID NO: 2395678 - RNA, 19 nt, Human
cagagcaggaggccccugg

SEQ ID NO: 2395679 - RNA, 23 nt, Human
cagagcaggaggccccuggccca

SEQ ID NO: 2395680 - RNA, 21 nt, Human
cagagcaggaagcauucagag

SEQ ID NO: 2395681 - RNA, 20 nt, Human
cagagcagcagugaaaacaa

SEQ ID NO: 2395682 - RNA, 14 nt, Human
cagagcaggacugc

SEQ ID NO: 2395683 - RNA, 14 nt, Human
cagagcaggaggcc

SEQ ID NO: 2395684 - RNA, 15 nt, Human
cagagcaggaggccc

SEQ ID NO: 2395685 - RNA, 21 nt, Human
cagagcagugggccuggccag

SEQ ID NO: 2395686 - RNA, 20 nt, Human
cagagcagugggccuggcca

SEQ ID NO: 2395687 - RNA, 17 nt, Human
cagagcagugggccugg

SEQ ID NO: 2395688 - RNA, 15 nt, Human
cagagcagugggccu

SEQ ID NO: 2395689 - RNA, 22 nt, Human
cagagccaccccuaaagagaua

SEQ ID NO: 2395690 - RNA, 21 nt, Human
cagagcauuuccaacaccaca

SEQ ID NO: 2395691 - RNA, 23 nt, Human
cagagcauuacgugagccaggua

SEQ ID NO: 2395692 - RNA, 19 nt, Human
cagagcauuacgugagcca

SEQ ID NO: 2395693 - RNA, 20 nt, Human
cagagcauuacgugagccag

SEQ ID NO: 2395694 - RNA, 21 nt, Human
cagagcauuacgugagccagg

SEQ ID NO: 2395695 - RNA, 22 nt, Human
cagagcauuacgugagccaggu

SEQ ID NO: 2395696 - RNA, 18 nt, Human
cagagcauuacgugagcc

SEQ ID NO: 2395697 - RNA, 23 nt, Human
cagagcagggguccuugguguga

SEQ ID NO: 2395698 - RNA, 22 nt, Human
cagagcagugggccuggccagc

SEQ ID NO: 2395699 - RNA, 14 nt, Human
cagagccauggacu

SEQ ID NO: 2395700 - RNA, 11 nt, Human
cagagccaugg

SEQ ID NO: 2395701 - RNA, 17 nt, Human
cagagccaugcugggaa

SEQ ID NO: 2395702 - RNA, 23 nt, Human
cagagccaggggggugaggagcu

SEQ ID NO: 2395703 - RNA, 15 nt, Human
cagagcccaccuugg

SEQ ID NO: 2395704 - RNA, 17 nt, Human
cagagcccaccuuggcu

SEQ ID NO: 2395705 - RNA, 19 nt, Human
cagagcccaccuuggcuca

SEQ ID NO: 2395706 - RNA, 20 nt, Human
cagagcccaccuuggcucaa

SEQ ID NO: 2395707 - RNA, 16 nt, Human
cagagcccacgccccc

SEQ ID NO: 2395708 - RNA, 22 nt, Human
cagagauaguggggagacuucu

SEQ ID NO: 2395709 - RNA, 20 nt, Human
cagagauccaaaagaagccc

SEQ ID NO: 2395710 - RNA, 19 nt, Human
cagagauccaaaagaagcc

SEQ ID NO: 2395711 - RNA, 15 nt, Human
cagagaguggcuccu

SEQ ID NO: 2395712 - RNA, 18 nt, Human
cagagaguggcuccuccc

SEQ ID NO: 2395713 - RNA, 13 nt, Human
cagagaguggcuc

SEQ ID NO: 2395714 - RNA, 14 nt, Human
cagagaguggcucc

SEQ ID NO: 2395715 - RNA, 16 nt, Human
cagagaccuccugccu

SEQ ID NO: 2395716 - RNA, 23 nt, Human
cagagagucccacugccucaggu

SEQ ID NO: 2395717 - RNA, 14 nt, Human
cagagaguccucug

SEQ ID NO: 2395718 - RNA, 15 nt, Human
cagagaguccucugg

SEQ ID NO: 2395719 - RNA, 16 nt, Human
cagagaguccucugga

SEQ ID NO: 2395720 - RNA, 17 nt, Human
cagagaguccucuggau

SEQ ID NO: 2395721 - RNA, 18 nt, Human
cagagaguccucuggaug

SEQ ID NO: 2395722 - RNA, 19 nt, Human
cagagaguccucuggaugg

SEQ ID NO: 2395723 - RNA, 21 nt, Human
cagagaugccuccaccgcugc

SEQ ID NO: 2395724 - RNA, 19 nt, Human
cagagaugccuccaccgcu

SEQ ID NO: 2395725 - RNA, 18 nt, Human
cagagaugccuccaccgc

SEQ ID NO: 2395726 - RNA, 16 nt, Human
cagagaugccuccacc

SEQ ID NO: 2395727 - RNA, 15 nt, Human
cagagaugccuccac

SEQ ID NO: 2395728 - RNA, 14 nt, Human
cagagaugccucca

SEQ ID NO: 2395729 - RNA, 13 nt, Human
cagagaugccucc

SEQ ID NO: 2395730 - RNA, 23 nt, Human
cagagauccaaaagaagccccca

SEQ ID NO: 2395731 - RNA, 21 nt, Human
cagagauccaaaagaagcccc

SEQ ID NO: 2395732 - RNA, 20 nt, Human
cagagaugcaccaccaagcc

SEQ ID NO: 2395733 - RNA, 21 nt, Human
cagagaugcaccaccaagcca

SEQ ID NO: 2395734 - RNA, 18 nt, Human
cagagaugggacugggag

SEQ ID NO: 2395735 - RNA, 15 nt, Human
cagagaugggacugg

SEQ ID NO: 2395736 - RNA, 23 nt, Human
cagagauggagguucucucggag

SEQ ID NO: 2395737 - RNA, 21 nt, Human
cagagauggagguucucucgg

SEQ ID NO: 2395738 - RNA, 22 nt, Human
cagagaugggacugggagggcc

SEQ ID NO: 2395739 - RNA, 19 nt, Human
cagagaugggacugggagg

SEQ ID NO: 2395740 - RNA, 23 nt, Human
cagagaugggacugggagggccc

SEQ ID NO: 2395741 - RNA, 14 nt, Human
cagagaugugcacc

SEQ ID NO: 2395742 - RNA, 15 nt, Human
cagagcaagucugca

SEQ ID NO: 2395743 - RNA, 16 nt, Human
cagagcaagucugcag

SEQ ID NO: 2395744 - RNA, 17 nt, Human
cagagcaagucugcagg

SEQ ID NO: 2395745 - RNA, 20 nt, Human
cagagcaagauccugucuuu

SEQ ID NO: 2395746 - RNA, 18 nt, Human
cagagcaagauccugucu

SEQ ID NO: 2395747 - RNA, 20 nt, Human
cagagcaagacucugucuca

SEQ ID NO: 2395748 - RNA, 16 nt, Human
cagagcaaaauaauuu

SEQ ID NO: 2395749 - RNA, 14 nt, Human
cagagcaaaauaau

SEQ ID NO: 2395750 - RNA, 16 nt, Human
cagagaugugcaccca

SEQ ID NO: 2395751 - RNA, 21 nt, Human
cagagauuggaaugggcagcu

SEQ ID NO: 2395752 - RNA, 22 nt, Human
cagagauuggaaugggcagcuc

SEQ ID NO: 2395753 - RNA, 23 nt, Human
cagagauuggaaugggcagcuca

SEQ ID NO: 2395754 - RNA, 20 nt, Human
cagagcaagugagacccugu

SEQ ID NO: 2395755 - RNA, 14 nt, Human
cagagcaagugaga

SEQ ID NO: 2395756 - RNA, 18 nt, Human
cagagcacagcagccccu

SEQ ID NO: 2395757 - RNA, 18 nt, Human
cagagcaagucugcaggu

SEQ ID NO: 2395758 - RNA, 16 nt, Human
cagagcaccuuagaca

SEQ ID NO: 2395759 - RNA, 23 nt, Human
cagagacucagggccccagcacu

SEQ ID NO: 2395760 - RNA, 22 nt, Human
cagagacucagggccccagcac

SEQ ID NO: 2395761 - RNA, 21 nt, Human
cagagacucagggccccagca

SEQ ID NO: 2395762 - RNA, 20 nt, Human
cagagacucagggccccagc

SEQ ID NO: 2395763 - RNA, 13 nt, Human
cagagacuccugc

SEQ ID NO: 2395764 - RNA, 14 nt, Human
cagagacuccugca

SEQ ID NO: 2395765 - RNA, 15 nt, Human
cagagacuccugcag

SEQ ID NO: 2395766 - RNA, 16 nt, Human
cagagacuccugcagg

SEQ ID NO: 2395767 - RNA, 17 nt, Human
cagagacuccugcaggc

SEQ ID NO: 2395768 - RNA, 18 nt, Human
cagagacuccugcaggca

SEQ ID NO: 2395769 - RNA, 19 nt, Human
cagagacuccugcaggcag

SEQ ID NO: 2395770 - RNA, 19 nt, Human
cagagacucagggccccag

SEQ ID NO: 2395771 - RNA, 20 nt, Human
cagagaccguccucaccccu

SEQ ID NO: 2395772 - RNA, 18 nt, Human
cagagaccuccugccucc

SEQ ID NO: 2395773 - RNA, 19 nt, Human
cagagacccucugccacca

SEQ ID NO: 2395774 - RNA, 20 nt, Human
cagagacccucugccaccag

SEQ ID NO: 2395775 - RNA, 13 nt, Human
cagagaccguccu

SEQ ID NO: 2395776 - RNA, 16 nt, Human
cagagaccguccucac

SEQ ID NO: 2395777 - RNA, 17 nt, Human
cagagaccguccucacc

SEQ ID NO: 2395778 - RNA, 18 nt, Human
cagagaccguccucaccc

SEQ ID NO: 2395779 - RNA, 19 nt, Human
cagagaccguccucacccc

SEQ ID NO: 2395780 - RNA, 21 nt, Human
cagagaccaucccugaaggcc

SEQ ID NO: 2395781 - RNA, 14 nt, Human
cagagaccauugca

SEQ ID NO: 2395782 - RNA, 15 nt, Human
cagagacccucugcc

SEQ ID NO: 2395783 - RNA, 17 nt, Human
cagagaccaucccugaa

SEQ ID NO: 2395784 - RNA, 18 nt, Human
cagagaccaucccugaag

SEQ ID NO: 2395785 - RNA, 19 nt, Human
cagagaccaucccugaagg

SEQ ID NO: 2395786 - RNA, 20 nt, Human
cagagaccaucccugaaggc

SEQ ID NO: 2395787 - RNA, 23 nt, Human
cagagaagcuauaaauuccucuu

SEQ ID NO: 2395788 - RNA, 21 nt, Human
cagagaagcuauaaauuccuc

SEQ ID NO: 2395789 - RNA, 15 nt, Human
cagagaagccccuuc

SEQ ID NO: 2395790 - RNA, 24 nt, Human
cagagaagccccuuccccauggga

SEQ ID NO: 2395791 - RNA, 17 nt, Human
cagagaagccccuuccc

SEQ ID NO: 2395792 - RNA, 18 nt, Human
cagagaagccccuucccc

SEQ ID NO: 2395793 - RNA, 20 nt, Human
cagagaagccaaaagauugg

SEQ ID NO: 2395794 - RNA, 23 nt, Human
cagagaagagaguauuggguaga

SEQ ID NO: 2395795 - RNA, 23 nt, Human
cagagaacuaacacuauuuuaug

SEQ ID NO: 2395796 - RNA, 20 nt, Human
cagagaacuaacacuauuuu

SEQ ID NO: 2395797 - RNA, 21 nt, Human
cagagaacuaacacuauuuua

SEQ ID NO: 2395798 - RNA, 22 nt, Human
cagagaacuaacacuauuuuau

SEQ ID NO: 2395799 - RNA, 19 nt, Human
cagagaaaggggagcccac

SEQ ID NO: 2395800 - RNA, 18 nt, Human
cagagaacuaacacuauu

SEQ ID NO: 2395801 - RNA, 17 nt, Human
cagagaaggcaggaaug

SEQ ID NO: 2395802 - RNA, 14 nt, Human
cagagaaggcagga

SEQ ID NO: 2395803 - RNA, 13 nt, Human
cagagaaggcagg

SEQ ID NO: 2395804 - RNA, 20 nt, Human
cagagaaggcaggaaugugu

SEQ ID NO: 2395805 - RNA, 13 nt, Human
cagagaagugaca

SEQ ID NO: 2395806 - RNA, 14 nt, Human
cagagaagugacag

SEQ ID NO: 2395807 - RNA, 15 nt, Human
cagagaagugacagg

SEQ ID NO: 2395808 - RNA, 16 nt, Human
cagagaagugacaggg

SEQ ID NO: 2395809 - RNA, 19 nt, Human
cagagaaugaaagggccca

SEQ ID NO: 2395810 - RNA, 17 nt, Human
cagagaagugacaggga

SEQ ID NO: 2395811 - RNA, 18 nt, Human
cagagaagugacagggaa

SEQ ID NO: 2395812 - RNA, 19 nt, Human
cagagaagugacagggaag

SEQ ID NO: 2395813 - RNA, 20 nt, Human
cagagaagugacagggaagc

SEQ ID NO: 2395814 - RNA, 21 nt, Human
cagagaagugacagggaagcu

SEQ ID NO: 2395815 - RNA, 22 nt, Human
cagagaagugacagggaagcua

SEQ ID NO: 2395816 - RNA, 23 nt, Human
cagagaagugacagggaagcuac

SEQ ID NO: 2395817 - RNA, 24 nt, Human
cagagaagugacagggaagcuaca

SEQ ID NO: 2395818 - RNA, 15 nt, Human
cagagaauucucuua

SEQ ID NO: 2395819 - RNA, 21 nt, Human
cagagaauugcugauucuuga

SEQ ID NO: 2395820 - RNA, 14 nt, Human
cagagaauucuuag

SEQ ID NO: 2395821 - RNA, 19 nt, Human
cagagaaucauacuuagca

SEQ ID NO: 2395822 - RNA, 11 nt, Human
cagagaaguuc

SEQ ID NO: 2395823 - RNA, 11 nt, Human
cagagaauaua

SEQ ID NO: 2395824 - RNA, 20 nt, Human
cagagaaugaaagggcccag

SEQ ID NO: 2395825 - RNA, 21 nt, Human
cagagaaugaaagggcccaga

SEQ ID NO: 2395826 - RNA, 14 nt, Human
cagagacagagagg

SEQ ID NO: 2395827 - RNA, 16 nt, Human
cagagacagagaggac

SEQ ID NO: 2395828 - RNA, 22 nt, Human
cagagacaccugcaccuccccc

SEQ ID NO: 2395829 - RNA, 20 nt, Human
cagagacaccugcaccuccc

SEQ ID NO: 2395830 - RNA, 18 nt, Human
cagagacaccugcaccuc

SEQ ID NO: 2395831 - RNA, 17 nt, Human
cagagacaccugcaccu

SEQ ID NO: 2395832 - RNA, 16 nt, Human
cagagacaccugcacc

SEQ ID NO: 2395833 - RNA, 15 nt, Human
cagagacaccugcac

SEQ ID NO: 2395834 - RNA, 14 nt, Human
cagagacaccugca

SEQ ID NO: 2395835 - RNA, 13 nt, Human
cagagacaccugc

SEQ ID NO: 2395836 - RNA, 16 nt, Human
cagagacacaagccuu

SEQ ID NO: 2395837 - RNA, 17 nt, Human
cagagacacaagccuuc

SEQ ID NO: 2395838 - RNA, 23 nt, Human
cagagaauuucuaccauuucaga

SEQ ID NO: 2395839 - RNA, 22 nt, Human
cagagaauuucuaccauuucag

SEQ ID NO: 2395840 - RNA, 16 nt, Human
cagagaauuucuacca

SEQ ID NO: 2395841 - RNA, 15 nt, Human
cagagaauuucuacc

SEQ ID NO: 2395842 - RNA, 13 nt, Human
cagagaauuucua

SEQ ID NO: 2395843 - RNA, 14 nt, Human
cagagacacaagcc

SEQ ID NO: 2395844 - RNA, 15 nt, Human
cagagacacaagccu

SEQ ID NO: 2395845 - RNA, 23 nt, Human
cagagacaggaaaauccucuggc

SEQ ID NO: 2395846 - RNA, 22 nt, Human
cagagacaggaaaauccucugg

SEQ ID NO: 2395847 - RNA, 21 nt, Human
cagagacaggaaaauccucug

SEQ ID NO: 2395848 - RNA, 15 nt, Human
cagagacaggaaaau

SEQ ID NO: 2395849 - RNA, 14 nt, Human
cagagacaggaaaa

SEQ ID NO: 2395850 - RNA, 13 nt, Human
cagagacaggaaa

SEQ ID NO: 2395851 - RNA, 19 nt, Human
cagagacaggcccaagaga

SEQ ID NO: 2395852 - RNA, 14 nt, Human
cagagacaggccca

SEQ ID NO: 2395853 - RNA, 22 nt, Human
cagagacaggaagucuucaggg

SEQ ID NO: 2395854 - RNA, 16 nt, Human
cagagacauacuugaa

SEQ ID NO: 2395855 - RNA, 15 nt, Human
cagagacauacuuga

SEQ ID NO: 2395856 - RNA, 23 nt, Human
cagagacaggcccaagagaugaa

SEQ ID NO: 2395857 - RNA, 23 nt, Human
cagagacauacuugaagggccag

SEQ ID NO: 2395858 - RNA, 21 nt, Human
cagagacauacuugaagggcc

SEQ ID NO: 2395859 - RNA, 20 nt, Human
cagagacauacuugaagggc

SEQ ID NO: 2395860 - RNA, 19 nt, Human
cagagacauacuugaaggg

SEQ ID NO: 2395861 - RNA, 17 nt, Human
cagagacauacuugaag

SEQ ID NO: 2395862 - RNA, 13 nt, Human
cagagaccauccc

SEQ ID NO: 2395863 - RNA, 13 nt, Human
cagagacauuccu

SEQ ID NO: 2395864 - RNA, 19 nt, Human
cagagacauuccuccgagc

SEQ ID NO: 2395865 - RNA, 14 nt, Human
cagagaccaucccu

SEQ ID NO: 2395866 - RNA, 16 nt, Human
cagagaccaucccuga

SEQ ID NO: 2395867 - RNA, 14 nt, Human
cagaugcaaugacu

SEQ ID NO: 2395868 - RNA, 21 nt, Human
cagaugcaaugugcuacugau

SEQ ID NO: 2395869 - RNA, 15 nt, Human
cagaugcaaugugcu

SEQ ID NO: 2395870 - RNA, 13 nt, Human
cagaugcaccagc

SEQ ID NO: 2395871 - RNA, 14 nt, Human
cagaugcaccagcc

SEQ ID NO: 2395872 - RNA, 16 nt, Human
cagaugcaccagcccu

SEQ ID NO: 2395873 - RNA, 17 nt, Human
cagaugcaccagcccuu

SEQ ID NO: 2395874 - RNA, 22 nt, Human
cagaugcaccagcccuuagcag

SEQ ID NO: 2395875 - RNA, 20 nt, Human
cagaugcagagagccauuuu

SEQ ID NO: 2395876 - RNA, 16 nt, Human
cagaugcagagagcca

SEQ ID NO: 2395877 - RNA, 18 nt, Human
cagaugcagagagccauu

SEQ ID NO: 2395878 - RNA, 14 nt, Human
cagaugcagggcag

SEQ ID NO: 2395879 - RNA, 13 nt, Human
cagaugcagggca

SEQ ID NO: 2395880 - RNA, 13 nt, Human
cagaugaccccuc

SEQ ID NO: 2395881 - RNA, 14 nt, Human
cagaugaccccucc

SEQ ID NO: 2395882 - RNA, 18 nt, Human
cagaugaccccuccccua

SEQ ID NO: 2395883 - RNA, 19 nt, Human
cagaugagaaacucuugag

SEQ ID NO: 2395884 - RNA, 23 nt, Human
cagaugcaaagaggcaagaggcu

SEQ ID NO: 2395885 - RNA, 18 nt, Human
cagaugcaaagaggcaag

SEQ ID NO: 2395886 - RNA, 17 nt, Human
cagaugcaaagaggcaa

SEQ ID NO: 2395887 - RNA, 23 nt, Human
cagaugaugccaaccucuggagc

SEQ ID NO: 2395888 - RNA, 14 nt, Human
cagaugauccauga

SEQ ID NO: 2395889 - RNA, 16 nt, Human
cagaugcaaagaggca

SEQ ID NO: 2395890 - RNA, 12 nt, Human
cagaugagcugu

SEQ ID NO: 2395891 - RNA, 17 nt, Human
cagaugagaaacucuug

SEQ ID NO: 2395892 - RNA, 16 nt, Human
cagaugaguaaaggag

SEQ ID NO: 2395893 - RNA, 23 nt, Human
cagaucugugccccaugccuguc

SEQ ID NO: 2395894 - RNA, 21 nt, Human
cagaucugugccccaugccug

SEQ ID NO: 2395895 - RNA, 20 nt, Human
cagaucugugccccaugccu

SEQ ID NO: 2395896 - RNA, 18 nt, Human
cagaucugugccccaugc

SEQ ID NO: 2395897 - RNA, 18 nt, Human
cagaucugucugauagga

SEQ ID NO: 2395898 - RNA, 17 nt, Human
cagaugaaugccgugga

SEQ ID NO: 2395899 - RNA, 20 nt, Human
cagaugaacucuuagaaaug

SEQ ID NO: 2395900 - RNA, 14 nt, Human
cagaugaaugauaa

SEQ ID NO: 2395901 - RNA, 23 nt, Human
cagaugaauguauuuauuuggga

SEQ ID NO: 2395902 - RNA, 19 nt, Human
cagaugaaugauaaacucu

SEQ ID NO: 2395903 - RNA, 20 nt, Human
cagaugacaaaaauucaacu

SEQ ID NO: 2395904 - RNA, 19 nt, Human
cagaugaauguauuuauuu

SEQ ID NO: 2395905 - RNA, 15 nt, Human
cagaugaauguauuu

SEQ ID NO: 2395906 - RNA, 15 nt, Human
cagaucugugcccca

SEQ ID NO: 2395907 - RNA, 14 nt, Human
cagaucugugcccc

SEQ ID NO: 2395908 - RNA, 13 nt, Human
cagaucugugccc

SEQ ID NO: 2395909 - RNA, 12 nt, Human
cagaucugugcc

SEQ ID NO: 2395910 - RNA, 13 nt, Human
cagaucugucuga

SEQ ID NO: 2395911 - RNA, 18 nt, Human
cagaucuggucccuugca

SEQ ID NO: 2395912 - RNA, 17 nt, Human
cagaucuggucccuugc

SEQ ID NO: 2395913 - RNA, 24 nt, Human
cagaucugacaugauuccuuccug

SEQ ID NO: 2395914 - RNA, 23 nt, Human
cagaucuggaaccucagccuggc

SEQ ID NO: 2395915 - RNA, 22 nt, Human
cagaucuggaaccucagccugg

SEQ ID NO: 2395916 - RNA, 21 nt, Human
cagaucuggaaccucagccug

SEQ ID NO: 2395917 - RNA, 20 nt, Human
cagaucuggaaccucagccu

SEQ ID NO: 2395918 - RNA, 19 nt, Human
cagaucuggaaccucagcc

SEQ ID NO: 2395919 - RNA, 18 nt, Human
cagaucuggaaccucagc

SEQ ID NO: 2395920 - RNA, 15 nt, Human
cagaucuggaaccuc

SEQ ID NO: 2395921 - RNA, 14 nt, Human
cagaucuggaaccu

SEQ ID NO: 2395922 - RNA, 23 nt, Human
cagaucugacaugauuccuuccu

SEQ ID NO: 2395923 - RNA, 22 nt, Human
cagaucugacaugauuccuucc

SEQ ID NO: 2395924 - RNA, 19 nt, Human
cagauccuuguuucaaaca

SEQ ID NO: 2395925 - RNA, 18 nt, Human
cagaucggaucuguugca

SEQ ID NO: 2395926 - RNA, 14 nt, Human
cagaucuccuggca

SEQ ID NO: 2395927 - RNA, 19 nt, Human
cagaucuaccccuuacuua

SEQ ID NO: 2395928 - RNA, 20 nt, Human
cagaucucuaacuucaccau

SEQ ID NO: 2395929 - RNA, 13 nt, Human
cagauccuuguuu

SEQ ID NO: 2395930 - RNA, 17 nt, Human
cagauacaauguauuua

SEQ ID NO: 2395931 - RNA, 14 nt, Human
cagauccuuguuuc

SEQ ID NO: 2395932 - RNA, 15 nt, Human
cagauccuuguuuca

SEQ ID NO: 2395933 - RNA, 16 nt, Human
cagauccuuguuucaa

SEQ ID NO: 2395934 - RNA, 18 nt, Human
cagauccuuguuucaaac

SEQ ID NO: 2395935 - RNA, 14 nt, Human
cagauccuggaaau

SEQ ID NO: 2395936 - RNA, 20 nt, Human
cagauacaggaaaagcugcu

SEQ ID NO: 2395937 - RNA, 21 nt, Human
cagauacaggaaaagcugcug

SEQ ID NO: 2395938 - RNA, 22 nt, Human
cagauacaggaaaagcugcuga

SEQ ID NO: 2395939 - RNA, 20 nt, Human
cagagugugggaagggagag

SEQ ID NO: 2395940 - RNA, 19 nt, Human
cagagugugggaagggaga

SEQ ID NO: 2395941 - RNA, 23 nt, Human
cagaguguggccuucggacaacu

SEQ ID NO: 2395942 - RNA, 21 nt, Human
cagaguggucuuucuggagag

SEQ ID NO: 2395943 - RNA, 12 nt, Human
cagagugugcug

SEQ ID NO: 2395944 - RNA, 22 nt, Human
cagaguggucuuucuggagagg

SEQ ID NO: 2395945 - RNA, 18 nt, Human
cagagugugcuggaggac

SEQ ID NO: 2395946 - RNA, 15 nt, Human
cagagugugcuggag

SEQ ID NO: 2395947 - RNA, 16 nt, Human
cagagugugcuggagg

SEQ ID NO: 2395948 - RNA, 20 nt, Human
cagaguucacuauaaauggu

SEQ ID NO: 2395949 - RNA, 14 nt, Human
cagaguucacuaua

SEQ ID NO: 2395950 - RNA, 12 nt, Human
cagaguucacua

SEQ ID NO: 2395951 - RNA, 14 nt, Human
cagaguugaagaca

SEQ ID NO: 2395952 - RNA, 16 nt, Human
cagaguuccccaugca

SEQ ID NO: 2395953 - RNA, 18 nt, Human
cagaguuccccaugcaga

SEQ ID NO: 2395954 - RNA, 24 nt, Human
cagaguuccccaugcagacaugag

SEQ ID NO: 2395955 - RNA, 17 nt, Human
cagaguuccugcggagu

SEQ ID NO: 2395956 - RNA, 23 nt, Human
cagaguuccugcggagugaagag

SEQ ID NO: 2395957 - RNA, 22 nt, Human
cagaguuccugcggagugaaga

SEQ ID NO: 2395958 - RNA, 15 nt, Human
cagaguucugcucua

SEQ ID NO: 2395959 - RNA, 15 nt, Human
cagaguugaagacag

SEQ ID NO: 2395960 - RNA, 16 nt, Human
cagaguugaagacaga

SEQ ID NO: 2395961 - RNA, 22 nt, Human
cagaguugaagacagagcuaca

SEQ ID NO: 2395962 - RNA, 20 nt, Human
cagaguugcugcaaaccuga

SEQ ID NO: 2395963 - RNA, 20 nt, Human
cagaguugacaugagauuua

SEQ ID NO: 2395964 - RNA, 15 nt, Human
cagaguugcugggag

SEQ ID NO: 2395965 - RNA, 19 nt, Human
cagaguugcugggagcuga

SEQ ID NO: 2395966 - RNA, 20 nt, Human
cagaguugcugggagcugaa

SEQ ID NO: 2395967 - RNA, 12 nt, Human
cagaguuguaaa

SEQ ID NO: 2395968 - RNA, 14 nt, Human
cagaguuguuacau

SEQ ID NO: 2395969 - RNA, 13 nt, Human
cagaguuguaaau

SEQ ID NO: 2395970 - RNA, 14 nt, Human
cagaguuguaaaua

SEQ ID NO: 2395971 - RNA, 16 nt, Human
cagaguuguaaauaua

SEQ ID NO: 2395972 - RNA, 17 nt, Human
cagaguuguaaauauau

SEQ ID NO: 2395973 - RNA, 18 nt, Human
cagaguuguaaauauaua

SEQ ID NO: 2395974 - RNA, 19 nt, Human
cagaguuguaaauauauaa

SEQ ID NO: 2395975 - RNA, 20 nt, Human
cagaguuguaaauauauaaa

SEQ ID NO: 2395976 - RNA, 23 nt, Human
cagaguuguaaauauauaaauau

SEQ ID NO: 2395977 - RNA, 17 nt, Human
cagaguugaagacagag

SEQ ID NO: 2395978 - RNA, 18 nt, Human
cagaguugaagacagagc

SEQ ID NO: 2395979 - RNA, 19 nt, Human
cagaguugaagacagagcu

SEQ ID NO: 2395980 - RNA, 20 nt, Human
cagaguugaagacagagcua

SEQ ID NO: 2395981 - RNA, 23 nt, Human
cagaguugugcacauggcuuagu

SEQ ID NO: 2395982 - RNA, 17 nt, Human
cagaguuuguguguugu

SEQ ID NO: 2395983 - RNA, 19 nt, Human
cagaguuuguguguugucu

SEQ ID NO: 2395984 - RNA, 22 nt, Human
cagaguuuguguguugucuuga

SEQ ID NO: 2395985 - RNA, 23 nt, Human
cagaguuuagaggaaaaaaauga

SEQ ID NO: 2395986 - RNA, 19 nt, Human
cagaguuguuacauuuuua

SEQ ID NO: 2395987 - RNA, 18 nt, Human
cagaguuguuacauuuuu

SEQ ID NO: 2395988 - RNA, 15 nt, Human
cagaguuguuacauu

SEQ ID NO: 2395989 - RNA, 21 nt, Human
cagauaaaauuauagauggga

SEQ ID NO: 2395990 - RNA, 15 nt, Human
cagaguuuuuaugua

SEQ ID NO: 2395991 - RNA, 16 nt, Human
cagauaaaauuauaga

SEQ ID NO: 2395992 - RNA, 14 nt, Human
cagauaaacaguag

SEQ ID NO: 2395993 - RNA, 22 nt, Human
cagauaaagguucaugcaaacu

SEQ ID NO: 2395994 - RNA, 23 nt, Human
cagauaaauaguuuaugauucca

SEQ ID NO: 2395995 - RNA, 18 nt, Human
cagauaaucagccucuua

SEQ ID NO: 2395996 - RNA, 17 nt, Human
cagauaaucagccucuu

SEQ ID NO: 2395997 - RNA, 16 nt, Human
cagauaaucagccucu

SEQ ID NO: 2395998 - RNA, 15 nt, Human
cagauaaucagccuc

SEQ ID NO: 2395999 - RNA, 14 nt, Human
cagauaaucacaau

SEQ ID NO: 2396000 - RNA, 19 nt, Human
cagauaaucagccucuuaa

SEQ ID NO: 2396001 - RNA, 14 nt, Human
cagauaaucagugu

SEQ ID NO: 2396002 - RNA, 16 nt, Human
cagauaaugugaaaau

SEQ ID NO: 2396003 - RNA, 13 nt, Human
cagauacaaugua

SEQ ID NO: 2396004 - RNA, 14 nt, Human
cagauacaauguau

SEQ ID NO: 2396005 - RNA, 14 nt, Human
cagauaaugugaaa

SEQ ID NO: 2396006 - RNA, 13 nt, Human
cagauaaugugaa

SEQ ID NO: 2396007 - RNA, 21 nt, Human
cagauaagaaugcugguuuuc

SEQ ID NO: 2396008 - RNA, 19 nt, Human
cagauaagaaugcugguuu

SEQ ID NO: 2396009 - RNA, 22 nt, Human
cagauaagcaagagagauguuu

SEQ ID NO: 2396010 - RNA, 20 nt, Human
cagauaagcaagagagaugu

SEQ ID NO: 2396011 - RNA, 21 nt, Human
cagauaacuguuauuuauaau

SEQ ID NO: 2396012 - RNA, 20 nt, Human
cagauaacuguuauuuauaa

SEQ ID NO: 2396013 - RNA, 17 nt, Human
cagauaaccagcuguaa

SEQ ID NO: 2396014 - RNA, 14 nt, Human
cagauaacuguuau

SEQ ID NO: 2396015 - RNA, 19 nt, Human
cagauaacuguuauuuaua

SEQ ID NO: 2396016 - RNA, 16 nt, Human
cagauaacuguuauuu

SEQ ID NO: 2396017 - RNA, 23 nt, Human
cagagugcaagccccugcuccag

SEQ ID NO: 2396018 - RNA, 18 nt, Human
cagagugcaagccccugc

SEQ ID NO: 2396019 - RNA, 20 nt, Human
cagagugagacccugucucu

SEQ ID NO: 2396020 - RNA, 19 nt, Human
cagagugagacucugucuc

SEQ ID NO: 2396021 - RNA, 20 nt, Human
cagagugagacucugucuca

SEQ ID NO: 2396022 - RNA, 20 nt, Human
cagagugcaagccccugcuc

SEQ ID NO: 2396023 - RNA, 14 nt, Human
cagagugcccagaa

SEQ ID NO: 2396024 - RNA, 13 nt, Human
cagagugcccaga

SEQ ID NO: 2396025 - RNA, 15 nt, Human
cagagugcccagaac

SEQ ID NO: 2396026 - RNA, 13 nt, Human
cagaguggccugg

SEQ ID NO: 2396027 - RNA, 12 nt, Human
cagaguggccug

SEQ ID NO: 2396028 - RNA, 14 nt, Human
cagaguggaaugcu

SEQ ID NO: 2396029 - RNA, 15 nt, Human
cagaguggucuuucu

SEQ ID NO: 2396030 - RNA, 23 nt, Human
cagaguggccuggccaggagcuc

SEQ ID NO: 2396031 - RNA, 22 nt, Human
cagaguggccuggccaggagcu

SEQ ID NO: 2396032 - RNA, 21 nt, Human
cagaguggccuggccaggagc

SEQ ID NO: 2396033 - RNA, 18 nt, Human
cagaguggccuggccagg

SEQ ID NO: 2396034 - RNA, 17 nt, Human
cagaguggccuggccag

SEQ ID NO: 2396035 - RNA, 16 nt, Human
cagaguggccuggcca

SEQ ID NO: 2396036 - RNA, 15 nt, Human
cagaguggccuggcc

SEQ ID NO: 2396037 - RNA, 23 nt, Human
cagagucucgcucuguugcccag

SEQ ID NO: 2396038 - RNA, 18 nt, Human
cagagucggaacggagaa

SEQ ID NO: 2396039 - RNA, 15 nt, Human
cagagucggaacgga

SEQ ID NO: 2396040 - RNA, 23 nt, Human
cagagucggaacggagaaaggug

SEQ ID NO: 2396041 - RNA, 15 nt, Human
cagagugagacccag

SEQ ID NO: 2396042 - RNA, 14 nt, Human
cagagugagaccca

SEQ ID NO: 2396043 - RNA, 20 nt, Human
cagagucuggugaagcucac

SEQ ID NO: 2396044 - RNA, 18 nt, Human
cagagucuugcuaccuca

SEQ ID NO: 2396045 - RNA, 22 nt, Human
cagagucucacuguugcccagg

SEQ ID NO: 2396046 - RNA, 23 nt, Human
cagagucucacuguugcccaggc

SEQ ID NO: 2396047 - RNA, 19 nt, Human
cagagugagacccugucuc

SEQ ID NO: 2396048 - RNA, 15 nt, Human
cagagugagacccug

SEQ ID NO: 2396049 - RNA, 20 nt, Human
cagagugagacccagcccuc

SEQ ID NO: 2396050 - RNA, 17 nt, Human
cagagugagacccagcc

SEQ ID NO: 2396051 - RNA, 16 nt, Human
cagagugagacucugu

SEQ ID NO: 2396052 - RNA, 17 nt, Human
cagagugagacucuguc

SEQ ID NO: 2396053 - RNA, 18 nt, Human
cagagugagacucugucu

SEQ ID NO: 2396054 - RNA, 13 nt, Human
cagagucucacug

SEQ ID NO: 2396055 - RNA, 14 nt, Human
cagaguccuuucca

SEQ ID NO: 2396056 - RNA, 15 nt, Human
cagaguccuuuccaa

SEQ ID NO: 2396057 - RNA, 15 nt, Human
cagagucagcagaac

SEQ ID NO: 2396058 - RNA, 22 nt, Human
cagagggcccaggcaggccacc

SEQ ID NO: 2396059 - RNA, 16 nt, Human
cagaguccaggcccca

SEQ ID NO: 2396060 - RNA, 15 nt, Human
cagaguccaggcccc

SEQ ID NO: 2396061 - RNA, 14 nt, Human
cagaguccaggccc

SEQ ID NO: 2396062 - RNA, 17 nt, Human
cagagucucacuguugc

SEQ ID NO: 2396063 - RNA, 19 nt, Human
cagagucucacuguugccc

SEQ ID NO: 2396064 - RNA, 20 nt, Human
cagagucucacuguugccca

SEQ ID NO: 2396065 - RNA, 21 nt, Human
cagagucucacuguugcccag

SEQ ID NO: 2396066 - RNA, 18 nt, Human
cagagggcccaggcaggc

SEQ ID NO: 2396067 - RNA, 16 nt, Human
cagagggcccaggcag

SEQ ID NO: 2396068 - RNA, 15 nt, Human
cagagggcccaggca

SEQ ID NO: 2396069 - RNA, 13 nt, Human
cagagggcccagg

SEQ ID NO: 2396070 - RNA, 18 nt, Human
cagagggcagaggcugga

SEQ ID NO: 2396071 - RNA, 17 nt, Human
cagagggcagaggcugg

SEQ ID NO: 2396072 - RNA, 16 nt, Human
cagagggcagaggcug

SEQ ID NO: 2396073 - RNA, 23 nt, Human
cagagggaggaaucgaggaacca

SEQ ID NO: 2396074 - RNA, 22 nt, Human
cagagggaggaaucgaggaacc

SEQ ID NO: 2396075 - RNA, 19 nt, Human
cagagggacuuuguauaga

SEQ ID NO: 2396076 - RNA, 14 nt, Human
cagagggcacucug

SEQ ID NO: 2396077 - RNA, 15 nt, Human
cagagggccugcaag

SEQ ID NO: 2396078 - RNA, 19 nt, Human
cagagggccugcaagggag

SEQ ID NO: 2396079 - RNA, 20 nt, Human
cagagggagugacagaggca

SEQ ID NO: 2396080 - RNA, 21 nt, Human
cagagggagugacagaggcag

SEQ ID NO: 2396081 - RNA, 22 nt, Human
cagagggagugacagaggcagc

SEQ ID NO: 2396082 - RNA, 23 nt, Human
cagagggagugacagaggcagcc

SEQ ID NO: 2396083 - RNA, 16 nt, Human
cagaggccuauaauga

SEQ ID NO: 2396084 - RNA, 20 nt, Human
cagaggcccucgcugccagc

SEQ ID NO: 2396085 - RNA, 20 nt, Human
cagaggccuauaaugaagcu

SEQ ID NO: 2396086 - RNA, 19 nt, Human
cagaggcccucgcugccag

SEQ ID NO: 2396087 - RNA, 23 nt, Human
cagaggcccccagcccagggcuc

SEQ ID NO: 2396088 - RNA, 24 nt, Human
cagaggcccccagcccagggcucc

SEQ ID NO: 2396089 - RNA, 17 nt, Human
cagaggccccagccucc

SEQ ID NO: 2396090 - RNA, 16 nt, Human
cagaggccccagccuc

SEQ ID NO: 2396091 - RNA, 14 nt, Human
cagaggccccagcc

SEQ ID NO: 2396092 - RNA, 13 nt, Human
cagaggccccagc

SEQ ID NO: 2396093 - RNA, 16 nt, Human
cagaggcccccagccc

SEQ ID NO: 2396094 - RNA, 17 nt, Human
cagaggcccccagccca

SEQ ID NO: 2396095 - RNA, 19 nt, Human
cagaggcccccagcccagg

SEQ ID NO: 2396096 - RNA, 22 nt, Human
cagaggcccccagcccagggcu

SEQ ID NO: 2396097 - RNA, 13 nt, Human
cagaggcugccuc

SEQ ID NO: 2396098 - RNA, 20 nt, Human
cagaggcuauuauuuucacu

SEQ ID NO: 2396099 - RNA, 18 nt, Human
cagaggcgcacugugacc

SEQ ID NO: 2396100 - RNA, 23 nt, Human
cagaggcgcaugaauuugugaag

SEQ ID NO: 2396101 - RNA, 13 nt, Human
cagaggccugccc

SEQ ID NO: 2396102 - RNA, 14 nt, Human
cagaggccugcccg

SEQ ID NO: 2396103 - RNA, 17 nt, Human
cagaggcgcacugugac

SEQ ID NO: 2396104 - RNA, 19 nt, Human
cagagggaagaaaagagcu

SEQ ID NO: 2396105 - RNA, 23 nt, Human
cagagggaaaguaaauauuucag

SEQ ID NO: 2396106 - RNA, 20 nt, Human
cagaggcuucuucagaucag

SEQ ID NO: 2396107 - RNA, 16 nt, Human
cagaggcuucuucaga

SEQ ID NO: 2396108 - RNA, 15 nt, Human
cagaggcuucuucag

SEQ ID NO: 2396109 - RNA, 21 nt, Human
cagaggcuggaggcagggccu

SEQ ID NO: 2396110 - RNA, 14 nt, Human
cagaggcuggguuc

SEQ ID NO: 2396111 - RNA, 20 nt, Human
cagaggcuggaggcagggcc

SEQ ID NO: 2396112 - RNA, 19 nt, Human
cagaggcuggaggcagggc

SEQ ID NO: 2396113 - RNA, 12 nt, Human
cagaggcugggu

SEQ ID NO: 2396114 - RNA, 13 nt, Human
cagaggcuggguu

SEQ ID NO: 2396115 - RNA, 18 nt, Human
cagaggcuggaggcaggg

SEQ ID NO: 2396116 - RNA, 17 nt, Human
cagaggcuggaggcagg

SEQ ID NO: 2396117 - RNA, 16 nt, Human
cagaggcuggaggcag

SEQ ID NO: 2396118 - RNA, 14 nt, Human
cagaggcuggaggc

SEQ ID NO: 2396119 - RNA, 17 nt, Human
cagaggcuaauucugca

SEQ ID NO: 2396120 - RNA, 13 nt, Human
cagaggcuggagg

SEQ ID NO: 2396121 - RNA, 14 nt, Human
cagaggcugcccca

SEQ ID NO: 2396122 - RNA, 23 nt, Human
cagaggcugccucucccaucacu

SEQ ID NO: 2396123 - RNA, 14 nt, Human
cagagggagugaca

SEQ ID NO: 2396124 - RNA, 16 nt, Human
cagagggagugacaga

SEQ ID NO: 2396125 - RNA, 18 nt, Human
cagagggagugacagagg

SEQ ID NO: 2396126 - RNA, 19 nt, Human
cagagggagugacagaggc

SEQ ID NO: 2396127 - RNA, 21 nt, Human
cagaggauugcugccccauca

SEQ ID NO: 2396128 - RNA, 19 nt, Human
cagaggauggccagugucu

SEQ ID NO: 2396129 - RNA, 22 nt, Human
cagaggauggccagugucuguc

SEQ ID NO: 2396130 - RNA, 23 nt, Human
cagaggcagccccauucugccug

SEQ ID NO: 2396131 - RNA, 19 nt, Human
cagaggccaugggccuccu

SEQ ID NO: 2396132 - RNA, 16 nt, Human
cagaggccaugggccu

SEQ ID NO: 2396133 - RNA, 20 nt, Human
cagaggccaugggccuccug

SEQ ID NO: 2396134 - RNA, 21 nt, Human
cagaggccaugggccuccugu

SEQ ID NO: 2396135 - RNA, 14 nt, Human
cagaggccauggca

SEQ ID NO: 2396136 - RNA, 20 nt, Human
cagaggccagaggcccccag

SEQ ID NO: 2396137 - RNA, 12 nt, Human
cagaggcagccc

SEQ ID NO: 2396138 - RNA, 13 nt, Human
cagaggcagcccc

SEQ ID NO: 2396139 - RNA, 14 nt, Human
cagaggcagcccca

SEQ ID NO: 2396140 - RNA, 15 nt, Human
cagaggcagccccau

SEQ ID NO: 2396141 - RNA, 18 nt, Human
cagaggcagccccauucu

SEQ ID NO: 2396142 - RNA, 19 nt, Human
cagaggcagccccauucug

SEQ ID NO: 2396143 - RNA, 20 nt, Human
cagaggcagccccauucugc

SEQ ID NO: 2396144 - RNA, 22 nt, Human
cagaggcagccccauucugccu

SEQ ID NO: 2396145 - RNA, 13 nt, Human
cagcagcccuccu

SEQ ID NO: 2396146 - RNA, 15 nt, Human
cagaugccccagagc

SEQ ID NO: 2396147 - RNA, 21 nt, Human
cacccuuuuccagcuggauga

SEQ ID NO: 2396148 - RNA, 21 nt, Human
caccgaaguggacuggccccu

SEQ ID NO: 2396149 - RNA, 22 nt, Human
caccgaaaacguggcugcuuca

SEQ ID NO: 2396150 - RNA, 19 nt, Human
caccgaaaacguggcugcu

SEQ ID NO: 2396151 - RNA, 21 nt, Human
caccgaaaacguggcugcuuc

SEQ ID NO: 2396152 - RNA, 23 nt, Human
cacccuuggccugucucaucccc

SEQ ID NO: 2396153 - RNA, 21 nt, Human
cacccuuggccugucucaucc

SEQ ID NO: 2396154 - RNA, 22 nt, Human
cacccuuggaggcugucuucuc

SEQ ID NO: 2396155 - RNA, 17 nt, Human
cacccuuuuccagcugg

SEQ ID NO: 2396156 - RNA, 15 nt, Human
cacccuuuuccagcu

SEQ ID NO: 2396157 - RNA, 20 nt, Human
cacccuuugcugugaggcug

SEQ ID NO: 2396158 - RNA, 22 nt, Human
cacccuuugcugugaggcuguc

SEQ ID NO: 2396159 - RNA, 15 nt, Human
caccgaaaacguggc

SEQ ID NO: 2396160 - RNA, 18 nt, Human
caccgaaaacguggcugc

SEQ ID NO: 2396161 - RNA, 18 nt, Human
caccgagaguagccgaga

SEQ ID NO: 2396162 - RNA, 13 nt, Human
caccgagaauguu

SEQ ID NO: 2396163 - RNA, 17 nt, Human
caccgagggcgaccccg

SEQ ID NO: 2396164 - RNA, 12 nt, Human
caccgagugggg

SEQ ID NO: 2396165 - RNA, 19 nt, Human
caccgacgcgucuccuguu

SEQ ID NO: 2396166 - RNA, 22 nt, Human
caccgaaguggacuggccccug

SEQ ID NO: 2396167 - RNA, 23 nt, Human
caccgaaguggacuggccccugg

SEQ ID NO: 2396168 - RNA, 17 nt, Human
caccgacgcgucuccug

SEQ ID NO: 2396169 - RNA, 18 nt, Human
caccgacgcgucuccugu

SEQ ID NO: 2396170 - RNA, 12 nt, Human
caccgcagacag

SEQ ID NO: 2396171 - RNA, 13 nt, Human
caccgcagacagg

SEQ ID NO: 2396172 - RNA, 14 nt, Human
caccgcagacagga

SEQ ID NO: 2396173 - RNA, 15 nt, Human
caccgcagacaggac

SEQ ID NO: 2396174 - RNA, 17 nt, Human
caccgcagacaggacca

SEQ ID NO: 2396175 - RNA, 18 nt, Human
caccgcagacaggaccag

SEQ ID NO: 2396176 - RNA, 23 nt, Human
cacccuuccccuccuucucccuu

SEQ ID NO: 2396177 - RNA, 22 nt, Human
cacccuuccccuccuucucccu

SEQ ID NO: 2396178 - RNA, 14 nt, Human
cacccuuccccucc

SEQ ID NO: 2396179 - RNA, 13 nt, Human
cacccuuccccuc

SEQ ID NO: 2396180 - RNA, 22 nt, Human
cacccuucacauacccuccccc

SEQ ID NO: 2396181 - RNA, 20 nt, Human
cacccuucacauacccuccc

SEQ ID NO: 2396182 - RNA, 16 nt, Human
cacccuuaccaugugc

SEQ ID NO: 2396183 - RNA, 18 nt, Human
cacccuuggccugucuca

SEQ ID NO: 2396184 - RNA, 15 nt, Human
cacccuuggccuguc

SEQ ID NO: 2396185 - RNA, 13 nt, Human
cacccuuggccug

SEQ ID NO: 2396186 - RNA, 12 nt, Human
cacccuuggccu

SEQ ID NO: 2396187 - RNA, 21 nt, Human
cacccuuggaggcugucuucu

SEQ ID NO: 2396188 - RNA, 20 nt, Human
cacccuuggaggcugucuuc

SEQ ID NO: 2396189 - RNA, 19 nt, Human
cacccuuggaggcugucuu

SEQ ID NO: 2396190 - RNA, 17 nt, Human
cacccuuggaggcuguc

SEQ ID NO: 2396191 - RNA, 16 nt, Human
cacccuuggacuugag

SEQ ID NO: 2396192 - RNA, 13 nt, Human
cacccuucuuucc

SEQ ID NO: 2396193 - RNA, 15 nt, Human
cacccuucuuuccuc

SEQ ID NO: 2396194 - RNA, 16 nt, Human
cacccuucuuuccucu

SEQ ID NO: 2396195 - RNA, 18 nt, Human
cacccuucuuuccucuuc

SEQ ID NO: 2396196 - RNA, 19 nt, Human
cacccuucuuuccucuucc

SEQ ID NO: 2396197 - RNA, 20 nt, Human
cacccuucuuuccucuuccc

SEQ ID NO: 2396198 - RNA, 21 nt, Human
cacccuucuuuccucuucccc

SEQ ID NO: 2396199 - RNA, 12 nt, Human
cacccuugccca

SEQ ID NO: 2396200 - RNA, 23 nt, Human
cacccuugcccaccccaccccca

SEQ ID NO: 2396201 - RNA, 13 nt, Human
cacccuuggacuu

SEQ ID NO: 2396202 - RNA, 14 nt, Human
cacccuuggacuug

SEQ ID NO: 2396203 - RNA, 11 nt, Human
cacccugugau

SEQ ID NO: 2396204 - RNA, 12 nt, Human
cacccugugaug

SEQ ID NO: 2396205 - RNA, 15 nt, Human
cacccugugaugggg

SEQ ID NO: 2396206 - RNA, 18 nt, Human
cacccugugauggggccc

SEQ ID NO: 2396207 - RNA, 20 nt, Human
cacccugugauggggcccug

SEQ ID NO: 2396208 - RNA, 21 nt, Human
cacccugugauggggcccugc

SEQ ID NO: 2396209 - RNA, 22 nt, Human
cacccugugauggggcccugcc

SEQ ID NO: 2396210 - RNA, 23 nt, Human
cacccugugauggggcccugccu

SEQ ID NO: 2396211 - RNA, 20 nt, Human
cacccuagucccuuccccuc

SEQ ID NO: 2396212 - RNA, 18 nt, Human
cacccuagucccuucccc

SEQ ID NO: 2396213 - RNA, 18 nt, Human
cacccucaaccucuucug

SEQ ID NO: 2396214 - RNA, 16 nt, Human
cacccuaguuucccug

SEQ ID NO: 2396215 - RNA, 17 nt, Human
cacccuaguuucccuga

SEQ ID NO: 2396216 - RNA, 12 nt, Human
cacccucacacu

SEQ ID NO: 2396217 - RNA, 16 nt, Human
cacccucagcaccccu

SEQ ID NO: 2396218 - RNA, 17 nt, Human
cacccucagcaccccuu

SEQ ID NO: 2396219 - RNA, 18 nt, Human
cacccucagcaccccuuc

SEQ ID NO: 2396220 - RNA, 17 nt, Human
cacccugucuaaaaaac

SEQ ID NO: 2396221 - RNA, 22 nt, Human
cacccugucccccagcucuggu

SEQ ID NO: 2396222 - RNA, 23 nt, Human
cacccugucccccagcucuggug

SEQ ID NO: 2396223 - RNA, 16 nt, Human
cacccugucccccagc

SEQ ID NO: 2396224 - RNA, 18 nt, Human
cacccugucccccagcuc

SEQ ID NO: 2396225 - RNA, 19 nt, Human
cacccugucccccagcucu

SEQ ID NO: 2396226 - RNA, 20 nt, Human
cacccugucccccagcucug

SEQ ID NO: 2396227 - RNA, 17 nt, Human
cacccuagucccuuccc

SEQ ID NO: 2396228 - RNA, 16 nt, Human
cacccuagucccuucc

SEQ ID NO: 2396229 - RNA, 16 nt, Human
cacccuaccugugccu

SEQ ID NO: 2396230 - RNA, 14 nt, Human
cacccuaccuguuc

SEQ ID NO: 2396231 - RNA, 16 nt, Human
cacccuaccuguucag

SEQ ID NO: 2396232 - RNA, 12 nt, Human
cacccuaccugu

SEQ ID NO: 2396233 - RNA, 21 nt, Human
cacccguucugcuggccugga

SEQ ID NO: 2396234 - RNA, 19 nt, Human
cacccguucugcuggccug

SEQ ID NO: 2396235 - RNA, 20 nt, Human
cacccguucugcuggccugg

SEQ ID NO: 2396236 - RNA, 17 nt, Human
cacccguggagauggga

SEQ ID NO: 2396237 - RNA, 18 nt, Human
cacccguucugcuggccu

SEQ ID NO: 2396238 - RNA, 16 nt, Human
cacccguggagauggg

SEQ ID NO: 2396239 - RNA, 13 nt, Human
cacccgggcucag

SEQ ID NO: 2396240 - RNA, 23 nt, Human
cacccgggcucagggaccacagc

SEQ ID NO: 2396241 - RNA, 15 nt, Human
cacccggcugcagag

SEQ ID NO: 2396242 - RNA, 21 nt, Human
cacccggcugcagaggccaga

SEQ ID NO: 2396243 - RNA, 23 nt, Human
cacccgaugcugcuuuccccugu

SEQ ID NO: 2396244 - RNA, 13 nt, Human
cacccgccucucc

SEQ ID NO: 2396245 - RNA, 14 nt, Human
cacccgccucuccc

SEQ ID NO: 2396246 - RNA, 16 nt, Human
cacccgccuuuuauaa

SEQ ID NO: 2396247 - RNA, 12 nt, Human
cacccggccccu

SEQ ID NO: 2396248 - RNA, 19 nt, Human
cacccgcuaagagggaggg

SEQ ID NO: 2396249 - RNA, 13 nt, Human
cacccggccccug

SEQ ID NO: 2396250 - RNA, 14 nt, Human
cacccggccccugc

SEQ ID NO: 2396251 - RNA, 16 nt, Human
cacccggccccugcug

SEQ ID NO: 2396252 - RNA, 17 nt, Human
cacccggccccugcugg

SEQ ID NO: 2396253 - RNA, 18 nt, Human
cacccggccccugcuggu

SEQ ID NO: 2396254 - RNA, 21 nt, Human
cacccggccccugcugguuca

SEQ ID NO: 2396255 - RNA, 13 nt, Human
caccccuucccca

SEQ ID NO: 2396256 - RNA, 12 nt, Human
caccccuucccc

SEQ ID NO: 2396257 - RNA, 11 nt, Human
caccccuuccc

SEQ ID NO: 2396258 - RNA, 16 nt, Human
caccccuuccaugugg

SEQ ID NO: 2396259 - RNA, 20 nt, Human
caccccuuauccaggacucu

SEQ ID NO: 2396260 - RNA, 11 nt, Human
caccccuucca

SEQ ID NO: 2396261 - RNA, 14 nt, Human
caccccuuccaugu

SEQ ID NO: 2396262 - RNA, 15 nt, Human
caccccuuccaugug

SEQ ID NO: 2396263 - RNA, 17 nt, Human
caccccugugcuccgug

SEQ ID NO: 2396264 - RNA, 21 nt, Human
caccccugugcuccgugccuc

SEQ ID NO: 2396265 - RNA, 22 nt, Human
caccccugugcuccgugccucc

SEQ ID NO: 2396266 - RNA, 23 nt, Human
caccccugugcuccgugccucca

SEQ ID NO: 2396267 - RNA, 16 nt, Human
caccccuuauccagga

SEQ ID NO: 2396268 - RNA, 17 nt, Human
caccccuuauccaggac

SEQ ID NO: 2396269 - RNA, 18 nt, Human
caccccuuauccaggacu

SEQ ID NO: 2396270 - RNA, 19 nt, Human
caccccuuauccaggacuc

SEQ ID NO: 2396271 - RNA, 17 nt, Human
caccccugguucucauc

SEQ ID NO: 2396272 - RNA, 18 nt, Human
caccccugguucucaucu

SEQ ID NO: 2396273 - RNA, 18 nt, Human
caccccugggggcucuca

SEQ ID NO: 2396274 - RNA, 14 nt, Human
caccccugggggcu

SEQ ID NO: 2396275 - RNA, 12 nt, Human
caccccuggggg

SEQ ID NO: 2396276 - RNA, 17 nt, Human
caccccuguccucacug

SEQ ID NO: 2396277 - RNA, 18 nt, Human
caccccuguccucacugc

SEQ ID NO: 2396278 - RNA, 20 nt, Human
caccccuguccucacugcuc

SEQ ID NO: 2396279 - RNA, 21 nt, Human
caccccuguccucacugcucc

SEQ ID NO: 2396280 - RNA, 23 nt, Human
caccccuguccucacugcucccu

SEQ ID NO: 2396281 - RNA, 13 nt, Human
caccccugucucu

SEQ ID NO: 2396282 - RNA, 12 nt, Human
caccccugugcu

SEQ ID NO: 2396283 - RNA, 13 nt, Human
caccccugugcuc

SEQ ID NO: 2396284 - RNA, 18 nt, Human
caccccuuccccacugcc

SEQ ID NO: 2396285 - RNA, 12 nt, Human
caccccuuccug

SEQ ID NO: 2396286 - RNA, 15 nt, Human
caccccuuccccacu

SEQ ID NO: 2396287 - RNA, 14 nt, Human
caccccuuccccac

SEQ ID NO: 2396288 - RNA, 13 nt, Human
caccccuuccugu

SEQ ID NO: 2396289 - RNA, 14 nt, Human
caccccuuccuguc

SEQ ID NO: 2396290 - RNA, 16 nt, Human
caccccuuccuguccc

SEQ ID NO: 2396291 - RNA, 22 nt, Human
caccccuuccugucccaccucu

SEQ ID NO: 2396292 - RNA, 12 nt, Human
caccccuucucu

SEQ ID NO: 2396293 - RNA, 18 nt, Human
caccccuucucuccuccc

SEQ ID NO: 2396294 - RNA, 21 nt, Human
caccccuucucuccuccccaa

SEQ ID NO: 2396295 - RNA, 19 nt, Human
caccccuugcucucaaccc

SEQ ID NO: 2396296 - RNA, 13 nt, Human
cacccgaccacac

SEQ ID NO: 2396297 - RNA, 18 nt, Human
cacccgaggcugcccacu

SEQ ID NO: 2396298 - RNA, 17 nt, Human
cacccgaggcugcccac

SEQ ID NO: 2396299 - RNA, 13 nt, Human
cacccgaugcugc

SEQ ID NO: 2396300 - RNA, 14 nt, Human
cacccgaugcugcu

SEQ ID NO: 2396301 - RNA, 15 nt, Human
cacccgaugcugcuu

SEQ ID NO: 2396302 - RNA, 16 nt, Human
cacccgaugcugcuuu

SEQ ID NO: 2396303 - RNA, 18 nt, Human
cacccgaugcugcuuucc

SEQ ID NO: 2396304 - RNA, 19 nt, Human
cacccgaugcugcuuuccc

SEQ ID NO: 2396305 - RNA, 16 nt, Human
cacccgaggcugccca

SEQ ID NO: 2396306 - RNA, 15 nt, Human
cacccgaggcugccc

SEQ ID NO: 2396307 - RNA, 12 nt, Human
cacccgaggcug

SEQ ID NO: 2396308 - RNA, 16 nt, Human
cacccgacuccucaaa

SEQ ID NO: 2396309 - RNA, 15 nt, Human
cacccgacuccucaa

SEQ ID NO: 2396310 - RNA, 14 nt, Human
cacccgacuccuca

SEQ ID NO: 2396311 - RNA, 24 nt, Human
caccccugcccugggauguccaca

SEQ ID NO: 2396312 - RNA, 16 nt, Human
caccccugcccuggga

SEQ ID NO: 2396313 - RNA, 12 nt, Human
caccccugccuc

SEQ ID NO: 2396314 - RNA, 13 nt, Human
caccccugccucc

SEQ ID NO: 2396315 - RNA, 15 nt, Human
caccccugcccuggg

SEQ ID NO: 2396316 - RNA, 19 nt, Human
caccccugcccccagcccc

SEQ ID NO: 2396317 - RNA, 21 nt, Human
caccccugcccccacuuccug

SEQ ID NO: 2396318 - RNA, 18 nt, Human
caccccugcccccagccc

SEQ ID NO: 2396319 - RNA, 23 nt, Human
caccccugccuccacccucugag

SEQ ID NO: 2396320 - RNA, 20 nt, Human
caccccugccuccacccucu

SEQ ID NO: 2396321 - RNA, 22 nt, Human
caccccugccuccacccucuga

SEQ ID NO: 2396322 - RNA, 14 nt, Human
caccccugccucca

SEQ ID NO: 2396323 - RNA, 15 nt, Human
caccccugccuccac

SEQ ID NO: 2396324 - RNA, 16 nt, Human
caccccugccuccacc

SEQ ID NO: 2396325 - RNA, 18 nt, Human
caccccugccuccacccu

SEQ ID NO: 2396326 - RNA, 23 nt, Human
caccccuccuuccuugaccagca

SEQ ID NO: 2396327 - RNA, 12 nt, Human
caccccucucug

SEQ ID NO: 2396328 - RNA, 11 nt, Human
caccccugccc

SEQ ID NO: 2396329 - RNA, 15 nt, Human
caccccucucugcau

SEQ ID NO: 2396330 - RNA, 13 nt, Human
caccccugccccc

SEQ ID NO: 2396331 - RNA, 14 nt, Human
caccccugccccca

SEQ ID NO: 2396332 - RNA, 18 nt, Human
caccccugcccccacuuc

SEQ ID NO: 2396333 - RNA, 14 nt, Human
caccccuccuuccu

SEQ ID NO: 2396334 - RNA, 12 nt, Human
caccccuccuuc

SEQ ID NO: 2396335 - RNA, 18 nt, Human
caccccucccuuucuccc

SEQ ID NO: 2396336 - RNA, 22 nt, Human
caccccuccccugcccuagagc

SEQ ID NO: 2396337 - RNA, 15 nt, Human
caccccucccuuucu

SEQ ID NO: 2396338 - RNA, 15 nt, Human
caccccuccccugcc

SEQ ID NO: 2396339 - RNA, 13 nt, Human
caccccuccccau

SEQ ID NO: 2396340 - RNA, 17 nt, Human
caccccucccauuagga

SEQ ID NO: 2396341 - RNA, 13 nt, Human
caccccuccagga

SEQ ID NO: 2396342 - RNA, 10 nt, Human
caccccuccc

SEQ ID NO: 2396343 - RNA, 12 nt, Human
caccccucccau

SEQ ID NO: 2396344 - RNA, 13 nt, Human
caccccucccauu

SEQ ID NO: 2396345 - RNA, 12 nt, Human
caccccucacuc

SEQ ID NO: 2396346 - RNA, 17 nt, Human
caccccucacucuggcc

SEQ ID NO: 2396347 - RNA, 20 nt, Human
caccccucaacaccucugca

SEQ ID NO: 2396348 - RNA, 13 nt, Human
cacauauugauuu

SEQ ID NO: 2396349 - RNA, 20 nt, Human
cacauauugauuuccguuaa

SEQ ID NO: 2396350 - RNA, 14 nt, Human
caccguacugugga

SEQ ID NO: 2396351 - RNA, 23 nt, Human
caccgucauggcuuaauguuuau

SEQ ID NO: 2396352 - RNA, 15 nt, Human
caccgucauggcuua

SEQ ID NO: 2396353 - RNA, 19 nt, Human
caccgucauggcuuaaugu

SEQ ID NO: 2396354 - RNA, 14 nt, Human
caccguccgcccug

SEQ ID NO: 2396355 - RNA, 15 nt, Human
caccguccgcccugc

SEQ ID NO: 2396356 - RNA, 16 nt, Human
caccguccgcccugcu

SEQ ID NO: 2396357 - RNA, 15 nt, Human
caccgugccuggcca

SEQ ID NO: 2396358 - RNA, 15 nt, Human
caccguggcuaagag

SEQ ID NO: 2396359 - RNA, 17 nt, Human
caccguggaggaggaag

SEQ ID NO: 2396360 - RNA, 20 nt, Human
caccguggaccuuccugcca

SEQ ID NO: 2396361 - RNA, 23 nt, Human
caccguggaccuuccugccacca

SEQ ID NO: 2396362 - RNA, 16 nt, Human
caccguggaccuuccu

SEQ ID NO: 2396363 - RNA, 17 nt, Human
caccguggaccuuccug

SEQ ID NO: 2396364 - RNA, 18 nt, Human
caccguggaccuuccugc

SEQ ID NO: 2396365 - RNA, 19 nt, Human
caccguggaccuuccugcc

SEQ ID NO: 2396366 - RNA, 20 nt, Human
caccgugccuggccacgccc

SEQ ID NO: 2396367 - RNA, 15 nt, Human
caccguggaccuucc

SEQ ID NO: 2396368 - RNA, 18 nt, Human
caccguccgcccugcucc

SEQ ID NO: 2396369 - RNA, 19 nt, Human
caccguccgcccugcuccu

SEQ ID NO: 2396370 - RNA, 23 nt, Human
caccucaguucccuuggccucag

SEQ ID NO: 2396371 - RNA, 12 nt, Human
caccucaugccc

SEQ ID NO: 2396372 - RNA, 14 nt, Human
caccucaugcccac

SEQ ID NO: 2396373 - RNA, 15 nt, Human
caccucaugcccacc

SEQ ID NO: 2396374 - RNA, 16 nt, Human
caccucaugcccaccc

SEQ ID NO: 2396375 - RNA, 17 nt, Human
caccucaugcccacccc

SEQ ID NO: 2396376 - RNA, 18 nt, Human
caccucaugcccaccccc

SEQ ID NO: 2396377 - RNA, 22 nt, Human
caccucaguucccuuggccuca

SEQ ID NO: 2396378 - RNA, 21 nt, Human
caccucaguucccuuggccuc

SEQ ID NO: 2396379 - RNA, 20 nt, Human
caccucaguucccuuggccu

SEQ ID NO: 2396380 - RNA, 19 nt, Human
caccucaguucccuuggcc

SEQ ID NO: 2396381 - RNA, 18 nt, Human
caccucaguucccuuggc

SEQ ID NO: 2396382 - RNA, 17 nt, Human
caccucaguucccuugg

SEQ ID NO: 2396383 - RNA, 11 nt, Human
caccucaguuc

SEQ ID NO: 2396384 - RNA, 15 nt, Human
caccguguaaaccaa

SEQ ID NO: 2396385 - RNA, 16 nt, Human
caccguguaaaccaaa

SEQ ID NO: 2396386 - RNA, 15 nt, Human
caccgugggcaggga

SEQ ID NO: 2396387 - RNA, 13 nt, Human
caccgugggcucc

SEQ ID NO: 2396388 - RNA, 18 nt, Human
caccgugggcucccugac

SEQ ID NO: 2396389 - RNA, 17 nt, Human
caccgugggcucccuga

SEQ ID NO: 2396390 - RNA, 15 nt, Human
caccgggcacucaga

SEQ ID NO: 2396391 - RNA, 22 nt, Human
caccgggcacucagaagacacu

SEQ ID NO: 2396392 - RNA, 15 nt, Human
caccgggccacagag

SEQ ID NO: 2396393 - RNA, 18 nt, Human
caccgggccacagagaaa

SEQ ID NO: 2396394 - RNA, 13 nt, Human
caccgggccugga

SEQ ID NO: 2396395 - RNA, 15 nt, Human
caccggggccucgga

SEQ ID NO: 2396396 - RNA, 13 nt, Human
caccgcugccuaa

SEQ ID NO: 2396397 - RNA, 12 nt, Human
caccgcugccua

SEQ ID NO: 2396398 - RNA, 21 nt, Human
caccgcuccccagcccagggu

SEQ ID NO: 2396399 - RNA, 20 nt, Human
caccgcuccccagcccaggg

SEQ ID NO: 2396400 - RNA, 18 nt, Human
caccgcuccccagcccag

SEQ ID NO: 2396401 - RNA, 17 nt, Human
caccgcuccccagccca

SEQ ID NO: 2396402 - RNA, 16 nt, Human
caccgcuccccagccc

SEQ ID NO: 2396403 - RNA, 14 nt, Human
caccgcuccccagc

SEQ ID NO: 2396404 - RNA, 19 nt, Human
caccgcugccuaaguggcu

SEQ ID NO: 2396405 - RNA, 22 nt, Human
caccgcuuccggcuccugugcu

SEQ ID NO: 2396406 - RNA, 22 nt, Human
caccgcugccuaaguggcugcu

SEQ ID NO: 2396407 - RNA, 22 nt, Human
caccggagcuuucaaagaagga

SEQ ID NO: 2396408 - RNA, 23 nt, Human
caccgcuuccggcuccugugcuu

SEQ ID NO: 2396409 - RNA, 17 nt, Human
caccgccuccuacagcc

SEQ ID NO: 2396410 - RNA, 13 nt, Human
caccgcuccccag

SEQ ID NO: 2396411 - RNA, 21 nt, Human
caccgagaguagccgagagcc

SEQ ID NO: 2396412 - RNA, 13 nt, Human
caccgcagucguc

SEQ ID NO: 2396413 - RNA, 19 nt, Human
caccgcagucgucgcacag

SEQ ID NO: 2396414 - RNA, 14 nt, Human
caccgcaugccccc

SEQ ID NO: 2396415 - RNA, 21 nt, Human
caccgcagacaggaccaggga

SEQ ID NO: 2396416 - RNA, 15 nt, Human
caccgcaugcccccu

SEQ ID NO: 2396417 - RNA, 16 nt, Human
caccgcaugcccccuc

SEQ ID NO: 2396418 - RNA, 18 nt, Human
caccgcaugcccccucgu

SEQ ID NO: 2396419 - RNA, 19 nt, Human
caccgcaugcccccucgug

SEQ ID NO: 2396420 - RNA, 22 nt, Human
caccgcaugcccccucgugcca

SEQ ID NO: 2396421 - RNA, 21 nt, Human
caccgccacaauaaagaucgc

SEQ ID NO: 2396422 - RNA, 18 nt, Human
caccgccacauggcuucc

SEQ ID NO: 2396423 - RNA, 13 nt, Human
caccgccauggcu

SEQ ID NO: 2396424 - RNA, 23 nt, Human
caccgccauggcuuccaaggugg

SEQ ID NO: 2396425 - RNA, 16 nt, Human
caccgccauggcuucc

SEQ ID NO: 2396426 - RNA, 22 nt, Human
caccgccauggcuuccaaggug

SEQ ID NO: 2396427 - RNA, 19 nt, Human
caccgccgacuuuguaccc

SEQ ID NO: 2396428 - RNA, 22 nt, Human
caccgccgacuuuguacccccc

SEQ ID NO: 2396429 - RNA, 14 nt, Human
caccgggcacucag

SEQ ID NO: 2396430 - RNA, 20 nt, Human
caccggcuggccuggccccu

SEQ ID NO: 2396431 - RNA, 17 nt, Human
caccggcuggccuggcc

SEQ ID NO: 2396432 - RNA, 18 nt, Human
caccggcuggccuggccc

SEQ ID NO: 2396433 - RNA, 22 nt, Human
caccggauccuggguggucugc

SEQ ID NO: 2396434 - RNA, 21 nt, Human
caccggauccuggguggucug

SEQ ID NO: 2396435 - RNA, 15 nt, Human
caccggauccugggu

SEQ ID NO: 2396436 - RNA, 14 nt, Human
caccggcuggccug

SEQ ID NO: 2396437 - RNA, 15 nt, Human
caccggcuggccugg

SEQ ID NO: 2396438 - RNA, 16 nt, Human
caccggcuggccuggc

SEQ ID NO: 2396439 - RNA, 19 nt, Human
caccucucccugacccugu

SEQ ID NO: 2396440 - RNA, 14 nt, Human
caccucucccucaa

SEQ ID NO: 2396441 - RNA, 19 nt, Human
caccucucccucaacaagg

SEQ ID NO: 2396442 - RNA, 18 nt, Human
caccucuccaagggcuuc

SEQ ID NO: 2396443 - RNA, 22 nt, Human
caccucuccaagggcuucugca

SEQ ID NO: 2396444 - RNA, 12 nt, Human
caccucucccuc

SEQ ID NO: 2396445 - RNA, 13 nt, Human
caccucucccuca

SEQ ID NO: 2396446 - RNA, 13 nt, Human
caccucucccuug

SEQ ID NO: 2396447 - RNA, 14 nt, Human
caccucucccuugg

SEQ ID NO: 2396448 - RNA, 17 nt, Human
caccucucccuuggauu

SEQ ID NO: 2396449 - RNA, 12 nt, Human
caccuccuucuc

SEQ ID NO: 2396450 - RNA, 11 nt, Human
caccucuccaa

SEQ ID NO: 2396451 - RNA, 12 nt, Human
caccucuccaag

SEQ ID NO: 2396452 - RNA, 13 nt, Human
caccucuccaagg

SEQ ID NO: 2396453 - RNA, 15 nt, Human
caccucuccaagggc

SEQ ID NO: 2396454 - RNA, 16 nt, Human
caccucuccaagggcu

SEQ ID NO: 2396455 - RNA, 19 nt, Human
caccucccugaaccauccc

SEQ ID NO: 2396456 - RNA, 16 nt, Human
caccucccucccggca

SEQ ID NO: 2396457 - RNA, 12 nt, Human
caccucccuccc

SEQ ID NO: 2396458 - RNA, 12 nt, Human
caccucccugcc

SEQ ID NO: 2396459 - RNA, 14 nt, Human
caccuccucaugua

SEQ ID NO: 2396460 - RNA, 17 nt, Human
caccucccugccuccag

SEQ ID NO: 2396461 - RNA, 15 nt, Human
caccucccugccucc

SEQ ID NO: 2396462 - RNA, 14 nt, Human
caccucccugccuc

SEQ ID NO: 2396463 - RNA, 13 nt, Human
caccucccugccu

SEQ ID NO: 2396464 - RNA, 14 nt, Human
caccucccugaccc

SEQ ID NO: 2396465 - RNA, 14 nt, Human
caccuccugccucg

SEQ ID NO: 2396466 - RNA, 13 nt, Human
caccuccugccuc

SEQ ID NO: 2396467 - RNA, 11 nt, Human
caccuccugcc

SEQ ID NO: 2396468 - RNA, 21 nt, Human
caccuccccaggccguggcug

SEQ ID NO: 2396469 - RNA, 14 nt, Human
caccuccccagccu

SEQ ID NO: 2396470 - RNA, 14 nt, Human
caccuccccaggcc

SEQ ID NO: 2396471 - RNA, 15 nt, Human
caccuccccaggccg

SEQ ID NO: 2396472 - RNA, 21 nt, Human
caccucccccaucucuucugg

SEQ ID NO: 2396473 - RNA, 14 nt, Human
caccucccccaucu

SEQ ID NO: 2396474 - RNA, 18 nt, Human
caccuccccuauccaccc

SEQ ID NO: 2396475 - RNA, 14 nt, Human
caccuccccuaucc

SEQ ID NO: 2396476 - RNA, 13 nt, Human
caccuccccuauc

SEQ ID NO: 2396477 - RNA, 16 nt, Human
caccucccccugcccc

SEQ ID NO: 2396478 - RNA, 23 nt, Human
caccuccccccacugcaggcccc

SEQ ID NO: 2396479 - RNA, 20 nt, Human
caccucccccucccccuucu

SEQ ID NO: 2396480 - RNA, 22 nt, Human
caccuccccccacugcaggccc

SEQ ID NO: 2396481 - RNA, 21 nt, Human
caccuccccccacugcaggcc

SEQ ID NO: 2396482 - RNA, 18 nt, Human
caccuccccccacugcag

SEQ ID NO: 2396483 - RNA, 17 nt, Human
caccuccccccacugca

SEQ ID NO: 2396484 - RNA, 16 nt, Human
caccuccccccacugc

SEQ ID NO: 2396485 - RNA, 15 nt, Human
caccuccccccacug

SEQ ID NO: 2396486 - RNA, 14 nt, Human
caccuccccccacu

SEQ ID NO: 2396487 - RNA, 14 nt, Human
caccuccccuccuu

SEQ ID NO: 2396488 - RNA, 11 nt, Human
caccuccccuc

SEQ ID NO: 2396489 - RNA, 20 nt, Human
caccuccccuauccacccag

SEQ ID NO: 2396490 - RNA, 19 nt, Human
caccuccccuauccaccca

SEQ ID NO: 2396491 - RNA, 23 nt, Human
caccuccccuccuugccuccugu

SEQ ID NO: 2396492 - RNA, 15 nt, Human
caccuccccuccuug

SEQ ID NO: 2396493 - RNA, 10 nt, Human
caccucccug

SEQ ID NO: 2396494 - RNA, 10 nt, Human
caccucccuc

SEQ ID NO: 2396495 - RNA, 16 nt, Human
caccucccauccuaau

SEQ ID NO: 2396496 - RNA, 13 nt, Human
caccucccauccu

SEQ ID NO: 2396497 - RNA, 9 nt, Human
caccucccc

SEQ ID NO: 2396498 - RNA, 13 nt, Human
caccuccccacgc

SEQ ID NO: 2396499 - RNA, 12 nt, Human
caccucccagga

SEQ ID NO: 2396500 - RNA, 11 nt, Human
caccucccagg

SEQ ID NO: 2396501 - RNA, 14 nt, Human
caccuccccagcau

SEQ ID NO: 2396502 - RNA, 16 nt, Human
caccuccccagcauuc

SEQ ID NO: 2396503 - RNA, 14 nt, Human
caccuccccacgcc

SEQ ID NO: 2396504 - RNA, 17 nt, Human
caccuccccacgcccuc

SEQ ID NO: 2396505 - RNA, 19 nt, Human
caccuccccacgcccuccc

SEQ ID NO: 2396506 - RNA, 21 nt, Human
caccuccccacgcccuccccu

SEQ ID NO: 2396507 - RNA, 10 nt, Human
caccucccag

SEQ ID NO: 2396508 - RNA, 16 nt, Human
caccuccacauccucc

SEQ ID NO: 2396509 - RNA, 17 nt, Human
caccuccacauccucca

SEQ ID NO: 2396510 - RNA, 11 nt, Human
caccucaugga

SEQ ID NO: 2396511 - RNA, 12 nt, Human
caccucauggaa

SEQ ID NO: 2396512 - RNA, 14 nt, Human
caccucauggaauu

SEQ ID NO: 2396513 - RNA, 19 nt, Human
caccucaugcccacccccu

SEQ ID NO: 2396514 - RNA, 20 nt, Human
caccucaugcccacccccug

SEQ ID NO: 2396515 - RNA, 21 nt, Human
caccucaugcccacccccugc

SEQ ID NO: 2396516 - RNA, 22 nt, Human
caccucaugcccacccccugcc

SEQ ID NO: 2396517 - RNA, 13 nt, Human
caccuccacaguu

SEQ ID NO: 2396518 - RNA, 14 nt, Human
caccuccacaguuc

SEQ ID NO: 2396519 - RNA, 18 nt, Human
caccuccacaguucagug

SEQ ID NO: 2396520 - RNA, 20 nt, Human
caccuccacaguucaguggc

SEQ ID NO: 2396521 - RNA, 22 nt, Human
caccugcauccguaguucccug

SEQ ID NO: 2396522 - RNA, 22 nt, Human
caccugcagguugggccauacu

SEQ ID NO: 2396523 - RNA, 23 nt, Human
caccugcagguugggccauacug

SEQ ID NO: 2396524 - RNA, 18 nt, Human
caccugcagguugggcca

SEQ ID NO: 2396525 - RNA, 19 nt, Human
caccugcucccaggccagu

SEQ ID NO: 2396526 - RNA, 13 nt, Human
caccugcucccag

SEQ ID NO: 2396527 - RNA, 14 nt, Human
caccugcucccagg

SEQ ID NO: 2396528 - RNA, 23 nt, Human
caccugcugagaaaacaugccuc

SEQ ID NO: 2396529 - RNA, 23 nt, Human
caccugcggugcuaucuccccca

SEQ ID NO: 2396530 - RNA, 15 nt, Human
caccugcuggaguga

SEQ ID NO: 2396531 - RNA, 13 nt, Human
caccugcugcugc

SEQ ID NO: 2396532 - RNA, 22 nt, Human
caccugcugagagacccaagga

SEQ ID NO: 2396533 - RNA, 19 nt, Human
caccugcugagagacccaa

SEQ ID NO: 2396534 - RNA, 18 nt, Human
caccugcugagagaccca

SEQ ID NO: 2396535 - RNA, 14 nt, Human
caccugcucuucua

SEQ ID NO: 2396536 - RNA, 20 nt, Human
caccugcuggccccucaccu

SEQ ID NO: 2396537 - RNA, 18 nt, Human
caccugcuggccccucac

SEQ ID NO: 2396538 - RNA, 17 nt, Human
caccugcuggccccuca

SEQ ID NO: 2396539 - RNA, 16 nt, Human
caccugcuggccccuc

SEQ ID NO: 2396540 - RNA, 15 nt, Human
caccugcuggccccu

SEQ ID NO: 2396541 - RNA, 14 nt, Human
caccugcuggcccc

SEQ ID NO: 2396542 - RNA, 13 nt, Human
caccugcuggccc

SEQ ID NO: 2396543 - RNA, 22 nt, Human
caccugcuggccccucaccugg

SEQ ID NO: 2396544 - RNA, 20 nt, Human
caccuggaauauauaaccag

SEQ ID NO: 2396545 - RNA, 18 nt, Human
caccugagguuaggaguu

SEQ ID NO: 2396546 - RNA, 20 nt, Human
caccugaggugggcccagga

SEQ ID NO: 2396547 - RNA, 21 nt, Human
caccugaggugggcccaggac

SEQ ID NO: 2396548 - RNA, 17 nt, Human
caccugaggugggccca

SEQ ID NO: 2396549 - RNA, 18 nt, Human
caccugaggugggcccag

SEQ ID NO: 2396550 - RNA, 19 nt, Human
caccugaggugggcccagg

SEQ ID NO: 2396551 - RNA, 23 nt, Human
caccugagcccggaugcuucucc

SEQ ID NO: 2396552 - RNA, 21 nt, Human
caccugagcccggaugcuucu

SEQ ID NO: 2396553 - RNA, 15 nt, Human
caccugaggugggcc

SEQ ID NO: 2396554 - RNA, 15 nt, Human
caccugacucugaaa

SEQ ID NO: 2396555 - RNA, 20 nt, Human
caccugacucugaaaucuga

SEQ ID NO: 2396556 - RNA, 23 nt, Human
caccugacucugaaaucugaaga

SEQ ID NO: 2396557 - RNA, 21 nt, Human
caccugagcaggaccucugaa

SEQ ID NO: 2396558 - RNA, 20 nt, Human
caccugagcaggaccucuga

SEQ ID NO: 2396559 - RNA, 19 nt, Human
caccugagcaggaccucug

SEQ ID NO: 2396560 - RNA, 16 nt, Human
caccugagcaggaccu

SEQ ID NO: 2396561 - RNA, 15 nt, Human
caccugcaccucccc

SEQ ID NO: 2396562 - RNA, 14 nt, Human
caccugcaccuccc

SEQ ID NO: 2396563 - RNA, 13 nt, Human
caccugcaccucc

SEQ ID NO: 2396564 - RNA, 11 nt, Human
caccugcaccu

SEQ ID NO: 2396565 - RNA, 19 nt, Human
caccugcaccuccccccac

SEQ ID NO: 2396566 - RNA, 17 nt, Human
caccugcaccucccccc

SEQ ID NO: 2396567 - RNA, 22 nt, Human
caccugcaccuccccccacugc

SEQ ID NO: 2396568 - RNA, 23 nt, Human
caccugcacuuaaggcacucugu

SEQ ID NO: 2396569 - RNA, 24 nt, Human
caccugaggugggcccaggaccag

SEQ ID NO: 2396570 - RNA, 11 nt, Human
caccugaugug

SEQ ID NO: 2396571 - RNA, 15 nt, Human
caccugauguguaca

SEQ ID NO: 2396572 - RNA, 23 nt, Human
caccugagucacccuaccugugc

SEQ ID NO: 2396573 - RNA, 19 nt, Human
caccugagucacccuaccu

SEQ ID NO: 2396574 - RNA, 21 nt, Human
caccugauucaacuaaaaaaa

SEQ ID NO: 2396575 - RNA, 19 nt, Human
caccugauucaacuaaaaa

SEQ ID NO: 2396576 - RNA, 18 nt, Human
caccugauucaacuaaaa

SEQ ID NO: 2396577 - RNA, 17 nt, Human
caccugauucaacuaaa

SEQ ID NO: 2396578 - RNA, 16 nt, Human
caccugauucaacuaa

SEQ ID NO: 2396579 - RNA, 15 nt, Human
caccugauucaacua

SEQ ID NO: 2396580 - RNA, 16 nt, Human
caccugauguguacau

SEQ ID NO: 2396581 - RNA, 23 nt, Human
caccugaagacucauucuucugu

SEQ ID NO: 2396582 - RNA, 14 nt, Human
caccugaagacuca

SEQ ID NO: 2396583 - RNA, 15 nt, Human
caccugaagacucau

SEQ ID NO: 2396584 - RNA, 22 nt, Human
caccucuucucuuccuguaaca

SEQ ID NO: 2396585 - RNA, 19 nt, Human
caccucuuuguguuuuauu

SEQ ID NO: 2396586 - RNA, 17 nt, Human
caccucuucucuuccug

SEQ ID NO: 2396587 - RNA, 18 nt, Human
caccucuucucuuccugu

SEQ ID NO: 2396588 - RNA, 14 nt, Human
caccucuucacccc

SEQ ID NO: 2396589 - RNA, 20 nt, Human
caccucuucaccccccacuc

SEQ ID NO: 2396590 - RNA, 22 nt, Human
caccucugugaccucaggcacu

SEQ ID NO: 2396591 - RNA, 20 nt, Human
caccucugugaccucaggca

SEQ ID NO: 2396592 - RNA, 22 nt, Human
caccucuuaaagaaaacccacc

SEQ ID NO: 2396593 - RNA, 19 nt, Human
caccucuggacuggcuaga

SEQ ID NO: 2396594 - RNA, 13 nt, Human
caccucugugacc

SEQ ID NO: 2396595 - RNA, 14 nt, Human
caccucugugaccu

SEQ ID NO: 2396596 - RNA, 15 nt, Human
caccucugugaccuc

SEQ ID NO: 2396597 - RNA, 17 nt, Human
caccucugugaccucag

SEQ ID NO: 2396598 - RNA, 18 nt, Human
caccucugugaccucagg

SEQ ID NO: 2396599 - RNA, 19 nt, Human
caccucugugaccucaggc

SEQ ID NO: 2396600 - RNA, 18 nt, Human
caccucuggacuggcuag

SEQ ID NO: 2396601 - RNA, 17 nt, Human
caccucuggacuggcua

SEQ ID NO: 2396602 - RNA, 13 nt, Human
caccucuggacug

SEQ ID NO: 2396603 - RNA, 22 nt, Human
caccucugcggaccccagcugu

SEQ ID NO: 2396604 - RNA, 20 nt, Human
caccucugcggaccccagcu

SEQ ID NO: 2396605 - RNA, 21 nt, Human
caccucugcggaccccagcug

SEQ ID NO: 2396606 - RNA, 14 nt, Human
caccucugccucaa

SEQ ID NO: 2396607 - RNA, 12 nt, Human
caccucugcgga

SEQ ID NO: 2396608 - RNA, 18 nt, Human
caccucugcggaccccag

SEQ ID NO: 2396609 - RNA, 19 nt, Human
caccucugcggaccccagc

SEQ ID NO: 2396610 - RNA, 13 nt, Human
caccucugccuca

SEQ ID NO: 2396611 - RNA, 19 nt, Human
caccucugccagaagaucc

SEQ ID NO: 2396612 - RNA, 12 nt, Human
caccucugccag

SEQ ID NO: 2396613 - RNA, 13 nt, Human
caccucugccaga

SEQ ID NO: 2396614 - RNA, 23 nt, Human
caccucucccucaacaagggaga

SEQ ID NO: 2396615 - RNA, 16 nt, Human
caccucucuccuuugc

SEQ ID NO: 2396616 - RNA, 22 nt, Human
caccucugaaaacggcccucuu

SEQ ID NO: 2396617 - RNA, 22 nt, Human
caccucugaccuaucacuucca

SEQ ID NO: 2396618 - RNA, 19 nt, Human
caccucugcacaagcugca

SEQ ID NO: 2396619 - RNA, 18 nt, Human
caccucugcacaagcugc

SEQ ID NO: 2396620 - RNA, 15 nt, Human
caccucucucacucc

SEQ ID NO: 2396621 - RNA, 17 nt, Human
caccucucucacuccuu

SEQ ID NO: 2396622 - RNA, 18 nt, Human
caccucucucacuccuug

SEQ ID NO: 2396623 - RNA, 19 nt, Human
caccucucucacuccuuga

SEQ ID NO: 2396624 - RNA, 18 nt, Human
caccuguaaucccagcac

SEQ ID NO: 2396625 - RNA, 16 nt, Human
caccuguaaucccagc

SEQ ID NO: 2396626 - RNA, 21 nt, Human
caccuguaaucccagcuacuu

SEQ ID NO: 2396627 - RNA, 14 nt, Human
caccuguaaaccug

SEQ ID NO: 2396628 - RNA, 16 nt, Human
caccuguaaaccugag

SEQ ID NO: 2396629 - RNA, 15 nt, Human
caccuguaaaccuga

SEQ ID NO: 2396630 - RNA, 16 nt, Human
caccugguuccggaau

SEQ ID NO: 2396631 - RNA, 20 nt, Human
caccugguuccggaauccug

SEQ ID NO: 2396632 - RNA, 21 nt, Human
caccugguuccggaauccugu

SEQ ID NO: 2396633 - RNA, 23 nt, Human
caccugguuccggaauccugucc

SEQ ID NO: 2396634 - RNA, 17 nt, Human
caccugguggccucugc

SEQ ID NO: 2396635 - RNA, 15 nt, Human
caccugguggccucu

SEQ ID NO: 2396636 - RNA, 20 nt, Human
caccuggggugugggaggcc

SEQ ID NO: 2396637 - RNA, 19 nt, Human
caccugggcaccuggggag

SEQ ID NO: 2396638 - RNA, 15 nt, Human
caccugggcaccugg

SEQ ID NO: 2396639 - RNA, 12 nt, Human
caccugggcacc

SEQ ID NO: 2396640 - RNA, 16 nt, Human
caccugggcuuaagaa

SEQ ID NO: 2396641 - RNA, 19 nt, Human
caccugggcuuaagaaauc

SEQ ID NO: 2396642 - RNA, 20 nt, Human
caccuggggcagucaccugc

SEQ ID NO: 2396643 - RNA, 19 nt, Human
caccuggggcagucaccug

SEQ ID NO: 2396644 - RNA, 15 nt, Human
caccuggggcaguca

SEQ ID NO: 2396645 - RNA, 14 nt, Human
caccuggggcaguc

SEQ ID NO: 2396646 - RNA, 22 nt, Human
caccuggggagugggacagagu

SEQ ID NO: 2396647 - RNA, 17 nt, Human
caccuggggagugggac

SEQ ID NO: 2396648 - RNA, 15 nt, Human
caccuggggaguggg

SEQ ID NO: 2396649 - RNA, 14 nt, Human
caccuggggagugg

SEQ ID NO: 2396650 - RNA, 22 nt, Human
caccuggggugugggaggcccg

SEQ ID NO: 2396651 - RNA, 18 nt, Human
caccuggggugugggagg

SEQ ID NO: 2396652 - RNA, 10 nt, Human
caccuggggu

SEQ ID NO: 2396653 - RNA, 23 nt, Human
caccuggggcagucaccugccca

SEQ ID NO: 2396654 - RNA, 14 nt, Human
caccuggggcugcu

SEQ ID NO: 2396655 - RNA, 15 nt, Human
caccuggggcugcug

SEQ ID NO: 2396656 - RNA, 21 nt, Human
caccugucaaacaaagccaga

SEQ ID NO: 2396657 - RNA, 20 nt, Human
caccugucaaacaaagccag

SEQ ID NO: 2396658 - RNA, 13 nt, Human
caccugucaaaca

SEQ ID NO: 2396659 - RNA, 19 nt, Human
caccuguagucccagcuac

SEQ ID NO: 2396660 - RNA, 20 nt, Human
caccuguagucccagcuacu

SEQ ID NO: 2396661 - RNA, 18 nt, Human
caccuguagucccagcua

SEQ ID NO: 2396662 - RNA, 18 nt, Human
caccuguacucuuccgaa

SEQ ID NO: 2396663 - RNA, 16 nt, Human
caccuguagucccagc

SEQ ID NO: 2396664 - RNA, 15 nt, Human
caccuguagucccag

SEQ ID NO: 2396665 - RNA, 22 nt, Human
caccuguagcacuuacugguag

SEQ ID NO: 2396666 - RNA, 15 nt, Human
caccuguagcagcca

SEQ ID NO: 2396667 - RNA, 22 nt, Human
caccuguacucaggaggcugag

SEQ ID NO: 2396668 - RNA, 16 nt, Human
caccuguacucaggag

SEQ ID NO: 2396669 - RNA, 15 nt, Human
caccuguacucagga

SEQ ID NO: 2396670 - RNA, 23 nt, Human
caccuguacucaggaggcugagg

SEQ ID NO: 2396671 - RNA, 15 nt, Human
caccuguacucuucc

SEQ ID NO: 2396672 - RNA, 17 nt, Human
caccuguacucuuccga

SEQ ID NO: 2396673 - RNA, 18 nt, Human
caccuguagcacuuacug

SEQ ID NO: 2396674 - RNA, 23 nt, Human
caccugucaaacaaagccagaag

SEQ ID NO: 2396675 - RNA, 14 nt, Human
caccugucaggccu

SEQ ID NO: 2396676 - RNA, 15 nt, Human
caccugucccagaaa

SEQ ID NO: 2396677 - RNA, 18 nt, Human
caccugucucagccuccc

SEQ ID NO: 2396678 - RNA, 17 nt, Human
caccugucucagccucc

SEQ ID NO: 2396679 - RNA, 15 nt, Human
caccugucucagccu

SEQ ID NO: 2396680 - RNA, 14 nt, Human
caccugucccagaa

SEQ ID NO: 2396681 - RNA, 19 nt, Human
caccugucucagccuccca

SEQ ID NO: 2396682 - RNA, 16 nt, Human
caccuggccccauguc

SEQ ID NO: 2396683 - RNA, 15 nt, Human
caccuggccccaugu

SEQ ID NO: 2396684 - RNA, 14 nt, Human
caccuggccccaug

SEQ ID NO: 2396685 - RNA, 11 nt, Human
caccuggcccc

SEQ ID NO: 2396686 - RNA, 17 nt, Human
caccuggccaccugagg

SEQ ID NO: 2396687 - RNA, 19 nt, Human
caccuggccaccugaggug

SEQ ID NO: 2396688 - RNA, 20 nt, Human
caccuggccaccugaggugg

SEQ ID NO: 2396689 - RNA, 21 nt, Human
caccuggccaccugagguggg

SEQ ID NO: 2396690 - RNA, 22 nt, Human
caccuggccccaugucucucag

SEQ ID NO: 2396691 - RNA, 20 nt, Human
caccuggccccaugucucuc

SEQ ID NO: 2396692 - RNA, 17 nt, Human
caccuggcacugcugug

SEQ ID NO: 2396693 - RNA, 23 nt, Human
caccuggcaucgcaccauucuga

SEQ ID NO: 2396694 - RNA, 18 nt, Human
caccuggcacugcugugc

SEQ ID NO: 2396695 - RNA, 11 nt, Human
caccuggccac

SEQ ID NO: 2396696 - RNA, 12 nt, Human
caccuggccacc

SEQ ID NO: 2396697 - RNA, 13 nt, Human
caccuggccaccu

SEQ ID NO: 2396698 - RNA, 14 nt, Human
caccuggccaccug

SEQ ID NO: 2396699 - RNA, 15 nt, Human
caccuggccaccuga

SEQ ID NO: 2396700 - RNA, 12 nt, Human
caccuggccucu

SEQ ID NO: 2396701 - RNA, 13 nt, Human
caccuggccucug

SEQ ID NO: 2396702 - RNA, 14 nt, Human
caccuggccucugc

SEQ ID NO: 2396703 - RNA, 15 nt, Human
caccuggccucugca

SEQ ID NO: 2396704 - RNA, 23 nt, Human
caccuggccucugcacuccccug

SEQ ID NO: 2396705 - RNA, 11 nt, Human
caccugggcac

SEQ ID NO: 2396706 - RNA, 22 nt, Human
caccuggcugagguuccucugc

SEQ ID NO: 2396707 - RNA, 23 nt, Human
caccuggcugagguuccucugcc

SEQ ID NO: 2396708 - RNA, 19 nt, Human
caccuggcugagccuggcu

SEQ ID NO: 2396709 - RNA, 19 nt, Human
caccuggcugagguuccuc

SEQ ID NO: 2396710 - RNA, 20 nt, Human
caccuggcugagguuccucu

SEQ ID NO: 2396711 - RNA, 21 nt, Human
caccuggcugagguuccucug

SEQ ID NO: 2396712 - RNA, 17 nt, Human
caccuggccucugcacu

SEQ ID NO: 2396713 - RNA, 18 nt, Human
caccuggccucugcacuc

SEQ ID NO: 2396714 - RNA, 19 nt, Human
caccuggccucugcacucc

SEQ ID NO: 2396715 - RNA, 20 nt, Human
caccuggccucugcacuccc

SEQ ID NO: 2396716 - RNA, 16 nt, Human
cacgccagauucuuuc

SEQ ID NO: 2396717 - RNA, 19 nt, Human
cacgcaggaacucccagca

SEQ ID NO: 2396718 - RNA, 20 nt, Human
cacgcaggaacucccagcaa

SEQ ID NO: 2396719 - RNA, 13 nt, Human
cacgcaggaacuc

SEQ ID NO: 2396720 - RNA, 16 nt, Human
cacgcaggaacuccca

SEQ ID NO: 2396721 - RNA, 17 nt, Human
cacgcaggaacucccag

SEQ ID NO: 2396722 - RNA, 16 nt, Human
cacgcacgcacacaca

SEQ ID NO: 2396723 - RNA, 13 nt, Human
cacgccacugcac

SEQ ID NO: 2396724 - RNA, 15 nt, Human
cacgccacugcacua

SEQ ID NO: 2396725 - RNA, 19 nt, Human
cacgccagauucuuuccug

SEQ ID NO: 2396726 - RNA, 20 nt, Human
cacgccagauucuuuccuga

SEQ ID NO: 2396727 - RNA, 22 nt, Human
cacgccagauucuuuccugagg

SEQ ID NO: 2396728 - RNA, 13 nt, Human
cacgcccuccccu

SEQ ID NO: 2396729 - RNA, 15 nt, Human
cacgcccuccccucc

SEQ ID NO: 2396730 - RNA, 20 nt, Human
cacgcccguccugccugugg

SEQ ID NO: 2396731 - RNA, 21 nt, Human
cacgcccguccugccuguggc

SEQ ID NO: 2396732 - RNA, 14 nt, Human
cacgcccguccugc

SEQ ID NO: 2396733 - RNA, 15 nt, Human
cacgcccguccugcc

SEQ ID NO: 2396734 - RNA, 16 nt, Human
cacgcccguccugccu

SEQ ID NO: 2396735 - RNA, 19 nt, Human
cacgcccguccugccugug

SEQ ID NO: 2396736 - RNA, 17 nt, Human
cacgcccccacugguga

SEQ ID NO: 2396737 - RNA, 18 nt, Human
cacgcccccacuggugac

SEQ ID NO: 2396738 - RNA, 22 nt, Human
cacgccacugcacuccagccug

SEQ ID NO: 2396739 - RNA, 14 nt, Human
cacgccacugcacu

SEQ ID NO: 2396740 - RNA, 23 nt, Human
cacgcccaugugugagugugugc

SEQ ID NO: 2396741 - RNA, 15 nt, Human
cacgcccauguguga

SEQ ID NO: 2396742 - RNA, 14 nt, Human
cacgcccaugugug

SEQ ID NO: 2396743 - RNA, 23 nt, Human
cacgccagauucuuuccugaggc

SEQ ID NO: 2396744 - RNA, 13 nt, Human
cacgcccccacug

SEQ ID NO: 2396745 - RNA, 15 nt, Human
cacgcccccacuggu

SEQ ID NO: 2396746 - RNA, 14 nt, Human
cacgcacacacaca

SEQ ID NO: 2396747 - RNA, 13 nt, Human
cacgcacacacac

SEQ ID NO: 2396748 - RNA, 15 nt, Human
cacgcacacacacaa

SEQ ID NO: 2396749 - RNA, 21 nt, Human
cacgauguggcccuggccugc

SEQ ID NO: 2396750 - RNA, 12 nt, Human
cacgcacacaca

SEQ ID NO: 2396751 - RNA, 16 nt, Human
cacgauuucuguuuag

SEQ ID NO: 2396752 - RNA, 14 nt, Human
cacgauuucuguuu

SEQ ID NO: 2396753 - RNA, 12 nt, Human
cacgauuucugu

SEQ ID NO: 2396754 - RNA, 20 nt, Human
cacgcacacacacacacagg

SEQ ID NO: 2396755 - RNA, 15 nt, Human
cacgcacacacacac

SEQ ID NO: 2396756 - RNA, 12 nt, Human
cacgcaccuccc

SEQ ID NO: 2396757 - RNA, 19 nt, Human
cacgcaccucccauccuaa

SEQ ID NO: 2396758 - RNA, 15 nt, Human
cacgcaccucccauc

SEQ ID NO: 2396759 - RNA, 14 nt, Human
cacgcaccucccau

SEQ ID NO: 2396760 - RNA, 22 nt, Human
cacgcacacacacacacaggag

SEQ ID NO: 2396761 - RNA, 15 nt, Human
cacgcaccugccuca

SEQ ID NO: 2396762 - RNA, 12 nt, Human
cacgcaccugcc

SEQ ID NO: 2396763 - RNA, 17 nt, Human
cacgcacuucgggaggu

SEQ ID NO: 2396764 - RNA, 16 nt, Human
cacgcaccugccucag

SEQ ID NO: 2396765 - RNA, 13 nt, Human
cacgcaccugggu

SEQ ID NO: 2396766 - RNA, 12 nt, Human
cacgcacgcaca

SEQ ID NO: 2396767 - RNA, 13 nt, Human
cacgcacgcacac

SEQ ID NO: 2396768 - RNA, 14 nt, Human
cacgcacgcacaca

SEQ ID NO: 2396769 - RNA, 15 nt, Human
cacgcacgcacacac

SEQ ID NO: 2396770 - RNA, 20 nt, Human
cacgagcuguuuacuaggga

SEQ ID NO: 2396771 - RNA, 22 nt, Human
cacgagcaggcuacugucagcu

SEQ ID NO: 2396772 - RNA, 22 nt, Human
cacgauguggcccuggccugcu

SEQ ID NO: 2396773 - RNA, 18 nt, Human
cacgauguggcccuggcc

SEQ ID NO: 2396774 - RNA, 17 nt, Human
cacgauguggcccuggc

SEQ ID NO: 2396775 - RNA, 16 nt, Human
cacgauguggcccugg

SEQ ID NO: 2396776 - RNA, 15 nt, Human
cacgauguggcccug

SEQ ID NO: 2396777 - RNA, 14 nt, Human
cacgauguggcccu

SEQ ID NO: 2396778 - RNA, 15 nt, Human
cacgaugaaaaacuu

SEQ ID NO: 2396779 - RNA, 20 nt, Human
cacgauaaauaaucggccca

SEQ ID NO: 2396780 - RNA, 12 nt, Human
cacgaugaaaaa

SEQ ID NO: 2396781 - RNA, 23 nt, Human
cacgagcaaagugaagacacugg

SEQ ID NO: 2396782 - RNA, 13 nt, Human
cacgagagcccgg

SEQ ID NO: 2396783 - RNA, 17 nt, Human
cacgagcaggcuacugu

SEQ ID NO: 2396784 - RNA, 20 nt, Human
cacgagcaggcuacugucag

SEQ ID NO: 2396785 - RNA, 19 nt, Human
cacgagcaggcuacuguca

SEQ ID NO: 2396786 - RNA, 14 nt, Human
caccuuccagcucc

SEQ ID NO: 2396787 - RNA, 15 nt, Human
caccuuccagcuccu

SEQ ID NO: 2396788 - RNA, 15 nt, Human
caccuucccagcucu

SEQ ID NO: 2396789 - RNA, 13 nt, Human
caccuucccagcu

SEQ ID NO: 2396790 - RNA, 12 nt, Human
caccuucccagc

SEQ ID NO: 2396791 - RNA, 16 nt, Human
caccuuccagcuccug

SEQ ID NO: 2396792 - RNA, 18 nt, Human
caccuuccagcuccugua

SEQ ID NO: 2396793 - RNA, 19 nt, Human
caccuucaauuccugggcc

SEQ ID NO: 2396794 - RNA, 18 nt, Human
caccuucaauuccugggc

SEQ ID NO: 2396795 - RNA, 17 nt, Human
caccuucaauuccuggg

SEQ ID NO: 2396796 - RNA, 15 nt, Human
caccuuauauuuacg

SEQ ID NO: 2396797 - RNA, 18 nt, Human
caccuuaggcagggaagu

SEQ ID NO: 2396798 - RNA, 15 nt, Human
caccuuaguggcuuu

SEQ ID NO: 2396799 - RNA, 17 nt, Human
caccuuaggcagggaag

SEQ ID NO: 2396800 - RNA, 14 nt, Human
caccuuaggcaggg

SEQ ID NO: 2396801 - RNA, 13 nt, Human
caccuuaggcagg

SEQ ID NO: 2396802 - RNA, 22 nt, Human
caccuuagccugcccuccuuuc

SEQ ID NO: 2396803 - RNA, 13 nt, Human
caccuuagcuggc

SEQ ID NO: 2396804 - RNA, 17 nt, Human
caccuuaccaacuuucu

SEQ ID NO: 2396805 - RNA, 20 nt, Human
caccuguugcuuacaauuuu

SEQ ID NO: 2396806 - RNA, 18 nt, Human
caccuuaccaacuuucug

SEQ ID NO: 2396807 - RNA, 19 nt, Human
caccuuaccaacuuucugu

SEQ ID NO: 2396808 - RNA, 21 nt, Human
caccuuagacagucccugcca

SEQ ID NO: 2396809 - RNA, 23 nt, Human
caccuuagacagucccugccaau

SEQ ID NO: 2396810 - RNA, 19 nt, Human
caccugugaguuuaaagca

SEQ ID NO: 2396811 - RNA, 20 nt, Human
caccugugaguuuaaagcaa

SEQ ID NO: 2396812 - RNA, 19 nt, Human
caccuguuuuuaagcuguu

SEQ ID NO: 2396813 - RNA, 16 nt, Human
caccuguugcuuacaa

SEQ ID NO: 2396814 - RNA, 19 nt, Human
caccuguugcuuacaauuu

SEQ ID NO: 2396815 - RNA, 20 nt, Human
caccuguuuuuaagcuguuu

SEQ ID NO: 2396816 - RNA, 19 nt, Human
caccugugcuucgggcccu

SEQ ID NO: 2396817 - RNA, 23 nt, Human
caccugugcagcgaagcuuagcg

SEQ ID NO: 2396818 - RNA, 11 nt, Human
caccuguuacu

SEQ ID NO: 2396819 - RNA, 14 nt, Human
caccuuagacaguc

SEQ ID NO: 2396820 - RNA, 16 nt, Human
caccuuagacaguccc

SEQ ID NO: 2396821 - RNA, 18 nt, Human
caccuuagacagucccug

SEQ ID NO: 2396822 - RNA, 19 nt, Human
caccuuagacagucccugc

SEQ ID NO: 2396823 - RNA, 22 nt, Human
cacgaacccaccugcugagaga

SEQ ID NO: 2396824 - RNA, 19 nt, Human
cacgaacuuuagcugcauc

SEQ ID NO: 2396825 - RNA, 15 nt, Human
cacgaaguguugcau

SEQ ID NO: 2396826 - RNA, 16 nt, Human
cacgaaguguugcaug

SEQ ID NO: 2396827 - RNA, 18 nt, Human
cacgaacccaccugcuga

SEQ ID NO: 2396828 - RNA, 16 nt, Human
cacgaacccaccugcu

SEQ ID NO: 2396829 - RNA, 14 nt, Human
cacgaacccaccug

SEQ ID NO: 2396830 - RNA, 16 nt, Human
cacgaauauugcugau

SEQ ID NO: 2396831 - RNA, 19 nt, Human
cacgaauauugcugauggu

SEQ ID NO: 2396832 - RNA, 22 nt, Human
cacgaauauugcugauggugca

SEQ ID NO: 2396833 - RNA, 16 nt, Human
cacgacugcccggcag

SEQ ID NO: 2396834 - RNA, 18 nt, Human
cacgaauuugcuggggaa

SEQ ID NO: 2396835 - RNA, 18 nt, Human
cacgaaguguugcaugga

SEQ ID NO: 2396836 - RNA, 22 nt, Human
cacgaauuugcuggggaaucuc

SEQ ID NO: 2396837 - RNA, 17 nt, Human
cacgacugcccggcagg

SEQ ID NO: 2396838 - RNA, 16 nt, Human
cacgacugucuccaug

SEQ ID NO: 2396839 - RNA, 13 nt, Human
cacgacugucucc

SEQ ID NO: 2396840 - RNA, 19 nt, Human
cacgaccucggcucacugc

SEQ ID NO: 2396841 - RNA, 13 nt, Human
caccuugacaggg

SEQ ID NO: 2396842 - RNA, 23 nt, Human
caccuucguuuacuaugccugug

SEQ ID NO: 2396843 - RNA, 22 nt, Human
caccuucguuuacuaugccugu

SEQ ID NO: 2396844 - RNA, 21 nt, Human
caccuucguuuacuaugccug

SEQ ID NO: 2396845 - RNA, 14 nt, Human
caccuuccucacuu

SEQ ID NO: 2396846 - RNA, 20 nt, Human
caccuuccucacuuccauac

SEQ ID NO: 2396847 - RNA, 22 nt, Human
caccuucccagcucucccucug

SEQ ID NO: 2396848 - RNA, 21 nt, Human
caccuucccagcucucccucu

SEQ ID NO: 2396849 - RNA, 19 nt, Human
caccuucccagcucucccu

SEQ ID NO: 2396850 - RNA, 17 nt, Human
caccuucccagcucucc

SEQ ID NO: 2396851 - RNA, 13 nt, Human
caccuucccaugc

SEQ ID NO: 2396852 - RNA, 14 nt, Human
caccuucccaugcc

SEQ ID NO: 2396853 - RNA, 13 nt, Human
caccuuccucacu

SEQ ID NO: 2396854 - RNA, 15 nt, Human
caccuugacagggca

SEQ ID NO: 2396855 - RNA, 16 nt, Human
caccuugacagggcac

SEQ ID NO: 2396856 - RNA, 18 nt, Human
caccuugacagggcacac

SEQ ID NO: 2396857 - RNA, 22 nt, Human
caccuugaagaaccucucacuu

SEQ ID NO: 2396858 - RNA, 17 nt, Human
cacgaaauguuauuuuu

SEQ ID NO: 2396859 - RNA, 20 nt, Human
cacgccuguaaucccagcac

SEQ ID NO: 2396860 - RNA, 21 nt, Human
cacgccuguaaucccagcacu

SEQ ID NO: 2396861 - RNA, 22 nt, Human
cacgccuguaaucccagcacuu

SEQ ID NO: 2396862 - RNA, 12 nt, Human
cacgccugugca

SEQ ID NO: 2396863 - RNA, 15 nt, Human
cacgcgugcacacac

SEQ ID NO: 2396864 - RNA, 16 nt, Human
cacgcgugcacacacc

SEQ ID NO: 2396865 - RNA, 21 nt, Human
cacgcgugcacacaccagagc

SEQ ID NO: 2396866 - RNA, 21 nt, Human
cacgccuguaaucccagcagu

SEQ ID NO: 2396867 - RNA, 20 nt, Human
cacgccuguaaucccagcag

SEQ ID NO: 2396868 - RNA, 22 nt, Human
cacgcuaaucccgauucacccu

SEQ ID NO: 2396869 - RNA, 23 nt, Human
cacgcgugcacacaccagagccc

SEQ ID NO: 2396870 - RNA, 15 nt, Human
cacgcuccccgccug

SEQ ID NO: 2396871 - RNA, 16 nt, Human
cacgcuccccgccugu

SEQ ID NO: 2396872 - RNA, 18 nt, Human
cacgcuccccgccuguuc

SEQ ID NO: 2396873 - RNA, 19 nt, Human
cacgcuccccgccuguucc

SEQ ID NO: 2396874 - RNA, 20 nt, Human
cacgcuccccgccuguuccc

SEQ ID NO: 2396875 - RNA, 21 nt, Human
cacgcuccccgccuguucccc

SEQ ID NO: 2396876 - RNA, 18 nt, Human
cacgcuccucccucugag

SEQ ID NO: 2396877 - RNA, 23 nt, Human
cacgcuccucccucugaggcugu

SEQ ID NO: 2396878 - RNA, 22 nt, Human
cacgccucccacugggguccag

SEQ ID NO: 2396879 - RNA, 17 nt, Human
cacgccugcaaacgcug

SEQ ID NO: 2396880 - RNA, 17 nt, Human
cacgccucccacugggg

SEQ ID NO: 2396881 - RNA, 18 nt, Human
cacgccucccacuggggu

SEQ ID NO: 2396882 - RNA, 13 nt, Human
cacgccucccacu

SEQ ID NO: 2396883 - RNA, 14 nt, Human
cacgccucccacug

SEQ ID NO: 2396884 - RNA, 15 nt, Human
cacgccucccacugg

SEQ ID NO: 2396885 - RNA, 16 nt, Human
cacgccucccacuggg

SEQ ID NO: 2396886 - RNA, 22 nt, Human
cacgccuaugaucccagcacuu

SEQ ID NO: 2396887 - RNA, 21 nt, Human
cacgccuaugaucccagcacu

SEQ ID NO: 2396888 - RNA, 19 nt, Human
cacgccuaugaucccagca

SEQ ID NO: 2396889 - RNA, 18 nt, Human
cacgccuaugaucccagc

SEQ ID NO: 2396890 - RNA, 21 nt, Human
cacgcccuccccuccccugcu

SEQ ID NO: 2396891 - RNA, 16 nt, Human
cacgcccuccccuccc

SEQ ID NO: 2396892 - RNA, 20 nt, Human
cacgcccuccccuccccugc

SEQ ID NO: 2396893 - RNA, 24 nt, Human
cacgcccuccccuccccugcugca

SEQ ID NO: 2396894 - RNA, 20 nt, Human
cacgccuguaauccuagcac

SEQ ID NO: 2396895 - RNA, 19 nt, Human
cacgccuguaauccuagca

SEQ ID NO: 2396896 - RNA, 14 nt, Human
cacgccuguaaucc

SEQ ID NO: 2396897 - RNA, 22 nt, Human
cacgccugcaaacgcugccugc

SEQ ID NO: 2396898 - RNA, 21 nt, Human
cacgccugcaaacgcugccug

SEQ ID NO: 2396899 - RNA, 16 nt, Human
cacgccuguaauccca

SEQ ID NO: 2396900 - RNA, 23 nt, Human
cacgccugcaaacgcugccugcc

SEQ ID NO: 2396901 - RNA, 19 nt, Human
cacgccuguaaucccagca

SEQ ID NO: 2396902 - RNA, 18 nt, Human
cacgccuguaaucccagc

SEQ ID NO: 2396903 - RNA, 17 nt, Human
cacgccuguaaucccag

SEQ ID NO: 2396904 - RNA, 20 nt, Human
cacgcuggaccuugaacugg

SEQ ID NO: 2396905 - RNA, 17 nt, Human
cacgcuggaccuugaac

SEQ ID NO: 2396906 - RNA, 14 nt, Human
cacgcuccuuccuc

SEQ ID NO: 2396907 - RNA, 16 nt, Human
cacggcucacugcagc

SEQ ID NO: 2396908 - RNA, 17 nt, Human
cacggcucacugcagcc

SEQ ID NO: 2396909 - RNA, 19 nt, Human
cacggcucacugcagccuc

SEQ ID NO: 2396910 - RNA, 20 nt, Human
cacggcucacugcagccuca

SEQ ID NO: 2396911 - RNA, 15 nt, Human
cacgggagauuucuu

SEQ ID NO: 2396912 - RNA, 12 nt, Human
cacggcugcuga

SEQ ID NO: 2396913 - RNA, 13 nt, Human
cacggcugcugag

SEQ ID NO: 2396914 - RNA, 20 nt, Human
cacggcucuagguggggcgg

SEQ ID NO: 2396915 - RNA, 15 nt, Human
cacgggguauuuuag

SEQ ID NO: 2396916 - RNA, 15 nt, Human
cacgggggcagcuga

SEQ ID NO: 2396917 - RNA, 22 nt, Human
cacgggggcagcugauacaaau

SEQ ID NO: 2396918 - RNA, 15 nt, Human
cacgggggccaagga

SEQ ID NO: 2396919 - RNA, 14 nt, Human
cacggucuguucuu

SEQ ID NO: 2396920 - RNA, 14 nt, Human
cacgguagugccug

SEQ ID NO: 2396921 - RNA, 21 nt, Human
cacggucgccaccuggcauuc

SEQ ID NO: 2396922 - RNA, 15 nt, Human
cacgguagugccuga

SEQ ID NO: 2396923 - RNA, 15 nt, Human
cacggugccuuuuuu

SEQ ID NO: 2396924 - RNA, 17 nt, Human
cacggugccuuuuuuca

SEQ ID NO: 2396925 - RNA, 16 nt, Human
cacggugggccuugcu

SEQ ID NO: 2396926 - RNA, 14 nt, Human
cacggugggccuug

SEQ ID NO: 2396927 - RNA, 17 nt, Human
cacgguuugaagccugg

SEQ ID NO: 2396928 - RNA, 18 nt, Human
cacgguuugaagccugga

SEQ ID NO: 2396929 - RNA, 22 nt, Human
cacuaaacuuuacccaaaaacu

SEQ ID NO: 2396930 - RNA, 12 nt, Human
cacuaaagcagu

SEQ ID NO: 2396931 - RNA, 17 nt, Human
cacuaaacagacuauuu

SEQ ID NO: 2396932 - RNA, 13 nt, Human
cacuaaacaaaga

SEQ ID NO: 2396933 - RNA, 22 nt, Human
cacguucucacacccaccgucc

SEQ ID NO: 2396934 - RNA, 23 nt, Human
cacguuucuaaaggcuaccuuug

SEQ ID NO: 2396935 - RNA, 14 nt, Human
cacguuucuaaagg

SEQ ID NO: 2396936 - RNA, 12 nt, Human
cacguuucuaaa

SEQ ID NO: 2396937 - RNA, 13 nt, Human
cacguucaccccu

SEQ ID NO: 2396938 - RNA, 19 nt, Human
cacguuccuuacugcagaa

SEQ ID NO: 2396939 - RNA, 18 nt, Human
cacguuaugguguuucuc

SEQ ID NO: 2396940 - RNA, 20 nt, Human
cacguuccuucccccgcaau

SEQ ID NO: 2396941 - RNA, 18 nt, Human
cacguucucacacccacc

SEQ ID NO: 2396942 - RNA, 19 nt, Human
cacguucucacacccaccg

SEQ ID NO: 2396943 - RNA, 22 nt, Human
cacguucuuacuaguuucccuu

SEQ ID NO: 2396944 - RNA, 16 nt, Human
cacgugugugacucag

SEQ ID NO: 2396945 - RNA, 12 nt, Human
cacgugugugac

SEQ ID NO: 2396946 - RNA, 11 nt, Human
cacguguguga

SEQ ID NO: 2396947 - RNA, 13 nt, Human
cacguuauggugu

SEQ ID NO: 2396948 - RNA, 23 nt, Human
cacguguuuuauuccuguauguu

SEQ ID NO: 2396949 - RNA, 22 nt, Human
cacguguuuuauuccuguaugu

SEQ ID NO: 2396950 - RNA, 16 nt, Human
cacguguuugugcugu

SEQ ID NO: 2396951 - RNA, 20 nt, Human
cacguguaacugucagccgg

SEQ ID NO: 2396952 - RNA, 16 nt, Human
cacgugggcucauaug

SEQ ID NO: 2396953 - RNA, 19 nt, Human
cacguguggccuguucuuc

SEQ ID NO: 2396954 - RNA, 15 nt, Human
cacguguccuguagu

SEQ ID NO: 2396955 - RNA, 16 nt, Human
cacguguccuguaguu

SEQ ID NO: 2396956 - RNA, 16 nt, Human
cacgugguccuaaucu

SEQ ID NO: 2396957 - RNA, 19 nt, Human
cacgugguccuaaucuucu

SEQ ID NO: 2396958 - RNA, 17 nt, Human
cacguaguagggucagg

SEQ ID NO: 2396959 - RNA, 23 nt, Human
cacguagcccccaggcugcugga

SEQ ID NO: 2396960 - RNA, 16 nt, Human
cacguacuuaaaugaa

SEQ ID NO: 2396961 - RNA, 20 nt, Human
cacgguuugaagccuggaac

SEQ ID NO: 2396962 - RNA, 19 nt, Human
cacgguuugaagccuggaa

SEQ ID NO: 2396963 - RNA, 15 nt, Human
cacguacaaaaucca

SEQ ID NO: 2396964 - RNA, 19 nt, Human
cacguaguagggucaggcc

SEQ ID NO: 2396965 - RNA, 20 nt, Human
cacguaguagggucaggcca

SEQ ID NO: 2396966 - RNA, 21 nt, Human
cacguaguagggucaggccac

SEQ ID NO: 2396967 - RNA, 23 nt, Human
cacguaguagggucaggccacgg

SEQ ID NO: 2396968 - RNA, 17 nt, Human
cacgucauguuucuuca

SEQ ID NO: 2396969 - RNA, 14 nt, Human
cacgucaugggagg

SEQ ID NO: 2396970 - RNA, 16 nt, Human
cacguccagaauuuuu

SEQ ID NO: 2396971 - RNA, 13 nt, Human
cacgucccccugg

SEQ ID NO: 2396972 - RNA, 17 nt, Human
cacgucaucuaguuuua

SEQ ID NO: 2396973 - RNA, 14 nt, Human
cacguccugucagu

SEQ ID NO: 2396974 - RNA, 15 nt, Human
cacgucccccugggg

SEQ ID NO: 2396975 - RNA, 16 nt, Human
cacgucccccuggggc

SEQ ID NO: 2396976 - RNA, 17 nt, Human
cacgucccccuggggcu

SEQ ID NO: 2396977 - RNA, 20 nt, Human
cacgucccccuggggcuucu

SEQ ID NO: 2396978 - RNA, 18 nt, Human
cacguacacacacauaca

SEQ ID NO: 2396979 - RNA, 19 nt, Human
cacguacacacacauacac

SEQ ID NO: 2396980 - RNA, 14 nt, Human
cacguacacacaca

SEQ ID NO: 2396981 - RNA, 19 nt, Human
cacguaaugaaacuuggau

SEQ ID NO: 2396982 - RNA, 16 nt, Human
cacguaaugaaacuug

SEQ ID NO: 2396983 - RNA, 20 nt, Human
cacguggaggaaugcucccc

SEQ ID NO: 2396984 - RNA, 19 nt, Human
cacgugcuacccccaugcu

SEQ ID NO: 2396985 - RNA, 18 nt, Human
cacguggaggagcagugc

SEQ ID NO: 2396986 - RNA, 20 nt, Human
cacguggaggagcagugcag

SEQ ID NO: 2396987 - RNA, 21 nt, Human
cacguggaggagcagugcagg

SEQ ID NO: 2396988 - RNA, 18 nt, Human
cacguggcauguggccug

SEQ ID NO: 2396989 - RNA, 19 nt, Human
cacguggcauguggccugu

SEQ ID NO: 2396990 - RNA, 20 nt, Human
cacguggcauguggccugug

SEQ ID NO: 2396991 - RNA, 23 nt, Human
cacguggagagcuggugcccgga

SEQ ID NO: 2396992 - RNA, 15 nt, Human
cacguggagagcugg

SEQ ID NO: 2396993 - RNA, 13 nt, Human
cacguggagagcu

SEQ ID NO: 2396994 - RNA, 16 nt, Human
cacgugccaggcccgg

SEQ ID NO: 2396995 - RNA, 15 nt, Human
cacgugggaaccccc

SEQ ID NO: 2396996 - RNA, 22 nt, Human
cacguggcauguggccuguggc

SEQ ID NO: 2396997 - RNA, 21 nt, Human
cacgugggaaccccccuccca

SEQ ID NO: 2396998 - RNA, 20 nt, Human
cacguggccucuugagcagu

SEQ ID NO: 2396999 - RNA, 23 nt, Human
cacguggccucuugagcaguggc

SEQ ID NO: 2397000 - RNA, 12 nt, Human
cacguggccucu

SEQ ID NO: 2397001 - RNA, 13 nt, Human
cacguggccucuu

SEQ ID NO: 2397002 - RNA, 17 nt, Human
cacguggccucuugagc

SEQ ID NO: 2397003 - RNA, 18 nt, Human
cacguggccucuugagca

SEQ ID NO: 2397004 - RNA, 15 nt, Human
cacgugccaggcccg

SEQ ID NO: 2397005 - RNA, 14 nt, Human
cacgugccaggccc

SEQ ID NO: 2397006 - RNA, 13 nt, Human
cacgugccaggcc

SEQ ID NO: 2397007 - RNA, 21 nt, Human
cacgugagaaucccuggcaaa

SEQ ID NO: 2397008 - RNA, 18 nt, Human
cacgugacagugccuggg

SEQ ID NO: 2397009 - RNA, 20 nt, Human
cacgugagaaucccuggcaa

SEQ ID NO: 2397010 - RNA, 16 nt, Human
cacgugcagcucaagg

SEQ ID NO: 2397011 - RNA, 13 nt, Human
cacgugacagccg

SEQ ID NO: 2397012 - RNA, 18 nt, Human
cacgucuuccuucugccu

SEQ ID NO: 2397013 - RNA, 23 nt, Human
cacgucuuccuucugccugagcu

SEQ ID NO: 2397014 - RNA, 15 nt, Human
cacgucugucuucac

SEQ ID NO: 2397015 - RNA, 15 nt, Human
cacgucuuccuucug

SEQ ID NO: 2397016 - RNA, 16 nt, Human
cacgucuuccuucugc

SEQ ID NO: 2397017 - RNA, 14 nt, Human
cacgucugucuuca

SEQ ID NO: 2397018 - RNA, 18 nt, Human
cacgucugacccucucca

SEQ ID NO: 2397019 - RNA, 17 nt, Human
cacgucugacccucucc

SEQ ID NO: 2397020 - RNA, 16 nt, Human
cacgucugacccucuc

SEQ ID NO: 2397021 - RNA, 16 nt, Human
cacguccugucagugc

SEQ ID NO: 2397022 - RNA, 17 nt, Human
cacguccugucagugcc

SEQ ID NO: 2397023 - RNA, 19 nt, Human
cacguccugucagugccgc

SEQ ID NO: 2397024 - RNA, 23 nt, Human
cacguccugucagugccgccgcc

SEQ ID NO: 2397025 - RNA, 23 nt, Human
cacuauuuuuauuuauauuuuug

SEQ ID NO: 2397026 - RNA, 14 nt, Human
cacucaacaugagu

SEQ ID NO: 2397027 - RNA, 14 nt, Human
cacucaagaagcag

SEQ ID NO: 2397028 - RNA, 15 nt, Human
cacucaagaagcagg

SEQ ID NO: 2397029 - RNA, 17 nt, Human
cacucaagaagcaggcu

SEQ ID NO: 2397030 - RNA, 16 nt, Human
cacucaaauuaaucuu

SEQ ID NO: 2397031 - RNA, 19 nt, Human
cacucaaauuaaucuuucu

SEQ ID NO: 2397032 - RNA, 20 nt, Human
cacucaaauuaaucuuucuu

SEQ ID NO: 2397033 - RNA, 20 nt, Human
cacucaaaagcugggcaggu

SEQ ID NO: 2397034 - RNA, 16 nt, Human
cacucaaaucaagaaa

SEQ ID NO: 2397035 - RNA, 15 nt, Human
cacucacacagccag

SEQ ID NO: 2397036 - RNA, 16 nt, Human
cacucacacagccagg

SEQ ID NO: 2397037 - RNA, 18 nt, Human
cacucacacagccaggug

SEQ ID NO: 2397038 - RNA, 22 nt, Human
cacucaaugcagccagaccuau

SEQ ID NO: 2397039 - RNA, 22 nt, Human
cacucacacagccaggugccuu

SEQ ID NO: 2397040 - RNA, 23 nt, Human
cacucacacagccaggugccuug

SEQ ID NO: 2397041 - RNA, 12 nt, Human
cacucacacagg

SEQ ID NO: 2397042 - RNA, 13 nt, Human
cacucacacagga

SEQ ID NO: 2397043 - RNA, 14 nt, Human
cacucacacaggac

SEQ ID NO: 2397044 - RNA, 21 nt, Human
cacucacacaggacccccuuc

SEQ ID NO: 2397045 - RNA, 22 nt, Human
cacucacacaggacccccuucc

SEQ ID NO: 2397046 - RNA, 16 nt, Human
cacucacagaccugga

SEQ ID NO: 2397047 - RNA, 18 nt, Human
cacucaagccaagcagcc

SEQ ID NO: 2397048 - RNA, 13 nt, Human
cacucaagcuugg

SEQ ID NO: 2397049 - RNA, 16 nt, Human
cacucaagccaagcag

SEQ ID NO: 2397050 - RNA, 15 nt, Human
cacucaagccaagca

SEQ ID NO: 2397051 - RNA, 17 nt, Human
cacucaaugcagccaga

SEQ ID NO: 2397052 - RNA, 12 nt, Human
cacucaagccaa

SEQ ID NO: 2397053 - RNA, 23 nt, Human
cacucaagaagcaggcuacacug

SEQ ID NO: 2397054 - RNA, 19 nt, Human
cacucaagaagcaggcuac

SEQ ID NO: 2397055 - RNA, 20 nt, Human
cacucaagaagcaggcuaca

SEQ ID NO: 2397056 - RNA, 19 nt, Human
cacucaaaagcugggcagg

SEQ ID NO: 2397057 - RNA, 18 nt, Human
cacucaaaagcugggcag

SEQ ID NO: 2397058 - RNA, 17 nt, Human
cacucaaaagcugggca

SEQ ID NO: 2397059 - RNA, 15 nt, Human
cacucaaaagcuggg

SEQ ID NO: 2397060 - RNA, 22 nt, Human
cacuauuuuuauuuauauuuuu

SEQ ID NO: 2397061 - RNA, 14 nt, Human
cacuauuuuaugca

SEQ ID NO: 2397062 - RNA, 17 nt, Human
cacuauuuccuuuauaa

SEQ ID NO: 2397063 - RNA, 13 nt, Human
cacuauuuuaugc

SEQ ID NO: 2397064 - RNA, 17 nt, Human
cacuauuuuuauuuaua

SEQ ID NO: 2397065 - RNA, 19 nt, Human
cacuauuuaucugugcaaa

SEQ ID NO: 2397066 - RNA, 15 nt, Human
cacuauggugccaau

SEQ ID NO: 2397067 - RNA, 22 nt, Human
cacuauggugccaauggaaccu

SEQ ID NO: 2397068 - RNA, 22 nt, Human
cacuauuggcugggaguggugg

SEQ ID NO: 2397069 - RNA, 13 nt, Human
cacuauuuccuuu

SEQ ID NO: 2397070 - RNA, 14 nt, Human
cacuauuuccuuua

SEQ ID NO: 2397071 - RNA, 20 nt, Human
cacuauguugcccaggcagg

SEQ ID NO: 2397072 - RNA, 21 nt, Human
cacuauguugcccaggcaggu

SEQ ID NO: 2397073 - RNA, 22 nt, Human
cacucagcacaaggccaucugg

SEQ ID NO: 2397074 - RNA, 15 nt, Human
cacucagcacaaggc

SEQ ID NO: 2397075 - RNA, 13 nt, Human
cacucagcacaag

SEQ ID NO: 2397076 - RNA, 12 nt, Human
cacucagcacaa

SEQ ID NO: 2397077 - RNA, 12 nt, Human
cacucagaccug

SEQ ID NO: 2397078 - RNA, 22 nt, Human
cacucagaagacacugaugggc

SEQ ID NO: 2397079 - RNA, 15 nt, Human
cacucacuccugaga

SEQ ID NO: 2397080 - RNA, 17 nt, Human
cacucacugcggagaac

SEQ ID NO: 2397081 - RNA, 18 nt, Human
cacucagaagacacugau

SEQ ID NO: 2397082 - RNA, 19 nt, Human
cacucagaagacacugaug

SEQ ID NO: 2397083 - RNA, 18 nt, Human
cacucaccaguguccccu

SEQ ID NO: 2397084 - RNA, 19 nt, Human
cacucacagaccuggagcc

SEQ ID NO: 2397085 - RNA, 23 nt, Human
cacucacagaccuggagccccug

SEQ ID NO: 2397086 - RNA, 17 nt, Human
cacucaccgaagccacu

SEQ ID NO: 2397087 - RNA, 22 nt, Human
cacucacccaugugccaaggug

SEQ ID NO: 2397088 - RNA, 14 nt, Human
cacucaccgaagcc

SEQ ID NO: 2397089 - RNA, 21 nt, Human
cacucaccaguguccccucca

SEQ ID NO: 2397090 - RNA, 16 nt, Human
cacucacccaugugcc

SEQ ID NO: 2397091 - RNA, 21 nt, Human
cacucacccaugugccaaggu

SEQ ID NO: 2397092 - RNA, 19 nt, Human
cacucacauuuauucugcu

SEQ ID NO: 2397093 - RNA, 20 nt, Human
cacucacauuuauucugcuc

SEQ ID NO: 2397094 - RNA, 12 nt, Human
cacucagaagac

SEQ ID NO: 2397095 - RNA, 16 nt, Human
cacucacuaggccccc

SEQ ID NO: 2397096 - RNA, 17 nt, Human
cacucacuaggccccca

SEQ ID NO: 2397097 - RNA, 22 nt, Human
cacucacuaggcccccacuugc

SEQ ID NO: 2397098 - RNA, 12 nt, Human
cacucacuccug

SEQ ID NO: 2397099 - RNA, 14 nt, Human
cacucacuccugag

SEQ ID NO: 2397100 - RNA, 16 nt, Human
cacucagaagacacug

SEQ ID NO: 2397101 - RNA, 17 nt, Human
cacucagaagacacuga

SEQ ID NO: 2397102 - RNA, 17 nt, Human
cacuaugaagcuaccuc

SEQ ID NO: 2397103 - RNA, 18 nt, Human
cacuaucugggugcauga

SEQ ID NO: 2397104 - RNA, 14 nt, Human
cacuaugaaucuau

SEQ ID NO: 2397105 - RNA, 13 nt, Human
cacuauggugcca

SEQ ID NO: 2397106 - RNA, 17 nt, Human
cacuaugguauuugagu

SEQ ID NO: 2397107 - RNA, 15 nt, Human
cacuauguugcccag

SEQ ID NO: 2397108 - RNA, 21 nt, Human
cacuaugaagauguuucaaaa

SEQ ID NO: 2397109 - RNA, 11 nt, Human
cacuaucuggg

SEQ ID NO: 2397110 - RNA, 17 nt, Human
cacuaucugggugcaug

SEQ ID NO: 2397111 - RNA, 14 nt, Human
cacuaugaagaugu

SEQ ID NO: 2397112 - RNA, 19 nt, Human
cacuaucccggcugcccuu

SEQ ID NO: 2397113 - RNA, 18 nt, Human
cacuaucccggcugcccu

SEQ ID NO: 2397114 - RNA, 16 nt, Human
cacuauguugcccagg

SEQ ID NO: 2397115 - RNA, 17 nt, Human
cacuauguugcccaggc

SEQ ID NO: 2397116 - RNA, 18 nt, Human
cacuauguugcccaggca

SEQ ID NO: 2397117 - RNA, 19 nt, Human
cacuauguugcccaggcag

SEQ ID NO: 2397118 - RNA, 12 nt, Human
cacuauaaaugg

SEQ ID NO: 2397119 - RNA, 17 nt, Human
cacuaguuuugugccag

SEQ ID NO: 2397120 - RNA, 16 nt, Human
cacuagugcaaaucau

SEQ ID NO: 2397121 - RNA, 12 nt, Human
cacuaguuuugu

SEQ ID NO: 2397122 - RNA, 17 nt, Human
cacuaaguuauaguaua

SEQ ID NO: 2397123 - RNA, 15 nt, Human
cacuagugcaaauca

SEQ ID NO: 2397124 - RNA, 14 nt, Human
cacuauaauguaag

SEQ ID NO: 2397125 - RNA, 14 nt, Human
cacuaguauuucua

SEQ ID NO: 2397126 - RNA, 19 nt, Human
cacuaguauuucuaugaaa

SEQ ID NO: 2397127 - RNA, 18 nt, Human
cacuauaauguaagcucu

SEQ ID NO: 2397128 - RNA, 14 nt, Human
cacuauagccuagg

SEQ ID NO: 2397129 - RNA, 21 nt, Human
cacuauagccuaggugacaga

SEQ ID NO: 2397130 - RNA, 19 nt, Human
cacuauaaaugguguuuuu

SEQ ID NO: 2397131 - RNA, 14 nt, Human
cacuauacagauuc

SEQ ID NO: 2397132 - RNA, 23 nt, Human
cacuauauaggcaucacauuuuu

SEQ ID NO: 2397133 - RNA, 14 nt, Human
cacuauaucuguau

SEQ ID NO: 2397134 - RNA, 19 nt, Human
cacuauaucuguauauaaa

SEQ ID NO: 2397135 - RNA, 13 nt, Human
cacuaaagcagug

SEQ ID NO: 2397136 - RNA, 15 nt, Human
cacuaaaguauguaa

SEQ ID NO: 2397137 - RNA, 16 nt, Human
cacuaaaguauguaaa

SEQ ID NO: 2397138 - RNA, 22 nt, Human
cacuaaaguauguaaaguaugu

SEQ ID NO: 2397139 - RNA, 16 nt, Human
cacuaacaugauuugg

SEQ ID NO: 2397140 - RNA, 21 nt, Human
cacuaaauugacacuuaaaaa

SEQ ID NO: 2397141 - RNA, 14 nt, Human
cacuaaccacgcug

SEQ ID NO: 2397142 - RNA, 15 nt, Human
cacuaaccacgcugg

SEQ ID NO: 2397143 - RNA, 16 nt, Human
cacuaaccacgcugga

SEQ ID NO: 2397144 - RNA, 17 nt, Human
cacuaaggugugcucug

SEQ ID NO: 2397145 - RNA, 21 nt, Human
cacuaagcagaggaggggccg

SEQ ID NO: 2397146 - RNA, 20 nt, Human
cacuaagcagaggaggggcc

SEQ ID NO: 2397147 - RNA, 18 nt, Human
cacuaagcagaggagggg

SEQ ID NO: 2397148 - RNA, 17 nt, Human
cacuaagcagaggaggg

SEQ ID NO: 2397149 - RNA, 16 nt, Human
cacuaagcagaggagg

SEQ ID NO: 2397150 - RNA, 15 nt, Human
cacuaagcagaggag

SEQ ID NO: 2397151 - RNA, 14 nt, Human
cacuaagcagagga

SEQ ID NO: 2397152 - RNA, 13 nt, Human
cacuaagcagagg

SEQ ID NO: 2397153 - RNA, 18 nt, Human
cacuaaggugugcucuga

SEQ ID NO: 2397154 - RNA, 14 nt, Human
cacuaaguuauagu

SEQ ID NO: 2397155 - RNA, 23 nt, Human
cacuaaggggcccggccagccau

SEQ ID NO: 2397156 - RNA, 13 nt, Human
cacuaaggggccc

SEQ ID NO: 2397157 - RNA, 12 nt, Human
cacuaaggggcc

SEQ ID NO: 2397158 - RNA, 19 nt, Human
cacuaacgacuucagggca

SEQ ID NO: 2397159 - RNA, 20 nt, Human
cacuaacguugagccccugg

SEQ ID NO: 2397160 - RNA, 13 nt, Human
cacuaaccugacc

SEQ ID NO: 2397161 - RNA, 14 nt, Human
cacuaaccugaccg

SEQ ID NO: 2397162 - RNA, 18 nt, Human
cacuaaccacgcuggacc

SEQ ID NO: 2397163 - RNA, 20 nt, Human
cacuaacuagagcagcccug

SEQ ID NO: 2397164 - RNA, 11 nt, Human
cacuaacuaga

SEQ ID NO: 2397165 - RNA, 17 nt, Human
cacuaagagagaaugag

SEQ ID NO: 2397166 - RNA, 10 nt, Human
cacuccuggg

SEQ ID NO: 2397167 - RNA, 12 nt, Human
cacuccuggggc

SEQ ID NO: 2397168 - RNA, 11 nt, Human
cacuccugggg

SEQ ID NO: 2397169 - RNA, 11 nt, Human
cacuccuuccu

SEQ ID NO: 2397170 - RNA, 18 nt, Human
cacuccuguuacuuaccu

SEQ ID NO: 2397171 - RNA, 13 nt, Human
cacuccuguacac

SEQ ID NO: 2397172 - RNA, 19 nt, Human
cacuccuggggccucuugg

SEQ ID NO: 2397173 - RNA, 24 nt, Human
cacuccuuccugccaccugcugcu

SEQ ID NO: 2397174 - RNA, 21 nt, Human
cacuccuuccugccaccugcu

SEQ ID NO: 2397175 - RNA, 18 nt, Human
cacuccuuccugccaccu

SEQ ID NO: 2397176 - RNA, 17 nt, Human
cacuccuuccugccacc

SEQ ID NO: 2397177 - RNA, 15 nt, Human
cacuccuuccugcca

SEQ ID NO: 2397178 - RNA, 15 nt, Human
cacucgcccgcccac

SEQ ID NO: 2397179 - RNA, 13 nt, Human
cacucgcuucccc

SEQ ID NO: 2397180 - RNA, 23 nt, Human
cacucgcccgcccacuguccugg

SEQ ID NO: 2397181 - RNA, 16 nt, Human
cacucgcccgcccacu

SEQ ID NO: 2397182 - RNA, 17 nt, Human
cacucgcccgcccacug

SEQ ID NO: 2397183 - RNA, 18 nt, Human
cacucgcccgcccacugu

SEQ ID NO: 2397184 - RNA, 22 nt, Human
cacucgcccgcccacuguccug

SEQ ID NO: 2397185 - RNA, 20 nt, Human
cacucgcuucccccauagcc

SEQ ID NO: 2397186 - RNA, 16 nt, Human
cacucgcuucccccau

SEQ ID NO: 2397187 - RNA, 18 nt, Human
cacucgggaggcugagac

SEQ ID NO: 2397188 - RNA, 22 nt, Human
cacucggcauuucaaaugugcu

SEQ ID NO: 2397189 - RNA, 22 nt, Human
cacucgggaggcugagacagga

SEQ ID NO: 2397190 - RNA, 20 nt, Human
cacucuaaaagguucaggga

SEQ ID NO: 2397191 - RNA, 18 nt, Human
cacucuaaaagguucagg

SEQ ID NO: 2397192 - RNA, 19 nt, Human
cacucuaaaagguucaggg

SEQ ID NO: 2397193 - RNA, 15 nt, Human
cacucuccccacacu

SEQ ID NO: 2397194 - RNA, 14 nt, Human
cacucuccccacac

SEQ ID NO: 2397195 - RNA, 12 nt, Human
cacucuccccac

SEQ ID NO: 2397196 - RNA, 18 nt, Human
cacucucauuccccaggu

SEQ ID NO: 2397197 - RNA, 21 nt, Human
cacucuccccacacuaaccug

SEQ ID NO: 2397198 - RNA, 16 nt, Human
cacucucccccacccc

SEQ ID NO: 2397199 - RNA, 18 nt, Human
cacucucccccacccccu

SEQ ID NO: 2397200 - RNA, 20 nt, Human
cacucucccccacccccucc

SEQ ID NO: 2397201 - RNA, 17 nt, Human
cacucucauuccccagg

SEQ ID NO: 2397202 - RNA, 21 nt, Human
cacucuacccucccacccccu

SEQ ID NO: 2397203 - RNA, 13 nt, Human
cacucuagccugg

SEQ ID NO: 2397204 - RNA, 15 nt, Human
cacucuagccugggc

SEQ ID NO: 2397205 - RNA, 15 nt, Human
cacucuagggcagug

SEQ ID NO: 2397206 - RNA, 19 nt, Human
cacucuagggcaguggagu

SEQ ID NO: 2397207 - RNA, 22 nt, Human
cacucuaggggucaggcuccau

SEQ ID NO: 2397208 - RNA, 17 nt, Human
cacucuaggggucaggc

SEQ ID NO: 2397209 - RNA, 19 nt, Human
cacucuaggggucaggcuc

SEQ ID NO: 2397210 - RNA, 17 nt, Human
cacucuacccucccacc

SEQ ID NO: 2397211 - RNA, 16 nt, Human
cacucuacccucccac

SEQ ID NO: 2397212 - RNA, 15 nt, Human
cacucuacccuccca

SEQ ID NO: 2397213 - RNA, 17 nt, Human
cacucuacccuauacaa

SEQ ID NO: 2397214 - RNA, 19 nt, Human
cacucuacccucccacccc

SEQ ID NO: 2397215 - RNA, 18 nt, Human
cacucuacccucccaccc

SEQ ID NO: 2397216 - RNA, 14 nt, Human
cacucuacuuagca

SEQ ID NO: 2397217 - RNA, 21 nt, Human
cacucuccuugcuacccagaa

SEQ ID NO: 2397218 - RNA, 17 nt, Human
cacucuccuugcuaccc

SEQ ID NO: 2397219 - RNA, 20 nt, Human
cacucuccuugcuacccaga

SEQ ID NO: 2397220 - RNA, 12 nt, Human
cacucuccuugg

SEQ ID NO: 2397221 - RNA, 12 nt, Human
cacucugagacu

SEQ ID NO: 2397222 - RNA, 23 nt, Human
cacucugagacucgcgacaaugc

SEQ ID NO: 2397223 - RNA, 19 nt, Human
cacucugccucugccugca

SEQ ID NO: 2397224 - RNA, 17 nt, Human
cacucugccucugccug

SEQ ID NO: 2397225 - RNA, 15 nt, Human
cacucugccucugcc

SEQ ID NO: 2397226 - RNA, 20 nt, Human
cacucugccucugccugcau

SEQ ID NO: 2397227 - RNA, 15 nt, Human
cacucugcucgccuu

SEQ ID NO: 2397228 - RNA, 18 nt, Human
cacucugcucgccuuagc

SEQ ID NO: 2397229 - RNA, 12 nt, Human
cacucugcucug

SEQ ID NO: 2397230 - RNA, 19 nt, Human
cacucugacuggcacaguc

SEQ ID NO: 2397231 - RNA, 23 nt, Human
cacucucugaagaugaucauuug

SEQ ID NO: 2397232 - RNA, 13 nt, Human
cacucucugaaga

SEQ ID NO: 2397233 - RNA, 14 nt, Human
cacucucugaagau

SEQ ID NO: 2397234 - RNA, 20 nt, Human
cacucucugaagaugaucau

SEQ ID NO: 2397235 - RNA, 21 nt, Human
cacucugcuuugacugagcag

SEQ ID NO: 2397236 - RNA, 19 nt, Human
cacucugcuuugacugagc

SEQ ID NO: 2397237 - RNA, 16 nt, Human
cacucugcuuguuauu

SEQ ID NO: 2397238 - RNA, 21 nt, Human
cacucugcuucucugacuucu

SEQ ID NO: 2397239 - RNA, 16 nt, Human
cacucugcuucucuga

SEQ ID NO: 2397240 - RNA, 17 nt, Human
cacucugcuucucugac

SEQ ID NO: 2397241 - RNA, 18 nt, Human
cacucugcuucucugacu

SEQ ID NO: 2397242 - RNA, 19 nt, Human
cacucugcuucucugacuu

SEQ ID NO: 2397243 - RNA, 15 nt, Human
cacucugcucugccc

SEQ ID NO: 2397244 - RNA, 16 nt, Human
cacucugcucugcccu

SEQ ID NO: 2397245 - RNA, 21 nt, Human
cacucugcucugcccuuguuc

SEQ ID NO: 2397246 - RNA, 14 nt, Human
cacucugcugcuua

SEQ ID NO: 2397247 - RNA, 11 nt, Human
cacucugcugc

SEQ ID NO: 2397248 - RNA, 12 nt, Human
cacucugcugcu

SEQ ID NO: 2397249 - RNA, 12 nt, Human
cacucugcuucu

SEQ ID NO: 2397250 - RNA, 13 nt, Human
cacucugcuucuc

SEQ ID NO: 2397251 - RNA, 14 nt, Human
cacucugcuucucu

SEQ ID NO: 2397252 - RNA, 15 nt, Human
cacucugcuucucug

SEQ ID NO: 2397253 - RNA, 12 nt, Human
cacucuggcagc

SEQ ID NO: 2397254 - RNA, 13 nt, Human
cacucuggcagcu

SEQ ID NO: 2397255 - RNA, 14 nt, Human
cacucuggcagcuc

SEQ ID NO: 2397256 - RNA, 23 nt, Human
cacuccugagaccccuggccucc

SEQ ID NO: 2397257 - RNA, 14 nt, Human
cacuccugccaagg

SEQ ID NO: 2397258 - RNA, 13 nt, Human
cacuccugccaag

SEQ ID NO: 2397259 - RNA, 21 nt, Human
cacuccugagaccccuggccu

SEQ ID NO: 2397260 - RNA, 22 nt, Human
cacuccugagaccccuggccuc

SEQ ID NO: 2397261 - RNA, 14 nt, Human
cacuccuucacaga

SEQ ID NO: 2397262 - RNA, 21 nt, Human
cacuccuucacagaugggugc

SEQ ID NO: 2397263 - RNA, 23 nt, Human
cacuccucugacucagggcuccu

SEQ ID NO: 2397264 - RNA, 21 nt, Human
cacuccucugacucagggcuc

SEQ ID NO: 2397265 - RNA, 20 nt, Human
cacuccucugacucagggcu

SEQ ID NO: 2397266 - RNA, 14 nt, Human
cacuccugagaccc

SEQ ID NO: 2397267 - RNA, 16 nt, Human
cacuccugagaccccu

SEQ ID NO: 2397268 - RNA, 20 nt, Human
cacuccugagaccccuggcc

SEQ ID NO: 2397269 - RNA, 15 nt, Human
cacuccuccaaagga

SEQ ID NO: 2397270 - RNA, 13 nt, Human
cacuccuccuagc

SEQ ID NO: 2397271 - RNA, 18 nt, Human
cacuccuccuagccaccc

SEQ ID NO: 2397272 - RNA, 13 nt, Human
cacuccucugacu

SEQ ID NO: 2397273 - RNA, 12 nt, Human
cacuccucugac

SEQ ID NO: 2397274 - RNA, 17 nt, Human
cacucccuucuaccugc

SEQ ID NO: 2397275 - RNA, 18 nt, Human
cacucccuucuaccugcc

SEQ ID NO: 2397276 - RNA, 19 nt, Human
cacucccuucuaccugcca

SEQ ID NO: 2397277 - RNA, 20 nt, Human
cacucccuucuaccugccac

SEQ ID NO: 2397278 - RNA, 20 nt, Human
cacucccuugggcucccugu

SEQ ID NO: 2397279 - RNA, 16 nt, Human
cacucccuugggcucc

SEQ ID NO: 2397280 - RNA, 13 nt, Human
cacucccuugggc

SEQ ID NO: 2397281 - RNA, 22 nt, Human
cacucccuucuaccugccacuc

SEQ ID NO: 2397282 - RNA, 23 nt, Human
cacucccuucuaccugccacuca

SEQ ID NO: 2397283 - RNA, 19 nt, Human
cacucccuucccauaagcu

SEQ ID NO: 2397284 - RNA, 22 nt, Human
cacucccuucccaugacccagg

SEQ ID NO: 2397285 - RNA, 15 nt, Human
cacucccuccaucaa

SEQ ID NO: 2397286 - RNA, 14 nt, Human
cacucccuccauca

SEQ ID NO: 2397287 - RNA, 17 nt, Human
cacucccugcaaccuga

SEQ ID NO: 2397288 - RNA, 21 nt, Human
cacuccggugugccugcagcc

SEQ ID NO: 2397289 - RNA, 20 nt, Human
cacuccggugugccugcagc

SEQ ID NO: 2397290 - RNA, 19 nt, Human
cacuccggugugccugcag

SEQ ID NO: 2397291 - RNA, 17 nt, Human
cacuccggugugccugc

SEQ ID NO: 2397292 - RNA, 19 nt, Human
cacuccgagaggugggcca

SEQ ID NO: 2397293 - RNA, 21 nt, Human
cacucccuugguggcaagagc

SEQ ID NO: 2397294 - RNA, 22 nt, Human
cacuccggugugccugcagccc

SEQ ID NO: 2397295 - RNA, 20 nt, Human
cacuccggccugaugacaga

SEQ ID NO: 2397296 - RNA, 18 nt, Human
cacuccuacaccuaacuc

SEQ ID NO: 2397297 - RNA, 13 nt, Human
cacuccuaccugg

SEQ ID NO: 2397298 - RNA, 14 nt, Human
cacuccuaccuggu

SEQ ID NO: 2397299 - RNA, 12 nt, Human
cacuccuagaga

SEQ ID NO: 2397300 - RNA, 19 nt, Human
cacuccuagagaacgcagc

SEQ ID NO: 2397301 - RNA, 21 nt, Human
cacuccuagagaacgcagccc

SEQ ID NO: 2397302 - RNA, 22 nt, Human
cacuccuagagaacgcagcccu

SEQ ID NO: 2397303 - RNA, 16 nt, Human
cacucauccccucacu

SEQ ID NO: 2397304 - RNA, 19 nt, Human
cacucagcuuccuacccac

SEQ ID NO: 2397305 - RNA, 12 nt, Human
cacucaugcuga

SEQ ID NO: 2397306 - RNA, 13 nt, Human
cacucaugcugaa

SEQ ID NO: 2397307 - RNA, 14 nt, Human
cacucaugcugaaa

SEQ ID NO: 2397308 - RNA, 15 nt, Human
cacucauugaccuga

SEQ ID NO: 2397309 - RNA, 15 nt, Human
cacucaugcugaaag

SEQ ID NO: 2397310 - RNA, 17 nt, Human
cacucaugcugaaagcc

SEQ ID NO: 2397311 - RNA, 15 nt, Human
cacucauuccuguag

SEQ ID NO: 2397312 - RNA, 22 nt, Human
cacucagcucuuggcuccacug

SEQ ID NO: 2397313 - RNA, 19 nt, Human
cacucaggccaacaagcca

SEQ ID NO: 2397314 - RNA, 20 nt, Human
cacucaggaggcugaggcag

SEQ ID NO: 2397315 - RNA, 19 nt, Human
cacucaggaggcugaggca

SEQ ID NO: 2397316 - RNA, 21 nt, Human
cacucaggaggcugaggcagg

SEQ ID NO: 2397317 - RNA, 16 nt, Human
cacucaguccauagca

SEQ ID NO: 2397318 - RNA, 18 nt, Human
cacucauugaccugaggc

SEQ ID NO: 2397319 - RNA, 19 nt, Human
cacucauugaccugaggcc

SEQ ID NO: 2397320 - RNA, 20 nt, Human
cacucauugaccugaggccc

SEQ ID NO: 2397321 - RNA, 22 nt, Human
cacucauugaccugaggcccuu

SEQ ID NO: 2397322 - RNA, 21 nt, Human
cacucccggcacuccaugcuu

SEQ ID NO: 2397323 - RNA, 13 nt, Human
cacucauuccugu

SEQ ID NO: 2397324 - RNA, 12 nt, Human
cacucccugcaa

SEQ ID NO: 2397325 - RNA, 13 nt, Human
cacucccugcaac

SEQ ID NO: 2397326 - RNA, 16 nt, Human
cacucccugcaaccug

SEQ ID NO: 2397327 - RNA, 23 nt, Human
cacugugacccccagcuccggcc

SEQ ID NO: 2397328 - RNA, 14 nt, Human
cacugugccaugug

SEQ ID NO: 2397329 - RNA, 22 nt, Human
cacugugacccccagcuccggc

SEQ ID NO: 2397330 - RNA, 20 nt, Human
cacugugacccccagcuccg

SEQ ID NO: 2397331 - RNA, 19 nt, Human
cacugugacccccagcucc

SEQ ID NO: 2397332 - RNA, 15 nt, Human
cacugugacccccag

SEQ ID NO: 2397333 - RNA, 14 nt, Human
cacugugaccccca

SEQ ID NO: 2397334 - RNA, 15 nt, Human
cacugugaaggaccc

SEQ ID NO: 2397335 - RNA, 17 nt, Human
cacugugaaggacccuu

SEQ ID NO: 2397336 - RNA, 14 nt, Human
cacugucuugaaga

SEQ ID NO: 2397337 - RNA, 14 nt, Human
cacugucuucuuca

SEQ ID NO: 2397338 - RNA, 23 nt, Human
cacugucugagaguuuaguugua

SEQ ID NO: 2397339 - RNA, 12 nt, Human
cacugucucagu

SEQ ID NO: 2397340 - RNA, 23 nt, Human
cacuguccugggcgcccuggaag

SEQ ID NO: 2397341 - RNA, 19 nt, Human
cacuguccugggcgcccug

SEQ ID NO: 2397342 - RNA, 21 nt, Human
cacuguccugggcgcccugga

SEQ ID NO: 2397343 - RNA, 10 nt, Human
cacugucuga

SEQ ID NO: 2397344 - RNA, 11 nt, Human
cacugucugag

SEQ ID NO: 2397345 - RNA, 13 nt, Human
cacugucugagag

SEQ ID NO: 2397346 - RNA, 18 nt, Human
cacugucugagaguuuag

SEQ ID NO: 2397347 - RNA, 13 nt, Human
cacugugaagaga

SEQ ID NO: 2397348 - RNA, 13 nt, Human
cacugucuuuccu

SEQ ID NO: 2397349 - RNA, 14 nt, Human
cacugugaaggacc

SEQ ID NO: 2397350 - RNA, 13 nt, Human
cacugugaaggac

SEQ ID NO: 2397351 - RNA, 18 nt, Human
cacuguccuccaagccag

SEQ ID NO: 2397352 - RNA, 18 nt, Human
cacugucccucaaaugac

SEQ ID NO: 2397353 - RNA, 11 nt, Human
cacuguccugc

SEQ ID NO: 2397354 - RNA, 17 nt, Human
cacuguccuccaagcca

SEQ ID NO: 2397355 - RNA, 14 nt, Human
cacuguccuccaag

SEQ ID NO: 2397356 - RNA, 18 nt, Human
cacugucccuugccucaa

SEQ ID NO: 2397357 - RNA, 12 nt, Human
cacugucccuug

SEQ ID NO: 2397358 - RNA, 17 nt, Human
cacugucccuugccuca

SEQ ID NO: 2397359 - RNA, 18 nt, Human
cacuguccugggccugca

SEQ ID NO: 2397360 - RNA, 15 nt, Human
cacuguccugggccu

SEQ ID NO: 2397361 - RNA, 13 nt, Human
cacuguccugggc

SEQ ID NO: 2397362 - RNA, 14 nt, Human
cacuguccugggcg

SEQ ID NO: 2397363 - RNA, 15 nt, Human
cacuguccugggcgc

SEQ ID NO: 2397364 - RNA, 16 nt, Human
cacuguccugggcgcc

SEQ ID NO: 2397365 - RNA, 12 nt, Human
cacuguccugcu

SEQ ID NO: 2397366 - RNA, 13 nt, Human
cacuguccugcuc

SEQ ID NO: 2397367 - RNA, 15 nt, Human
cacuguccugcucca

SEQ ID NO: 2397368 - RNA, 16 nt, Human
cacuguccugcuccac

SEQ ID NO: 2397369 - RNA, 20 nt, Human
cacuguccugcuccacagug

SEQ ID NO: 2397370 - RNA, 21 nt, Human
cacuguccugcuccacagugu

SEQ ID NO: 2397371 - RNA, 11 nt, Human
cacuguccugg

SEQ ID NO: 2397372 - RNA, 12 nt, Human
cacuguccuggg

SEQ ID NO: 2397373 - RNA, 22 nt, Human
cacugucacuguuucucugcug

SEQ ID NO: 2397374 - RNA, 13 nt, Human
cacugucacuuug

SEQ ID NO: 2397375 - RNA, 16 nt, Human
cacugucacuuugcuc

SEQ ID NO: 2397376 - RNA, 19 nt, Human
cacugucacuguuucucug

SEQ ID NO: 2397377 - RNA, 18 nt, Human
cacugucacuguuucucu

SEQ ID NO: 2397378 - RNA, 15 nt, Human
cacugucaggaagaa

SEQ ID NO: 2397379 - RNA, 17 nt, Human
cacugucacuuugcucu

SEQ ID NO: 2397380 - RNA, 19 nt, Human
cacugucacuuugcucugg

SEQ ID NO: 2397381 - RNA, 20 nt, Human
cacugucacuuugcucuggg

SEQ ID NO: 2397382 - RNA, 16 nt, Human
cacugucccucaaaug

SEQ ID NO: 2397383 - RNA, 23 nt, Human
cacugucccucaaaugacccaaa

SEQ ID NO: 2397384 - RNA, 16 nt, Human
cacugucacuguuucu

SEQ ID NO: 2397385 - RNA, 17 nt, Human
cacuguauuuguaucuc

SEQ ID NO: 2397386 - RNA, 20 nt, Human
cacugucacccuccaccucu

SEQ ID NO: 2397387 - RNA, 14 nt, Human
cacuguauuuguau

SEQ ID NO: 2397388 - RNA, 16 nt, Human
cacugucacccuccac

SEQ ID NO: 2397389 - RNA, 14 nt, Human
cacugucaagauga

SEQ ID NO: 2397390 - RNA, 14 nt, Human
cacuguaaaaugaa

SEQ ID NO: 2397391 - RNA, 21 nt, Human
cacuggcugagcggaugcauc

SEQ ID NO: 2397392 - RNA, 13 nt, Human
cacuguaaaauga

SEQ ID NO: 2397393 - RNA, 17 nt, Human
cacuguaaaaugaaauu

SEQ ID NO: 2397394 - RNA, 16 nt, Human
cacuguaaaaugaaau

SEQ ID NO: 2397395 - RNA, 22 nt, Human
cacuguaagacucauucccuag

SEQ ID NO: 2397396 - RNA, 21 nt, Human
cacuggcucuccaagugccag

SEQ ID NO: 2397397 - RNA, 22 nt, Human
cacuggcucuccaagugccaga

SEQ ID NO: 2397398 - RNA, 16 nt, Human
cacuggcucuccaagu

SEQ ID NO: 2397399 - RNA, 17 nt, Human
cacuggcucuccaagug

SEQ ID NO: 2397400 - RNA, 18 nt, Human
cacuggcucuccaagugc

SEQ ID NO: 2397401 - RNA, 19 nt, Human
cacuggcucuccaagugcc

SEQ ID NO: 2397402 - RNA, 15 nt, Human
cacuggcucucucca

SEQ ID NO: 2397403 - RNA, 16 nt, Human
cacuggcucucuccag

SEQ ID NO: 2397404 - RNA, 17 nt, Human
cacuggcucucuccagg

SEQ ID NO: 2397405 - RNA, 18 nt, Human
cacuggcucucuccagga

SEQ ID NO: 2397406 - RNA, 22 nt, Human
cacuggccccuagaaucagccu

SEQ ID NO: 2397407 - RNA, 17 nt, Human
cacuggccccugagauc

SEQ ID NO: 2397408 - RNA, 13 nt, Human
cacuggccccuca

SEQ ID NO: 2397409 - RNA, 24 nt, Human
cacuggccccucaaaucguccagc

SEQ ID NO: 2397410 - RNA, 20 nt, Human
cacuggccggagucagugcc

SEQ ID NO: 2397411 - RNA, 17 nt, Human
cacuggccaucuccacc

SEQ ID NO: 2397412 - RNA, 23 nt, Human
cacuggcgcaucauaugcaguga

SEQ ID NO: 2397413 - RNA, 23 nt, Human
cacuggcguagaaguuuuuguac

SEQ ID NO: 2397414 - RNA, 11 nt, Human
cacuggcucuc

SEQ ID NO: 2397415 - RNA, 12 nt, Human
cacuggcucucc

SEQ ID NO: 2397416 - RNA, 14 nt, Human
cacuggcucuccaa

SEQ ID NO: 2397417 - RNA, 15 nt, Human
cacuggcucuccaag

SEQ ID NO: 2397418 - RNA, 21 nt, Human
cacuguagcauuacagugggu

SEQ ID NO: 2397419 - RNA, 18 nt, Human
cacuguagaaugauuuca

SEQ ID NO: 2397420 - RNA, 18 nt, Human
cacuguaaaaugaaauua

SEQ ID NO: 2397421 - RNA, 20 nt, Human
cacuguacaagguaccccuu

SEQ ID NO: 2397422 - RNA, 19 nt, Human
cacuguacuugcucuugau

SEQ ID NO: 2397423 - RNA, 15 nt, Human
cacuguacuugcucu

SEQ ID NO: 2397424 - RNA, 18 nt, Human
cacuguacuugcucuuga

SEQ ID NO: 2397425 - RNA, 23 nt, Human
cacuguauaaauaggagaggaug

SEQ ID NO: 2397426 - RNA, 19 nt, Human
cacuguauaaauaggagag

SEQ ID NO: 2397427 - RNA, 21 nt, Human
cacuguauaaauaggagagga

SEQ ID NO: 2397428 - RNA, 15 nt, Human
cacuguauaaauagg

SEQ ID NO: 2397429 - RNA, 16 nt, Human
cacuguauaaauagga

SEQ ID NO: 2397430 - RNA, 17 nt, Human
cacuguauaaauaggag

SEQ ID NO: 2397431 - RNA, 18 nt, Human
cacuguauaaauaggaga

SEQ ID NO: 2397432 - RNA, 18 nt, Human
cacuguaugcuggacggc

SEQ ID NO: 2397433 - RNA, 16 nt, Human
cacuguaugcuggacg

SEQ ID NO: 2397434 - RNA, 22 nt, Human
cacuguaguaaauggcaauucu

SEQ ID NO: 2397435 - RNA, 13 nt, Human
cacuguauaaaua

SEQ ID NO: 2397436 - RNA, 14 nt, Human
cacuguauaaauag

SEQ ID NO: 2397437 - RNA, 17 nt, Human
cacuguguccuggugcu

SEQ ID NO: 2397438 - RNA, 15 nt, Human
cacuguguauuuaac

SEQ ID NO: 2397439 - RNA, 12 nt, Human
cacuguguccug

SEQ ID NO: 2397440 - RNA, 15 nt, Human
cacuguuaucaaaac

SEQ ID NO: 2397441 - RNA, 23 nt, Human
cacuguuacuuucguacauuggc

SEQ ID NO: 2397442 - RNA, 17 nt, Human
cacuguucccccugugc

SEQ ID NO: 2397443 - RNA, 20 nt, Human
cacuguuccagccugcccuc

SEQ ID NO: 2397444 - RNA, 19 nt, Human
cacuguucccccugugcag

SEQ ID NO: 2397445 - RNA, 14 nt, Human
cacuguucccucug

SEQ ID NO: 2397446 - RNA, 16 nt, Human
cacuguucccucugcu

SEQ ID NO: 2397447 - RNA, 17 nt, Human
cacuguucccucugcuc

SEQ ID NO: 2397448 - RNA, 20 nt, Human
cacuguucccucugcuccug

SEQ ID NO: 2397449 - RNA, 23 nt, Human
cacuguucuauucaucucaagga

SEQ ID NO: 2397450 - RNA, 16 nt, Human
cacugugggacucuuc

SEQ ID NO: 2397451 - RNA, 14 nt, Human
cacuguggugucug

SEQ ID NO: 2397452 - RNA, 12 nt, Human
cacuguguaagc

SEQ ID NO: 2397453 - RNA, 15 nt, Human
cacuguggugucugu

SEQ ID NO: 2397454 - RNA, 22 nt, Human
cacuguggguagacacacauga

SEQ ID NO: 2397455 - RNA, 24 nt, Human
cacuguggguagacacacaugaag

SEQ ID NO: 2397456 - RNA, 13 nt, Human
cacuguucucugc

SEQ ID NO: 2397457 - RNA, 14 nt, Human
cacuguucucugcc

SEQ ID NO: 2397458 - RNA, 15 nt, Human
cacuguucucugccc

SEQ ID NO: 2397459 - RNA, 16 nt, Human
cacuguucucugcccu

SEQ ID NO: 2397460 - RNA, 17 nt, Human
cacuguucucugcccuc

SEQ ID NO: 2397461 - RNA, 19 nt, Human
cacuguucucugcccucca

SEQ ID NO: 2397462 - RNA, 21 nt, Human
cacuguucucugcccuccaag

SEQ ID NO: 2397463 - RNA, 22 nt, Human
cacuguucucugcccuccaaga

SEQ ID NO: 2397464 - RNA, 20 nt, Human
cacugugcacaucugugucu

SEQ ID NO: 2397465 - RNA, 22 nt, Human
cacugugcacaucugugucuug

SEQ ID NO: 2397466 - RNA, 17 nt, Human
cacugugcccagcccgg

SEQ ID NO: 2397467 - RNA, 22 nt, Human
cacugugcccagcccggaccuu

SEQ ID NO: 2397468 - RNA, 18 nt, Human
cacugugccaugugccag

SEQ ID NO: 2397469 - RNA, 15 nt, Human
cacugugccaugugc

SEQ ID NO: 2397470 - RNA, 16 nt, Human
cacugugccaugugcc

SEQ ID NO: 2397471 - RNA, 19 nt, Human
cacugugcuaauaacagug

SEQ ID NO: 2397472 - RNA, 21 nt, Human
cacugugcuaauaacagugca

SEQ ID NO: 2397473 - RNA, 17 nt, Human
cacugugcccuggugga

SEQ ID NO: 2397474 - RNA, 18 nt, Human
cacugugcccugguggag

SEQ ID NO: 2397475 - RNA, 12 nt, Human
cacugugcccug

SEQ ID NO: 2397476 - RNA, 13 nt, Human
cacugugcccugg

SEQ ID NO: 2397477 - RNA, 15 nt, Human
cacugugcccuggug

SEQ ID NO: 2397478 - RNA, 16 nt, Human
cacugugcccuggugg

SEQ ID NO: 2397479 - RNA, 13 nt, Human
cacugugcugagu

SEQ ID NO: 2397480 - RNA, 15 nt, Human
cacugugcugagucu

SEQ ID NO: 2397481 - RNA, 24 nt, Human
cacuguggacuuggucaccagcuc

SEQ ID NO: 2397482 - RNA, 13 nt, Human
cacuguggacuug

SEQ ID NO: 2397483 - RNA, 23 nt, Human
cacuguggacuuggucaccagcu

SEQ ID NO: 2397484 - RNA, 14 nt, Human
cacugugggaaggc

SEQ ID NO: 2397485 - RNA, 17 nt, Human
cacugugggaaggccag

SEQ ID NO: 2397486 - RNA, 20 nt, Human
cacugugggaaggccagcug

SEQ ID NO: 2397487 - RNA, 21 nt, Human
cacugugggaaggccagcugc

SEQ ID NO: 2397488 - RNA, 19 nt, Human
cacuguggguagacacaca

SEQ ID NO: 2397489 - RNA, 22 nt, Human
cacugugcuuucuauuguacag

SEQ ID NO: 2397490 - RNA, 23 nt, Human
cacugugcuuucuauuguacaga

SEQ ID NO: 2397491 - RNA, 17 nt, Human
cacugugcuuucuauug

SEQ ID NO: 2397492 - RNA, 16 nt, Human
cacugugcucagggcu

SEQ ID NO: 2397493 - RNA, 13 nt, Human
cacugugcucagg

SEQ ID NO: 2397494 - RNA, 15 nt, Human
cacugugcucagggc

SEQ ID NO: 2397495 - RNA, 17 nt, Human
cacugugcugagucuga

SEQ ID NO: 2397496 - RNA, 20 nt, Human
cacugugcugagucugaagg

SEQ ID NO: 2397497 - RNA, 21 nt, Human
cacugugcugagucugaaggc

SEQ ID NO: 2397498 - RNA, 22 nt, Human
cacugugcugagucugaaggcu

SEQ ID NO: 2397499 - RNA, 19 nt, Human
cacuucacagagugugcug

SEQ ID NO: 2397500 - RNA, 18 nt, Human
cacuucacuccagccugg

SEQ ID NO: 2397501 - RNA, 17 nt, Human
cacuucagagagcuggu

SEQ ID NO: 2397502 - RNA, 16 nt, Human
cacuucagagagcugg

SEQ ID NO: 2397503 - RNA, 15 nt, Human
cacuucagagagcug

SEQ ID NO: 2397504 - RNA, 13 nt, Human
cacuucagagagc

SEQ ID NO: 2397505 - RNA, 18 nt, Human
cacuucacacacaggcaa

SEQ ID NO: 2397506 - RNA, 13 nt, Human
cacuucacagagu

SEQ ID NO: 2397507 - RNA, 21 nt, Human
cacuucaagugaccaccagga

SEQ ID NO: 2397508 - RNA, 14 nt, Human
cacuucacccugga

SEQ ID NO: 2397509 - RNA, 14 nt, Human
cacuucacagagug

SEQ ID NO: 2397510 - RNA, 15 nt, Human
cacuucacagagugu

SEQ ID NO: 2397511 - RNA, 13 nt, Human
cacuguugaauuu

SEQ ID NO: 2397512 - RNA, 17 nt, Human
cacuguugaaaauuauu

SEQ ID NO: 2397513 - RNA, 18 nt, Human
cacuguugaaaauuauuu

SEQ ID NO: 2397514 - RNA, 19 nt, Human
cacuguucugaaagugacu

SEQ ID NO: 2397515 - RNA, 22 nt, Human
cacuguucccucugcuccugga

SEQ ID NO: 2397516 - RNA, 14 nt, Human
cacuguugaaaauu

SEQ ID NO: 2397517 - RNA, 16 nt, Human
cacuguugaaaauuau

SEQ ID NO: 2397518 - RNA, 17 nt, Human
cacuguugaauuuucuc

SEQ ID NO: 2397519 - RNA, 22 nt, Human
cacuuauuggaacucugcuuga

SEQ ID NO: 2397520 - RNA, 14 nt, Human
cacuuauuucauaa

SEQ ID NO: 2397521 - RNA, 21 nt, Human
cacuguugaaaauuauuuuaa

SEQ ID NO: 2397522 - RNA, 17 nt, Human
cacuuauuucauaaaca

SEQ ID NO: 2397523 - RNA, 18 nt, Human
cacuucaggucaggaguu

SEQ ID NO: 2397524 - RNA, 15 nt, Human
cacuucauaauccag

SEQ ID NO: 2397525 - RNA, 14 nt, Human
cacuucauaaucca

SEQ ID NO: 2397526 - RNA, 22 nt, Human
cacuucauucuugaaagcugug

SEQ ID NO: 2397527 - RNA, 16 nt, Human
cacuucauugagaguu

SEQ ID NO: 2397528 - RNA, 13 nt, Human
cacuucaucuucu

SEQ ID NO: 2397529 - RNA, 15 nt, Human
cacuucaucuucuca

SEQ ID NO: 2397530 - RNA, 18 nt, Human
cacuucaucuucucagcu

SEQ ID NO: 2397531 - RNA, 23 nt, Human
cacuucaggcucuucuccuuuca

SEQ ID NO: 2397532 - RNA, 18 nt, Human
cacuucagagagcuggua

SEQ ID NO: 2397533 - RNA, 22 nt, Human
cacuucaggguucuccucuccc

SEQ ID NO: 2397534 - RNA, 21 nt, Human
cacuucagcugacuuuucugu

SEQ ID NO: 2397535 - RNA, 12 nt, Human
cacuucagcuga

SEQ ID NO: 2397536 - RNA, 14 nt, Human
cacuucaggcucuu

SEQ ID NO: 2397537 - RNA, 15 nt, Human
cacuucaggcucuuc

SEQ ID NO: 2397538 - RNA, 16 nt, Human
cacuucaggcucuucu

SEQ ID NO: 2397539 - RNA, 20 nt, Human
cacuucaggcucuucuccuu

SEQ ID NO: 2397540 - RNA, 16 nt, Human
cacuucugaccacacu

SEQ ID NO: 2397541 - RNA, 19 nt, Human
cacuucugaccacacuucc

SEQ ID NO: 2397542 - RNA, 13 nt, Human
cacuucugaccac

SEQ ID NO: 2397543 - RNA, 22 nt, Human
cacuucugccauauucuguugg

SEQ ID NO: 2397544 - RNA, 18 nt, Human
cacuucugggcuucaucu

SEQ ID NO: 2397545 - RNA, 23 nt, Human
cacuucgggaggucgaggcagga

SEQ ID NO: 2397546 - RNA, 21 nt, Human
cacuucgggaggucgaggcag

SEQ ID NO: 2397547 - RNA, 17 nt, Human
cacuucuaaauagcaau

SEQ ID NO: 2397548 - RNA, 23 nt, Human
cacuucgugggaucugccccucc

SEQ ID NO: 2397549 - RNA, 21 nt, Human
cacuucgcgugcccucgcugc

SEQ ID NO: 2397550 - RNA, 18 nt, Human
cacuucuaaaugaagugc

SEQ ID NO: 2397551 - RNA, 17 nt, Human
cacuucuaaaugaagug

SEQ ID NO: 2397552 - RNA, 16 nt, Human
cacuucccuacaugga

SEQ ID NO: 2397553 - RNA, 18 nt, Human
cacuuccauacagcucua

SEQ ID NO: 2397554 - RNA, 23 nt, Human
cacuucccagguaagcaggagga

SEQ ID NO: 2397555 - RNA, 12 nt, Human
cacuuccccucc

SEQ ID NO: 2397556 - RNA, 13 nt, Human
cacuuccccuccu

SEQ ID NO: 2397557 - RNA, 15 nt, Human
cacuuccccuccuac

SEQ ID NO: 2397558 - RNA, 19 nt, Human
cacuuccaccagccugcac

SEQ ID NO: 2397559 - RNA, 18 nt, Human
cacuuccaccagccugca

SEQ ID NO: 2397560 - RNA, 17 nt, Human
cacuuccaccagccugc

SEQ ID NO: 2397561 - RNA, 16 nt, Human
cacuuccaccagccug

SEQ ID NO: 2397562 - RNA, 15 nt, Human
cacuuccaccagccu

SEQ ID NO: 2397563 - RNA, 14 nt, Human
cacuuccaccagcc

SEQ ID NO: 2397564 - RNA, 22 nt, Human
cacuucauugagaguuuugucu

SEQ ID NO: 2397565 - RNA, 20 nt, Human
cacuuccauaaucuggacuc

SEQ ID NO: 2397566 - RNA, 20 nt, Human
cacuuccaccagccugcacu

SEQ ID NO: 2397567 - RNA, 18 nt, Human
cacuuccuguccagagag

SEQ ID NO: 2397568 - RNA, 24 nt, Human
cacuuccuguuugggccccucucc

SEQ ID NO: 2397569 - RNA, 17 nt, Human
cacuuccuguccagaga

SEQ ID NO: 2397570 - RNA, 14 nt, Human
cacuuccuguccag

SEQ ID NO: 2397571 - RNA, 13 nt, Human
cacuuccugucca

SEQ ID NO: 2397572 - RNA, 12 nt, Human
cacuuccugucc

SEQ ID NO: 2397573 - RNA, 13 nt, Human
cacuuccugccua

SEQ ID NO: 2397574 - RNA, 14 nt, Human
cacuuccugccuaa

SEQ ID NO: 2397575 - RNA, 23 nt, Human
cacuuccuacaagagcagccugu

SEQ ID NO: 2397576 - RNA, 17 nt, Human
cacuuccuacaagagca

SEQ ID NO: 2397577 - RNA, 12 nt, Human
cacuuccugccu

SEQ ID NO: 2397578 - RNA, 11 nt, Human
cacuuccugcc

SEQ ID NO: 2397579 - RNA, 13 nt, Human
cacuucccugggc

SEQ ID NO: 2397580 - RNA, 19 nt, Human
cacuucccugggcaaauga

SEQ ID NO: 2397581 - RNA, 20 nt, Human
cacuucccugacacugcggg

SEQ ID NO: 2397582 - RNA, 21 nt, Human
cacuuccccuccuaccccucc

SEQ ID NO: 2397583 - RNA, 19 nt, Human
cacuucccucaucucuccu

SEQ ID NO: 2397584 - RNA, 14 nt, Human
cacuucccucuguu

SEQ ID NO: 2397585 - RNA, 15 nt, Human
cacuucccucuguuu

SEQ ID NO: 2397586 - RNA, 16 nt, Human
cacuucccucuguuuc

SEQ ID NO: 2397587 - RNA, 17 nt, Human
cacuucccucuguuucu

SEQ ID NO: 2397588 - RNA, 18 nt, Human
cacuucccucuguuucuc

SEQ ID NO: 2397589 - RNA, 15 nt, Human
cacuucccugacacu

SEQ ID NO: 2397590 - RNA, 22 nt, Human
cacuugccgcgucgcccuccca

SEQ ID NO: 2397591 - RNA, 14 nt, Human
cacuugcccacacc

SEQ ID NO: 2397592 - RNA, 12 nt, Human
cacuugccucuu

SEQ ID NO: 2397593 - RNA, 13 nt, Human
cacuugccucuuc

SEQ ID NO: 2397594 - RNA, 21 nt, Human
cacuugccucuuccuugaaga

SEQ ID NO: 2397595 - RNA, 14 nt, Human
cacuugccucuucc

SEQ ID NO: 2397596 - RNA, 17 nt, Human
cacuugccucuuccuug

SEQ ID NO: 2397597 - RNA, 18 nt, Human
cacuugccccuguuaccu

SEQ ID NO: 2397598 - RNA, 14 nt, Human
cacuugauuccuug

SEQ ID NO: 2397599 - RNA, 13 nt, Human
cacuugcaucugu

SEQ ID NO: 2397600 - RNA, 12 nt, Human
cacuugcauuuc

SEQ ID NO: 2397601 - RNA, 24 nt, Human
cacuugcagacucuacagaggcca

SEQ ID NO: 2397602 - RNA, 14 nt, Human
cacuugcagacucu

SEQ ID NO: 2397603 - RNA, 18 nt, Human
cacuugcagacucuacag

SEQ ID NO: 2397604 - RNA, 19 nt, Human
cacuugcagacucuacaga

SEQ ID NO: 2397605 - RNA, 22 nt, Human
cacuugcagacucuacagaggc

SEQ ID NO: 2397606 - RNA, 16 nt, Human
cacuuggccucuggau

SEQ ID NO: 2397607 - RNA, 23 nt, Human
cacuuggcugcauaaauguggua

SEQ ID NO: 2397608 - RNA, 18 nt, Human
cacuuggccaagcaggga

SEQ ID NO: 2397609 - RNA, 20 nt, Human
cacuuggccaagcagggagg

SEQ ID NO: 2397610 - RNA, 19 nt, Human
cacuuggcccaaguggcag

SEQ ID NO: 2397611 - RNA, 22 nt, Human
cacuuggcccaaguggcagagc

SEQ ID NO: 2397612 - RNA, 12 nt, Human
cacuuggagcca

SEQ ID NO: 2397613 - RNA, 17 nt, Human
cacuuggacucuugcuc

SEQ ID NO: 2397614 - RNA, 18 nt, Human
cacuuggacucuugcucu

SEQ ID NO: 2397615 - RNA, 14 nt, Human
cacuuggcagcgcg

SEQ ID NO: 2397616 - RNA, 17 nt, Human
cacuuggcaucagcugg

SEQ ID NO: 2397617 - RNA, 19 nt, Human
cacuuggcaucagcuggcg

SEQ ID NO: 2397618 - RNA, 11 nt, Human
cacuuggccaa

SEQ ID NO: 2397619 - RNA, 19 nt, Human
cacuuucuagccagaggag

SEQ ID NO: 2397620 - RNA, 20 nt, Human
cacuuucuagccagaggaga

SEQ ID NO: 2397621 - RNA, 18 nt, Human
cacuuucuagccagagga

SEQ ID NO: 2397622 - RNA, 15 nt, Human
cacuuggucugugag

SEQ ID NO: 2397623 - RNA, 21 nt, Human
cacuucugugagacccccaca

SEQ ID NO: 2397624 - RNA, 20 nt, Human
cacuucugugagacccccac

SEQ ID NO: 2397625 - RNA, 19 nt, Human
cacuucuuacaauaauucu

SEQ ID NO: 2397626 - RNA, 18 nt, Human
cacuucuggguggggcag

SEQ ID NO: 2397627 - RNA, 20 nt, Human
cacuucugggcuucaucugg

SEQ ID NO: 2397628 - RNA, 19 nt, Human
cacuucuggguggggcagu

SEQ ID NO: 2397629 - RNA, 22 nt, Human
cacuucugugagacccccacac

SEQ ID NO: 2397630 - RNA, 23 nt, Human
cacuucuucuuggucuuauuuau

SEQ ID NO: 2397631 - RNA, 18 nt, Human
cacuucuuguuccccacu

SEQ ID NO: 2397632 - RNA, 16 nt, Human
cacuugacaucaacug

SEQ ID NO: 2397633 - RNA, 23 nt, Human
cacuugaacccgggaggcagagg

SEQ ID NO: 2397634 - RNA, 21 nt, Human
cacuugaacccgggaggcaga

SEQ ID NO: 2397635 - RNA, 20 nt, Human
cacuugaacccgggaggcag

SEQ ID NO: 2397636 - RNA, 20 nt, Human
cacuugagaauuacccuuuu

SEQ ID NO: 2397637 - RNA, 15 nt, Human
cacuucuuuuauaac

SEQ ID NO: 2397638 - RNA, 15 nt, Human
cacuugaauccuagg

SEQ ID NO: 2397639 - RNA, 13 nt, Human
cacuugagaggau

SEQ ID NO: 2397640 - RNA, 17 nt, Human
cacuugagaauuacccu

SEQ ID NO: 2397641 - RNA, 19 nt, Human
cacuugacaucaacugcau

SEQ ID NO: 2397642 - RNA, 13 nt, Human
cacuugaguccag

SEQ ID NO: 2397643 - RNA, 18 nt, Human
cacuugaggucaggaguu

SEQ ID NO: 2397644 - RNA, 19 nt, Human
cacuugaugacccccaacc

SEQ ID NO: 2397645 - RNA, 23 nt, Human
cacuugcacgcccaugugugagu

SEQ ID NO: 2397646 - RNA, 16 nt, Human
cacuugaugugccauu

SEQ ID NO: 2397647 - RNA, 22 nt, Human
cacuugaggucaggaguuccua

SEQ ID NO: 2397648 - RNA, 13 nt, Human
cacuugcagacuc

SEQ ID NO: 2397649 - RNA, 15 nt, Human
cacuggacuccggcc

SEQ ID NO: 2397650 - RNA, 16 nt, Human
cacuggacuccggccc

SEQ ID NO: 2397651 - RNA, 18 nt, Human
cacuggacucaccucccc

SEQ ID NO: 2397652 - RNA, 15 nt, Human
cacuggacucaccuc

SEQ ID NO: 2397653 - RNA, 16 nt, Human
cacuggaccacugggc

SEQ ID NO: 2397654 - RNA, 19 nt, Human
cacuggacuccggcccucc

SEQ ID NO: 2397655 - RNA, 21 nt, Human
cacuggagcaccaggcacgaa

SEQ ID NO: 2397656 - RNA, 20 nt, Human
cacuggagccaucucuuccu

SEQ ID NO: 2397657 - RNA, 17 nt, Human
cacuggagcaccaggca

SEQ ID NO: 2397658 - RNA, 16 nt, Human
cacuggagcaccaggc

SEQ ID NO: 2397659 - RNA, 21 nt, Human
cacugcuuuuggucuguguga

SEQ ID NO: 2397660 - RNA, 15 nt, Human
cacugcuugaggaaa

SEQ ID NO: 2397661 - RNA, 12 nt, Human
cacuggaaaggg

SEQ ID NO: 2397662 - RNA, 15 nt, Human
cacuggaaaggggag

SEQ ID NO: 2397663 - RNA, 17 nt, Human
cacuggaacacuaauga

SEQ ID NO: 2397664 - RNA, 16 nt, Human
cacuggaaaggggaga

SEQ ID NO: 2397665 - RNA, 18 nt, Human
cacuggaaaggggagagc

SEQ ID NO: 2397666 - RNA, 19 nt, Human
cacuggaaaggggagagcc

SEQ ID NO: 2397667 - RNA, 22 nt, Human
cacuggaaaggggagagccugc

SEQ ID NO: 2397668 - RNA, 23 nt, Human
cacuggaaaggggagagccugcu

SEQ ID NO: 2397669 - RNA, 24 nt, Human
cacuggaaaggggagagccugcug

SEQ ID NO: 2397670 - RNA, 13 nt, Human
cacuggaacucag

SEQ ID NO: 2397671 - RNA, 19 nt, Human
cacuggaacucagugugac

SEQ ID NO: 2397672 - RNA, 14 nt, Human
cacuggagcccagg

SEQ ID NO: 2397673 - RNA, 13 nt, Human
cacuggagcccag

SEQ ID NO: 2397674 - RNA, 12 nt, Human
cacuggagccca

SEQ ID NO: 2397675 - RNA, 11 nt, Human
cacuggagccc

SEQ ID NO: 2397676 - RNA, 15 nt, Human
cacuggagcccagga

SEQ ID NO: 2397677 - RNA, 16 nt, Human
cacuggaggagagaag

SEQ ID NO: 2397678 - RNA, 18 nt, Human
cacuggaggagagaagaa

SEQ ID NO: 2397679 - RNA, 19 nt, Human
cacuggaggagagaagaau

SEQ ID NO: 2397680 - RNA, 22 nt, Human
cacuggaggagagaagaaugag

SEQ ID NO: 2397681 - RNA, 18 nt, Human
cacuggagguugaagcca

SEQ ID NO: 2397682 - RNA, 16 nt, Human
cacuggaguccagucu

SEQ ID NO: 2397683 - RNA, 16 nt, Human
cacuggagugcaggga

SEQ ID NO: 2397684 - RNA, 20 nt, Human
cacuggagguugaagccaag

SEQ ID NO: 2397685 - RNA, 21 nt, Human
cacuggagguugaagccaagu

SEQ ID NO: 2397686 - RNA, 17 nt, Human
cacuggagugcagggag

SEQ ID NO: 2397687 - RNA, 18 nt, Human
cacuggagugcagggagg

SEQ ID NO: 2397688 - RNA, 23 nt, Human
cacuggagugcagggaggagagg

SEQ ID NO: 2397689 - RNA, 19 nt, Human
cacuggaugcaaagaaaau

SEQ ID NO: 2397690 - RNA, 20 nt, Human
cacuggagugcagggaggag

SEQ ID NO: 2397691 - RNA, 22 nt, Human
cacuggaguuacauuaauguua

SEQ ID NO: 2397692 - RNA, 23 nt, Human
cacuggaugcaaagaaaaucaga

SEQ ID NO: 2397693 - RNA, 15 nt, Human
cacuggaugcagaaa

SEQ ID NO: 2397694 - RNA, 16 nt, Human
cacuggcaaugaaaaa

SEQ ID NO: 2397695 - RNA, 21 nt, Human
cacuggaugggcugcagcaga

SEQ ID NO: 2397696 - RNA, 14 nt, Human
cacuggcauugucc

SEQ ID NO: 2397697 - RNA, 18 nt, Human
cacuggcauugucccugu

SEQ ID NO: 2397698 - RNA, 19 nt, Human
cacuggcauugucccugug

SEQ ID NO: 2397699 - RNA, 17 nt, Human
cacuggccacaguuguu

SEQ ID NO: 2397700 - RNA, 22 nt, Human
cacuggcauugucccugugccu

SEQ ID NO: 2397701 - RNA, 10 nt, Human
cacuggccac

SEQ ID NO: 2397702 - RNA, 12 nt, Human
cacuggccacca

SEQ ID NO: 2397703 - RNA, 14 nt, Human
cacuggccaccagg

SEQ ID NO: 2397704 - RNA, 15 nt, Human
cacuggccaccaggc

SEQ ID NO: 2397705 - RNA, 16 nt, Human
cacuggccaccaggcu

SEQ ID NO: 2397706 - RNA, 17 nt, Human
cacuggccaccaggcug

SEQ ID NO: 2397707 - RNA, 18 nt, Human
cacuggccaccaggcugg

SEQ ID NO: 2397708 - RNA, 19 nt, Human
cacuggccaccaggcuggc

SEQ ID NO: 2397709 - RNA, 20 nt, Human
cacuggccaccaggcuggcg

SEQ ID NO: 2397710 - RNA, 21 nt, Human
cacuggccaccaggcuggcgc

SEQ ID NO: 2397711 - RNA, 22 nt, Human
cacuggccaccaggcuggcgca

SEQ ID NO: 2397712 - RNA, 24 nt, Human
cacuggccaccaggcuggcgcagc

SEQ ID NO: 2397713 - RNA, 14 nt, Human
cacuggccaucccu

SEQ ID NO: 2397714 - RNA, 12 nt, Human
cacugcuggcug

SEQ ID NO: 2397715 - RNA, 13 nt, Human
cacugcuggcugc

SEQ ID NO: 2397716 - RNA, 14 nt, Human
cacugcuggcugcc

SEQ ID NO: 2397717 - RNA, 15 nt, Human
cacugcuggcugccu

SEQ ID NO: 2397718 - RNA, 16 nt, Human
cacugcuggcugccuu

SEQ ID NO: 2397719 - RNA, 21 nt, Human
cacugcuggcugccuuagaac

SEQ ID NO: 2397720 - RNA, 13 nt, Human
cacugcugggugg

SEQ ID NO: 2397721 - RNA, 14 nt, Human
cacugcuggguggc

SEQ ID NO: 2397722 - RNA, 17 nt, Human
cacugcuggguggccca

SEQ ID NO: 2397723 - RNA, 18 nt, Human
cacugcuggguggcccau

SEQ ID NO: 2397724 - RNA, 19 nt, Human
cacugcuggguggcccauc

SEQ ID NO: 2397725 - RNA, 20 nt, Human
cacugcuggguggcccaucc

SEQ ID NO: 2397726 - RNA, 22 nt, Human
cacugcuggguggcccaucccc

SEQ ID NO: 2397727 - RNA, 23 nt, Human
cacugcuggguggcccauccccc

SEQ ID NO: 2397728 - RNA, 13 nt, Human
cacugcuuaacuu

SEQ ID NO: 2397729 - RNA, 14 nt, Human
cacugcuuccagug

SEQ ID NO: 2397730 - RNA, 15 nt, Human
cacugcuuccaguga

SEQ ID NO: 2397731 - RNA, 16 nt, Human
cacugcuuccagugag

SEQ ID NO: 2397732 - RNA, 17 nt, Human
cacugcugugcugugcc

SEQ ID NO: 2397733 - RNA, 10 nt, Human
cacugcuguc

SEQ ID NO: 2397734 - RNA, 11 nt, Human
cacugcuguca

SEQ ID NO: 2397735 - RNA, 21 nt, Human
cacugcugugcugugcccaag

SEQ ID NO: 2397736 - RNA, 22 nt, Human
cacugcuuccagugaggcucug

SEQ ID NO: 2397737 - RNA, 20 nt, Human
cacugcuuuuggucugugug

SEQ ID NO: 2397738 - RNA, 20 nt, Human
cacugcuugaggaaaacaag

SEQ ID NO: 2397739 - RNA, 14 nt, Human
cacugcuugaggaa

SEQ ID NO: 2397740 - RNA, 13 nt, Human
cacugcuugagga

SEQ ID NO: 2397741 - RNA, 18 nt, Human
cacugcuuccagugaggc

SEQ ID NO: 2397742 - RNA, 19 nt, Human
cacugcuuccagugaggcu

SEQ ID NO: 2397743 - RNA, 20 nt, Human
cacugcuuccagugaggcuc

SEQ ID NO: 2397744 - RNA, 21 nt, Human
cacugcuuccagugaggcucu

SEQ ID NO: 2397745 - RNA, 22 nt, Human
cacugccucgggaaccucacuc

SEQ ID NO: 2397746 - RNA, 23 nt, Human
cacugccucgggaaccucacucu

SEQ ID NO: 2397747 - RNA, 16 nt, Human
cacugccucucccugg

SEQ ID NO: 2397748 - RNA, 20 nt, Human
cacugccucucccuggcccu

SEQ ID NO: 2397749 - RNA, 16 nt, Human
cacugccucuuccucc

SEQ ID NO: 2397750 - RNA, 21 nt, Human
cacugcccgagcuggugcauu

SEQ ID NO: 2397751 - RNA, 16 nt, Human
cacugccuacugcauc

SEQ ID NO: 2397752 - RNA, 15 nt, Human
cacugccuacugcau

SEQ ID NO: 2397753 - RNA, 21 nt, Human
cacugccucgggaaccucacu

SEQ ID NO: 2397754 - RNA, 16 nt, Human
cacugccucagguucc

SEQ ID NO: 2397755 - RNA, 17 nt, Human
cacugccucagguuccu

SEQ ID NO: 2397756 - RNA, 12 nt, Human
cacugccucagg

SEQ ID NO: 2397757 - RNA, 13 nt, Human
cacugccucaggu

SEQ ID NO: 2397758 - RNA, 14 nt, Human
cacugccucagguu

SEQ ID NO: 2397759 - RNA, 15 nt, Human
cacugccucagguuc

SEQ ID NO: 2397760 - RNA, 17 nt, Human
cacugccauggaggcac

SEQ ID NO: 2397761 - RNA, 19 nt, Human
cacugccauggaggcacac

SEQ ID NO: 2397762 - RNA, 22 nt, Human
cacugccauggaggcacacagc

SEQ ID NO: 2397763 - RNA, 20 nt, Human
cacugcccaaagugcuucca

SEQ ID NO: 2397764 - RNA, 21 nt, Human
cacugcccaaagugcuuccaa

SEQ ID NO: 2397765 - RNA, 14 nt, Human
cacugcccaccccc

SEQ ID NO: 2397766 - RNA, 15 nt, Human
cacugcccacccccu

SEQ ID NO: 2397767 - RNA, 16 nt, Human
cacugcccacccccuc

SEQ ID NO: 2397768 - RNA, 19 nt, Human
cacugcccgagcuggugca

SEQ ID NO: 2397769 - RNA, 18 nt, Human
cacugcccgagcuggugc

SEQ ID NO: 2397770 - RNA, 17 nt, Human
cacugcccgagcuggug

SEQ ID NO: 2397771 - RNA, 16 nt, Human
cacugcccgagcuggu

SEQ ID NO: 2397772 - RNA, 15 nt, Human
cacugcccgagcugg

SEQ ID NO: 2397773 - RNA, 21 nt, Human
cacugcccccagcucuucucc

SEQ ID NO: 2397774 - RNA, 18 nt, Human
cacugcccauggacaggc

SEQ ID NO: 2397775 - RNA, 17 nt, Human
cacugcccauggacagg

SEQ ID NO: 2397776 - RNA, 17 nt, Human
cacugcccacccccuca

SEQ ID NO: 2397777 - RNA, 18 nt, Human
cacugcccacccccucaa

SEQ ID NO: 2397778 - RNA, 14 nt, Human
cacugcaccgggcc

SEQ ID NO: 2397779 - RNA, 15 nt, Human
cacugcaccgggcca

SEQ ID NO: 2397780 - RNA, 23 nt, Human
cacugcacagugcaucucagccc

SEQ ID NO: 2397781 - RNA, 22 nt, Human
cacugcacagagcucuccagcu

SEQ ID NO: 2397782 - RNA, 15 nt, Human
cacugcaccaccgag

SEQ ID NO: 2397783 - RNA, 13 nt, Human
cacugcacccccu

SEQ ID NO: 2397784 - RNA, 14 nt, Human
cacugcacccccuc

SEQ ID NO: 2397785 - RNA, 15 nt, Human
cacugcacccccucc

SEQ ID NO: 2397786 - RNA, 16 nt, Human
cacugcacccccuccu

SEQ ID NO: 2397787 - RNA, 18 nt, Human
cacugcacccccuccugc

SEQ ID NO: 2397788 - RNA, 19 nt, Human
cacugcacccccuccugcu

SEQ ID NO: 2397789 - RNA, 20 nt, Human
cacugcacccccuccugcug

SEQ ID NO: 2397790 - RNA, 21 nt, Human
cacugcacccccuccugcugc

SEQ ID NO: 2397791 - RNA, 22 nt, Human
cacugcacccccuccugcugca

SEQ ID NO: 2397792 - RNA, 17 nt, Human
cacugcaccccgucuca

SEQ ID NO: 2397793 - RNA, 16 nt, Human
cacugcaccgggccac

SEQ ID NO: 2397794 - RNA, 18 nt, Human
cacugcaccgggccacag

SEQ ID NO: 2397795 - RNA, 19 nt, Human
cacugcaccgggccacaga

SEQ ID NO: 2397796 - RNA, 18 nt, Human
cacugcacuauagccuag

SEQ ID NO: 2397797 - RNA, 20 nt, Human
cacugccuucgauacaccgg

SEQ ID NO: 2397798 - RNA, 22 nt, Human
cacugccuucgauacaccgggc

SEQ ID NO: 2397799 - RNA, 10 nt, Human
cacugccugc

SEQ ID NO: 2397800 - RNA, 13 nt, Human
cacugccugcaga

SEQ ID NO: 2397801 - RNA, 22 nt, Human
cacugccugcagaggucugugc

SEQ ID NO: 2397802 - RNA, 23 nt, Human
cacugccugcagaggucugugcu

SEQ ID NO: 2397803 - RNA, 22 nt, Human
cacugccugauggaccugucac

SEQ ID NO: 2397804 - RNA, 19 nt, Human
cacugccucucccuggccc

SEQ ID NO: 2397805 - RNA, 18 nt, Human
cacugccucucccuggcc

SEQ ID NO: 2397806 - RNA, 15 nt, Human
cacugccugcccacc

SEQ ID NO: 2397807 - RNA, 14 nt, Human
cacugccugcccac

SEQ ID NO: 2397808 - RNA, 18 nt, Human
cacugcuaagaauauuug

SEQ ID NO: 2397809 - RNA, 20 nt, Human
cacugcggagaaccuugugc

SEQ ID NO: 2397810 - RNA, 21 nt, Human
cacugcggagaaccuugugcc

SEQ ID NO: 2397811 - RNA, 22 nt, Human
cacugcggagaaccuugugccu

SEQ ID NO: 2397812 - RNA, 19 nt, Human
cacugcggggcuuggcuga

SEQ ID NO: 2397813 - RNA, 12 nt, Human
cacugccuuuga

SEQ ID NO: 2397814 - RNA, 20 nt, Human
cacugccuucucaacuccaa

SEQ ID NO: 2397815 - RNA, 18 nt, Human
cacugccuucgcuucuug

SEQ ID NO: 2397816 - RNA, 19 nt, Human
cacugccuucgcuucuugc

SEQ ID NO: 2397817 - RNA, 21 nt, Human
cacugccuucgcuucuugccu

SEQ ID NO: 2397818 - RNA, 23 nt, Human
cacugccuucgcuucuugccucu

SEQ ID NO: 2397819 - RNA, 12 nt, Human
cacugcucuggu

SEQ ID NO: 2397820 - RNA, 16 nt, Human
cacugcugcaaggccu

SEQ ID NO: 2397821 - RNA, 20 nt, Human
cacugcucugaugaagagga

SEQ ID NO: 2397822 - RNA, 15 nt, Human
cacugcugcccagcc

SEQ ID NO: 2397823 - RNA, 17 nt, Human
cacugcugcaaggccuu

SEQ ID NO: 2397824 - RNA, 18 nt, Human
cacugcugcaaggccuuu

SEQ ID NO: 2397825 - RNA, 19 nt, Human
cacugcugcaaggccuuuc

SEQ ID NO: 2397826 - RNA, 16 nt, Human
cacugcugcugccuuu

SEQ ID NO: 2397827 - RNA, 22 nt, Human
cacugcugcaaggccuuucugu

SEQ ID NO: 2397828 - RNA, 23 nt, Human
cacugcugcuucuccauggccac

SEQ ID NO: 2397829 - RNA, 17 nt, Human
cacugcugcccagccuc

SEQ ID NO: 2397830 - RNA, 22 nt, Human
cacugcuaggugggccagcccc

SEQ ID NO: 2397831 - RNA, 17 nt, Human
cacugcuaggugggcca

SEQ ID NO: 2397832 - RNA, 16 nt, Human
cacugcuaggugggcc

SEQ ID NO: 2397833 - RNA, 22 nt, Human
cacugcuaggcgagugccagga

SEQ ID NO: 2397834 - RNA, 20 nt, Human
cacugcggggcuuggcugag

SEQ ID NO: 2397835 - RNA, 21 nt, Human
cacugcggggcuuggcugaga

SEQ ID NO: 2397836 - RNA, 20 nt, Human
cacugcuaggcgagugccag

SEQ ID NO: 2397837 - RNA, 21 nt, Human
cacugcuaggcgagugccagg

SEQ ID NO: 2397838 - RNA, 23 nt, Human
cacugcuaggugggccagccccu

SEQ ID NO: 2397839 - RNA, 19 nt, Human
cacugcucaagaagacaug

SEQ ID NO: 2397840 - RNA, 22 nt, Human
cacugcucaagaagacauggag

SEQ ID NO: 2397841 - RNA, 14 nt, Human
cacugcucccugaa

SEQ ID NO: 2397842 - RNA, 17 nt, Human
cacugcucccugaagcc

SEQ ID NO: 2397843 - RNA, 18 nt, Human
cacugcucccugaagcca

SEQ ID NO: 2397844 - RNA, 19 nt, Human
cacugcucccugaagccag

SEQ ID NO: 2397845 - RNA, 20 nt, Human
cacugcucccugaagccagc

SEQ ID NO: 2397846 - RNA, 21 nt, Human
cacugcucccugaagccagcc

SEQ ID NO: 2397847 - RNA, 22 nt, Human
cacugcucccugaagccagccu

SEQ ID NO: 2397848 - RNA, 23 nt, Human
cacugcucccugaagccagccuu

SEQ ID NO: 2397849 - RNA, 15 nt, Human
cacucugggcuccag

SEQ ID NO: 2397850 - RNA, 14 nt, Human
cacucugggcucca

SEQ ID NO: 2397851 - RNA, 12 nt, Human
cacucuggccuc

SEQ ID NO: 2397852 - RNA, 19 nt, Human
cacucuggcugguuuggaa

SEQ ID NO: 2397853 - RNA, 23 nt, Human
cacucuggcagcucagagagggu

SEQ ID NO: 2397854 - RNA, 20 nt, Human
cacucuggcagcucagagag

SEQ ID NO: 2397855 - RNA, 21 nt, Human
cacucuggcagcucagagagg

SEQ ID NO: 2397856 - RNA, 15 nt, Human
cacucuggcagcuca

SEQ ID NO: 2397857 - RNA, 16 nt, Human
cacucuggcagcucag

SEQ ID NO: 2397858 - RNA, 17 nt, Human
cacucuggcagcucaga

SEQ ID NO: 2397859 - RNA, 19 nt, Human
cacucuggcagcucagaga

SEQ ID NO: 2397860 - RNA, 17 nt, Human
cacucugggcuccagag

SEQ ID NO: 2397861 - RNA, 16 nt, Human
cacucugggcuccaga

SEQ ID NO: 2397862 - RNA, 13 nt, Human
cacucuggccuca

SEQ ID NO: 2397863 - RNA, 15 nt, Human
cacucugucgcccag

SEQ ID NO: 2397864 - RNA, 16 nt, Human
cacucugucgcccagu

SEQ ID NO: 2397865 - RNA, 19 nt, Human
cacucugucgcccagucug

SEQ ID NO: 2397866 - RNA, 23 nt, Human
cacugacauuguuggccaaagcc

SEQ ID NO: 2397867 - RNA, 15 nt, Human
cacugacagccuccc

SEQ ID NO: 2397868 - RNA, 14 nt, Human
cacugacagccucc

SEQ ID NO: 2397869 - RNA, 13 nt, Human
cacugacagccuc

SEQ ID NO: 2397870 - RNA, 17 nt, Human
cacugacagccucccac

SEQ ID NO: 2397871 - RNA, 16 nt, Human
cacugacagccuccca

SEQ ID NO: 2397872 - RNA, 20 nt, Human
cacugacagccucccacccc

SEQ ID NO: 2397873 - RNA, 13 nt, Human
cacugaccagaac

SEQ ID NO: 2397874 - RNA, 17 nt, Human
cacugaccauccacucu

SEQ ID NO: 2397875 - RNA, 16 nt, Human
cacugaccauccacuc

SEQ ID NO: 2397876 - RNA, 15 nt, Human
cacugaccagaacua

SEQ ID NO: 2397877 - RNA, 14 nt, Human
cacugaccagaacu

SEQ ID NO: 2397878 - RNA, 23 nt, Human
cacugaccauccacucuacccuc

SEQ ID NO: 2397879 - RNA, 18 nt, Human
cacugaccugucaugccc

SEQ ID NO: 2397880 - RNA, 19 nt, Human
cacugacuacuggcucuca

SEQ ID NO: 2397881 - RNA, 23 nt, Human
cacugaccugucaugccccccuc

SEQ ID NO: 2397882 - RNA, 22 nt, Human
cacugaccugucaugccccccu

SEQ ID NO: 2397883 - RNA, 15 nt, Human
cacugacuacuggcu

SEQ ID NO: 2397884 - RNA, 20 nt, Human
cacugacuucuaaguaaaac

SEQ ID NO: 2397885 - RNA, 16 nt, Human
cacugacuucuaagua

SEQ ID NO: 2397886 - RNA, 15 nt, Human
cacugacuucuaagu

SEQ ID NO: 2397887 - RNA, 14 nt, Human
cacugacuucuaag

SEQ ID NO: 2397888 - RNA, 17 nt, Human
cacugagaagauuguga

SEQ ID NO: 2397889 - RNA, 16 nt, Human
cacugagaauguaaga

SEQ ID NO: 2397890 - RNA, 18 nt, Human
cacugagaauguaagaac

SEQ ID NO: 2397891 - RNA, 21 nt, Human
cacugacuucuaaguaaaacc

SEQ ID NO: 2397892 - RNA, 12 nt, Human
cacugagacagc

SEQ ID NO: 2397893 - RNA, 13 nt, Human
cacugagacagcc

SEQ ID NO: 2397894 - RNA, 14 nt, Human
cacugagacagccc

SEQ ID NO: 2397895 - RNA, 17 nt, Human
cacugagacagcccggg

SEQ ID NO: 2397896 - RNA, 19 nt, Human
cacugagacagcccgggcu

SEQ ID NO: 2397897 - RNA, 22 nt, Human
cacugagacagcccgggcucug

SEQ ID NO: 2397898 - RNA, 14 nt, Human
cacugagcaaagca

SEQ ID NO: 2397899 - RNA, 23 nt, Human
cacugagauaccagcgaggaggc

SEQ ID NO: 2397900 - RNA, 19 nt, Human
cacugagauaccagcgagg

SEQ ID NO: 2397901 - RNA, 18 nt, Human
cacugagauaccagcgag

SEQ ID NO: 2397902 - RNA, 23 nt, Human
cacugagacagcccgggcucugc

SEQ ID NO: 2397903 - RNA, 21 nt, Human
cacugagaauguaagaacuac

SEQ ID NO: 2397904 - RNA, 19 nt, Human
cacugagaagauugugaau

SEQ ID NO: 2397905 - RNA, 19 nt, Human
cacugagaauguaagaacu

SEQ ID NO: 2397906 - RNA, 20 nt, Human
cacugagaauguaagaacua

SEQ ID NO: 2397907 - RNA, 19 nt, Human
cacugaggcagggaagucc

SEQ ID NO: 2397908 - RNA, 17 nt, Human
cacugaggcagggaagu

SEQ ID NO: 2397909 - RNA, 16 nt, Human
cacugaggcagggaag

SEQ ID NO: 2397910 - RNA, 14 nt, Human
cacugaggcaggga

SEQ ID NO: 2397911 - RNA, 13 nt, Human
cacugaggcaggg

SEQ ID NO: 2397912 - RNA, 13 nt, Human
cacugaggaagaa

SEQ ID NO: 2397913 - RNA, 14 nt, Human
cacugaggaagaac

SEQ ID NO: 2397914 - RNA, 15 nt, Human
cacugaggaagaacg

SEQ ID NO: 2397915 - RNA, 17 nt, Human
cacugaggaagaacggg

SEQ ID NO: 2397916 - RNA, 11 nt, Human
cacugagcccc

SEQ ID NO: 2397917 - RNA, 13 nt, Human
cacugagcccccc

SEQ ID NO: 2397918 - RNA, 14 nt, Human
cacugagccccccc

SEQ ID NO: 2397919 - RNA, 16 nt, Human
cacugagcccccccaa

SEQ ID NO: 2397920 - RNA, 12 nt, Human
cacugagcucca

SEQ ID NO: 2397921 - RNA, 17 nt, Human
cacugagcuccaugugc

SEQ ID NO: 2397922 - RNA, 15 nt, Human
cacugagcugucaug

SEQ ID NO: 2397923 - RNA, 13 nt, Human
cacugagcagagu

SEQ ID NO: 2397924 - RNA, 18 nt, Human
cacugaggcagggaaguc

SEQ ID NO: 2397925 - RNA, 10 nt, Human
cacugagggc

SEQ ID NO: 2397926 - RNA, 14 nt, Human
cacugagggcaguc

SEQ ID NO: 2397927 - RNA, 18 nt, Human
cacugagggccacacuau

SEQ ID NO: 2397928 - RNA, 13 nt, Human
cacugagggccac

SEQ ID NO: 2397929 - RNA, 14 nt, Human
cacugagggccaca

SEQ ID NO: 2397930 - RNA, 19 nt, Human
cacugauauuuuaccucuu

SEQ ID NO: 2397931 - RNA, 20 nt, Human
cacugauauaucaugaguga

SEQ ID NO: 2397932 - RNA, 16 nt, Human
cacugauccagcccug

SEQ ID NO: 2397933 - RNA, 17 nt, Human
cacugaugcugccccuc

SEQ ID NO: 2397934 - RNA, 12 nt, Human
cacugaugcugc

SEQ ID NO: 2397935 - RNA, 15 nt, Human
cacugauccagcccu

SEQ ID NO: 2397936 - RNA, 14 nt, Human
cacugauccagccc

SEQ ID NO: 2397937 - RNA, 19 nt, Human
cacugauggacaaggaggu

SEQ ID NO: 2397938 - RNA, 16 nt, Human
cacugaugcuuagaug

SEQ ID NO: 2397939 - RNA, 15 nt, Human
cacugaugcuuagau

SEQ ID NO: 2397940 - RNA, 19 nt, Human
cacugaugcugccccucau

SEQ ID NO: 2397941 - RNA, 14 nt, Human
cacugaugggcaac

SEQ ID NO: 2397942 - RNA, 18 nt, Human
cacugaugggcaaccccc

SEQ ID NO: 2397943 - RNA, 24 nt, Human
cacugaugggcaacccccagccug

SEQ ID NO: 2397944 - RNA, 21 nt, Human
cacugauuucacaacagauca

SEQ ID NO: 2397945 - RNA, 18 nt, Human
cacugauuucacaacaga

SEQ ID NO: 2397946 - RNA, 19 nt, Human
cacugauuucacaacagau

SEQ ID NO: 2397947 - RNA, 22 nt, Human
cacugauauuuuaccucuuauu

SEQ ID NO: 2397948 - RNA, 13 nt, Human
cacugauuucaca

SEQ ID NO: 2397949 - RNA, 14 nt, Human
cacugauuuggaga

SEQ ID NO: 2397950 - RNA, 16 nt, Human
cacugauuuggagaua

SEQ ID NO: 2397951 - RNA, 13 nt, Human
cacugcaaccucc

SEQ ID NO: 2397952 - RNA, 23 nt, Human
cacugcaaccuccgccucuuggg

SEQ ID NO: 2397953 - RNA, 14 nt, Human
cacugcaaccuccg

SEQ ID NO: 2397954 - RNA, 16 nt, Human
cacugcaaccuccgcc

SEQ ID NO: 2397955 - RNA, 16 nt, Human
cacugcaacuucugcc

SEQ ID NO: 2397956 - RNA, 23 nt, Human
cacugcaaccuucgccaccuggg

SEQ ID NO: 2397957 - RNA, 22 nt, Human
cacugcaaccuucgccaccugg

SEQ ID NO: 2397958 - RNA, 14 nt, Human
cacugcaaccuucg

SEQ ID NO: 2397959 - RNA, 17 nt, Human
cacugcaacuucugccu

SEQ ID NO: 2397960 - RNA, 16 nt, Human
cacugcaagagccuug

SEQ ID NO: 2397961 - RNA, 15 nt, Human
cacugcaagagccuu

SEQ ID NO: 2397962 - RNA, 13 nt, Human
cacugcaagagcc

SEQ ID NO: 2397963 - RNA, 19 nt, Human
cacugcaagagccuuggug

SEQ ID NO: 2397964 - RNA, 18 nt, Human
cacugcaagagccuuggu

SEQ ID NO: 2397965 - RNA, 17 nt, Human
cacugcaagagccuugg

SEQ ID NO: 2397966 - RNA, 20 nt, Human
cacugcaagagccuuggugu

SEQ ID NO: 2397967 - RNA, 18 nt, Human
cacugcacagugcaucuc

SEQ ID NO: 2397968 - RNA, 19 nt, Human
cacugcacagugcaucuca

SEQ ID NO: 2397969 - RNA, 21 nt, Human
cacugcacagugcaucucagc

SEQ ID NO: 2397970 - RNA, 22 nt, Human
cacugcacagugcaucucagcc

SEQ ID NO: 2397971 - RNA, 16 nt, Human
cacugcaauccugucu

SEQ ID NO: 2397972 - RNA, 19 nt, Human
cacugcaauccugucuuuc

SEQ ID NO: 2397973 - RNA, 18 nt, Human
cacugcacacaccucaga

SEQ ID NO: 2397974 - RNA, 19 nt, Human
cacugcacacaccucagag

SEQ ID NO: 2397975 - RNA, 22 nt, Human
cacugcacacaccucagaggcu

SEQ ID NO: 2397976 - RNA, 13 nt, Human
cacugcacagagc

SEQ ID NO: 2397977 - RNA, 14 nt, Human
cacugcacagagcu

SEQ ID NO: 2397978 - RNA, 15 nt, Human
cacugcacagagcuc

SEQ ID NO: 2397979 - RNA, 16 nt, Human
cacugcacagagcucu

SEQ ID NO: 2397980 - RNA, 19 nt, Human
cacugcacagagcucucca

SEQ ID NO: 2397981 - RNA, 21 nt, Human
cacugcacagagcucuccagc

SEQ ID NO: 2397982 - RNA, 14 nt, Human
cacugugcccuggu

SEQ ID NO: 2397983 - RNA, 14 nt, Human immunodeficiency virus 1 [HIV-1]
cauagaacaaaaau

SEQ ID NO: 2397984 - RNA, 16 nt, Human immunodeficiency virus 1 [HIV-1]
uggaacuucugggacg

SEQ ID NO: 2397985 - RNA, 13 nt, Human immunodeficiency virus 1 [HIV-1]
agaucugagccug

SEQ ID NO: 2397986 - RNA, 14 nt, Human immunodeficiency virus 1 [HIV-1]
cacugcuuaagccu

SEQ ID NO: 2397987 - RNA, 13 nt, Human immunodeficiency virus 1 [HIV-1]
cacauuguaacau

SEQ ID NO: 2397988 - RNA, 20 nt, Human immunodeficiency virus 1 [HIV-1]
acugcccauacaaaaggaaa

SEQ ID NO: 2397989 - RNA, 16 nt, Human immunodeficiency virus 1 [HIV-1]
gacaguggcaaugaga

SEQ ID NO: 2397990 - RNA, 21 nt, Human immunodeficiency virus 1 [HIV-1]
caaaugucagcacaguacaau

SEQ ID NO: 2397991 - RNA, 19 nt, Human immunodeficiency virus 1 [HIV-1]
ccaaugcugcuugugccug

SEQ ID NO: 2397992 - RNA, 14 nt, Human immunodeficiency virus 1 [HIV-1]
uuaauaacaccaaa

SEQ ID NO: 2397993 - RNA, 18 nt, Human immunodeficiency virus 1 [HIV-1]
agaaaagaaugaacaaga

SEQ ID NO: 2397994 - RNA, 18 nt, Human immunodeficiency virus 1 [HIV-1]
ucacucccaaagaagaca

SEQ ID NO: 2397995 - RNA, 20 nt, Human immunodeficiency virus 1 [HIV-1]
cuucccugauuagcagaacu

SEQ ID NO: 2397996 - RNA, 14 nt, Human immunodeficiency virus 1 [HIV-1]
gagugggacagaga

SEQ ID NO: 2397997 - RNA, 12 nt, Human immunodeficiency virus 1 [HIV-1]
cacugaaggaag

SEQ ID NO: 2397998 - RNA, 15 nt, Human immunodeficiency virus 1 [HIV-1]
auagaagcagaaguu

SEQ ID NO: 2397999 - RNA, 19 nt, Human immunodeficiency virus 1 [HIV-1]
cugcauacaggagaaagag

SEQ ID NO: 2398000 - RNA, 23 nt, Human immunodeficiency virus 1 [HIV-1]
cgccacauaccuagaagaauaag

SEQ ID NO: 2398001 - RNA, 13 nt, Human immunodeficiency virus 1 [HIV-1]
ugccaagaagaaa

SEQ ID NO: 2398002 - RNA, 18 nt, Human immunodeficiency virus 1 [HIV-1]
accagaucugagccuggg

SEQ ID NO: 2398003 - RNA, 15 nt, Human immunodeficiency virus 1 [HIV-1]
auguggaaaaaugac

SEQ ID NO: 2398004 - RNA, 16 nt, Human immunodeficiency virus 1 [HIV-1]
gauucgggauuagaag

SEQ ID NO: 2398005 - RNA, 14 nt, Human immunodeficiency virus 1 [HIV-1]
gcagcuccaggcaa

SEQ ID NO: 2398006 - RNA, 19 nt, Human immunodeficiency virus 1 [HIV-1]
cuuaagccucaauaaagcu

SEQ ID NO: 2398007 - RNA, 19 nt, Human immunodeficiency virus 1 [HIV-1]
caggaacuaaagaauagug

SEQ ID NO: 2398008 - RNA, 14 nt, Human immunodeficiency virus 1 [HIV-1]
gacuuuccagggag

SEQ ID NO: 2398009 - RNA, 19 nt, Human immunodeficiency virus 1 [HIV-1]
uagcagaaauacagaagca

SEQ ID NO: 2398010 - RNA, 16 nt, Human immunodeficiency virus 1 [HIV-1]
auggugguaauagcaa

SEQ ID NO: 2398011 - RNA, 17 nt, Human immunodeficiency virus 1 [HIV-1]
gaggaggaggagguggg

SEQ ID NO: 2398012 - RNA, 18 nt, Human immunodeficiency virus 1 [HIV-1]
guaaacuccuuagaggaa

SEQ ID NO: 2398013 - RNA, 18 nt, Human immunodeficiency virus 1 [HIV-1]
aacacuuuaaaacagaua

SEQ ID NO: 2398014 - RNA, 21 nt, Human immunodeficiency virus 1 [HIV-1]
ggcaucuccuauggcaggaag

SEQ ID NO: 2398015 - RNA, 19 nt, Human immunodeficiency virus 1 [HIV-1]
uggccauugacagaagaaa

SEQ ID NO: 2398016 - RNA, 16 nt, Human immunodeficiency virus 1 [HIV-1]
acccugugagccugca

SEQ ID NO: 2398017 - RNA, 17 nt, Human immunodeficiency virus 1 [HIV-1]
gaauaguuuuugcugua

SEQ ID NO: 2398018 - RNA, 12 nt, Human immunodeficiency virus 1 [HIV-1]
aaaucucuggaa

SEQ ID NO: 2398019 - RNA, 11 nt, Human immunodeficiency virus 1 [HIV-1]
acauguggaaa

SEQ ID NO: 2398020 - RNA, 15 nt, Human immunodeficiency virus 1 [HIV-1]
uccauuuucagaauu

SEQ ID NO: 2398021 - RNA, 21 nt, Human immunodeficiency virus 1 [HIV-1]
agagcaguuaauaaaaaagga

SEQ ID NO: 2398022 - RNA, 15 nt, Human immunodeficiency virus 1 [HIV-1]
gaaaauauuaagaca

SEQ ID NO: 2398023 - RNA, 15 nt, Human immunodeficiency virus 1 [HIV-1]
cuacacaccagggcc

SEQ ID NO: 2398024 - RNA, 22 nt, Human immunodeficiency virus 1 [HIV-1]
aggaucaacagcuccuggggau

SEQ ID NO: 2398025 - RNA, 19 nt, Human immunodeficiency virus 1 [HIV-1]
gagaaauaucagcacuugu

SEQ ID NO: 2398026 - RNA, 14 nt, Human immunodeficiency virus 1 [HIV-1]
acaauuuuaaaaga

SEQ ID NO: 2398027 - RNA, 20 nt, Human immunodeficiency virus 1 [HIV-1]
cuugugccuggcuagaagca

SEQ ID NO: 2398028 - RNA, 13 nt, Human immunodeficiency virus 1 [HIV-1]
accagcaagaaaa

SEQ ID NO: 2398029 - RNA, 19 nt, Human immunodeficiency virus 1 [HIV-1]
acuugggcaggaguggaag

SEQ ID NO: 2398030 - RNA, 15 nt, Human immunodeficiency virus 1 [HIV-1]
acaagcuuaauacac

SEQ ID NO: 2398031 - RNA, 13 nt, Human immunodeficiency virus 1 [HIV-1]
uuaacauguggaa

SEQ ID NO: 2398032 - RNA, 15 nt, Human immunodeficiency virus 1 [HIV-1]
agagcaguuaauaaa

SEQ ID NO: 2398033 - RNA, 16 nt, Human immunodeficiency virus 1 [HIV-1]
ucucugguuagaccag

SEQ ID NO: 2398034 - RNA, 21 nt, Human immunodeficiency virus 1 [HIV-1]
ccuaaaggaucaacagcuccu

SEQ ID NO: 2398035 - RNA, 14 nt, Human immunodeficiency virus 1 [HIV-1]
gcugcuugugccug

SEQ ID NO: 2398036 - RNA, 22 nt, Human immunodeficiency virus 1 [HIV-1]
acaauuuggaaauaauaaaaca

SEQ ID NO: 2398037 - RNA, 13 nt, Human immunodeficiency virus 1 [HIV-1]
agcagcaggaagc

SEQ ID NO: 2398038 - RNA, 13 nt, Human immunodeficiency virus 1 [HIV-1]
gaggcguggccug

SEQ ID NO: 2398039 - RNA, 22 nt, Human immunodeficiency virus 1 [HIV-1]
agaacaauuuggaaauaauaaa

SEQ ID NO: 2398040 - RNA, 20 nt, Human immunodeficiency virus 1 [HIV-1]
cuuuccagggaggcguggcc

SEQ ID NO: 2398041 - RNA, 23 nt, Human immunodeficiency virus 1 [HIV-1]
auggguaccagcacacaaaggaa

SEQ ID NO: 2398042 - RNA, 14 nt, Human immunodeficiency virus 1 [HIV-1]
ggagagcaagaaau

SEQ ID NO: 2398043 - RNA, 13 nt, Human immunodeficiency virus 1 [HIV-1]
gagacgagcugag

SEQ ID NO: 2398044 - RNA, 12 nt, Human immunodeficiency virus 1 [HIV-1]
cugagccuggga

SEQ ID NO: 2398045 - RNA, 16 nt, Human immunodeficiency virus 1 [HIV-1]
uccagucacaccucag

SEQ ID NO: 2398046 - RNA, 16 nt, Human immunodeficiency virus 1 [HIV-1]
aagaagaaaagcaaag

SEQ ID NO: 2398047 - RNA, 19 nt, Human immunodeficiency virus 1 [HIV-1]
auuugggguugcucuggaa

SEQ ID NO: 2398048 - RNA, 18 nt, Human immunodeficiency virus 1 [HIV-1]
cugagccugggagcucuc

SEQ ID NO: 2398049 - RNA, 13 nt, Human immunodeficiency virus 1 [HIV-1]
aguaaaaacaaua

SEQ ID NO: 2398050 - RNA, 20 nt, Human immunodeficiency virus 1 [HIV-1]
uaaaacaauuaacagaggca

SEQ ID NO: 2398051 - RNA, 20 nt, Human immunodeficiency virus 1 [HIV-1]
aaaacagauagcuagcaaau

SEQ ID NO: 2398052 - RNA, 17 nt, Human immunodeficiency virus 1 [HIV-1]
uugcucaaugccacagc

SEQ ID NO: 2398053 - RNA, 23 nt, Human immunodeficiency virus 1 [HIV-1]
cugaccuuuggauggugcuacaa

SEQ ID NO: 2398054 - RNA, 16 nt, Human immunodeficiency virus 1 [HIV-1]
aauagugcuguuagcu

SEQ ID NO: 2398055 - RNA, 17 nt, Human immunodeficiency virus 1 [HIV-1]
cugggcgggacugggga

SEQ ID NO: 2398056 - RNA, 20 nt, Human immunodeficiency virus 1 [HIV-1]
gccuguacugggucucucug

SEQ ID NO: 2398057 - RNA, 23 nt, Human immunodeficiency virus 1 [HIV-1]
uaaaauuauucauaaugauagua

SEQ ID NO: 2398058 - RNA, 16 nt, Human immunodeficiency virus 1 [HIV-1]
ggagaaaggagagaua

SEQ ID NO: 2398059 - RNA, 19 nt, Human immunodeficiency virus 1 [HIV-1]
acugcccauacaaaaggaa

SEQ ID NO: 2398060 - RNA, 15 nt, Human immunodeficiency virus 1 [HIV-1]
aaggugcagaaagaa

SEQ ID NO: 2398061 - RNA, 20 nt, Human immunodeficiency virus 1 [HIV-1]
uggacaaauuagauguucau

SEQ ID NO: 2398062 - RNA, 15 nt, Human immunodeficiency virus 1 [HIV-1]
cugaggggacagaua

SEQ ID NO: 2398063 - RNA, 18 nt, Human immunodeficiency virus 1 [HIV-1]
ccaccaaggcaaagagaa

SEQ ID NO: 2398064 - RNA, 19 nt, Human immunodeficiency virus 1 [HIV-1]
acucccaaagaagacaaga

SEQ ID NO: 2398065 - RNA, 19 nt, Human immunodeficiency virus 1 [HIV-1]
accuguguggaaggaagca

SEQ ID NO: 2398066 - RNA, 15 nt, Human immunodeficiency virus 1 [HIV-1]
caauaguagcaauag

SEQ ID NO: 2398067 - RNA, 18 nt, Human immunodeficiency virus 1 [HIV-1]
uaaaucucuggaacagau

SEQ ID NO: 2398068 - RNA, 16 nt, Human immunodeficiency virus 1 [HIV-1]
aauggaggaaaaagag

SEQ ID NO: 2398069 - RNA, 15 nt, Human immunodeficiency virus 1 [HIV-1]
uggcgagcccucaga

SEQ ID NO: 2398070 - RNA, 19 nt, Human immunodeficiency virus 1 [HIV-1]
ccgcaggguuaaaaaagaa

SEQ ID NO: 2398071 - RNA, 18 nt, Human immunodeficiency virus 1 [HIV-1]
aucuguggacauaaagcu

SEQ ID NO: 2398072 - RNA, 14 nt, Human immunodeficiency virus 1 [HIV-1]
agcaaaagaaauag

SEQ ID NO: 2398073 - RNA, 23 nt, Human immunodeficiency virus 1 [HIV-1]
ggacuggggaguggcgagcccuc

SEQ ID NO: 2398074 - RNA, 14 nt, Human immunodeficiency virus 1 [HIV-1]
ucccacuaggggau

SEQ ID NO: 2398075 - RNA, 21 nt, Human immunodeficiency virus 1 [HIV-1]
aggugcagaaagaauaugcau

SEQ ID NO: 2398076 - RNA, 20 nt, Human immunodeficiency virus 1 [HIV-1]
agauauccuugaucugugga

SEQ ID NO: 2398077 - RNA, 13 nt, Human immunodeficiency virus 1 [HIV-1]
gaagaauaagaca

SEQ ID NO: 2398078 - RNA, 14 nt, Human immunodeficiency virus 1 [HIV-1]
aucugcggagccug

SEQ ID NO: 2398079 - RNA, 16 nt, Human immunodeficiency virus 1 [HIV-1]
acacauuuagaaggaa

SEQ ID NO: 2398080 - RNA, 18 nt, Human immunodeficiency virus 1 [HIV-1]
ccagggaggcguggccug

SEQ ID NO: 2398081 - RNA, 18 nt, Human immunodeficiency virus 1 [HIV-1]
cugguauagugcagcagc

SEQ ID NO: 2398082 - RNA, 16 nt, Human immunodeficiency virus 1 [HIV-1]
agcaucucgagaccug

SEQ ID NO: 2398083 - RNA, 21 nt, Human immunodeficiency virus 1 [HIV-1]
accagaucugagccugggagc

SEQ ID NO: 2398084 - RNA, 18 nt, Human immunodeficiency virus 1 [HIV-1]
gaagaagguggagagaga

SEQ ID NO: 2398085 - RNA, 14 nt, Human immunodeficiency virus 1 [HIV-1]
cagaaaacagagag

SEQ ID NO: 2398086 - RNA, 18 nt, Human immunodeficiency virus 1 [HIV-1]
acgcagggggugggaagc

SEQ ID NO: 2398087 - RNA, 13 nt, Human immunodeficiency virus 1 [HIV-1]
gaacuucugggac

SEQ ID NO: 2398088 - RNA, 23 nt, Human immunodeficiency virus 1 [HIV-1]
aguuggaguaauaaaucucugga

SEQ ID NO: 2398089 - RNA, 16 nt, Human immunodeficiency virus 1 [HIV-1]
ggcguuacucgacaga

SEQ ID NO: 2398090 - RNA, 22 nt, Human immunodeficiency virus 1 [HIV-1]
gcugacaucgagcuugcuacaa

SEQ ID NO: 2398091 - RNA, 14 nt, Human immunodeficiency virus 1 [HIV-1]
caaauuacaaaaau

SEQ ID NO: 2398092 - RNA, 14 nt, Human immunodeficiency virus 1 [HIV-1]
gaagaagguggaga

SEQ ID NO: 2398093 - RNA, 22 nt, Human immunodeficiency virus 1 [HIV-1]
uauccagagaggaccagggaga

SEQ ID NO: 2398094 - RNA, 12 nt, Human immunodeficiency virus 1 [HIV-1]
aagaacugcuga

SEQ ID NO: 2398095 - RNA, 15 nt, Human immunodeficiency virus 1 [HIV-1]
agggcuuggaaagga

SEQ ID NO: 2398096 - RNA, 15 nt, Human immunodeficiency virus 1 [HIV-1]
uuaucugggacgauc

SEQ ID NO: 2398097 - RNA, 21 nt, Human immunodeficiency virus 1 [HIV-1]
agaauggaggaaaaagagaua

SEQ ID NO: 2398098 - RNA, 18 nt, Human immunodeficiency virus 1 [HIV-1]
gacagcgacgaagagcuc

SEQ ID NO: 2398099 - RNA, 13 nt, Human immunodeficiency virus 1 [HIV-1]
gacuagagcccug

SEQ ID NO: 2398100 - RNA, 14 nt, Human immunodeficiency virus 1 [HIV-1]
auaaaggagagaac

SEQ ID NO: 2398101 - RNA, 15 nt, Human immunodeficiency virus 1 [HIV-1]
gaacaugagaaauau

SEQ ID NO: 2398102 - RNA, 16 nt, Human immunodeficiency virus 1 [HIV-1]
cagacccaccucccaa

SEQ ID NO: 2398103 - RNA, 15 nt, Human immunodeficiency virus 1 [HIV-1]
gcuaccaaugcugcu

SEQ ID NO: 2398104 - RNA, 20 nt, Human immunodeficiency virus 1 [HIV-1]
gagcaagaaauggagccagu

SEQ ID NO: 2398105 - RNA, 20 nt, Human immunodeficiency virus 1 [HIV-1]
cugguauagugcagcagcag

SEQ ID NO: 2398106 - RNA, 18 nt, Human immunodeficiency virus 1 [HIV-1]
aggaagaagcggagacag

SEQ ID NO: 2398107 - RNA, 21 nt, Human immunodeficiency virus 1 [HIV-1]
cacaaguagcaauacagcagc

SEQ ID NO: 2398108 - RNA, 18 nt, Human immunodeficiency virus 1 [HIV-1]
cuggauggagugggacag

SEQ ID NO: 2398109 - RNA, 16 nt, Human immunodeficiency virus 1 [HIV-1]
gguaccuguguggaag

SEQ ID NO: 2398110 - RNA, 21 nt, Human immunodeficiency virus 1 [HIV-1]
aucaaaagacuuaauagcaga

SEQ ID NO: 2398111 - RNA, 14 nt, Human immunodeficiency virus 1 [HIV-1]
agacuagagcccug

SEQ ID NO: 2398112 - RNA, 16 nt, Human immunodeficiency virus 1 [HIV-1]
ccacagagggagccac

SEQ ID NO: 2398113 - RNA, 15 nt, Human immunodeficiency virus 1 [HIV-1]
agcagauaggguggg

SEQ ID NO: 2398114 - RNA, 19 nt, Human immunodeficiency virus 1 [HIV-1]
cuaauagaggaagacaaaa

SEQ ID NO: 2398115 - RNA, 21 nt, Human immunodeficiency virus 1 [HIV-1]
agagaaaaaagagcaguggga

SEQ ID NO: 2398116 - RNA, 17 nt, Human immunodeficiency virus 1 [HIV-1]
ccgaaggaauagaagaa

SEQ ID NO: 2398117 - RNA, 22 nt, Human immunodeficiency virus 1 [HIV-1]
acaccucagguaccuuuaagac

SEQ ID NO: 2398118 - RNA, 22 nt, Human immunodeficiency virus 1 [HIV-1]
uggauauauagaagcagaaguu

SEQ ID NO: 2398119 - RNA, 17 nt, Human immunodeficiency virus 1 [HIV-1]
gcaaucacaaguagcaa

SEQ ID NO: 2398120 - RNA, 16 nt, Human immunodeficiency virus 1 [HIV-1]
augacuuacaaggcag

SEQ ID NO: 2398121 - RNA, 18 nt, Human immunodeficiency virus 1 [HIV-1]
cuacaguauuggagucag

SEQ ID NO: 2398122 - RNA, 22 nt, Human immunodeficiency virus 1 [HIV-1]
gaccagggagagcauuuguuac

SEQ ID NO: 2398123 - RNA, 16 nt, Human immunodeficiency virus 1 [HIV-1]
caguacaaauggcagu

SEQ ID NO: 2398124 - RNA, 15 nt, Human immunodeficiency virus 1 [HIV-1]
gccaugcauggacaa

SEQ ID NO: 2398125 - RNA, 14 nt, Human immunodeficiency virus 1 [HIV-1]
agacuuaauagcag

SEQ ID NO: 2398126 - RNA, 23 nt, Human immunodeficiency virus 1 [HIV-1]
gcaaucacaaguagcaauacagc

SEQ ID NO: 2398127 - RNA, 14 nt, Human immunodeficiency virus 1 [HIV-1]
ggccaauggacaua

SEQ ID NO: 2398128 - RNA, 23 nt, Human immunodeficiency virus 1 [HIV-1]
gaagcagaaguuauuccagcaga

SEQ ID NO: 2398129 - RNA, 15 nt, Human immunodeficiency virus 1 [HIV-1]
ggcccgagagcugca

SEQ ID NO: 2398130 - RNA, 16 nt, Human immunodeficiency virus 1 [HIV-1]
cacuaugggcgcagcc

SEQ ID NO: 2398131 - RNA, 13 nt, Human immunodeficiency virus 1 [HIV-1]
ccaguugagccag

SEQ ID NO: 2398132 - RNA, 13 nt, Human immunodeficiency virus 1 [HIV-1]
aaaggaagggaaa

SEQ ID NO: 2398133 - RNA, 23 nt, Human immunodeficiency virus 1 [HIV-1]
gcauuucaucacguggcccgaga

SEQ ID NO: 2398134 - RNA, 21 nt, Human immunodeficiency virus 1 [HIV-1]
agccugcaugggauggaugac

SEQ ID NO: 2398135 - RNA, 20 nt, Human immunodeficiency virus 1 [HIV-1]
uacccagggauuaaaguaag

SEQ ID NO: 2398136 - RNA, 15 nt, Human immunodeficiency virus 1 [HIV-1]
agaaauuaacaauua

SEQ ID NO: 2398137 - RNA, 16 nt, Human immunodeficiency virus 1 [HIV-1]
uaguagcaaaagaaau

SEQ ID NO: 2398138 - RNA, 20 nt, Human immunodeficiency virus 1 [HIV-1]
caauaguaguagcgggagaa

SEQ ID NO: 2398139 - RNA, 16 nt, Human immunodeficiency virus 1 [HIV-1]
gcaauaauaauagcaa

SEQ ID NO: 2398140 - RNA, 13 nt, Human immunodeficiency virus 1 [HIV-1]
acacccugugagc

SEQ ID NO: 2398141 - RNA, 14 nt, Human immunodeficiency virus 1 [HIV-1]
aaaguaagacagua

SEQ ID NO: 2398142 - RNA, 19 nt, Human immunodeficiency virus 1 [HIV-1]
ugaacaucuuaagacagca

SEQ ID NO: 2398143 - RNA, 16 nt, Human immunodeficiency virus 1 [HIV-1]
aaauuaagagaacaau

SEQ ID NO: 2398144 - RNA, 20 nt, Human immunodeficiency virus 1 [HIV-1]
ucguuucagacccaccuccc

SEQ ID NO: 2398145 - RNA, 16 nt, Human immunodeficiency virus 1 [HIV-1]
uggaagcauccaggaa

SEQ ID NO: 2398146 - RNA, 13 nt, Human immunodeficiency virus 1 [HIV-1]
agacaagcacauu

SEQ ID NO: 2398147 - RNA, 21 nt, Human immunodeficiency virus 1 [HIV-1]
caaaagacuuaauagcagaaa

SEQ ID NO: 2398148 - RNA, 17 nt, Human immunodeficiency virus 1 [HIV-1]
aguacaaggagcuugua

SEQ ID NO: 2398149 - RNA, 13 nt, Human immunodeficiency virus 1 [HIV-1]
ggcgcagccucaa

SEQ ID NO: 2398150 - RNA, 16 nt, Human immunodeficiency virus 1 [HIV-1]
aucagaugcuaaagca

SEQ ID NO: 2398151 - RNA, 19 nt, Human immunodeficiency virus 1 [HIV-1]
cuguagugcuacagaaaaa

SEQ ID NO: 2398152 - RNA, 15 nt, Human immunodeficiency virus 1 [HIV-1]
uaauagcaacaauga

SEQ ID NO: 2398153 - RNA, 23 nt, Human immunodeficiency virus 1 [HIV-1]
acuaaauggagaaaauuaguaga

SEQ ID NO: 2398154 - RNA, 12 nt, Human immunodeficiency virus 1 [HIV-1]
aaacaauacaua

SEQ ID NO: 2398155 - RNA, 16 nt, Human immunodeficiency virus 1 [HIV-1]
aacaccaaaaaagaua

SEQ ID NO: 2398156 - RNA, 20 nt, Human immunodeficiency virus 1 [HIV-1]
gaaauaugagacaagcacau

SEQ ID NO: 2398157 - RNA, 21 nt, Human immunodeficiency virus 1 [HIV-1]
agcaauacagcagcuaccaau

SEQ ID NO: 2398158 - RNA, 16 nt, Human immunodeficiency virus 1 [HIV-1]
auacagcagcuaccaa

SEQ ID NO: 2398159 - RNA, 15 nt, Human immunodeficiency virus 1 [HIV-1]
aaggaucaacagcuc

SEQ ID NO: 2398160 - RNA, 23 nt, Human immunodeficiency virus 1 [HIV-1]
ugauacuaccagcuauaaguuga

SEQ ID NO: 2398161 - RNA, 16 nt, Human immunodeficiency virus 1 [HIV-1]
uggacauaucaaauuu

SEQ ID NO: 2398162 - RNA, 21 nt, Human immunodeficiency virus 1 [HIV-1]
gaggagauaugagggacaauu

SEQ ID NO: 2398163 - RNA, 14 nt, Human immunodeficiency virus 1 [HIV-1]
gaggauuguggaac

SEQ ID NO: 2398164 - RNA, 19 nt, Human immunodeficiency virus 1 [HIV-1]
ucugcggagccugugccuc

SEQ ID NO: 2398165 - RNA, 16 nt, Human immunodeficiency virus 1 [HIV-1]
agagguaaggugcaga

SEQ ID NO: 2398166 - RNA, 16 nt, Human immunodeficiency virus 1 [HIV-1]
gcacccaccaaggcaa

SEQ ID NO: 2398167 - RNA, 15 nt, Human immunodeficiency virus 1 [HIV-1]
cuccauagaauggag

SEQ ID NO: 2398168 - RNA, 22 nt, Human immunodeficiency virus 1 [HIV-1]
guuagaccagaucugagccugg

SEQ ID NO: 2398169 - RNA, 16 nt, Human immunodeficiency virus 1 [HIV-1]
agacauacaaacuaaa

SEQ ID NO: 2398170 - RNA, 14 nt, Human immunodeficiency virus 1 [HIV-1]
uaguauaaacaaug

SEQ ID NO: 2398171 - RNA, 15 nt, Human immunodeficiency virus 1 [HIV-1]
augagacaccaggga

SEQ ID NO: 2398172 - RNA, 17 nt, Human immunodeficiency virus 1 [HIV-1]
gcgcagccucaaugacg

SEQ ID NO: 2398173 - RNA, 14 nt, Human immunodeficiency virus 1 [HIV-1]
agauccugcauaua

SEQ ID NO: 2398174 - RNA, 16 nt, Human immunodeficiency virus 1 [HIV-1]
aucaaauaauagagca

SEQ ID NO: 2398175 - RNA, 16 nt, Human immunodeficiency virus 1 [HIV-1]
gcaucaagcagcucca

SEQ ID NO: 2398176 - RNA, 17 nt, Human immunodeficiency virus 1 [HIV-1]
aggccagacaauuauug

SEQ ID NO: 2398177 - RNA, 14 nt, Human immunodeficiency virus 1 [HIV-1]
caguuagagaaaga

SEQ ID NO: 2398178 - RNA, 13 nt, Human immunodeficiency virus 1 [HIV-1]
auguggaaaaaug

SEQ ID NO: 2398179 - RNA, 12 nt, Human immunodeficiency virus 1 [HIV-1]
aagcagcugcuu

SEQ ID NO: 2398180 - RNA, 16 nt, Human immunodeficiency virus 1 [HIV-1]
ugaacaagaauuauug

SEQ ID NO: 2398181 - RNA, 22 nt, Human immunodeficiency virus 1 [HIV-1]
cacacuaaugauguaaaacaau

SEQ ID NO: 2398182 - RNA, 15 nt, Human immunodeficiency virus 1 [HIV-1]
cagaagacaguggca

SEQ ID NO: 2398183 - RNA, 14 nt, Human immunodeficiency virus 1 [HIV-1]
caagaauuauugga

SEQ ID NO: 2398184 - RNA, 21 nt, Human immunodeficiency virus 1 [HIV-1]
ugacaaguuguaacaccucag

SEQ ID NO: 2398185 - RNA, 18 nt, Human immunodeficiency virus 1 [HIV-1]
aauagacagguuaauuga

SEQ ID NO: 2398186 - RNA, 17 nt, Human immunodeficiency virus 1 [HIV-1]
ggagugggacagagaaa

SEQ ID NO: 2398187 - RNA, 14 nt, Human immunodeficiency virus 1 [HIV-1]
caguugagccagau

SEQ ID NO: 2398188 - RNA, 23 nt, Human immunodeficiency virus 1 [HIV-1]
aucgcaaaaccagcaagaaaaga

SEQ ID NO: 2398189 - RNA, 13 nt, Human immunodeficiency virus 1 [HIV-1]
auagaagcagaag

SEQ ID NO: 2398190 - RNA, 14 nt, Human immunodeficiency virus 1 [HIV-1]
cagaaacagggcag

SEQ ID NO: 2398191 - RNA, 13 nt, Human immunodeficiency virus 1 [HIV-1]
aacuaaagaauag

SEQ ID NO: 2398192 - RNA, 12 nt, Human immunodeficiency virus 1 [HIV-1]
cgagaccuggaa

SEQ ID NO: 2398193 - RNA, 19 nt, Human immunodeficiency virus 1 [HIV-1]
agcaagaaauggagccagu

SEQ ID NO: 2398194 - RNA, 18 nt, Human immunodeficiency virus 1 [HIV-1]
uucugcaacaacugcugu

SEQ ID NO: 2398195 - RNA, 22 nt, Human immunodeficiency virus 1 [HIV-1]
guacaaggagcuuguagagcua

SEQ ID NO: 2398196 - RNA, 13 nt, Human immunodeficiency virus 1 [HIV-1]
gaucugagccugg

SEQ ID NO: 2398197 - RNA, 19 nt, Human immunodeficiency virus 1 [HIV-1]
gaccagaucugagccuggg

SEQ ID NO: 2398198 - RNA, 16 nt, Human immunodeficiency virus 1 [HIV-1]
agcaaauuaagagaac

SEQ ID NO: 2398199 - RNA, 20 nt, Human immunodeficiency virus 1 [HIV-1]
gauccugcauauaagcagcu

SEQ ID NO: 2398200 - RNA, 22 nt, Human immunodeficiency virus 1 [HIV-1]
auuaagacaaagaaaaauagac

SEQ ID NO: 2398201 - RNA, 18 nt, Human immunodeficiency virus 1 [HIV-1]
cagggaaagcuaggggau

SEQ ID NO: 2398202 - RNA, 15 nt, Human immunodeficiency virus 1 [HIV-1]
gauauccacugaccu

SEQ ID NO: 2398203 - RNA, 14 nt, Human immunodeficiency virus 1 [HIV-1]
uggcccgagagcug

SEQ ID NO: 2398204 - RNA, 14 nt, Human immunodeficiency virus 1 [HIV-1]
ggagagaacaccag

SEQ ID NO: 2398205 - RNA, 16 nt, Human immunodeficiency virus 1 [HIV-1]
cugagccagcagcaga

SEQ ID NO: 2398206 - RNA, 17 nt, Human immunodeficiency virus 1 [HIV-1]
aagacaagauauccuug

SEQ ID NO: 2398207 - RNA, 18 nt, Human immunodeficiency virus 1 [HIV-1]
auugggugucgacauagc

SEQ ID NO: 2398208 - RNA, 22 nt, Human immunodeficiency virus 1 [HIV-1]
acacgaccuggauggaguggga

SEQ ID NO: 2398209 - RNA, 16 nt, Human immunodeficiency virus 1 [HIV-1]
agacccaacaacaaua

SEQ ID NO: 2398210 - RNA, 14 nt, Human immunodeficiency virus 1 [HIV-1]
accgcuugagagac

SEQ ID NO: 2398211 - RNA, 19 nt, Human immunodeficiency virus 1 [HIV-1]
uguaacauuaguagagcaa

SEQ ID NO: 2398212 - RNA, 21 nt, Human immunodeficiency virus 1 [HIV-1]
gguuuuccagucacaccucag

SEQ ID NO: 2398213 - RNA, 19 nt, Human immunodeficiency virus 1 [HIV-1]
acgagcugagccagcagca

SEQ ID NO: 2398214 - RNA, 13 nt, Human immunodeficiency virus 1 [HIV-1]
aaagcuugccuug

SEQ ID NO: 2398215 - RNA, 22 nt, Human immunodeficiency virus 1 [HIV-1]
augaggauuagaacauggaaaa

SEQ ID NO: 2398216 - RNA, 16 nt, Human immunodeficiency virus 1 [HIV-1]
gaaagagcagaagaca

SEQ ID NO: 2398217 - RNA, 14 nt, Human immunodeficiency virus 1 [HIV-1]
agggauggaaagga

SEQ ID NO: 2398218 - RNA, 17 nt, Human immunodeficiency virus 1 [HIV-1]
ugagacgagcugagcca

SEQ ID NO: 2398219 - RNA, 14 nt, Human immunodeficiency virus 1 [HIV-1]
acauagcagaauag

SEQ ID NO: 2398220 - RNA, 13 nt, Human immunodeficiency virus 1 [HIV-1]
cugcuauaagaaa

SEQ ID NO: 2398221 - RNA, 21 nt, Human immunodeficiency virus 1 [HIV-1]
ggaguacuucaagaacugcug

SEQ ID NO: 2398222 - RNA, 16 nt, Human immunodeficiency virus 1 [HIV-1]
agcagaugauacagua

SEQ ID NO: 2398223 - RNA, 20 nt, Human immunodeficiency virus 1 [HIV-1]
uacagcagcuaccaaugcug

SEQ ID NO: 2398224 - RNA, 13 nt, Human immunodeficiency virus 1 [HIV-1]
aaagaaaaaagac

SEQ ID NO: 2398225 - RNA, 17 nt, Human immunodeficiency virus 1 [HIV-1]
agccugcaugggaugga

SEQ ID NO: 2398226 - RNA, 22 nt, Human immunodeficiency virus 1 [HIV-1]
cagggagucuccauagaaugga

SEQ ID NO: 2398227 - RNA, 16 nt, Human immunodeficiency virus 1 [HIV-1]
aaacugcuuguaccaa

SEQ ID NO: 2398228 - RNA, 15 nt, Human immunodeficiency virus 1 [HIV-1]
gagagaacaccagcu

SEQ ID NO: 2398229 - RNA, 23 nt, Human immunodeficiency virus 1 [HIV-1]
acaaauuauaaacauguggcaga

SEQ ID NO: 2398230 - RNA, 17 nt, Human immunodeficiency virus 1 [HIV-1]
agaccagaucugagccu

SEQ ID NO: 2398231 - RNA, 15 nt, Human immunodeficiency virus 1 [HIV-1]
gaacaauuuggaaau

SEQ ID NO: 2398232 - RNA, 18 nt, Human immunodeficiency virus 1 [HIV-1]
caccaaggcaaagagaag

SEQ ID NO: 2398233 - RNA, 17 nt, Human immunodeficiency virus 1 [HIV-1]
gccaagaagaaaagcaa

SEQ ID NO: 2398234 - RNA, 13 nt, Human immunodeficiency virus 1 [HIV-1]
gacagguaagaga

SEQ ID NO: 2398235 - RNA, 14 nt, Human immunodeficiency virus 1 [HIV-1]
ugccaccuguagua

SEQ ID NO: 2398236 - RNA, 15 nt, Human immunodeficiency virus 1 [HIV-1]
uagaagaggccaaua

SEQ ID NO: 2398237 - RNA, 16 nt, Human immunodeficiency virus 1 [HIV-1]
cccucagauccugcau

SEQ ID NO: 2398238 - RNA, 21 nt, Human immunodeficiency virus 1 [HIV-1]
gggcgggaaucaagcaggaau

SEQ ID NO: 2398239 - RNA, 23 nt, Human immunodeficiency virus 1 [HIV-1]
cacaaguagcaauacagcagcua

SEQ ID NO: 2398240 - RNA, 22 nt, Human immunodeficiency virus 1 [HIV-1]
gauccuuggcacuuaucuggga

SEQ ID NO: 2398241 - RNA, 17 nt, Human immunodeficiency virus 1 [HIV-1]
agacgagcugagccagc

SEQ ID NO: 2398242 - RNA, 18 nt, Human immunodeficiency virus 1 [HIV-1]
aucuccuauggcaggaag

SEQ ID NO: 2398243 - RNA, 12 nt, Human immunodeficiency virus 1 [HIV-1]
accaguugagcc

SEQ ID NO: 2398244 - RNA, 17 nt, Human immunodeficiency virus 1 [HIV-1]
acucgacagaggagagc

SEQ ID NO: 2398245 - RNA, 18 nt, Human immunodeficiency virus 1 [HIV-1]
cuguaguagcaaaagaaa

SEQ ID NO: 2398246 - RNA, 22 nt, Human immunodeficiency virus 1 [HIV-1]
ccuggaaaaacauggagcaauc

SEQ ID NO: 2398247 - RNA, 17 nt, Human immunodeficiency virus 1 [HIV-1]
cacacgaccuggaugga

SEQ ID NO: 2398248 - RNA, 17 nt, Human immunodeficiency virus 1 [HIV-1]
cguggcccgagagcugc

SEQ ID NO: 2398249 - RNA, 17 nt, Human immunodeficiency virus 1 [HIV-1]
auuacagggacagcaga

SEQ ID NO: 2398250 - RNA, 15 nt, Human immunodeficiency virus 1 [HIV-1]
caguugagccagaua

SEQ ID NO: 2398251 - RNA, 17 nt, Human immunodeficiency virus 1 [HIV-1]
gggaggcguggccuggg

SEQ ID NO: 2398252 - RNA, 14 nt, Human immunodeficiency virus 1 [HIV-1]
ggcuguggaaagau

SEQ ID NO: 2398253 - RNA, 16 nt, Human immunodeficiency virus 1 [HIV-1]
acuacacaccagggcc

SEQ ID NO: 2398254 - RNA, 19 nt, Human immunodeficiency virus 1 [HIV-1]
acgaucugcggagccugug

SEQ ID NO: 2398255 - RNA, 13 nt, Human immunodeficiency virus 1 [HIV-1]
gcauuuguuacaa

SEQ ID NO: 2398256 - RNA, 13 nt, Human immunodeficiency virus 1 [HIV-1]
uuaagacaaagaa

SEQ ID NO: 2398257 - RNA, 17 nt, Human immunodeficiency virus 1 [HIV-1]
uacaaaugucagcacag

SEQ ID NO: 2398258 - RNA, 17 nt, Human immunodeficiency virus 1 [HIV-1]
cuggggacuuuccaggg

SEQ ID NO: 2398259 - RNA, 16 nt, Human immunodeficiency virus 1 [HIV-1]
uggaggaaaaagagau

SEQ ID NO: 2398260 - RNA, 19 nt, Human immunodeficiency virus 1 [HIV-1]
acuuucuauagugaauaga

SEQ ID NO: 2398261 - RNA, 15 nt, Human immunodeficiency virus 1 [HIV-1]
agaagaagagguagu

SEQ ID NO: 2398262 - RNA, 16 nt, Human immunodeficiency virus 1 [HIV-1]
ugccuggcuagaagca

SEQ ID NO: 2398263 - RNA, 19 nt, Human immunodeficiency virus 1 [HIV-1]
cuagaacuggcagaaaaca

SEQ ID NO: 2398264 - RNA, 16 nt, Human immunodeficiency virus 1 [HIV-1]
gacuuuccgcugggga

SEQ ID NO: 2398265 - RNA, 23 nt, Human immunodeficiency virus 1 [HIV-1]
auaaaugucagcuaaaaggagaa

SEQ ID NO: 2398266 - RNA, 22 nt, Human immunodeficiency virus 1 [HIV-1]
gggcaguaguaauacaagauaa

SEQ ID NO: 2398267 - RNA, 12 nt, Human immunodeficiency virus 1 [HIV-1]
gcacauuguaac

SEQ ID NO: 2398268 - RNA, 15 nt, Human immunodeficiency virus 1 [HIV-1]
uguuagcuugcucaa

SEQ ID NO: 2398269 - RNA, 23 nt, Human immunodeficiency virus 1 [HIV-1]
acuguuuaauaguacuugguuua

SEQ ID NO: 2398270 - RNA, 14 nt, Human immunodeficiency virus 1 [HIV-1]
ugcuuaagccucaa

SEQ ID NO: 2398271 - RNA, 21 nt, Human immunodeficiency virus 1 [HIV-1]
aauuaagagaacaauuuggaa

SEQ ID NO: 2398272 - RNA, 23 nt, Human immunodeficiency virus 1 [HIV-1]
agauagaagaggccaauaaagga

SEQ ID NO: 2398273 - RNA, 16 nt, Human immunodeficiency virus 1 [HIV-1]
gcgggaaucaagcagg

SEQ ID NO: 2398274 - RNA, 15 nt, Human immunodeficiency virus 1 [HIV-1]
aaacagggcaggaaa

SEQ ID NO: 2398275 - RNA, 17 nt, Human immunodeficiency virus 1 [HIV-1]
cuaaagaauuacaaaaa

SEQ ID NO: 2398276 - RNA, 24 nt, Human immunodeficiency virus 1 [HIV-1]
acaaauuauaaacauguggcagaa

SEQ ID NO: 2398277 - RNA, 20 nt, Human immunodeficiency virus 1 [HIV-1]
agggacuuuccgcuggggac

SEQ ID NO: 2398278 - RNA, 15 nt, Human immunodeficiency virus 1 [HIV-1]
auaaagaaaaaagac

SEQ ID NO: 2398279 - RNA, 21 nt, Human immunodeficiency virus 1 [HIV-1]
auggcagucuagcagaagaag

SEQ ID NO: 2398280 - RNA, 13 nt, Human immunodeficiency virus 1 [HIV-1]
aacagauuuggaa

SEQ ID NO: 2398281 - RNA, 18 nt, Human immunodeficiency virus 1 [HIV-1]
auaaagaauuaaagaaaa

SEQ ID NO: 2398282 - RNA, 13 nt, Human immunodeficiency virus 1 [HIV-1]
caaguagacagga

SEQ ID NO: 2398283 - RNA, 18 nt, Human immunodeficiency virus 1 [HIV-1]
agcaagaaauggagccag

SEQ ID NO: 2398284 - RNA, 16 nt, Human immunodeficiency virus 1 [HIV-1]
agauccuagacuagag

SEQ ID NO: 2398285 - RNA, 12 nt, Human immunodeficiency virus 1 [HIV-1]
caugacaaaaau

SEQ ID NO: 2398286 - RNA, 18 nt, Human immunodeficiency virus 1 [HIV-1]
aggccaauaaaggagaga

SEQ ID NO: 2398287 - RNA, 11 nt, Human immunodeficiency virus 1 [HIV-1]
uagaaggaaaa

SEQ ID NO: 2398288 - RNA, 13 nt, Human immunodeficiency virus 1 [HIV-1]
gguugcucuggaa

SEQ ID NO: 2398289 - RNA, 16 nt, Human immunodeficiency virus 1 [HIV-1]
guucuugggagcagca

SEQ ID NO: 2398290 - RNA, 20 nt, Human immunodeficiency virus 1 [HIV-1]
gacuuacucuugauuguaac

SEQ ID NO: 2398291 - RNA, 14 nt, Human immunodeficiency virus 1 [HIV-1]
ucuaaaagaaccag

SEQ ID NO: 2398292 - RNA, 18 nt, Human immunodeficiency virus 1 [HIV-1]
aguaaucauagaauauag

SEQ ID NO: 2398293 - RNA, 13 nt, Human immunodeficiency virus 1 [HIV-1]
gaaauggagccag

SEQ ID NO: 2398294 - RNA, 18 nt, Human immunodeficiency virus 1 [HIV-1]
agauggggcagcuaacag

SEQ ID NO: 2398295 - RNA, 20 nt, Human immunodeficiency virus 1 [HIV-1]
gagcagcaucucgagaccug

SEQ ID NO: 2398296 - RNA, 20 nt, Human immunodeficiency virus 1 [HIV-1]
ccacugcuuaagccucaaua

SEQ ID NO: 2398297 - RNA, 13 nt, Human immunodeficiency virus 1 [HIV-1]
gcgagcccucaga

SEQ ID NO: 2398298 - RNA, 22 nt, Human immunodeficiency virus 1 [HIV-1]
uguuucauaacaaaagccuuag

SEQ ID NO: 2398299 - RNA, 18 nt, Human immunodeficiency virus 1 [HIV-1]
acacccugugagccugca

SEQ ID NO: 2398300 - RNA, 18 nt, Human immunodeficiency virus 1 [HIV-1]
gaaaaguuuaguaaaaca

SEQ ID NO: 2398301 - RNA, 13 nt, Human immunodeficiency virus 1 [HIV-1]
aacaacugcuguu

SEQ ID NO: 2398302 - RNA, 14 nt, Human immunodeficiency virus 1 [HIV-1]
uaacagaagaagca

SEQ ID NO: 2398303 - RNA, 20 nt, Human immunodeficiency virus 1 [HIV-1]
caaaaccagcaagaaaagaa

SEQ ID NO: 2398304 - RNA, 17 nt, Human immunodeficiency virus 1 [HIV-1]
cuuaagccucaauaaag

SEQ ID NO: 2398305 - RNA, 14 nt, Human immunodeficiency virus 1 [HIV-1]
aacacugaaggaag

SEQ ID NO: 2398306 - RNA, 18 nt, Human immunodeficiency virus 1 [HIV-1]
uggcacuuaucugggacg

SEQ ID NO: 2398307 - RNA, 16 nt, Human immunodeficiency virus 1 [HIV-1]
cugaccuuuggauggu

SEQ ID NO: 2398308 - RNA, 19 nt, Human immunodeficiency virus 1 [HIV-1]
agguggagagagagacaga

SEQ ID NO: 2398309 - RNA, 13 nt, Human immunodeficiency virus 1 [HIV-1]
cauuguaacauua

SEQ ID NO: 2398310 - RNA, 18 nt, Human immunodeficiency virus 1 [HIV-1]
aauugugggucacagucu

SEQ ID NO: 2398311 - RNA, 20 nt, Human immunodeficiency virus 1 [HIV-1]
agaaugagacgagcugagcc

SEQ ID NO: 2398312 - RNA, 19 nt, Human immunodeficiency virus 1 [HIV-1]
guggauauauagaagcaga

SEQ ID NO: 2398313 - RNA, 18 nt, Human immunodeficiency virus 1 [HIV-1]
uagcaaauuaagagaaca

SEQ ID NO: 2398314 - RNA, 20 nt, Human immunodeficiency virus 1 [HIV-1]
aacagacauacaaacuaaag

SEQ ID NO: 2398315 - RNA, 15 nt, Human immunodeficiency virus 1 [HIV-1]
uaccagcacacaaag

SEQ ID NO: 2398316 - RNA, 20 nt, Human immunodeficiency virus 1 [HIV-1]
caagcagcuccaggcaagaa

SEQ ID NO: 2398317 - RNA, 22 nt, Human immunodeficiency virus 1 [HIV-1]
ugagacaagcacauuguaacau

SEQ ID NO: 2398318 - RNA, 13 nt, Human immunodeficiency virus 1 [HIV-1]
uagaucuuagcca

SEQ ID NO: 2398319 - RNA, 20 nt, Human immunodeficiency virus 1 [HIV-1]
guagacauaauagcaacaga

SEQ ID NO: 2398320 - RNA, 22 nt, Human immunodeficiency virus 1 [HIV-1]
acacaaguagacccugaacuag

SEQ ID NO: 2398321 - RNA, 17 nt, Human immunodeficiency virus 1 [HIV-1]
aaagaaaaaagacagua

SEQ ID NO: 2398322 - RNA, 14 nt, Human immunodeficiency virus 1 [HIV-1]
caccagcuuguuac

SEQ ID NO: 2398323 - RNA, 21 nt, Human immunodeficiency virus 1 [HIV-1]
gaucugcggagccugugccuc

SEQ ID NO: 2398324 - RNA, 10 nt, Human immunodeficiency virus 1 [HIV-1]
gacuggggag

SEQ ID NO: 2398325 - RNA, 15 nt, Human immunodeficiency virus 1 [HIV-1]
ggaggaggagguggg

SEQ ID NO: 2398326 - RNA, 20 nt, Human immunodeficiency virus 1 [HIV-1]
auuugggguugcucuggaaa

SEQ ID NO: 2398327 - RNA, 11 nt, Human immunodeficiency virus 1 [HIV-1]
aucaaaguaag

SEQ ID NO: 2398328 - RNA, 17 nt, Human immunodeficiency virus 1 [HIV-1]
gcagaagacaguggcaa

SEQ ID NO: 2398329 - RNA, 23 nt, Human immunodeficiency virus 1 [HIV-1]
uccaagaauaaguucagaaguac

SEQ ID NO: 2398330 - RNA, 24 nt, Human immunodeficiency virus 1 [HIV-1]
cgccuagcauuucaucacguggcc

SEQ ID NO: 2398331 - RNA, 15 nt, Human immunodeficiency virus 1 [HIV-1]
cagggacagcagaaa

SEQ ID NO: 2398332 - RNA, 14 nt, Human immunodeficiency virus 1 [HIV-1]
aaggaccagcaaag

SEQ ID NO: 2398333 - RNA, 19 nt, Human immunodeficiency virus 1 [HIV-1]
acaggccagacaauuauug

SEQ ID NO: 2398334 - RNA, 16 nt, Human immunodeficiency virus 1 [HIV-1]
gauaauggagaaagga

SEQ ID NO: 2398335 - RNA, 17 nt, Human immunodeficiency virus 1 [HIV-1]
caaauuauaaacaugug

SEQ ID NO: 2398336 - RNA, 14 nt, Human immunodeficiency virus 1 [HIV-1]
gcuuguagagcuau

SEQ ID NO: 2398337 - RNA, 17 nt, Human immunodeficiency virus 1 [HIV-1]
aauagcagaaauacaga

SEQ ID NO: 2398338 - RNA, 16 nt, Human immunodeficiency virus 1 [HIV-1]
ccugugagccugcaug

SEQ ID NO: 2398339 - RNA, 17 nt, Human immunodeficiency virus 1 [HIV-1]
acuaaauggagaaaauu

SEQ ID NO: 2398340 - RNA, 18 nt, Human immunodeficiency virus 1 [HIV-1]
ucuuuaagcaauccucag

SEQ ID NO: 2398341 - RNA, 13 nt, Human immunodeficiency virus 1 [HIV-1]
gagcagcaggaag

SEQ ID NO: 2398342 - RNA, 17 nt, Human immunodeficiency virus 1 [HIV-1]
gcacaguacaauguaca

SEQ ID NO: 2398343 - RNA, 17 nt, Human immunodeficiency virus 1 [HIV-1]
acagauccauucgauua

SEQ ID NO: 2398344 - RNA, 16 nt, Human immunodeficiency virus 1 [HIV-1]
gggugggagcagcauc

SEQ ID NO: 2398345 - RNA, 22 nt, Human immunodeficiency virus 1 [HIV-1]
auggguaccagcacacaaagga

SEQ ID NO: 2398346 - RNA, 22 nt, Human immunodeficiency virus 1 [HIV-1]
agaccagaucugagccugggag

SEQ ID NO: 2398347 - RNA, 13 nt, Human immunodeficiency virus 1 [HIV-1]
caucaagcagcuc

SEQ ID NO: 2398348 - RNA, 20 nt, Human immunodeficiency virus 1 [HIV-1]
agaaguguuagaguggaggu

SEQ ID NO: 2398349 - RNA, 19 nt, Human immunodeficiency virus 1 [HIV-1]
ccugggcgggacuggggag

SEQ ID NO: 2398350 - RNA, 15 nt, Human immunodeficiency virus 1 [HIV-1]
agagaacaccagcuu

SEQ ID NO: 2398351 - RNA, 14 nt, Human immunodeficiency virus 1 [HIV-1]
gcagcagcagaaca

SEQ ID NO: 2398352 - RNA, 16 nt, Human immunodeficiency virus 1 [HIV-1]
agagaggaccagggag

SEQ ID NO: 2398353 - RNA, 18 nt, Human immunodeficiency virus 1 [HIV-1]
ucaaagcaguaaguagua

SEQ ID NO: 2398354 - RNA, 17 nt, Human immunodeficiency virus 1 [HIV-1]
gcacuuaucugggacga

SEQ ID NO: 2398355 - RNA, 21 nt, Human immunodeficiency virus 1 [HIV-1]
auaagacagggcuuggaaagg

SEQ ID NO: 2398356 - RNA, 22 nt, Human immunodeficiency virus 1 [HIV-1]
ccagcuuguuacacccugugag

SEQ ID NO: 2398357 - RNA, 13 nt, Human immunodeficiency virus 1 [HIV-1]
aaaaagagcagug

SEQ ID NO: 2398358 - RNA, 15 nt, Human immunodeficiency virus 1 [HIV-1]
agagcaagaaaugga

SEQ ID NO: 2398359 - RNA, 22 nt, Human immunodeficiency virus 1 [HIV-1]
gggacgaucugcggagccugug

SEQ ID NO: 2398360 - RNA, 16 nt, Human immunodeficiency virus 1 [HIV-1]
auuugccauaaagaaa

SEQ ID NO: 2398361 - RNA, 17 nt, Human immunodeficiency virus 1 [HIV-1]
gcugcuugugccuggcu

SEQ ID NO: 2398362 - RNA, 13 nt, Human immunodeficiency virus 1 [HIV-1]
uacaauaggaaaa

SEQ ID NO: 2398363 - RNA, 20 nt, Human immunodeficiency virus 1 [HIV-1]
gccucaauaaagcuugccuu

SEQ ID NO: 2398364 - RNA, 15 nt, Human immunodeficiency virus 1 [HIV-1]
cuaaagccaugugua

SEQ ID NO: 2398365 - RNA, 16 nt, Human immunodeficiency virus 1 [HIV-1]
gaaaagcaaagaucau

SEQ ID NO: 2398366 - RNA, 21 nt, Human immunodeficiency virus 1 [HIV-1]
gguggagagagagacagagac

SEQ ID NO: 2398367 - RNA, 21 nt, Human immunodeficiency virus 1 [HIV-1]
agacgagcugagccagcagca

SEQ ID NO: 2398368 - RNA, 18 nt, Human immunodeficiency virus 1 [HIV-1]
uaagagaacaauuuggaa

SEQ ID NO: 2398369 - RNA, 19 nt, Human immunodeficiency virus 1 [HIV-1]
auggagugggacagagaaa

SEQ ID NO: 2398370 - RNA, 15 nt, Human immunodeficiency virus 1 [HIV-1]
cuaacugacacaaca

SEQ ID NO: 2398371 - RNA, 14 nt, Human immunodeficiency virus 1 [HIV-1]
agaaagagcagaag

SEQ ID NO: 2398372 - RNA, 18 nt, Human immunodeficiency virus 1 [HIV-1]
ugacaugguagaacagau

SEQ ID NO: 2398373 - RNA, 18 nt, Human immunodeficiency virus 1 [HIV-1]
ccacugcuuaagccucaa

SEQ ID NO: 2398374 - RNA, 16 nt, Human immunodeficiency virus 1 [HIV-1]
aggcguggccugggcg

SEQ ID NO: 2398375 - RNA, 17 nt, Human immunodeficiency virus 1 [HIV-1]
cacaaucacccucccau

SEQ ID NO: 2398376 - RNA, 14 nt, Human immunodeficiency virus 1 [HIV-1]
gagagagacagaga

SEQ ID NO: 2398377 - RNA, 13 nt, Human immunodeficiency virus 1 [HIV-1]
ccugugagccugc

SEQ ID NO: 2398378 - RNA, 15 nt, Human immunodeficiency virus 1 [HIV-1]
guacaguauuaguag

SEQ ID NO: 2398379 - RNA, 14 nt, Human immunodeficiency virus 1 [HIV-1]
gcaccacugcugug

SEQ ID NO: 2398380 - RNA, 17 nt, Human immunodeficiency virus 1 [HIV-1]
ccaggggucagauaucc

SEQ ID NO: 2398381 - RNA, 14 nt, Human immunodeficiency virus 1 [HIV-1]
aggccaauaaagga

SEQ ID NO: 2398382 - RNA, 16 nt, Human immunodeficiency virus 1 [HIV-1]
acaguacaauguacac

SEQ ID NO: 2398383 - RNA, 12 nt, Human immunodeficiency virus 1 [HIV-1]
ucacccucccau

SEQ ID NO: 2398384 - RNA, 15 nt, Human immunodeficiency virus 1 [HIV-1]
gagcauuuguuacaa

SEQ ID NO: 2398385 - RNA, 19 nt, Human immunodeficiency virus 1 [HIV-1]
gacuuaauagcagaaauac

SEQ ID NO: 2398386 - RNA, 20 nt, Human immunodeficiency virus 1 [HIV-1]
auaaacuugauauaauacca

SEQ ID NO: 2398387 - RNA, 14 nt, Human immunodeficiency virus 1 [HIV-1]
caauacagcagcua

SEQ ID NO: 2398388 - RNA, 18 nt, Human immunodeficiency virus 1 [HIV-1]
ccaaagcacuaacagaag

SEQ ID NO: 2398389 - RNA, 13 nt, Human immunodeficiency virus 1 [HIV-1]
gcaccacugcugu

SEQ ID NO: 2398390 - RNA, 21 nt, Human immunodeficiency virus 1 [HIV-1]
cuuaccacaccagacaaaaaa

SEQ ID NO: 2398391 - RNA, 14 nt, Human immunodeficiency virus 1 [HIV-1]
acaugguagaacag

SEQ ID NO: 2398392 - RNA, 19 nt, Human immunodeficiency virus 1 [HIV-1]
acauuguaacauuaguaga

SEQ ID NO: 2398393 - RNA, 17 nt, Human immunodeficiency virus 1 [HIV-1]
aaaaagagcagugggaa

SEQ ID NO: 2398394 - RNA, 13 nt, Human immunodeficiency virus 1 [HIV-1]
agcauccaggaag

SEQ ID NO: 2398395 - RNA, 18 nt, Human immunodeficiency virus 1 [HIV-1]
gcccucagauccugcaua

SEQ ID NO: 2398396 - RNA, 20 nt, Human immunodeficiency virus 1 [HIV-1]
ggggcaucaagcagcuccag

SEQ ID NO: 2398397 - RNA, 13 nt, Human immunodeficiency virus 1 [HIV-1]
ggaaaagcaggau

SEQ ID NO: 2398398 - RNA, 17 nt, Human immunodeficiency virus 1 [HIV-1]
gauaaaaaacugcucuu

SEQ ID NO: 2398399 - RNA, 14 nt, Human immunodeficiency virus 1 [HIV-1]
ucaagcagcuccag

SEQ ID NO: 2398400 - RNA, 22 nt, Human immunodeficiency virus 1 [HIV-1]
gcuugcucaaugccacagccau

SEQ ID NO: 2398401 - RNA, 14 nt, Human immunodeficiency virus 1 [HIV-1]
aggguuauagaagu

SEQ ID NO: 2398402 - RNA, 22 nt, Human immunodeficiency virus 1 [HIV-1]
ucugcauacaggagaaagagac

SEQ ID NO: 2398403 - RNA, 17 nt, Human immunodeficiency virus 1 [HIV-1]
guuagaccagaucugag

SEQ ID NO: 2398404 - RNA, 15 nt, Human immunodeficiency virus 1 [HIV-1]
acagccauagcagua

SEQ ID NO: 2398405 - RNA, 12 nt, Human immunodeficiency virus 1 [HIV-1]
uaacauguggaa

SEQ ID NO: 2398406 - RNA, 21 nt, Human immunodeficiency virus 1 [HIV-1]
aaaauaggaaauaugagacaa

SEQ ID NO: 2398407 - RNA, 18 nt, Human immunodeficiency virus 1 [HIV-1]
aguauugguaaaugugac

SEQ ID NO: 2398408 - RNA, 18 nt, Human immunodeficiency virus 1 [HIV-1]
uggcagaaaguaggaaaa

SEQ ID NO: 2398409 - RNA, 18 nt, Human immunodeficiency virus 1 [HIV-1]
ugauaauggagaaaggag

SEQ ID NO: 2398410 - RNA, 20 nt, Human immunodeficiency virus 1 [HIV-1]
gacaggaugaggauuagaac

SEQ ID NO: 2398411 - RNA, 22 nt, Human immunodeficiency virus 1 [HIV-1]
gacauaauagcaacagacauac

SEQ ID NO: 2398412 - RNA, 17 nt, Human immunodeficiency virus 1 [HIV-1]
uaaaaggagaagccaug

SEQ ID NO: 2398413 - RNA, 20 nt, Human immunodeficiency virus 1 [HIV-1]
uuguuacacccugugagccu

SEQ ID NO: 2398414 - RNA, 15 nt, Human immunodeficiency virus 1 [HIV-1]
accacuaacagaaga

SEQ ID NO: 2398415 - RNA, 21 nt, Human immunodeficiency virus 1 [HIV-1]
uccaaaguagcaugacaaaaa

SEQ ID NO: 2398416 - RNA, 23 nt, Human immunodeficiency virus 1 [HIV-1]
accagcuuguuacacccugugag

SEQ ID NO: 2398417 - RNA, 17 nt, Human immunodeficiency virus 1 [HIV-1]
cauaguaggagcagaaa

SEQ ID NO: 2398418 - RNA, 21 nt, Human immunodeficiency virus 1 [HIV-1]
caguauuugccauaaagaaaa

SEQ ID NO: 2398419 - RNA, 16 nt, Human immunodeficiency virus 1 [HIV-1]
aaagaaaaaaucagua

SEQ ID NO: 2398420 - RNA, 18 nt, Human immunodeficiency virus 1 [HIV-1]
agaaauuuguacagagau

SEQ ID NO: 2398421 - RNA, 15 nt, Human immunodeficiency virus 1 [HIV-1]
aaccagcaagaaaag

SEQ ID NO: 2398422 - RNA, 11 nt, Human immunodeficiency virus 1 [HIV-1]
auaagaaaggc

SEQ ID NO: 2398423 - RNA, 21 nt, Human immunodeficiency virus 1 [HIV-1]
cauaauuggaagaaaucuguu

SEQ ID NO: 2398424 - RNA, 23 nt, Human immunodeficiency virus 1 [HIV-1]
acugcuuaagccucaauaaagcu

SEQ ID NO: 2398425 - RNA, 17 nt, Human immunodeficiency virus 1 [HIV-1]
caucacguggcccgaga

SEQ ID NO: 2398426 - RNA, 11 nt, Human immunodeficiency virus 1 [HIV-1]
uuccagggagg

SEQ ID NO: 2398427 - RNA, 21 nt, Human immunodeficiency virus 1 [HIV-1]
ggugugaauaucaagcaggac

SEQ ID NO: 2398428 - RNA, 23 nt, Human immunodeficiency virus 1 [HIV-1]
ucagaagacugaguuacaagcaa

SEQ ID NO: 2398429 - RNA, 14 nt, Human immunodeficiency virus 1 [HIV-1]
cagaaauacagaag

SEQ ID NO: 2398430 - RNA, 15 nt, Human immunodeficiency virus 1 [HIV-1]
uaguaguagcaauaa

SEQ ID NO: 2398431 - RNA, 14 nt, Human immunodeficiency virus 1 [HIV-1]
cuacaguauuggag

SEQ ID NO: 2398432 - RNA, 19 nt, Human immunodeficiency virus 1 [HIV-1]
caggcccgaaggaauagaa

SEQ ID NO: 2398433 - RNA, 19 nt, Human immunodeficiency virus 1 [HIV-1]
gagcagcaggaagcacuau

SEQ ID NO: 2398434 - RNA, 12 nt, Human immunodeficiency virus 1 [HIV-1]
ugccccucccau

SEQ ID NO: 2398435 - RNA, 12 nt, Human immunodeficiency virus 1 [HIV-1]
agaaagcauagu

SEQ ID NO: 2398436 - RNA, 17 nt, Human immunodeficiency virus 1 [HIV-1]
ggagagagagacagaga

SEQ ID NO: 2398437 - RNA, 11 nt, Human immunodeficiency virus 1 [HIV-1]
cauagcagaau

SEQ ID NO: 2398438 - RNA, 17 nt, Human immunodeficiency virus 1 [HIV-1]
cucccaugcagaauaaa

SEQ ID NO: 2398439 - RNA, 18 nt, Human immunodeficiency virus 1 [HIV-1]
gacgaucugcggagccug

SEQ ID NO: 2398440 - RNA, 22 nt, Human immunodeficiency virus 1 [HIV-1]
ggaaaggugaaggggcaguagu

SEQ ID NO: 2398441 - RNA, 17 nt, Human immunodeficiency virus 1 [HIV-1]
cucucugguuagaccag

SEQ ID NO: 2398442 - RNA, 19 nt, Human immunodeficiency virus 1 [HIV-1]
auaccacuaacagaagaag

SEQ ID NO: 2398443 - RNA, 14 nt, Human immunodeficiency virus 1 [HIV-1]
aaaguaguaaaaau

SEQ ID NO: 2398444 - RNA, 16 nt, Human immunodeficiency virus 1 [HIV-1]
cagauaagauagaaga

SEQ ID NO: 2398445 - RNA, 19 nt, Human immunodeficiency virus 1 [HIV-1]
uacaguauuagaagaaaug

SEQ ID NO: 2398446 - RNA, 14 nt, Human immunodeficiency virus 1 [HIV-1]
aauuuuaacaugug

SEQ ID NO: 2398447 - RNA, 22 nt, Human immunodeficiency virus 1 [HIV-1]
accagaucugagccugggagcu

SEQ ID NO: 2398448 - RNA, 16 nt, Human immunodeficiency virus 1 [HIV-1]
auggagaaaggagaga

SEQ ID NO: 2398449 - RNA, 19 nt, Human immunodeficiency virus 1 [HIV-1]
guagacuguaguccaggaa

SEQ ID NO: 2398450 - RNA, 20 nt, Human immunodeficiency virus 1 [HIV-1]
guagacccugaacuagcaga

SEQ ID NO: 2398451 - RNA, 22 nt, Human immunodeficiency virus 1 [HIV-1]
ggaucuaccacacacaaggcua

SEQ ID NO: 2398452 - RNA, 16 nt, Human immunodeficiency virus 1 [HIV-1]
aauacuuggcacuagc

SEQ ID NO: 2398453 - RNA, 16 nt, Human immunodeficiency virus 1 [HIV-1]
uguagaucuuagccac

SEQ ID NO: 2398454 - RNA, 12 nt, Human immunodeficiency virus 1 [HIV-1]
ggacuuuccagg

SEQ ID NO: 2398455 - RNA, 17 nt, Human immunodeficiency virus 1 [HIV-1]
cacaccagacaaaaaac

SEQ ID NO: 2398456 - RNA, 22 nt, Human immunodeficiency virus 1 [HIV-1]
aaaaguagugugauuggauggc

SEQ ID NO: 2398457 - RNA, 16 nt, Human immunodeficiency virus 1 [HIV-1]
aagcauccaggaaguc

SEQ ID NO: 2398458 - RNA, 16 nt, Human immunodeficiency virus 1 [HIV-1]
agaccagaucugagcc

SEQ ID NO: 2398459 - RNA, 19 nt, Human immunodeficiency virus 1 [HIV-1]
cuuuuaaaauuagcaggaa

SEQ ID NO: 2398460 - RNA, 21 nt, Human immunodeficiency virus 1 [HIV-1]
cugagccugggagcucucugg

SEQ ID NO: 2398461 - RNA, 14 nt, Human immunodeficiency virus 1 [HIV-1]
acccauaguaggag

SEQ ID NO: 2398462 - RNA, 17 nt, Human immunodeficiency virus 1 [HIV-1]
uaaaaaucugaaaacag

SEQ ID NO: 2398463 - RNA, 17 nt, Human immunodeficiency virus 1 [HIV-1]
cagaucugagccuggga

SEQ ID NO: 2398464 - RNA, 13 nt, Human immunodeficiency virus 1 [HIV-1]
cuaauagaaagag

SEQ ID NO: 2398465 - RNA, 22 nt, Human immunodeficiency virus 1 [HIV-1]
acaauuacacaagcuuaauaca

SEQ ID NO: 2398466 - RNA, 19 nt, Human immunodeficiency virus 1 [HIV-1]
agggaaagaaugagacgag

SEQ ID NO: 2398467 - RNA, 16 nt, Human immunodeficiency virus 1 [HIV-1]
agaacaccagcuuguu

SEQ ID NO: 2398468 - RNA, 22 nt, Human immunodeficiency virus 1 [HIV-1]
cagaacuacacaccagggccag

SEQ ID NO: 2398469 - RNA, 13 nt, Human immunodeficiency virus 1 [HIV-1]
auuaaagaaaauu

SEQ ID NO: 2398470 - RNA, 21 nt, Human immunodeficiency virus 1 [HIV-1]
accaaugcugcuugugccugg

SEQ ID NO: 2398471 - RNA, 20 nt, Human immunodeficiency virus 1 [HIV-1]
aaaccauaauaguacagcug

SEQ ID NO: 2398472 - RNA, 18 nt, Human immunodeficiency virus 1 [HIV-1]
cagaacuacacaccaggg

SEQ ID NO: 2398473 - RNA, 12 nt, Human immunodeficiency virus 1 [HIV-1]
uaauaauagcaa

SEQ ID NO: 2398474 - RNA, 15 nt, Human immunodeficiency virus 1 [HIV-1]
ccuugaucuguggau

SEQ ID NO: 2398475 - RNA, 14 nt, Human immunodeficiency virus 1 [HIV-1]
caagagaugguggu

SEQ ID NO: 2398476 - RNA, 15 nt, Human immunodeficiency virus 1 [HIV-1]
aggaggagauaugag

SEQ ID NO: 2398477 - RNA, 16 nt, Human immunodeficiency virus 1 [HIV-1]
ucagcacuuguggaga

SEQ ID NO: 2398478 - RNA, 16 nt, Human immunodeficiency virus 1 [HIV-1]
agaauuauuggaauua

SEQ ID NO: 2398479 - RNA, 19 nt, Human immunodeficiency virus 1 [HIV-1]
agcagcaucucgagaccug

SEQ ID NO: 2398480 - RNA, 12 nt, Human immunodeficiency virus 1 [HIV-1]
auacagcagcua

SEQ ID NO: 2398481 - RNA, 16 nt, Human immunodeficiency virus 1 [HIV-1]
aguggaagccauaaua

SEQ ID NO: 2398482 - RNA, 14 nt, Human immunodeficiency virus 1 [HIV-1]
auggagaaaggaga

SEQ ID NO: 2398483 - RNA, 16 nt, Human immunodeficiency virus 1 [HIV-1]
aguagcaauacagcag

SEQ ID NO: 2398484 - RNA, 15 nt, Human immunodeficiency virus 1 [HIV-1]
cauaccuagaagaau

SEQ ID NO: 2398485 - RNA, 15 nt, Human immunodeficiency virus 1 [HIV-1]
uggggacuuuccagg

SEQ ID NO: 2398486 - RNA, 15 nt, Human immunodeficiency virus 1 [HIV-1]
uucaagaacugcuga

SEQ ID NO: 2398487 - RNA, 21 nt, Human immunodeficiency virus 1 [HIV-1]
uaauaguacagcugaacacau

SEQ ID NO: 2398488 - RNA, 15 nt, Human immunodeficiency virus 1 [HIV-1]
ggacuuuccagggag

SEQ ID NO: 2398489 - RNA, 17 nt, Human immunodeficiency virus 1 [HIV-1]
agaucugagccugggag

SEQ ID NO: 2398490 - RNA, 15 nt, Human immunodeficiency virus 1 [HIV-1]
ggagagagagacaga

SEQ ID NO: 2398491 - RNA, 17 nt, Human immunodeficiency virus 1 [HIV-1]
agauuuacccagggauu

SEQ ID NO: 2398492 - RNA, 21 nt, Human immunodeficiency virus 1 [HIV-1]
augguaccaguuagagaaaga

SEQ ID NO: 2398493 - RNA, 17 nt, Human immunodeficiency virus 1 [HIV-1]
cagucuagcagaagaag

SEQ ID NO: 2398494 - RNA, 20 nt, Human immunodeficiency virus 1 [HIV-1]
gcugcuuuuugccuguacug

SEQ ID NO: 2398495 - RNA, 16 nt, Human immunodeficiency virus 1 [HIV-1]
caagaauaaguucaga

SEQ ID NO: 2398496 - RNA, 23 nt, Human immunodeficiency virus 1 [HIV-1]
guggccugggcgggacuggggag

SEQ ID NO: 2398497 - RNA, 21 nt, Human immunodeficiency virus 1 [HIV-1]
aaguuuguuucauaacaaaag

SEQ ID NO: 2398498 - RNA, 16 nt, Human immunodeficiency virus 1 [HIV-1]
uaacauuaguagagca

SEQ ID NO: 2398499 - RNA, 14 nt, Human immunodeficiency virus 1 [HIV-1]
auagugcagcagca

SEQ ID NO: 2398500 - RNA, 14 nt, Human immunodeficiency virus 1 [HIV-1]
ggaacuucugggac

SEQ ID NO: 2398501 - RNA, 13 nt, Human immunodeficiency virus 1 [HIV-1]
auccuagacuaga

SEQ ID NO: 2398502 - RNA, 18 nt, Human immunodeficiency virus 1 [HIV-1]
gaacccacugcuuaagcc

SEQ ID NO: 2398503 - RNA, 17 nt, Human immunodeficiency virus 1 [HIV-1]
ucaaugacauacagaag

SEQ ID NO: 2398504 - RNA, 22 nt, Human immunodeficiency virus 1 [HIV-1]
agauccugcauauaagcagcug

SEQ ID NO: 2398505 - RNA, 22 nt, Human immunodeficiency virus 1 [HIV-1]
uggcaguauucauccacaauuu

SEQ ID NO: 2398506 - RNA, 17 nt, Human immunodeficiency virus 1 [HIV-1]
agcagaagacaguggca

SEQ ID NO: 2398507 - RNA, 19 nt, Human immunodeficiency virus 1 [HIV-1]
guagcaauacagcagcuac

SEQ ID NO: 2398508 - RNA, 14 nt, Human immunodeficiency virus 1 [HIV-1]
ggaacaagccccag

SEQ ID NO: 2398509 - RNA, 17 nt, Human immunodeficiency virus 1 [HIV-1]
cuaaugauguaaaacaa

SEQ ID NO: 2398510 - RNA, 20 nt, Human immunodeficiency virus 1 [HIV-1]
auaucagcacuuguggagau

SEQ ID NO: 2398511 - RNA, 18 nt, Human immunodeficiency virus 1 [HIV-1]
agaaugauacuaauacca

SEQ ID NO: 2398512 - RNA, 21 nt, Human immunodeficiency virus 1 [HIV-1]
gcagcagauagggugggagca

SEQ ID NO: 2398513 - RNA, 14 nt, Human immunodeficiency virus 1 [HIV-1]
cugacaauggcagc

SEQ ID NO: 2398514 - RNA, 18 nt, Human immunodeficiency virus 1 [HIV-1]
cacccugugagccugcau

SEQ ID NO: 2398515 - RNA, 14 nt, Human immunodeficiency virus 1 [HIV-1]
aauagaggaagaca

SEQ ID NO: 2398516 - RNA, 16 nt, Human immunodeficiency virus 1 [HIV-1]
cuucccugauuagcag

SEQ ID NO: 2398517 - RNA, 16 nt, Human immunodeficiency virus 1 [HIV-1]
caauccucaggagggg

SEQ ID NO: 2398518 - RNA, 21 nt, Human immunodeficiency virus 1 [HIV-1]
agaagguggagagagagacag

SEQ ID NO: 2398519 - RNA, 18 nt, Human immunodeficiency virus 1 [HIV-1]
agccuuuuagaaaacaaa

SEQ ID NO: 2398520 - RNA, 18 nt, Human immunodeficiency virus 1 [HIV-1]
aucuucagaccuggagga

SEQ ID NO: 2398521 - RNA, 16 nt, Human immunodeficiency virus 1 [HIV-1]
ugaguuacaagcaauu

SEQ ID NO: 2398522 - RNA, 10 nt, Human immunodeficiency virus 1 [HIV-1]
gagcagcagg

SEQ ID NO: 2398523 - RNA, 22 nt, Human immunodeficiency virus 1 [HIV-1]
ucagguaccuuuaagaccaaug

SEQ ID NO: 2398524 - RNA, 18 nt, Human immunodeficiency virus 1 [HIV-1]
gaaugaagcuguuagaca

SEQ ID NO: 2398525 - RNA, 21 nt, Human immunodeficiency virus 1 [HIV-1]
ccagaucugagccugggagcu

SEQ ID NO: 2398526 - RNA, 18 nt, Human immunodeficiency virus 1 [HIV-1]
acuaaauuaggaaaagca

SEQ ID NO: 2398527 - RNA, 21 nt, Human immunodeficiency virus 1 [HIV-1]
cuaugaauaaagaauuaaaga

SEQ ID NO: 2398528 - RNA, 21 nt, Human immunodeficiency virus 1 [HIV-1]
caggcccgaaggaauagaaga

SEQ ID NO: 2398529 - RNA, 22 nt, Human immunodeficiency virus 1 [HIV-1]
agccugugccucuucagcuacc

SEQ ID NO: 2398530 - RNA, 18 nt, Human immunodeficiency virus 1 [HIV-1]
caagaaguaguauuggua

SEQ ID NO: 2398531 - RNA, 13 nt, Human immunodeficiency virus 1 [HIV-1]
gaacccacugcuu

SEQ ID NO: 2398532 - RNA, 14 nt, Human immunodeficiency virus 1 [HIV-1]
ugccagaaaaagac

SEQ ID NO: 2398533 - RNA, 14 nt, Human immunodeficiency virus 1 [HIV-1]
gacgagcugagcca

SEQ ID NO: 2398534 - RNA, 18 nt, Human immunodeficiency virus 1 [HIV-1]
aauugauagacuaauaga

SEQ ID NO: 2398535 - RNA, 13 nt, Human immunodeficiency virus 1 [HIV-1]
guagacuguaguc

SEQ ID NO: 2398536 - RNA, 14 nt, Human immunodeficiency virus 1 [HIV-1]
gagaaaggagagau

SEQ ID NO: 2398537 - RNA, 22 nt, Human immunodeficiency virus 1 [HIV-1]
auagacuaauagaaagagcaga

SEQ ID NO: 2398538 - RNA, 16 nt, Human immunodeficiency virus 1 [HIV-1]
agagagaaaaaagagc

SEQ ID NO: 2398539 - RNA, 23 nt, Human immunodeficiency virus 1 [HIV-1]
uaccuaaaggaucaacagcuccu

SEQ ID NO: 2398540 - RNA, 15 nt, Human immunodeficiency virus 1 [HIV-1]
gaacaucuuaagaca

SEQ ID NO: 2398541 - RNA, 13 nt, Human immunodeficiency virus 1 [HIV-1]
aggcaaagagaag

SEQ ID NO: 2398542 - RNA, 23 nt, Human immunodeficiency virus 1 [HIV-1]
acagggagacuaaauuaggaaaa

SEQ ID NO: 2398543 - RNA, 14 nt, Human immunodeficiency virus 1 [HIV-1]
cauagaaaucugug

SEQ ID NO: 2398544 - RNA, 20 nt, Human immunodeficiency virus 1 [HIV-1]
cagucacaccucagguaccu

SEQ ID NO: 2398545 - RNA, 13 nt, Human immunodeficiency virus 1 [HIV-1]
uauaaaauuauuc

SEQ ID NO: 2398546 - RNA, 19 nt, Human immunodeficiency virus 1 [HIV-1]
cagagaggaccagggagag

SEQ ID NO: 2398547 - RNA, 13 nt, Human immunodeficiency virus 1 [HIV-1]
acuuuuuaaaaga

SEQ ID NO: 2398548 - RNA, 21 nt, Human immunodeficiency virus 1 [HIV-1]
agaggccaauaaaggagagaa

SEQ ID NO: 2398549 - RNA, 13 nt, Human immunodeficiency virus 1 [HIV-1]
uuaauuguggagg

SEQ ID NO: 2398550 - RNA, 16 nt, Human immunodeficiency virus 1 [HIV-1]
ccuguguggaaggaag

SEQ ID NO: 2398551 - RNA, 18 nt, Human immunodeficiency virus 1 [HIV-1]
agcugcuuuuugccugua

SEQ ID NO: 2398552 - RNA, 14 nt, Human immunodeficiency virus 1 [HIV-1]
aucaaaguaagaca

SEQ ID NO: 2398553 - RNA, 17 nt, Human immunodeficiency virus 1 [HIV-1]
caguuaauaaaaaagga

SEQ ID NO: 2398554 - RNA, 14 nt, Human immunodeficiency virus 1 [HIV-1]
caggaguggaagcc

SEQ ID NO: 2398555 - RNA, 16 nt, Human immunodeficiency virus 1 [HIV-1]
cugcauacaggagaaa

SEQ ID NO: 2398556 - RNA, 14 nt, Human immunodeficiency virus 1 [HIV-1]
gaugacccggagag

SEQ ID NO: 2398557 - RNA, 20 nt, Human immunodeficiency virus 1 [HIV-1]
ugugagccugcaugggaugg

SEQ ID NO: 2398558 - RNA, 19 nt, Human immunodeficiency virus 1 [HIV-1]
caaaaaacaucagaaagaa

SEQ ID NO: 2398559 - RNA, 21 nt, Human immunodeficiency virus 1 [HIV-1]
agggagucuccauagaaugga

SEQ ID NO: 2398560 - RNA, 18 nt, Human immunodeficiency virus 1 [HIV-1]
gcccgagagcugcauccg

SEQ ID NO: 2398561 - RNA, 14 nt, Human immunodeficiency virus 1 [HIV-1]
ucaagcacaaccag

SEQ ID NO: 2398562 - RNA, 22 nt, Human immunodeficiency virus 1 [HIV-1]
cuguagugcuacagaaaaauug

SEQ ID NO: 2398563 - RNA, 18 nt, Human immunodeficiency virus 1 [HIV-1]
cuaauaccaauaguagua

SEQ ID NO: 2398564 - RNA, 14 nt, Human immunodeficiency virus 1 [HIV-1]
uggagugggacaga

SEQ ID NO: 2398565 - RNA, 17 nt, Human immunodeficiency virus 1 [HIV-1]
aguuaauaaaaaaggaa

SEQ ID NO: 2398566 - RNA, 17 nt, Human immunodeficiency virus 1 [HIV-1]
gcaucaagcagcuccag

SEQ ID NO: 2398567 - RNA, 15 nt, Human immunodeficiency virus 1 [HIV-1]
guaugccccucccau

SEQ ID NO: 2398568 - RNA, 15 nt, Human immunodeficiency virus 1 [HIV-1]
gcauggacaaguaga

SEQ ID NO: 2398569 - RNA, 19 nt, Human immunodeficiency virus 1 [HIV-1]
gagaagaguggugcagaga

SEQ ID NO: 2398570 - RNA, 19 nt, Human immunodeficiency virus 1 [HIV-1]
aggcaucuccuauggcagg

SEQ ID NO: 2398571 - RNA, 17 nt, Human immunodeficiency virus 1 [HIV-1]
gagguaaggugcagaaa

SEQ ID NO: 2398572 - RNA, 19 nt, Human immunodeficiency virus 1 [HIV-1]
cuguuagcuugcucaaugc

SEQ ID NO: 2398573 - RNA, 16 nt, Human immunodeficiency virus 1 [HIV-1]
caaagaagacaagaua

SEQ ID NO: 2398574 - RNA, 23 nt, Human immunodeficiency virus 1 [HIV-1]
gcauuaguagaaauuuguacaga

SEQ ID NO: 2398575 - RNA, 22 nt, Human immunodeficiency virus 1 [HIV-1]
gaaguaguauugguaaauguga

SEQ ID NO: 2398576 - RNA, 21 nt, Human immunodeficiency virus 1 [HIV-1]
gagcuagaacuggcagaaaac

SEQ ID NO: 2398577 - RNA, 19 nt, Human immunodeficiency virus 1 [HIV-1]
acugcuuaagccucaauaa

SEQ ID NO: 2398578 - RNA, 23 nt, Human immunodeficiency virus 1 [HIV-1]
agugccaagaagaaaagcaaaga

SEQ ID NO: 2398579 - RNA, 14 nt, Human immunodeficiency virus 1 [HIV-1]
auaaaaaaggaaaa

SEQ ID NO: 2398580 - RNA, 19 nt, Human immunodeficiency virus 1 [HIV-1]
cuuaccacaccagacaaaa

SEQ ID NO: 2398581 - RNA, 14 nt, Human immunodeficiency virus 1 [HIV-1]
acaaauuauaaaca

SEQ ID NO: 2398582 - RNA, 15 nt, Human immunodeficiency virus 1 [HIV-1]
aaaugucagcuaaaa

SEQ ID NO: 2398583 - RNA, 13 nt, Human immunodeficiency virus 1 [HIV-1]
agauggaauagau

SEQ ID NO: 2398584 - RNA, 16 nt, Human immunodeficiency virus 1 [HIV-1]
cauagcaguagcugag

SEQ ID NO: 2398585 - RNA, 15 nt, Human immunodeficiency virus 1 [HIV-1]
cucccaucaguggac

SEQ ID NO: 2398586 - RNA, 17 nt, Human immunodeficiency virus 1 [HIV-1]
gauggaugacccggaga

SEQ ID NO: 2398587 - RNA, 24 nt, Human immunodeficiency virus 1 [HIV-1]
agucaggaacuaaagaauagugcu

SEQ ID NO: 2398588 - RNA, 23 nt, Human immunodeficiency virus 1 [HIV-1]
cagauccugcauauaagcagcug

SEQ ID NO: 2398589 - RNA, 14 nt, Human immunodeficiency virus 1 [HIV-1]
ggagugggacagag

SEQ ID NO: 2398590 - RNA, 22 nt, Human immunodeficiency virus 1 [HIV-1]
cugcucuuucaauaucagcaca

SEQ ID NO: 2398591 - RNA, 18 nt, Human immunodeficiency virus 1 [HIV-1]
agcaauacagcagcuacc

SEQ ID NO: 2398592 - RNA, 12 nt, Human immunodeficiency virus 1 [HIV-1]
auggagaaagga

SEQ ID NO: 2398593 - RNA, 19 nt, Human immunodeficiency virus 1 [HIV-1]
acuaacagaaguaauacca

SEQ ID NO: 2398594 - RNA, 13 nt, Human immunodeficiency virus 1 [HIV-1]
guucuugggagca

SEQ ID NO: 2398595 - RNA, 14 nt, Human immunodeficiency virus 1 [HIV-1]
ucuaaaauguaaua

SEQ ID NO: 2398596 - RNA, 14 nt, Human immunodeficiency virus 1 [HIV-1]
gcaucaagcagcuc

SEQ ID NO: 2398597 - RNA, 18 nt, Human immunodeficiency virus 1 [HIV-1]
accauaauaguacagcug

SEQ ID NO: 2398598 - RNA, 22 nt, Human immunodeficiency virus 1 [HIV-1]
agaaaggagagauaaaaaacug

SEQ ID NO: 2398599 - RNA, 18 nt, Human immunodeficiency virus 1 [HIV-1]
uaaaaaagaaaaaaucag

SEQ ID NO: 2398600 - RNA, 13 nt, Human immunodeficiency virus 1 [HIV-1]
ggugggagcagca

SEQ ID NO: 2398601 - RNA, 17 nt, Human immunodeficiency virus 1 [HIV-1]
cuuggcacuagcagcau

SEQ ID NO: 2398602 - RNA, 12 nt, Human immunodeficiency virus 1 [HIV-1]
auggaaaaggaa

SEQ ID NO: 2398603 - RNA, 20 nt, Human immunodeficiency virus 1 [HIV-1]
cacuagagcuuuuagaggag

SEQ ID NO: 2398604 - RNA, 16 nt, Human immunodeficiency virus 1 [HIV-1]
gggaggcguggccugg

SEQ ID NO: 2398605 - RNA, 19 nt, Human immunodeficiency virus 1 [HIV-1]
gaacaccagcuuguuacac

SEQ ID NO: 2398606 - RNA, 21 nt, Human immunodeficiency virus 1 [HIV-1]
cucaauaaagcuugccuugag

SEQ ID NO: 2398607 - RNA, 19 nt, Human immunodeficiency virus 1 [HIV-1]
agugcugccagaaaaagac

SEQ ID NO: 2398608 - RNA, 16 nt, Human immunodeficiency virus 1 [HIV-1]
agcaauaauaauagca

SEQ ID NO: 2398609 - RNA, 16 nt, Human immunodeficiency virus 1 [HIV-1]
ccaagaugaacaugag

SEQ ID NO: 2398610 - RNA, 14 nt, Human immunodeficiency virus 1 [HIV-1]
cgggaaucaagcag

SEQ ID NO: 2398611 - RNA, 16 nt, Human immunodeficiency virus 1 [HIV-1]
acaacuguuuaauagu

SEQ ID NO: 2398612 - RNA, 15 nt, Human immunodeficiency virus 1 [HIV-1]
acccacaagaaguag

SEQ ID NO: 2398613 - RNA, 14 nt, Human immunodeficiency virus 1 [HIV-1]
gcuugugccuggcu

SEQ ID NO: 2398614 - RNA, 13 nt, Human immunodeficiency virus 1 [HIV-1]
aauacagcagcua

SEQ ID NO: 2398615 - RNA, 13 nt, Human immunodeficiency virus 1 [HIV-1]
agagaaaaaagag

SEQ ID NO: 2398616 - RNA, 23 nt, Human immunodeficiency virus 1 [HIV-1]
ccaaguuuguuucauaacaaaag

SEQ ID NO: 2398617 - RNA, 17 nt, Human immunodeficiency virus 1 [HIV-1]
auuuagaaggaaaaguu

SEQ ID NO: 2398618 - RNA, 20 nt, Human immunodeficiency virus 1 [HIV-1]
agauaggggggcaacuaaag

SEQ ID NO: 2398619 - RNA, 22 nt, Human immunodeficiency virus 1 [HIV-1]
cgaucugcggagccugugccuc

SEQ ID NO: 2398620 - RNA, 16 nt, Human immunodeficiency virus 1 [HIV-1]
gaagacaguggcaaug

SEQ ID NO: 2398621 - RNA, 13 nt, Human immunodeficiency virus 1 [HIV-1]
gccucaauaaagc

SEQ ID NO: 2398622 - RNA, 15 nt, Human immunodeficiency virus 1 [HIV-1]
aaaauauuaagacaa

SEQ ID NO: 2398623 - RNA, 19 nt, Human immunodeficiency virus 1 [HIV-1]
ccaguauuugccauaaaga

SEQ ID NO: 2398624 - RNA, 13 nt, Human immunodeficiency virus 1 [HIV-1]
cacagagggagcc

SEQ ID NO: 2398625 - RNA, 16 nt, Human immunodeficiency virus 1 [HIV-1]
cucauccaagaauaag

SEQ ID NO: 2398626 - RNA, 11 nt, Human immunodeficiency virus 1 [HIV-1]
agugaauagag

SEQ ID NO: 2398627 - RNA, 19 nt, Human immunodeficiency virus 1 [HIV-1]
agccugggagcucucuggc

SEQ ID NO: 2398628 - RNA, 10 nt, Human immunodeficiency virus 1 [HIV-1]
ccagggaggc

SEQ ID NO: 2398629 - RNA, 12 nt, Human immunodeficiency virus 1 [HIV-1]
caggagaaagag

SEQ ID NO: 2398630 - RNA, 16 nt, Human immunodeficiency virus 1 [HIV-1]
ggaguacuucaagaac

SEQ ID NO: 2398631 - RNA, 18 nt, Human immunodeficiency virus 1 [HIV-1]
accaaaaaagauaaagcc

SEQ ID NO: 2398632 - RNA, 16 nt, Human immunodeficiency virus 1 [HIV-1]
uggcaaguagacagga

SEQ ID NO: 2398633 - RNA, 22 nt, Human immunodeficiency virus 1 [HIV-1]
cacacgaccuggauggaguggg

SEQ ID NO: 2398634 - RNA, 23 nt, Human immunodeficiency virus 1 [HIV-1]
cagcuuguuacacccugugagcc

SEQ ID NO: 2398635 - RNA, 22 nt, Human immunodeficiency virus 1 [HIV-1]
acauggaauuaggccaguagua

SEQ ID NO: 2398636 - RNA, 14 nt, Human immunodeficiency virus 1 [HIV-1]
accuaguauaaaca

SEQ ID NO: 2398637 - RNA, 17 nt, Human immunodeficiency virus 1 [HIV-1]
auauuaagacaaagaaa

SEQ ID NO: 2398638 - RNA, 14 nt, Human immunodeficiency virus 1 [HIV-1]
cuugggagcagcag

SEQ ID NO: 2398639 - RNA, 20 nt, Human immunodeficiency virus 1 [HIV-1]
ggacgaucugcggagccugu

SEQ ID NO: 2398640 - RNA, 17 nt, Human immunodeficiency virus 1 [HIV-1]
auggaaaccaaaaauga

SEQ ID NO: 2398641 - RNA, 16 nt, Human immunodeficiency virus 1 [HIV-1]
cagagauggaaaagga

SEQ ID NO: 2398642 - RNA, 15 nt, Human immunodeficiency virus 1 [HIV-1]
gaguggcgagcccuc

SEQ ID NO: 2398643 - RNA, 14 nt, Human immunodeficiency virus 1 [HIV-1]
acacccugugagcc

SEQ ID NO: 2398644 - RNA, 15 nt, Human immunodeficiency virus 1 [HIV-1]
cuauggcaggaagaa

SEQ ID NO: 2398645 - RNA, 14 nt, Human immunodeficiency virus 1 [HIV-1]
aguauaaacaauga

SEQ ID NO: 2398646 - RNA, 20 nt, Human immunodeficiency virus 1 [HIV-1]
cuuuuaaaauuagcaggaag

SEQ ID NO: 2398647 - RNA, 17 nt, Human immunodeficiency virus 1 [HIV-1]
ugagggacaauuggaga

SEQ ID NO: 2398648 - RNA, 17 nt, Human immunodeficiency virus 1 [HIV-1]
agcaauaauaauagcaa

SEQ ID NO: 2398649 - RNA, 13 nt, Human immunodeficiency virus 1 [HIV-1]
uggguuuuccagu

SEQ ID NO: 2398650 - RNA, 18 nt, Human immunodeficiency virus 1 [HIV-1]
uggcagaaaacagagaga

SEQ ID NO: 2398651 - RNA, 15 nt, Human immunodeficiency virus 1 [HIV-1]
cccgagagcugcauc

SEQ ID NO: 2398652 - RNA, 18 nt, Human immunodeficiency virus 1 [HIV-1]
agguaaggugcagaaaga

SEQ ID NO: 2398653 - RNA, 22 nt, Human immunodeficiency virus 1 [HIV-1]
caaacuaaagaauuacaaaaac

SEQ ID NO: 2398654 - RNA, 18 nt, Human immunodeficiency virus 1 [HIV-1]
gaauccuggcuguggaaa

SEQ ID NO: 2398655 - RNA, 13 nt, Human immunodeficiency virus 1 [HIV-1]
auuuuaaaagaaa

SEQ ID NO: 2398656 - RNA, 16 nt, Human immunodeficiency virus 1 [HIV-1]
aggaggaggagguggg

SEQ ID NO: 2398657 - RNA, 17 nt, Human immunodeficiency virus 1 [HIV-1]
gaaaaggggggacugga

SEQ ID NO: 2398658 - RNA, 21 nt, Human immunodeficiency virus 1 [HIV-1]
gagaacaccagcuuguuacac

SEQ ID NO: 2398659 - RNA, 17 nt, Human immunodeficiency virus 1 [HIV-1]
caaauuaagagaacaau

SEQ ID NO: 2398660 - RNA, 16 nt, Human immunodeficiency virus 1 [HIV-1]
agaagaguggugcaga

SEQ ID NO: 2398661 - RNA, 18 nt, Human immunodeficiency virus 1 [HIV-1]
cuacuguaagggaaagaa

SEQ ID NO: 2398662 - RNA, 21 nt, Human immunodeficiency virus 1 [HIV-1]
ugugccuggcuagaagcacaa

SEQ ID NO: 2398663 - RNA, 18 nt, Human immunodeficiency virus 1 [HIV-1]
uggauggugcuacaagcu

SEQ ID NO: 2398664 - RNA, 17 nt, Human immunodeficiency virus 1 [HIV-1]
cuguagaucuuagccac

SEQ ID NO: 2398665 - RNA, 16 nt, Human immunodeficiency virus 1 [HIV-1]
cuuacaaggcagcugu

SEQ ID NO: 2398666 - RNA, 15 nt, Human immunodeficiency virus 1 [HIV-1]
guacacauuuagaag

SEQ ID NO: 2398667 - RNA, 21 nt, Human immunodeficiency virus 1 [HIV-1]
agcagcaucucgagaccugga

SEQ ID NO: 2398668 - RNA, 15 nt, Human immunodeficiency virus 1 [HIV-1]
gaauaagacagggcu

SEQ ID NO: 2398669 - RNA, 11 nt, Human immunodeficiency virus 1 [HIV-1]
acaaaaacaaa

SEQ ID NO: 2398670 - RNA, 22 nt, Human immunodeficiency virus 1 [HIV-1]
cuaccaaugcugcuugugccug

SEQ ID NO: 2398671 - RNA, 21 nt, Human immunodeficiency virus 1 [HIV-1]
acacccugugagccugcaugg

SEQ ID NO: 2398672 - RNA, 17 nt, Human immunodeficiency virus 1 [HIV-1]
aggaaauaugagacaag

SEQ ID NO: 2398673 - RNA, 15 nt, Human immunodeficiency virus 1 [HIV-1]
ugagccugggagcuc

SEQ ID NO: 2398674 - RNA, 15 nt, Human immunodeficiency virus 1 [HIV-1]
ccauagcaguagcug

SEQ ID NO: 2398675 - RNA, 14 nt, Human immunodeficiency virus 1 [HIV-1]
acugcugacaucga

SEQ ID NO: 2398676 - RNA, 16 nt, Human immunodeficiency virus 1 [HIV-1]
aacacaucuguagaaa

SEQ ID NO: 2398677 - RNA, 21 nt, Human immunodeficiency virus 1 [HIV-1]
agcaguuaauaaaaaaggaaa

SEQ ID NO: 2398678 - RNA, 19 nt, Human immunodeficiency virus 1 [HIV-1]
uuaaacugcccauacaaaa

SEQ ID NO: 2398679 - RNA, 13 nt, Human immunodeficiency virus 1 [HIV-1]
caguaaaaacaau

SEQ ID NO: 2398680 - RNA, 15 nt, Human immunodeficiency virus 1 [HIV-1]
gcugaggggacagau

SEQ ID NO: 2398681 - RNA, 16 nt, Human immunodeficiency virus 1 [HIV-1]
aauacaagaaaaagaa

SEQ ID NO: 2398682 - RNA, 13 nt, Human immunodeficiency virus 1 [HIV-1]
auacuaccagcua

SEQ ID NO: 2398683 - RNA, 20 nt, Human immunodeficiency virus 1 [HIV-1]
aggagagcaagaaauggagc

SEQ ID NO: 2398684 - RNA, 20 nt, Human immunodeficiency virus 1 [HIV-1]
cagggaggcguggccugggc

SEQ ID NO: 2398685 - RNA, 22 nt, Human immunodeficiency virus 1 [HIV-1]
cagacaaaaaacaucagaaaga

SEQ ID NO: 2398686 - RNA, 19 nt, Human immunodeficiency virus 1 [HIV-1]
guagcugaggggacagaua

SEQ ID NO: 2398687 - RNA, 20 nt, Human immunodeficiency virus 1 [HIV-1]
cugacacaacaaaucagaag

SEQ ID NO: 2398688 - RNA, 20 nt, Human immunodeficiency virus 1 [HIV-1]
guuucagacccaccucccaa

SEQ ID NO: 2398689 - RNA, 12 nt, Human immunodeficiency virus 1 [HIV-1]
caccagcaauau

SEQ ID NO: 2398690 - RNA, 18 nt, Human immunodeficiency virus 1 [HIV-1]
cuuguuacacccugugag

SEQ ID NO: 2398691 - RNA, 14 nt, Human immunodeficiency virus 1 [HIV-1]
guggguuuuccagu

SEQ ID NO: 2398692 - RNA, 14 nt, Human immunodeficiency virus 1 [HIV-1]
auguaaaacaauua

SEQ ID NO: 2398693 - RNA, 17 nt, Human immunodeficiency virus 1 [HIV-1]
gaagaagguggagagag

SEQ ID NO: 2398694 - RNA, 22 nt, Human immunodeficiency virus 1 [HIV-1]
gaggccaauaaaggagagaaca

SEQ ID NO: 2398695 - RNA, 13 nt, Human immunodeficiency virus 1 [HIV-1]
gaggaccagggag

SEQ ID NO: 2398696 - RNA, 18 nt, Human immunodeficiency virus 1 [HIV-1]
agagaaaaaagagcagug

SEQ ID NO: 2398697 - RNA, 17 nt, Human immunodeficiency virus 1 [HIV-1]
gccaauaaaggagagaa

SEQ ID NO: 2398698 - RNA, 17 nt, Human immunodeficiency virus 1 [HIV-1]
cagaaauacagaagcag

SEQ ID NO: 2398699 - RNA, 19 nt, Human immunodeficiency virus 1 [HIV-1]
guaucaacucaacugcugu

SEQ ID NO: 2398700 - RNA, 13 nt, Human immunodeficiency virus 1 [HIV-1]
ugagccugggagc

SEQ ID NO: 2398701 - RNA, 20 nt, Human immunodeficiency virus 1 [HIV-1]
ccguauccagagaggaccag

SEQ ID NO: 2398702 - RNA, 12 nt, Human immunodeficiency virus 1 [HIV-1]
cccaccucccaa

SEQ ID NO: 2398703 - RNA, 19 nt, Human immunodeficiency virus 1 [HIV-1]
aaguuuguuucauaacaaa

SEQ ID NO: 2398704 - RNA, 11 nt, Human immunodeficiency virus 1 [HIV-1]
augaacuccau

SEQ ID NO: 2398705 - RNA, 23 nt, Human immunodeficiency virus 1 [HIV-1]
ucuaaaagaaccaguacauggag

SEQ ID NO: 2398706 - RNA, 21 nt, Human immunodeficiency virus 1 [HIV-1]
aaaaccauaauaguacagcug

SEQ ID NO: 2398707 - RNA, 17 nt, Human immunodeficiency virus 1 [HIV-1]
aggaucaacagcuccug

SEQ ID NO: 2398708 - RNA, 15 nt, Human immunodeficiency virus 1 [HIV-1]
cacuuguggagaugg

SEQ ID NO: 2398709 - RNA, 17 nt, Human immunodeficiency virus 1 [HIV-1]
acuagcagcauuaauaa

SEQ ID NO: 2398710 - RNA, 21 nt, Human immunodeficiency virus 1 [HIV-1]
agcuaguaccaguugagccag

SEQ ID NO: 2398711 - RNA, 20 nt, Human immunodeficiency virus 1 [HIV-1]
uuagaccagaucugagccug

SEQ ID NO: 2398712 - RNA, 19 nt, Human immunodeficiency virus 1 [HIV-1]
ugaacacaucuguagaaau

SEQ ID NO: 2398713 - RNA, 15 nt, Human immunodeficiency virus 1 [HIV-1]
auguaauaauaagac

SEQ ID NO: 2398714 - RNA, 14 nt, Human immunodeficiency virus 1 [HIV-1]
cuauagugaauaga

SEQ ID NO: 2398715 - RNA, 14 nt, Human immunodeficiency virus 1 [HIV-1]
gcagauaggguggg

SEQ ID NO: 2398716 - RNA, 17 nt, Human immunodeficiency virus 1 [HIV-1]
gcagcagauaggguggg

SEQ ID NO: 2398717 - RNA, 17 nt, Human immunodeficiency virus 1 [HIV-1]
augucagcuaaaaggag

SEQ ID NO: 2398718 - RNA, 23 nt, Human immunodeficiency virus 1 [HIV-1]
acaccagggauuagauaucagua

SEQ ID NO: 2398719 - RNA, 16 nt, Human immunodeficiency virus 1 [HIV-1]
aucucuggaacagauu

SEQ ID NO: 2398720 - RNA, 16 nt, Human immunodeficiency virus 1 [HIV-1]
gagccugcaugggaug

SEQ ID NO: 2398721 - RNA, 19 nt, Human immunodeficiency virus 1 [HIV-1]
gagcuugcuacaagggacu

SEQ ID NO: 2398722 - RNA, 20 nt, Human immunodeficiency virus 1 [HIV-1]
aaguuuguggaauugguuua

SEQ ID NO: 2398723 - RNA, 21 nt, Human immunodeficiency virus 1 [HIV-1]
aaacaauaaucuuuaagcaau

SEQ ID NO: 2398724 - RNA, 13 nt, Human immunodeficiency virus 1 [HIV-1]
agcacuaacagaa

SEQ ID NO: 2398725 - RNA, 13 nt, Human immunodeficiency virus 1 [HIV-1]
gagccagcagcag

SEQ ID NO: 2398726 - RNA, 23 nt, Human immunodeficiency virus 1 [HIV-1]
auguuacuaauagaggaagacaa

SEQ ID NO: 2398727 - RNA, 22 nt, Human immunodeficiency virus 1 [HIV-1]
gacagagaaauuaacaauuaca

SEQ ID NO: 2398728 - RNA, 16 nt, Human immunodeficiency virus 1 [HIV-1]
uaccaguugagccaga

SEQ ID NO: 2398729 - RNA, 18 nt, Human immunodeficiency virus 1 [HIV-1]
augacccggagagagaag

SEQ ID NO: 2398730 - RNA, 15 nt, Human immunodeficiency virus 1 [HIV-1]
cugagccagcagcag

SEQ ID NO: 2398731 - RNA, 17 nt, Human immunodeficiency virus 1 [HIV-1]
guagcugaggggacaga

SEQ ID NO: 2398732 - RNA, 15 nt, Human immunodeficiency virus 1 [HIV-1]
aggaggggacccaga

SEQ ID NO: 2398733 - RNA, 15 nt, Human immunodeficiency virus 1 [HIV-1]
uagcaauacagcagc

SEQ ID NO: 2398734 - RNA, 14 nt, Human immunodeficiency virus 1 [HIV-1]
accaguuagagaaa

SEQ ID NO: 2398735 - RNA, 16 nt, Human immunodeficiency virus 1 [HIV-1]
aucuuaagacagcagu

SEQ ID NO: 2398736 - RNA, 18 nt, Human immunodeficiency virus 1 [HIV-1]
cagaagaagcagagcuag

SEQ ID NO: 2398737 - RNA, 19 nt, Human immunodeficiency virus 1 [HIV-1]
aaagcauaugauacagagg

SEQ ID NO: 2398738 - RNA, 16 nt, Human immunodeficiency virus 1 [HIV-1]
ggcacuuaucugggac

SEQ ID NO: 2398739 - RNA, 17 nt, Human immunodeficiency virus 1 [HIV-1]
agaaucuaugaauaaag

SEQ ID NO: 2398740 - RNA, 16 nt, Human immunodeficiency virus 1 [HIV-1]
ggcgcagccucaauga

SEQ ID NO: 2398741 - RNA, 20 nt, Human immunodeficiency virus 1 [HIV-1]
gaucugcggagccugugccu

SEQ ID NO: 2398742 - RNA, 18 nt, Human immunodeficiency virus 1 [HIV-1]
augagagugaaggagaaa

SEQ ID NO: 2398743 - RNA, 15 nt, Human immunodeficiency virus 1 [HIV-1]
gaggccaauaaagga

SEQ ID NO: 2398744 - RNA, 20 nt, Human immunodeficiency virus 1 [HIV-1]
agaaaggagagauaaaaaac

SEQ ID NO: 2398745 - RNA, 21 nt, Human immunodeficiency virus 1 [HIV-1]
acagaagaaaaaauaaaagca

SEQ ID NO: 2398746 - RNA, 15 nt, Human immunodeficiency virus 1 [HIV-1]
aaaauuagcaggaag

SEQ ID NO: 2398747 - RNA, 18 nt, Human immunodeficiency virus 1 [HIV-1]
aguaccaguugagccaga

SEQ ID NO: 2398748 - RNA, 18 nt, Human immunodeficiency virus 1 [HIV-1]
uauaaauauaaaguagua

SEQ ID NO: 2398749 - RNA, 15 nt, Human immunodeficiency virus 1 [HIV-1]
gauuagaaguaaaca

SEQ ID NO: 2398750 - RNA, 12 nt, Human immunodeficiency virus 1 [HIV-1]
ugcagagagaaa

SEQ ID NO: 2398751 - RNA, 21 nt, Human immunodeficiency virus 1 [HIV-1]
cuggcuaacuagggaacccac

SEQ ID NO: 2398752 - RNA, 16 nt, Human immunodeficiency virus 1 [HIV-1]
aguacauguaaugcaa

SEQ ID NO: 2398753 - RNA, 18 nt, Human immunodeficiency virus 1 [HIV-1]
ccaaccccgaggggaccc

SEQ ID NO: 2398754 - RNA, 13 nt, Human immunodeficiency virus 1 [HIV-1]
caauaguagcaau

SEQ ID NO: 2398755 - RNA, 23 nt, Human immunodeficiency virus 1 [HIV-1]
ccagaucugagccugggagcucu

SEQ ID NO: 2398756 - RNA, 13 nt, Human immunodeficiency virus 1 [HIV-1]
caugguggacaga

SEQ ID NO: 2398757 - RNA, 22 nt, Human immunodeficiency virus 1 [HIV-1]
auagugcugccagaaaaagaca

SEQ ID NO: 2398758 - RNA, 15 nt, Human immunodeficiency virus 1 [HIV-1]
agacuaauagaaaga

SEQ ID NO: 2398759 - RNA, 17 nt, Human immunodeficiency virus 1 [HIV-1]
guacacauuuagaagga

SEQ ID NO: 2398760 - RNA, 16 nt, Human immunodeficiency virus 1 [HIV-1]
gccaaguuuguuucau

SEQ ID NO: 2398761 - RNA, 20 nt, Human immunodeficiency virus 1 [HIV-1]
accagacaaaaaacaucaga

SEQ ID NO: 2398762 - RNA, 21 nt, Human immunodeficiency virus 1 [HIV-1]
agaacuggcagaaaacagaga

SEQ ID NO: 2398763 - RNA, 20 nt, Human immunodeficiency virus 1 [HIV-1]
aucaaauuuaucaagagcca

SEQ ID NO: 2398764 - RNA, 21 nt, Human immunodeficiency virus 1 [HIV-1]
gguauagugcagcagcagaac

SEQ ID NO: 2398765 - RNA, 14 nt, Human immunodeficiency virus 1 [HIV-1]
aggaccagcaaagc

SEQ ID NO: 2398766 - RNA, 21 nt, Human immunodeficiency virus 1 [HIV-1]
aaagugcacugauuugaagaa

SEQ ID NO: 2398767 - RNA, 20 nt, Human immunodeficiency virus 1 [HIV-1]
uuaacaagagauggugguaa

SEQ ID NO: 2398768 - RNA, 21 nt, Human immunodeficiency virus 1 [HIV-1]
gugacacaaucacccucccau

SEQ ID NO: 2398769 - RNA, 18 nt, Human immunodeficiency virus 1 [HIV-1]
uaguacaaggagcuugua

SEQ ID NO: 2398770 - RNA, 13 nt, Human immunodeficiency virus 1 [HIV-1]
auaagcagcugcu

SEQ ID NO: 2398771 - RNA, 19 nt, Human immunodeficiency virus 1 [HIV-1]
agacccaacaacaauacaa

SEQ ID NO: 2398772 - RNA, 20 nt, Human immunodeficiency virus 1 [HIV-1]
aaacagauagcuagcaaauu

SEQ ID NO: 2398773 - RNA, 17 nt, Human immunodeficiency virus 1 [HIV-1]
ucagacccaccucccaa

SEQ ID NO: 2398774 - RNA, 19 nt, Human immunodeficiency virus 1 [HIV-1]
acgcagggggugggaagcc

SEQ ID NO: 2398775 - RNA, 13 nt, Human immunodeficiency virus 1 [HIV-1]
gugguccauagua

SEQ ID NO: 2398776 - RNA, 13 nt, Human immunodeficiency virus 1 [HIV-1]
ggccauugacaga

SEQ ID NO: 2398777 - RNA, 20 nt, Human immunodeficiency virus 1 [HIV-1]
uacacccugugagccugcau

SEQ ID NO: 2398778 - RNA, 16 nt, Human immunodeficiency virus 1 [HIV-1]
cagucuagcagaagaa

SEQ ID NO: 2398779 - RNA, 13 nt, Human immunodeficiency virus 1 [HIV-1]
agaagaauaagac

SEQ ID NO: 2398780 - RNA, 12 nt, Human immunodeficiency virus 1 [HIV-1]
agcauaugauac

SEQ ID NO: 2398781 - RNA, 22 nt, Human immunodeficiency virus 1 [HIV-1]
aguggcgagcccucagauccug

SEQ ID NO: 2398782 - RNA, 21 nt, Human immunodeficiency virus 1 [HIV-1]
gauggaacaagccccagaaga

SEQ ID NO: 2398783 - RNA, 22 nt, Human immunodeficiency virus 1 [HIV-1]
agacuguaccaguaaaauuaaa

SEQ ID NO: 2398784 - RNA, 19 nt, Human immunodeficiency virus 1 [HIV-1]
aaacagauagcuagcaaau

SEQ ID NO: 2398785 - RNA, 16 nt, Human immunodeficiency virus 1 [HIV-1]
aaaaguuaaacaaugg

SEQ ID NO: 2398786 - RNA, 18 nt, Human immunodeficiency virus 1 [HIV-1]
gacaugguagaacagaug

SEQ ID NO: 2398787 - RNA, 19 nt, Human immunodeficiency virus 1 [HIV-1]
cagcuaccaccgcuugaga

SEQ ID NO: 2398788 - RNA, 19 nt, Human immunodeficiency virus 1 [HIV-1]
cagauagggugggagcagc

SEQ ID NO: 2398789 - RNA, 20 nt, Human immunodeficiency virus 1 [HIV-1]
acagucuggggcaucaagca

SEQ ID NO: 2398790 - RNA, 12 nt, Human immunodeficiency virus 1 [HIV-1]
acaauuggagaa

SEQ ID NO: 2398791 - RNA, 17 nt, Human immunodeficiency virus 1 [HIV-1]
acaacaauacaagaaaa

SEQ ID NO: 2398792 - RNA, 18 nt, Human immunodeficiency virus 1 [HIV-1]
uaaaguaguaaaaauuga

SEQ ID NO: 2398793 - RNA, 14 nt, Human immunodeficiency virus 1 [HIV-1]
gaucaacagcuccu

SEQ ID NO: 2398794 - RNA, 20 nt, Human immunodeficiency virus 1 [HIV-1]
ggaguaauaaaucucuggaa

SEQ ID NO: 2398795 - RNA, 13 nt, Human immunodeficiency virus 1 [HIV-1]
gagcugagccagc

SEQ ID NO: 2398796 - RNA, 21 nt, Human immunodeficiency virus 1 [HIV-1]
cugugguauauaaaauuauuc

SEQ ID NO: 2398797 - RNA, 15 nt, Human immunodeficiency virus 1 [HIV-1]
gagacaccagggauu

SEQ ID NO: 2398798 - RNA, 15 nt, Human immunodeficiency virus 1 [HIV-1]
uagaauauaggaaaa

SEQ ID NO: 2398799 - RNA, 14 nt, Human immunodeficiency virus 1 [HIV-1]
aauuacaaaaacaa

SEQ ID NO: 2398800 - RNA, 23 nt, Human immunodeficiency virus 1 [HIV-1]
agcaguagcugaggggacagaua

SEQ ID NO: 2398801 - RNA, 16 nt, Human immunodeficiency virus 1 [HIV-1]
gccugggagcucucug

SEQ ID NO: 2398802 - RNA, 14 nt, Human immunodeficiency virus 1 [HIV-1]
gcaucucgagaccu

SEQ ID NO: 2398803 - RNA, 17 nt, Human immunodeficiency virus 1 [HIV-1]
cuuuaaaacagauagcu

SEQ ID NO: 2398804 - RNA, 16 nt, Human immunodeficiency virus 1 [HIV-1]
auggcccaaaaguuaa

SEQ ID NO: 2398805 - RNA, 17 nt, Human immunodeficiency virus 1 [HIV-1]
cugcauauaagcagcug

SEQ ID NO: 2398806 - RNA, 18 nt, Human immunodeficiency virus 1 [HIV-1]
gggcaucaagcagcucca

SEQ ID NO: 2398807 - RNA, 15 nt, Human immunodeficiency virus 1 [HIV-1]
auggaggaaaaagag

SEQ ID NO: 2398808 - RNA, 18 nt, Human immunodeficiency virus 1 [HIV-1]
auggaggaaaaagagaua

SEQ ID NO: 2398809 - RNA, 18 nt, Human immunodeficiency virus 1 [HIV-1]
caguauuagaagaaauga

SEQ ID NO: 2398810 - RNA, 15 nt, Human immunodeficiency virus 1 [HIV-1]
uaaaauuaaagccag

SEQ ID NO: 2398811 - RNA, 13 nt, Human immunodeficiency virus 1 [HIV-1]
ugagacaagcaca

SEQ ID NO: 2398812 - RNA, 16 nt, Human immunodeficiency virus 1 [HIV-1]
caaucaaauaauagag

SEQ ID NO: 2398813 - RNA, 21 nt, Human immunodeficiency virus 1 [HIV-1]
ggcgagcccucagauccugca

SEQ ID NO: 2398814 - RNA, 17 nt, Human immunodeficiency virus 1 [HIV-1]
acaauuuuaaaagaaaa

SEQ ID NO: 2398815 - RNA, 15 nt, Human immunodeficiency virus 1 [HIV-1]
cucaggaggggaccc

SEQ ID NO: 2398816 - RNA, 23 nt, Human immunodeficiency virus 1 [HIV-1]
guaguaucaacucaacugcuguu

SEQ ID NO: 2398817 - RNA, 13 nt, Human immunodeficiency virus 1 [HIV-1]
aaaucucuggaac

SEQ ID NO: 2398818 - RNA, 13 nt, Human immunodeficiency virus 1 [HIV-1]
acccggagagaga

SEQ ID NO: 2398819 - RNA, 17 nt, Human immunodeficiency virus 1 [HIV-1]
gaccagaucugagccug

SEQ ID NO: 2398820 - RNA, 15 nt, Human immunodeficiency virus 1 [HIV-1]
gacagccgccuagca

SEQ ID NO: 2398821 - RNA, 20 nt, Human immunodeficiency virus 1 [HIV-1]
gcagaaaguaggaaaagcaa

SEQ ID NO: 2398822 - RNA, 17 nt, Human immunodeficiency virus 1 [HIV-1]
uacacaccagggccagg

SEQ ID NO: 2398823 - RNA, 18 nt, Human immunodeficiency virus 1 [HIV-1]
ugacaauggcagcaauuu

SEQ ID NO: 2398824 - RNA, 17 nt, Human immunodeficiency virus 1 [HIV-1]
agccugggagcucucug

SEQ ID NO: 2398825 - RNA, 15 nt, Human immunodeficiency virus 1 [HIV-1]
auuucacggacaaug

SEQ ID NO: 2398826 - RNA, 15 nt, Human immunodeficiency virus 1 [HIV-1]
cccugauuagcagaa

SEQ ID NO: 2398827 - RNA, 18 nt, Human immunodeficiency virus 1 [HIV-1]
aggagauaugagggacaa

SEQ ID NO: 2398828 - RNA, 19 nt, Human immunodeficiency virus 1 [HIV-1]
agccucaauaaagcuugcc

SEQ ID NO: 2398829 - RNA, 21 nt, Human immunodeficiency virus 1 [HIV-1]
caggauauguuacuaauagag

SEQ ID NO: 2398830 - RNA, 20 nt, Human immunodeficiency virus 1 [HIV-1]
aggaaaauaugcaagaauga

SEQ ID NO: 2398831 - RNA, 20 nt, Human immunodeficiency virus 1 [HIV-1]
agacauaauagcaacagaca

SEQ ID NO: 2398832 - RNA, 20 nt, Human immunodeficiency virus 1 [HIV-1]
ggaacuaaagaauagugcug

SEQ ID NO: 2398833 - RNA, 13 nt, Human immunodeficiency virus 1 [HIV-1]
auuaguagaaauu

SEQ ID NO: 2398834 - RNA, 20 nt, Human immunodeficiency virus 1 [HIV-1]
acuguaagggaaagaaugag

SEQ ID NO: 2398835 - RNA, 15 nt, Human immunodeficiency virus 1 [HIV-1]
gggaggcguggccug

SEQ ID NO: 2398836 - RNA, 15 nt, Human immunodeficiency virus 1 [HIV-1]
guggaacuucuggga

SEQ ID NO: 2398837 - RNA, 21 nt, Human immunodeficiency virus 1 [HIV-1]
gagagaaguguuagaguggag

SEQ ID NO: 2398838 - RNA, 19 nt, Human immunodeficiency virus 1 [HIV-1]
aggggcaguaguaauacaa

SEQ ID NO: 2398839 - RNA, 15 nt, Human immunodeficiency virus 1 [HIV-1]
ccacugcugugccuu

SEQ ID NO: 2398840 - RNA, 17 nt, Human immunodeficiency virus 1 [HIV-1]
accugccaccuguagua

SEQ ID NO: 2398841 - RNA, 13 nt, Human immunodeficiency virus 1 [HIV-1]
caacucacagucu

SEQ ID NO: 2398842 - RNA, 16 nt, Human immunodeficiency virus 1 [HIV-1]
gauuaaaguaaggcaa

SEQ ID NO: 2398843 - RNA, 15 nt, Human immunodeficiency virus 1 [HIV-1]
aucagaacagucaga

SEQ ID NO: 2398844 - RNA, 15 nt, Human immunodeficiency virus 1 [HIV-1]
agcaauacagcagcu

SEQ ID NO: 2398845 - RNA, 23 nt, Human immunodeficiency virus 1 [HIV-1]
agagagaaaaaagagcaguggga

SEQ ID NO: 2398846 - RNA, 19 nt, Human immunodeficiency virus 1 [HIV-1]
acagccauagcaguagcug

SEQ ID NO: 2398847 - RNA, 16 nt, Human immunodeficiency virus 1 [HIV-1]
gacuuacaaggcagcu

SEQ ID NO: 2398848 - RNA, 14 nt, Human immunodeficiency virus 1 [HIV-1]
ucugagccugggag

SEQ ID NO: 2398849 - RNA, 21 nt, Human immunodeficiency virus 1 [HIV-1]
guaauaccacuaacagaagaa

SEQ ID NO: 2398850 - RNA, 23 nt, Human immunodeficiency virus 1 [HIV-1]
gaaaaagaauccguauccagaga

SEQ ID NO: 2398851 - RNA, 21 nt, Human immunodeficiency virus 1 [HIV-1]
uaccaauaguagcaauaguag

SEQ ID NO: 2398852 - RNA, 16 nt, Human immunodeficiency virus 1 [HIV-1]
gacccggagagagaag

SEQ ID NO: 2398853 - RNA, 22 nt, Human immunodeficiency virus 1 [HIV-1]
uauagugcagcagcagaacaau

SEQ ID NO: 2398854 - RNA, 19 nt, Human immunodeficiency virus 1 [HIV-1]
cagauccugcauauaagca

SEQ ID NO: 2398855 - RNA, 13 nt, Human immunodeficiency virus 1 [HIV-1]
agaacaccagcuu

SEQ ID NO: 2398856 - RNA, 19 nt, Human immunodeficiency virus 1 [HIV-1]
agaggccaauaaaggagag

SEQ ID NO: 2398857 - RNA, 17 nt, Human immunodeficiency virus 1 [HIV-1]
aacaagaauuauuggaa

SEQ ID NO: 2398858 - RNA, 12 nt, Human immunodeficiency virus 1 [HIV-1]
gcagaaguuauu

SEQ ID NO: 2398859 - RNA, 19 nt, Human immunodeficiency virus 1 [HIV-1]
uagaacuggcagaaaacag

SEQ ID NO: 2398860 - RNA, 22 nt, Human immunodeficiency virus 1 [HIV-1]
ugauagacuaauagaaagagca

SEQ ID NO: 2398861 - RNA, 15 nt, Human immunodeficiency virus 1 [HIV-1]
auacaagaaaaagaa

SEQ ID NO: 2398862 - RNA, 18 nt, Human immunodeficiency virus 1 [HIV-1]
uagaagaggccaauaaag

SEQ ID NO: 2398863 - RNA, 15 nt, Human immunodeficiency virus 1 [HIV-1]
caucaagcagcucca

SEQ ID NO: 2398864 - RNA, 18 nt, Human immunodeficiency virus 1 [HIV-1]
auuagggauuauggaaaa

SEQ ID NO: 2398865 - RNA, 21 nt, Human immunodeficiency virus 1 [HIV-1]
caggaagucagccuaaaacug

SEQ ID NO: 2398866 - RNA, 13 nt, Human immunodeficiency virus 1 [HIV-1]
cucuucagcuacc

SEQ ID NO: 2398867 - RNA, 11 nt, Human immunodeficiency virus 1 [HIV-1]
gucucucuggu

SEQ ID NO: 2398868 - RNA, 22 nt, Human immunodeficiency virus 1 [HIV-1]
cacaguuuuaauuguggagggg

SEQ ID NO: 2398869 - RNA, 15 nt, Human immunodeficiency virus 1 [HIV-1]
agcuaguaccaguug

SEQ ID NO: 2398870 - RNA, 23 nt, Human immunodeficiency virus 1 [HIV-1]
cuccaggcaagaauccuggcugu

SEQ ID NO: 2398871 - RNA, 16 nt, Human immunodeficiency virus 1 [HIV-1]
uaaagaauuacaaaaa

SEQ ID NO: 2398872 - RNA, 13 nt, Human immunodeficiency virus 1 [HIV-1]
augcaagaaugag

SEQ ID NO: 2398873 - RNA, 21 nt, Human immunodeficiency virus 1 [HIV-1]
ccauccugauaaauggacagu

SEQ ID NO: 2398874 - RNA, 23 nt, Human immunodeficiency virus 1 [HIV-1]
ucccgcaggguuaaaaaagaaaa

SEQ ID NO: 2398875 - RNA, 23 nt, Human immunodeficiency virus 1 [HIV-1]
gauagcuagcaaauuaagagaac

SEQ ID NO: 2398876 - RNA, 14 nt, Human immunodeficiency virus 1 [HIV-1]
gcaaauuaagagaa

SEQ ID NO: 2398877 - RNA, 20 nt, Human immunodeficiency virus 1 [HIV-1]
auauaaaguaguaaaaauug

SEQ ID NO: 2398878 - RNA, 19 nt, Human immunodeficiency virus 1 [HIV-1]
cuauugaggcgcaacagca

SEQ ID NO: 2398879 - RNA, 21 nt, Human immunodeficiency virus 1 [HIV-1]
cuaauagaggaagacaaaaag

SEQ ID NO: 2398880 - RNA, 15 nt, Human immunodeficiency virus 1 [HIV-1]
gcuuaagccucaaua

SEQ ID NO: 2398881 - RNA, 16 nt, Human immunodeficiency virus 1 [HIV-1]
uguaugccccucccau

SEQ ID NO: 2398882 - RNA, 22 nt, Human immunodeficiency virus 1 [HIV-1]
uuaguaguagcaauaauaauag

SEQ ID NO: 2398883 - RNA, 18 nt, Human immunodeficiency virus 1 [HIV-1]
uacuaauaccaauaguag

SEQ ID NO: 2398884 - RNA, 18 nt, Human immunodeficiency virus 1 [HIV-1]
cugcauauaagcagcugc

SEQ ID NO: 2398885 - RNA, 15 nt, Human immunodeficiency virus 1 [HIV-1]
cagggauggaaagga

SEQ ID NO: 2398886 - RNA, 16 nt, Human immunodeficiency virus 1 [HIV-1]
gauacaguauuagaag

SEQ ID NO: 2398887 - RNA, 14 nt, Human immunodeficiency virus 1 [HIV-1]
cugagccagcagca

SEQ ID NO: 2398888 - RNA, 15 nt, Human immunodeficiency virus 1 [HIV-1]
uagacauaauagcaa

SEQ ID NO: 2398889 - RNA, 18 nt, Human immunodeficiency virus 1 [HIV-1]
aaagcuauagguacagua

SEQ ID NO: 2398890 - RNA, 22 nt, Human immunodeficiency virus 1 [HIV-1]
ugguuagaccagaucugagccu

SEQ ID NO: 2398891 - RNA, 22 nt, Human immunodeficiency virus 1 [HIV-1]
uuagaacauggaaaaguuuagu

SEQ ID NO: 2398892 - RNA, 15 nt, Human immunodeficiency virus 1 [HIV-1]
agaacaaaaauagag

SEQ ID NO: 2398893 - RNA, 21 nt, Human immunodeficiency virus 1 [HIV-1]
gcaaucacaaguagcaauaca

SEQ ID NO: 2398894 - RNA, 16 nt, Human immunodeficiency virus 1 [HIV-1]
agcugagccagcagca

SEQ ID NO: 2398895 - RNA, 14 nt, Human immunodeficiency virus 1 [HIV-1]
acaccaaaaaagau

SEQ ID NO: 2398896 - RNA, 15 nt, Human immunodeficiency virus 1 [HIV-1]
uaaagccauguguaa

SEQ ID NO: 2398897 - RNA, 15 nt, Human immunodeficiency virus 1 [HIV-1]
ugacauacagaaguu

SEQ ID NO: 2398898 - RNA, 18 nt, Human immunodeficiency virus 1 [HIV-1]
gcaaaaccagcaagaaaa

SEQ ID NO: 2398899 - RNA, 20 nt, Human immunodeficiency virus 1 [HIV-1]
uaauagcagaaauacagaag

SEQ ID NO: 2398900 - RNA, 20 nt, Human immunodeficiency virus 1 [HIV-1]
gcacaagaggaggaggaggu

SEQ ID NO: 2398901 - RNA, 13 nt, Human immunodeficiency virus 1 [HIV-1]
caaugccacagcc

SEQ ID NO: 2398902 - RNA, 24 nt, Human immunodeficiency virus 1 [HIV-1]
gaagucagccuaaaacugcuugua

SEQ ID NO: 2398903 - RNA, 12 nt, Human immunodeficiency virus 1 [HIV-1]
uggccugggcgg

SEQ ID NO: 2398904 - RNA, 20 nt, Human immunodeficiency virus 1 [HIV-1]
gauauccuugaucuguggau

SEQ ID NO: 2398905 - RNA, 16 nt, Human immunodeficiency virus 1 [HIV-1]
ccaguuagagaaagaa

SEQ ID NO: 2398906 - RNA, 23 nt, Human immunodeficiency virus 1 [HIV-1]
auucgauuagugaacggauccuu

SEQ ID NO: 2398907 - RNA, 15 nt, Human immunodeficiency virus 1 [HIV-1]
uaaccacagaaagca

SEQ ID NO: 2398908 - RNA, 24 nt, Human immunodeficiency virus 1 [HIV-1]
agaucugagccugggagcucucug

SEQ ID NO: 2398909 - RNA, 21 nt, Human immunodeficiency virus 1 [HIV-1]
uacuucaagaacugcugacau

SEQ ID NO: 2398910 - RNA, 21 nt, Human immunodeficiency virus 1 [HIV-1]
aacaugagaaauaucacagua

SEQ ID NO: 2398911 - RNA, 12 nt, Human immunodeficiency virus 1 [HIV-1]
ggagucaggaac

SEQ ID NO: 2398912 - RNA, 20 nt, Human immunodeficiency virus 1 [HIV-1]
agaccagaucugagccuggg

SEQ ID NO: 2398913 - RNA, 19 nt, Human immunodeficiency virus 1 [HIV-1]
auuagaacauggaaaaguu

SEQ ID NO: 2398914 - RNA, 13 nt, Human immunodeficiency virus 1 [HIV-1]
acaccagcuuguu

SEQ ID NO: 2398915 - RNA, 13 nt, Human immunodeficiency virus 1 [HIV-1]
aagacuuaauagc

SEQ ID NO: 2398916 - RNA, 13 nt, Human immunodeficiency virus 1 [HIV-1]
acagauagcuagc

SEQ ID NO: 2398917 - RNA, 16 nt, Human immunodeficiency virus 1 [HIV-1]
guacuucaagaacugc

SEQ ID NO: 2398918 - RNA, 20 nt, Human immunodeficiency virus 1 [HIV-1]
cagaucaaagugaaucagag

SEQ ID NO: 2398919 - RNA, 15 nt, Human immunodeficiency virus 1 [HIV-1]
auggagaaaggagag

SEQ ID NO: 2398920 - RNA, 14 nt, Human immunodeficiency virus 1 [HIV-1]
auggagccaguaga

SEQ ID NO: 2398921 - RNA, 21 nt, Human immunodeficiency virus 1 [HIV-1]
uuagagccuuuuagaaaacaa

SEQ ID NO: 2398922 - RNA, 17 nt, Human immunodeficiency virus 1 [HIV-1]
uaacgaggauuguggaa

SEQ ID NO: 2398923 - RNA, 17 nt, Human immunodeficiency virus 1 [HIV-1]
gggcaaguuuguggaau

SEQ ID NO: 2398924 - RNA, 17 nt, Human immunodeficiency virus 1 [HIV-1]
gacccagaaauuguaac

SEQ ID NO: 2398925 - RNA, 12 nt, Human immunodeficiency virus 1 [HIV-1]
cacaagaaguag

SEQ ID NO: 2398926 - RNA, 21 nt, Human immunodeficiency virus 1 [HIV-1]
ccuuggguucuugggagcagc

SEQ ID NO: 2398927 - RNA, 14 nt, Human immunodeficiency virus 1 [HIV-1]
aguggcgagcccuc

SEQ ID NO: 2398928 - RNA, 11 nt, Human immunodeficiency virus 1 [HIV-1]
gaccaaugacu

SEQ ID NO: 2398929 - RNA, 21 nt, Human immunodeficiency virus 1 [HIV-1]
ugaauugggcaagucagauuu

SEQ ID NO: 2398930 - RNA, 16 nt, Human immunodeficiency virus 1 [HIV-1]
gaaagaauaguagaca

SEQ ID NO: 2398931 - RNA, 18 nt, Human immunodeficiency virus 1 [HIV-1]
gaaaguaggaaaagcaau

SEQ ID NO: 2398932 - RNA, 14 nt, Human immunodeficiency virus 1 [HIV-1]
aaaacaaaauccag

SEQ ID NO: 2398933 - RNA, 15 nt, Human immunodeficiency virus 1 [HIV-1]
caguauuagaagaaa

SEQ ID NO: 2398934 - RNA, 14 nt, Human immunodeficiency virus 1 [HIV-1]
agcagaacuacaca

SEQ ID NO: 2398935 - RNA, 14 nt, Human immunodeficiency virus 1 [HIV-1]
uuggaagaaaucug

SEQ ID NO: 2398936 - RNA, 17 nt, Human immunodeficiency virus 1 [HIV-1]
gugcuuccacagggaug

SEQ ID NO: 2398937 - RNA, 23 nt, Human immunodeficiency virus 1 [HIV-1]
aaacugcccauacaaaaggaaac

SEQ ID NO: 2398938 - RNA, 12 nt, Human immunodeficiency virus 1 [HIV-1]
cuuggaaaggau

SEQ ID NO: 2398939 - RNA, 16 nt, Human immunodeficiency virus 1 [HIV-1]
auuaagacaaagaaaa

SEQ ID NO: 2398940 - RNA, 22 nt, Human immunodeficiency virus 1 [HIV-1]
cagacucugcuauaagaaaggc

SEQ ID NO: 2398941 - RNA, 21 nt, Human immunodeficiency virus 1 [HIV-1]
gguuagaccagaucugagccu

SEQ ID NO: 2398942 - RNA, 16 nt, Human immunodeficiency virus 1 [HIV-1]
agggccacagagggag

SEQ ID NO: 2398943 - RNA, 20 nt, Human immunodeficiency virus 1 [HIV-1]
agccugggagcucucuggcu

SEQ ID NO: 2398944 - RNA, 20 nt, Human immunodeficiency virus 1 [HIV-1]
cuaauagaggaagacaaaaa

SEQ ID NO: 2398945 - RNA, 13 nt, Human immunodeficiency virus 1 [HIV-1]
uagacuaauagaa

SEQ ID NO: 2398946 - RNA, 18 nt, Human immunodeficiency virus 1 [HIV-1]
aguaauaaaucucuggaa

SEQ ID NO: 2398947 - RNA, 22 nt, Human immunodeficiency virus 1 [HIV-1]
acagauaggguuauagaaguag

SEQ ID NO: 2398948 - RNA, 19 nt, Human immunodeficiency virus 1 [HIV-1]
cagagcuagaacuggcaga

SEQ ID NO: 2398949 - RNA, 14 nt, Human immunodeficiency virus 1 [HIV-1]
gacagagacagauc

SEQ ID NO: 2398950 - RNA, 21 nt, Human immunodeficiency virus 1 [HIV-1]
ucaucacguggcccgagagcu

SEQ ID NO: 2398951 - RNA, 18 nt, Human immunodeficiency virus 1 [HIV-1]
caguagcugaggggacag

SEQ ID NO: 2398952 - RNA, 19 nt, Human immunodeficiency virus 1 [HIV-1]
gagaucuucagaccuggag

SEQ ID NO: 2398953 - RNA, 16 nt, Human immunodeficiency virus 1 [HIV-1]
augaguuugccaggaa

SEQ ID NO: 2398954 - RNA, 13 nt, Human immunodeficiency virus 1 [HIV-1]
cguggccugggcg

SEQ ID NO: 2398955 - RNA, 14 nt, Human immunodeficiency virus 1 [HIV-1]
ugaggcgcaacagc

SEQ ID NO: 2398956 - RNA, 22 nt, Human immunodeficiency virus 1 [HIV-1]
ugagacgagcugagccagcagc

SEQ ID NO: 2398957 - RNA, 20 nt, Human immunodeficiency virus 1 [HIV-1]
auaagagguaaggugcagaa

SEQ ID NO: 2398958 - RNA, 23 nt, Human immunodeficiency virus 1 [HIV-1]
caggcccgaaggaauagaagaag

SEQ ID NO: 2398959 - RNA, 22 nt, Human immunodeficiency virus 1 [HIV-1]
uauccacugaccuuuggauggu

SEQ ID NO: 2398960 - RNA, 15 nt, Human immunodeficiency virus 1 [HIV-1]
gcaaauuaagagaac

SEQ ID NO: 2398961 - RNA, 19 nt, Human immunodeficiency virus 1 [HIV-1]
accuggauggagugggaca

SEQ ID NO: 2398962 - RNA, 16 nt, Human immunodeficiency virus 1 [HIV-1]
uggaaucuccuacagu

SEQ ID NO: 2398963 - RNA, 15 nt, Human immunodeficiency virus 1 [HIV-1]
gaagcacaagaggag

SEQ ID NO: 2398964 - RNA, 15 nt, Human immunodeficiency virus 1 [HIV-1]
ccagaucugagccug

SEQ ID NO: 2398965 - RNA, 19 nt, Human immunodeficiency virus 1 [HIV-1]
agauccugcauauaagcag

SEQ ID NO: 2398966 - RNA, 18 nt, Human immunodeficiency virus 1 [HIV-1]
ccugauuagcagaacuac

SEQ ID NO: 2398967 - RNA, 21 nt, Human immunodeficiency virus 1 [HIV-1]
acuuacaaggcagcuguagau

SEQ ID NO: 2398968 - RNA, 23 nt, Human immunodeficiency virus 1 [HIV-1]
agccaguggauauauagaagcag

SEQ ID NO: 2398969 - RNA, 14 nt, Human immunodeficiency virus 1 [HIV-1]
cuguguggaaggaa

SEQ ID NO: 2398970 - RNA, 16 nt, Human immunodeficiency virus 1 [HIV-1]
cagaucugagccuggg

SEQ ID NO: 2398971 - RNA, 22 nt, Human immunodeficiency virus 1 [HIV-1]
gauaaagccaccuuugccuagu

SEQ ID NO: 2398972 - RNA, 19 nt, Human immunodeficiency virus 1 [HIV-1]
cuguacugggucucucugg

SEQ ID NO: 2398973 - RNA, 20 nt, Human immunodeficiency virus 1 [HIV-1]
ugggaagcccucaaauauug

SEQ ID NO: 2398974 - RNA, 20 nt, Human immunodeficiency virus 1 [HIV-1]
uaacaaauuggcugugguau

SEQ ID NO: 2398975 - RNA, 19 nt, Human immunodeficiency virus 1 [HIV-1]
uaauacacuccuuaauuga

SEQ ID NO: 2398976 - RNA, 13 nt, Human immunodeficiency virus 1 [HIV-1]
uccagucacaccu

SEQ ID NO: 2398977 - RNA, 21 nt, Human immunodeficiency virus 1 [HIV-1]
uaaauggcagucuagcagaag

SEQ ID NO: 2398978 - RNA, 15 nt, Human immunodeficiency virus 1 [HIV-1]
cacugaccuuuggau

SEQ ID NO: 2398979 - RNA, 17 nt, Human immunodeficiency virus 1 [HIV-1]
ucuggcuaacuagggaa

SEQ ID NO: 2398980 - RNA, 14 nt, Human immunodeficiency virus 1 [HIV-1]
auaauaaaacaaua

SEQ ID NO: 2398981 - RNA, 18 nt, Human immunodeficiency virus 1 [HIV-1]
caguaaguaguacaugua

SEQ ID NO: 2398982 - RNA, 15 nt, Human immunodeficiency virus 1 [HIV-1]
cauagaauauaggaa

SEQ ID NO: 2398983 - RNA, 15 nt, Human immunodeficiency virus 1 [HIV-1]
gauuagcagaacuac

SEQ ID NO: 2398984 - RNA, 13 nt, Human immunodeficiency virus 1 [HIV-1]
gggcgggacuggg

SEQ ID NO: 2398985 - RNA, 19 nt, Human immunodeficiency virus 1 [HIV-1]
aagaguggugcagagagaa

SEQ ID NO: 2398986 - RNA, 17 nt, Human immunodeficiency virus 1 [HIV-1]
cgggaaucaagcaggaa

SEQ ID NO: 2398987 - RNA, 19 nt, Human immunodeficiency virus 1 [HIV-1]
ugcauccggaguacuucaa

SEQ ID NO: 2398988 - RNA, 14 nt, Human immunodeficiency virus 1 [HIV-1]
gagccagcagcaga

SEQ ID NO: 2398989 - RNA, 20 nt, Human immunodeficiency virus 1 [HIV-1]
auagaggaagacaaaaaguu

SEQ ID NO: 2398990 - RNA, 18 nt, Human immunodeficiency virus 1 [HIV-1]
augagacgagcugagcca

SEQ ID NO: 2398991 - RNA, 21 nt, Human immunodeficiency virus 1 [HIV-1]
agcagcagauagggugggagc

SEQ ID NO: 2398992 - RNA, 18 nt, Human immunodeficiency virus 1 [HIV-1]
uaacacuuuaaaacagau

SEQ ID NO: 2398993 - RNA, 13 nt, Human immunodeficiency virus 1 [HIV-1]
acaggaccaugua

SEQ ID NO: 2398994 - RNA, 16 nt, Human immunodeficiency virus 1 [HIV-1]
aaagcuugccuugagu

SEQ ID NO: 2398995 - RNA, 14 nt, Human immunodeficiency virus 1 [HIV-1]
agagguacauaaug

SEQ ID NO: 2398996 - RNA, 21 nt, Human immunodeficiency virus 1 [HIV-1]
cagaggagagcaagaaaugga

SEQ ID NO: 2398997 - RNA, 19 nt, Human immunodeficiency virus 1 [HIV-1]
ucaaucaaauaauagagca

SEQ ID NO: 2398998 - RNA, 18 nt, Human immunodeficiency virus 1 [HIV-1]
agggcuaauucacuccca

SEQ ID NO: 2398999 - RNA, 14 nt, Human immunodeficiency virus 1 [HIV-1]
uaugccccucccau

SEQ ID NO: 2399000 - RNA, 20 nt, Human immunodeficiency virus 1 [HIV-1]
ccaguggauauauagaagca

SEQ ID NO: 2399001 - RNA, 15 nt, Human immunodeficiency virus 1 [HIV-1]
aaauauuacagggcu

SEQ ID NO: 2399002 - RNA, 19 nt, Human immunodeficiency virus 1 [HIV-1]
uuuagaaggaaaaguuauc

SEQ ID NO: 2399003 - RNA, 19 nt, Human immunodeficiency virus 1 [HIV-1]
gcaacagcaucuguugcaa

SEQ ID NO: 2399004 - RNA, 18 nt, Human immunodeficiency virus 1 [HIV-1]
gcacaagcauaagaggua

SEQ ID NO: 2399005 - RNA, 18 nt, Human immunodeficiency virus 1 [HIV-1]
uggggacuuuccagggag

SEQ ID NO: 2399006 - RNA, 20 nt, Human immunodeficiency virus 1 [HIV-1]
gaacuacacaccagggccag

SEQ ID NO: 2399007 - RNA, 16 nt, Human immunodeficiency virus 1 [HIV-1]
auauguuacuaauaga

SEQ ID NO: 2399008 - RNA, 22 nt, Human immunodeficiency virus 1 [HIV-1]
agaaaauuuuaacauguggaaa

SEQ ID NO: 2399009 - RNA, 13 nt, Human immunodeficiency virus 1 [HIV-1]
uaccuagaagaau

SEQ ID NO: 2399010 - RNA, 20 nt, Human immunodeficiency virus 1 [HIV-1]
cgaagagcucaucagaacag

SEQ ID NO: 2399011 - RNA, 21 nt, Human immunodeficiency virus 1 [HIV-1]
auuaauaacaccaaaaaagau

SEQ ID NO: 2399012 - RNA, 16 nt, Human immunodeficiency virus 1 [HIV-1]
cacuuuaaaacagaua

SEQ ID NO: 2399013 - RNA, 17 nt, Human immunodeficiency virus 1 [HIV-1]
gccucuucagcuaccac

SEQ ID NO: 2399014 - RNA, 16 nt, Human immunodeficiency virus 1 [HIV-1]
augucagcuaaaagga

SEQ ID NO: 2399015 - RNA, 20 nt, Human immunodeficiency virus 1 [HIV-1]
caauggaacaggaccaugua

SEQ ID NO: 2399016 - RNA, 16 nt, Human immunodeficiency virus 1 [HIV-1]
agggagucuccauaga

SEQ ID NO: 2399017 - RNA, 18 nt, Human immunodeficiency virus 1 [HIV-1]
uagaccagaucugagccu

SEQ ID NO: 2399018 - RNA, 22 nt, Human immunodeficiency virus 1 [HIV-1]
auccugcauauaagcagcugcu

SEQ ID NO: 2399019 - RNA, 18 nt, Human immunodeficiency virus 1 [HIV-1]
ccucaggaggggacccag

SEQ ID NO: 2399020 - RNA, 15 nt, Human immunodeficiency virus 1 [HIV-1]
acuuaauaagagaac

SEQ ID NO: 2399021 - RNA, 23 nt, Human immunodeficiency virus 1 [HIV-1]
ugcugacaucgagcuugcuacaa

SEQ ID NO: 2399022 - RNA, 14 nt, Human immunodeficiency virus 1 [HIV-1]
agacauaauagcaa

SEQ ID NO: 2399023 - RNA, 23 nt, Human immunodeficiency virus 1 [HIV-1]
ggggauuugggguugcucuggaa

SEQ ID NO: 2399024 - RNA, 17 nt, Human immunodeficiency virus 1 [HIV-1]
accaccgcuugagagac

SEQ ID NO: 2399025 - RNA, 17 nt, Human immunodeficiency virus 1 [HIV-1]
gacuaauagaaagagca

SEQ ID NO: 2399026 - RNA, 22 nt, Human immunodeficiency virus 1 [HIV-1]
auugguuuaacauaacaaauug

SEQ ID NO: 2399027 - RNA, 16 nt, Human immunodeficiency virus 1 [HIV-1]
ggcaaugagagugaag

SEQ ID NO: 2399028 - RNA, 18 nt, Human immunodeficiency virus 1 [HIV-1]
ugggguaccuguguggaa

SEQ ID NO: 2399029 - RNA, 22 nt, Human immunodeficiency virus 1 [HIV-1]
cuacuucccugauuagcagaac

SEQ ID NO: 2399030 - RNA, 16 nt, Human immunodeficiency virus 1 [HIV-1]
gugaauaucaagcagg

SEQ ID NO: 2399031 - RNA, 16 nt, Human immunodeficiency virus 1 [HIV-1]
gcaggaagaagcggag

SEQ ID NO: 2399032 - RNA, 17 nt, Human immunodeficiency virus 1 [HIV-1]
gccaggggucagauauc

SEQ ID NO: 2399033 - RNA, 21 nt, Human immunodeficiency virus 1 [HIV-1]
gaacaagccccagaagaccaa

SEQ ID NO: 2399034 - RNA, 16 nt, Human immunodeficiency virus 1 [HIV-1]
cuggcuguggaaagau

SEQ ID NO: 2399035 - RNA, 14 nt, Human immunodeficiency virus 1 [HIV-1]
cauguggaaaaaug

SEQ ID NO: 2399036 - RNA, 12 nt, Human immunodeficiency virus 1 [HIV-1]
agcagcaggaag

SEQ ID NO: 2399037 - RNA, 14 nt, Human immunodeficiency virus 1 [HIV-1]
gggaacccacugcu

SEQ ID NO: 2399038 - RNA, 22 nt, Human immunodeficiency virus 1 [HIV-1]
aucccgcaggguuaaaaaagaa

SEQ ID NO: 2399039 - RNA, 13 nt, Human immunodeficiency virus 1 [HIV-1]
uagcagaaauaca

SEQ ID NO: 2399040 - RNA, 19 nt, Human immunodeficiency virus 1 [HIV-1]
cuacuucccugauuagcag

SEQ ID NO: 2399041 - RNA, 18 nt, Human immunodeficiency virus 1 [HIV-1]
agaggccaauaaaggaga

SEQ ID NO: 2399042 - RNA, 18 nt, Human immunodeficiency virus 1 [HIV-1]
agacaguaugaucagaua

SEQ ID NO: 2399043 - RNA, 14 nt, Human immunodeficiency virus 1 [HIV-1]
agauagggugggag

SEQ ID NO: 2399044 - RNA, 16 nt, Human immunodeficiency virus 1 [HIV-1]
aacauguggcagaaag

SEQ ID NO: 2399045 - RNA, 19 nt, Human immunodeficiency virus 1 [HIV-1]
agaaauuguaacgcacagu

SEQ ID NO: 2399046 - RNA, 18 nt, Human immunodeficiency virus 1 [HIV-1]
cuucccugauuagcagaa

SEQ ID NO: 2399047 - RNA, 15 nt, Human immunodeficiency virus 1 [HIV-1]
cagaacuacacacca

SEQ ID NO: 2399048 - RNA, 15 nt, Human immunodeficiency virus 1 [HIV-1]
auguggcagaaagua

SEQ ID NO: 2399049 - RNA, 18 nt, Human immunodeficiency virus 1 [HIV-1]
ggacuuuccgcuggggac

SEQ ID NO: 2399050 - RNA, 19 nt, Human immunodeficiency virus 1 [HIV-1]
cgcaggguuaaaaaagaaa

SEQ ID NO: 2399051 - RNA, 16 nt, Human immunodeficiency virus 1 [HIV-1]
gaugacccggagagag

SEQ ID NO: 2399052 - RNA, 14 nt, Human immunodeficiency virus 1 [HIV-1]
acucgacagaggag

SEQ ID NO: 2399053 - RNA, 15 nt, Human immunodeficiency virus 1 [HIV-1]
cuggcuagaagcaca

SEQ ID NO: 2399054 - RNA, 16 nt, Human immunodeficiency virus 1 [HIV-1]
guggaacuucugggac

SEQ ID NO: 2399055 - RNA, 17 nt, Human immunodeficiency virus 1 [HIV-1]
caaucacaaguagcaau

SEQ ID NO: 2399056 - RNA, 22 nt, Human immunodeficiency virus 1 [HIV-1]
gcacugauuugaagaaugauac

SEQ ID NO: 2399057 - RNA, 18 nt, Human immunodeficiency virus 1 [HIV-1]
gacaaguagacuguaguc

SEQ ID NO: 2399058 - RNA, 18 nt, Human immunodeficiency virus 1 [HIV-1]
acaaguagcaauacagca

SEQ ID NO: 2399059 - RNA, 13 nt, Human immunodeficiency virus 1 [HIV-1]
ccacuaacagaag

SEQ ID NO: 2399060 - RNA, 16 nt, Human immunodeficiency virus 1 [HIV-1]
cuaauagaaagagcag

SEQ ID NO: 2399061 - RNA, 13 nt, Human immunodeficiency virus 1 [HIV-1]
cauagaacaaaaa

SEQ ID NO: 2399062 - RNA, 14 nt, Human immunodeficiency virus 1 [HIV-1]
aggagaaauaucag

SEQ ID NO: 2399063 - RNA, 20 nt, Human immunodeficiency virus 1 [HIV-1]
acuagagcuuuuagaggagc

SEQ ID NO: 2399064 - RNA, 23 nt, Human immunodeficiency virus 1 [HIV-1]
uggcaggaagaagcggagacagc

SEQ ID NO: 2399065 - RNA, 20 nt, Human immunodeficiency virus 1 [HIV-1]
ccaaagaagacaagauaucc

SEQ ID NO: 2399066 - RNA, 15 nt, Human immunodeficiency virus 1 [HIV-1]
cacaaguagcaauac

SEQ ID NO: 2399067 - RNA, 17 nt, Human immunodeficiency virus 1 [HIV-1]
gaaugagacgagcugag

SEQ ID NO: 2399068 - RNA, 13 nt, Human immunodeficiency virus 1 [HIV-1]
gaaaaaagagcag

SEQ ID NO: 2399069 - RNA, 15 nt, Human immunodeficiency virus 1 [HIV-1]
agaccagaucugagc

SEQ ID NO: 2399070 - RNA, 17 nt, Human immunodeficiency virus 1 [HIV-1]
guaccaguugagccaga

SEQ ID NO: 2399071 - RNA, 16 nt, Human immunodeficiency virus 1 [HIV-1]
uaaucauagaauauag

SEQ ID NO: 2399072 - RNA, 13 nt, Human immunodeficiency virus 1 [HIV-1]
acaagaauuauug

SEQ ID NO: 2399073 - RNA, 13 nt, Human immunodeficiency virus 1 [HIV-1]
ucauagaaaucug

SEQ ID NO: 2399074 - RNA, 17 nt, Human immunodeficiency virus 1 [HIV-1]
acgaucugcggagccug

SEQ ID NO: 2399075 - RNA, 20 nt, Human immunodeficiency virus 1 [HIV-1]
gaaaaaauaaaagcauuagu

SEQ ID NO: 2399076 - RNA, 23 nt, Human immunodeficiency virus 1 [HIV-1]
auggccuacuguaagggaaagaa

SEQ ID NO: 2399077 - RNA, 13 nt, Human immunodeficiency virus 1 [HIV-1]
ucagaacagucag

SEQ ID NO: 2399078 - RNA, 18 nt, Human immunodeficiency virus 1 [HIV-1]
ucaagcaggacauaacaa

SEQ ID NO: 2399079 - RNA, 14 nt, Human immunodeficiency virus 1 [HIV-1]
aggaccauguacaa

SEQ ID NO: 2399080 - RNA, 16 nt, Human immunodeficiency virus 1 [HIV-1]
uaauuggagagcaaug

SEQ ID NO: 2399081 - RNA, 17 nt, Human immunodeficiency virus 1 [HIV-1]
guuagcuugcucaaugc

SEQ ID NO: 2399082 - RNA, 13 nt, Human immunodeficiency virus 1 [HIV-1]
gauuagcagaacu

SEQ ID NO: 2399083 - RNA, 16 nt, Human immunodeficiency virus 1 [HIV-1]
cagggcuuggaaagga

SEQ ID NO: 2399084 - RNA, 21 nt, Human immunodeficiency virus 1 [HIV-1]
cucagauccugcauauaagca

SEQ ID NO: 2399085 - RNA, 13 nt, Human immunodeficiency virus 1 [HIV-1]
acccugugagccu

SEQ ID NO: 2399086 - RNA, 23 nt, Human immunodeficiency virus 1 [HIV-1]
auacagcagcuaccaaugcugcu

SEQ ID NO: 2399087 - RNA, 19 nt, Human immunodeficiency virus 1 [HIV-1]
gaagaguggugcagagaga

SEQ ID NO: 2399088 - RNA, 21 nt, Human immunodeficiency virus 1 [HIV-1]
cagauaggguuauagaaguag

SEQ ID NO: 2399089 - RNA, 21 nt, Human immunodeficiency virus 1 [HIV-1]
cagcagauagggugggagcag

SEQ ID NO: 2399090 - RNA, 15 nt, Human immunodeficiency virus 1 [HIV-1]
gaggcguggccuggg

SEQ ID NO: 2399091 - RNA, 22 nt, Human immunodeficiency virus 1 [HIV-1]
cacaaguagcaauacagcagcu

SEQ ID NO: 2399092 - RNA, 22 nt, Human immunodeficiency virus 1 [HIV-1]
cagaaauccacuuuggaaagga

SEQ ID NO: 2399093 - RNA, 14 nt, Human immunodeficiency virus 1 [HIV-1]
ugcaugggauggau

SEQ ID NO: 2399094 - RNA, 15 nt, Human immunodeficiency virus 1 [HIV-1]
auugacagaagaaaa

SEQ ID NO: 2399095 - RNA, 20 nt, Human immunodeficiency virus 1 [HIV-1]
acaucagaaagaaccuccau

SEQ ID NO: 2399096 - RNA, 13 nt, Human immunodeficiency virus 1 [HIV-1]
cgaaggaauagaa

SEQ ID NO: 2399097 - RNA, 12 nt, Human immunodeficiency virus 1 [HIV-1]
cagcagcagaac

SEQ ID NO: 2399098 - RNA, 13 nt, Human immunodeficiency virus 1 [HIV-1]
caaauuaagagaa

SEQ ID NO: 2399099 - RNA, 22 nt, Human immunodeficiency virus 1 [HIV-1]
aaagaauagugcuguuagcuug

SEQ ID NO: 2399100 - RNA, 15 nt, Human immunodeficiency virus 1 [HIV-1]
gaucugagccuggga

SEQ ID NO: 2399101 - RNA, 18 nt, Human immunodeficiency virus 1 [HIV-1]
ccuuuuagaaaacaaaau

SEQ ID NO: 2399102 - RNA, 18 nt, Human immunodeficiency virus 1 [HIV-1]
agguauccuuugagccaa

SEQ ID NO: 2399103 - RNA, 23 nt, Human immunodeficiency virus 1 [HIV-1]
ggaauaacacuuuaaaacagaua

SEQ ID NO: 2399104 - RNA, 17 nt, Human immunodeficiency virus 1 [HIV-1]
augagagugaaggagaa

SEQ ID NO: 2399105 - RNA, 15 nt, Human immunodeficiency virus 1 [HIV-1]
aaauaugcaagaaug

SEQ ID NO: 2399106 - RNA, 18 nt, Human immunodeficiency virus 1 [HIV-1]
cccugugagccugcaugg

SEQ ID NO: 2399107 - RNA, 23 nt, Human immunodeficiency virus 1 [HIV-1]
cauggguaccagcacacaaagga

SEQ ID NO: 2399108 - RNA, 18 nt, Human immunodeficiency virus 1 [HIV-1]
cuauaccaauaguagcaa

SEQ ID NO: 2399109 - RNA, 11 nt, Human immunodeficiency virus 1 [HIV-1]
ugcugugccuu

SEQ ID NO: 2399110 - RNA, 23 nt, Human immunodeficiency virus 1 [HIV-1]
ccuggggauuugggguugcucug

SEQ ID NO: 2399111 - RNA, 22 nt, Human immunodeficiency virus 1 [HIV-1]
aguggcaaugagagugaaggag

SEQ ID NO: 2399112 - RNA, 13 nt, Human immunodeficiency virus 1 [HIV-1]
aagaagguggaga

SEQ ID NO: 2399113 - RNA, 21 nt, Human immunodeficiency virus 1 [HIV-1]
augaauaaagaauuaaagaaa

SEQ ID NO: 2399114 - RNA, 13 nt, Human immunodeficiency virus 1 [HIV-1]
uuaagaccaauga

SEQ ID NO: 2399115 - RNA, 17 nt, Human immunodeficiency virus 2 (HIV-2)
aguaccacggagagaaa

SEQ ID NO: 2399116 - RNA, 14 nt, Human immunodeficiency virus 2 (HIV-2)
ggcagacggcucca

SEQ ID NO: 2399117 - RNA, 15 nt, Human immunodeficiency virus 2 (HIV-2)
gauguagauucugau

SEQ ID NO: 2399118 - RNA, 20 nt, Human immunodeficiency virus 2 (HIV-2)
accggggacagccagccaac

SEQ ID NO: 2399119 - RNA, 20 nt, Human immunodeficiency virus 2 (HIV-2)
uccuugcccagcugcaccga

SEQ ID NO: 2399120 - RNA, 15 nt, Human immunodeficiency virus 2 (HIV-2)
gucuguuaggacccu

SEQ ID NO: 2399121 - RNA, 13 nt, Human immunodeficiency virus 2 (HIV-2)
ucaggcagggagc

SEQ ID NO: 2399122 - RNA, 23 nt, Human immunodeficiency virus 2 (HIV-2)
caacagauccauauccacaagga

SEQ ID NO: 2399123 - RNA, 18 nt, Human immunodeficiency virus 2 (HIV-2)
uggcaggagugggagaaa

SEQ ID NO: 2399124 - RNA, 14 nt, Human immunodeficiency virus 2 (HIV-2)
gauagugcagcaac

SEQ ID NO: 2399125 - RNA, 24 nt, Human immunodeficiency virus 2 (HIV-2)
cggagaggcuggcagaucgagccc

SEQ ID NO: 2399126 - RNA, 22 nt, Human immunodeficiency virus 2 (HIV-2)
auacagugcuugccagacaaug

SEQ ID NO: 2399127 - RNA, 20 nt, Human immunodeficiency virus 2 (HIV-2)
cauaugagcgaaagggcaga

SEQ ID NO: 2399128 - RNA, 17 nt, Human immunodeficiency virus 2 (HIV-2)
auucaauauggagugca

SEQ ID NO: 2399129 - RNA, 18 nt, Human immunodeficiency virus 2 (HIV-2)
ggaagccaugcaggaggu

SEQ ID NO: 2399130 - RNA, 19 nt, Human immunodeficiency virus 2 (HIV-2)
cuaugagguuuagauacug

SEQ ID NO: 2399131 - RNA, 14 nt, Human immunodeficiency virus 2 (HIV-2)
uaguaguacaacaa

SEQ ID NO: 2399132 - RNA, 21 nt, Human immunodeficiency virus 2 (HIV-2)
gcagccuccauaauaaaugaa

SEQ ID NO: 2399133 - RNA, 19 nt, Human immunodeficiency virus 2 (HIV-2)
acagaggcuuuugaugcau

SEQ ID NO: 2399134 - RNA, 14 nt, Human immunodeficiency virus 2 (HIV-2)
uccugauccaccua

SEQ ID NO: 2399135 - RNA, 12 nt, Human immunodeficiency virus 2 (HIV-2)
aacaaggagaag

SEQ ID NO: 2399136 - RNA, 14 nt, Human immunodeficiency virus 2 (HIV-2)
cgguacugggcaga

SEQ ID NO: 2399137 - RNA, 15 nt, Human immunodeficiency virus 2 (HIV-2)
agucgcucugcggag

SEQ ID NO: 2399138 - RNA, 20 nt, Human immunodeficiency virus 2 (HIV-2)
gcaccuacagaucagagaag

SEQ ID NO: 2399139 - RNA, 17 nt, Human immunodeficiency virus 2 (HIV-2)
gcaacagaaagacagaa

SEQ ID NO: 2399140 - RNA, 17 nt, Human immunodeficiency virus 2 (HIV-2)
acaagaaaagaauaugu

SEQ ID NO: 2399141 - RNA, 18 nt, Human immunodeficiency virus 2 (HIV-2)
gccuggguguucccugcu

SEQ ID NO: 2399142 - RNA, 23 nt, Human immunodeficiency virus 2 (HIV-2)
gcacaagucaggauugccagaga

SEQ ID NO: 2399143 - RNA, 13 nt, Human immunodeficiency virus 2 (HIV-2)
aaguaagaagagc

SEQ ID NO: 2399144 - RNA, 19 nt, Human immunodeficiency virus 2 (HIV-2)
ucacucuguacccagaaga

SEQ ID NO: 2399145 - RNA, 19 nt, Human immunodeficiency virus 2 (HIV-2)
ggaaacaguggagaagaga

SEQ ID NO: 2399146 - RNA, 16 nt, Human immunodeficiency virus 2 (HIV-2)
cuuaguacacccagca

SEQ ID NO: 2399147 - RNA, 16 nt, Human immunodeficiency virus 2 (HIV-2)
uauaccuagaaaaaga

SEQ ID NO: 2399148 - RNA, 20 nt, Human immunodeficiency virus 2 (HIV-2)
ucccuuauuuugugcaacua

SEQ ID NO: 2399149 - RNA, 13 nt, Human immunodeficiency virus 2 (HIV-2)
ccuagaaaaagag

SEQ ID NO: 2399150 - RNA, 18 nt, Human immunodeficiency virus 2 (HIV-2)
gacaagugaguauggagc

SEQ ID NO: 2399151 - RNA, 12 nt, Human immunodeficiency virus 2 (HIV-2)
ccuagggaaggg

SEQ ID NO: 2399152 - RNA, 16 nt, Human immunodeficiency virus 2 (HIV-2)
gggacuuagggaguga

SEQ ID NO: 2399153 - RNA, 18 nt, Human immunodeficiency virus 2 (HIV-2)
gcaaugugaguucaauau

SEQ ID NO: 2399154 - RNA, 20 nt, Human immunodeficiency virus 2 (HIV-2)
gacagcaguaucagcaggga

SEQ ID NO: 2399155 - RNA, 18 nt, Human immunodeficiency virus 2 (HIV-2)
aacccagcaacagaaaga

SEQ ID NO: 2399156 - RNA, 22 nt, Human immunodeficiency virus 2 (HIV-2)
gacagcaguaucagcagggaga

SEQ ID NO: 2399157 - RNA, 17 nt, Human immunodeficiency virus 2 (HIV-2)
cgaguggauccaagaag

SEQ ID NO: 2399158 - RNA, 21 nt, Human immunodeficiency virus 2 (HIV-2)
gagacuuacuauccaagaacu

SEQ ID NO: 2399159 - RNA, 13 nt, Human immunodeficiency virus 2 (HIV-2)
agaguacaugaac

SEQ ID NO: 2399160 - RNA, 16 nt, Human immunodeficiency virus 2 (HIV-2)
gacucucaccaguacu

SEQ ID NO: 2399161 - RNA, 18 nt, Human immunodeficiency virus 2 (HIV-2)
uguucccaucucuccuag

SEQ ID NO: 2399162 - RNA, 22 nt, Human immunodeficiency virus 2 (HIV-2)
uguguguucccaucucuccuag

SEQ ID NO: 2399163 - RNA, 12 nt, Human immunodeficiency virus 2 (HIV-2)
agggacagcagu

SEQ ID NO: 2399164 - RNA, 18 nt, Human immunodeficiency virus 2 (HIV-2)
aaaaugacagaccccaga

SEQ ID NO: 2399165 - RNA, 19 nt, Human immunodeficiency virus 2 (HIV-2)
cagucaaaguuuagaagaa

SEQ ID NO: 2399166 - RNA, 14 nt, Human immunodeficiency virus 2 (HIV-2)
caucagaggggaaa

SEQ ID NO: 2399167 - RNA, 14 nt, Human immunodeficiency virus 2 (HIV-2)
gcagaggaagauga

SEQ ID NO: 2399168 - RNA, 12 nt, Human immunodeficiency virus 2 (HIV-2)
aguacacccagc

SEQ ID NO: 2399169 - RNA, 14 nt, Human immunodeficiency virus 2 (HIV-2)
uuacaguaggagga

SEQ ID NO: 2399170 - RNA, 15 nt, Human immunodeficiency virus 2 (HIV-2)
gcagaaguggcagaa

SEQ ID NO: 2399171 - RNA, 14 nt, Human immunodeficiency virus 2 (HIV-2)
ugaaagcaagaggg

SEQ ID NO: 2399172 - RNA, 16 nt, Human immunodeficiency virus 2 (HIV-2)
gagggacaugggagga

SEQ ID NO: 2399173 - RNA, 23 nt, Human immunodeficiency virus 2 (HIV-2)
aauaucagucaaaguuuagaaga

SEQ ID NO: 2399174 - RNA, 15 nt, Human immunodeficiency virus 2 (HIV-2)
agaguuugggcacaa

SEQ ID NO: 2399175 - RNA, 23 nt, Human immunodeficiency virus 2 (HIV-2)
gaacucucacaagaggcagagga

SEQ ID NO: 2399176 - RNA, 18 nt, Human immunodeficiency virus 2 (HIV-2)
auuucaagagagggugca

SEQ ID NO: 2399177 - RNA, 22 nt, Human immunodeficiency virus 2 (HIV-2)
uuauacucaugggccaggagua

SEQ ID NO: 2399178 - RNA, 23 nt, Human immunodeficiency virus 2 (HIV-2)
cuuggguuuucucgcgacagcag

SEQ ID NO: 2399179 - RNA, 17 nt, Human immunodeficiency virus 2 (HIV-2)
gggaaauaaaggaagaa

SEQ ID NO: 2399180 - RNA, 22 nt, Human immunodeficiency virus 2 (HIV-2)
caagucaggauugccagagaaa

SEQ ID NO: 2399181 - RNA, 20 nt, Human immunodeficiency virus 2 (HIV-2)
guacuuggccgguacugggc

SEQ ID NO: 2399182 - RNA, 17 nt, Human immunodeficiency virus 2 (HIV-2)
acagcccauggagaaac

SEQ ID NO: 2399183 - RNA, 23 nt, Human immunodeficiency virus 2 (HIV-2)
cccuagagccaugcacuaacaaa

SEQ ID NO: 2399184 - RNA, 16 nt, Human immunodeficiency virus 2 (HIV-2)
cugaggcugcagggac

SEQ ID NO: 2399185 - RNA, 23 nt, Human immunodeficiency virus 2 (HIV-2)
cugcagggacuuuccagaagggg

SEQ ID NO: 2399186 - RNA, 20 nt, Human immunodeficiency virus 2 (HIV-2)
ucucagccaaucaacacaag

SEQ ID NO: 2399187 - RNA, 15 nt, Human immunodeficiency virus 2 (HIV-2)
gcagaucgagcccug

SEQ ID NO: 2399188 - RNA, 21 nt, Human immunodeficiency virus 2 (HIV-2)
uuuaucgccugacuggaaaaa

SEQ ID NO: 2399189 - RNA, 21 nt, Human immunodeficiency virus 2 (HIV-2)
acagaguuucccccagaagau

SEQ ID NO: 2399190 - RNA, 14 nt, Human immunodeficiency virus 2 (HIV-2)
agaaaagaauaugu

SEQ ID NO: 2399191 - RNA, 19 nt, Human immunodeficiency virus 2 (HIV-2)
ccugagagguucucuccag

SEQ ID NO: 2399192 - RNA, 17 nt, Human immunodeficiency virus 2 (HIV-2)
ugcuggacucucaccag

SEQ ID NO: 2399193 - RNA, 19 nt, Human immunodeficiency virus 2 (HIV-2)
caaaacugaaagcaagagg

SEQ ID NO: 2399194 - RNA, 16 nt, Human immunodeficiency virus 2 (HIV-2)
gcugcaccgaccccua

SEQ ID NO: 2399195 - RNA, 15 nt, Human immunodeficiency virus 2 (HIV-2)
agacauauaccuaga

SEQ ID NO: 2399196 - RNA, 17 nt, Human immunodeficiency virus 2 (HIV-2)
ggaaacaguggagaaga

SEQ ID NO: 2399197 - RNA, 18 nt, Human immunodeficiency virus 2 (HIV-2)
acuuaaccuccuggguca

SEQ ID NO: 2399198 - RNA, 15 nt, Human immunodeficiency virus 2 (HIV-2)
caaucaacacaaggc

SEQ ID NO: 2399199 - RNA, 16 nt, Human immunodeficiency virus 2 (HIV-2)
cuaaugcaaaaagcua

SEQ ID NO: 2399200 - RNA, 14 nt, Human immunodeficiency virus 2 (HIV-2)
uucccaucucuccu

SEQ ID NO: 2399201 - RNA, 17 nt, Human immunodeficiency virus 2 (HIV-2)
cauggagaaacccagca

SEQ ID NO: 2399202 - RNA, 16 nt, Human immunodeficiency virus 2 (HIV-2)
acuacaaauuaauaga

SEQ ID NO: 2399203 - RNA, 18 nt, Human immunodeficiency virus 2 (HIV-2)
uaccacggagagaaauga

SEQ ID NO: 2399204 - RNA, 12 nt, Human immunodeficiency virus 2 (HIV-2)
ucaggcagggag

SEQ ID NO: 2399205 - RNA, 13 nt, Human immunodeficiency virus 2 (HIV-2)
guuugggcacaag

SEQ ID NO: 2399206 - RNA, 18 nt, Human immunodeficiency virus 2 (HIV-2)
gacuggcugagacuuaag

SEQ ID NO: 2399207 - RNA, 14 nt, Human immunodeficiency virus 2 (HIV-2)
caacaagaaaagaa

SEQ ID NO: 2399208 - RNA, 12 nt, Human immunodeficiency virus 2 (HIV-2)
cagcaaucaggg

SEQ ID NO: 2399209 - RNA, 16 nt, Human immunodeficiency virus 2 (HIV-2)
caagcaguagaagaug

SEQ ID NO: 2399210 - RNA, 15 nt, Human immunodeficiency virus 2 (HIV-2)
ucaggcagggagcag

SEQ ID NO: 2399211 - RNA, 14 nt, Human immunodeficiency virus 2 (HIV-2)
auauccauaauaga

SEQ ID NO: 2399212 - RNA, 19 nt, Human immunodeficiency virus 2 (HIV-2)
uggagaaacccagcaacag

SEQ ID NO: 2399213 - RNA, 21 nt, Human immunodeficiency virus 2 (HIV-2)
augcacaaggaugauggaaac

SEQ ID NO: 2399214 - RNA, 17 nt, Human immunodeficiency virus 2 (HIV-2)
cugagagguucucucca

SEQ ID NO: 2399215 - RNA, 15 nt, Human immunodeficiency virus 2 (HIV-2)
caagauaagaaaagg

SEQ ID NO: 2399216 - RNA, 13 nt, Human immunodeficiency virus 2 (HIV-2)
gggccgggaagga

SEQ ID NO: 2399217 - RNA, 14 nt, Human immunodeficiency virus 2 (HIV-2)
ucaaggcaggaagu

SEQ ID NO: 2399218 - RNA, 16 nt, Human immunodeficiency virus 2 (HIV-2)
ggaauaucauaugagc

SEQ ID NO: 2399219 - RNA, 18 nt, Human immunodeficiency virus 2 (HIV-2)
acuagcagguagagccug

SEQ ID NO: 2399220 - RNA, 21 nt, Human immunodeficiency virus 2 (HIV-2)
uauagugaauaacaggaacaa

SEQ ID NO: 2399221 - RNA, 15 nt, Human immunodeficiency virus 2 (HIV-2)
uugcuggggggagga

SEQ ID NO: 2399222 - RNA, 16 nt, Human immunodeficiency virus 2 (HIV-2)
ucccugcuggacucuc

SEQ ID NO: 2399223 - RNA, 21 nt, Human immunodeficiency virus 2 (HIV-2)
cagcaaucagggacuggcuga

SEQ ID NO: 2399224 - RNA, 18 nt, Human immunodeficiency virus 2 (HIV-2)
cagugaggaacaaaagag

SEQ ID NO: 2399225 - RNA, 23 nt, Human immunodeficiency virus 2 (HIV-2)
uggacguagucaagagacaacaa

SEQ ID NO: 2399226 - RNA, 12 nt, Human immunodeficiency virus 2 (HIV-2)
ucccugcuggac

SEQ ID NO: 2399227 - RNA, 15 nt, Human immunodeficiency virus 2 (HIV-2)
gagcauggggagaca

SEQ ID NO: 2399228 - RNA, 20 nt, Human immunodeficiency virus 2 (HIV-2)
gggacagcaguaucagcagg

SEQ ID NO: 2399229 - RNA, 12 nt, Human immunodeficiency virus 2 (HIV-2)
ugggcacaaguc

SEQ ID NO: 2399230 - RNA, 14 nt, Human immunodeficiency virus 2 (HIV-2)
uauaaggacacaug

SEQ ID NO: 2399231 - RNA, 23 nt, Human immunodeficiency virus 2 (HIV-2)
agggauaauaccagauuggcaga

SEQ ID NO: 2399232 - RNA, 20 nt, Human immunodeficiency virus 2 (HIV-2)
aauaugaagggguuagaaca

SEQ ID NO: 2399233 - RNA, 21 nt, Human immunodeficiency virus 2 (HIV-2)
ugcuucaugcacaaggaugau

SEQ ID NO: 2399234 - RNA, 12 nt, Human immunodeficiency virus 2 (HIV-2)
caacgagcccuc

SEQ ID NO: 2399235 - RNA, 16 nt, Human immunodeficiency virus 2 (HIV-2)
cugugagggacagcag

SEQ ID NO: 2399236 - RNA, 22 nt, Human immunodeficiency virus 2 (HIV-2)
ggcuagagaggaccauagaagc

SEQ ID NO: 2399237 - RNA, 17 nt, Human immunodeficiency virus 2 (HIV-2)
caaaaauuaaauagcug

SEQ ID NO: 2399238 - RNA, 15 nt, Human immunodeficiency virus 2 (HIV-2)
ggacuacgagagaga

SEQ ID NO: 2399239 - RNA, 18 nt, Human immunodeficiency virus 2 (HIV-2)
caugaugaugagcauggg

SEQ ID NO: 2399240 - RNA, 12 nt, Human immunodeficiency virus 2 (HIV-2)
aaaaccuccagg

SEQ ID NO: 2399241 - RNA, 17 nt, Human immunodeficiency virus 2 (HIV-2)
gacuacgagagagacuc

SEQ ID NO: 2399242 - RNA, 14 nt, Human immunodeficiency virus 2 (HIV-2)
cugcagaggagaau

SEQ ID NO: 2399243 - RNA, 20 nt, Human immunodeficiency virus 2 (HIV-2)
uggcauaaaguagggaaaaa

SEQ ID NO: 2399244 - RNA, 15 nt, Human immunodeficiency virus 2 (HIV-2)
uauaaucucacaaug

SEQ ID NO: 2399245 - RNA, 21 nt, Human immunodeficiency virus 2 (HIV-2)
cugcagggacuuuccagaagg

SEQ ID NO: 2399246 - RNA, 19 nt, Human immunodeficiency virus 2 (HIV-2)
ugaacagcccauggagaaa

SEQ ID NO: 2399247 - RNA, 23 nt, Human immunodeficiency virus 2 (HIV-2)
accucuauguguggcaaugaauu

SEQ ID NO: 2399248 - RNA, 21 nt, Human immunodeficiency virus 2 (HIV-2)
agaacaagcaguagaagaugu

SEQ ID NO: 2399249 - RNA, 18 nt, Human immunodeficiency virus 2 (HIV-2)
acaaaggaaucaaugaua

SEQ ID NO: 2399250 - RNA, 19 nt, Human immunodeficiency virus 2 (HIV-2)
gaaacccagcaacagaaag

SEQ ID NO: 2399251 - RNA, 14 nt, Human immunodeficiency virus 2 (HIV-2)
aggagaugaugcaa

SEQ ID NO: 2399252 - RNA, 19 nt, Human immunodeficiency virus 2 (HIV-2)
cagggacuuuccagaaggg

SEQ ID NO: 2399253 - RNA, 13 nt, Human immunodeficiency virus 2 (HIV-2)
aaagaauauguau

SEQ ID NO: 2399254 - RNA, 22 nt, Human immunodeficiency virus 2 (HIV-2)
agcugguggggaacgcccucau

SEQ ID NO: 2399255 - RNA, 19 nt, Human immunodeficiency virus 2 (HIV-2)
guuccaagaagaaucaggc

SEQ ID NO: 2399256 - RNA, 24 nt, Human immunodeficiency virus 2 (HIV-2)
agucaggauugccagagaaagaau

SEQ ID NO: 2399257 - RNA, 12 nt, Human immunodeficiency virus 2 (HIV-2)
gaagcuuuccaa

SEQ ID NO: 2399258 - RNA, 20 nt, Human immunodeficiency virus 2 (HIV-2)
gaagaaucaggcagggagca

SEQ ID NO: 2399259 - RNA, 16 nt, Human immunodeficiency virus 2 (HIV-2)
cuguacccagaagagu

SEQ ID NO: 2399260 - RNA, 18 nt, Human immunodeficiency virus 2 (HIV-2)
acaaggaccggggacagc

SEQ ID NO: 2399261 - RNA, 17 nt, Human immunodeficiency virus 2 (HIV-2)
aacagcccauggagaaa

SEQ ID NO: 2399262 - RNA, 21 nt, Human immunodeficiency virus 2 (HIV-2)
caagaguaccacggagagaaa

SEQ ID NO: 2399263 - RNA, 20 nt, Human immunodeficiency virus 2 (HIV-2)
aagaauggaaggcaaaacug

SEQ ID NO: 2399264 - RNA, 23 nt, Human immunodeficiency virus 2 (HIV-2)
cuguaccgauuagaacugggaga

SEQ ID NO: 2399265 - RNA, 22 nt, Human immunodeficiency virus 2 (HIV-2)
cagagacuuacuauccaagaac

SEQ ID NO: 2399266 - RNA, 22 nt, Human immunodeficiency virus 2 (HIV-2)
gcuacuaagaaacagcugaggc

SEQ ID NO: 2399267 - RNA, 19 nt, Human immunodeficiency virus 2 (HIV-2)
auaaaguagggaaaaaugu

SEQ ID NO: 2399268 - RNA, 15 nt, Human immunodeficiency virus 2 (HIV-2)
cugaccgucugggga

SEQ ID NO: 2399269 - RNA, 20 nt, Human immunodeficiency virus 2 (HIV-2)
acuucuaacugcauagaaaa

SEQ ID NO: 2399270 - RNA, 19 nt, Human immunodeficiency virus 2 (HIV-2)
uagaacucucacaagaggc

SEQ ID NO: 2399271 - RNA, 17 nt, Human immunodeficiency virus 2 (HIV-2)
cagaccccagagaaagg

SEQ ID NO: 2399272 - RNA, 17 nt, Human immunodeficiency virus 2 (HIV-2)
cucgcaguuccaagaag

SEQ ID NO: 2399273 - RNA, 21 nt, Human immunodeficiency virus 2 (HIV-2)
uacuuggccgguacugggcag

SEQ ID NO: 2399274 - RNA, 22 nt, Human immunodeficiency virus 2 (HIV-2)
ccuggguguucccugcuggacu

SEQ ID NO: 2399275 - RNA, 23 nt, Human immunodeficiency virus 2 (HIV-2)
ggcacaagucaggauugccagag

SEQ ID NO: 2399276 - RNA, 20 nt, Human immunodeficiency virus 2 (HIV-2)
acaagacccuggucuguuag

SEQ ID NO: 2399277 - RNA, 15 nt, Human immunodeficiency virus 2 (HIV-2)
uccuguuacaccaag

SEQ ID NO: 2399278 - RNA, 13 nt, Human immunodeficiency virus 2 (HIV-2)
gaaaccgggagca

SEQ ID NO: 2399279 - RNA, 16 nt, Human immunodeficiency virus 2 (HIV-2)
acuacgagagagacuc

SEQ ID NO: 2399280 - RNA, 14 nt, Human immunodeficiency virus 2 (HIV-2)
gaaucaggcaggga

SEQ ID NO: 2399281 - RNA, 13 nt, Human immunodeficiency virus 2 (HIV-2)
gcagacggcucca

SEQ ID NO: 2399282 - RNA, 12 nt, Human immunodeficiency virus 2 (HIV-2)
gacaaugaugau

SEQ ID NO: 2399283 - RNA, 16 nt, Human immunodeficiency virus 2 (HIV-2)
aacagaaagacagaaa

SEQ ID NO: 2399284 - RNA, 14 nt, Human immunodeficiency virus 2 (HIV-2)
aaaugugacagagg

SEQ ID NO: 2399285 - RNA, 14 nt, Human immunodeficiency virus 2 (HIV-2)
acuacaaauuaaua

SEQ ID NO: 2399286 - RNA, 21 nt, Human immunodeficiency virus 2 (HIV-2)
auaaauuggcaauagauaugu

SEQ ID NO: 2399287 - RNA, 12 nt, Human immunodeficiency virus 2 (HIV-2)
aaggagaagaac

SEQ ID NO: 2399288 - RNA, 19 nt, Human immunodeficiency virus 2 (HIV-2)
cagcaguaucagcagggag

SEQ ID NO: 2399289 - RNA, 15 nt, Human immunodeficiency virus 2 (HIV-2)
agaucgagcccugag

SEQ ID NO: 2399290 - RNA, 19 nt, Human immunodeficiency virus 2 (HIV-2)
ccugcuggacucucaccag

SEQ ID NO: 2399291 - RNA, 14 nt, Human immunodeficiency virus 2 (HIV-2)
uggucaaggcagga

SEQ ID NO: 2399292 - RNA, 20 nt, Human immunodeficiency virus 2 (HIV-2)
guagcugcuucaugcacaag

SEQ ID NO: 2399293 - RNA, 20 nt, Human immunodeficiency virus 2 (HIV-2)
uacaacaucugcagagacuu

SEQ ID NO: 2399294 - RNA, 16 nt, Human immunodeficiency virus 2 (HIV-2)
acuuagggagugacug

SEQ ID NO: 2399295 - RNA, 14 nt, Human immunodeficiency virus 2 (HIV-2)
uagauucugaugau

SEQ ID NO: 2399296 - RNA, 23 nt, Human immunodeficiency virus 2 (HIV-2)
aggcucagacccggaaguggcau

SEQ ID NO: 2399297 - RNA, 23 nt, Human immunodeficiency virus 2 (HIV-2)
gcgacugaccgucuggggaacga

SEQ ID NO: 2399298 - RNA, 13 nt, Human immunodeficiency virus 2 (HIV-2)
uaaacagggaggc

SEQ ID NO: 2399299 - RNA, 17 nt, Human immunodeficiency virus 2 (HIV-2)
caauaaacuaugugcag

SEQ ID NO: 2399300 - RNA, 16 nt, Human immunodeficiency virus 2 (HIV-2)
guggggaacgcccuca

SEQ ID NO: 2399301 - RNA, 21 nt, Human immunodeficiency virus 2 (HIV-2)
ggagaagagaccauuggagag

SEQ ID NO: 2399302 - RNA, 15 nt, Human immunodeficiency virus 2 (HIV-2)
acagcugaggcugca

SEQ ID NO: 2399303 - RNA, 18 nt, Human immunodeficiency virus 2 (HIV-2)
gacaugggaggagcuggu

SEQ ID NO: 2399304 - RNA, 14 nt, Human immunodeficiency virus 2 (HIV-2)
guaugaggagauga

SEQ ID NO: 2399305 - RNA, 15 nt, Human immunodeficiency virus 2 (HIV-2)
acaucccagauacaa

SEQ ID NO: 2399306 - RNA, 14 nt, Human immunodeficiency virus 2 (HIV-2)
aaacaguggagaag

SEQ ID NO: 2399307 - RNA, 15 nt, Human immunodeficiency virus 2 (HIV-2)
aacagcugaggcugc

SEQ ID NO: 2399308 - RNA, 15 nt, Human immunodeficiency virus 2 (HIV-2)
cagccagccaacgaa

SEQ ID NO: 2399309 - RNA, 13 nt, Human immunodeficiency virus 2 (HIV-2)
gccccgagagcuc

SEQ ID NO: 2399310 - RNA, 14 nt, Human immunodeficiency virus 2 (HIV-2)
cacuagagcagaaa

SEQ ID NO: 2399311 - RNA, 22 nt, Human immunodeficiency virus 2 (HIV-2)
acugcauagaaaacaacacaug

SEQ ID NO: 2399312 - RNA, 17 nt, Human immunodeficiency virus 2 (HIV-2)
cagcaguaucagcaggg

SEQ ID NO: 2399313 - RNA, 15 nt, Human immunodeficiency virus 2 (HIV-2)
caacagcaacagcug

SEQ ID NO: 2399314 - RNA, 16 nt, Human immunodeficiency virus 2 (HIV-2)
uacagugacagaacaa

SEQ ID NO: 2399315 - RNA, 18 nt, Human immunodeficiency virus 2 (HIV-2)
gacuggguaauagaaacu

SEQ ID NO: 2399316 - RNA, 16 nt, Human immunodeficiency virus 2 (HIV-2)
uccugugagggacagc

SEQ ID NO: 2399317 - RNA, 15 nt, Human immunodeficiency virus 2 (HIV-2)
cuucaugcacaagga

SEQ ID NO: 2399318 - RNA, 18 nt, Human immunodeficiency virus 2 (HIV-2)
gagguucucuccagcacu

SEQ ID NO: 2399319 - RNA, 21 nt, Human immunodeficiency virus 2 (HIV-2)
cuccugugagggacagcagua

SEQ ID NO: 2399320 - RNA, 19 nt, Human immunodeficiency virus 2 (HIV-2)
agugcaauuguuaaguaga

SEQ ID NO: 2399321 - RNA, 13 nt, Human immunodeficiency virus 2 (HIV-2)
acuuacuguauaa

SEQ ID NO: 2399322 - RNA, 13 nt, Human immunodeficiency virus 2 (HIV-2)
gaacugggagacu

SEQ ID NO: 2399323 - RNA, 14 nt, Human immunodeficiency virus 2 (HIV-2)
guauaggcagcaaa

SEQ ID NO: 2399324 - RNA, 16 nt, Human immunodeficiency virus 2 (HIV-2)
gccuucugcaccagac

SEQ ID NO: 2399325 - RNA, 12 nt, Human immunodeficiency virus 2 (HIV-2)
ggcauggcagag

SEQ ID NO: 2399326 - RNA, 22 nt, Human immunodeficiency virus 2 (HIV-2)
cagcaaucagggacuggcugag

SEQ ID NO: 2399327 - RNA, 17 nt, Human immunodeficiency virus 2 (HIV-2)
gcaguuccaagaagaau

SEQ ID NO: 2399328 - RNA, 21 nt, Human immunodeficiency virus 2 (HIV-2)
gcuggccuauaacuacaaggc

SEQ ID NO: 2399329 - RNA, 13 nt, Human immunodeficiency virus 2 (HIV-2)
gcagagacuuacu

SEQ ID NO: 2399330 - RNA, 13 nt, Human immunodeficiency virus 2 (HIV-2)
gaccccagagaaa

SEQ ID NO: 2399331 - RNA, 20 nt, Human immunodeficiency virus 2 (HIV-2)
agccaucagaggggaaaagu

SEQ ID NO: 2399332 - RNA, 16 nt, Human immunodeficiency virus 2 (HIV-2)
ggagaggcuggcagau

SEQ ID NO: 2399333 - RNA, 21 nt, Human immunodeficiency virus 2 (HIV-2)
gaagcuaguaucaguagaacu

SEQ ID NO: 2399334 - RNA, 17 nt, Human immunodeficiency virus 2 (HIV-2)
aaagcagauaauuaaua

SEQ ID NO: 2399335 - RNA, 15 nt, Human immunodeficiency virus 2 (HIV-2)
gauucugaugaugau

SEQ ID NO: 2399336 - RNA, 14 nt, Human immunodeficiency virus 2 (HIV-2)
gcugaggcugcagg

SEQ ID NO: 2399337 - RNA, 17 nt, Human immunodeficiency virus 2 (HIV-2)
acugcaauaugggugcg

SEQ ID NO: 2399338 - RNA, 20 nt, Human immunodeficiency virus 2 (HIV-2)
aauauguaugaauuacaaaa

SEQ ID NO: 2399339 - RNA, 18 nt, Human immunodeficiency virus 2 (HIV-2)
acagaaagauuuguauag

SEQ ID NO: 2399340 - RNA, 20 nt, Human immunodeficiency virus 2 (HIV-2)
ccccgguuaucuccaacaga

SEQ ID NO: 2399341 - RNA, 16 nt, Human immunodeficiency virus 2 (HIV-2)
uacuuggucaaggcag

SEQ ID NO: 2399342 - RNA, 11 nt, Human immunodeficiency virus 2 (HIV-2)
caagaaaagaa

SEQ ID NO: 2399343 - RNA, 20 nt, Human immunodeficiency virus 2 (HIV-2)
caggaaacaguggagaagag

SEQ ID NO: 2399344 - RNA, 22 nt, Human immunodeficiency virus 2 (HIV-2)
ccaagcauucgcgaggacuacg

SEQ ID NO: 2399345 - RNA, 12 nt, Human immunodeficiency virus 2 (HIV-2)
cucucagccaau

SEQ ID NO: 2399346 - RNA, 17 nt, Human immunodeficiency virus 2 (HIV-2)
cuucugcaccagacaag

SEQ ID NO: 2399347 - RNA, 14 nt, Human immunodeficiency virus 2 (HIV-2)
gauugccagagaaa

SEQ ID NO: 2399348 - RNA, 22 nt, Human immunodeficiency virus 2 (HIV-2)
agaaacaaguccgcuaccuaga

SEQ ID NO: 2399349 - RNA, 21 nt, Human immunodeficiency virus 2 (HIV-2)
caugcuggccuauaacuacaa

SEQ ID NO: 2399350 - RNA, 17 nt, Human immunodeficiency virus 2 (HIV-2)
uuggucaaggcaggaag

SEQ ID NO: 2399351 - RNA, 17 nt, Human immunodeficiency virus 2 (HIV-2)
gcuaaacaaggagaaga

SEQ ID NO: 2399352 - RNA, 21 nt, Human immunodeficiency virus 2 (HIV-2)
cccuaguaguaguacaacaaa

SEQ ID NO: 2399353 - RNA, 15 nt, Human immunodeficiency virus 2 (HIV-2)
aaggaacagaagaag

SEQ ID NO: 2399354 - RNA, 22 nt, Human immunodeficiency virus 2 (HIV-2)
caugaugaugagcauggggaga

SEQ ID NO: 2399355 - RNA, 20 nt, Human immunodeficiency virus 2 (HIV-2)
ggaauaauacagugacagaa

SEQ ID NO: 2399356 - RNA, 21 nt, Human immunodeficiency virus 2 (HIV-2)
caacaucccagauacaaagga

SEQ ID NO: 2399357 - RNA, 14 nt, Human immunodeficiency virus 2 (HIV-2)
uccugcugcaacua

SEQ ID NO: 2399358 - RNA, 20 nt, Human immunodeficiency virus 2 (HIV-2)
acuaagaaacagcugaggcu

SEQ ID NO: 2399359 - RNA, 19 nt, Human immunodeficiency virus 2 (HIV-2)
gaggacuacgagagagacu

SEQ ID NO: 2399360 - RNA, 18 nt, Human immunodeficiency virus 2 (HIV-2)
cacuagagcagaaaauag

SEQ ID NO: 2399361 - RNA, 14 nt, Human immunodeficiency virus 2 (HIV-2)
aaaagggggacugc

SEQ ID NO: 2399362 - RNA, 16 nt, Human immunodeficiency virus 2 (HIV-2)
aggcagcaaaauaugg

SEQ ID NO: 2399363 - RNA, 21 nt, Human immunodeficiency virus 2 (HIV-2)
gaagccuuaaacagggaggca

SEQ ID NO: 2399364 - RNA, 22 nt, Human immunodeficiency virus 2 (HIV-2)
cacuagcagguagagccugggu

SEQ ID NO: 2399365 - RNA, 18 nt, Human immunodeficiency virus 2 (HIV-2)
aagcaguagaagaugucu

SEQ ID NO: 2399366 - RNA, 17 nt, Human immunodeficiency virus 2 (HIV-2)
gaccauuggagaggccu

SEQ ID NO: 2399367 - RNA, 21 nt, Human immunodeficiency virus 2 (HIV-2)
uagaagccuuaaacagggagg

SEQ ID NO: 2399368 - RNA, 20 nt, Human immunodeficiency virus 2 (HIV-2)
uucccugcuggacucucacc

SEQ ID NO: 2399369 - RNA, 16 nt, Human immunodeficiency virus 2 (HIV-2)
acguagucaagagaca

SEQ ID NO: 2399370 - RNA, 23 nt, Human immunodeficiency virus 2 (HIV-2)
gacacccuugaaggcgccagaga

SEQ ID NO: 2399371 - RNA, 22 nt, Human immunodeficiency virus 2 (HIV-2)
aauuguuaaguagauuuagaaa

SEQ ID NO: 2399372 - RNA, 20 nt, Human immunodeficiency virus 2 (HIV-2)
cccugacgcugucagcccag

SEQ ID NO: 2399373 - RNA, 18 nt, Human immunodeficiency virus 2 (HIV-2)
ggacuacgagagagacuc

SEQ ID NO: 2399374 - RNA, 21 nt, Human immunodeficiency virus 2 (HIV-2)
gcaguuuccauugccagcugu

SEQ ID NO: 2399375 - RNA, 23 nt, Human immunodeficiency virus 2 (HIV-2)
guggcaaugaauuguagcagggu

SEQ ID NO: 2399376 - RNA, 16 nt, Human immunodeficiency virus 2 (HIV-2)
cagaucgagcccugag

SEQ ID NO: 2399377 - RNA, 17 nt, Human immunodeficiency virus 2 (HIV-2)
ucaguagaacucucaca

SEQ ID NO: 2399378 - RNA, 20 nt, Human immunodeficiency virus 2 (HIV-2)
ugacuuaaccuccuggguca

SEQ ID NO: 2399379 - RNA, 18 nt, Human immunodeficiency virus 2 (HIV-2)
ggcagacggcuccacgcu

SEQ ID NO: 2399380 - RNA, 13 nt, Human immunodeficiency virus 2 (HIV-2)
cagauuggcagaa

SEQ ID NO: 2399381 - RNA, 16 nt, Human immunodeficiency virus 2 (HIV-2)
gugggagaaacaaguc

SEQ ID NO: 2399382 - RNA, 15 nt, Human immunodeficiency virus 2 (HIV-2)
gcagggacuuuccag

SEQ ID NO: 2399383 - RNA, 21 nt, Human immunodeficiency virus 2 (HIV-2)
gcccugagagguucucuccag

SEQ ID NO: 2399384 - RNA, 23 nt, Human immunodeficiency virus 2 (HIV-2)
agaagaacuccuugcccagcugc

SEQ ID NO: 2399385 - RNA, 14 nt, Human immunodeficiency virus 2 (HIV-2)
agggguuagaacaa

SEQ ID NO: 2399386 - RNA, 14 nt, Human immunodeficiency virus 2 (HIV-2)
uauaggcagcaaaa

SEQ ID NO: 2399387 - RNA, 20 nt, Human immunodeficiency virus 2 (HIV-2)
augaacagcccauggagaaa

SEQ ID NO: 2399388 - RNA, 13 nt, Human immunodeficiency virus 2 (HIV-2)
agcaguagaagau

SEQ ID NO: 2399389 - RNA, 17 nt, Human immunodeficiency virus 2 (HIV-2)
guggcuagagaggacca

SEQ ID NO: 2399390 - RNA, 20 nt, Human immunodeficiency virus 2 (HIV-2)
ggggaugguuaugggaagca

SEQ ID NO: 2399391 - RNA, 15 nt, Human immunodeficiency virus 2 (HIV-2)
caucugcagagacuu

SEQ ID NO: 2399392 - RNA, 19 nt, Human immunodeficiency virus 2 (HIV-2)
uaaauagcugggauauucu

SEQ ID NO: 2399393 - RNA, 17 nt, Human immunodeficiency virus 2 (HIV-2)
gacagaaagauuuguau

SEQ ID NO: 2399394 - RNA, 21 nt, Human immunodeficiency virus 2 (HIV-2)
ucuaacagcaaucagggacug

SEQ ID NO: 2399395 - RNA, 15 nt, Human immunodeficiency virus 2 (HIV-2)
uucaacaagaaaaga

SEQ ID NO: 2399396 - RNA, 18 nt, Human immunodeficiency virus 2 (HIV-2)
uccugugagggacagcag

SEQ ID NO: 2399397 - RNA, 14 nt, Human immunodeficiency virus 2 (HIV-2)
gaaguggcagaacu

SEQ ID NO: 2399398 - RNA, 21 nt, Human immunodeficiency virus 2 (HIV-2)
uggcauacccgcguggaaaaa

SEQ ID NO: 2399399 - RNA, 18 nt, Human immunodeficiency virus 2 (HIV-2)
cauggcaggagugggaga

SEQ ID NO: 2399400 - RNA, 19 nt, Human immunodeficiency virus 2 (HIV-2)
gcucugcggagaggcuggc

SEQ ID NO: 2399401 - RNA, 14 nt, Human immunodeficiency virus 2 (HIV-2)
aucugcagagacuu

SEQ ID NO: 2399402 - RNA, 14 nt, Human immunodeficiency virus 2 (HIV-2)
uagugcagcaacag

SEQ ID NO: 2399403 - RNA, 13 nt, Human immunodeficiency virus 2 (HIV-2)
aucaaugauacag

SEQ ID NO: 2399404 - RNA, 11 nt, Human immunodeficiency virus 2 (HIV-2)
gaaaaauauga

SEQ ID NO: 2399405 - RNA, 19 nt, Human immunodeficiency virus 2 (HIV-2)
agauuuguauaggcagcaa

SEQ ID NO: 2399406 - RNA, 22 nt, Human immunodeficiency virus 2 (HIV-2)
uaggcagcaaaauauggaugau

SEQ ID NO: 2399407 - RNA, 17 nt, Human immunodeficiency virus 2 (HIV-2)
cacauuuuauaaaagaa

SEQ ID NO: 2399408 - RNA, 16 nt, Human immunodeficiency virus 2 (HIV-2)
ggcaagagucacugcu

SEQ ID NO: 2399409 - RNA, 17 nt, Human immunodeficiency virus 2 (HIV-2)
uguaccgauuagaacug

SEQ ID NO: 2399410 - RNA, 12 nt, Human immunodeficiency virus 2 (HIV-2)
ugcggagaggcu

SEQ ID NO: 2399411 - RNA, 19 nt, Human immunodeficiency virus 2 (HIV-2)
ggagcagaacucgcccucc

SEQ ID NO: 2399412 - RNA, 11 nt, Human immunodeficiency virus 2 (HIV-2)
ucuaacagcaa

SEQ ID NO: 2399413 - RNA, 15 nt, Human immunodeficiency virus 2 (HIV-2)
agaguuucccccaga

SEQ ID NO: 2399414 - RNA, 17 nt, Human immunodeficiency virus 2 (HIV-2)
uggcaauagauauguca

SEQ ID NO: 2399415 - RNA, 22 nt, Human immunodeficiency virus 2 (HIV-2)
cccauggagaaacccagcaaca

SEQ ID NO: 2399416 - RNA, 23 nt, Human immunodeficiency virus 2 (HIV-2)
gcaaugugaguucaauaugaagg

SEQ ID NO: 2399417 - RNA, 19 nt, Human immunodeficiency virus 2 (HIV-2)
uucgaguggcuagagagga

SEQ ID NO: 2399418 - RNA, 17 nt, Human immunodeficiency virus 2 (HIV-2)
aggcagggagcagaacu

SEQ ID NO: 2399419 - RNA, 23 nt, Human immunodeficiency virus 2 (HIV-2)
aaguagcuacuaagaaacagcug

SEQ ID NO: 2399420 - RNA, 21 nt, Human immunodeficiency virus 2 (HIV-2)
ggacagcaguaucagcaggga

SEQ ID NO: 2399421 - RNA, 15 nt, Human immunodeficiency virus 2 (HIV-2)
aggcgccagagagcu

SEQ ID NO: 2399422 - RNA, 19 nt, Human immunodeficiency virus 2 (HIV-2)
aacaagcagacaugaugau

SEQ ID NO: 2399423 - RNA, 19 nt, Human immunodeficiency virus 2 (HIV-2)
guucaucugaguaacaaga

SEQ ID NO: 2399424 - RNA, 14 nt, Human immunodeficiency virus 2 (HIV-2)
acaagaaaagaaua

SEQ ID NO: 2399425 - RNA, 20 nt, Human immunodeficiency virus 2 (HIV-2)
caucugaguaacaagacccu

SEQ ID NO: 2399426 - RNA, 15 nt, Human immunodeficiency virus 2 (HIV-2)
acaagucaggauugc

SEQ ID NO: 2399427 - RNA, 16 nt, Human immunodeficiency virus 2 (HIV-2)
agaagaaucaggcagg

SEQ ID NO: 2399428 - RNA, 19 nt, Human immunodeficiency virus 2 (HIV-2)
ggcaguuugacuccaugcu

SEQ ID NO: 2399429 - RNA, 22 nt, Human immunodeficiency virus 2 (HIV-2)
cuagcagguagagccugggugu

SEQ ID NO: 2399430 - RNA, 14 nt, Human immunodeficiency virus 2 (HIV-2)
ugcagcaacagcaa

SEQ ID NO: 2399431 - RNA, 14 nt, Human immunodeficiency virus 2 (HIV-2)
gacugaucucccag

SEQ ID NO: 2399432 - RNA, 22 nt, Human immunodeficiency virus 2 (HIV-2)
acauggcaggagugggagaaac

SEQ ID NO: 2399433 - RNA, 18 nt, Human immunodeficiency virus 2 (HIV-2)
ugggaauccaaggcagga

SEQ ID NO: 2399434 - RNA, 22 nt, Human immunodeficiency virus 2 (HIV-2)
gcauuguauucagucgcucugc

SEQ ID NO: 2399435 - RNA, 15 nt, Human immunodeficiency virus 2 (HIV-2)
ggcgccagagagcuc

SEQ ID NO: 2399436 - RNA, 19 nt, Human immunodeficiency virus 2 (HIV-2)
gacuuacuauccaagaacu

SEQ ID NO: 2399437 - RNA, 19 nt, Human immunodeficiency virus 2 (HIV-2)
caaaauauggaugauguag

SEQ ID NO: 2399438 - RNA, 19 nt, Human immunodeficiency virus 2 (HIV-2)
ggcagacgaagaaggacuc

SEQ ID NO: 2399439 - RNA, 14 nt, Human immunodeficiency virus 2 (HIV-2)
cuaccuagaggcaa

SEQ ID NO: 2399440 - RNA, 15 nt, Human immunodeficiency virus 2 (HIV-2)
auggagaaacccagc

SEQ ID NO: 2399441 - RNA, 20 nt, Human immunodeficiency virus 2 (HIV-2)
gagacuacaaauuaauagaa

SEQ ID NO: 2399442 - RNA, 19 nt, Human immunodeficiency virus 2 (HIV-2)
agucaaaguuuagaagaag

SEQ ID NO: 2399443 - RNA, 15 nt, Human immunodeficiency virus 2 (HIV-2)
cagaggaagaugagg

SEQ ID NO: 2399444 - RNA, 18 nt, Human immunodeficiency virus 2 (HIV-2)
gcuauacaacaucugcag

SEQ ID NO: 2399445 - RNA, 19 nt, Human immunodeficiency virus 2 (HIV-2)
gcagagacuuacuauccaa

SEQ ID NO: 2399446 - RNA, 14 nt, Human immunodeficiency virus 2 (HIV-2)
cuguacccagaaga

SEQ ID NO: 2399447 - RNA, 15 nt, Human immunodeficiency virus 2 (HIV-2)
uaguacaacaaaaug

SEQ ID NO: 2399448 - RNA, 17 nt, Human immunodeficiency virus 2 (HIV-2)
acuaaaaauagagacac

SEQ ID NO: 2399449 - RNA, 16 nt, Human immunodeficiency virus 2 (HIV-2)
agaauauguaugaauu

SEQ ID NO: 2399450 - RNA, 12 nt, Human immunodeficiency virus 2 (HIV-2)
ucccccuccagg

SEQ ID NO: 2399451 - RNA, 15 nt, Human immunodeficiency virus 2 (HIV-2)
uucucuccagcacua

SEQ ID NO: 2399452 - RNA, 20 nt, Human immunodeficiency virus 2 (HIV-2)
gaugugcguuuagacagguc

SEQ ID NO: 2399453 - RNA, 15 nt, Human immunodeficiency virus 2 (HIV-2)
ucgccuucugcacca

SEQ ID NO: 2399454 - RNA, 19 nt, Human immunodeficiency virus 2 (HIV-2)
cugcggagaggcuggcaga

SEQ ID NO: 2399455 - RNA, 18 nt, Human immunodeficiency virus 2 (HIV-2)
cccuagagccaugcacua

SEQ ID NO: 2399456 - RNA, 17 nt, Human immunodeficiency virus 2 (HIV-2)
guacugggcagacggcu

SEQ ID NO: 2399457 - RNA, 14 nt, Human immunodeficiency virus 2 (HIV-2)
aaggcaaaacugaa

SEQ ID NO: 2399458 - RNA, 21 nt, Human immunodeficiency virus 2 (HIV-2)
cagcuguguuucucgaaaaag

SEQ ID NO: 2399459 - RNA, 14 nt, Human immunodeficiency virus 2 (HIV-2)
acaacaagaaaugu

SEQ ID NO: 2399460 - RNA, 12 nt, Human
aaaacaaagaag

SEQ ID NO: 2399461 - RNA, 15 nt, Human
aaaacaaaaagaaca

SEQ ID NO: 2399462 - RNA, 17 nt, Human
aaaacaaaaagaacaaa

SEQ ID NO: 2399463 - RNA, 16 nt, Human
aaaacaaaaagaacaa

SEQ ID NO: 2399464 - RNA, 14 nt, Human
aaaacaaggaugaa

SEQ ID NO: 2399465 - RNA, 15 nt, Human
aaaacaaaugccaca

SEQ ID NO: 2399466 - RNA, 13 nt, Human
aaaaauuuaagug

SEQ ID NO: 2399467 - RNA, 21 nt, Human
aaaaauuuaagcauuguuugc

SEQ ID NO: 2399468 - RNA, 22 nt, Human
aaaaauuuaagcauuguuugcu

SEQ ID NO: 2399469 - RNA, 23 nt, Human
aaaaauuguuucaaaauaaaaac

SEQ ID NO: 2399470 - RNA, 21 nt, Human
aaaaauuuaaaggguguacuu

SEQ ID NO: 2399471 - RNA, 14 nt, Human
aaaaauuuaagcau

SEQ ID NO: 2399472 - RNA, 15 nt, Human
aaaaauuuaagcauu

SEQ ID NO: 2399473 - RNA, 16 nt, Human
aaaaauuuaagcauug

SEQ ID NO: 2399474 - RNA, 18 nt, Human
aaaaauuuaagcauuguu

SEQ ID NO: 2399475 - RNA, 20 nt, Human
aaaaauuuaagcauuguuug

SEQ ID NO: 2399476 - RNA, 22 nt, Human
aaaaauuuuauaaaauuaagca

SEQ ID NO: 2399477 - RNA, 12 nt, Human
aaaacacagcaa

SEQ ID NO: 2399478 - RNA, 13 nt, Human
aaaacacagcaag

SEQ ID NO: 2399479 - RNA, 18 nt, Human
aaaacacagcaaggguga

SEQ ID NO: 2399480 - RNA, 12 nt, Human
aaaacacauuuu

SEQ ID NO: 2399481 - RNA, 15 nt, Human
aaaacaauauuguuu

SEQ ID NO: 2399482 - RNA, 17 nt, Human
aaaacaauauuguuucu

SEQ ID NO: 2399483 - RNA, 18 nt, Human
aaaacaauauuguuucua

SEQ ID NO: 2399484 - RNA, 19 nt, Human
aaaacaaucauuugcuuuu

SEQ ID NO: 2399485 - RNA, 15 nt, Human
aaaacacaagcaaaa

SEQ ID NO: 2399486 - RNA, 14 nt, Human
aaaacaauuguaau

SEQ ID NO: 2399487 - RNA, 13 nt, Human
aaaacaaugaaga

SEQ ID NO: 2399488 - RNA, 17 nt, Human
aaaacaaggaugaauua

SEQ ID NO: 2399489 - RNA, 16 nt, Human
aaaacaauaaaauuuu

SEQ ID NO: 2399490 - RNA, 22 nt, Human
aaaacaacuauggaucagaaua

SEQ ID NO: 2399491 - RNA, 18 nt, Human
aaaacaacuucuuuguaa

SEQ ID NO: 2399492 - RNA, 13 nt, Human
aaaaacugauuuu

SEQ ID NO: 2399493 - RNA, 14 nt, Human
aaaaacauggccuu

SEQ ID NO: 2399494 - RNA, 14 nt, Human
aaaaaccaaaacug

SEQ ID NO: 2399495 - RNA, 15 nt, Human
aaaaacugauuuuuu

SEQ ID NO: 2399496 - RNA, 12 nt, Human
aaaaacugaaug

SEQ ID NO: 2399497 - RNA, 12 nt, Human
aaaaacuguauu

SEQ ID NO: 2399498 - RNA, 19 nt, Human
aaaaacuucaguaaguacg

SEQ ID NO: 2399499 - RNA, 18 nt, Human
aaaaacuuguaaaugcug

SEQ ID NO: 2399500 - RNA, 12 nt, Human
aaaaacuuguaa

SEQ ID NO: 2399501 - RNA, 17 nt, Human
aaaaagauauauuaaaa

SEQ ID NO: 2399502 - RNA, 13 nt, Human
aaaaagauauauu

SEQ ID NO: 2399503 - RNA, 22 nt, Human
aaaaagauauauuaaaaauaua

SEQ ID NO: 2399504 - RNA, 19 nt, Human
aaaaagaggaaagaaugaa

SEQ ID NO: 2399505 - RNA, 12 nt, Human
aaaaagaggcua

SEQ ID NO: 2399506 - RNA, 18 nt, Human
aaaaagaggaaagaauga

SEQ ID NO: 2399507 - RNA, 19 nt, Human
aaaaagagaaguauuauaa

SEQ ID NO: 2399508 - RNA, 13 nt, Human
aaaaagaccagac

SEQ ID NO: 2399509 - RNA, 14 nt, Human
aaaaagacagggcu

SEQ ID NO: 2399510 - RNA, 19 nt, Human
aaaaauuccuuuguguuuc

SEQ ID NO: 2399511 - RNA, 21 nt, Human
aaaaauuguuaauuuuuccua

SEQ ID NO: 2399512 - RNA, 14 nt, Human
aaaaauugugauca

SEQ ID NO: 2399513 - RNA, 18 nt, Human
aaaaauugguucuuuauu

SEQ ID NO: 2399514 - RNA, 12 nt, Human
aaaaacacagca

SEQ ID NO: 2399515 - RNA, 19 nt, Human
aaaaacagcauugcuuucu

SEQ ID NO: 2399516 - RNA, 20 nt, Human
aaaaacagcauugcuuucug

SEQ ID NO: 2399517 - RNA, 21 nt, Human
aaaaacagcauugcuuucuga

SEQ ID NO: 2399518 - RNA, 19 nt, Human
aaaaacagccucacagaag

SEQ ID NO: 2399519 - RNA, 22 nt, Human
aaaaaauuugagaaagccuuca

SEQ ID NO: 2399520 - RNA, 14 nt, Human
aaaaaauuuaagug

SEQ ID NO: 2399521 - RNA, 16 nt, Human
aaaaaauuuccaguga

SEQ ID NO: 2399522 - RNA, 11 nt, Human
aaaaacaaaaa

SEQ ID NO: 2399523 - RNA, 14 nt, Human
aaaaacacaaaagu

SEQ ID NO: 2399524 - RNA, 11 nt, Human
aaaaaauuggu

SEQ ID NO: 2399525 - RNA, 12 nt, Human
aaaaaauuuaag

SEQ ID NO: 2399526 - RNA, 17 nt, Human
aagugcuguauaaaauc

SEQ ID NO: 2399527 - RNA, 16 nt, Human
aagugcuguauaaaau

SEQ ID NO: 2399528 - RNA, 15 nt, Human
aagugcuguauaaaa

SEQ ID NO: 2399529 - RNA, 13 nt, Human
aagugcuguauaa

SEQ ID NO: 2399530 - RNA, 12 nt, Human
aagugcuguaua

SEQ ID NO: 2399531 - RNA, 22 nt, Human
aagugcuguauaaaaucagcca

SEQ ID NO: 2399532 - RNA, 19 nt, Human
aagugcuguauaaaaucag

SEQ ID NO: 2399533 - RNA, 23 nt, Human
aagugcuguauaaaaucagccaa

SEQ ID NO: 2399534 - RNA, 22 nt, Human
aagugcugggauuacaggugug

SEQ ID NO: 2399535 - RNA, 21 nt, Human
aauaauccuaaacauaugaau

SEQ ID NO: 2399536 - RNA, 16 nt, Human
aauaaucuauuucuau

SEQ ID NO: 2399537 - RNA, 13 nt, Human
aauaaucggccca

SEQ ID NO: 2399538 - RNA, 16 nt, Human
aauaaucggcccacag

SEQ ID NO: 2399539 - RNA, 13 nt, Human
aauaaucuuauua

SEQ ID NO: 2399540 - RNA, 19 nt, Human
aauaaucuuauuagggaga

SEQ ID NO: 2399541 - RNA, 23 nt, Human
aauaaucuuauuagggagaaaau

SEQ ID NO: 2399542 - RNA, 22 nt, Human
aauaaugaauggacucaaacug

SEQ ID NO: 2399543 - RNA, 14 nt, Human
aauaaucuuugggu

SEQ ID NO: 2399544 - RNA, 14 nt, Human
aauaaguuauugca

SEQ ID NO: 2399545 - RNA, 13 nt, Human
aauaaguuauugc

SEQ ID NO: 2399546 - RNA, 18 nt, Human
aauaaguuauugcaguuu

SEQ ID NO: 2399547 - RNA, 21 nt, Human
aauaaguucaaauucuucuga

SEQ ID NO: 2399548 - RNA, 22 nt, Human
aauaaguucaaauucuucugaa

SEQ ID NO: 2399549 - RNA, 20 nt, Human
aauaaucacgcuuuccugaa

SEQ ID NO: 2399550 - RNA, 21 nt, Human
aauaaucacgcuuuccugaau

SEQ ID NO: 2399551 - RNA, 13 nt, Human
aauaaucauugga

SEQ ID NO: 2399552 - RNA, 13 nt, Human
aauaauaaacuuu

SEQ ID NO: 2399553 - RNA, 13 nt, Human
aauaaugguacca

SEQ ID NO: 2399554 - RNA, 19 nt, Human
aauaaugggcuuagagcag

SEQ ID NO: 2399555 - RNA, 20 nt, Human
aauaaugggcuuagagcagu

SEQ ID NO: 2399556 - RNA, 19 nt, Human
aauaauguaagacaaauau

SEQ ID NO: 2399557 - RNA, 12 nt, Human
aauaauguaaga

SEQ ID NO: 2399558 - RNA, 16 nt, Human
aauaaugugaaacugg

SEQ ID NO: 2399559 - RNA, 12 nt, Human
aauaaugucucu

SEQ ID NO: 2399560 - RNA, 11 nt, Human
aauaaugucuc

SEQ ID NO: 2399561 - RNA, 13 nt, Human
aauaaugucucug

SEQ ID NO: 2399562 - RNA, 23 nt, Human
aauaaugguaccagauaaaauua

SEQ ID NO: 2399563 - RNA, 21 nt, Human
aauaaugguaccagauaaaau

SEQ ID NO: 2399564 - RNA, 20 nt, Human
aauaaugguaccagauaaaa

SEQ ID NO: 2399565 - RNA, 17 nt, Human
aauaaugguaccagaua

SEQ ID NO: 2399566 - RNA, 21 nt, Human
aauaauggucccauccaggca

SEQ ID NO: 2399567 - RNA, 20 nt, Human
aauaauggucccauccaggc

SEQ ID NO: 2399568 - RNA, 19 nt, Human
aauaauguacaucuggccu

SEQ ID NO: 2399569 - RNA, 17 nt, Human
aaguguaaagcauucca

SEQ ID NO: 2399570 - RNA, 16 nt, Human
aaguguaaagcauucc

SEQ ID NO: 2399571 - RNA, 14 nt, Human
aaguguaaagcauu

SEQ ID NO: 2399572 - RNA, 13 nt, Human
aaguguaaagcau

SEQ ID NO: 2399573 - RNA, 11 nt, Human
aaguguaaagc

SEQ ID NO: 2399574 - RNA, 17 nt, Human
aaguguaaacaccauag

SEQ ID NO: 2399575 - RNA, 22 nt, Human
aaguguaaaauauuuugaauca

SEQ ID NO: 2399576 - RNA, 19 nt, Human
aaguggugcucaguuguag

SEQ ID NO: 2399577 - RNA, 17 nt, Human
aaguggugcucaguugu

SEQ ID NO: 2399578 - RNA, 15 nt, Human
aaguggugcucaguu

SEQ ID NO: 2399579 - RNA, 13 nt, Human
aaguggugcucag

SEQ ID NO: 2399580 - RNA, 17 nt, Human
aaguggugguaacccug

SEQ ID NO: 2399581 - RNA, 18 nt, Human
aaguggugguaacccugg

SEQ ID NO: 2399582 - RNA, 20 nt, Human
aaguggguuauucuggaguu

SEQ ID NO: 2399583 - RNA, 17 nt, Human
aagugguauagaaaugc

SEQ ID NO: 2399584 - RNA, 13 nt, Human
aagugguauagaa

SEQ ID NO: 2399585 - RNA, 18 nt, Human
aaguguaaagcauuccaa

SEQ ID NO: 2399586 - RNA, 18 nt, Human
aaguugugccuuuuauag

SEQ ID NO: 2399587 - RNA, 22 nt, Human
aaguuguaggcauaaagucagg

SEQ ID NO: 2399588 - RNA, 20 nt, Human
aaguugugccuuuuauagcu

SEQ ID NO: 2399589 - RNA, 19 nt, Human
aaguugugccuuuuauagc

SEQ ID NO: 2399590 - RNA, 15 nt, Human
aaguugugcuuguuu

SEQ ID NO: 2399591 - RNA, 15 nt, Human
aaguuguuaauaaaa

SEQ ID NO: 2399592 - RNA, 12 nt, Human
aaguuguuugag

SEQ ID NO: 2399593 - RNA, 15 nt, Human
aaguuguuucauuga

SEQ ID NO: 2399594 - RNA, 20 nt, Human
aaguuguggugcugacaaag

SEQ ID NO: 2399595 - RNA, 16 nt, Human
aaguuguggugcugac

SEQ ID NO: 2399596 - RNA, 20 nt, Human
aaguuguuacuaacuaaacu

SEQ ID NO: 2399597 - RNA, 17 nt, Human
aaguuguuaacuaaauu

SEQ ID NO: 2399598 - RNA, 23 nt, Human
aaguuguuacuaacuaaacucuc

SEQ ID NO: 2399599 - RNA, 21 nt, Human
aaguuguuacuaacuaaacuc

SEQ ID NO: 2399600 - RNA, 14 nt, Human
aauaaaauugcacu

SEQ ID NO: 2399601 - RNA, 15 nt, Human
aauaaaauuauuuug

SEQ ID NO: 2399602 - RNA, 23 nt, Human
aauaaaauuaaagcugaaaacug

SEQ ID NO: 2399603 - RNA, 17 nt, Human
aauaaaauguugaaaag

SEQ ID NO: 2399604 - RNA, 21 nt, Human
aauaaaaugugauuuuucuga

SEQ ID NO: 2399605 - RNA, 13 nt, Human
aauaaaaugugau

SEQ ID NO: 2399606 - RNA, 14 nt, Human
aauaaaaugugauu

SEQ ID NO: 2399607 - RNA, 19 nt, Human
aauaaaaugaggacauguu

SEQ ID NO: 2399608 - RNA, 19 nt, Human
aauaaacuauuuguaaagu

SEQ ID NO: 2399609 - RNA, 18 nt, Human
aauaaacuggcagcucag

SEQ ID NO: 2399610 - RNA, 18 nt, Human
aauaaacucaaugagcuc

SEQ ID NO: 2399611 - RNA, 17 nt, Human
aauaaacuguguuuacu

SEQ ID NO: 2399612 - RNA, 21 nt, Human
aauaaacuuagaauaaaauug

SEQ ID NO: 2399613 - RNA, 19 nt, Human
aauaaacuuagaauaaaau

SEQ ID NO: 2399614 - RNA, 17 nt, Human
aauaaacuuagaauaaa

SEQ ID NO: 2399615 - RNA, 15 nt, Human
aauaaacucuaaaca

SEQ ID NO: 2399616 - RNA, 17 nt, Human
aauaagugccaggaugg

SEQ ID NO: 2399617 - RNA, 17 nt, Human
aauaagugguuauuucu

SEQ ID NO: 2399618 - RNA, 11 nt, Human
aauaaguuauu

SEQ ID NO: 2399619 - RNA, 22 nt, Human
aauaaguuaacuauuuuauuuu

SEQ ID NO: 2399620 - RNA, 18 nt, Human
aaggugcugacggccagg

SEQ ID NO: 2399621 - RNA, 11 nt, Human
aaggugggagg

SEQ ID NO: 2399622 - RNA, 20 nt, Human
aaggugcuggaggugggagc

SEQ ID NO: 2399623 - RNA, 15 nt, Human
aaggugcuggaggug

SEQ ID NO: 2399624 - RNA, 20 nt, Human
aagguggacuggaaggggcc

SEQ ID NO: 2399625 - RNA, 22 nt, Human
aaggugggccuugcuaccucaa

SEQ ID NO: 2399626 - RNA, 18 nt, Human
aaggugggcugagcccug

SEQ ID NO: 2399627 - RNA, 19 nt, Human
aaggugggcugagcccugg

SEQ ID NO: 2399628 - RNA, 19 nt, Human
aagguggauggccccagca

SEQ ID NO: 2399629 - RNA, 17 nt, Human
aaggugggccuugcuac

SEQ ID NO: 2399630 - RNA, 16 nt, Human
aaggugggcugagccc

SEQ ID NO: 2399631 - RNA, 15 nt, Human
aagguuaauaaagua

SEQ ID NO: 2399632 - RNA, 16 nt, Human
aagguuaauaaaguaa

SEQ ID NO: 2399633 - RNA, 20 nt, Human
aagguuaauguucaucaucc

SEQ ID NO: 2399634 - RNA, 18 nt, Human
aagguucuggugugaacu

SEQ ID NO: 2399635 - RNA, 21 nt, Human
aagguucuucccuuuuacaua

SEQ ID NO: 2399636 - RNA, 22 nt, Human
aagguugacaauaaaugugcuu

SEQ ID NO: 2399637 - RNA, 16 nt, Human
aagguugggcagggug

SEQ ID NO: 2399638 - RNA, 13 nt, Human
aagguuguauugc

SEQ ID NO: 2399639 - RNA, 23 nt, Human
aagguuuaaacuucucugaaggg

SEQ ID NO: 2399640 - RNA, 22 nt, Human
aagguuuaaacuucucugaagg

SEQ ID NO: 2399641 - RNA, 17 nt, Human
aagguuguauugcauau

SEQ ID NO: 2399642 - RNA, 16 nt, Human
aagguuaagcccugag

SEQ ID NO: 2399643 - RNA, 15 nt, Human
aaguacuuuuggcau

SEQ ID NO: 2399644 - RNA, 14 nt, Human
aaguacuuuuggca

SEQ ID NO: 2399645 - RNA, 21 nt, Human
aagguuuacaauuuacaaagu

SEQ ID NO: 2399646 - RNA, 15 nt, Human
aagguuuaggcuggu

SEQ ID NO: 2399647 - RNA, 19 nt, Human
aagguuuaggcugguggcc

SEQ ID NO: 2399648 - RNA, 20 nt, Human
aagguuuaggcugguggccc

SEQ ID NO: 2399649 - RNA, 21 nt, Human
aagguuuaggcugguggccca

SEQ ID NO: 2399650 - RNA, 11 nt, Human
aaguacuucuu

SEQ ID NO: 2399651 - RNA, 12 nt, Human
aaguauauaaug

SEQ ID NO: 2399652 - RNA, 18 nt, Human
aaguauauauauauauua

SEQ ID NO: 2399653 - RNA, 11 nt, Human
aaguaucaugc

SEQ ID NO: 2399654 - RNA, 23 nt, Human
aaguauauaaugguuucaaagau

SEQ ID NO: 2399655 - RNA, 18 nt, Human
aaguauauaaugguuuca

SEQ ID NO: 2399656 - RNA, 11 nt, Human
aaguauauaua

SEQ ID NO: 2399657 - RNA, 16 nt, Human
aaguauauauagaauc

SEQ ID NO: 2399658 - RNA, 13 nt, Human
aaguauauauuua

SEQ ID NO: 2399659 - RNA, 23 nt, Human
aaguccaggcuuuuuuaucaugu

SEQ ID NO: 2399660 - RNA, 12 nt, Human
aaguauguaaag

SEQ ID NO: 2399661 - RNA, 21 nt, Human
aaguauguaaacaggagacag

SEQ ID NO: 2399662 - RNA, 22 nt, Human
aaguauguaaaguauguaaaca

SEQ ID NO: 2399663 - RNA, 13 nt, Human
aaguaugugagug

SEQ ID NO: 2399664 - RNA, 18 nt, Human
aaguauguguaaaaugug

SEQ ID NO: 2399665 - RNA, 18 nt, Human
aaguaugugagugugucc

SEQ ID NO: 2399666 - RNA, 16 nt, Human
aaguaucccuacugua

SEQ ID NO: 2399667 - RNA, 15 nt, Human
aaguaucugacaucu

SEQ ID NO: 2399668 - RNA, 14 nt, Human
aaguaucaugcauu

SEQ ID NO: 2399669 - RNA, 12 nt, Human
aaguaucaugca

SEQ ID NO: 2399670 - RNA, 15 nt, Human
aaguaucaugcauuc

SEQ ID NO: 2399671 - RNA, 23 nt, Human
aaguaugaaucuaugccaaagau

SEQ ID NO: 2399672 - RNA, 16 nt, Human
aaguaugaaucuaugc

SEQ ID NO: 2399673 - RNA, 14 nt, Human
aaguaugaaucuau

SEQ ID NO: 2399674 - RNA, 14 nt, Human
aaguaucuucaugu

SEQ ID NO: 2399675 - RNA, 22 nt, Human
aaguaucugacaucucugcaau

SEQ ID NO: 2399676 - RNA, 18 nt, Human
aaguaucuuuuuucaaaa

SEQ ID NO: 2399677 - RNA, 21 nt, Human
aaguaugagggaaaaugagua

SEQ ID NO: 2399678 - RNA, 17 nt, Human
aaguaugagggaaaaug

SEQ ID NO: 2399679 - RNA, 13 nt, Human
aaguauguaaaca

SEQ ID NO: 2399680 - RNA, 16 nt, Human
aagucuuagauguaua

SEQ ID NO: 2399681 - RNA, 15 nt, Human
aagucuguuuuauga

SEQ ID NO: 2399682 - RNA, 16 nt, Human
aagucuguuuuaugac

SEQ ID NO: 2399683 - RNA, 18 nt, Human
aagucuguuuuaugacuu

SEQ ID NO: 2399684 - RNA, 19 nt, Human
aagucuguuuuaugacuuc

SEQ ID NO: 2399685 - RNA, 23 nt, Human
aagucuuaaaauaacuuauauca

SEQ ID NO: 2399686 - RNA, 18 nt, Human
aagucuuaaaauaacuua

SEQ ID NO: 2399687 - RNA, 17 nt, Human
aagucuuaaaauaacuu

SEQ ID NO: 2399688 - RNA, 20 nt, Human
aagucuguuuuaugacuuca

SEQ ID NO: 2399689 - RNA, 23 nt, Human
aagucuguuuuaugacuucauua

SEQ ID NO: 2399690 - RNA, 19 nt, Human
aagucucuggaauuugaaa

SEQ ID NO: 2399691 - RNA, 16 nt, Human
aagucucugcuggccc

SEQ ID NO: 2399692 - RNA, 21 nt, Human
aagucucugcuggcccagcca

SEQ ID NO: 2399693 - RNA, 23 nt, Human
aaguccagauuuacacugggaga

SEQ ID NO: 2399694 - RNA, 21 nt, Human
aaguccccgaguuuccccaga

SEQ ID NO: 2399695 - RNA, 14 nt, Human
aaguccccaggccc

SEQ ID NO: 2399696 - RNA, 18 nt, Human
aaguccccaggccccagg

SEQ ID NO: 2399697 - RNA, 21 nt, Human
aaguccccaggccccaggaag

SEQ ID NO: 2399698 - RNA, 23 nt, Human
aaguccccaggccccaggaagcc

SEQ ID NO: 2399699 - RNA, 19 nt, Human
aagucccugacucucugug

SEQ ID NO: 2399700 - RNA, 22 nt, Human
aaguccccaggccccaggaagc

SEQ ID NO: 2399701 - RNA, 22 nt, Human
aagucucugaagugaaacugcu

SEQ ID NO: 2399702 - RNA, 15 nt, Human
aagucucugcuggcc

SEQ ID NO: 2399703 - RNA, 19 nt, Human
aagucucugaagugaaacu

SEQ ID NO: 2399704 - RNA, 17 nt, Human
aagucucuagguucuga

SEQ ID NO: 2399705 - RNA, 14 nt, Human
aagucuccuucccc

SEQ ID NO: 2399706 - RNA, 16 nt, Human
aagcuaaaaccugagc

SEQ ID NO: 2399707 - RNA, 12 nt, Human
aagcguggugga

SEQ ID NO: 2399708 - RNA, 21 nt, Human
aagcuaaauccuuuacuguua

SEQ ID NO: 2399709 - RNA, 23 nt, Human
aagcuaaaaccugagcuagaagc

SEQ ID NO: 2399710 - RNA, 11 nt, Human
aagcuaaagag

SEQ ID NO: 2399711 - RNA, 21 nt, Human
aagcugcacccucaggcaggu

SEQ ID NO: 2399712 - RNA, 20 nt, Human
aagcugcacccucaggcagg

SEQ ID NO: 2399713 - RNA, 23 nt, Human
aagcugccuccccucuccuuccu

SEQ ID NO: 2399714 - RNA, 22 nt, Human
aagcugcacccucaggcaggug

SEQ ID NO: 2399715 - RNA, 15 nt, Human
aagcugccugcuuuu

SEQ ID NO: 2399716 - RNA, 12 nt, Human
aagcugccugcu

SEQ ID NO: 2399717 - RNA, 20 nt, Human
aagcugccugcuuuucacug

SEQ ID NO: 2399718 - RNA, 17 nt, Human
aagcugccugcuuuuca

SEQ ID NO: 2399719 - RNA, 15 nt, Human
aagcugccugguaua

SEQ ID NO: 2399720 - RNA, 20 nt, Human
aagcugccugguauauccaa

SEQ ID NO: 2399721 - RNA, 14 nt, Human
aagcugccuguagu

SEQ ID NO: 2399722 - RNA, 16 nt, Human
aaggauuuuaugcuuu

SEQ ID NO: 2399723 - RNA, 20 nt, Human
aaggauuuuaugcuuuaaac

SEQ ID NO: 2399724 - RNA, 21 nt, Human
aaggauuuuaugcuuuaaaca

SEQ ID NO: 2399725 - RNA, 22 nt, Human
aaggauuuuaugcuuuaaacau

SEQ ID NO: 2399726 - RNA, 23 nt, Human
aaggauuuuaugcuuuaaacauu

SEQ ID NO: 2399727 - RNA, 12 nt, Human
aaggauuuuaug

SEQ ID NO: 2399728 - RNA, 13 nt, Human
aaggauuuuaugc

SEQ ID NO: 2399729 - RNA, 14 nt, Human
aaggauugugauau

SEQ ID NO: 2399730 - RNA, 20 nt, Human
aaggacugugacaggcagca

SEQ ID NO: 2399731 - RNA, 17 nt, Human
aaggauugugauauuuu

SEQ ID NO: 2399732 - RNA, 23 nt, Human
aaggacugcgggacuugggucuc

SEQ ID NO: 2399733 - RNA, 17 nt, Human
aaggacugagggacucu

SEQ ID NO: 2399734 - RNA, 13 nt, Human
aaggacugaggga

SEQ ID NO: 2399735 - RNA, 22 nt, Human
aaggacugccgaccgaggcugg

SEQ ID NO: 2399736 - RNA, 18 nt, Human
aaggacuaggguccuggg

SEQ ID NO: 2399737 - RNA, 20 nt, Human
aaggacuaggguccugggga

SEQ ID NO: 2399738 - RNA, 13 nt, Human
aaggacuccaccc

SEQ ID NO: 2399739 - RNA, 12 nt, Human
aaggacucuggg

SEQ ID NO: 2399740 - RNA, 15 nt, Human
aaggacuaggguccu

SEQ ID NO: 2399741 - RNA, 21 nt, Human
aaggacccggaggggccuggc

SEQ ID NO: 2399742 - RNA, 18 nt, Human
aaggacccggaggggccu

SEQ ID NO: 2399743 - RNA, 20 nt, Human
aaggaccacauuuuauauuu

SEQ ID NO: 2399744 - RNA, 13 nt, Human
aaggaccccucac

SEQ ID NO: 2399745 - RNA, 15 nt, Human
aaggaccccucaccu

SEQ ID NO: 2399746 - RNA, 20 nt, Human
aaggaccccucaccuugcaa

SEQ ID NO: 2399747 - RNA, 22 nt, Human
aagcuggccgaggguccuggcu

SEQ ID NO: 2399748 - RNA, 21 nt, Human
aagcuggccgaggguccuggc

SEQ ID NO: 2399749 - RNA, 11 nt, Human
aagcugggcag

SEQ ID NO: 2399750 - RNA, 16 nt, Human
aagcugcucuggaauu

SEQ ID NO: 2399751 - RNA, 22 nt, Human
aagcugccuguaguuaggaaau

SEQ ID NO: 2399752 - RNA, 15 nt, Human
aagcugccuguaguu

SEQ ID NO: 2399753 - RNA, 16 nt, Human
aagcugccuguaguua

SEQ ID NO: 2399754 - RNA, 19 nt, Human
aagcugccuguaguuagga

SEQ ID NO: 2399755 - RNA, 21 nt, Human
aagcugccuguaguuaggaaa

SEQ ID NO: 2399756 - RNA, 18 nt, Human
aaggacauugcggacagc

SEQ ID NO: 2399757 - RNA, 23 nt, Human
aaggaccacauuuuauauuuauu

SEQ ID NO: 2399758 - RNA, 19 nt, Human
aaggaccacauuuuauauu

SEQ ID NO: 2399759 - RNA, 16 nt, Human
aaggaccacauuuuau

SEQ ID NO: 2399760 - RNA, 12 nt, Human
aaggaccaggac

SEQ ID NO: 2399761 - RNA, 13 nt, Human
aaggaccaggacu

SEQ ID NO: 2399762 - RNA, 13 nt, Human
aagcugggcaggu

SEQ ID NO: 2399763 - RNA, 18 nt, Human
aaggcaaggcugucaauu

SEQ ID NO: 2399764 - RNA, 17 nt, Human
aaggcaaggcugucaau

SEQ ID NO: 2399765 - RNA, 16 nt, Human
aaggcaaggcugucaa

SEQ ID NO: 2399766 - RNA, 14 nt, Human
aaggcaaaaaugua

SEQ ID NO: 2399767 - RNA, 22 nt, Human
aaggcaaugccauccucaaaca

SEQ ID NO: 2399768 - RNA, 20 nt, Human
aaggcaaguuucuagcuaga

SEQ ID NO: 2399769 - RNA, 22 nt, Human
aaggcaccuauaaaacagguca

SEQ ID NO: 2399770 - RNA, 16 nt, Human
aagcugccucaaggaa

SEQ ID NO: 2399771 - RNA, 16 nt, Human
aagauuuaccacuugu

SEQ ID NO: 2399772 - RNA, 16 nt, Human
aagaacauagaacucu

SEQ ID NO: 2399773 - RNA, 18 nt, Human
aagaacauccaaggagaa

SEQ ID NO: 2399774 - RNA, 16 nt, Human
aagauugcugaaauuu

SEQ ID NO: 2399775 - RNA, 16 nt, Human
aagauugcuuaaaaua

SEQ ID NO: 2399776 - RNA, 17 nt, Human
aagauuuaucaaaucag

SEQ ID NO: 2399777 - RNA, 14 nt, Human
aagauuuaucaaau

SEQ ID NO: 2399778 - RNA, 16 nt, Human
aagauuuccauauaaa

SEQ ID NO: 2399779 - RNA, 18 nt, Human
aagauuuaucaaaucagu

SEQ ID NO: 2399780 - RNA, 17 nt, Human
aagauuuccaagugcca

SEQ ID NO: 2399781 - RNA, 17 nt, Human
aagauuuggaauaaagu

SEQ ID NO: 2399782 - RNA, 16 nt, Human
aagauuugcuuuaauu

SEQ ID NO: 2399783 - RNA, 23 nt, Human
aagauuugaugcuggagagguua

SEQ ID NO: 2399784 - RNA, 22 nt, Human
aagauuugaugcuggagagguu

SEQ ID NO: 2399785 - RNA, 13 nt, Human
aagauuucuugag

SEQ ID NO: 2399786 - RNA, 16 nt, Human
aagauuuuaaagacau

SEQ ID NO: 2399787 - RNA, 21 nt, Human
aagauuuguuuugucaagugu

SEQ ID NO: 2399788 - RNA, 21 nt, Human
aagaacaaaaaaaucugcaga

SEQ ID NO: 2399789 - RNA, 20 nt, Human
aagaacaaaaaaaucugcag

SEQ ID NO: 2399790 - RNA, 16 nt, Human
aagaaauugcaauaac

SEQ ID NO: 2399791 - RNA, 13 nt, Human
aagaaauugcaau

SEQ ID NO: 2399792 - RNA, 17 nt, Human
aagaaauuuaaaagaca

SEQ ID NO: 2399793 - RNA, 16 nt, Human
aagaaauuugauuucu

SEQ ID NO: 2399794 - RNA, 21 nt, Human
aagaacacccuauauuuugca

SEQ ID NO: 2399795 - RNA, 19 nt, Human
aagaacacccuauauuuug

SEQ ID NO: 2399796 - RNA, 20 nt, Human
aagaacacuuuuaauaaacu

SEQ ID NO: 2399797 - RNA, 16 nt, Human
aagaacacccucuaaa

SEQ ID NO: 2399798 - RNA, 12 nt, Human
aagaacauagaa

SEQ ID NO: 2399799 - RNA, 14 nt, Human
aagaacaagaauuu

SEQ ID NO: 2399800 - RNA, 15 nt, Human
aagaacaauauugac

SEQ ID NO: 2399801 - RNA, 21 nt, Human
aagaacaaagagaaaaaauac

SEQ ID NO: 2399802 - RNA, 21 nt, Human
aagaacaauauugacuuuguc

SEQ ID NO: 2399803 - RNA, 22 nt, Human
aagaaauuaugugccagauuua

SEQ ID NO: 2399804 - RNA, 17 nt, Human
aagaaauuccuguagca

SEQ ID NO: 2399805 - RNA, 14 nt, Human
aagaaauuccugua

SEQ ID NO: 2399806 - RNA, 13 nt, Human
aagaaauuaugug

SEQ ID NO: 2399807 - RNA, 12 nt, Human
aagccagcuuuc

SEQ ID NO: 2399808 - RNA, 14 nt, Human
aagccagcuuuccc

SEQ ID NO: 2399809 - RNA, 15 nt, Human
aagccagcuuucccu

SEQ ID NO: 2399810 - RNA, 17 nt, Human
aagccagcuuucccugc

SEQ ID NO: 2399811 - RNA, 23 nt, Human
aagccagcuuucccugccucuca

SEQ ID NO: 2399812 - RNA, 20 nt, Human
aagccaggaauuucccagga

SEQ ID NO: 2399813 - RNA, 21 nt, Human
aagccaggaauuucccaggac

SEQ ID NO: 2399814 - RNA, 22 nt, Human
aagccaggaauuucccaggacc

SEQ ID NO: 2399815 - RNA, 20 nt, Human
aagccagcguccuccucugu

SEQ ID NO: 2399816 - RNA, 15 nt, Human
aagccagcugccgac

SEQ ID NO: 2399817 - RNA, 21 nt, Human
aagccagcugccgaccagagc

SEQ ID NO: 2399818 - RNA, 23 nt, Human
aagccagcugccgaccagagccc

SEQ ID NO: 2399819 - RNA, 16 nt, Human
aagccagaggcugggu

SEQ ID NO: 2399820 - RNA, 15 nt, Human
aagccagaggcuggg

SEQ ID NO: 2399821 - RNA, 19 nt, Human
aagccagcguccuccucug

SEQ ID NO: 2399822 - RNA, 13 nt, Human
aagccagauuuuc

SEQ ID NO: 2399823 - RNA, 14 nt, Human
aagccagaggcugg

SEQ ID NO: 2399824 - RNA, 11 nt, Human
aagccagacag

SEQ ID NO: 2399825 - RNA, 13 nt, Human
aagccagaagcug

SEQ ID NO: 2399826 - RNA, 14 nt, Human
aagccagaagcuga

SEQ ID NO: 2399827 - RNA, 17 nt, Human
aagccagaagcugagca

SEQ ID NO: 2399828 - RNA, 20 nt, Human
aagccagaagcugagcacca

SEQ ID NO: 2399829 - RNA, 18 nt, Human
aagccacuuaaaauguuc

SEQ ID NO: 2399830 - RNA, 15 nt, Human
aagccagaaccagau

SEQ ID NO: 2399831 - RNA, 12 nt, Human
aagccagaagcu

SEQ ID NO: 2399832 - RNA, 15 nt, Human
aagcaggcuggaggu

SEQ ID NO: 2399833 - RNA, 22 nt, Human
aagcaggcuacacugacacugg

SEQ ID NO: 2399834 - RNA, 16 nt, Human
aagcaggcuacacuga

SEQ ID NO: 2399835 - RNA, 21 nt, Human
aagcaggaggaggugccaaca

SEQ ID NO: 2399836 - RNA, 16 nt, Human
aagcaggaagcucaga

SEQ ID NO: 2399837 - RNA, 17 nt, Human
aagcagcuuuaaacaaa

SEQ ID NO: 2399838 - RNA, 16 nt, Human
aagcagcuuuaaacaa

SEQ ID NO: 2399839 - RNA, 22 nt, Human
aagcaggaaaugaaaaugucuu

SEQ ID NO: 2399840 - RNA, 21 nt, Human
aagcagcuuuaaacaaauuca

SEQ ID NO: 2399841 - RNA, 11 nt, Human
aagcaggaagc

SEQ ID NO: 2399842 - RNA, 12 nt, Human
aagcaggaagcu

SEQ ID NO: 2399843 - RNA, 13 nt, Human
aagcaggaagcuc

SEQ ID NO: 2399844 - RNA, 11 nt, Human
aagcagcucuu

SEQ ID NO: 2399845 - RNA, 17 nt, Human
aagcagcucuugcuaau

SEQ ID NO: 2399846 - RNA, 17 nt, Human
aagcagcucuccccuca

SEQ ID NO: 2399847 - RNA, 13 nt, Human
aagcagagcuucc

SEQ ID NO: 2399848 - RNA, 14 nt, Human
aagcagcucucccc

SEQ ID NO: 2399849 - RNA, 13 nt, Human
aagcagcucuccc

SEQ ID NO: 2399850 - RNA, 21 nt, Human
aagcagaccacugauaaaacc

SEQ ID NO: 2399851 - RNA, 14 nt, Human
aagcagacagcucc

SEQ ID NO: 2399852 - RNA, 15 nt, Human
aagcagacagcucca

SEQ ID NO: 2399853 - RNA, 12 nt, Human
aagcagacagcu

SEQ ID NO: 2399854 - RNA, 17 nt, Human
aagauuuuaaucaaguu

SEQ ID NO: 2399855 - RNA, 18 nt, Human
aagauuuuaaucaaguug

SEQ ID NO: 2399856 - RNA, 13 nt, Human
aagauuuuaaauu

SEQ ID NO: 2399857 - RNA, 14 nt, Human
aagcagaggaagga

SEQ ID NO: 2399858 - RNA, 18 nt, Human
aagccauaauuguucuua

SEQ ID NO: 2399859 - RNA, 14 nt, Human
aagccaucuuggua

SEQ ID NO: 2399860 - RNA, 15 nt, Human
aagccaucuugguaa

SEQ ID NO: 2399861 - RNA, 16 nt, Human
aagccaucuugguaaa

SEQ ID NO: 2399862 - RNA, 13 nt, Human
aauauaagaauaa

SEQ ID NO: 2399863 - RNA, 21 nt, Human
aauauaacuuaaaaauguaaa

SEQ ID NO: 2399864 - RNA, 22 nt, Human
aauauaacugccuuaaaacuuu

SEQ ID NO: 2399865 - RNA, 20 nt, Human
aauauaggaacuuaaauaau

SEQ ID NO: 2399866 - RNA, 21 nt, Human
aauauaggaacuuaaauaaug

SEQ ID NO: 2399867 - RNA, 21 nt, Human
aauauggacacuuaauacuac

SEQ ID NO: 2399868 - RNA, 17 nt, Human
aauauggacucaguuuu

SEQ ID NO: 2399869 - RNA, 17 nt, Human
aauauggacacuuaaua

SEQ ID NO: 2399870 - RNA, 18 nt, Human
aauauauaaaaagaaaag

SEQ ID NO: 2399871 - RNA, 18 nt, Human
aauauaauuuuuuagaga

SEQ ID NO: 2399872 - RNA, 18 nt, Human
aauauaggaacuuaaaua

SEQ ID NO: 2399873 - RNA, 11 nt, Human
aauauaauuau

SEQ ID NO: 2399874 - RNA, 16 nt, Human
aauauaauucuguaaa

SEQ ID NO: 2399875 - RNA, 15 nt, Human
aauauaauucuguaa

SEQ ID NO: 2399876 - RNA, 13 nt, Human
aauauaauucugu

SEQ ID NO: 2399877 - RNA, 14 nt, Human
aauauaauuaucgg

SEQ ID NO: 2399878 - RNA, 22 nt, Human
aauauaagaauaaaauguugaa

SEQ ID NO: 2399879 - RNA, 16 nt, Human
aauauaagaauaaaau

SEQ ID NO: 2399880 - RNA, 18 nt, Human
aauauaaggaaagcaaua

SEQ ID NO: 2399881 - RNA, 19 nt, Human
aauauaaggaaagcaauaa

SEQ ID NO: 2399882 - RNA, 21 nt, Human
aauauaaggaaagcaauaaau

SEQ ID NO: 2399883 - RNA, 16 nt, Human
aauauaaguuucuuug

SEQ ID NO: 2399884 - RNA, 23 nt, Human
aauauaaggaaagcaauaaauga

SEQ ID NO: 2399885 - RNA, 17 nt, Human
aauauaaguuucuuugc

SEQ ID NO: 2399886 - RNA, 14 nt, Human
aauauaauacugua

SEQ ID NO: 2399887 - RNA, 20 nt, Human
aaucaauuacugguccaaaa

SEQ ID NO: 2399888 - RNA, 18 nt, Human
aaucaauuuaaacccauu

SEQ ID NO: 2399889 - RNA, 13 nt, Human
aaucacagaauca

SEQ ID NO: 2399890 - RNA, 22 nt, Human
aaucaauuuaaacccauuuuag

SEQ ID NO: 2399891 - RNA, 20 nt, Human
aaucaauuuaaacccauuuu

SEQ ID NO: 2399892 - RNA, 21 nt, Human
aaucacagcuuguauuuugug

SEQ ID NO: 2399893 - RNA, 19 nt, Human
aaucacagcuuguauuuug

SEQ ID NO: 2399894 - RNA, 16 nt, Human
aaucacauccuggccu

SEQ ID NO: 2399895 - RNA, 13 nt, Human
aaucacauccugg

SEQ ID NO: 2399896 - RNA, 11 nt, Human
aaucacauccu

SEQ ID NO: 2399897 - RNA, 15 nt, Human
aaucacaguuggccu

SEQ ID NO: 2399898 - RNA, 13 nt, Human
aaucacaauacau

SEQ ID NO: 2399899 - RNA, 22 nt, Human
aaucaauuaauuuuuuuauugu

SEQ ID NO: 2399900 - RNA, 15 nt, Human
aaucaagaaacuuaa

SEQ ID NO: 2399901 - RNA, 14 nt, Human
aaucaacugggcug

SEQ ID NO: 2399902 - RNA, 19 nt, Human
aaucaacugggcugaacac

SEQ ID NO: 2399903 - RNA, 14 nt, Human
aaucaacucuaaua

SEQ ID NO: 2399904 - RNA, 16 nt, Human
aauauuauguuaaaac

SEQ ID NO: 2399905 - RNA, 14 nt, Human
aauauuauguguuu

SEQ ID NO: 2399906 - RNA, 15 nt, Human
aauauguauuguaaa

SEQ ID NO: 2399907 - RNA, 14 nt, Human
aauauguauuguaa

SEQ ID NO: 2399908 - RNA, 20 nt, Human
aauauguauuguaaacaugu

SEQ ID NO: 2399909 - RNA, 19 nt, Human
aauaugggcauuguaguua

SEQ ID NO: 2399910 - RNA, 18 nt, Human
aauauggcuauaaauaua

SEQ ID NO: 2399911 - RNA, 15 nt, Human
aauauggcuauaaau

SEQ ID NO: 2399912 - RNA, 13 nt, Human
aauaugggagaaa

SEQ ID NO: 2399913 - RNA, 16 nt, Human
aauaugguugauaguu

SEQ ID NO: 2399914 - RNA, 18 nt, Human
aauaugguguacauucuu

SEQ ID NO: 2399915 - RNA, 21 nt, Human
aaugaugauguggaagaacuu

SEQ ID NO: 2399916 - RNA, 19 nt, Human
aaugaugccaugaggaaca

SEQ ID NO: 2399917 - RNA, 16 nt, Human
aaugaucucuucuuuu

SEQ ID NO: 2399918 - RNA, 20 nt, Human
aaugaugaugggaauugugu

SEQ ID NO: 2399919 - RNA, 17 nt, Human
aaugaucuuuucaaguu

SEQ ID NO: 2399920 - RNA, 14 nt, Human
aauccauacauuug

SEQ ID NO: 2399921 - RNA, 13 nt, Human
aauccauacauuu

SEQ ID NO: 2399922 - RNA, 20 nt, Human
aauccaggcagauccaggac

SEQ ID NO: 2399923 - RNA, 21 nt, Human
aauccaggcagauccaggacu

SEQ ID NO: 2399924 - RNA, 22 nt, Human
aauccaggcagauccaggacua

SEQ ID NO: 2399925 - RNA, 18 nt, Human
aauccaggguggugguga

SEQ ID NO: 2399926 - RNA, 18 nt, Human
aaucccaaauuugauuga

SEQ ID NO: 2399927 - RNA, 13 nt, Human
aaucuccaaaaua

SEQ ID NO: 2399928 - RNA, 14 nt, Human
aaucuccaaaauaa

SEQ ID NO: 2399929 - RNA, 22 nt, Human
aaucugauuuguuuuccucuua

SEQ ID NO: 2399930 - RNA, 11 nt, Human
aaucccaaauu

SEQ ID NO: 2399931 - RNA, 16 nt, Human
aaucccaaauuugauu

SEQ ID NO: 2399932 - RNA, 19 nt, Human
aauccauguuaguuuuuac

SEQ ID NO: 2399933 - RNA, 22 nt, Human
aauccauguuaguuuuuacuuu

SEQ ID NO: 2399934 - RNA, 17 nt, Human
aauccauguuaguuuuu

SEQ ID NO: 2399935 - RNA, 20 nt, Human
aaugauaacuggaaacuuca

SEQ ID NO: 2399936 - RNA, 18 nt, Human
aaugauaaguaaaugcua

SEQ ID NO: 2399937 - RNA, 21 nt, Human
aaugaugauccuaggcauuug

SEQ ID NO: 2399938 - RNA, 21 nt, Human
aaugauaaguaaaugcuaggu

SEQ ID NO: 2399939 - RNA, 20 nt, Human
aaugauaauauuguggugcc

SEQ ID NO: 2399940 - RNA, 22 nt, Human
aaugaucucucugaauccuaag

SEQ ID NO: 2399941 - RNA, 17 nt, Human
aaugauaacuggaaacu

SEQ ID NO: 2399942 - RNA, 11 nt, Human
aaugaagaaag

SEQ ID NO: 2399943 - RNA, 15 nt, Human
aaugaacugaaguuu

SEQ ID NO: 2399944 - RNA, 14 nt, Human
aaugaacugaaguu

SEQ ID NO: 2399945 - RNA, 11 nt, Human
aaugaacugaa

SEQ ID NO: 2399946 - RNA, 18 nt, Human
aaugaaccgcugaauaug

SEQ ID NO: 2399947 - RNA, 22 nt, Human
aaugaacccccaugauguaagu

SEQ ID NO: 2399948 - RNA, 21 nt, Human
aaugaacccccaugauguaag

SEQ ID NO: 2399949 - RNA, 17 nt, Human
aaugaaccccacugggu

SEQ ID NO: 2399950 - RNA, 23 nt, Human
aaugaaccacaucuugcucugcu

SEQ ID NO: 2399951 - RNA, 17 nt, Human
aaugaaccacaucuugc

SEQ ID NO: 2399952 - RNA, 22 nt, Human
aaucuggaccccaucugugaau

SEQ ID NO: 2399953 - RNA, 16 nt, Human
aaugaaccacaucuug

SEQ ID NO: 2399954 - RNA, 23 nt, Human
aaucugcagaaggaaaaaugugu

SEQ ID NO: 2399955 - RNA, 17 nt, Human
aaucugcagaaggaaaa

SEQ ID NO: 2399956 - RNA, 14 nt, Human
aaucugcagaagga

SEQ ID NO: 2399957 - RNA, 23 nt, Human
aaucucauagguugccaauaaua

SEQ ID NO: 2399958 - RNA, 17 nt, Human
aaucucauugcuuacaa

SEQ ID NO: 2399959 - RNA, 22 nt, Human
aaucugcuuuuuaaagaaugcu

SEQ ID NO: 2399960 - RNA, 21 nt, Human
aaucuggaccccaucugugaa

SEQ ID NO: 2399961 - RNA, 18 nt, Human
aauuaguggcacuugcuu

SEQ ID NO: 2399962 - RNA, 21 nt, Human
aauuagugcuaagugugaacu

SEQ ID NO: 2399963 - RNA, 20 nt, Human
aauuaguuuuauaugcuucu

SEQ ID NO: 2399964 - RNA, 17 nt, Human
aauuaguuuuauaugcu

SEQ ID NO: 2399965 - RNA, 14 nt, Human
aauuaguuuuauau

SEQ ID NO: 2399966 - RNA, 22 nt, Human
aauuagugcuaagugugaacug

SEQ ID NO: 2399967 - RNA, 18 nt, Human
aaugucucugugagacuc

SEQ ID NO: 2399968 - RNA, 17 nt, Human
aaugucucugugagacu

SEQ ID NO: 2399969 - RNA, 20 nt, Human
aaugucuaauguauuuuauu

SEQ ID NO: 2399970 - RNA, 19 nt, Human
aaugucuaauguauuuuau

SEQ ID NO: 2399971 - RNA, 14 nt, Human
aaugucuauuaagg

SEQ ID NO: 2399972 - RNA, 16 nt, Human
aaugucuaauguauuu

SEQ ID NO: 2399973 - RNA, 18 nt, Human
aaugucuaaaugcugaaa

SEQ ID NO: 2399974 - RNA, 17 nt, Human
aaugucugagugaaccu

SEQ ID NO: 2399975 - RNA, 20 nt, Human
aaugucucuuuaaugucaca

SEQ ID NO: 2399976 - RNA, 21 nt, Human
aaugucagugugacugaucuc

SEQ ID NO: 2399977 - RNA, 17 nt, Human
aaugucagugugacuga

SEQ ID NO: 2399978 - RNA, 22 nt, Human
aaugucuaguuguaacaccaug

SEQ ID NO: 2399979 - RNA, 16 nt, Human
aaugucaguaugugga

SEQ ID NO: 2399980 - RNA, 22 nt, Human
aaugucaguauguggaagugug

SEQ ID NO: 2399981 - RNA, 13 nt, Human
aaugucaguguga

SEQ ID NO: 2399982 - RNA, 16 nt, Human
aaugucagugugacug

SEQ ID NO: 2399983 - RNA, 15 nt, Human
aaugucagugugacu

SEQ ID NO: 2399984 - RNA, 16 nt, Human
aauggugccuucauuu

SEQ ID NO: 2399985 - RNA, 22 nt, Human
aaugguggggaacuauaaagaa

SEQ ID NO: 2399986 - RNA, 16 nt, Human
aaugguguacauaaug

SEQ ID NO: 2399987 - RNA, 10 nt, Human
aauggugccu

SEQ ID NO: 2399988 - RNA, 13 nt, Human
aaugguguacaua

SEQ ID NO: 2399989 - RNA, 22 nt, Human
aauggugaaaauaaaauaaagc

SEQ ID NO: 2399990 - RNA, 22 nt, Human
aauggucuuucuaaugugugaa

SEQ ID NO: 2399991 - RNA, 15 nt, Human
aauggucgcccagga

SEQ ID NO: 2399992 - RNA, 16 nt, Human
aauggucgcccaggag

SEQ ID NO: 2399993 - RNA, 13 nt, Human
aaugggcagagca

SEQ ID NO: 2399994 - RNA, 15 nt, Human
aaugggcagagcaga

SEQ ID NO: 2399995 - RNA, 17 nt, Human
aaugggcuuagagcagu

SEQ ID NO: 2399996 - RNA, 12 nt, Human
aauggggccaga

SEQ ID NO: 2399997 - RNA, 13 nt, Human
aauggggccagau

SEQ ID NO: 2399998 - RNA, 22 nt, Human
aaugggcaguuacaugcauacu

SEQ ID NO: 2399999 - RNA, 21 nt, Human
aaugggcaguuacaugcauac

SEQ ID NO: 2400000 - RNA, 18 nt, Human
aaugggcaguuacaugca

SEQ ID NO: 2400001 - RNA, 17 nt, Human
aaugggcaguuacaugc

SEQ ID NO: 2400002 - RNA, 22 nt, Human
aaugggaacugccucuuuccug

SEQ ID NO: 2400003 - RNA, 16 nt, Human
aaugguaccagauaaa

SEQ ID NO: 2400004 - RNA, 17 nt, Human
aauggggaucacagaga

SEQ ID NO: 2400005 - RNA, 15 nt, Human
aaugguaccagauaa

SEQ ID NO: 2400006 - RNA, 16 nt, Human
aauggguuuuucccug

SEQ ID NO: 2400007 - RNA, 16 nt, Human
aaugguauaaauuuca

SEQ ID NO: 2400008 - RNA, 17 nt, Human
aaugguaggcauuuccu

SEQ ID NO: 2400009 - RNA, 18 nt, Human
aaugguaggcauuuccua

SEQ ID NO: 2400010 - RNA, 23 nt, Human
aaugguaguaaucacaguuggcc

SEQ ID NO: 2400011 - RNA, 22 nt, Human
aauggcuuauccagcuggugag

SEQ ID NO: 2400012 - RNA, 21 nt, Human
aauggcuuauccagcugguga

SEQ ID NO: 2400013 - RNA, 20 nt, Human
aaugggaaauacuacuccug

SEQ ID NO: 2400014 - RNA, 14 nt, Human
aaugggaaaagaga

SEQ ID NO: 2400015 - RNA, 12 nt, Human
aauuaaaguguc

SEQ ID NO: 2400016 - RNA, 15 nt, Human
aauuaaagcuguuau

SEQ ID NO: 2400017 - RNA, 21 nt, Human
aauuaaaguguccauugacau

SEQ ID NO: 2400018 - RNA, 20 nt, Human
aauuaaaguguccauugaca

SEQ ID NO: 2400019 - RNA, 18 nt, Human
aauuaaaguguccauuga

SEQ ID NO: 2400020 - RNA, 13 nt, Human
aauuaaagugucc

SEQ ID NO: 2400021 - RNA, 11 nt, Human
aauuaaaugua

SEQ ID NO: 2400022 - RNA, 12 nt, Human
aauuaaauguag

SEQ ID NO: 2400023 - RNA, 22 nt, Human
aauuaaauuuugaguucuacau

SEQ ID NO: 2400024 - RNA, 14 nt, Human
aauuaaauuuugag

SEQ ID NO: 2400025 - RNA, 14 nt, Human
aauuaaauuaggaa

SEQ ID NO: 2400026 - RNA, 13 nt, Human
aauguuuuucuau

SEQ ID NO: 2400027 - RNA, 15 nt, Human
aauguuuuucugcca

SEQ ID NO: 2400028 - RNA, 21 nt, Human
aauguuuuucugccagggagc

SEQ ID NO: 2400029 - RNA, 17 nt, Human
aauuaaaaaauuuccag

SEQ ID NO: 2400030 - RNA, 13 nt, Human
aauuaaaacugaa

SEQ ID NO: 2400031 - RNA, 18 nt, Human
aauuaaaacacaacaucu

SEQ ID NO: 2400032 - RNA, 22 nt, Human
aauuaaacggauuauuuuuuca

SEQ ID NO: 2400033 - RNA, 21 nt, Human
aauuaaacggauuauuuuuuc

SEQ ID NO: 2400034 - RNA, 17 nt, Human
aauuaaacggauuauuu

SEQ ID NO: 2400035 - RNA, 16 nt, Human
aauuaaacggauuauu

SEQ ID NO: 2400036 - RNA, 23 nt, Human
aauuaaacggauuauuuuuucag

SEQ ID NO: 2400037 - RNA, 15 nt, Human
aauuaaacggauuau

SEQ ID NO: 2400038 - RNA, 14 nt, Human
aauuaaacggauua

SEQ ID NO: 2400039 - RNA, 13 nt, Human
aauuaaacggauu

SEQ ID NO: 2400040 - RNA, 18 nt, Human
aauuaaaaguugaauuuu

SEQ ID NO: 2400041 - RNA, 12 nt, Human
aauuaaacggau

SEQ ID NO: 2400042 - RNA, 19 nt, Human
aauguuugccucugccucu

SEQ ID NO: 2400043 - RNA, 12 nt, Human
aauguuugcuau

SEQ ID NO: 2400044 - RNA, 23 nt, Human
aauguuugggcagaagggagaag

SEQ ID NO: 2400045 - RNA, 18 nt, Human
aauguuugggcagaaggg

SEQ ID NO: 2400046 - RNA, 18 nt, Human
aauguuugucucauccca

SEQ ID NO: 2400047 - RNA, 13 nt, Human
aauguuuuaaauu

SEQ ID NO: 2400048 - RNA, 14 nt, Human
aauguuuuaaauuc

SEQ ID NO: 2400049 - RNA, 15 nt, Human
aauguuuuaaauucu

SEQ ID NO: 2400050 - RNA, 12 nt, Human
aauguuuugaca

SEQ ID NO: 2400051 - RNA, 22 nt, Human
aauguuuuacugugaaacuggc

SEQ ID NO: 2400052 - RNA, 20 nt, Human
aauguuuuacugugaaacug

SEQ ID NO: 2400053 - RNA, 17 nt, Human
aauguuuuauacuguuu

SEQ ID NO: 2400054 - RNA, 20 nt, Human
aaugucuugaugcaugcacu

SEQ ID NO: 2400055 - RNA, 11 nt, Human
aaugucuugug

SEQ ID NO: 2400056 - RNA, 13 nt, Human
aaugucuuguguu

SEQ ID NO: 2400057 - RNA, 18 nt, Human
aauguuugccucugccuc

SEQ ID NO: 2400058 - RNA, 17 nt, Human
aaugucuguuaacuuaa

SEQ ID NO: 2400059 - RNA, 17 nt, Human
aaugucuucauuucauu

SEQ ID NO: 2400060 - RNA, 13 nt, Human
aaugucugugcua

SEQ ID NO: 2400061 - RNA, 12 nt, Human
aaugucugugcu

SEQ ID NO: 2400062 - RNA, 23 nt, Human
aaugucuguagcuccucaacuca

SEQ ID NO: 2400063 - RNA, 21 nt, Human
aaugucuucauuucauuguau

SEQ ID NO: 2400064 - RNA, 22 nt, Human
aaugucuucuguauucacuuau

SEQ ID NO: 2400065 - RNA, 17 nt, Human
aaauaacaauguuaagg

SEQ ID NO: 2400066 - RNA, 16 nt, Human
aaauaacaauguuaag

SEQ ID NO: 2400067 - RNA, 15 nt, Human
aaauaacaauguuaa

SEQ ID NO: 2400068 - RNA, 14 nt, Human
aaauaacaauguua

SEQ ID NO: 2400069 - RNA, 21 nt, Human
aaauaacaagucgaugaacua

SEQ ID NO: 2400070 - RNA, 14 nt, Human
aaauaacaaugugc

SEQ ID NO: 2400071 - RNA, 17 nt, Human
aaauaacaaugugcucu

SEQ ID NO: 2400072 - RNA, 23 nt, Human
aaauaacaaaucucaagcaaaca

SEQ ID NO: 2400073 - RNA, 19 nt, Human
aaauaaauuugguucuaau

SEQ ID NO: 2400074 - RNA, 17 nt, Human
aaaggcuucucucucac

SEQ ID NO: 2400075 - RNA, 15 nt, Human
aaaggcuucucucuc

SEQ ID NO: 2400076 - RNA, 14 nt, Human
aaagggaaacuauu

SEQ ID NO: 2400077 - RNA, 21 nt, Human
aaagggaacugaacauuccag

SEQ ID NO: 2400078 - RNA, 16 nt, Human
aaagggaacugaacau

SEQ ID NO: 2400079 - RNA, 16 nt, Human
aaagggacugagaaau

SEQ ID NO: 2400080 - RNA, 18 nt, Human
aaagggaaguugugccuu

SEQ ID NO: 2400081 - RNA, 19 nt, Human
aaagucucuggaauuugaa

SEQ ID NO: 2400082 - RNA, 22 nt, Human
aaagucucuggaauuugaaaca

SEQ ID NO: 2400083 - RNA, 20 nt, Human
aaagucucuggaauuugaaa

SEQ ID NO: 2400084 - RNA, 23 nt, Human
aaagucugugugaugaacuuucu

SEQ ID NO: 2400085 - RNA, 22 nt, Human
aaagucugugugaugaacuuuc

SEQ ID NO: 2400086 - RNA, 12 nt, Human
aaagucucuugu

SEQ ID NO: 2400087 - RNA, 11 nt, Human
aaagucugcaa

SEQ ID NO: 2400088 - RNA, 20 nt, Human
aaagucuucacucucugaag

SEQ ID NO: 2400089 - RNA, 12 nt, Human
aaagugaauuug

SEQ ID NO: 2400090 - RNA, 23 nt, Human
aaagugaagcaaaucagaaacuu

SEQ ID NO: 2400091 - RNA, 15 nt, Human
aaagugaauuugaau

SEQ ID NO: 2400092 - RNA, 17 nt, Human
aaagugaauuugaauga

SEQ ID NO: 2400093 - RNA, 19 nt, Human
aaagugaauuugaaugaaa

SEQ ID NO: 2400094 - RNA, 20 nt, Human
aaagugaauuugaaugaaaa

SEQ ID NO: 2400095 - RNA, 13 nt, Human
aaagugaagcaaa

SEQ ID NO: 2400096 - RNA, 20 nt, Human
aaagugaaaguccagaaacu

SEQ ID NO: 2400097 - RNA, 11 nt, Human
aaagugcuggg

SEQ ID NO: 2400098 - RNA, 14 nt, Human
aaagugacacagca

SEQ ID NO: 2400099 - RNA, 13 nt, Human
aaagugacacagc

SEQ ID NO: 2400100 - RNA, 21 nt, Human
aaagugaauuugaaugaaaaa

SEQ ID NO: 2400101 - RNA, 22 nt, Human
aaagugaauuugaaugaaaaau

SEQ ID NO: 2400102 - RNA, 20 nt, Human
aaagugagggccgagugaga

SEQ ID NO: 2400103 - RNA, 18 nt, Human
aaauaaaaggaagccaaa

SEQ ID NO: 2400104 - RNA, 16 nt, Human
aaauaaaagugaucaa

SEQ ID NO: 2400105 - RNA, 14 nt, Human
aaauaaaauaaagc

SEQ ID NO: 2400106 - RNA, 16 nt, Human
aaauaaaaugaccagu

SEQ ID NO: 2400107 - RNA, 15 nt, Human
aaauaaaaugaccag

SEQ ID NO: 2400108 - RNA, 14 nt, Human
aaauaaaaugacca

SEQ ID NO: 2400109 - RNA, 14 nt, Human
aaagugcugggauu

SEQ ID NO: 2400110 - RNA, 12 nt, Human
aaagugcuggga

SEQ ID NO: 2400111 - RNA, 17 nt, Human
aaauaaaaggaagccaa

SEQ ID NO: 2400112 - RNA, 14 nt, Human
aaauaaacucuaaa

SEQ ID NO: 2400113 - RNA, 15 nt, Human
aaauaaaauggauuu

SEQ ID NO: 2400114 - RNA, 22 nt, Human
aaauaaaauuaaagcugaaaac

SEQ ID NO: 2400115 - RNA, 17 nt, Human
aaauaaaauuuguugca

SEQ ID NO: 2400116 - RNA, 16 nt, Human
aaauaaaauuuguugc

SEQ ID NO: 2400117 - RNA, 15 nt, Human
aaauaaaauuuguug

SEQ ID NO: 2400118 - RNA, 13 nt, Human
aaauaaaauuaug

SEQ ID NO: 2400119 - RNA, 12 nt, Human
aaauaacaauga

SEQ ID NO: 2400120 - RNA, 13 nt, Human
aaauaaaggaacc

SEQ ID NO: 2400121 - RNA, 23 nt, Human
aaauaaaggaugugauuguggaa

SEQ ID NO: 2400122 - RNA, 13 nt, Human
aaauaaaguauau

SEQ ID NO: 2400123 - RNA, 20 nt, Human
aaauaaagcuugcaacaaaa

SEQ ID NO: 2400124 - RNA, 12 nt, Human
aaauaaagcccu

SEQ ID NO: 2400125 - RNA, 20 nt, Human
aaauacuguguuucagaagc

SEQ ID NO: 2400126 - RNA, 14 nt, Human
aaauacuguuugag

SEQ ID NO: 2400127 - RNA, 22 nt, Human
aaauacuguuuuuaacaacuau

SEQ ID NO: 2400128 - RNA, 22 nt, Human
aaauacuugucaauauuuaaac

SEQ ID NO: 2400129 - RNA, 21 nt, Human
aaauacuugucaauauuuaaa

SEQ ID NO: 2400130 - RNA, 20 nt, Human
aaauacuugucaauauuuaa

SEQ ID NO: 2400131 - RNA, 15 nt, Human
aaauacuuuaaagga

SEQ ID NO: 2400132 - RNA, 11 nt, Human
aaauacuuguc

SEQ ID NO: 2400133 - RNA, 17 nt, Human
aaauacuuuaaaggaaa

SEQ ID NO: 2400134 - RNA, 16 nt, Human
aaauacuuuaaaggaa

SEQ ID NO: 2400135 - RNA, 14 nt, Human
aaauagaaauaagu

SEQ ID NO: 2400136 - RNA, 16 nt, Human
aaauagaaccacuaug

SEQ ID NO: 2400137 - RNA, 22 nt, Human
aaauagaagaauacaaacauau

SEQ ID NO: 2400138 - RNA, 15 nt, Human
aaauagacaguauau

SEQ ID NO: 2400139 - RNA, 16 nt, Human
aaauagacaguauauu

SEQ ID NO: 2400140 - RNA, 19 nt, Human
aaauagacaguauauuuau

SEQ ID NO: 2400141 - RNA, 14 nt, Human
aaauaguauuugag

SEQ ID NO: 2400142 - RNA, 16 nt, Human
aaauaguaaaaauaaa

SEQ ID NO: 2400143 - RNA, 13 nt, Human
aaauaguaaaaau

SEQ ID NO: 2400144 - RNA, 21 nt, Human
aaauagugcagaaucucauag

SEQ ID NO: 2400145 - RNA, 20 nt, Human
aaauagugcagaaucucaua

SEQ ID NO: 2400146 - RNA, 16 nt, Human
aaauagggucuaacuc

SEQ ID NO: 2400147 - RNA, 13 nt, Human
aaauauaaaauau

SEQ ID NO: 2400148 - RNA, 12 nt, Human
aaauauaaaacu

SEQ ID NO: 2400149 - RNA, 16 nt, Human
aaauauaauucuguaa

SEQ ID NO: 2400150 - RNA, 13 nt, Human
aaauauaauucug

SEQ ID NO: 2400151 - RNA, 12 nt, Human
aaauauaauucu

SEQ ID NO: 2400152 - RNA, 11 nt, Human
aaauauaauuc

SEQ ID NO: 2400153 - RNA, 14 nt, Human
aaauauaagaauaa

SEQ ID NO: 2400154 - RNA, 18 nt, Human
aaauauaauucuguaaau

SEQ ID NO: 2400155 - RNA, 17 nt, Human
aaauauaauucuguaaa

SEQ ID NO: 2400156 - RNA, 19 nt, Human
aaauauaauucuguaaaug

SEQ ID NO: 2400157 - RNA, 22 nt, Human
aaauggacguguuaugacucca

SEQ ID NO: 2400158 - RNA, 21 nt, Human
aaauggacguguuaugacucc

SEQ ID NO: 2400159 - RNA, 20 nt, Human
aaauggacguguuaugacuc

SEQ ID NO: 2400160 - RNA, 18 nt, Human
aaauggaagacacauuga

SEQ ID NO: 2400161 - RNA, 15 nt, Human
aaauggaagacacau

SEQ ID NO: 2400162 - RNA, 21 nt, Human
aaauggaaaggagaggaaaga

SEQ ID NO: 2400163 - RNA, 18 nt, Human
aaaucuuucuuucuuaga

SEQ ID NO: 2400164 - RNA, 16 nt, Human
aaaucuuucuuucuua

SEQ ID NO: 2400165 - RNA, 20 nt, Human
aaaugcuuuuuauuucugca

SEQ ID NO: 2400166 - RNA, 20 nt, Human
aaaucuuucuuucuuagaaa

SEQ ID NO: 2400167 - RNA, 18 nt, Human
aaaugcuuuuuauuucug

SEQ ID NO: 2400168 - RNA, 18 nt, Human
aaauggaagacagcucuu

SEQ ID NO: 2400169 - RNA, 16 nt, Human
aaauggaaaugggcag

SEQ ID NO: 2400170 - RNA, 16 nt, Human
aaauauuuucuggguu

SEQ ID NO: 2400171 - RNA, 20 nt, Human
aaauauuuucauacagcauu

SEQ ID NO: 2400172 - RNA, 21 nt, Human
aaauauuuugaaucaauaaua

SEQ ID NO: 2400173 - RNA, 15 nt, Human
aaauauuuugaauca

SEQ ID NO: 2400174 - RNA, 18 nt, Human
aaaucaaauaugcaaagc

SEQ ID NO: 2400175 - RNA, 19 nt, Human
aaaucaaauaugcaaagca

SEQ ID NO: 2400176 - RNA, 13 nt, Human
aaaucuugaaauu

SEQ ID NO: 2400177 - RNA, 17 nt, Human
aaaucuuggcacagaaa

SEQ ID NO: 2400178 - RNA, 18 nt, Human
aaauggcuuccuggcaau

SEQ ID NO: 2400179 - RNA, 22 nt, Human
aaauggccucauguggcuggaa

SEQ ID NO: 2400180 - RNA, 21 nt, Human
aaauggccucauguggcugga

SEQ ID NO: 2400181 - RNA, 16 nt, Human
aaauggcucagaugcc

SEQ ID NO: 2400182 - RNA, 21 nt, Human
aaauggcgucuggaaguccaa

SEQ ID NO: 2400183 - RNA, 15 nt, Human
aaauggccucaugug

SEQ ID NO: 2400184 - RNA, 11 nt, Human
aaauggccuca

SEQ ID NO: 2400185 - RNA, 22 nt, Human
aaauggccauuugcuuuuucac

SEQ ID NO: 2400186 - RNA, 23 nt, Human
aaauggccauuugcuuuuucacc

SEQ ID NO: 2400187 - RNA, 19 nt, Human
aaauggccauuugcuuuuu

SEQ ID NO: 2400188 - RNA, 17 nt, Human
aaauggcugguuuuuag

SEQ ID NO: 2400189 - RNA, 23 nt, Human
aaauggcugcaucccccccaccu

SEQ ID NO: 2400190 - RNA, 13 nt, Human
aaacacucuugaa

SEQ ID NO: 2400191 - RNA, 21 nt, Human
aaaauugccauauugcacaug

SEQ ID NO: 2400192 - RNA, 19 nt, Human
aaaauugccauauugcaca

SEQ ID NO: 2400193 - RNA, 15 nt, Human
aaaauugcugugccu

SEQ ID NO: 2400194 - RNA, 21 nt, Human
aaaauugcugugccucccaaa

SEQ ID NO: 2400195 - RNA, 17 nt, Human
aaacacucuugaaaaau

SEQ ID NO: 2400196 - RNA, 14 nt, Human
aaacacucuugaaa

SEQ ID NO: 2400197 - RNA, 18 nt, Human
aaacacuguucucugccc

SEQ ID NO: 2400198 - RNA, 13 nt, Human
aaacacugccauc

SEQ ID NO: 2400199 - RNA, 15 nt, Human
aaacacugcaggcau

SEQ ID NO: 2400200 - RNA, 14 nt, Human
aaacacugcaggca

SEQ ID NO: 2400201 - RNA, 21 nt, Human
aaacacucggcauuucaaaug

SEQ ID NO: 2400202 - RNA, 20 nt, Human
aaacacucggcauuucaaau

SEQ ID NO: 2400203 - RNA, 17 nt, Human
aaacacucggcauuuca

SEQ ID NO: 2400204 - RNA, 18 nt, Human
aaaauugccauauugcac

SEQ ID NO: 2400205 - RNA, 17 nt, Human
aaaauugccauauugca

SEQ ID NO: 2400206 - RNA, 16 nt, Human
aaaauugccauauugc

SEQ ID NO: 2400207 - RNA, 14 nt, Human
aaaauugccauauu

SEQ ID NO: 2400208 - RNA, 13 nt, Human
aaaauugccauau

SEQ ID NO: 2400209 - RNA, 14 nt, Human
aaaauucaauugua

SEQ ID NO: 2400210 - RNA, 18 nt, Human
aaaauucacuauuggcug

SEQ ID NO: 2400211 - RNA, 17 nt, Human
aaaauucaauuguaaau

SEQ ID NO: 2400212 - RNA, 13 nt, Human
aaaauucagugga

SEQ ID NO: 2400213 - RNA, 13 nt, Human
aaaacacauuuuu

SEQ ID NO: 2400214 - RNA, 15 nt, Human
aaaacacauuuuucu

SEQ ID NO: 2400215 - RNA, 18 nt, Human
aaaauucaaaaaguguuu

SEQ ID NO: 2400216 - RNA, 17 nt, Human
aaaauucaaaaaguguu

SEQ ID NO: 2400217 - RNA, 16 nt, Human
aaaauucaaaaagugu

SEQ ID NO: 2400218 - RNA, 14 nt, Human
aaaauucaaaaagu

SEQ ID NO: 2400219 - RNA, 20 nt, Human
aaaacacaguguuuuuguaa

SEQ ID NO: 2400220 - RNA, 21 nt, Human
aaaacacaguguuuuuguaaa

SEQ ID NO: 2400221 - RNA, 23 nt, Human
aaaacacagacauucugccaggc

SEQ ID NO: 2400222 - RNA, 20 nt, Human
aaacagaucuccuggcaaag

SEQ ID NO: 2400223 - RNA, 12 nt, Human
aaacagauauaa

SEQ ID NO: 2400224 - RNA, 15 nt, Human
aaacagauauaaaug

SEQ ID NO: 2400225 - RNA, 20 nt, Human
aaacagaggccauggcagaa

SEQ ID NO: 2400226 - RNA, 22 nt, Human
aaacagagacaggcccaagaga

SEQ ID NO: 2400227 - RNA, 16 nt, Human
aaacagagaugugaua

SEQ ID NO: 2400228 - RNA, 15 nt, Human
aaacagauuuuuaca

SEQ ID NO: 2400229 - RNA, 19 nt, Human
aaacagauuuuuacaaaug

SEQ ID NO: 2400230 - RNA, 14 nt, Human
aaacagauuuuuac

SEQ ID NO: 2400231 - RNA, 22 nt, Human
aaacacuguucucugcccucca

SEQ ID NO: 2400232 - RNA, 19 nt, Human
aaacacuguucucugcccu

SEQ ID NO: 2400233 - RNA, 23 nt, Human
aaacacugccaucuuaguuugga

SEQ ID NO: 2400234 - RNA, 12 nt, Human
aaaauugccaua

SEQ ID NO: 2400235 - RNA, 15 nt, Human
aaacagagacaggcc

SEQ ID NO: 2400236 - RNA, 16 nt, Human
aaacagagacaggccc

SEQ ID NO: 2400237 - RNA, 14 nt, Human
aaacagacucaggu

SEQ ID NO: 2400238 - RNA, 20 nt, Human
aaacagacucgauucauauu

SEQ ID NO: 2400239 - RNA, 13 nt, Human
aaagaugaaaaua

SEQ ID NO: 2400240 - RNA, 16 nt, Human
aaagaugaaaauauuu

SEQ ID NO: 2400241 - RNA, 17 nt, Human
aaagaugaaaauauuug

SEQ ID NO: 2400242 - RNA, 23 nt, Human
aaagauauauuaaaaauauaaaa

SEQ ID NO: 2400243 - RNA, 21 nt, Human
aaagaucuguuuugaaggcaa

SEQ ID NO: 2400244 - RNA, 16 nt, Human
aaagaaaacccacccc

SEQ ID NO: 2400245 - RNA, 23 nt, Human
aaagaaaagauaaagaugaucua

SEQ ID NO: 2400246 - RNA, 14 nt, Human
aaagaaaagauaaa

SEQ ID NO: 2400247 - RNA, 12 nt, Human
aaagaaaauaaa

SEQ ID NO: 2400248 - RNA, 13 nt, Human
aaagaaagagaga

SEQ ID NO: 2400249 - RNA, 14 nt, Human
aaagaaagagagaa

SEQ ID NO: 2400250 - RNA, 15 nt, Human
aaagaaagagagaaa

SEQ ID NO: 2400251 - RNA, 16 nt, Human
aaagaaagagagaaaa

SEQ ID NO: 2400252 - RNA, 21 nt, Human
aaagaaaauaaaaaaaagaaa

SEQ ID NO: 2400253 - RNA, 12 nt, Human
aaagaaagagag

SEQ ID NO: 2400254 - RNA, 14 nt, Human
aaagaaagaaggaa

SEQ ID NO: 2400255 - RNA, 20 nt, Human
aaagaaaacuuguauuaugu

SEQ ID NO: 2400256 - RNA, 12 nt, Human
aaagaaaacuug

SEQ ID NO: 2400257 - RNA, 19 nt, Human
aaacugccagcaacgcagg

SEQ ID NO: 2400258 - RNA, 20 nt, Human
aaacugccaguuuuguuucc

SEQ ID NO: 2400259 - RNA, 17 nt, Human
aaacugcauuagaaauu

SEQ ID NO: 2400260 - RNA, 16 nt, Human
aaacugacucuuaaga

SEQ ID NO: 2400261 - RNA, 17 nt, Human
aaacugaagucugaaau

SEQ ID NO: 2400262 - RNA, 16 nt, Human
aaacugaagucugaaa

SEQ ID NO: 2400263 - RNA, 15 nt, Human
aaacugaagucugaa

SEQ ID NO: 2400264 - RNA, 14 nt, Human
aaacugaagccaga

SEQ ID NO: 2400265 - RNA, 14 nt, Human
aaacugccagcaac

SEQ ID NO: 2400266 - RNA, 15 nt, Human
aaacugccagcaacg

SEQ ID NO: 2400267 - RNA, 17 nt, Human
aaacugacucuuaagaa

SEQ ID NO: 2400268 - RNA, 19 nt, Human
aaacugaagucugaaauuu

SEQ ID NO: 2400269 - RNA, 14 nt, Human
aaacugcauuagaa

SEQ ID NO: 2400270 - RNA, 16 nt, Human
aaacugaaugaaaccc

SEQ ID NO: 2400271 - RNA, 14 nt, Human
aaacugaauggaag

SEQ ID NO: 2400272 - RNA, 11 nt, Human
aaagaacaucc

SEQ ID NO: 2400273 - RNA, 15 nt, Human
aaagaacaguaaaca

SEQ ID NO: 2400274 - RNA, 16 nt, Human
aaagaacaaaaaaauc

SEQ ID NO: 2400275 - RNA, 18 nt, Human
aaagaacauggacuugua

SEQ ID NO: 2400276 - RNA, 11 nt, Human
aaagagguuuu

SEQ ID NO: 2400277 - RNA, 15 nt, Human
aaagaaauuaugugc

SEQ ID NO: 2400278 - RNA, 19 nt, Human
aaagaaaugucuauuaagg

SEQ ID NO: 2400279 - RNA, 13 nt, Human
aaagaaauuaugu

SEQ ID NO: 2400280 - RNA, 23 nt, Human
aaagaaaguugcacggcugcuga

SEQ ID NO: 2400281 - RNA, 17 nt, Human
aaagaaagagagaaaau

SEQ ID NO: 2400282 - RNA, 18 nt, Human
aaagaaagagagaaaaua

SEQ ID NO: 2400283 - RNA, 17 nt, Human
aaagaaagccucagaga

SEQ ID NO: 2400284 - RNA, 18 nt, Human
aaagaaagccucagagaa

SEQ ID NO: 2400285 - RNA, 21 nt, Human
aaagaacauggacuuguauau

SEQ ID NO: 2400286 - RNA, 20 nt, Human
aaagaacauggacuuguaua

SEQ ID NO: 2400287 - RNA, 16 nt, Human
aaagagguuuuucuua

SEQ ID NO: 2400288 - RNA, 19 nt, Human
aaagaguaaaggaaaugau

SEQ ID NO: 2400289 - RNA, 22 nt, Human
aaagaacauggacuuguauauu

SEQ ID NO: 2400290 - RNA, 19 nt, Human
aaagagguuuuucuuaaau

SEQ ID NO: 2400291 - RNA, 12 nt, Human
aaagaguacucu

SEQ ID NO: 2400292 - RNA, 17 nt, Human
aaagaguacucuuguuu

SEQ ID NO: 2400293 - RNA, 13 nt, Human
aaagaguagaauu

SEQ ID NO: 2400294 - RNA, 18 nt, Human
aaagaguagaauugcauu

SEQ ID NO: 2400295 - RNA, 23 nt, Human
aaagaguagacauuucucuuacu

SEQ ID NO: 2400296 - RNA, 16 nt, Human
aaagauacgacuuuau

SEQ ID NO: 2400297 - RNA, 20 nt, Human
aaagauacgacuuuauuuuc

SEQ ID NO: 2400298 - RNA, 17 nt, Human
aaagauauaagugcugu

SEQ ID NO: 2400299 - RNA, 16 nt, Human
aaagauauaagugcug

SEQ ID NO: 2400300 - RNA, 15 nt, Human
aaagauauaagugcu

SEQ ID NO: 2400301 - RNA, 22 nt, Human
aaagauacgacuuuauuuucug

SEQ ID NO: 2400302 - RNA, 22 nt, Human
aaagauauaagugcuguauaaa

SEQ ID NO: 2400303 - RNA, 21 nt, Human
aaagauauaagugcuguauaa

SEQ ID NO: 2400304 - RNA, 20 nt, Human
aaagauauaagugcuguaua

SEQ ID NO: 2400305 - RNA, 18 nt, Human
aaagauauaagugcugua

SEQ ID NO: 2400306 - RNA, 21 nt, Human
aaagauauauuaaaaauauaa

SEQ ID NO: 2400307 - RNA, 20 nt, Human
aaagauauauuaaaaauaua

SEQ ID NO: 2400308 - RNA, 20 nt, Human
aaagauaucucaucucuucu

SEQ ID NO: 2400309 - RNA, 19 nt, Human
aaagauauauuaaaaauau

SEQ ID NO: 2400310 - RNA, 17 nt, Human
aaagauauauacacagg

SEQ ID NO: 2400311 - RNA, 12 nt, Human
aaagauauauua

SEQ ID NO: 2400312 - RNA, 12 nt, Human
aacuuuuauaaa

SEQ ID NO: 2400313 - RNA, 15 nt, Human
aacuuuuauaaacuu

SEQ ID NO: 2400314 - RNA, 18 nt, Human
aacuuuggaguccccuca

SEQ ID NO: 2400315 - RNA, 22 nt, Human
aacuuuuaauuaaaugcucauc

SEQ ID NO: 2400316 - RNA, 20 nt, Human
aacuuuguggaugucuuccu

SEQ ID NO: 2400317 - RNA, 19 nt, Human
aacuuuguggaugucuucc

SEQ ID NO: 2400318 - RNA, 19 nt, Human
aacuuugaccucugcagca

SEQ ID NO: 2400319 - RNA, 20 nt, Human
aacuuugaccucugcagcaa

SEQ ID NO: 2400320 - RNA, 21 nt, Human
aacuuugcuugcaguagauuu

SEQ ID NO: 2400321 - RNA, 12 nt, Human
aacuuugcuugc

SEQ ID NO: 2400322 - RNA, 15 nt, Human
aacuuugcugagccu

SEQ ID NO: 2400323 - RNA, 13 nt, Human
aacuuugaccucu

SEQ ID NO: 2400324 - RNA, 15 nt, Human
aacuuucuguaaacu

SEQ ID NO: 2400325 - RNA, 11 nt, Human
aacuuucugua

SEQ ID NO: 2400326 - RNA, 14 nt, Human
aacuuugaccucug

SEQ ID NO: 2400327 - RNA, 17 nt, Human
aacuuugaccucugcag

SEQ ID NO: 2400328 - RNA, 18 nt, Human
aacuuucucuucauacuu

SEQ ID NO: 2400329 - RNA, 16 nt, Human
aacuuuuauaaacuuu

SEQ ID NO: 2400330 - RNA, 19 nt, Human
aacuuuuauaaacuuuacc

SEQ ID NO: 2400331 - RNA, 12 nt, Human
aacuuuucucag

SEQ ID NO: 2400332 - RNA, 18 nt, Human
aacuuuuccccuguccug

SEQ ID NO: 2400333 - RNA, 15 nt, Human
aacuuuuccccuguc

SEQ ID NO: 2400334 - RNA, 15 nt, Human
aacuuuuuaaagagu

SEQ ID NO: 2400335 - RNA, 11 nt, Human
aacuuuuguaa

SEQ ID NO: 2400336 - RNA, 21 nt, Human
aacuuuuguaagacaaagguu

SEQ ID NO: 2400337 - RNA, 14 nt, Human
aacuuuuguaaaua

SEQ ID NO: 2400338 - RNA, 13 nt, Human
aagaaauguaagg

SEQ ID NO: 2400339 - RNA, 14 nt, Human
aagaaauguaaggg

SEQ ID NO: 2400340 - RNA, 14 nt, Human
aagaaaugacacuu

SEQ ID NO: 2400341 - RNA, 23 nt, Human
aagaaaucccuguuuaauauuua

SEQ ID NO: 2400342 - RNA, 22 nt, Human
aacuuuuugguuugcagaugac

SEQ ID NO: 2400343 - RNA, 13 nt, Human
aacuuuuuuccac

SEQ ID NO: 2400344 - RNA, 14 nt, Human
aacuuuuuuuuaag

SEQ ID NO: 2400345 - RNA, 17 nt, Human
aacuuuuuuuugagaau

SEQ ID NO: 2400346 - RNA, 16 nt, Human
aacuuuuuuuugagaa

SEQ ID NO: 2400347 - RNA, 19 nt, Human
aacuuuuuugaaauaauaa

SEQ ID NO: 2400348 - RNA, 20 nt, Human
aacuuuuuuuuaaguuacac

SEQ ID NO: 2400349 - RNA, 19 nt, Human
aacuucaacauuuacaugu

SEQ ID NO: 2400350 - RNA, 14 nt, Human
aacuucaacauuua

SEQ ID NO: 2400351 - RNA, 22 nt, Human
aacuuauuuuuuucugauugua

SEQ ID NO: 2400352 - RNA, 21 nt, Human
aacuuauuuuuuucugauugu

SEQ ID NO: 2400353 - RNA, 20 nt, Human
aacuuauuuuuuucugauug

SEQ ID NO: 2400354 - RNA, 19 nt, Human
aacuuauuuuuuucugauu

SEQ ID NO: 2400355 - RNA, 18 nt, Human
aacuuauuuuuuucugau

SEQ ID NO: 2400356 - RNA, 17 nt, Human
aacuuauuuuuuucuga

SEQ ID NO: 2400357 - RNA, 16 nt, Human
aacuuauuuuuuucug

SEQ ID NO: 2400358 - RNA, 13 nt, Human
aacuuauuugagu

SEQ ID NO: 2400359 - RNA, 19 nt, Human
aacuuauuugagugauuau

SEQ ID NO: 2400360 - RNA, 23 nt, Human
aacuuauucuguagauucugugg

SEQ ID NO: 2400361 - RNA, 13 nt, Human
aacuucacauauu

SEQ ID NO: 2400362 - RNA, 22 nt, Human
aacuucaagugcaugcucucug

SEQ ID NO: 2400363 - RNA, 19 nt, Human
aacugauuuuuuuuuccuu

SEQ ID NO: 2400364 - RNA, 17 nt, Human
aacuuaaaaauguaaau

SEQ ID NO: 2400365 - RNA, 13 nt, Human
aacuuaaaaaugu

SEQ ID NO: 2400366 - RNA, 17 nt, Human
aacugauuuuuuuuucc

SEQ ID NO: 2400367 - RNA, 13 nt, Human
aacugauucauaa

SEQ ID NO: 2400368 - RNA, 21 nt, Human
aacugacaggcagccuggaca

SEQ ID NO: 2400369 - RNA, 14 nt, Human
aacugaccagccuc

SEQ ID NO: 2400370 - RNA, 16 nt, Human
aacuuagcauguguug

SEQ ID NO: 2400371 - RNA, 13 nt, Human
aacuuaaauaaua

SEQ ID NO: 2400372 - RNA, 14 nt, Human
aacuuaaauaauaa

SEQ ID NO: 2400373 - RNA, 19 nt, Human
aacuuagcauguguugaaa

SEQ ID NO: 2400374 - RNA, 16 nt, Human
aacuuagguggcaagc

SEQ ID NO: 2400375 - RNA, 23 nt, Human
aacuuagugcggacaaguuuuaa

SEQ ID NO: 2400376 - RNA, 17 nt, Human
aacuuaaauaaugugaa

SEQ ID NO: 2400377 - RNA, 21 nt, Human
aacuuaaaaauguaaauauuc

SEQ ID NO: 2400378 - RNA, 18 nt, Human
aacuuaaaaauguaaaua

SEQ ID NO: 2400379 - RNA, 13 nt, Human
aacuuaaaauauu

SEQ ID NO: 2400380 - RNA, 14 nt, Human
aacuuaaaauauuu

SEQ ID NO: 2400381 - RNA, 16 nt, Human
aacuuaaaauauuuua

SEQ ID NO: 2400382 - RNA, 15 nt, Human
aacuuaaauaaaugu

SEQ ID NO: 2400383 - RNA, 19 nt, Human
aacuuaaauaaaugucauu

SEQ ID NO: 2400384 - RNA, 15 nt, Human
aacuuauauuguaag

SEQ ID NO: 2400385 - RNA, 19 nt, Human
aacuuauauuguaagaaau

SEQ ID NO: 2400386 - RNA, 20 nt, Human
aacuuauauuguaagaaaua

SEQ ID NO: 2400387 - RNA, 21 nt, Human
aacuuauauuguaagaaauac

SEQ ID NO: 2400388 - RNA, 23 nt, Human
aacuuauaucaucagcauaccuu

SEQ ID NO: 2400389 - RNA, 20 nt, Human
aacuuauauacuauuucccu

SEQ ID NO: 2400390 - RNA, 22 nt, Human
aacuuagugcggacaaguuuua

SEQ ID NO: 2400391 - RNA, 21 nt, Human
aacuuaugaccucuuccuuua

SEQ ID NO: 2400392 - RNA, 19 nt, Human
aacuuauccuaaaacaaau

SEQ ID NO: 2400393 - RNA, 14 nt, Human
aacuuauucuguag

SEQ ID NO: 2400394 - RNA, 13 nt, Human
aacuuauucugua

SEQ ID NO: 2400395 - RNA, 23 nt, Human
aacucagucauuagacuccuccu

SEQ ID NO: 2400396 - RNA, 22 nt, Human
aacucagucauuagacuccucc

SEQ ID NO: 2400397 - RNA, 18 nt, Human
aacucagggacagagcca

SEQ ID NO: 2400398 - RNA, 18 nt, Human
aacucaguuuuaacuaga

SEQ ID NO: 2400399 - RNA, 15 nt, Human
aacucaguuuuaacu

SEQ ID NO: 2400400 - RNA, 17 nt, Human
aacucagggacagagcc

SEQ ID NO: 2400401 - RNA, 16 nt, Human
aacucagggacagagc

SEQ ID NO: 2400402 - RNA, 13 nt, Human
aacucagggacag

SEQ ID NO: 2400403 - RNA, 21 nt, Human
aacucagccaagcacaguggu

SEQ ID NO: 2400404 - RNA, 22 nt, Human
aacucagccucaauaagccuug

SEQ ID NO: 2400405 - RNA, 20 nt, Human
aacucagccaagcacagugg

SEQ ID NO: 2400406 - RNA, 18 nt, Human
aacucagccaagcacagu

SEQ ID NO: 2400407 - RNA, 17 nt, Human
aacucagccaagcacag

SEQ ID NO: 2400408 - RNA, 16 nt, Human
aacucagccaagcaca

SEQ ID NO: 2400409 - RNA, 15 nt, Human
aacucagccaagcac

SEQ ID NO: 2400410 - RNA, 14 nt, Human
aacucagccaagca

SEQ ID NO: 2400411 - RNA, 12 nt, Human
aacucagccaag

SEQ ID NO: 2400412 - RNA, 15 nt, Human
aacucaccuggggcu

SEQ ID NO: 2400413 - RNA, 17 nt, Human
aacucagaucugucuga

SEQ ID NO: 2400414 - RNA, 20 nt, Human
aacucaccuggggcugcugg

SEQ ID NO: 2400415 - RNA, 20 nt, Human
aacucaccugcuggccccuc

SEQ ID NO: 2400416 - RNA, 21 nt, Human
aacucaccugcuggccccuca

SEQ ID NO: 2400417 - RNA, 19 nt, Human
aacugaacucugacaacag

SEQ ID NO: 2400418 - RNA, 20 nt, Human
aacugaacucugacaacaga

SEQ ID NO: 2400419 - RNA, 14 nt, Human
aacugaacucugac

SEQ ID NO: 2400420 - RNA, 18 nt, Human
aacucauaccuuuaaagg

SEQ ID NO: 2400421 - RNA, 16 nt, Human
aacugaacucugacaa

SEQ ID NO: 2400422 - RNA, 23 nt, Human
aacugaacucugacaacagacuu

SEQ ID NO: 2400423 - RNA, 18 nt, Human
aacugaagcagccucucc

SEQ ID NO: 2400424 - RNA, 16 nt, Human
aacucauacugugcug

SEQ ID NO: 2400425 - RNA, 15 nt, Human
aacucaccugccccu

SEQ ID NO: 2400426 - RNA, 17 nt, Human
aacucaccuaauguuua

SEQ ID NO: 2400427 - RNA, 15 nt, Human
aacucaccauguaaa

SEQ ID NO: 2400428 - RNA, 16 nt, Human
aacucaccauguaaaa

SEQ ID NO: 2400429 - RNA, 21 nt, Human
aacucaccauguaaaagaguc

SEQ ID NO: 2400430 - RNA, 16 nt, Human
aacucaccugccccuc

SEQ ID NO: 2400431 - RNA, 21 nt, Human
aacucaccuaauguuuaugag

SEQ ID NO: 2400432 - RNA, 17 nt, Human
aacucaccucucaaggu

SEQ ID NO: 2400433 - RNA, 12 nt, Human
aacucaccugcu

SEQ ID NO: 2400434 - RNA, 16 nt, Human
aacucaccugcuggcc

SEQ ID NO: 2400435 - RNA, 22 nt, Human
aacucaccugcuggccccucac

SEQ ID NO: 2400436 - RNA, 13 nt, Human
aacucaauauuuu

SEQ ID NO: 2400437 - RNA, 12 nt, Human
aacucaauauuu

SEQ ID NO: 2400438 - RNA, 12 nt, Human
aacucaccccag

SEQ ID NO: 2400439 - RNA, 21 nt, Human
aacucaauauuuuccaugaaa

SEQ ID NO: 2400440 - RNA, 20 nt, Human
aacucaauauuuuccaugaa

SEQ ID NO: 2400441 - RNA, 14 nt, Human
aacucaauauuuuc

SEQ ID NO: 2400442 - RNA, 22 nt, Human
aacagcuccuugggaggaagca

SEQ ID NO: 2400443 - RNA, 18 nt, Human
aacagcuccuugggagga

SEQ ID NO: 2400444 - RNA, 15 nt, Human
aacagcuccuuggga

SEQ ID NO: 2400445 - RNA, 14 nt, Human
aacagcuccuuggg

SEQ ID NO: 2400446 - RNA, 13 nt, Human
aacagcucgacuu

SEQ ID NO: 2400447 - RNA, 23 nt, Human
aacagcuccuugggaggaagcag

SEQ ID NO: 2400448 - RNA, 19 nt, Human
aacagcugaggucucuuga

SEQ ID NO: 2400449 - RNA, 21 nt, Human
aacagcugaggucucuugagg

SEQ ID NO: 2400450 - RNA, 20 nt, Human
aacagcugaggucucuugag

SEQ ID NO: 2400451 - RNA, 12 nt, Human
aacaucaauguu

SEQ ID NO: 2400452 - RNA, 13 nt, Human
aacaucaauguuc

SEQ ID NO: 2400453 - RNA, 14 nt, Human
aacaucaauguuca

SEQ ID NO: 2400454 - RNA, 13 nt, Human
aacagcuccuugg

SEQ ID NO: 2400455 - RNA, 10 nt, Human
aacagcuccu

SEQ ID NO: 2400456 - RNA, 14 nt, Human
aacagcucaggauc

SEQ ID NO: 2400457 - RNA, 18 nt, Human
aacagcucaguucuaguc

SEQ ID NO: 2400458 - RNA, 15 nt, Human
aacaucauuagaaca

SEQ ID NO: 2400459 - RNA, 17 nt, Human
aacaugagucaagagca

SEQ ID NO: 2400460 - RNA, 19 nt, Human
aacaugcaauuuugcauuu

SEQ ID NO: 2400461 - RNA, 22 nt, Human
aacaugcaauuuugcauuugaa

SEQ ID NO: 2400462 - RNA, 22 nt, Human
aacauguaauauaaagauguua

SEQ ID NO: 2400463 - RNA, 19 nt, Human
aacauguaauauaaagaug

SEQ ID NO: 2400464 - RNA, 18 nt, Human
aacauguaauauaaagau

SEQ ID NO: 2400465 - RNA, 12 nt, Human
aacauguaauau

SEQ ID NO: 2400466 - RNA, 20 nt, Human
aacaugguuuugaaaugcuu

SEQ ID NO: 2400467 - RNA, 14 nt, Human
aacaugcccuguuc

SEQ ID NO: 2400468 - RNA, 22 nt, Human
aacaugccugccccaaacaaau

SEQ ID NO: 2400469 - RNA, 21 nt, Human
aacaugccugccccaaacaaa

SEQ ID NO: 2400470 - RNA, 13 nt, Human
aacaugauuuggg

SEQ ID NO: 2400471 - RNA, 22 nt, Human
aacaucaucaaggcacugccug

SEQ ID NO: 2400472 - RNA, 14 nt, Human
aacaucauuagaac

SEQ ID NO: 2400473 - RNA, 21 nt, Human
aacaucaucaaggcacugccu

SEQ ID NO: 2400474 - RNA, 16 nt, Human
aacaucaucaaggcac

SEQ ID NO: 2400475 - RNA, 14 nt, Human
aacaucaucaaggc

SEQ ID NO: 2400476 - RNA, 18 nt, Human
aacaucaguuacucugaa

SEQ ID NO: 2400477 - RNA, 19 nt, Human
aacaucaguuacucugaag

SEQ ID NO: 2400478 - RNA, 21 nt, Human
aacaucaguuacucugaaggg

SEQ ID NO: 2400479 - RNA, 13 nt, Human
aacaucacacaca

SEQ ID NO: 2400480 - RNA, 18 nt, Human
aacaucaauguucauugu

SEQ ID NO: 2400481 - RNA, 19 nt, Human
aacaucaauguucauugua

SEQ ID NO: 2400482 - RNA, 17 nt, Human
aacaucacugaaaugcu

SEQ ID NO: 2400483 - RNA, 18 nt, Human
aaccaggagcugcucacu

SEQ ID NO: 2400484 - RNA, 17 nt, Human
aaccaggagcugcucac

SEQ ID NO: 2400485 - RNA, 18 nt, Human
aaccaguccccccacccu

SEQ ID NO: 2400486 - RNA, 22 nt, Human
aaccaguccccccacccucauu

SEQ ID NO: 2400487 - RNA, 17 nt, Human
aacccugcccccaaaua

SEQ ID NO: 2400488 - RNA, 12 nt, Human
aacccugccccu

SEQ ID NO: 2400489 - RNA, 14 nt, Human
aacccugccccugc

SEQ ID NO: 2400490 - RNA, 11 nt, Human
aacccugcccc

SEQ ID NO: 2400491 - RNA, 14 nt, Human
aaccaguguagccu

SEQ ID NO: 2400492 - RNA, 17 nt, Human
aacccugcaaaggacug

SEQ ID NO: 2400493 - RNA, 15 nt, Human
aaccaggagcugcuc

SEQ ID NO: 2400494 - RNA, 15 nt, Human
aaccaggaaauggaa

SEQ ID NO: 2400495 - RNA, 22 nt, Human
aaccagcuguaacacagcugag

SEQ ID NO: 2400496 - RNA, 16 nt, Human
aaccagcuaagaaaag

SEQ ID NO: 2400497 - RNA, 21 nt, Human
aaccagcuaagaaaagauuuu

SEQ ID NO: 2400498 - RNA, 21 nt, Human
aaccagcaucccuugaccagg

SEQ ID NO: 2400499 - RNA, 14 nt, Human
aaccagcuaagaaa

SEQ ID NO: 2400500 - RNA, 22 nt, Human
aaccacucuaucaaguauuaua

SEQ ID NO: 2400501 - RNA, 23 nt, Human
aacauguaauuaaguacuaugua

SEQ ID NO: 2400502 - RNA, 14 nt, Human
aacauguaauuaag

SEQ ID NO: 2400503 - RNA, 21 nt, Human
aacauguaauuaaguacuaug

SEQ ID NO: 2400504 - RNA, 12 nt, Human
aaccagaucauu

SEQ ID NO: 2400505 - RNA, 14 nt, Human
aaccagaucauugu

SEQ ID NO: 2400506 - RNA, 11 nt, Human
aaccacugaau

SEQ ID NO: 2400507 - RNA, 13 nt, Human
aaccacugaaucu

SEQ ID NO: 2400508 - RNA, 14 nt, Human
aaccacugcaacgg

SEQ ID NO: 2400509 - RNA, 17 nt, Human
aaccacugaaucuggac

SEQ ID NO: 2400510 - RNA, 19 nt, Human
aaccacucaaauuaaucuu

SEQ ID NO: 2400511 - RNA, 21 nt, Human
aaccacgucugucuucacagc

SEQ ID NO: 2400512 - RNA, 18 nt, Human
aaccacgucugucuucac

SEQ ID NO: 2400513 - RNA, 12 nt, Human
aacccugugcug

SEQ ID NO: 2400514 - RNA, 14 nt, Human
aacccugugcuggu

SEQ ID NO: 2400515 - RNA, 21 nt, Human
aacccugugcugguguccuga

SEQ ID NO: 2400516 - RNA, 19 nt, Human
aacccugugcugguguccu

SEQ ID NO: 2400517 - RNA, 13 nt, Human
aacccuguuuccu

SEQ ID NO: 2400518 - RNA, 14 nt, Human
aacccuggugacca

SEQ ID NO: 2400519 - RNA, 12 nt, Human
aacccuggagag

SEQ ID NO: 2400520 - RNA, 19 nt, Human
aacccugcguggggacagg

SEQ ID NO: 2400521 - RNA, 17 nt, Human
aacccugcguggggaca

SEQ ID NO: 2400522 - RNA, 16 nt, Human
aacccugcguggggac

SEQ ID NO: 2400523 - RNA, 19 nt, Human
aacccugccccugccccgu

SEQ ID NO: 2400524 - RNA, 15 nt, Human
aacacgcaccugccu

SEQ ID NO: 2400525 - RNA, 13 nt, Human
aacaccuucucug

SEQ ID NO: 2400526 - RNA, 14 nt, Human
aacacgcaccugcc

SEQ ID NO: 2400527 - RNA, 22 nt, Human
aacaacuuaauguucugaauaa

SEQ ID NO: 2400528 - RNA, 21 nt, Human
aacaacuccuagggccacuga

SEQ ID NO: 2400529 - RNA, 15 nt, Human
aacaacucuuugaga

SEQ ID NO: 2400530 - RNA, 16 nt, Human
aacaacuucuuuguaa

SEQ ID NO: 2400531 - RNA, 17 nt, Human
aacaacuucuuuguaau

SEQ ID NO: 2400532 - RNA, 16 nt, Human
aacaaagcuuagcagg

SEQ ID NO: 2400533 - RNA, 14 nt, Human
aacaaagcuuagca

SEQ ID NO: 2400534 - RNA, 19 nt, Human
aacaaagcuuagcaggaga

SEQ ID NO: 2400535 - RNA, 17 nt, Human
aacaaagcuuagcagga

SEQ ID NO: 2400536 - RNA, 16 nt, Human
aacaacuaggcuucag

SEQ ID NO: 2400537 - RNA, 13 nt, Human
aacaaccuggaga

SEQ ID NO: 2400538 - RNA, 19 nt, Human
aacaaagagaaaaaauaca

SEQ ID NO: 2400539 - RNA, 15 nt, Human
aacaaagcacagugu

SEQ ID NO: 2400540 - RNA, 13 nt, Human
aacaaagaagguu

SEQ ID NO: 2400541 - RNA, 17 nt, Human
aacaaagaagacaacau

SEQ ID NO: 2400542 - RNA, 12 nt, Human
aacaaagccaga

SEQ ID NO: 2400543 - RNA, 15 nt, Human
aacaaagcuguugau

SEQ ID NO: 2400544 - RNA, 14 nt, Human
aacaaagccagaag

SEQ ID NO: 2400545 - RNA, 17 nt, Human
aacaaagccagaagcug

SEQ ID NO: 2400546 - RNA, 17 nt, Human
aacaaagcacaguguua

SEQ ID NO: 2400547 - RNA, 16 nt, Human
aacaaagcacaguguu

SEQ ID NO: 2400548 - RNA, 14 nt, Human
aacaaagcagccac

SEQ ID NO: 2400549 - RNA, 15 nt, Human
aacaaagcagccacg

SEQ ID NO: 2400550 - RNA, 11 nt, Human
aacaaagccag

SEQ ID NO: 2400551 - RNA, 15 nt, Human
aacacauuuuguaua

SEQ ID NO: 2400552 - RNA, 14 nt, Human
aacacauuuuguau

SEQ ID NO: 2400553 - RNA, 12 nt, Human
aacaagaauugg

SEQ ID NO: 2400554 - RNA, 21 nt, Human
aacaagaagccacagaccuag

SEQ ID NO: 2400555 - RNA, 19 nt, Human
aacacauuuuucuuaggga

SEQ ID NO: 2400556 - RNA, 22 nt, Human
aacacauuuuguauaauuguau

SEQ ID NO: 2400557 - RNA, 21 nt, Human
aacacauuuuguauaauugua

SEQ ID NO: 2400558 - RNA, 19 nt, Human
aacacauuuuguauaauug

SEQ ID NO: 2400559 - RNA, 16 nt, Human
aacacauuuuguauaa

SEQ ID NO: 2400560 - RNA, 23 nt, Human
aacacauuuuguauaauuguauc

SEQ ID NO: 2400561 - RNA, 15 nt, Human
aacacgagcaggcua

SEQ ID NO: 2400562 - RNA, 19 nt, Human
aacaccugggcuuaagaaa

SEQ ID NO: 2400563 - RNA, 17 nt, Human
aacaccugauguguaca

SEQ ID NO: 2400564 - RNA, 17 nt, Human
aacaccuuccagcuccu

SEQ ID NO: 2400565 - RNA, 15 nt, Human
aacaccugaugugua

SEQ ID NO: 2400566 - RNA, 13 nt, Human
aacaccugaugug

SEQ ID NO: 2400567 - RNA, 18 nt, Human
aacaccaagcacagcagc

SEQ ID NO: 2400568 - RNA, 19 nt, Human
aacaccaagcacagcagcc

SEQ ID NO: 2400569 - RNA, 14 nt, Human
aacaccaagcacag

SEQ ID NO: 2400570 - RNA, 17 nt, Human
aacaccaagcacagcag

SEQ ID NO: 2400571 - RNA, 19 nt, Human
aaauuggaacagaauguuu

SEQ ID NO: 2400572 - RNA, 16 nt, Human
aaauuggaacagaaug

SEQ ID NO: 2400573 - RNA, 15 nt, Human
aaauugggaaaggag

SEQ ID NO: 2400574 - RNA, 20 nt, Human
aaauugggaaaggaguagaa

SEQ ID NO: 2400575 - RNA, 16 nt, Human
aaauugcuugaaagaa

SEQ ID NO: 2400576 - RNA, 14 nt, Human
aaauugcuguguau

SEQ ID NO: 2400577 - RNA, 18 nt, Human
aaauugcuuacuuuggaa

SEQ ID NO: 2400578 - RNA, 13 nt, Human
aaauugcuugaaa

SEQ ID NO: 2400579 - RNA, 22 nt, Human
aaauugcugugccucccaaaau

SEQ ID NO: 2400580 - RNA, 14 nt, Human
aaauugccauauug

SEQ ID NO: 2400581 - RNA, 18 nt, Human
aaauugcauuuccugaca

SEQ ID NO: 2400582 - RNA, 21 nt, Human
aaauugauguguuuauuuaua

SEQ ID NO: 2400583 - RNA, 14 nt, Human
aaauugcaaaucuu

SEQ ID NO: 2400584 - RNA, 19 nt, Human
aaauugcaaaucuugaaau

SEQ ID NO: 2400585 - RNA, 13 nt, Human
aaauugcaaaucu

SEQ ID NO: 2400586 - RNA, 12 nt, Human
aaauugcacaau

SEQ ID NO: 2400587 - RNA, 17 nt, Human
aacaaagaaauuaugug

SEQ ID NO: 2400588 - RNA, 15 nt, Human
aacaaagaaauuaug

SEQ ID NO: 2400589 - RNA, 20 nt, Human
aacaaaaucuccucuuuuag

SEQ ID NO: 2400590 - RNA, 12 nt, Human
aacaaaauagaa

SEQ ID NO: 2400591 - RNA, 13 nt, Human
aacaaaaagaaca

SEQ ID NO: 2400592 - RNA, 13 nt, Human
aacaaaaauuguc

SEQ ID NO: 2400593 - RNA, 11 nt, Human
aacaaaaauaa

SEQ ID NO: 2400594 - RNA, 13 nt, Human
aacaaaaauuagg

SEQ ID NO: 2400595 - RNA, 14 nt, Human
aacaaaaagcuucc

SEQ ID NO: 2400596 - RNA, 16 nt, Human
aacaaaaagcuucccc

SEQ ID NO: 2400597 - RNA, 15 nt, Human
aacaaaagcaagacu

SEQ ID NO: 2400598 - RNA, 14 nt, Human
aacaaaaauuaggu

SEQ ID NO: 2400599 - RNA, 14 nt, Human
acgauuucuguuua

SEQ ID NO: 2400600 - RNA, 17 nt, Human
acgauuucuguuuagau

SEQ ID NO: 2400601 - RNA, 18 nt, Human
acgccacugcacuauagc

SEQ ID NO: 2400602 - RNA, 20 nt, Human
acgccacugcacuccagccu

SEQ ID NO: 2400603 - RNA, 22 nt, Human
acgccacugcacuccagccugg

SEQ ID NO: 2400604 - RNA, 13 nt, Human
acgccaccucgcc

SEQ ID NO: 2400605 - RNA, 12 nt, Human
acgauuucuguu

SEQ ID NO: 2400606 - RNA, 13 nt, Human
acgauuucuguuu

SEQ ID NO: 2400607 - RNA, 19 nt, Human
acgauuuaauucucuugaa

SEQ ID NO: 2400608 - RNA, 17 nt, Human
acgauuuaauucucuug

SEQ ID NO: 2400609 - RNA, 15 nt, Human
acgauuuaauucucu

SEQ ID NO: 2400610 - RNA, 14 nt, Human
acgauuuaauucuc

SEQ ID NO: 2400611 - RNA, 18 nt, Human
acgauuuagaaagaagcc

SEQ ID NO: 2400612 - RNA, 22 nt, Human
acgauguggcccuggccugcug

SEQ ID NO: 2400613 - RNA, 16 nt, Human
acgauguggcccuggc

SEQ ID NO: 2400614 - RNA, 17 nt, Human
acgauguggcccuggcc

SEQ ID NO: 2400615 - RNA, 18 nt, Human
acgauguggcccuggccu

SEQ ID NO: 2400616 - RNA, 19 nt, Human
acgauguggcccuggccug

SEQ ID NO: 2400617 - RNA, 13 nt, Human
acgaugucuucau

SEQ ID NO: 2400618 - RNA, 21 nt, Human
acgauguggaaaaaugagaga

SEQ ID NO: 2400619 - RNA, 14 nt, Human
acgauguggcccug

SEQ ID NO: 2400620 - RNA, 15 nt, Human
acgauggcacccagu

SEQ ID NO: 2400621 - RNA, 14 nt, Human
acgaugaaaaacuu

SEQ ID NO: 2400622 - RNA, 15 nt, Human
acuaaguuuuuaugg

SEQ ID NO: 2400623 - RNA, 22 nt, Human
acuaaguuuuuauggcuuuugu

SEQ ID NO: 2400624 - RNA, 13 nt, Human
acuaagcagagga

SEQ ID NO: 2400625 - RNA, 14 nt, Human
acuaagcagaggag

SEQ ID NO: 2400626 - RNA, 20 nt, Human
acuaagaugacauugcuaag

SEQ ID NO: 2400627 - RNA, 12 nt, Human
acuaagcagagg

SEQ ID NO: 2400628 - RNA, 22 nt, Human
acuaauaaaagcauaaaugcaa

SEQ ID NO: 2400629 - RNA, 15 nt, Human
acguggcugcuucaa

SEQ ID NO: 2400630 - RNA, 14 nt, Human
acguggcugcuuca

SEQ ID NO: 2400631 - RNA, 16 nt, Human
acgugcauugugcuuc

SEQ ID NO: 2400632 - RNA, 15 nt, Human
acgugcauugugcuu

SEQ ID NO: 2400633 - RNA, 14 nt, Human
acgugcauugugcu

SEQ ID NO: 2400634 - RNA, 12 nt, Human
acgugcauugug

SEQ ID NO: 2400635 - RNA, 13 nt, Human
acguggcugcuuc

SEQ ID NO: 2400636 - RNA, 16 nt, Human
acuaagagagaaugag

SEQ ID NO: 2400637 - RNA, 15 nt, Human
acuaagagagaauga

SEQ ID NO: 2400638 - RNA, 11 nt, Human
acguggcugcu

SEQ ID NO: 2400639 - RNA, 19 nt, Human
acuaagaugacauugcuaa

SEQ ID NO: 2400640 - RNA, 18 nt, Human
acuaagaugacauugcua

SEQ ID NO: 2400641 - RNA, 17 nt, Human
acuaagaugacauugcu

SEQ ID NO: 2400642 - RNA, 17 nt, Human
acgcugugcugcccugc

SEQ ID NO: 2400643 - RNA, 16 nt, Human
acgcugugcugcccug

SEQ ID NO: 2400644 - RNA, 15 nt, Human
acgcugugcugcccu

SEQ ID NO: 2400645 - RNA, 21 nt, Human
acgugcaccuguacucaggag

SEQ ID NO: 2400646 - RNA, 23 nt, Human
acgugcaccuguacucaggaggc

SEQ ID NO: 2400647 - RNA, 20 nt, Human
acgugcaauuuguuugugcu

SEQ ID NO: 2400648 - RNA, 19 nt, Human
acgugcaauuuguuugugc

SEQ ID NO: 2400649 - RNA, 14 nt, Human
acgugcaauuuguu

SEQ ID NO: 2400650 - RNA, 22 nt, Human
acgugcaauuuguuugugcuuc

SEQ ID NO: 2400651 - RNA, 21 nt, Human
acgugcaauuuguuugugcuu

SEQ ID NO: 2400652 - RNA, 20 nt, Human
acgugcaccuguacucagga

SEQ ID NO: 2400653 - RNA, 18 nt, Human
acgcugugcugcccugcc

SEQ ID NO: 2400654 - RNA, 22 nt, Human
acgugauucaauucaacacucc

SEQ ID NO: 2400655 - RNA, 23 nt, Human
acgccacugcacuccagccuggg

SEQ ID NO: 2400656 - RNA, 19 nt, Human
acgugauuuugcuguagaa

SEQ ID NO: 2400657 - RNA, 15 nt, Human
accucuucacccccc

SEQ ID NO: 2400658 - RNA, 19 nt, Human
accucuuccggagauguag

SEQ ID NO: 2400659 - RNA, 22 nt, Human
accucuuccccagaaaggagac

SEQ ID NO: 2400660 - RNA, 23 nt, Human
accucuuccccagaaaggagacu

SEQ ID NO: 2400661 - RNA, 17 nt, Human
accucuucucuuccugu

SEQ ID NO: 2400662 - RNA, 16 nt, Human
accucuucucuuccug

SEQ ID NO: 2400663 - RNA, 14 nt, Human
accucuucuggcuc

SEQ ID NO: 2400664 - RNA, 13 nt, Human
accugcccaaccu

SEQ ID NO: 2400665 - RNA, 21 nt, Human
accugcccaaccugcucuccu

SEQ ID NO: 2400666 - RNA, 16 nt, Human
accucuucuggcucaa

SEQ ID NO: 2400667 - RNA, 21 nt, Human
accucuucucuuccuguaaca

SEQ ID NO: 2400668 - RNA, 20 nt, Human
accugcccagaucccagaag

SEQ ID NO: 2400669 - RNA, 17 nt, Human
accugccccaacucucc

SEQ ID NO: 2400670 - RNA, 15 nt, Human
accugcccaucacag

SEQ ID NO: 2400671 - RNA, 22 nt, Human
accugcccagaucccagaagga

SEQ ID NO: 2400672 - RNA, 23 nt, Human
accugccccucaacucuccucca

SEQ ID NO: 2400673 - RNA, 14 nt, Human
accugccccuccuc

SEQ ID NO: 2400674 - RNA, 18 nt, Human
accugccccuccucucug

SEQ ID NO: 2400675 - RNA, 16 nt, Human
accugcccccaaucca

SEQ ID NO: 2400676 - RNA, 13 nt, Human
accugcccccugg

SEQ ID NO: 2400677 - RNA, 15 nt, Human
accugcccccuggug

SEQ ID NO: 2400678 - RNA, 12 nt, Human
accugcccccuu

SEQ ID NO: 2400679 - RNA, 16 nt, Human
accucugcacaagcug

SEQ ID NO: 2400680 - RNA, 18 nt, Human
accucugcacaagcugca

SEQ ID NO: 2400681 - RNA, 21 nt, Human
accucugcacuacugacaugu

SEQ ID NO: 2400682 - RNA, 22 nt, Human
accucuguuguccuccccuugg

SEQ ID NO: 2400683 - RNA, 20 nt, Human
accucuguuguccuccccuu

SEQ ID NO: 2400684 - RNA, 17 nt, Human
accucuguuguccuccc

SEQ ID NO: 2400685 - RNA, 21 nt, Human
accucugcacaagcugcaccc

SEQ ID NO: 2400686 - RNA, 17 nt, Human
accucuucagaggcccu

SEQ ID NO: 2400687 - RNA, 18 nt, Human
accucuucagaggcccuc

SEQ ID NO: 2400688 - RNA, 13 nt, Human
accucuuccccag

SEQ ID NO: 2400689 - RNA, 14 nt, Human
accucuuccccaga

SEQ ID NO: 2400690 - RNA, 15 nt, Human
accucuuagcugagu

SEQ ID NO: 2400691 - RNA, 20 nt, Human
accucuuaacaauuucuguc

SEQ ID NO: 2400692 - RNA, 15 nt, Human
accucuucagaggcc

SEQ ID NO: 2400693 - RNA, 22 nt, Human
accucuuaaagaaaacccaccc

SEQ ID NO: 2400694 - RNA, 21 nt, Human
accucuuaaagaaaacccacc

SEQ ID NO: 2400695 - RNA, 14 nt, Human
accucuuagcugag

SEQ ID NO: 2400696 - RNA, 15 nt, Human
accuugugucuguac

SEQ ID NO: 2400697 - RNA, 13 nt, Human
accuugugucugu

SEQ ID NO: 2400698 - RNA, 20 nt, Human
accuuguggcaagccccugc

SEQ ID NO: 2400699 - RNA, 14 nt, Human
accuugugccuggc

SEQ ID NO: 2400700 - RNA, 12 nt, Human
accuugugucug

SEQ ID NO: 2400701 - RNA, 16 nt, Human
accuuguuacuucuga

SEQ ID NO: 2400702 - RNA, 15 nt, Human
accuuguuacuucug

SEQ ID NO: 2400703 - RNA, 21 nt, Human
accuugugucuguacacgugu

SEQ ID NO: 2400704 - RNA, 18 nt, Human
accuugugucuguacacg

SEQ ID NO: 2400705 - RNA, 17 nt, Human
accuugugccuggcuca

SEQ ID NO: 2400706 - RNA, 14 nt, Human
accuuggcugcagg

SEQ ID NO: 2400707 - RNA, 17 nt, Human
accuuguuacuucugag

SEQ ID NO: 2400708 - RNA, 18 nt, Human
accuuguguguaugugua

SEQ ID NO: 2400709 - RNA, 17 nt, Human
accuuguuauuucucag

SEQ ID NO: 2400710 - RNA, 21 nt, Human
accuuguucacacucucacau

SEQ ID NO: 2400711 - RNA, 16 nt, Human
accuuguucacacucu

SEQ ID NO: 2400712 - RNA, 14 nt, Human
accuuguucacacu

SEQ ID NO: 2400713 - RNA, 22 nt, Human
accuuguuauuucucagacuuu

SEQ ID NO: 2400714 - RNA, 12 nt, Human
accuuuauucug

SEQ ID NO: 2400715 - RNA, 13 nt, Human
accuuuauucugg

SEQ ID NO: 2400716 - RNA, 16 nt, Human
accuuucaauaggaaa

SEQ ID NO: 2400717 - RNA, 20 nt, Human
accuuuauuaaaaucuuaaa

SEQ ID NO: 2400718 - RNA, 18 nt, Human
accuuuauugugaucuau

SEQ ID NO: 2400719 - RNA, 16 nt, Human
accuuuauugugaucu

SEQ ID NO: 2400720 - RNA, 14 nt, Human
accuuuauugugau

SEQ ID NO: 2400721 - RNA, 12 nt, Human
accuuggcucaa

SEQ ID NO: 2400722 - RNA, 17 nt, Human
accuguaugucuccagu

SEQ ID NO: 2400723 - RNA, 19 nt, Human
accugucaaacaaagccag

SEQ ID NO: 2400724 - RNA, 20 nt, Human
accugucaaacaaagccaga

SEQ ID NO: 2400725 - RNA, 24 nt, Human
accugucaaacaaagccagaagcu

SEQ ID NO: 2400726 - RNA, 22 nt, Human
accugucaaugauacagucccu

SEQ ID NO: 2400727 - RNA, 12 nt, Human
accuuggcugca

SEQ ID NO: 2400728 - RNA, 14 nt, Human
accuuggcucaagu

SEQ ID NO: 2400729 - RNA, 20 nt, Human
accugccccuccucucugcc

SEQ ID NO: 2400730 - RNA, 22 nt, Human
accugccccuccucucugcccu

SEQ ID NO: 2400731 - RNA, 20 nt, Human
accuguaaucccagcuacuu

SEQ ID NO: 2400732 - RNA, 17 nt, Human
accugcccccuucuccc

SEQ ID NO: 2400733 - RNA, 15 nt, Human
accugcccccuucuc

SEQ ID NO: 2400734 - RNA, 16 nt, Human
accugcccccuucucc

SEQ ID NO: 2400735 - RNA, 23 nt, Human
accuguauaaguggaggcacuuu

SEQ ID NO: 2400736 - RNA, 21 nt, Human
accuguauaaguggaggcacu

SEQ ID NO: 2400737 - RNA, 17 nt, Human
accuguagucccagcua

SEQ ID NO: 2400738 - RNA, 18 nt, Human
accuguagucccagcuac

SEQ ID NO: 2400739 - RNA, 12 nt, Human
accuguacucag

SEQ ID NO: 2400740 - RNA, 14 nt, Human
accuguagucccag

SEQ ID NO: 2400741 - RNA, 21 nt, Human
accuuucaauaggaaaaacug

SEQ ID NO: 2400742 - RNA, 17 nt, Human
accuuucaauaggaaaa

SEQ ID NO: 2400743 - RNA, 23 nt, Human
accuuucaauaggaaaaacugau

SEQ ID NO: 2400744 - RNA, 15 nt, Human
accuuucacauagag

SEQ ID NO: 2400745 - RNA, 17 nt, Human
accuuucaaauuucaca

SEQ ID NO: 2400746 - RNA, 17 nt, Human
accuuuauuuuagaauu

SEQ ID NO: 2400747 - RNA, 17 nt, Human
accuuucagcugugaac

SEQ ID NO: 2400748 - RNA, 16 nt, Human
accuuucagcugugaa

SEQ ID NO: 2400749 - RNA, 23 nt, Human
accuuucagauaacuguuauuua

SEQ ID NO: 2400750 - RNA, 22 nt, Human
acucccuugguggcaagagccc

SEQ ID NO: 2400751 - RNA, 21 nt, Human
acucccuugguggcaagagcc

SEQ ID NO: 2400752 - RNA, 19 nt, Human
acucccuugguggcaagag

SEQ ID NO: 2400753 - RNA, 14 nt, Human
acucccuugggcuc

SEQ ID NO: 2400754 - RNA, 12 nt, Human
acucccuuucaa

SEQ ID NO: 2400755 - RNA, 13 nt, Human
acucccuuucaac

SEQ ID NO: 2400756 - RNA, 22 nt, Human
acucccuucuaccugccacuca

SEQ ID NO: 2400757 - RNA, 21 nt, Human
acucccuucuaccugccacuc

SEQ ID NO: 2400758 - RNA, 19 nt, Human
acucccggcacuccaugcu

SEQ ID NO: 2400759 - RNA, 18 nt, Human
acucccggcacuccaugc

SEQ ID NO: 2400760 - RNA, 20 nt, Human
acuccccuugagcugagaug

SEQ ID NO: 2400761 - RNA, 15 nt, Human
acuccccuugagcug

SEQ ID NO: 2400762 - RNA, 17 nt, Human
acuccccuugagcugag

SEQ ID NO: 2400763 - RNA, 13 nt, Human
acucuaccucaua

SEQ ID NO: 2400764 - RNA, 22 nt, Human
acucuaccucauaucaguuugc

SEQ ID NO: 2400765 - RNA, 21 nt, Human
acucuacccucuuagaaaaac

SEQ ID NO: 2400766 - RNA, 13 nt, Human
acucuacccucuu

SEQ ID NO: 2400767 - RNA, 18 nt, Human
acucuacccucuuagaaa

SEQ ID NO: 2400768 - RNA, 21 nt, Human
acucugugcccaugggcacug

SEQ ID NO: 2400769 - RNA, 18 nt, Human
acucugugcccaugggca

SEQ ID NO: 2400770 - RNA, 15 nt, Human
acucugugcccaugg

SEQ ID NO: 2400771 - RNA, 13 nt, Human
acucugugcccau

SEQ ID NO: 2400772 - RNA, 24 nt, Human
acucugugcccaugggcacugcug

SEQ ID NO: 2400773 - RNA, 23 nt, Human
acucugugcccaugggcacugcu

SEQ ID NO: 2400774 - RNA, 20 nt, Human
acucugugccugaccuugag

SEQ ID NO: 2400775 - RNA, 12 nt, Human
acucugugccca

SEQ ID NO: 2400776 - RNA, 16 nt, Human
acucugugucaggugg

SEQ ID NO: 2400777 - RNA, 17 nt, Human
acucuguggggccuugg

SEQ ID NO: 2400778 - RNA, 15 nt, Human
acucuguggccaaag

SEQ ID NO: 2400779 - RNA, 16 nt, Human
acucuguggggccuug

SEQ ID NO: 2400780 - RNA, 11 nt, Human
acucuuaaaac

SEQ ID NO: 2400781 - RNA, 18 nt, Human
acucuuaaaacccaagug

SEQ ID NO: 2400782 - RNA, 20 nt, Human
acucuguugcaagugcaaua

SEQ ID NO: 2400783 - RNA, 20 nt, Human
acucuguuccuucacauccu

SEQ ID NO: 2400784 - RNA, 22 nt, Human
acucuguuccuucacauccugu

SEQ ID NO: 2400785 - RNA, 17 nt, Human
acucuguuccuucacau

SEQ ID NO: 2400786 - RNA, 14 nt, Human
acucuguuccuuca

SEQ ID NO: 2400787 - RNA, 14 nt, Human
acucuaucaaguau

SEQ ID NO: 2400788 - RNA, 15 nt, Human
acucuauagacucua

SEQ ID NO: 2400789 - RNA, 16 nt, Human
acucuaucaaguauua

SEQ ID NO: 2400790 - RNA, 18 nt, Human
acucuauagacucuagga

SEQ ID NO: 2400791 - RNA, 19 nt, Human
acucugggaaauaagagag

SEQ ID NO: 2400792 - RNA, 17 nt, Human
acucuggcuuccaggua

SEQ ID NO: 2400793 - RNA, 15 nt, Human
acucuggcuuccagg

SEQ ID NO: 2400794 - RNA, 13 nt, Human
acucugggaaaua

SEQ ID NO: 2400795 - RNA, 14 nt, Human
acucuggcuuccag

SEQ ID NO: 2400796 - RNA, 23 nt, Human
acucuggcugguuuggaaugcuu

SEQ ID NO: 2400797 - RNA, 22 nt, Human
acucuggcugguuuggaaugcu

SEQ ID NO: 2400798 - RNA, 11 nt, Human
acucuggccuc

SEQ ID NO: 2400799 - RNA, 12 nt, Human
acucuggcuggu

SEQ ID NO: 2400800 - RNA, 17 nt, Human
acucugggguuuuuacu

SEQ ID NO: 2400801 - RNA, 17 nt, Human
acucugggcugcuaccc

SEQ ID NO: 2400802 - RNA, 14 nt, Human
acucugggcuccag

SEQ ID NO: 2400803 - RNA, 16 nt, Human
acucugggcuccagag

SEQ ID NO: 2400804 - RNA, 18 nt, Human
acuauaaagguugacaau

SEQ ID NO: 2400805 - RNA, 20 nt, Human
acuauaaagaaguaacaaaa

SEQ ID NO: 2400806 - RNA, 19 nt, Human
acuaguuuaguuaaaugag

SEQ ID NO: 2400807 - RNA, 17 nt, Human
acuaguuuugugccagc

SEQ ID NO: 2400808 - RNA, 15 nt, Human
acucaaaauauuugu

SEQ ID NO: 2400809 - RNA, 18 nt, Human
acucaaaagcugggcagg

SEQ ID NO: 2400810 - RNA, 11 nt, Human
acuauaaugua

SEQ ID NO: 2400811 - RNA, 14 nt, Human
acucaaacugagga

SEQ ID NO: 2400812 - RNA, 21 nt, Human
acucaaacugaggaauuucac

SEQ ID NO: 2400813 - RNA, 19 nt, Human
acucaaaccaaaucacuga

SEQ ID NO: 2400814 - RNA, 20 nt, Human
acucaaaccaaaucacugaa

SEQ ID NO: 2400815 - RNA, 17 nt, Human
acucaaacucuuaaaac

SEQ ID NO: 2400816 - RNA, 16 nt, Human
acucaaacucuuaaaa

SEQ ID NO: 2400817 - RNA, 17 nt, Human
acucaaaauauuuguac

SEQ ID NO: 2400818 - RNA, 19 nt, Human
acucaaaauauuuguacau

SEQ ID NO: 2400819 - RNA, 20 nt, Human
acucaaaauauuuguacaua

SEQ ID NO: 2400820 - RNA, 15 nt, Human
acucagcacaaggcc

SEQ ID NO: 2400821 - RNA, 13 nt, Human
acucagcagcccu

SEQ ID NO: 2400822 - RNA, 16 nt, Human
acucagaucugucuga

SEQ ID NO: 2400823 - RNA, 21 nt, Human
acucagaucacuacugcaguc

SEQ ID NO: 2400824 - RNA, 21 nt, Human
acucagauggaaccgcaggaa

SEQ ID NO: 2400825 - RNA, 22 nt, Human
acucagauggaaccgcaggaag

SEQ ID NO: 2400826 - RNA, 23 nt, Human
acucagauggaaccgcaggaagc

SEQ ID NO: 2400827 - RNA, 22 nt, Human
acucagaugucucuggcgugug

SEQ ID NO: 2400828 - RNA, 14 nt, Human
acucagcagcccuc

SEQ ID NO: 2400829 - RNA, 15 nt, Human
acucagcagcccucc

SEQ ID NO: 2400830 - RNA, 15 nt, Human
acucagcccugaggu

SEQ ID NO: 2400831 - RNA, 12 nt, Human
acucagcccugg

SEQ ID NO: 2400832 - RNA, 13 nt, Human
acucagcccuggg

SEQ ID NO: 2400833 - RNA, 14 nt, Human
acucagcccugggc

SEQ ID NO: 2400834 - RNA, 22 nt, Human
acucagccucaauaagccuugu

SEQ ID NO: 2400835 - RNA, 15 nt, Human
acucagcccugggcc

SEQ ID NO: 2400836 - RNA, 16 nt, Human
acucagcccugggccc

SEQ ID NO: 2400837 - RNA, 22 nt, Human
acucagcccugggccccaccac

SEQ ID NO: 2400838 - RNA, 14 nt, Human
acucaaaucaagaa

SEQ ID NO: 2400839 - RNA, 11 nt, Human
acucagaucca

SEQ ID NO: 2400840 - RNA, 12 nt, Human
acucagauccag

SEQ ID NO: 2400841 - RNA, 14 nt, Human
acucagauccaggg

SEQ ID NO: 2400842 - RNA, 16 nt, Human
acucagauccagggac

SEQ ID NO: 2400843 - RNA, 17 nt, Human
acucagauccagggaca

SEQ ID NO: 2400844 - RNA, 19 nt, Human
acucagauccagggacaga

SEQ ID NO: 2400845 - RNA, 22 nt, Human
acucaaaguuucagagaccauu

SEQ ID NO: 2400846 - RNA, 19 nt, Human
acucaaaguuucagagacc

SEQ ID NO: 2400847 - RNA, 20 nt, Human
acucaaaguuucagagacca

SEQ ID NO: 2400848 - RNA, 23 nt, Human
acucaaacugaggaauuucaccu

SEQ ID NO: 2400849 - RNA, 21 nt, Human
acucaaacugccuuggcuuca

SEQ ID NO: 2400850 - RNA, 23 nt, Human
acucaaacuuuuccccuguccug

SEQ ID NO: 2400851 - RNA, 13 nt, Human
acuccccugcugg

SEQ ID NO: 2400852 - RNA, 12 nt, Human
acuccccuccuu

SEQ ID NO: 2400853 - RNA, 17 nt, Human
acuccccugcugggugu

SEQ ID NO: 2400854 - RNA, 17 nt, Human
acuccccgaagucuuuu

SEQ ID NO: 2400855 - RNA, 11 nt, Human
acuccccucca

SEQ ID NO: 2400856 - RNA, 12 nt, Human
acuccccugcac

SEQ ID NO: 2400857 - RNA, 16 nt, Human
acuccccugcacugga

SEQ ID NO: 2400858 - RNA, 22 nt, Human
acuccccugcacuggaguccag

SEQ ID NO: 2400859 - RNA, 19 nt, Human
acuccccaggccaggccac

SEQ ID NO: 2400860 - RNA, 15 nt, Human
acuccccaggccagg

SEQ ID NO: 2400861 - RNA, 13 nt, Human
acuccccaggcca

SEQ ID NO: 2400862 - RNA, 14 nt, Human
acuccccgaagucu

SEQ ID NO: 2400863 - RNA, 16 nt, Human
acuccccgaagucuuu

SEQ ID NO: 2400864 - RNA, 14 nt, Human
acucccccaggugg

SEQ ID NO: 2400865 - RNA, 12 nt, Human
acuccccaggcc

SEQ ID NO: 2400866 - RNA, 22 nt, Human
acucaguuugucagacuuuaaa

SEQ ID NO: 2400867 - RNA, 13 nt, Human
acucaguuuucuu

SEQ ID NO: 2400868 - RNA, 21 nt, Human
acucauaaaaagccugcaauu

SEQ ID NO: 2400869 - RNA, 22 nt, Human
acucaguuuuaacuagaauuua

SEQ ID NO: 2400870 - RNA, 15 nt, Human
acucaguuuuaacua

SEQ ID NO: 2400871 - RNA, 13 nt, Human
acucagucuuuaa

SEQ ID NO: 2400872 - RNA, 14 nt, Human
acucaguggggagg

SEQ ID NO: 2400873 - RNA, 18 nt, Human
acucagggccaugccugc

SEQ ID NO: 2400874 - RNA, 13 nt, Human
acucaguuuguca

SEQ ID NO: 2400875 - RNA, 14 nt, Human
acucaguuugucag

SEQ ID NO: 2400876 - RNA, 15 nt, Human
acucaguuugucaga

SEQ ID NO: 2400877 - RNA, 19 nt, Human
acucaguuugucagacuuu

SEQ ID NO: 2400878 - RNA, 17 nt, Human
acucagggcagcgccag

SEQ ID NO: 2400879 - RNA, 20 nt, Human
acucagggcagcgccaggcu

SEQ ID NO: 2400880 - RNA, 21 nt, Human
acucagggcagcgccaggcug

SEQ ID NO: 2400881 - RNA, 22 nt, Human
acucagggcagcgccaggcuga

SEQ ID NO: 2400882 - RNA, 13 nt, Human
acucagggcccca

SEQ ID NO: 2400883 - RNA, 14 nt, Human
acucagggccccag

SEQ ID NO: 2400884 - RNA, 20 nt, Human
acucagggacagagccaugc

SEQ ID NO: 2400885 - RNA, 18 nt, Human
acucagggacagagccau

SEQ ID NO: 2400886 - RNA, 17 nt, Human
acucagggacagagcca

SEQ ID NO: 2400887 - RNA, 15 nt, Human
acucagggacagagc

SEQ ID NO: 2400888 - RNA, 13 nt, Human
acucagggacaga

SEQ ID NO: 2400889 - RNA, 23 nt, Human
acucaggcuuucacuauuuccuu

SEQ ID NO: 2400890 - RNA, 15 nt, Human
acucaggcuuucacu

SEQ ID NO: 2400891 - RNA, 17 nt, Human
acucaggcccaaagccu

SEQ ID NO: 2400892 - RNA, 23 nt, Human
acucagccuucagacagagagga

SEQ ID NO: 2400893 - RNA, 11 nt, Human
acucagccuuc

SEQ ID NO: 2400894 - RNA, 19 nt, Human
acucagcuccccagagucc

SEQ ID NO: 2400895 - RNA, 15 nt, Human
acucagcuccccaga

SEQ ID NO: 2400896 - RNA, 14 nt, Human
acucagcuccccag

SEQ ID NO: 2400897 - RNA, 21 nt, Human
acucagcccugggccccacca

SEQ ID NO: 2400898 - RNA, 14 nt, Human
acucagcuccguga

SEQ ID NO: 2400899 - RNA, 22 nt, Human
acucagcucuuggcuccacugg

SEQ ID NO: 2400900 - RNA, 23 nt, Human
acuagccaccaacucuugcaggu

SEQ ID NO: 2400901 - RNA, 16 nt, Human
acuagccaccaacucu

SEQ ID NO: 2400902 - RNA, 15 nt, Human
acuagccaccaacuc

SEQ ID NO: 2400903 - RNA, 14 nt, Human
acuagcuauggugu

SEQ ID NO: 2400904 - RNA, 21 nt, Human
acuagccaugauaacugcaau

SEQ ID NO: 2400905 - RNA, 22 nt, Human
acuagccagacacucugcucug

SEQ ID NO: 2400906 - RNA, 15 nt, Human
acuagcccaaugaaa

SEQ ID NO: 2400907 - RNA, 17 nt, Human
acuagcccaaugaaaug

SEQ ID NO: 2400908 - RNA, 22 nt, Human
acuagccuuuggcucuggagac

SEQ ID NO: 2400909 - RNA, 20 nt, Human
acuagccuuuggcucuggag

SEQ ID NO: 2400910 - RNA, 19 nt, Human
acuagccuuuggcucugga

SEQ ID NO: 2400911 - RNA, 18 nt, Human
acuagccuuuggcucugg

SEQ ID NO: 2400912 - RNA, 17 nt, Human
acuagccuuuggcucug

SEQ ID NO: 2400913 - RNA, 21 nt, Human
acuagccccuguggagacugg

SEQ ID NO: 2400914 - RNA, 15 nt, Human
acuagccucuccagg

SEQ ID NO: 2400915 - RNA, 18 nt, Human
acuaggaaauccauucac

SEQ ID NO: 2400916 - RNA, 16 nt, Human
acuaggacucugaggc

SEQ ID NO: 2400917 - RNA, 18 nt, Human
acuaggagaaccaaaucu

SEQ ID NO: 2400918 - RNA, 17 nt, Human
acuaggacucugaggcu

SEQ ID NO: 2400919 - RNA, 23 nt, Human
acuagcuagaagugggccaggac

SEQ ID NO: 2400920 - RNA, 20 nt, Human
acuaggcccccacuugccuc

SEQ ID NO: 2400921 - RNA, 18 nt, Human
acuagggaucccucaucu

SEQ ID NO: 2400922 - RNA, 19 nt, Human
acuagggaucccucaucug

SEQ ID NO: 2400923 - RNA, 20 nt, Human
acuagggaucccucaucugu

SEQ ID NO: 2400924 - RNA, 18 nt, Human
acuaggcccccacuugcc

SEQ ID NO: 2400925 - RNA, 15 nt, Human
acuaggguccugggg

SEQ ID NO: 2400926 - RNA, 16 nt, Human
acuagggccaagccca

SEQ ID NO: 2400927 - RNA, 21 nt, Human
acuagggauucaggcugcuug

SEQ ID NO: 2400928 - RNA, 16 nt, Human
acuagggauucaggcu

SEQ ID NO: 2400929 - RNA, 17 nt, Human
acuagggauucaggcug

SEQ ID NO: 2400930 - RNA, 18 nt, Human
acuagggauucaggcugc

SEQ ID NO: 2400931 - RNA, 19 nt, Human
acuagggauucaggcugcu

SEQ ID NO: 2400932 - RNA, 15 nt, Human
acuagguaacuucau

SEQ ID NO: 2400933 - RNA, 15 nt, Human
acuaguuacacaucu

SEQ ID NO: 2400934 - RNA, 18 nt, Human
acuaguuacacaucuuca

SEQ ID NO: 2400935 - RNA, 21 nt, Human
acuaguugugaccuuaguguu

SEQ ID NO: 2400936 - RNA, 20 nt, Human
acuaguugugaccuuagugu

SEQ ID NO: 2400937 - RNA, 17 nt, Human
acuaguugugaccuuag

SEQ ID NO: 2400938 - RNA, 22 nt, Human
acuaguuacacaucuucaacag

SEQ ID NO: 2400939 - RNA, 16 nt, Human
acuaggguccugggga

SEQ ID NO: 2400940 - RNA, 14 nt, Human
acuagguaacuuca

SEQ ID NO: 2400941 - RNA, 22 nt, Human
acuaggggauauaggagaggaa

SEQ ID NO: 2400942 - RNA, 17 nt, Human
agaaaggagucugcaca

SEQ ID NO: 2400943 - RNA, 14 nt, Human
agaaaggacucugg

SEQ ID NO: 2400944 - RNA, 11 nt, Human
agaaaggagac

SEQ ID NO: 2400945 - RNA, 15 nt, Human
agaaaggacucuggg

SEQ ID NO: 2400946 - RNA, 23 nt, Human
agaaaggaggggauagagagaga

SEQ ID NO: 2400947 - RNA, 20 nt, Human
agaaaggaggggauagagag

SEQ ID NO: 2400948 - RNA, 18 nt, Human
agaaauaaaaggaagcca

SEQ ID NO: 2400949 - RNA, 19 nt, Human
agaaauaaaaggaagccaa

SEQ ID NO: 2400950 - RNA, 20 nt, Human
agaaauaaaaggaagccaaa

SEQ ID NO: 2400951 - RNA, 15 nt, Human
agaaauaaaguuucu

SEQ ID NO: 2400952 - RNA, 18 nt, Human
agaaauaaaguuucuguu

SEQ ID NO: 2400953 - RNA, 18 nt, Human
agaaauaaaguuugcuua

SEQ ID NO: 2400954 - RNA, 21 nt, Human
agaaauaaaguuggugacaga

SEQ ID NO: 2400955 - RNA, 19 nt, Human
agaaauaaaguuggugaca

SEQ ID NO: 2400956 - RNA, 15 nt, Human
acuuuuauaaacuuu

SEQ ID NO: 2400957 - RNA, 19 nt, Human
acuuuuauaaacuuuaccu

SEQ ID NO: 2400958 - RNA, 14 nt, Human
acuuuuaaacugug

SEQ ID NO: 2400959 - RNA, 15 nt, Human
acuuuuaaacugugu

SEQ ID NO: 2400960 - RNA, 17 nt, Human
acuuuuaaacuguguac

SEQ ID NO: 2400961 - RNA, 22 nt, Human
acuuuuauaaacuuuaccuuuu

SEQ ID NO: 2400962 - RNA, 18 nt, Human
acuuuuccuuugaauccu

SEQ ID NO: 2400963 - RNA, 19 nt, Human
acuuuuccuuugaauccuc

SEQ ID NO: 2400964 - RNA, 15 nt, Human
acuuuucuccaugag

SEQ ID NO: 2400965 - RNA, 19 nt, Human
acuuuuauaauaaaaggaa

SEQ ID NO: 2400966 - RNA, 17 nt, Human
acuuuuccucccucagu

SEQ ID NO: 2400967 - RNA, 23 nt, Human
acuuuuauacucuuucuguauau

SEQ ID NO: 2400968 - RNA, 11 nt, Human
acuuuuauaau

SEQ ID NO: 2400969 - RNA, 12 nt, Human
agaaaauaaaaa

SEQ ID NO: 2400970 - RNA, 16 nt, Human
agaaaauaaaaaaaag

SEQ ID NO: 2400971 - RNA, 17 nt, Human
agaaaauaaaaaaaaga

SEQ ID NO: 2400972 - RNA, 18 nt, Human
agaaaauaaaaaaaagaa

SEQ ID NO: 2400973 - RNA, 19 nt, Human
agaaaauaaaaaaaagaaa

SEQ ID NO: 2400974 - RNA, 20 nt, Human
agaaaauaaaaaaaagaaaa

SEQ ID NO: 2400975 - RNA, 15 nt, Human
agaaaauaaaaaguu

SEQ ID NO: 2400976 - RNA, 16 nt, Human
agaaaauaaaaaguua

SEQ ID NO: 2400977 - RNA, 17 nt, Human
agaaaauaaaaaguuaa

SEQ ID NO: 2400978 - RNA, 18 nt, Human
agaaaauaaaaaguuaaa

SEQ ID NO: 2400979 - RNA, 13 nt, Human
agaaaauaaaaag

SEQ ID NO: 2400980 - RNA, 14 nt, Human
agaaaauaaaaagu

SEQ ID NO: 2400981 - RNA, 21 nt, Human
agaaaauaaaaaaaagaaaaa

SEQ ID NO: 2400982 - RNA, 22 nt, Human
agaaaauaaaaaaaagaaaaaa

SEQ ID NO: 2400983 - RNA, 15 nt, Human
agaaaaguaagcccu

SEQ ID NO: 2400984 - RNA, 16 nt, Human
acuuuucuuaaaccuu

SEQ ID NO: 2400985 - RNA, 24 nt, Human
acuuuucuuaaaccuucaguuaug

SEQ ID NO: 2400986 - RNA, 23 nt, Human
agaaaagggaaguugugccuuuu

SEQ ID NO: 2400987 - RNA, 20 nt, Human
agaaaagggaacugaacauu

SEQ ID NO: 2400988 - RNA, 20 nt, Human
agaaaauggacguguuauga

SEQ ID NO: 2400989 - RNA, 15 nt, Human
agaaaauggacgugu

SEQ ID NO: 2400990 - RNA, 23 nt, Human
agaaaauggaagacagcucuuau

SEQ ID NO: 2400991 - RNA, 23 nt, Human
agaaaauauacuguaaagaaaga

SEQ ID NO: 2400992 - RNA, 22 nt, Human
agaaaauaucugaaaugugaua

SEQ ID NO: 2400993 - RNA, 15 nt, Human
agaaaauauacugua

SEQ ID NO: 2400994 - RNA, 16 nt, Human
agaaaauauacuguaa

SEQ ID NO: 2400995 - RNA, 17 nt, Human
agaaaauauacuguaaa

SEQ ID NO: 2400996 - RNA, 18 nt, Human
agaaaauauacuguaaag

SEQ ID NO: 2400997 - RNA, 19 nt, Human
agaaaauauacuguaaaga

SEQ ID NO: 2400998 - RNA, 20 nt, Human
agaaaauauacuguaaagaa

SEQ ID NO: 2400999 - RNA, 21 nt, Human
agaaaauauacuguaaagaaa

SEQ ID NO: 2401000 - RNA, 22 nt, Human
agaaaauauacuguaaagaaag

SEQ ID NO: 2401001 - RNA, 11 nt, Human
agaaaauauac

SEQ ID NO: 2401002 - RNA, 13 nt, Human
agaaaauauacug

SEQ ID NO: 2401003 - RNA, 14 nt, Human
agaaaauauacugu

SEQ ID NO: 2401004 - RNA, 12 nt, Human
agaaaauauacu

SEQ ID NO: 2401005 - RNA, 14 nt, Human
agaaaauugcugug

SEQ ID NO: 2401006 - RNA, 18 nt, Human
agaaacaacaauuucuac

SEQ ID NO: 2401007 - RNA, 18 nt, Human
agaaaauugcugugccuc

SEQ ID NO: 2401008 - RNA, 16 nt, Human
agaaaauguugagaau

SEQ ID NO: 2401009 - RNA, 17 nt, Human
agaaaauguugagaauc

SEQ ID NO: 2401010 - RNA, 12 nt, Human
agaaaauucaau

SEQ ID NO: 2401011 - RNA, 13 nt, Human
agaaaauucaauu

SEQ ID NO: 2401012 - RNA, 15 nt, Human
agaaaauucaauugu

SEQ ID NO: 2401013 - RNA, 17 nt, Human
agaaaauucaauuguaa

SEQ ID NO: 2401014 - RNA, 18 nt, Human
agaaaauucaauuguaaa

SEQ ID NO: 2401015 - RNA, 23 nt, Human
agaaaauggacguguuaugacuc

SEQ ID NO: 2401016 - RNA, 22 nt, Human
agaaaauggacguguuaugacu

SEQ ID NO: 2401017 - RNA, 19 nt, Human
agaaaauguuauuuaacag

SEQ ID NO: 2401018 - RNA, 16 nt, Human
agaaaauguuauuuaa

SEQ ID NO: 2401019 - RNA, 18 nt, Human
agaaaauguuauuuaaca

SEQ ID NO: 2401020 - RNA, 13 nt, Human
agaaaauguuauu

SEQ ID NO: 2401021 - RNA, 23 nt, Human
agaaaauauuauguguuuccaua

SEQ ID NO: 2401022 - RNA, 15 nt, Human
agaaaauggacacug

SEQ ID NO: 2401023 - RNA, 17 nt, Human
acuuucuacaaugugaa

SEQ ID NO: 2401024 - RNA, 19 nt, Human
acuuucuacaaugugaacu

SEQ ID NO: 2401025 - RNA, 21 nt, Human
acuuucuacaaugugaacuuu

SEQ ID NO: 2401026 - RNA, 23 nt, Human
acuuuguucuggcucuuccaggc

SEQ ID NO: 2401027 - RNA, 19 nt, Human
acuuuguucuuuaggagau

SEQ ID NO: 2401028 - RNA, 12 nt, Human
acuuuuaaacag

SEQ ID NO: 2401029 - RNA, 15 nt, Human
acuuuuaaacaguga

SEQ ID NO: 2401030 - RNA, 13 nt, Human
acuuuuaaacugu

SEQ ID NO: 2401031 - RNA, 20 nt, Human
acuuuguucuuuaggagauu

SEQ ID NO: 2401032 - RNA, 20 nt, Human
acuuuguuucguggggaggu

SEQ ID NO: 2401033 - RNA, 15 nt, Human
acuuucuagauuaag

SEQ ID NO: 2401034 - RNA, 15 nt, Human
acuuuguucuuuagg

SEQ ID NO: 2401035 - RNA, 16 nt, Human
acuuucguacauuggc

SEQ ID NO: 2401036 - RNA, 15 nt, Human
acuuucguacauugg

SEQ ID NO: 2401037 - RNA, 19 nt, Human
acuuuccuuuccccagccc

SEQ ID NO: 2401038 - RNA, 22 nt, Human
acuuuccuuuccccagcccagg

SEQ ID NO: 2401039 - RNA, 18 nt, Human
acuuuccuuuccccagcc

SEQ ID NO: 2401040 - RNA, 17 nt, Human
acuuuccuuuccccagc

SEQ ID NO: 2401041 - RNA, 23 nt, Human
acuuuccuucauucaacccaccu

SEQ ID NO: 2401042 - RNA, 23 nt, Human
acuuucauuuuuuuccaggcugg

SEQ ID NO: 2401043 - RNA, 21 nt, Human
acuuucauuuuuuuccaggcu

SEQ ID NO: 2401044 - RNA, 16 nt, Human
acuuuccacccccucc

SEQ ID NO: 2401045 - RNA, 14 nt, Human
acuuuccugcaacu

SEQ ID NO: 2401046 - RNA, 18 nt, Human
acuuuccacccccucccu

SEQ ID NO: 2401047 - RNA, 19 nt, Human
acuuuccacccccucccug

SEQ ID NO: 2401048 - RNA, 20 nt, Human
acuuuccacccccucccugg

SEQ ID NO: 2401049 - RNA, 18 nt, Human
acuuuagucugcaaaaug

SEQ ID NO: 2401050 - RNA, 17 nt, Human
acuuuagucugcaaaau

SEQ ID NO: 2401051 - RNA, 16 nt, Human
acuuuagucugcaaaa

SEQ ID NO: 2401052 - RNA, 15 nt, Human
acuuuagucugcaaa

SEQ ID NO: 2401053 - RNA, 15 nt, Human
acuuuagggcuguaa

SEQ ID NO: 2401054 - RNA, 22 nt, Human
acuuuagggcuguaaaaugcau

SEQ ID NO: 2401055 - RNA, 23 nt, Human
acuuuagggcuguaaaaugcaug

SEQ ID NO: 2401056 - RNA, 23 nt, Human
acuuuagggaaguacuuuuggca

SEQ ID NO: 2401057 - RNA, 23 nt, Human
acuuucauccugacucugccccc

SEQ ID NO: 2401058 - RNA, 21 nt, Human
acuuucauccugacucugccc

SEQ ID NO: 2401059 - RNA, 19 nt, Human
acuuucauccugacucugc

SEQ ID NO: 2401060 - RNA, 20 nt, Human
acuuucauuuuuuuccaggc

SEQ ID NO: 2401061 - RNA, 17 nt, Human
acuuucauuuuuuucca

SEQ ID NO: 2401062 - RNA, 19 nt, Human
acuuucauuaaagcauuua

SEQ ID NO: 2401063 - RNA, 18 nt, Human
acuuucagugaaagcauc

SEQ ID NO: 2401064 - RNA, 15 nt, Human
acugaagucugaaau

SEQ ID NO: 2401065 - RNA, 20 nt, Human
acugaaggccuggcccacag

SEQ ID NO: 2401066 - RNA, 17 nt, Human
acugaaggccuggccca

SEQ ID NO: 2401067 - RNA, 13 nt, Human
acugaaggagaag

SEQ ID NO: 2401068 - RNA, 14 nt, Human
acugaaggagaagg

SEQ ID NO: 2401069 - RNA, 21 nt, Human
acugaaggagaaggugcccca

SEQ ID NO: 2401070 - RNA, 18 nt, Human
acugaaggaaaaacacaa

SEQ ID NO: 2401071 - RNA, 22 nt, Human
acugaaggaaaaacacaagcaa

SEQ ID NO: 2401072 - RNA, 20 nt, Human
acugaaggaaaaacacaagc

SEQ ID NO: 2401073 - RNA, 23 nt, Human
acugaaggaaaaacacaagcaaa

SEQ ID NO: 2401074 - RNA, 11 nt, Human
acugaaggaga

SEQ ID NO: 2401075 - RNA, 16 nt, Human
acugaagucugaaauu

SEQ ID NO: 2401076 - RNA, 14 nt, Human
acugaagucugaaa

SEQ ID NO: 2401077 - RNA, 13 nt, Human
acugaagucugaa

SEQ ID NO: 2401078 - RNA, 17 nt, Human
acugaagugcuuagugu

SEQ ID NO: 2401079 - RNA, 13 nt, Human
acugaagugcuua

SEQ ID NO: 2401080 - RNA, 19 nt, Human
acugaaguagugugcaguu

SEQ ID NO: 2401081 - RNA, 19 nt, Human
acugaagccugcaggaguu

SEQ ID NO: 2401082 - RNA, 17 nt, Human
acugaagguaaaauuga

SEQ ID NO: 2401083 - RNA, 14 nt, Human
acugccaaccuggg

SEQ ID NO: 2401084 - RNA, 22 nt, Human
acugccacacgucugacccucu

SEQ ID NO: 2401085 - RNA, 21 nt, Human
acugccaaagggaaauaucau

SEQ ID NO: 2401086 - RNA, 17 nt, Human
acugccaaaaugcucua

SEQ ID NO: 2401087 - RNA, 18 nt, Human
acugccaaaaugcucuag

SEQ ID NO: 2401088 - RNA, 19 nt, Human
acugcccccucugcccugc

SEQ ID NO: 2401089 - RNA, 18 nt, Human
acugcccccucugcccug

SEQ ID NO: 2401090 - RNA, 14 nt, Human
acugccagaugcug

SEQ ID NO: 2401091 - RNA, 20 nt, Human
acugcccccucugcccugcg

SEQ ID NO: 2401092 - RNA, 17 nt, Human
acugccccgugcagacu

SEQ ID NO: 2401093 - RNA, 18 nt, Human
acugccccgugcagacug

SEQ ID NO: 2401094 - RNA, 19 nt, Human
acugccccgugcagacugg

SEQ ID NO: 2401095 - RNA, 23 nt, Human
acugccccgugcagacuggaggg

SEQ ID NO: 2401096 - RNA, 14 nt, Human
acugcccgagcugg

SEQ ID NO: 2401097 - RNA, 15 nt, Human
acugcccgagcuggu

SEQ ID NO: 2401098 - RNA, 16 nt, Human
acugcccgagcuggug

SEQ ID NO: 2401099 - RNA, 18 nt, Human
acugcccgagcuggugca

SEQ ID NO: 2401100 - RNA, 14 nt, Human
acuggaagcacagc

SEQ ID NO: 2401101 - RNA, 21 nt, Human
acugcccgagcuggugcauua

SEQ ID NO: 2401102 - RNA, 15 nt, Human
acuggaagcacagcu

SEQ ID NO: 2401103 - RNA, 16 nt, Human
acuggaagcacagcuu

SEQ ID NO: 2401104 - RNA, 19 nt, Human
acugcccgagcuggugcau

SEQ ID NO: 2401105 - RNA, 20 nt, Human
acugcccgagcuggugcauu

SEQ ID NO: 2401106 - RNA, 14 nt, Human
acuggguuccugca

SEQ ID NO: 2401107 - RNA, 13 nt, Human
acuggguugacuu

SEQ ID NO: 2401108 - RNA, 14 nt, Human
acuggguuucuagc

SEQ ID NO: 2401109 - RNA, 16 nt, Human
acuggguucccaugcu

SEQ ID NO: 2401110 - RNA, 20 nt, Human
acuggguugacuuucaggua

SEQ ID NO: 2401111 - RNA, 22 nt, Human
acuggguuuggaccccagcugg

SEQ ID NO: 2401112 - RNA, 21 nt, Human
acuggguuuggaccccagcug

SEQ ID NO: 2401113 - RNA, 20 nt, Human
acuggguuuggaccccagcu

SEQ ID NO: 2401114 - RNA, 19 nt, Human
acuggguuuggaccccagc

SEQ ID NO: 2401115 - RNA, 16 nt, Human
acuggguuuggacccc

SEQ ID NO: 2401116 - RNA, 15 nt, Human
acuggguuucuagcc

SEQ ID NO: 2401117 - RNA, 20 nt, Human
acuggguuucucuguauagu

SEQ ID NO: 2401118 - RNA, 20 nt, Human
acuggguggggugaggacca

SEQ ID NO: 2401119 - RNA, 22 nt, Human
acuggguggggugaggaccacu

SEQ ID NO: 2401120 - RNA, 21 nt, Human
acugggugcccaagcucagaa

SEQ ID NO: 2401121 - RNA, 18 nt, Human
acuggguggggugaggac

SEQ ID NO: 2401122 - RNA, 22 nt, Human
acuggacuugagcuuggcagcu

SEQ ID NO: 2401123 - RNA, 18 nt, Human
acuggacuccggcccucc

SEQ ID NO: 2401124 - RNA, 16 nt, Human
acuggacccuguugcu

SEQ ID NO: 2401125 - RNA, 15 nt, Human
acuggacccuguugc

SEQ ID NO: 2401126 - RNA, 18 nt, Human
acuggacccuguugcuaa

SEQ ID NO: 2401127 - RNA, 17 nt, Human
acuggacccuguugcua

SEQ ID NO: 2401128 - RNA, 20 nt, Human
acuggacccuguugcuaagc

SEQ ID NO: 2401129 - RNA, 19 nt, Human
acuggacccuguugcuaag

SEQ ID NO: 2401130 - RNA, 14 nt, Human
acuggacucaggau

SEQ ID NO: 2401131 - RNA, 20 nt, Human
acuggacucaggaugcccag

SEQ ID NO: 2401132 - RNA, 21 nt, Human
acuggacucaggaugcccagg

SEQ ID NO: 2401133 - RNA, 23 nt, Human
acuggacucaggaugcccagggc

SEQ ID NO: 2401134 - RNA, 14 nt, Human
acuggagaaaaugg

SEQ ID NO: 2401135 - RNA, 19 nt, Human
acuggacuccggcccuccu

SEQ ID NO: 2401136 - RNA, 16 nt, Human
acuggacuccggcccu

SEQ ID NO: 2401137 - RNA, 14 nt, Human
acuggacuccggcc

SEQ ID NO: 2401138 - RNA, 20 nt, Human
acuguccugggcgcccugga

SEQ ID NO: 2401139 - RNA, 19 nt, Human
acuguccugggcgcccugg

SEQ ID NO: 2401140 - RNA, 22 nt, Human
acuguccugggcgcccuggaag

SEQ ID NO: 2401141 - RNA, 23 nt, Human
acuguccugggcgcccuggaagc

SEQ ID NO: 2401142 - RNA, 18 nt, Human
acuguccugggcgcccug

SEQ ID NO: 2401143 - RNA, 13 nt, Human
acuguccugggcg

SEQ ID NO: 2401144 - RNA, 19 nt, Human
acuguccugggccugcaga

SEQ ID NO: 2401145 - RNA, 18 nt, Human
acugucuauuucugcuga

SEQ ID NO: 2401146 - RNA, 17 nt, Human
acugucuauuucugcug

SEQ ID NO: 2401147 - RNA, 16 nt, Human
acugucuauuucugcu

SEQ ID NO: 2401148 - RNA, 13 nt, Human
acugucuauuucu

SEQ ID NO: 2401149 - RNA, 15 nt, Human
acugucucuccugau

SEQ ID NO: 2401150 - RNA, 23 nt, Human
acuggguuuggaccccagcuggg

SEQ ID NO: 2401151 - RNA, 20 nt, Human
acugguggcccgacagccug

SEQ ID NO: 2401152 - RNA, 22 nt, Human
acugguggcccgacagccuggc

SEQ ID NO: 2401153 - RNA, 21 nt, Human
acugguggcccgacagccugg

SEQ ID NO: 2401154 - RNA, 21 nt, Human
acugguguuaucaccgugggc

SEQ ID NO: 2401155 - RNA, 22 nt, Human
acugguguuaucaccgugggcu

SEQ ID NO: 2401156 - RNA, 17 nt, Human
acuguccugggccugca

SEQ ID NO: 2401157 - RNA, 21 nt, Human
acuggugugaccugagggcag

SEQ ID NO: 2401158 - RNA, 16 nt, Human
acuguccugggccugc

SEQ ID NO: 2401159 - RNA, 23 nt, Human
acugguggcccgacagccuggca

SEQ ID NO: 2401160 - RNA, 14 nt, Human
acuggugugaccug

SEQ ID NO: 2401161 - RNA, 17 nt, Human
acuggugugaccugagg

SEQ ID NO: 2401162 - RNA, 20 nt, Human
acuggugggaucugugccca

SEQ ID NO: 2401163 - RNA, 21 nt, Human
acugugcagagucuagaaguu

SEQ ID NO: 2401164 - RNA, 12 nt, Human
acugugcagagu

SEQ ID NO: 2401165 - RNA, 18 nt, Human
acugugcaccaagcagga

SEQ ID NO: 2401166 - RNA, 15 nt, Human
acugugcacaucugu

SEQ ID NO: 2401167 - RNA, 19 nt, Human
acugugcacaucugugucu

SEQ ID NO: 2401168 - RNA, 20 nt, Human
acugugcacaucugugucuu

SEQ ID NO: 2401169 - RNA, 21 nt, Human
acugugcacaucugugucuug

SEQ ID NO: 2401170 - RNA, 20 nt, Human
acugugaugccacacagagu

SEQ ID NO: 2401171 - RNA, 22 nt, Human
acugugaugccacacagagugg

SEQ ID NO: 2401172 - RNA, 13 nt, Human
acugugaugccac

SEQ ID NO: 2401173 - RNA, 12 nt, Human
acugucuucagu

SEQ ID NO: 2401174 - RNA, 16 nt, Human
acugucuucuucaggg

SEQ ID NO: 2401175 - RNA, 12 nt, Human
acugucuuuccu

SEQ ID NO: 2401176 - RNA, 12 nt, Human
acugucuuucag

SEQ ID NO: 2401177 - RNA, 23 nt, Human
acugugaucaggcuauguaugga

SEQ ID NO: 2401178 - RNA, 20 nt, Human
acugucugagaguuuaguug

SEQ ID NO: 2401179 - RNA, 15 nt, Human
acugucugagaguuu

SEQ ID NO: 2401180 - RNA, 23 nt, Human
acugucuauuucugcugaauuuu

SEQ ID NO: 2401181 - RNA, 19 nt, Human
acugucuauuucugcugaa

SEQ ID NO: 2401182 - RNA, 13 nt, Human
acugucugguuuu

SEQ ID NO: 2401183 - RNA, 19 nt, Human
acugucugguuuuaacaau

SEQ ID NO: 2401184 - RNA, 18 nt, Human
acugucugguuuuaacaa

SEQ ID NO: 2401185 - RNA, 17 nt, Human
acugucugguuuuaaca

SEQ ID NO: 2401186 - RNA, 15 nt, Human
acuuguaaauacacc

SEQ ID NO: 2401187 - RNA, 14 nt, Human
acuuguaaauacac

SEQ ID NO: 2401188 - RNA, 16 nt, Human
acuuguaaauacacca

SEQ ID NO: 2401189 - RNA, 13 nt, Human
acuuguaaauaca

SEQ ID NO: 2401190 - RNA, 21 nt, Human
acuucuuuucacauucuuaua

SEQ ID NO: 2401191 - RNA, 19 nt, Human
acuucuuuugcucuuagcu

SEQ ID NO: 2401192 - RNA, 18 nt, Human
acuuguaaaugugguaaa

SEQ ID NO: 2401193 - RNA, 14 nt, Human
acuuguaaaugcug

SEQ ID NO: 2401194 - RNA, 14 nt, Human
acuuguaaguugcu

SEQ ID NO: 2401195 - RNA, 20 nt, Human
acuuguaaaugugguaaaga

SEQ ID NO: 2401196 - RNA, 19 nt, Human
acuuguaaaggaauuuaaa

SEQ ID NO: 2401197 - RNA, 20 nt, Human
acuuguaaaggaauuuaaaa

SEQ ID NO: 2401198 - RNA, 19 nt, Human
acuucuuuucacauucuua

SEQ ID NO: 2401199 - RNA, 18 nt, Human
acuucuuuucacauucuu

SEQ ID NO: 2401200 - RNA, 17 nt, Human
acuucuuuucacauucu

SEQ ID NO: 2401201 - RNA, 15 nt, Human
acuucuuuucacauu

SEQ ID NO: 2401202 - RNA, 14 nt, Human
acuuggucugugag

SEQ ID NO: 2401203 - RNA, 15 nt, Human
acuuggucugugaga

SEQ ID NO: 2401204 - RNA, 18 nt, Human
acuuguaaaggaauuuaa

SEQ ID NO: 2401205 - RNA, 22 nt, Human
acuucugccagcauaauacuug

SEQ ID NO: 2401206 - RNA, 18 nt, Human
acuucugccauauucugu

SEQ ID NO: 2401207 - RNA, 22 nt, Human
acuucacagagugugcuggagg

SEQ ID NO: 2401208 - RNA, 20 nt, Human
acuucacagagugugcugga

SEQ ID NO: 2401209 - RNA, 19 nt, Human
acuucacagagugugcugg

SEQ ID NO: 2401210 - RNA, 18 nt, Human
acuucacagagugugcug

SEQ ID NO: 2401211 - RNA, 15 nt, Human
acuucugaccacacu

SEQ ID NO: 2401212 - RNA, 16 nt, Human
acuucugaccacacuu

SEQ ID NO: 2401213 - RNA, 20 nt, Human
acuucuuugcuuugcccagc

SEQ ID NO: 2401214 - RNA, 18 nt, Human
acuucuuugcuuugccca

SEQ ID NO: 2401215 - RNA, 16 nt, Human
acuucuuugcuuugcc

SEQ ID NO: 2401216 - RNA, 14 nt, Human
acuucuuuucacau

SEQ ID NO: 2401217 - RNA, 12 nt, Human
acuucuuuucac

SEQ ID NO: 2401218 - RNA, 11 nt, Human
acuucuuuuca

SEQ ID NO: 2401219 - RNA, 21 nt, Human
acuucuuugcuuugcccagca

SEQ ID NO: 2401220 - RNA, 15 nt, Human
acuucuuuuauaacu

SEQ ID NO: 2401221 - RNA, 22 nt, Human
acuucuuuuauaacuaguccuu

SEQ ID NO: 2401222 - RNA, 19 nt, Human
acuucugccauauucuguu

SEQ ID NO: 2401223 - RNA, 15 nt, Human
acuuauuuaaacucu

SEQ ID NO: 2401224 - RNA, 13 nt, Human
acuuauuuaaugc

SEQ ID NO: 2401225 - RNA, 17 nt, Human
acuucacacacaggcaa

SEQ ID NO: 2401226 - RNA, 19 nt, Human
acuucacacacaggcaacu

SEQ ID NO: 2401227 - RNA, 16 nt, Human
acuucacacacaggca

SEQ ID NO: 2401228 - RNA, 19 nt, Human
acuucacauauugauuucc

SEQ ID NO: 2401229 - RNA, 13 nt, Human
acuucacacugca

SEQ ID NO: 2401230 - RNA, 14 nt, Human
acuucacacugcaa

SEQ ID NO: 2401231 - RNA, 15 nt, Human
acuucacacugcaag

SEQ ID NO: 2401232 - RNA, 16 nt, Human
acuucacacugcaaga

SEQ ID NO: 2401233 - RNA, 16 nt, Human
acuucacagagugugc

SEQ ID NO: 2401234 - RNA, 12 nt, Human
acuucacagagu

SEQ ID NO: 2401235 - RNA, 19 nt, Human
acuucacacugcaagagcc

SEQ ID NO: 2401236 - RNA, 23 nt, Human
acuucacacugcaagagccuugg

SEQ ID NO: 2401237 - RNA, 23 nt, Human
acuguuuucucucggcuccccau

SEQ ID NO: 2401238 - RNA, 22 nt, Human
acuguuuucucucggcucccca

SEQ ID NO: 2401239 - RNA, 12 nt, Human
acuguuuuuacc

SEQ ID NO: 2401240 - RNA, 21 nt, Human
acuuauuggaacucugcuuga

SEQ ID NO: 2401241 - RNA, 20 nt, Human
acuuauuggaacucugcuug

SEQ ID NO: 2401242 - RNA, 20 nt, Human
acuguuuacaagaaaaaaug

SEQ ID NO: 2401243 - RNA, 15 nt, Human
acuguuguauaaauu

SEQ ID NO: 2401244 - RNA, 19 nt, Human
acuguuguauaaauuuauu

SEQ ID NO: 2401245 - RNA, 19 nt, Human
acuguugugaccugaaguu

SEQ ID NO: 2401246 - RNA, 13 nt, Human
acuguuguauaaa

SEQ ID NO: 2401247 - RNA, 16 nt, Human
acuguugugaccugaa

SEQ ID NO: 2401248 - RNA, 13 nt, Human
acuguuucaaacu

SEQ ID NO: 2401249 - RNA, 15 nt, Human
acuguuugucuucuc

SEQ ID NO: 2401250 - RNA, 21 nt, Human
acuguuugucuucuccccagg

SEQ ID NO: 2401251 - RNA, 20 nt, Human
acuguuugucuucuccccag

SEQ ID NO: 2401252 - RNA, 19 nt, Human
acuguuugucuucucccca

SEQ ID NO: 2401253 - RNA, 18 nt, Human
acuguuugucuucucccc

SEQ ID NO: 2401254 - RNA, 12 nt, Human
acuguuuguuau

SEQ ID NO: 2401255 - RNA, 23 nt, Human
acauguuuuuguuuucuuugaau

SEQ ID NO: 2401256 - RNA, 18 nt, Human
acauguuuagaguugcaa

SEQ ID NO: 2401257 - RNA, 21 nt, Human
acauguuuacuuuucagggca

SEQ ID NO: 2401258 - RNA, 15 nt, Human
acauuaaaacaauau

SEQ ID NO: 2401259 - RNA, 22 nt, Human
acauuaaaacaauauuguuucu

SEQ ID NO: 2401260 - RNA, 20 nt, Human
acauguuuagaguugcaauc

SEQ ID NO: 2401261 - RNA, 17 nt, Human
acauuaaaucuaugaag

SEQ ID NO: 2401262 - RNA, 23 nt, Human
acaugcacagcuaacauggaagu

SEQ ID NO: 2401263 - RNA, 21 nt, Human
acaugcaauuuauuaaaauga

SEQ ID NO: 2401264 - RNA, 18 nt, Human
acaugcacaccucccccu

SEQ ID NO: 2401265 - RNA, 20 nt, Human
acaugcacagcuaacaugga

SEQ ID NO: 2401266 - RNA, 20 nt, Human
acaucgugaaacccugucuc

SEQ ID NO: 2401267 - RNA, 13 nt, Human
acaucuaagccug

SEQ ID NO: 2401268 - RNA, 19 nt, Human
acaugcaaggucauuuuuu

SEQ ID NO: 2401269 - RNA, 21 nt, Human
acauguuuuucuucucccuca

SEQ ID NO: 2401270 - RNA, 20 nt, Human
acauguugggaaacuuggcu

SEQ ID NO: 2401271 - RNA, 15 nt, Human
acauguuauauauuu

SEQ ID NO: 2401272 - RNA, 13 nt, Human
acauguuacaaca

SEQ ID NO: 2401273 - RNA, 19 nt, Human
acauguuacugaccagcaa

SEQ ID NO: 2401274 - RNA, 14 nt, Human
acauguuauauauu

SEQ ID NO: 2401275 - RNA, 17 nt, Human
acauguuacugaccagc

SEQ ID NO: 2401276 - RNA, 16 nt, Human
acauguuacugaccag

SEQ ID NO: 2401277 - RNA, 17 nt, Human
acauguuaaacuuacuu

SEQ ID NO: 2401278 - RNA, 19 nt, Human
acaucagcacgauuucugu

SEQ ID NO: 2401279 - RNA, 15 nt, Human
acauaaauaaaauga

SEQ ID NO: 2401280 - RNA, 21 nt, Human
acauaaaggugguaugugugu

SEQ ID NO: 2401281 - RNA, 20 nt, Human
acaucagcacgauuucuguu

SEQ ID NO: 2401282 - RNA, 21 nt, Human
acaucagcacgauuucuguuu

SEQ ID NO: 2401283 - RNA, 22 nt, Human
acaucagcacgauuucuguuua

SEQ ID NO: 2401284 - RNA, 19 nt, Human
acauaaauaaaaugaccag

SEQ ID NO: 2401285 - RNA, 13 nt, Human
acauaaauuagag

SEQ ID NO: 2401286 - RNA, 16 nt, Human
acauccaagcuuccuu

SEQ ID NO: 2401287 - RNA, 20 nt, Human
acauccauguuuguaaaacu

SEQ ID NO: 2401288 - RNA, 19 nt, Human
acauccauaaagaagcaau

SEQ ID NO: 2401289 - RNA, 17 nt, Human
acauccauaaagaagca

SEQ ID NO: 2401290 - RNA, 15 nt, Human
acauccauaaagaag

SEQ ID NO: 2401291 - RNA, 18 nt, Human
acauccauguuuguaaaa

SEQ ID NO: 2401292 - RNA, 20 nt, Human
acauccauuucaucuauuuc

SEQ ID NO: 2401293 - RNA, 13 nt, Human
acauccauaaaga

SEQ ID NO: 2401294 - RNA, 20 nt, Human
acauccaauauuuucuuuaa

SEQ ID NO: 2401295 - RNA, 23 nt, Human
acauccaaggagaaacagagaca

SEQ ID NO: 2401296 - RNA, 13 nt, Human
acauccaaggaga

SEQ ID NO: 2401297 - RNA, 13 nt, Human
acauccaagcuuc

SEQ ID NO: 2401298 - RNA, 14 nt, Human
acauccaaggagaa

SEQ ID NO: 2401299 - RNA, 22 nt, Human
acauccaaggagaaacagagac

SEQ ID NO: 2401300 - RNA, 21 nt, Human
acauccuuucuauugaaaaau

SEQ ID NO: 2401301 - RNA, 18 nt, Human
acauccuuucuaaacaag

SEQ ID NO: 2401302 - RNA, 17 nt, Human
acauccuuucuaaacaa

SEQ ID NO: 2401303 - RNA, 14 nt, Human
acaucgaaugugua

SEQ ID NO: 2401304 - RNA, 19 nt, Human
acauccuuucuaaacaaga

SEQ ID NO: 2401305 - RNA, 14 nt, Human
acaucgcccuccac

SEQ ID NO: 2401306 - RNA, 16 nt, Human
acaucuaaccucaucu

SEQ ID NO: 2401307 - RNA, 17 nt, Human
acaucuaaccucaucuu

SEQ ID NO: 2401308 - RNA, 17 nt, Human
acaucgugaaacccugu

SEQ ID NO: 2401309 - RNA, 13 nt, Human
acauccuuccuuc

SEQ ID NO: 2401310 - RNA, 23 nt, Human
acauccuguguuucuagggaaau

SEQ ID NO: 2401311 - RNA, 15 nt, Human
acauccuuccuuccc

SEQ ID NO: 2401312 - RNA, 14 nt, Human
acauccuuccuucc

SEQ ID NO: 2401313 - RNA, 13 nt, Human
acauccuuucuaa

SEQ ID NO: 2401314 - RNA, 14 nt, Human
acauccuguguuuc

SEQ ID NO: 2401315 - RNA, 16 nt, Human
acauccuguguuucua

SEQ ID NO: 2401316 - RNA, 23 nt, Human
acagguuauuuuaguuucuguuc

SEQ ID NO: 2401317 - RNA, 22 nt, Human
acagguuauuuuaguuucuguu

SEQ ID NO: 2401318 - RNA, 21 nt, Human
acagguuauuuuaguuucugu

SEQ ID NO: 2401319 - RNA, 14 nt, Human
acagguuauuuuag

SEQ ID NO: 2401320 - RNA, 23 nt, Human
acagguuacaacagauuugugaa

SEQ ID NO: 2401321 - RNA, 22 nt, Human
acagguuacaacagauuuguga

SEQ ID NO: 2401322 - RNA, 21 nt, Human
acagguuacaacagauuugug

SEQ ID NO: 2401323 - RNA, 20 nt, Human
acagguuacaacagauuugu

SEQ ID NO: 2401324 - RNA, 19 nt, Human
acagguuacaacagauuug

SEQ ID NO: 2401325 - RNA, 15 nt, Human
acagguuugggaccc

SEQ ID NO: 2401326 - RNA, 18 nt, Human
acagguuugggaccccug

SEQ ID NO: 2401327 - RNA, 14 nt, Human
acagguuuuauaau

SEQ ID NO: 2401328 - RNA, 23 nt, Human
acauaaacaagaccacguuucua

SEQ ID NO: 2401329 - RNA, 13 nt, Human
acauaaacugacu

SEQ ID NO: 2401330 - RNA, 15 nt, Human
acauaaacugacuuu

SEQ ID NO: 2401331 - RNA, 22 nt, Human
accagcaucccuugaccaggcc

SEQ ID NO: 2401332 - RNA, 23 nt, Human
accaagcugugccacccugggcu

SEQ ID NO: 2401333 - RNA, 20 nt, Human
accaagcugugccacccugg

SEQ ID NO: 2401334 - RNA, 19 nt, Human
accaagcugugccacccug

SEQ ID NO: 2401335 - RNA, 18 nt, Human
accaagcugugccacccu

SEQ ID NO: 2401336 - RNA, 14 nt, Human
accaagcugugcca

SEQ ID NO: 2401337 - RNA, 13 nt, Human
accaagcugugcc

SEQ ID NO: 2401338 - RNA, 14 nt, Human
accacgcccggcua

SEQ ID NO: 2401339 - RNA, 13 nt, Human
accaaggaccccu

SEQ ID NO: 2401340 - RNA, 19 nt, Human
accacgauguggcccuggc

SEQ ID NO: 2401341 - RNA, 20 nt, Human
accacgauguggcccuggcc

SEQ ID NO: 2401342 - RNA, 21 nt, Human
accacgauguggcccuggccu

SEQ ID NO: 2401343 - RNA, 19 nt, Human
accacgcccguccugccug

SEQ ID NO: 2401344 - RNA, 18 nt, Human
accacgcccguccugccu

SEQ ID NO: 2401345 - RNA, 20 nt, Human
accacgcccggcuaauuuuu

SEQ ID NO: 2401346 - RNA, 21 nt, Human
accacgcccguccugccugug

SEQ ID NO: 2401347 - RNA, 20 nt, Human
accacgcccguccugccugu

SEQ ID NO: 2401348 - RNA, 23 nt, Human
accacgcccguccugccuguggc

SEQ ID NO: 2401349 - RNA, 22 nt, Human
accacgauguggcccuggccug

SEQ ID NO: 2401350 - RNA, 19 nt, Human
accaagccuggucagccca

SEQ ID NO: 2401351 - RNA, 20 nt, Human
accaagccuggucagcccaa

SEQ ID NO: 2401352 - RNA, 12 nt, Human
accaacuuucug

SEQ ID NO: 2401353 - RNA, 14 nt, Human
accaacuuucugua

SEQ ID NO: 2401354 - RNA, 15 nt, Human
accaagcuauccugg

SEQ ID NO: 2401355 - RNA, 17 nt, Human
accaagcuauccuggcu

SEQ ID NO: 2401356 - RNA, 13 nt, Human
accaacuuucugu

SEQ ID NO: 2401357 - RNA, 17 nt, Human
accaagcucacaguucc

SEQ ID NO: 2401358 - RNA, 12 nt, Human
accaagcugugc

SEQ ID NO: 2401359 - RNA, 14 nt, Human
accaagcucucugc

SEQ ID NO: 2401360 - RNA, 18 nt, Human
accaagcucacaguuccu

SEQ ID NO: 2401361 - RNA, 19 nt, Human
accaagcucacaguuccuc

SEQ ID NO: 2401362 - RNA, 15 nt, Human
accacguuucuaaag

SEQ ID NO: 2401363 - RNA, 19 nt, Human
accacguuucuaaaggcua

SEQ ID NO: 2401364 - RNA, 14 nt, Human
accacuacauucug

SEQ ID NO: 2401365 - RNA, 23 nt, Human
accacuaaaagaucgcaguuugc

SEQ ID NO: 2401366 - RNA, 13 nt, Human
accagcagccugg

SEQ ID NO: 2401367 - RNA, 14 nt, Human
accagcagccugga

SEQ ID NO: 2401368 - RNA, 17 nt, Human
accagcagccuggaccc

SEQ ID NO: 2401369 - RNA, 18 nt, Human
accagcagcgccuuuccc

SEQ ID NO: 2401370 - RNA, 17 nt, Human
accagcagcgccuuucc

SEQ ID NO: 2401371 - RNA, 17 nt, Human
accacuacaugcagccc

SEQ ID NO: 2401372 - RNA, 18 nt, Human
acauuugcucauggaauu

SEQ ID NO: 2401373 - RNA, 12 nt, Human
acauuuggaaua

SEQ ID NO: 2401374 - RNA, 14 nt, Human
acauuuguauaaaa

SEQ ID NO: 2401375 - RNA, 19 nt, Human
accaacuagacauucuguc

SEQ ID NO: 2401376 - RNA, 17 nt, Human
accaacuagacauucug

SEQ ID NO: 2401377 - RNA, 15 nt, Human
accaacuagacauuc

SEQ ID NO: 2401378 - RNA, 16 nt, Human
accaacuacaaccaag

SEQ ID NO: 2401379 - RNA, 23 nt, Human
accaacugucacucauugcugag

SEQ ID NO: 2401380 - RNA, 14 nt, Human
accaacucuugcag

SEQ ID NO: 2401381 - RNA, 20 nt, Human
accaacuagacauucugucg

SEQ ID NO: 2401382 - RNA, 14 nt, Human
accaacugggccca

SEQ ID NO: 2401383 - RNA, 15 nt, Human
acauuuggaguguuc

SEQ ID NO: 2401384 - RNA, 17 nt, Human
acauuugggagacaugu

SEQ ID NO: 2401385 - RNA, 20 nt, Human
acauuuggaguguuccccuu

SEQ ID NO: 2401386 - RNA, 15 nt, Human
acauuuggaauacuu

SEQ ID NO: 2401387 - RNA, 16 nt, Human
acauuuggaauacuuu

SEQ ID NO: 2401388 - RNA, 17 nt, Human
acauuuggaauacuuuu

SEQ ID NO: 2401389 - RNA, 18 nt, Human
acauuuggaauacuuuuu

SEQ ID NO: 2401390 - RNA, 21 nt, Human
acauuugggagacaugugaca

SEQ ID NO: 2401391 - RNA, 20 nt, Human
acauuugggagacaugugac

SEQ ID NO: 2401392 - RNA, 19 nt, Human
acauuugggagacauguga

SEQ ID NO: 2401393 - RNA, 21 nt, Human
acauuuguagcauccucuuua

SEQ ID NO: 2401394 - RNA, 16 nt, Human
accccuacaugaaaca

SEQ ID NO: 2401395 - RNA, 20 nt, Human
accccucaacaccucugcac

SEQ ID NO: 2401396 - RNA, 17 nt, Human
acccaaggacugaggga

SEQ ID NO: 2401397 - RNA, 22 nt, Human
acccaagcuuggcagccgagcu

SEQ ID NO: 2401398 - RNA, 18 nt, Human
acccaagcuuggcagccg

SEQ ID NO: 2401399 - RNA, 14 nt, Human
acccaagcuuggca

SEQ ID NO: 2401400 - RNA, 13 nt, Human
acccaagcuuggc

SEQ ID NO: 2401401 - RNA, 15 nt, Human
acccaagcuuagaac

SEQ ID NO: 2401402 - RNA, 15 nt, Human
accaucccuuuuuga

SEQ ID NO: 2401403 - RNA, 18 nt, Human
accaucccuuuuugaagu

SEQ ID NO: 2401404 - RNA, 22 nt, Human
accaucccugaaggccccgccc

SEQ ID NO: 2401405 - RNA, 21 nt, Human
accaucccugaaggccccgcc

SEQ ID NO: 2401406 - RNA, 16 nt, Human
accaucccugaaggcc

SEQ ID NO: 2401407 - RNA, 18 nt, Human
accaucccugaaggcccc

SEQ ID NO: 2401408 - RNA, 17 nt, Human
accaucaugucuggcua

SEQ ID NO: 2401409 - RNA, 16 nt, Human
accaucaugucuggcu

SEQ ID NO: 2401410 - RNA, 12 nt, Human
accaucauccua

SEQ ID NO: 2401411 - RNA, 14 nt, Human
accaucaugucugg

SEQ ID NO: 2401412 - RNA, 16 nt, Human
acccaagggccuggcc

SEQ ID NO: 2401413 - RNA, 13 nt, Human
acccaagggccug

SEQ ID NO: 2401414 - RNA, 16 nt, Human
acccaaguccaagcau

SEQ ID NO: 2401415 - RNA, 13 nt, Human
acccaaggacuga

SEQ ID NO: 2401416 - RNA, 16 nt, Human
acccaagugggggcag

SEQ ID NO: 2401417 - RNA, 15 nt, Human
acccaaggaggaaaa

SEQ ID NO: 2401418 - RNA, 18 nt, Human
acccaucuguuuuuugua

SEQ ID NO: 2401419 - RNA, 17 nt, Human
acccaucuguuuuuugu

SEQ ID NO: 2401420 - RNA, 13 nt, Human
acccaucugggcu

SEQ ID NO: 2401421 - RNA, 21 nt, Human
acccaucugcaccccccuggg

SEQ ID NO: 2401422 - RNA, 22 nt, Human
acccaucugcaccccccugggc

SEQ ID NO: 2401423 - RNA, 21 nt, Human
acccauccuaccaaugcaugc

SEQ ID NO: 2401424 - RNA, 20 nt, Human
acccauccuaccaaugcaug

SEQ ID NO: 2401425 - RNA, 17 nt, Human
acccaucgcuguguguu

SEQ ID NO: 2401426 - RNA, 15 nt, Human
acccaucgcugugug

SEQ ID NO: 2401427 - RNA, 13 nt, Human
acccaucugcacc

SEQ ID NO: 2401428 - RNA, 20 nt, Human
acccaucugcaccccccugg

SEQ ID NO: 2401429 - RNA, 15 nt, Human
acccacaagaaauga

SEQ ID NO: 2401430 - RNA, 13 nt, Human
acccaauccaaau

SEQ ID NO: 2401431 - RNA, 14 nt, Human
acccaauccaaaug

SEQ ID NO: 2401432 - RNA, 20 nt, Human
acccaaugcacacaaaacaa

SEQ ID NO: 2401433 - RNA, 13 nt, Human
acccaaugauuca

SEQ ID NO: 2401434 - RNA, 20 nt, Human
acccacaaaaguacaauuua

SEQ ID NO: 2401435 - RNA, 18 nt, Human
acccaugcugcccuguga

SEQ ID NO: 2401436 - RNA, 17 nt, Human
acccaugcugcccugug

SEQ ID NO: 2401437 - RNA, 23 nt, Human
acccaugacuuuauauggaugau

SEQ ID NO: 2401438 - RNA, 17 nt, Human
acccaugaaucaaagac

SEQ ID NO: 2401439 - RNA, 14 nt, Human
acccaugaaucaaa

SEQ ID NO: 2401440 - RNA, 19 nt, Human
acccaugaagacaggacag

SEQ ID NO: 2401441 - RNA, 20 nt, Human
acccaugaagacaggacagu

SEQ ID NO: 2401442 - RNA, 20 nt, Human
acccaugaguuggggucugg

SEQ ID NO: 2401443 - RNA, 21 nt, Human
acccaugaguuggggucuggc

SEQ ID NO: 2401444 - RNA, 13 nt, Human
acccaugaggcaa

SEQ ID NO: 2401445 - RNA, 20 nt, Human
acccaugaggcaaugucagg

SEQ ID NO: 2401446 - RNA, 19 nt, Human
accccaaagagccuggaga

SEQ ID NO: 2401447 - RNA, 15 nt, Human
accccaaagagccug

SEQ ID NO: 2401448 - RNA, 14 nt, Human
accccaaagagccu

SEQ ID NO: 2401449 - RNA, 14 nt, Human
accccaaaccucca

SEQ ID NO: 2401450 - RNA, 23 nt, Human
accccaaacaccuuccagcuccu

SEQ ID NO: 2401451 - RNA, 20 nt, Human
accccaaacaccuuccagcu

SEQ ID NO: 2401452 - RNA, 18 nt, Human
accccaaacaccuuccag

SEQ ID NO: 2401453 - RNA, 16 nt, Human
accccaaacaccuucc

SEQ ID NO: 2401454 - RNA, 20 nt, Human
acccauuuugagugacucga

SEQ ID NO: 2401455 - RNA, 19 nt, Human
acccaugcugcccugugag

SEQ ID NO: 2401456 - RNA, 16 nt, Human
acccaugcugcccugu

SEQ ID NO: 2401457 - RNA, 14 nt, Human
acccauuuucacau

SEQ ID NO: 2401458 - RNA, 18 nt, Human
acccccuuugugcugugg

SEQ ID NO: 2401459 - RNA, 17 nt, Human
acccccuucugggcauc

SEQ ID NO: 2401460 - RNA, 16 nt, Human
acccccuucugggcau

SEQ ID NO: 2401461 - RNA, 15 nt, Human
acccccuucugggca

SEQ ID NO: 2401462 - RNA, 18 nt, Human
accccgaccaccugccca

SEQ ID NO: 2401463 - RNA, 14 nt, Human
accccgccugcccu

SEQ ID NO: 2401464 - RNA, 20 nt, Human
accccgcagacaccuuggac

SEQ ID NO: 2401465 - RNA, 18 nt, Human
accccgcagacaccuugg

SEQ ID NO: 2401466 - RNA, 17 nt, Human
accccgcagacaccuug

SEQ ID NO: 2401467 - RNA, 15 nt, Human
accccgcagacaccu

SEQ ID NO: 2401468 - RNA, 18 nt, Human
accccaaagcuuuccugc

SEQ ID NO: 2401469 - RNA, 17 nt, Human
accccaaagcuuuccug

SEQ ID NO: 2401470 - RNA, 15 nt, Human
accccaaagcuuucc

SEQ ID NO: 2401471 - RNA, 22 nt, Human
accccaaagagccuggagaagc

SEQ ID NO: 2401472 - RNA, 21 nt, Human
accccaaagagccuggagaag

SEQ ID NO: 2401473 - RNA, 15 nt, Human
accccaaagccccuu

SEQ ID NO: 2401474 - RNA, 16 nt, Human
accccaaagccccuug

SEQ ID NO: 2401475 - RNA, 18 nt, Human
accccaaagccccuugcu

SEQ ID NO: 2401476 - RNA, 16 nt, Human
acccccuucucugcuc

SEQ ID NO: 2401477 - RNA, 14 nt, Human
acccccuucucugc

SEQ ID NO: 2401478 - RNA, 17 nt, Human
acccccuucucugcucc

SEQ ID NO: 2401479 - RNA, 18 nt, Human
acccccuucucugcucca

SEQ ID NO: 2401480 - RNA, 19 nt, Human
acccccuucucugcuccac

SEQ ID NO: 2401481 - RNA, 20 nt, Human
acccccuucucugcuccacc

SEQ ID NO: 2401482 - RNA, 14 nt, Human
acccccuucugggc

SEQ ID NO: 2401483 - RNA, 13 nt, Human
acccccuucuggg

SEQ ID NO: 2401484 - RNA, 23 nt, Human
acccccuucucugcuccaccaca

SEQ ID NO: 2401485 - RNA, 23 nt, Human
accccgcucugcaugcggcccag

SEQ ID NO: 2401486 - RNA, 16 nt, Human
accccgcucugcaugc

SEQ ID NO: 2401487 - RNA, 14 nt, Human
accccgcucugcau

SEQ ID NO: 2401488 - RNA, 19 nt, Human
accccgccugcccucaugg

SEQ ID NO: 2401489 - RNA, 15 nt, Human
accccggccaccugc

SEQ ID NO: 2401490 - RNA, 13 nt, Human
accccgggcgggu

SEQ ID NO: 2401491 - RNA, 22 nt, Human
accccgcucugcaugcggccca

SEQ ID NO: 2401492 - RNA, 21 nt, Human
accccgcucugcaugcggccc

SEQ ID NO: 2401493 - RNA, 13 nt, Human
accccgggcucuc

SEQ ID NO: 2401494 - RNA, 15 nt, Human
accccgggcucucug

SEQ ID NO: 2401495 - RNA, 16 nt, Human
accccgggcucucugc

SEQ ID NO: 2401496 - RNA, 17 nt, Human
accccgggcucucugcu

SEQ ID NO: 2401497 - RNA, 18 nt, Human
accccgggcucucugcug

SEQ ID NO: 2401498 - RNA, 21 nt, Human
accccgggcucucugcuguac

SEQ ID NO: 2401499 - RNA, 22 nt, Human
accccuaaagagauacuuugau

SEQ ID NO: 2401500 - RNA, 21 nt, Human
accccguguccccggccucag

SEQ ID NO: 2401501 - RNA, 18 nt, Human
accccggggacccuguga

SEQ ID NO: 2401502 - RNA, 17 nt, Human
accccggggacccugug

SEQ ID NO: 2401503 - RNA, 16 nt, Human
accccggggacccugu

SEQ ID NO: 2401504 - RNA, 15 nt, Human
accccggggacccug

SEQ ID NO: 2401505 - RNA, 20 nt, Human
accccggggugcccacaggc

SEQ ID NO: 2401506 - RNA, 21 nt, Human
accccggggugcccacaggcc

SEQ ID NO: 2401507 - RNA, 23 nt, Human
accccggggugcccacaggccgc

SEQ ID NO: 2401508 - RNA, 22 nt, Human
accccgucugggguucagcccc

SEQ ID NO: 2401509 - RNA, 23 nt, Human
accccgucugggguucagccccu

SEQ ID NO: 2401510 - RNA, 20 nt, Human
accccgucgaggggcucuca

SEQ ID NO: 2401511 - RNA, 19 nt, Human
acaaguccugugaauuucu

SEQ ID NO: 2401512 - RNA, 17 nt, Human
acaaguccugugaauuu

SEQ ID NO: 2401513 - RNA, 16 nt, Human
acaaguccugugaauu

SEQ ID NO: 2401514 - RNA, 15 nt, Human
acaaguccugugaau

SEQ ID NO: 2401515 - RNA, 17 nt, Human
acaagucccuguaauug

SEQ ID NO: 2401516 - RNA, 23 nt, Human
acaagucauagguuaauauuuaa

SEQ ID NO: 2401517 - RNA, 16 nt, Human
acaagucccuguaauu

SEQ ID NO: 2401518 - RNA, 21 nt, Human
acaagucauuuuaacuuuauc

SEQ ID NO: 2401519 - RNA, 23 nt, Human
acaagucauuuuaacuuuaucac

SEQ ID NO: 2401520 - RNA, 23 nt, Human
acaaguaugaauaaagacaccua

SEQ ID NO: 2401521 - RNA, 21 nt, Human
acaaguaugaauaaagacacc

SEQ ID NO: 2401522 - RNA, 12 nt, Human
acaagugccacu

SEQ ID NO: 2401523 - RNA, 18 nt, Human
acaagugaaaaacaucca

SEQ ID NO: 2401524 - RNA, 22 nt, Human
acaagugaguuguugcccuggg

SEQ ID NO: 2401525 - RNA, 14 nt, Human
acaacuucagcagu

SEQ ID NO: 2401526 - RNA, 17 nt, Human
acaacuuuaagaggaca

SEQ ID NO: 2401527 - RNA, 22 nt, Human
acaacuugucuauuaccuguua

SEQ ID NO: 2401528 - RNA, 14 nt, Human
acaacuucuuugua

SEQ ID NO: 2401529 - RNA, 16 nt, Human
acaacuauuuuuccaa

SEQ ID NO: 2401530 - RNA, 17 nt, Human
acaacuauggaucagaa

SEQ ID NO: 2401531 - RNA, 19 nt, Human
acaacuaggcuucagcaua

SEQ ID NO: 2401532 - RNA, 17 nt, Human
acaacuucaauauccaa

SEQ ID NO: 2401533 - RNA, 17 nt, Human
acaacuucaagugcaug

SEQ ID NO: 2401534 - RNA, 18 nt, Human
acaacuucccagugaauu

SEQ ID NO: 2401535 - RNA, 14 nt, Human
acaaaccaugcaaa

SEQ ID NO: 2401536 - RNA, 14 nt, Human
acaaaccagaagca

SEQ ID NO: 2401537 - RNA, 21 nt, Human
acaaaccgagugcaaugaaug

SEQ ID NO: 2401538 - RNA, 12 nt, Human
acaaaccugccu

SEQ ID NO: 2401539 - RNA, 20 nt, Human
acaaaauguaggguuauaau

SEQ ID NO: 2401540 - RNA, 20 nt, Human
aauuuugaguucuacauaag

SEQ ID NO: 2401541 - RNA, 19 nt, Human
aauuuugacacuauaucug

SEQ ID NO: 2401542 - RNA, 21 nt, Human
aauuuucuuuuuaauaaaaag

SEQ ID NO: 2401543 - RNA, 16 nt, Human
aauuuugacacuauau

SEQ ID NO: 2401544 - RNA, 21 nt, Human
aauuuugaauaaauaaaugua

SEQ ID NO: 2401545 - RNA, 21 nt, Human
acaaaccuguuucugcagcca

SEQ ID NO: 2401546 - RNA, 15 nt, Human
acaaacgggcucagc

SEQ ID NO: 2401547 - RNA, 21 nt, Human
acaaagaagacauguuuuaga

SEQ ID NO: 2401548 - RNA, 19 nt, Human
acaaagaagacauguuuua

SEQ ID NO: 2401549 - RNA, 16 nt, Human
acaaagaagacauguu

SEQ ID NO: 2401550 - RNA, 15 nt, Human
acaaagaagacaugu

SEQ ID NO: 2401551 - RNA, 22 nt, Human
acaaagaagacauguuuuagac

SEQ ID NO: 2401552 - RNA, 18 nt, Human
acaaagacaaauucuguu

SEQ ID NO: 2401553 - RNA, 18 nt, Human
acaaacguauguaaaugu

SEQ ID NO: 2401554 - RNA, 18 nt, Human
acaaaccugccuggguuu

SEQ ID NO: 2401555 - RNA, 14 nt, Human
acaaaccugccugg

SEQ ID NO: 2401556 - RNA, 13 nt, Human
acaaagaagacau

SEQ ID NO: 2401557 - RNA, 21 nt, Human
acaaacguauguaaauguaua

SEQ ID NO: 2401558 - RNA, 18 nt, Human
acaaagaagacaacauua

SEQ ID NO: 2401559 - RNA, 13 nt, Human
acaacuauauugu

SEQ ID NO: 2401560 - RNA, 18 nt, Human
acaacuaugauuuggaaa

SEQ ID NO: 2401561 - RNA, 13 nt, Human
acaaagacugagu

SEQ ID NO: 2401562 - RNA, 19 nt, Human
acaaagacaaauucuguuu

SEQ ID NO: 2401563 - RNA, 22 nt, Human
acaaagacaaauucuguuucuu

SEQ ID NO: 2401564 - RNA, 23 nt, Human
aauuuuagugacagcucugccug

SEQ ID NO: 2401565 - RNA, 19 nt, Human
aauuuuaguagagacaggg

SEQ ID NO: 2401566 - RNA, 13 nt, Human
aauuuugaaaaac

SEQ ID NO: 2401567 - RNA, 20 nt, Human
aauuuuauagcucaguuuau

SEQ ID NO: 2401568 - RNA, 16 nt, Human
aauuuuaucucuuauu

SEQ ID NO: 2401569 - RNA, 19 nt, Human
aauuuuaugagggccacgg

SEQ ID NO: 2401570 - RNA, 12 nt, Human
aauuuuaugaau

SEQ ID NO: 2401571 - RNA, 20 nt, Human
aauuuuaucccucaccugua

SEQ ID NO: 2401572 - RNA, 14 nt, Human
aauuuuaucccuca

SEQ ID NO: 2401573 - RNA, 19 nt, Human
aauuuuauagcucaguuua

SEQ ID NO: 2401574 - RNA, 16 nt, Human
aauuauaauauacuau

SEQ ID NO: 2401575 - RNA, 20 nt, Human
aauuauaagaggcugauaau

SEQ ID NO: 2401576 - RNA, 17 nt, Human
aauuauaagaggcugau

SEQ ID NO: 2401577 - RNA, 23 nt, Human
aauuauaacuuaaaauauuuuau

SEQ ID NO: 2401578 - RNA, 17 nt, Human
aauuauaacuuaaaaua

SEQ ID NO: 2401579 - RNA, 19 nt, Human
acaaugugaacuuuauuaa

SEQ ID NO: 2401580 - RNA, 22 nt, Human
acaaugugaacuuuauuaaaua

SEQ ID NO: 2401581 - RNA, 17 nt, Human
acaaugugaacuuuauu

SEQ ID NO: 2401582 - RNA, 12 nt, Human
acaauuuuguac

SEQ ID NO: 2401583 - RNA, 15 nt, Human
acacaaaccugccug

SEQ ID NO: 2401584 - RNA, 15 nt, Human
acaauuuuguacaaa

SEQ ID NO: 2401585 - RNA, 17 nt, Human
acacaaaccugccuggg

SEQ ID NO: 2401586 - RNA, 16 nt, Human
acacaaaccugccugg

SEQ ID NO: 2401587 - RNA, 14 nt, Human
acacaaacuguaaa

SEQ ID NO: 2401588 - RNA, 15 nt, Human
acacaaacuguaaau

SEQ ID NO: 2401589 - RNA, 16 nt, Human
acacaaacuguaaaua

SEQ ID NO: 2401590 - RNA, 18 nt, Human
acacaaacgggcucagca

SEQ ID NO: 2401591 - RNA, 19 nt, Human
acacaaacuguaaauaaaa

SEQ ID NO: 2401592 - RNA, 15 nt, Human
acacaaacguaugua

SEQ ID NO: 2401593 - RNA, 20 nt, Human
acacagaaaauguugagaau

SEQ ID NO: 2401594 - RNA, 21 nt, Human
acaauuugagauguauuucaa

SEQ ID NO: 2401595 - RNA, 23 nt, Human
acaauuuccuuuauauuuaguga

SEQ ID NO: 2401596 - RNA, 20 nt, Human
acaauuuccuuuauauuuag

SEQ ID NO: 2401597 - RNA, 11 nt, Human
acaauuucugu

SEQ ID NO: 2401598 - RNA, 16 nt, Human
acaauuuauuauggca

SEQ ID NO: 2401599 - RNA, 17 nt, Human
acaauuuccuuuauauu

SEQ ID NO: 2401600 - RNA, 16 nt, Human
acaauuuccuuuauau

SEQ ID NO: 2401601 - RNA, 20 nt, Human
acaauuucaaaaaaauaaaa

SEQ ID NO: 2401602 - RNA, 19 nt, Human
acaauuucaaaaaaauaaa

SEQ ID NO: 2401603 - RNA, 15 nt, Human
acaauuuauuauggc

SEQ ID NO: 2401604 - RNA, 16 nt, Human
acaauuaaagcuguua

SEQ ID NO: 2401605 - RNA, 19 nt, Human
acaauuaaagcuguuauuu

SEQ ID NO: 2401606 - RNA, 21 nt, Human
acaauguucaucccaugaugu

SEQ ID NO: 2401607 - RNA, 15 nt, Human
acaauguucauccca

SEQ ID NO: 2401608 - RNA, 22 nt, Human
acaauguuaaggaaacucuuau

SEQ ID NO: 2401609 - RNA, 21 nt, Human
acaauguuaaggaaacucuua

SEQ ID NO: 2401610 - RNA, 20 nt, Human
acaauguuaaggaaacucuu

SEQ ID NO: 2401611 - RNA, 19 nt, Human
acaauguuaaggaaacucu

SEQ ID NO: 2401612 - RNA, 14 nt, Human
acaauguuaaggaa

SEQ ID NO: 2401613 - RNA, 11 nt, Human
acaauguuaag

SEQ ID NO: 2401614 - RNA, 15 nt, Human
acacuaaccacgcug

SEQ ID NO: 2401615 - RNA, 14 nt, Human
acacuaaccacgcu

SEQ ID NO: 2401616 - RNA, 21 nt, Human
acacuaaacagacuauuuaac

SEQ ID NO: 2401617 - RNA, 20 nt, Human
acacuaaacagacuauuuaa

SEQ ID NO: 2401618 - RNA, 15 nt, Human
acacuaaacagacua

SEQ ID NO: 2401619 - RNA, 14 nt, Human
acacuaaaaauaaa

SEQ ID NO: 2401620 - RNA, 18 nt, Human
acacggagcccagcccuc

SEQ ID NO: 2401621 - RNA, 22 nt, Human
acacggagcccagcccucccca

SEQ ID NO: 2401622 - RNA, 15 nt, Human
acacggacacucaaa

SEQ ID NO: 2401623 - RNA, 21 nt, Human
acacagcuaacacacagcucc

SEQ ID NO: 2401624 - RNA, 16 nt, Human
acaccacacccagccu

SEQ ID NO: 2401625 - RNA, 15 nt, Human
acaccacacccagcc

SEQ ID NO: 2401626 - RNA, 14 nt, Human
acaccacacccagc

SEQ ID NO: 2401627 - RNA, 13 nt, Human
acaccacacccag

SEQ ID NO: 2401628 - RNA, 12 nt, Human
acacagcucugu

SEQ ID NO: 2401629 - RNA, 11 nt, Human
acacagcucug

SEQ ID NO: 2401630 - RNA, 17 nt, Human
acacagaaagccuauca

SEQ ID NO: 2401631 - RNA, 21 nt, Human
acacagaaaccuuuuuaaaaa

SEQ ID NO: 2401632 - RNA, 18 nt, Human
acacagaaaccuuuuuaa

SEQ ID NO: 2401633 - RNA, 19 nt, Human
acacagaaaccuuuuuaaa

SEQ ID NO: 2401634 - RNA, 13 nt, Human
acacagaaaccuu

SEQ ID NO: 2401635 - RNA, 23 nt, Human
acacagacauucugccaggcccc

SEQ ID NO: 2401636 - RNA, 23 nt, Human
acacagacugcgauuugucccag

SEQ ID NO: 2401637 - RNA, 23 nt, Human
acacagcuaacacacagcuccca

SEQ ID NO: 2401638 - RNA, 20 nt, Human
acacagcuaacacacagcuc

SEQ ID NO: 2401639 - RNA, 17 nt, Human
acacgcuccuuccucug

SEQ ID NO: 2401640 - RNA, 19 nt, Human
acacgcuccuuccucugag

SEQ ID NO: 2401641 - RNA, 22 nt, Human
acaccagagcagaugcagagag

SEQ ID NO: 2401642 - RNA, 20 nt, Human
acaccagagcagaugcagag

SEQ ID NO: 2401643 - RNA, 19 nt, Human
acaccagagcagaugcaga

SEQ ID NO: 2401644 - RNA, 18 nt, Human
acaccagagcagaugcag

SEQ ID NO: 2401645 - RNA, 16 nt, Human
acacgcuccuuccucu

SEQ ID NO: 2401646 - RNA, 12 nt, Human
acaccagagccc

SEQ ID NO: 2401647 - RNA, 17 nt, Human
acaccacagacacacac

SEQ ID NO: 2401648 - RNA, 16 nt, Human
acaccacagacacaca

SEQ ID NO: 2401649 - RNA, 15 nt, Human
acaccacagacacac

SEQ ID NO: 2401650 - RNA, 14 nt, Human
acaccacagacaca

SEQ ID NO: 2401651 - RNA, 13 nt, Human
acaccacagacac

SEQ ID NO: 2401652 - RNA, 12 nt, Human
acaccacagaca

SEQ ID NO: 2401653 - RNA, 18 nt, Human
acaccacacccagccuca

SEQ ID NO: 2401654 - RNA, 17 nt, Human
acaccacacccagccuc

SEQ ID NO: 2401655 - RNA, 18 nt, Human
acaccaccucacuccugu

SEQ ID NO: 2401656 - RNA, 22 nt, Human
acaccacagacacacacacgca

SEQ ID NO: 2401657 - RNA, 21 nt, Human
acaccacagacacacacacgc

SEQ ID NO: 2401658 - RNA, 18 nt, Human
acaccacagacacacaca

SEQ ID NO: 2401659 - RNA, 14 nt, Human
acaccacuacauuc

SEQ ID NO: 2401660 - RNA, 21 nt, Human
acaccacuacauucuguuaau

SEQ ID NO: 2401661 - RNA, 17 nt, Human
acaccagagcagaugca

SEQ ID NO: 2401662 - RNA, 13 nt, Human
acaccagagcaga

SEQ ID NO: 2401663 - RNA, 14 nt, Human
acaccagacagaca

SEQ ID NO: 2401664 - RNA, 13 nt, Human
acagcucuagaca

SEQ ID NO: 2401665 - RNA, 10 nt, Human
acagcugcuc

SEQ ID NO: 2401666 - RNA, 23 nt, Human
acagcugccugggaucccucauc

SEQ ID NO: 2401667 - RNA, 14 nt, Human
acagcugccuggga

SEQ ID NO: 2401668 - RNA, 20 nt, Human
acagcucugcauacucauua

SEQ ID NO: 2401669 - RNA, 22 nt, Human
acagcuccuugggaggaagcag

SEQ ID NO: 2401670 - RNA, 21 nt, Human
acagcuccuugggaggaagca

SEQ ID NO: 2401671 - RNA, 20 nt, Human
acagcuccuugggaggaagc

SEQ ID NO: 2401672 - RNA, 19 nt, Human
acagcuccuugggaggaag

SEQ ID NO: 2401673 - RNA, 23 nt, Human
acagcuccuugggaggaagcaga

SEQ ID NO: 2401674 - RNA, 17 nt, Human
acagcuccuugggagga

SEQ ID NO: 2401675 - RNA, 15 nt, Human
acagcuccuugggag

SEQ ID NO: 2401676 - RNA, 14 nt, Human
acagcuccuuggga

SEQ ID NO: 2401677 - RNA, 13 nt, Human
acagcuccuuggg

SEQ ID NO: 2401678 - RNA, 14 nt, Human
acagcuccuucugu

SEQ ID NO: 2401679 - RNA, 13 nt, Human
acagcuccuucug

SEQ ID NO: 2401680 - RNA, 12 nt, Human
acagcuccuucu

SEQ ID NO: 2401681 - RNA, 21 nt, Human
acaggugugagccaccacgcc

SEQ ID NO: 2401682 - RNA, 14 nt, Human
acaggucuccucuu

SEQ ID NO: 2401683 - RNA, 22 nt, Human
acaggugugagccaccacgccc

SEQ ID NO: 2401684 - RNA, 18 nt, Human
acagguuacaacagauuu

SEQ ID NO: 2401685 - RNA, 23 nt, Human
acaggugugaaccaccacaccca

SEQ ID NO: 2401686 - RNA, 20 nt, Human
acaggugugaaccaccacac

SEQ ID NO: 2401687 - RNA, 18 nt, Human
acagguaaacuaucuugg

SEQ ID NO: 2401688 - RNA, 15 nt, Human
acagguaauauaaaa

SEQ ID NO: 2401689 - RNA, 19 nt, Human
acagguaacgucuguaagc

SEQ ID NO: 2401690 - RNA, 19 nt, Human
acagggucucuagugcugu

SEQ ID NO: 2401691 - RNA, 17 nt, Human
acaggguagcagguacc

SEQ ID NO: 2401692 - RNA, 21 nt, Human
acagggucucuagugcuguga

SEQ ID NO: 2401693 - RNA, 22 nt, Human
acaggucaauacaguacaggca

SEQ ID NO: 2401694 - RNA, 23 nt, Human
acaggucaauacaguacaggcag

SEQ ID NO: 2401695 - RNA, 16 nt, Human
acaggcaagcaccucc

SEQ ID NO: 2401696 - RNA, 15 nt, Human
acaggcaagcaccuc

SEQ ID NO: 2401697 - RNA, 18 nt, Human
acaggcaagcaccuccug

SEQ ID NO: 2401698 - RNA, 21 nt, Human
acagcugcucaauaaaguaca

SEQ ID NO: 2401699 - RNA, 24 nt, Human
acagggcuggcccagcccugcugg

SEQ ID NO: 2401700 - RNA, 20 nt, Human
acagcugcuccuagagggag

SEQ ID NO: 2401701 - RNA, 20 nt, Human
acaggggaagguggccucug

SEQ ID NO: 2401702 - RNA, 15 nt, Human
acaggggcaggagga

SEQ ID NO: 2401703 - RNA, 15 nt, Human
acagccaugauucuu

SEQ ID NO: 2401704 - RNA, 19 nt, Human
acagccaggugccuuggag

SEQ ID NO: 2401705 - RNA, 17 nt, Human
acagccaggugccuugg

SEQ ID NO: 2401706 - RNA, 16 nt, Human
acagccaggugccuug

SEQ ID NO: 2401707 - RNA, 15 nt, Human
acagccaggugccuu

SEQ ID NO: 2401708 - RNA, 18 nt, Human
acagccaucccagccuug

SEQ ID NO: 2401709 - RNA, 16 nt, Human
acagccaucccagccu

SEQ ID NO: 2401710 - RNA, 15 nt, Human
acagccaucccagcc

SEQ ID NO: 2401711 - RNA, 18 nt, Human
acagcccaaagaaggaaa

SEQ ID NO: 2401712 - RNA, 17 nt, Human
acagcccaaagaaggaa

SEQ ID NO: 2401713 - RNA, 19 nt, Human
acagccaucccagccuugg

SEQ ID NO: 2401714 - RNA, 16 nt, Human
acagcccaaagaagga

SEQ ID NO: 2401715 - RNA, 13 nt, Human
acagccagacugg

SEQ ID NO: 2401716 - RNA, 15 nt, Human
acagccagacuggca

SEQ ID NO: 2401717 - RNA, 16 nt, Human
acagccagacuggcac

SEQ ID NO: 2401718 - RNA, 16 nt, Human
acagccagcaccuggc

SEQ ID NO: 2401719 - RNA, 13 nt, Human
acagccagcaccu

SEQ ID NO: 2401720 - RNA, 20 nt, Human
acagcaugagaggcucugug

SEQ ID NO: 2401721 - RNA, 15 nt, Human
acagcauugcuuucu

SEQ ID NO: 2401722 - RNA, 12 nt, Human
acagcauugcuu

SEQ ID NO: 2401723 - RNA, 13 nt, Human
acagcauugcuuu

SEQ ID NO: 2401724 - RNA, 13 nt, Human
acagcauguguau

SEQ ID NO: 2401725 - RNA, 11 nt, Human
acagcauugcu

SEQ ID NO: 2401726 - RNA, 19 nt, Human
acagccacggccaggccag

SEQ ID NO: 2401727 - RNA, 23 nt, Human
acagccaaaugcauggugcaguu

SEQ ID NO: 2401728 - RNA, 22 nt, Human
acagcaggguagucugguuucu

SEQ ID NO: 2401729 - RNA, 11 nt, Human
acagcaggugu

SEQ ID NO: 2401730 - RNA, 19 nt, Human
acagagucucacuguugcc

SEQ ID NO: 2401731 - RNA, 17 nt, Human
acagagucucacuguug

SEQ ID NO: 2401732 - RNA, 15 nt, Human
acagcaguugaaaag

SEQ ID NO: 2401733 - RNA, 18 nt, Human
acagcaguugaaaagacu

SEQ ID NO: 2401734 - RNA, 21 nt, Human
acagcaucauuuugcauucaa

SEQ ID NO: 2401735 - RNA, 20 nt, Human
acagcaucauuuugcauuca

SEQ ID NO: 2401736 - RNA, 17 nt, Human
acagcaucauuuugcau

SEQ ID NO: 2401737 - RNA, 17 nt, Human
acagcagugucaucaga

SEQ ID NO: 2401738 - RNA, 16 nt, Human
acagcagugucaucag

SEQ ID NO: 2401739 - RNA, 19 nt, Human
acagcaguguuccccaucu

SEQ ID NO: 2401740 - RNA, 13 nt, Human
acagcaguguucc

SEQ ID NO: 2401741 - RNA, 16 nt, Human
acagcaucauuuugca

SEQ ID NO: 2401742 - RNA, 21 nt, Human
acagaggggguggccucccaa

SEQ ID NO: 2401743 - RNA, 22 nt, Human
acagaaucauaugauucugcuu

SEQ ID NO: 2401744 - RNA, 22 nt, Human
acagaauacuguuaaaggaaaa

SEQ ID NO: 2401745 - RNA, 15 nt, Human
acagaauaaugaaug

SEQ ID NO: 2401746 - RNA, 18 nt, Human
acagaagucaugaagccc

SEQ ID NO: 2401747 - RNA, 14 nt, Human
acagagucucacug

SEQ ID NO: 2401748 - RNA, 12 nt, Human
acagagucucac

SEQ ID NO: 2401749 - RNA, 22 nt, Human
acagaggggguggccucccaac

SEQ ID NO: 2401750 - RNA, 21 nt, Human
acagaguaaauagcauucucu

SEQ ID NO: 2401751 - RNA, 23 nt, Human
acagaguaugaacaccugggcuu

SEQ ID NO: 2401752 - RNA, 19 nt, Human
acacugaaguuaacagaga

SEQ ID NO: 2401753 - RNA, 18 nt, Human
acacugaauauuuauauu

SEQ ID NO: 2401754 - RNA, 23 nt, Human
acacugaauauuuauauuucacu

SEQ ID NO: 2401755 - RNA, 22 nt, Human
acacugagaauguaagaacuac

SEQ ID NO: 2401756 - RNA, 20 nt, Human
acacugagaauguaagaacu

SEQ ID NO: 2401757 - RNA, 19 nt, Human
acacugagaauguaagaac

SEQ ID NO: 2401758 - RNA, 17 nt, Human
acacugaccauccacuc

SEQ ID NO: 2401759 - RNA, 15 nt, Human
acacugauccagccc

SEQ ID NO: 2401760 - RNA, 22 nt, Human
acacugacaccuuugcaggcau

SEQ ID NO: 2401761 - RNA, 14 nt, Human
acacugagcuguca

SEQ ID NO: 2401762 - RNA, 14 nt, Human
acacugaggcaggg

SEQ ID NO: 2401763 - RNA, 22 nt, Human
acacugaugcuuagauguucca

SEQ ID NO: 2401764 - RNA, 16 nt, Human
acacugaggcagggaa

SEQ ID NO: 2401765 - RNA, 17 nt, Human
acacugaggcagggaag

SEQ ID NO: 2401766 - RNA, 22 nt, Human
acacugccaucuuaguuuggau

SEQ ID NO: 2401767 - RNA, 21 nt, Human
acacugaagcucuugaagaca

SEQ ID NO: 2401768 - RNA, 22 nt, Human
acagaagcaguugagucgucau

SEQ ID NO: 2401769 - RNA, 15 nt, Human
acagaagcagcucuu

SEQ ID NO: 2401770 - RNA, 15 nt, Human
acagaagccaggagc

SEQ ID NO: 2401771 - RNA, 13 nt, Human
acagaagccagga

SEQ ID NO: 2401772 - RNA, 19 nt, Human
acagaagcaggcuggaggu

SEQ ID NO: 2401773 - RNA, 18 nt, Human
acagaagcaggcuggagg

SEQ ID NO: 2401774 - RNA, 16 nt, Human
acagaagccaggagca

SEQ ID NO: 2401775 - RNA, 17 nt, Human
acagaagucaugaagcc

SEQ ID NO: 2401776 - RNA, 13 nt, Human
acagaagcagcuc

SEQ ID NO: 2401777 - RNA, 14 nt, Human
acagaagcagcucu

SEQ ID NO: 2401778 - RNA, 12 nt, Human
acagaagcagcu

SEQ ID NO: 2401779 - RNA, 20 nt, Human
acagaagaaggcagcaggug

SEQ ID NO: 2401780 - RNA, 17 nt, Human
acagaacagcuucaggu

SEQ ID NO: 2401781 - RNA, 16 nt, Human
acagaacagcuucagg

SEQ ID NO: 2401782 - RNA, 15 nt, Human
acagaacagcuucag

SEQ ID NO: 2401783 - RNA, 14 nt, Human
acagaacagcuuca

SEQ ID NO: 2401784 - RNA, 13 nt, Human
acagaacagcuuc

SEQ ID NO: 2401785 - RNA, 12 nt, Human
acagaacagcuu

SEQ ID NO: 2401786 - RNA, 20 nt, Human
acagaacagcuucagguuau

SEQ ID NO: 2401787 - RNA, 18 nt, Human
acagaacagcuucagguu

SEQ ID NO: 2401788 - RNA, 16 nt, Human
acagaagaaggcagca

SEQ ID NO: 2401789 - RNA, 21 nt, Human
acagaacacauaauucaggaa

SEQ ID NO: 2401790 - RNA, 13 nt, Human
acagaacacuaaa

SEQ ID NO: 2401791 - RNA, 14 nt, Human
acagaacacugucu

SEQ ID NO: 2401792 - RNA, 12 nt, Human
acagaacacugu

SEQ ID NO: 2401793 - RNA, 13 nt, Human
acacugugcccug

SEQ ID NO: 2401794 - RNA, 12 nt, Human
acacugugcccu

SEQ ID NO: 2401795 - RNA, 23 nt, Human
acacugugcccagcccggaccuu

SEQ ID NO: 2401796 - RNA, 22 nt, Human
acacugugcccagcccggaccu

SEQ ID NO: 2401797 - RNA, 20 nt, Human
acacugugcacaucuguguc

SEQ ID NO: 2401798 - RNA, 21 nt, Human
acacugugcacaucugugucu

SEQ ID NO: 2401799 - RNA, 17 nt, Human
acacugugcccuggugg

SEQ ID NO: 2401800 - RNA, 16 nt, Human
acacugugcccuggug

SEQ ID NO: 2401801 - RNA, 15 nt, Human
acacugugcccuggu

SEQ ID NO: 2401802 - RNA, 14 nt, Human
acacugugcccugg

SEQ ID NO: 2401803 - RNA, 18 nt, Human
acacugugcccuggugga

SEQ ID NO: 2401804 - RNA, 18 nt, Human
acacugugcacaucugug

SEQ ID NO: 2401805 - RNA, 22 nt, Human
acacugucugguuucaccgagg

SEQ ID NO: 2401806 - RNA, 21 nt, Human
acacuguauuuguaucucuga

SEQ ID NO: 2401807 - RNA, 23 nt, Human
acacugcuaggugggccagcccc

SEQ ID NO: 2401808 - RNA, 13 nt, Human
acacugucuugaa

SEQ ID NO: 2401809 - RNA, 21 nt, Human
acacugcugcuccagugcagg

SEQ ID NO: 2401810 - RNA, 18 nt, Human
acacugcggggcuuggcu

SEQ ID NO: 2401811 - RNA, 19 nt, Human
acacugcggggcuuggcug

SEQ ID NO: 2401812 - RNA, 18 nt, Human
acacugcuaggugggcca

SEQ ID NO: 2401813 - RNA, 15 nt, Human
auaucaauuuaaaaa

SEQ ID NO: 2401814 - RNA, 17 nt, Human
auaucagaaaagggaag

SEQ ID NO: 2401815 - RNA, 14 nt, Human
auauccaccaccuc

SEQ ID NO: 2401816 - RNA, 14 nt, Human
auaucagaaaaggg

SEQ ID NO: 2401817 - RNA, 18 nt, Human
auaucacuugucaauaaa

SEQ ID NO: 2401818 - RNA, 18 nt, Human
auaucacauguuuucucu

SEQ ID NO: 2401819 - RNA, 17 nt, Human
auaucccuacauguauu

SEQ ID NO: 2401820 - RNA, 16 nt, Human
auaucccuacauguau

SEQ ID NO: 2401821 - RNA, 15 nt, Human
auaucccuacaugua

SEQ ID NO: 2401822 - RNA, 15 nt, Human
auauccccucccagu

SEQ ID NO: 2401823 - RNA, 17 nt, Human
auauccauucuuucuga

SEQ ID NO: 2401824 - RNA, 16 nt, Human
auauccaccaccuccc

SEQ ID NO: 2401825 - RNA, 21 nt, Human
auauccaugaccuaguuuucc

SEQ ID NO: 2401826 - RNA, 12 nt, Human
auauccauguac

SEQ ID NO: 2401827 - RNA, 18 nt, Human
auauccauucuuucugau

SEQ ID NO: 2401828 - RNA, 18 nt, Human
auauccccuauuuaacag

SEQ ID NO: 2401829 - RNA, 14 nt, Human
auauccauguacug

SEQ ID NO: 2401830 - RNA, 15 nt, Human
auauccauguacugu

SEQ ID NO: 2401831 - RNA, 17 nt, Human
auauccauguacuguag

SEQ ID NO: 2401832 - RNA, 18 nt, Human
auauccauguacuguagu

SEQ ID NO: 2401833 - RNA, 20 nt, Human
auauggaacuucuaauauau

SEQ ID NO: 2401834 - RNA, 18 nt, Human
auauggaacuucuaauau

SEQ ID NO: 2401835 - RNA, 19 nt, Human
auauggaacuuacauuguu

SEQ ID NO: 2401836 - RNA, 15 nt, Human
auauggacacuuaau

SEQ ID NO: 2401837 - RNA, 20 nt, Human
auauggacacuuaauacuac

SEQ ID NO: 2401838 - RNA, 18 nt, Human
auauuagaaguguuaacu

SEQ ID NO: 2401839 - RNA, 18 nt, Human
auauggacucaguuuucu

SEQ ID NO: 2401840 - RNA, 14 nt, Human
auaugcuuauacac

SEQ ID NO: 2401841 - RNA, 16 nt, Human
auaugcuuauacacuu

SEQ ID NO: 2401842 - RNA, 23 nt, Human
auaugcuucuguuuuauaauuuu

SEQ ID NO: 2401843 - RNA, 19 nt, Human
auaugcuuauacacuuaca

SEQ ID NO: 2401844 - RNA, 22 nt, Human
auaugccugggcagaaggaaga

SEQ ID NO: 2401845 - RNA, 19 nt, Human
auaugccucuccuuuguau

SEQ ID NO: 2401846 - RNA, 22 nt, Human
auaugccucuccuuuguauauu

SEQ ID NO: 2401847 - RNA, 15 nt, Human
auaugcuuaguaaug

SEQ ID NO: 2401848 - RNA, 13 nt, Human
auaugcuuaguaa

SEQ ID NO: 2401849 - RNA, 14 nt, Human
auaugcuuacugau

SEQ ID NO: 2401850 - RNA, 16 nt, Human
auauccuacuucucca

SEQ ID NO: 2401851 - RNA, 11 nt, Human
auauccucugu

SEQ ID NO: 2401852 - RNA, 13 nt, Human
auauccugagcca

SEQ ID NO: 2401853 - RNA, 14 nt, Human
auauccugagccau

SEQ ID NO: 2401854 - RNA, 14 nt, Human
auauccugccucag

SEQ ID NO: 2401855 - RNA, 13 nt, Human
auauccugccuca

SEQ ID NO: 2401856 - RNA, 12 nt, Human
auauccugccuc

SEQ ID NO: 2401857 - RNA, 11 nt, Human
auauccugccu

SEQ ID NO: 2401858 - RNA, 15 nt, Human
auauccugagccauc

SEQ ID NO: 2401859 - RNA, 16 nt, Human
auauccuuucuaacaa

SEQ ID NO: 2401860 - RNA, 15 nt, Human
auauccuuucuaaca

SEQ ID NO: 2401861 - RNA, 17 nt, Human
auaugcaguuuuccuua

SEQ ID NO: 2401862 - RNA, 23 nt, Human
auauuucagauaaucacaauaca

SEQ ID NO: 2401863 - RNA, 19 nt, Human
auauuuauuuuuuuuaagu

SEQ ID NO: 2401864 - RNA, 13 nt, Human
auauuucaagaca

SEQ ID NO: 2401865 - RNA, 18 nt, Human
auauuuauuuuuuuaagc

SEQ ID NO: 2401866 - RNA, 16 nt, Human
auauucaggaagcuca

SEQ ID NO: 2401867 - RNA, 14 nt, Human
auauucaggaagcu

SEQ ID NO: 2401868 - RNA, 19 nt, Human
auauuuagauuguuaaaau

SEQ ID NO: 2401869 - RNA, 20 nt, Human
auauuauacuaagaaaagau

SEQ ID NO: 2401870 - RNA, 20 nt, Human
auauuagaugugauuuaaua

SEQ ID NO: 2401871 - RNA, 18 nt, Human
auauuagaugugauuuaa

SEQ ID NO: 2401872 - RNA, 17 nt, Human
auauuagaugugauuua

SEQ ID NO: 2401873 - RNA, 16 nt, Human
auauuagaugugauuu

SEQ ID NO: 2401874 - RNA, 15 nt, Human
auauuagaugugauu

SEQ ID NO: 2401875 - RNA, 14 nt, Human
auauuagaugugau

SEQ ID NO: 2401876 - RNA, 13 nt, Human
auauuagauguga

SEQ ID NO: 2401877 - RNA, 15 nt, Human
auauuagcauuuagu

SEQ ID NO: 2401878 - RNA, 22 nt, Human
auauuagcauuuaguccaaugu

SEQ ID NO: 2401879 - RNA, 20 nt, Human
auauuagcuuuacuguuugu

SEQ ID NO: 2401880 - RNA, 21 nt, Human
auauuagcuuuacuguuuguu

SEQ ID NO: 2401881 - RNA, 13 nt, Human
auauucaggaagc

SEQ ID NO: 2401882 - RNA, 22 nt, Human
auauuauaauuuuuuucaauau

SEQ ID NO: 2401883 - RNA, 17 nt, Human
auauuauaacuuaaaaa

SEQ ID NO: 2401884 - RNA, 15 nt, Human
auauuaggaaaauau

SEQ ID NO: 2401885 - RNA, 19 nt, Human
auauuuauuacuguaagaa

SEQ ID NO: 2401886 - RNA, 14 nt, Human
auauuuauuacugu

SEQ ID NO: 2401887 - RNA, 18 nt, Human
auauuuauuuuaauaaug

SEQ ID NO: 2401888 - RNA, 22 nt, Human
auauuuauuacuguaagaaaau

SEQ ID NO: 2401889 - RNA, 21 nt, Human
auauuuauuuucuuucuguaa

SEQ ID NO: 2401890 - RNA, 16 nt, Human
auauuuauuaccucug

SEQ ID NO: 2401891 - RNA, 16 nt, Human
auauuuauaaaaauaa

SEQ ID NO: 2401892 - RNA, 18 nt, Human
auauuuaguguucauaaa

SEQ ID NO: 2401893 - RNA, 14 nt, Human
auauuuauuaccuc

SEQ ID NO: 2401894 - RNA, 11 nt, Human
auauuuauaac

SEQ ID NO: 2401895 - RNA, 13 nt, Human
auauuuauaacuc

SEQ ID NO: 2401896 - RNA, 22 nt, Human
auauuuaguuauaguuucagau

SEQ ID NO: 2401897 - RNA, 21 nt, Human
auauuuaguuauaguuucaga

SEQ ID NO: 2401898 - RNA, 14 nt, Human
auauuuauaaaacu

SEQ ID NO: 2401899 - RNA, 15 nt, Human
auauuuagcaaauaa

SEQ ID NO: 2401900 - RNA, 19 nt, Human
auauuuagcaaauaauuuc

SEQ ID NO: 2401901 - RNA, 16 nt, Human
auauaggaacuuaaau

SEQ ID NO: 2401902 - RNA, 18 nt, Human
auauacauucaaacuuaa

SEQ ID NO: 2401903 - RNA, 14 nt, Human
auauaccauuuauc

SEQ ID NO: 2401904 - RNA, 19 nt, Human
auauaauucuguacauagc

SEQ ID NO: 2401905 - RNA, 17 nt, Human
auauaauucuguacaua

SEQ ID NO: 2401906 - RNA, 22 nt, Human
auauaauucuguacauagccua

SEQ ID NO: 2401907 - RNA, 20 nt, Human
auauaauuuuuuagagagcu

SEQ ID NO: 2401908 - RNA, 23 nt, Human
auauagauuauaacuugucuaaa

SEQ ID NO: 2401909 - RNA, 18 nt, Human
auauagauuauaacuugu

SEQ ID NO: 2401910 - RNA, 15 nt, Human
auauagauuauaacu

SEQ ID NO: 2401911 - RNA, 20 nt, Human
auauacgugaaaauuauuug

SEQ ID NO: 2401912 - RNA, 18 nt, Human
auauacauucuuuaucuu

SEQ ID NO: 2401913 - RNA, 19 nt, Human
auauacucacuuucuagau

SEQ ID NO: 2401914 - RNA, 20 nt, Human
auauagcuguacaaauauaa

SEQ ID NO: 2401915 - RNA, 19 nt, Human
auauagcuguacaaauaua

SEQ ID NO: 2401916 - RNA, 18 nt, Human
auauagcuguacaaauau

SEQ ID NO: 2401917 - RNA, 17 nt, Human
auauagcuguacaaaua

SEQ ID NO: 2401918 - RNA, 15 nt, Human
auauagcuguacaaa

SEQ ID NO: 2401919 - RNA, 14 nt, Human
auauagcuguacaa

SEQ ID NO: 2401920 - RNA, 21 nt, Human
auauagcuauuuuuauggaau

SEQ ID NO: 2401921 - RNA, 16 nt, Human
auauagcccagccagg

SEQ ID NO: 2401922 - RNA, 18 nt, Human
auauaaguguacauaugu

SEQ ID NO: 2401923 - RNA, 15 nt, Human
auauaaguguacaua

SEQ ID NO: 2401924 - RNA, 22 nt, Human
auauaauguuguuauuuaaaga

SEQ ID NO: 2401925 - RNA, 21 nt, Human
auauaauguuguuauuuaaag

SEQ ID NO: 2401926 - RNA, 15 nt, Human
auauaaguguguguu

SEQ ID NO: 2401927 - RNA, 14 nt, Human
auauaauucuguac

SEQ ID NO: 2401928 - RNA, 17 nt, Human
auauaauucuguaaaug

SEQ ID NO: 2401929 - RNA, 16 nt, Human
auauaauucuguaaau

SEQ ID NO: 2401930 - RNA, 14 nt, Human
auauaauucuguaa

SEQ ID NO: 2401931 - RNA, 13 nt, Human
auauaauucugua

SEQ ID NO: 2401932 - RNA, 12 nt, Human
auauaauucugu

SEQ ID NO: 2401933 - RNA, 14 nt, Human
auauaauuaucgga

SEQ ID NO: 2401934 - RNA, 21 nt, Human
auauaauuaucggaagcagug

SEQ ID NO: 2401935 - RNA, 15 nt, Human
auauaagugcuguau

SEQ ID NO: 2401936 - RNA, 13 nt, Human
auauaagugcugu

SEQ ID NO: 2401937 - RNA, 18 nt, Human
auauaagugcuguauaaa

SEQ ID NO: 2401938 - RNA, 17 nt, Human
auauaagugcuguauaa

SEQ ID NO: 2401939 - RNA, 14 nt, Human
auauaaguguacau

SEQ ID NO: 2401940 - RNA, 20 nt, Human
auauaagugcuguauaaaau

SEQ ID NO: 2401941 - RNA, 15 nt, Human
auauaagugauugcu

SEQ ID NO: 2401942 - RNA, 16 nt, Human
auaguaugguggcugg

SEQ ID NO: 2401943 - RNA, 22 nt, Human
auaguauccuccagguuuuuca

SEQ ID NO: 2401944 - RNA, 20 nt, Human
auaguauccuccagguuuuu

SEQ ID NO: 2401945 - RNA, 19 nt, Human
auaguauccuccagguuuu

SEQ ID NO: 2401946 - RNA, 18 nt, Human
auaguauccuccagguuu

SEQ ID NO: 2401947 - RNA, 17 nt, Human
auaguauccuccagguu

SEQ ID NO: 2401948 - RNA, 16 nt, Human
auaguauccuccaggu

SEQ ID NO: 2401949 - RNA, 17 nt, Human
auaguauaucuggacaa

SEQ ID NO: 2401950 - RNA, 15 nt, Human
auaguaugguggcug

SEQ ID NO: 2401951 - RNA, 15 nt, Human
auaguauaucuggac

SEQ ID NO: 2401952 - RNA, 17 nt, Human
auaguagcauacauuua

SEQ ID NO: 2401953 - RNA, 16 nt, Human
auaguauaucuggaca

SEQ ID NO: 2401954 - RNA, 13 nt, Human
auaguaguaugau

SEQ ID NO: 2401955 - RNA, 16 nt, Human
auaguagcauacauuu

SEQ ID NO: 2401956 - RNA, 16 nt, Human
auacuugaaaauuaac

SEQ ID NO: 2401957 - RNA, 15 nt, Human
auacuugaaaauuaa

SEQ ID NO: 2401958 - RNA, 12 nt, Human
auacuucaaaag

SEQ ID NO: 2401959 - RNA, 21 nt, Human
auacuucaugaaauccugggu

SEQ ID NO: 2401960 - RNA, 14 nt, Human
auacuucaaaagua

SEQ ID NO: 2401961 - RNA, 22 nt, Human
auacuucagcucacacaugaga

SEQ ID NO: 2401962 - RNA, 21 nt, Human
auacuucucaaaccuguuuaa

SEQ ID NO: 2401963 - RNA, 19 nt, Human
auaaugugaaacuggauua

SEQ ID NO: 2401964 - RNA, 21 nt, Human
auaaugugaaacuggauuaaa

SEQ ID NO: 2401965 - RNA, 21 nt, Human
auaaguguguggucccaaguu

SEQ ID NO: 2401966 - RNA, 22 nt, Human
auaaguguguguuuuucauaaa

SEQ ID NO: 2401967 - RNA, 19 nt, Human
auaaguguguguuuuucau

SEQ ID NO: 2401968 - RNA, 18 nt, Human
auaaugugaaacuggauu

SEQ ID NO: 2401969 - RNA, 13 nt, Human
auaaugugaaaau

SEQ ID NO: 2401970 - RNA, 16 nt, Human
auaaugugaaaauggu

SEQ ID NO: 2401971 - RNA, 19 nt, Human
auaaugucucugugagacu

SEQ ID NO: 2401972 - RNA, 16 nt, Human
auaaguauuucaaauu

SEQ ID NO: 2401973 - RNA, 18 nt, Human
auaaguauuucaaauugg

SEQ ID NO: 2401974 - RNA, 19 nt, Human
auaaguauuucaaauugga

SEQ ID NO: 2401975 - RNA, 19 nt, Human
auaaguauuuaauucaugu

SEQ ID NO: 2401976 - RNA, 19 nt, Human
auaaguacuguguacagaa

SEQ ID NO: 2401977 - RNA, 18 nt, Human
auaaguacuguguacaga

SEQ ID NO: 2401978 - RNA, 20 nt, Human
auaaguguacauaugugcug

SEQ ID NO: 2401979 - RNA, 19 nt, Human
auaaguguacauaugugcu

SEQ ID NO: 2401980 - RNA, 14 nt, Human
auaaguguauuuuu

SEQ ID NO: 2401981 - RNA, 16 nt, Human
auaaguguauuuuuca

SEQ ID NO: 2401982 - RNA, 14 nt, Human
auaaguguacauau

SEQ ID NO: 2401983 - RNA, 13 nt, Human
auaaguguacaua

SEQ ID NO: 2401984 - RNA, 15 nt, Human
auaaguggugugugu

SEQ ID NO: 2401985 - RNA, 14 nt, Human
auaagucauguucc

SEQ ID NO: 2401986 - RNA, 14 nt, Human
auaagucuaaauaa

SEQ ID NO: 2401987 - RNA, 16 nt, Human
auaagucauguuccuu

SEQ ID NO: 2401988 - RNA, 21 nt, Human
auaaguccuugcaagaaucag

SEQ ID NO: 2401989 - RNA, 23 nt, Human
auaacagaaagccugggugacau

SEQ ID NO: 2401990 - RNA, 23 nt, Human
auaacacuauaaagguugacaau

SEQ ID NO: 2401991 - RNA, 23 nt, Human
auaacagguuauuuuaguuucug

SEQ ID NO: 2401992 - RNA, 22 nt, Human
auaacagguuauuuuaguuucu

SEQ ID NO: 2401993 - RNA, 18 nt, Human
auaacagguuauuuuagu

SEQ ID NO: 2401994 - RNA, 14 nt, Human
auaacagguuauuu

SEQ ID NO: 2401995 - RNA, 16 nt, Human
auaacaguaaaugugc

SEQ ID NO: 2401996 - RNA, 13 nt, Human
auaacagguuauu

SEQ ID NO: 2401997 - RNA, 12 nt, Human
auaacagcacug

SEQ ID NO: 2401998 - RNA, 22 nt, Human
auacuuagcaaaguuuuaccug

SEQ ID NO: 2401999 - RNA, 15 nt, Human
auacuuaucucucug

SEQ ID NO: 2402000 - RNA, 20 nt, Human
auacuuaucucucugugcug

SEQ ID NO: 2402001 - RNA, 18 nt, Human
auacuuaucucucugugc

SEQ ID NO: 2402002 - RNA, 17 nt, Human
auacuuaucucucugug

SEQ ID NO: 2402003 - RNA, 16 nt, Human
auacuuaucucucugu

SEQ ID NO: 2402004 - RNA, 13 nt, Human
auacacacacaca

SEQ ID NO: 2402005 - RNA, 14 nt, Human
auacacacacacac

SEQ ID NO: 2402006 - RNA, 11 nt, Human
auacacacaca

SEQ ID NO: 2402007 - RNA, 15 nt, Human
auacacaaguaaaca

SEQ ID NO: 2402008 - RNA, 18 nt, Human
auacacacacacacacag

SEQ ID NO: 2402009 - RNA, 19 nt, Human
auacacacacacacacagc

SEQ ID NO: 2402010 - RNA, 15 nt, Human
auacacacacacaca

SEQ ID NO: 2402011 - RNA, 20 nt, Human
auacacacacacacacagcc

SEQ ID NO: 2402012 - RNA, 22 nt, Human
auacccccugcaaagcccagcu

SEQ ID NO: 2402013 - RNA, 14 nt, Human
auaauuacuauguc

SEQ ID NO: 2402014 - RNA, 16 nt, Human
auaauuauaauauacu

SEQ ID NO: 2402015 - RNA, 11 nt, Human
auacacaaauu

SEQ ID NO: 2402016 - RNA, 15 nt, Human
auacacaacacacac

SEQ ID NO: 2402017 - RNA, 16 nt, Human
auaccucuuagcugag

SEQ ID NO: 2402018 - RNA, 15 nt, Human
auaccucuuagcuga

SEQ ID NO: 2402019 - RNA, 17 nt, Human
auaccucugugugcucc

SEQ ID NO: 2402020 - RNA, 16 nt, Human
auaccucugugugcuc

SEQ ID NO: 2402021 - RNA, 20 nt, Human
auaccucuuagcugagugga

SEQ ID NO: 2402022 - RNA, 17 nt, Human
auaccucuuagcugagu

SEQ ID NO: 2402023 - RNA, 20 nt, Human
auaccugauuuuuuuuccuu

SEQ ID NO: 2402024 - RNA, 17 nt, Human
auaccugggauacugug

SEQ ID NO: 2402025 - RNA, 13 nt, Human
auaccuaaaagag

SEQ ID NO: 2402026 - RNA, 12 nt, Human
auacccuccccc

SEQ ID NO: 2402027 - RNA, 19 nt, Human
auacccuggccgcccccug

SEQ ID NO: 2402028 - RNA, 15 nt, Human
auaccuacauguauu

SEQ ID NO: 2402029 - RNA, 12 nt, Human
auaccugucccc

SEQ ID NO: 2402030 - RNA, 18 nt, Human
auaccugggcauacuaau

SEQ ID NO: 2402031 - RNA, 11 nt, Human
auaccugcccu

SEQ ID NO: 2402032 - RNA, 20 nt, Human
auaccugggauacugugccc

SEQ ID NO: 2402033 - RNA, 16 nt, Human
aguuacagcugugauu

SEQ ID NO: 2402034 - RNA, 13 nt, Human
aguuacagcugug

SEQ ID NO: 2402035 - RNA, 23 nt, Human
aguuacagcgagaggcagagaaa

SEQ ID NO: 2402036 - RNA, 22 nt, Human
aguuacagcgagaggcagagaa

SEQ ID NO: 2402037 - RNA, 14 nt, Human
aguuaagaguagca

SEQ ID NO: 2402038 - RNA, 22 nt, Human
aguuaagaagcuguuguacauu

SEQ ID NO: 2402039 - RNA, 20 nt, Human
aguuacagccuguuaguaac

SEQ ID NO: 2402040 - RNA, 17 nt, Human
aguuacagcgagaggca

SEQ ID NO: 2402041 - RNA, 22 nt, Human
aguuacagccuguuaguaacau

SEQ ID NO: 2402042 - RNA, 13 nt, Human
aguuaagaccugg

SEQ ID NO: 2402043 - RNA, 16 nt, Human
aguuaagaccuggcag

SEQ ID NO: 2402044 - RNA, 17 nt, Human
aguuaagaccuggcagc

SEQ ID NO: 2402045 - RNA, 18 nt, Human
aguuacagacaaagcgug

SEQ ID NO: 2402046 - RNA, 17 nt, Human
aguuacaugcauacuuc

SEQ ID NO: 2402047 - RNA, 21 nt, Human
aguuacaugcauacuucaaaa

SEQ ID NO: 2402048 - RNA, 20 nt, Human
aguuacaugcauacuucaaa

SEQ ID NO: 2402049 - RNA, 21 nt, Human
aguugaaugacaacagaagcu

SEQ ID NO: 2402050 - RNA, 22 nt, Human
aguuacaugcauacuucaaaag

SEQ ID NO: 2402051 - RNA, 23 nt, Human
aguugaauugaggggauuaauau

SEQ ID NO: 2402052 - RNA, 20 nt, Human
aguugaauggccugccuuga

SEQ ID NO: 2402053 - RNA, 18 nt, Human
aguuguaccgcaauguga

SEQ ID NO: 2402054 - RNA, 19 nt, Human
aguuguaccgcaaugugac

SEQ ID NO: 2402055 - RNA, 17 nt, Human
aguuguagaauguauug

SEQ ID NO: 2402056 - RNA, 16 nt, Human
aguuguagaauguauu

SEQ ID NO: 2402057 - RNA, 13 nt, Human
aguuguagaaugu

SEQ ID NO: 2402058 - RNA, 20 nt, Human
aguuguaucagcacgugugg

SEQ ID NO: 2402059 - RNA, 23 nt, Human
aguuguaucagcacguguggccu

SEQ ID NO: 2402060 - RNA, 21 nt, Human
aguuguagaauguauuguacc

SEQ ID NO: 2402061 - RNA, 20 nt, Human
aguuguagaauguauuguac

SEQ ID NO: 2402062 - RNA, 18 nt, Human
aguuguagaauguauugu

SEQ ID NO: 2402063 - RNA, 21 nt, Human
aguuguaggcgaaucauuugu

SEQ ID NO: 2402064 - RNA, 22 nt, Human
aguuguaggcgaaucauuuguu

SEQ ID NO: 2402065 - RNA, 17 nt, Human
aguuguaucucuuuuga

SEQ ID NO: 2402066 - RNA, 22 nt, Human
aguuguaucucuuuugaaucca

SEQ ID NO: 2402067 - RNA, 14 nt, Human
aguuguaucucuuu

SEQ ID NO: 2402068 - RNA, 15 nt, Human
aguuguaucucuuuu

SEQ ID NO: 2402069 - RNA, 16 nt, Human
aguuguaucucuuuug

SEQ ID NO: 2402070 - RNA, 19 nt, Human
aguugucaagucucugcug

SEQ ID NO: 2402071 - RNA, 13 nt, Human
aguuguuacauuu

SEQ ID NO: 2402072 - RNA, 15 nt, Human
aguuguuacauuuuu

SEQ ID NO: 2402073 - RNA, 16 nt, Human
aguuguuacauuuuua

SEQ ID NO: 2402074 - RNA, 16 nt, Human
aguuguuaauaaaagu

SEQ ID NO: 2402075 - RNA, 23 nt, Human
aguuguuaauaaaaguacauguu

SEQ ID NO: 2402076 - RNA, 21 nt, Human
aguuaagaagcuguuguacau

SEQ ID NO: 2402077 - RNA, 20 nt, Human
aguuaagaagcuguuguaca

SEQ ID NO: 2402078 - RNA, 18 nt, Human
aguuaagaagcuguugua

SEQ ID NO: 2402079 - RNA, 17 nt, Human
aguuaagaagcuguugu

SEQ ID NO: 2402080 - RNA, 19 nt, Human
aguuaagacaugauuuccu

SEQ ID NO: 2402081 - RNA, 20 nt, Human
aguuaagacaugauuuccuu

SEQ ID NO: 2402082 - RNA, 16 nt, Human
aguuaagaagcuguug

SEQ ID NO: 2402083 - RNA, 15 nt, Human
aguuaagaagcuguu

SEQ ID NO: 2402084 - RNA, 12 nt, Human
aguuaagaagcu

SEQ ID NO: 2402085 - RNA, 18 nt, Human
aguuaacuuuaagacuga

SEQ ID NO: 2402086 - RNA, 14 nt, Human
aguuaacuuucaga

SEQ ID NO: 2402087 - RNA, 16 nt, Human
aguuaacuauuuuauu

SEQ ID NO: 2402088 - RNA, 18 nt, Human
agugauuaccagggacug

SEQ ID NO: 2402089 - RNA, 15 nt, Human
agugauuaccaggga

SEQ ID NO: 2402090 - RNA, 19 nt, Human
agugauucucaugccucag

SEQ ID NO: 2402091 - RNA, 18 nt, Human
agugauucucaugccuca

SEQ ID NO: 2402092 - RNA, 16 nt, Human
agugaucacagcagcu

SEQ ID NO: 2402093 - RNA, 15 nt, Human
agugaucacagcagc

SEQ ID NO: 2402094 - RNA, 14 nt, Human
agugaucacagcag

SEQ ID NO: 2402095 - RNA, 20 nt, Human
agugaucaauaaaaugugau

SEQ ID NO: 2402096 - RNA, 16 nt, Human
agugucuuuccacucc

SEQ ID NO: 2402097 - RNA, 23 nt, Human
agugucuuuccacggagccacuc

SEQ ID NO: 2402098 - RNA, 14 nt, Human
agugauuacuguca

SEQ ID NO: 2402099 - RNA, 19 nt, Human
agugucuucacggcaggac

SEQ ID NO: 2402100 - RNA, 13 nt, Human
agugucuuccaua

SEQ ID NO: 2402101 - RNA, 14 nt, Human
agugucuuccauaa

SEQ ID NO: 2402102 - RNA, 13 nt, Human
agugucuuuccac

SEQ ID NO: 2402103 - RNA, 14 nt, Human
agugucuuccugug

SEQ ID NO: 2402104 - RNA, 15 nt, Human
agugucuuccauaau

SEQ ID NO: 2402105 - RNA, 23 nt, Human
agugugaacuggacccuguugcu

SEQ ID NO: 2402106 - RNA, 22 nt, Human
agugugaacuggacccuguugc

SEQ ID NO: 2402107 - RNA, 22 nt, Human
agugugaacaaaagaugcucuu

SEQ ID NO: 2402108 - RNA, 13 nt, Human
agugugaacaaaa

SEQ ID NO: 2402109 - RNA, 14 nt, Human
agugugaacuggac

SEQ ID NO: 2402110 - RNA, 16 nt, Human
agugucuuccuguggg

SEQ ID NO: 2402111 - RNA, 15 nt, Human
agugugaaauagaca

SEQ ID NO: 2402112 - RNA, 23 nt, Human
agugugacaaggauugcuacugu

SEQ ID NO: 2402113 - RNA, 22 nt, Human
agugugaaguuagaauuccuuc

SEQ ID NO: 2402114 - RNA, 21 nt, Human
agugugaaguuagaauuccuu

SEQ ID NO: 2402115 - RNA, 20 nt, Human
agugugaaguuagaauuccu

SEQ ID NO: 2402116 - RNA, 18 nt, Human
agugugaaguuagaauuc

SEQ ID NO: 2402117 - RNA, 15 nt, Human
agugugaaguuagaa

SEQ ID NO: 2402118 - RNA, 14 nt, Human
agugugaaguuaga

SEQ ID NO: 2402119 - RNA, 13 nt, Human
agugugaaguuag

SEQ ID NO: 2402120 - RNA, 12 nt, Human
agugugaaguua

SEQ ID NO: 2402121 - RNA, 20 nt, Human
agugugaagcuuccuuggcu

SEQ ID NO: 2402122 - RNA, 22 nt, Human
agugauauggcagaagacacca

SEQ ID NO: 2402123 - RNA, 21 nt, Human
agugauauggcagaagacacc

SEQ ID NO: 2402124 - RNA, 24 nt, Human
agugauauggcagaagacaccaga

SEQ ID NO: 2402125 - RNA, 19 nt, Human
agugauauggcagaagaca

SEQ ID NO: 2402126 - RNA, 16 nt, Human
agugaucaauaaaaug

SEQ ID NO: 2402127 - RNA, 17 nt, Human
agugaucaauaaaaugu

SEQ ID NO: 2402128 - RNA, 19 nt, Human
agugaucaauaaaauguga

SEQ ID NO: 2402129 - RNA, 13 nt, Human
agugauccuccca

SEQ ID NO: 2402130 - RNA, 17 nt, Human
agugacagacaggcucu

SEQ ID NO: 2402131 - RNA, 16 nt, Human
agugacagacaggcuc

SEQ ID NO: 2402132 - RNA, 21 nt, Human
agugacagaccacaucuuuau

SEQ ID NO: 2402133 - RNA, 23 nt, Human
agugacacuucagagagcuggua

SEQ ID NO: 2402134 - RNA, 18 nt, Human
agugacacagcagcuuca

SEQ ID NO: 2402135 - RNA, 17 nt, Human
agugacacagcagcuuc

SEQ ID NO: 2402136 - RNA, 23 nt, Human
agugacacagcagcuucaccaga

SEQ ID NO: 2402137 - RNA, 15 nt, Human
agugacacuucagag

SEQ ID NO: 2402138 - RNA, 18 nt, Human
agugacacuucagagagc

SEQ ID NO: 2402139 - RNA, 20 nt, Human
agugacacuucagagagcug

SEQ ID NO: 2402140 - RNA, 21 nt, Human
agugacacuucagagagcugg

SEQ ID NO: 2402141 - RNA, 22 nt, Human
agugacacuucagagagcuggu

SEQ ID NO: 2402142 - RNA, 14 nt, Human
agugacaaggcccc

SEQ ID NO: 2402143 - RNA, 15 nt, Human
agugacaaggcccca

SEQ ID NO: 2402144 - RNA, 16 nt, Human
agugacaaggccccag

SEQ ID NO: 2402145 - RNA, 18 nt, Human
agugacaaggccccagag

SEQ ID NO: 2402146 - RNA, 20 nt, Human
agugacaaggccccagagac

SEQ ID NO: 2402147 - RNA, 21 nt, Human
agugacaaggccccagagacu

SEQ ID NO: 2402148 - RNA, 13 nt, Human
agugacacagcag

SEQ ID NO: 2402149 - RNA, 23 nt, Human
agugacaaggccccagagacuca

SEQ ID NO: 2402150 - RNA, 23 nt, Human
agugaauuuuucucuaacucaga

SEQ ID NO: 2402151 - RNA, 20 nt, Human
aguccuggaagccagcuuuc

SEQ ID NO: 2402152 - RNA, 22 nt, Human
aguccuggaagccagcuuuccc

SEQ ID NO: 2402153 - RNA, 23 nt, Human
aguccuggaagccagcuuucccu

SEQ ID NO: 2402154 - RNA, 14 nt, Human
aguccuggaagcca

SEQ ID NO: 2402155 - RNA, 16 nt, Human
aguccugccucagccu

SEQ ID NO: 2402156 - RNA, 13 nt, Human
aguccugccuggc

SEQ ID NO: 2402157 - RNA, 14 nt, Human
aguccugccuggcc

SEQ ID NO: 2402158 - RNA, 15 nt, Human
aguccugccuggcca

SEQ ID NO: 2402159 - RNA, 16 nt, Human
aguccugccuggccag

SEQ ID NO: 2402160 - RNA, 17 nt, Human
aguccugccuggccagg

SEQ ID NO: 2402161 - RNA, 20 nt, Human
aguccugccuggccaggcag

SEQ ID NO: 2402162 - RNA, 21 nt, Human
aguccugccuggccaggcaga

SEQ ID NO: 2402163 - RNA, 20 nt, Human
aguccacucccagugcuugc

SEQ ID NO: 2402164 - RNA, 16 nt, Human
aguccacucccagugc

SEQ ID NO: 2402165 - RNA, 14 nt, Human
aguccacucccagu

SEQ ID NO: 2402166 - RNA, 14 nt, Human
aguccacuuuguuu

SEQ ID NO: 2402167 - RNA, 12 nt, Human
aguccaccugag

SEQ ID NO: 2402168 - RNA, 18 nt, Human
aguccaaugucuuuuuaa

SEQ ID NO: 2402169 - RNA, 17 nt, Human
aguccaccugagcugcc

SEQ ID NO: 2402170 - RNA, 20 nt, Human
agucaagugcguccacgagc

SEQ ID NO: 2402171 - RNA, 17 nt, Human
agucaauauuuuuagau

SEQ ID NO: 2402172 - RNA, 20 nt, Human
agucaagugaaaaaggagga

SEQ ID NO: 2402173 - RNA, 13 nt, Human
agucaaauugugu

SEQ ID NO: 2402174 - RNA, 17 nt, Human
agucaaauugugugaaa

SEQ ID NO: 2402175 - RNA, 15 nt, Human
agucaaauuguguga

SEQ ID NO: 2402176 - RNA, 15 nt, Human
agucaaccugccuga

SEQ ID NO: 2402177 - RNA, 19 nt, Human
agucaagaaaaauuauugu

SEQ ID NO: 2402178 - RNA, 12 nt, Human
agucaagaaaaa

SEQ ID NO: 2402179 - RNA, 14 nt, Human
agucaaccugggca

SEQ ID NO: 2402180 - RNA, 15 nt, Human
agucaaccugggcaa

SEQ ID NO: 2402181 - RNA, 18 nt, Human
agucaaggguaggguggg

SEQ ID NO: 2402182 - RNA, 16 nt, Human
agucaagugaaaaagg

SEQ ID NO: 2402183 - RNA, 15 nt, Human
agucaagcuccuccu

SEQ ID NO: 2402184 - RNA, 16 nt, Human
agucaagcuccuccuc

SEQ ID NO: 2402185 - RNA, 17 nt, Human
agucaagcuccuccucc

SEQ ID NO: 2402186 - RNA, 18 nt, Human
agucaagcuccuccuccc

SEQ ID NO: 2402187 - RNA, 13 nt, Human
agucaagcuccuc

SEQ ID NO: 2402188 - RNA, 14 nt, Human
agucaagcuccucc

SEQ ID NO: 2402189 - RNA, 15 nt, Human
agucaagagcauccu

SEQ ID NO: 2402190 - RNA, 20 nt, Human
agucaagcuccuccucccug

SEQ ID NO: 2402191 - RNA, 22 nt, Human
agucaagcuccuccucccugca

SEQ ID NO: 2402192 - RNA, 16 nt, Human
agucaaggaguggcuu

SEQ ID NO: 2402193 - RNA, 20 nt, Human
agucauuauagaucccccag

SEQ ID NO: 2402194 - RNA, 19 nt, Human
agucauuauagauccccca

SEQ ID NO: 2402195 - RNA, 20 nt, Human
agucauuagacuccuccucc

SEQ ID NO: 2402196 - RNA, 19 nt, Human
agucauuagacuccuccuc

SEQ ID NO: 2402197 - RNA, 18 nt, Human
agucauuagacuccuccu

SEQ ID NO: 2402198 - RNA, 16 nt, Human
agucauuagacuccuc

SEQ ID NO: 2402199 - RNA, 15 nt, Human
agucauuagacuccu

SEQ ID NO: 2402200 - RNA, 14 nt, Human
agucauuagacucc

SEQ ID NO: 2402201 - RNA, 20 nt, Human
agucauuauccuugcuauga

SEQ ID NO: 2402202 - RNA, 18 nt, Human
agucauuauccuugcuau

SEQ ID NO: 2402203 - RNA, 23 nt, Human
agucauuauagaucccccagacu

SEQ ID NO: 2402204 - RNA, 21 nt, Human
agucauuauagaucccccaga

SEQ ID NO: 2402205 - RNA, 22 nt, Human
agucauuaugagaggcaaugau

SEQ ID NO: 2402206 - RNA, 21 nt, Human
aguccaagcauuuagauguau

SEQ ID NO: 2402207 - RNA, 11 nt, Human
aguccaagcug

SEQ ID NO: 2402208 - RNA, 14 nt, Human
aguccaagcuggga

SEQ ID NO: 2402209 - RNA, 18 nt, Human
aguccaaggaaaccacag

SEQ ID NO: 2402210 - RNA, 16 nt, Human
aguccaagcugggaga

SEQ ID NO: 2402211 - RNA, 23 nt, Human
aguccaaggaaaccacagcugcu

SEQ ID NO: 2402212 - RNA, 21 nt, Human
aguccaaggaaaccacagcug

SEQ ID NO: 2402213 - RNA, 14 nt, Human
aguccaauguggca

SEQ ID NO: 2402214 - RNA, 14 nt, Human
aguccacaaaauaa

SEQ ID NO: 2402215 - RNA, 20 nt, Human
aguccaaucucauggagaag

SEQ ID NO: 2402216 - RNA, 17 nt, Human
aguccaaugucuuuuua

SEQ ID NO: 2402217 - RNA, 16 nt, Human
aguccaagcauuuaga

SEQ ID NO: 2402218 - RNA, 22 nt, Human
agucauuggcuuuauccucuuu

SEQ ID NO: 2402219 - RNA, 21 nt, Human
agucauuggcuuuauccucuu

SEQ ID NO: 2402220 - RNA, 20 nt, Human
agucauuggcuuuauccucu

SEQ ID NO: 2402221 - RNA, 18 nt, Human
agucauuggcuuuauccu

SEQ ID NO: 2402222 - RNA, 15 nt, Human
agucauuggcuuuau

SEQ ID NO: 2402223 - RNA, 14 nt, Human
agucauuggcuuua

SEQ ID NO: 2402224 - RNA, 15 nt, Human
agucauuggcugucu

SEQ ID NO: 2402225 - RNA, 17 nt, Human
agucauucguucugugg

SEQ ID NO: 2402226 - RNA, 17 nt, Human
aucuugaagacuuuucu

SEQ ID NO: 2402227 - RNA, 21 nt, Human
aucuugaaauuaagaaggcaa

SEQ ID NO: 2402228 - RNA, 22 nt, Human
aucuugaaauuaagaaggcaaa

SEQ ID NO: 2402229 - RNA, 23 nt, Human
aucuugaaauuaagaaggcaaaa

SEQ ID NO: 2402230 - RNA, 17 nt, Human
aucuugaaaugaaagua

SEQ ID NO: 2402231 - RNA, 21 nt, Human
aucuucuuugcagccugggug

SEQ ID NO: 2402232 - RNA, 14 nt, Human
aucuucuuugcagc

SEQ ID NO: 2402233 - RNA, 12 nt, Human
aucuugaaauua

SEQ ID NO: 2402234 - RNA, 17 nt, Human
aucuucuuuauaauucu

SEQ ID NO: 2402235 - RNA, 21 nt, Human
aucuucucagcucccauuucu

SEQ ID NO: 2402236 - RNA, 16 nt, Human
aucuucucagcuccca

SEQ ID NO: 2402237 - RNA, 15 nt, Human
aucuucucagcuccc

SEQ ID NO: 2402238 - RNA, 14 nt, Human
aucuucucagcucc

SEQ ID NO: 2402239 - RNA, 13 nt, Human
aucuucucagcuc

SEQ ID NO: 2402240 - RNA, 12 nt, Human
aucuucucagcu

SEQ ID NO: 2402241 - RNA, 24 nt, Human
aucuucucagaaggcaaaugacuu

SEQ ID NO: 2402242 - RNA, 15 nt, Human
aucuucuccaggaug

SEQ ID NO: 2402243 - RNA, 22 nt, Human
aucuucucagcucccauuucua

SEQ ID NO: 2402244 - RNA, 15 nt, Human
aucuucuccaucugg

SEQ ID NO: 2402245 - RNA, 19 nt, Human
aucuucuccaucuggcagg

SEQ ID NO: 2402246 - RNA, 14 nt, Human
aucuucucuggcga

SEQ ID NO: 2402247 - RNA, 22 nt, Human
aucuucuccaucuggcagggug

SEQ ID NO: 2402248 - RNA, 14 nt, Human
aucucguuucaaaa

SEQ ID NO: 2402249 - RNA, 23 nt, Human
aucucguuuuucuucuuaagacu

SEQ ID NO: 2402250 - RNA, 22 nt, Human
aucucguuuuucuucuuaagac

SEQ ID NO: 2402251 - RNA, 17 nt, Human
aucucguuucaaaaaca

SEQ ID NO: 2402252 - RNA, 15 nt, Human
aucucguuucaaaaa

SEQ ID NO: 2402253 - RNA, 15 nt, Human
aucucuaauauggca

SEQ ID NO: 2402254 - RNA, 13 nt, Human
aucucuaauaugg

SEQ ID NO: 2402255 - RNA, 18 nt, Human
aucucuaacagcucagga

SEQ ID NO: 2402256 - RNA, 20 nt, Human
aucucuaacagcucaggauc

SEQ ID NO: 2402257 - RNA, 21 nt, Human
aucucuagaauuuuaagugcu

SEQ ID NO: 2402258 - RNA, 15 nt, Human
aucucuagaauuuua

SEQ ID NO: 2402259 - RNA, 16 nt, Human
aucucuagaauuuuaa

SEQ ID NO: 2402260 - RNA, 18 nt, Human
aucucuagaauuuuaagu

SEQ ID NO: 2402261 - RNA, 15 nt, Human
aucucuaauuggaag

SEQ ID NO: 2402262 - RNA, 22 nt, Human
aucucuaauauggcaaaaaugg

SEQ ID NO: 2402263 - RNA, 23 nt, Human
aucucuaauuggaagaaauuccu

SEQ ID NO: 2402264 - RNA, 18 nt, Human
aucucuacuaaaaauaca

SEQ ID NO: 2402265 - RNA, 22 nt, Human
aucucucgugauugauaagaac

SEQ ID NO: 2402266 - RNA, 16 nt, Human
aucucuauuuaauauu

SEQ ID NO: 2402267 - RNA, 15 nt, Human
aucucuauuuaauau

SEQ ID NO: 2402268 - RNA, 14 nt, Human
aucucuauuuaaua

SEQ ID NO: 2402269 - RNA, 13 nt, Human
aucucuauuuaau

SEQ ID NO: 2402270 - RNA, 21 nt, Human
aucucucuacuccuaccucag

SEQ ID NO: 2402271 - RNA, 22 nt, Human
aucucucuacuccuaccucagc

SEQ ID NO: 2402272 - RNA, 11 nt, Human
aucuggaaccu

SEQ ID NO: 2402273 - RNA, 16 nt, Human
aucuggaaccucagcc

SEQ ID NO: 2402274 - RNA, 17 nt, Human
aucuggaaccucagccu

SEQ ID NO: 2402275 - RNA, 18 nt, Human
aucuggaaccucagccug

SEQ ID NO: 2402276 - RNA, 19 nt, Human
aucuggaacccagacucag

SEQ ID NO: 2402277 - RNA, 23 nt, Human
aucuggaacccagacucagacau

SEQ ID NO: 2402278 - RNA, 14 nt, Human
aucugcuggaguuu

SEQ ID NO: 2402279 - RNA, 18 nt, Human
aucugcuggaguuucaug

SEQ ID NO: 2402280 - RNA, 21 nt, Human
aucugcucuccuuccuggagc

SEQ ID NO: 2402281 - RNA, 13 nt, Human
aucugcuccuccc

SEQ ID NO: 2402282 - RNA, 23 nt, Human
aucugcuguccagacagccugua

SEQ ID NO: 2402283 - RNA, 22 nt, Human
aucugcuguccagacagccugu

SEQ ID NO: 2402284 - RNA, 21 nt, Human
aucugcuguccagacagccug

SEQ ID NO: 2402285 - RNA, 18 nt, Human
aucugcuguccagacagc

SEQ ID NO: 2402286 - RNA, 17 nt, Human
aucugcuguccagacag

SEQ ID NO: 2402287 - RNA, 16 nt, Human
aucugcuguccagaca

SEQ ID NO: 2402288 - RNA, 11 nt, Human
aucugcugucc

SEQ ID NO: 2402289 - RNA, 20 nt, Human
aucugcucuccuuccuggag

SEQ ID NO: 2402290 - RNA, 17 nt, Human
aucugcucuccuuccug

SEQ ID NO: 2402291 - RNA, 16 nt, Human
aucugcucuccuuccu

SEQ ID NO: 2402292 - RNA, 15 nt, Human
aucugcucuccuucc

SEQ ID NO: 2402293 - RNA, 23 nt, Human
aucucucugugcuguggaagcaa

SEQ ID NO: 2402294 - RNA, 18 nt, Human
aucucucugugcugugga

SEQ ID NO: 2402295 - RNA, 20 nt, Human
aucugcucagcccuggaggu

SEQ ID NO: 2402296 - RNA, 19 nt, Human
aucugcucagcccuggagg

SEQ ID NO: 2402297 - RNA, 14 nt, Human
aucugcucuccuuc

SEQ ID NO: 2402298 - RNA, 13 nt, Human
aucugcucuccuu

SEQ ID NO: 2402299 - RNA, 14 nt, Human
aucucucugcccaa

SEQ ID NO: 2402300 - RNA, 23 nt, Human
aucucucuacuccuaccucagcc

SEQ ID NO: 2402301 - RNA, 22 nt, Human
aucucucugaauccuaagggcu

SEQ ID NO: 2402302 - RNA, 14 nt, Human
aucucucuggcccu

SEQ ID NO: 2402303 - RNA, 13 nt, Human
aucucucuggccc

SEQ ID NO: 2402304 - RNA, 12 nt, Human
aucucucuggcc

SEQ ID NO: 2402305 - RNA, 20 nt, Human
aucucucgguuccacguccc

SEQ ID NO: 2402306 - RNA, 15 nt, Human
aucucucuucuuuuc

SEQ ID NO: 2402307 - RNA, 13 nt, Human
aucuucuaaaugg

SEQ ID NO: 2402308 - RNA, 19 nt, Human
aucuuccaacucaaacucu

SEQ ID NO: 2402309 - RNA, 14 nt, Human
aucuucaguuuuau

SEQ ID NO: 2402310 - RNA, 20 nt, Human
aucuucaguuuuaucuuuaa

SEQ ID NO: 2402311 - RNA, 22 nt, Human
aucuucaguuuuaucuuuaauc

SEQ ID NO: 2402312 - RNA, 22 nt, Human
aucuucaccagaggaaucacuc

SEQ ID NO: 2402313 - RNA, 21 nt, Human
aucuucaccagaggaaucacu

SEQ ID NO: 2402314 - RNA, 15 nt, Human
aucuucagcuucuuc

SEQ ID NO: 2402315 - RNA, 14 nt, Human
aucuucagcuucuu

SEQ ID NO: 2402316 - RNA, 13 nt, Human
aucuucagcuucu

SEQ ID NO: 2402317 - RNA, 12 nt, Human
aucuucagcuuc

SEQ ID NO: 2402318 - RNA, 18 nt, Human
aucuucagagcagggguc

SEQ ID NO: 2402319 - RNA, 14 nt, Human
aucuucagagcagg

SEQ ID NO: 2402320 - RNA, 13 nt, Human
aucuucacuucua

SEQ ID NO: 2402321 - RNA, 23 nt, Human
aucuucacuucuaaaugcauauc

SEQ ID NO: 2402322 - RNA, 20 nt, Human
aucuuaucauggucucaguc

SEQ ID NO: 2402323 - RNA, 18 nt, Human
aucuuaucauggucucag

SEQ ID NO: 2402324 - RNA, 22 nt, Human
aucuuauaauuuaaaauaugcu

SEQ ID NO: 2402325 - RNA, 22 nt, Human
aucugggcuccuaaccuuccug

SEQ ID NO: 2402326 - RNA, 17 nt, Human
aucugggccagaauuuc

SEQ ID NO: 2402327 - RNA, 19 nt, Human
aucuggaaccucagccugg

SEQ ID NO: 2402328 - RNA, 20 nt, Human
aucuggaaccucagccuggc

SEQ ID NO: 2402329 - RNA, 21 nt, Human
aucuggaaccucagccuggcc

SEQ ID NO: 2402330 - RNA, 22 nt, Human
aucuggaaccucagccuggcca

SEQ ID NO: 2402331 - RNA, 21 nt, Human
aucuggaaucuggagaccagg

SEQ ID NO: 2402332 - RNA, 20 nt, Human
aucuggaaggggaucccacc

SEQ ID NO: 2402333 - RNA, 21 nt, Human
aucuggaagccaaaauguagg

SEQ ID NO: 2402334 - RNA, 19 nt, Human
aucuggaccccaucuguga

SEQ ID NO: 2402335 - RNA, 17 nt, Human
aucugggacccuuuccu

SEQ ID NO: 2402336 - RNA, 20 nt, Human
aucugggacccuuuccuucc

SEQ ID NO: 2402337 - RNA, 22 nt, Human
aucugggacccuuuccuuccuu

SEQ ID NO: 2402338 - RNA, 18 nt, Human
aucugggaguccccuuuu

SEQ ID NO: 2402339 - RNA, 23 nt, Human
aucugggacccuuuccuuccuuc

SEQ ID NO: 2402340 - RNA, 15 nt, Human
aucugggccagaauu

SEQ ID NO: 2402341 - RNA, 22 nt, Human
aucugggauucccaccaagguc

SEQ ID NO: 2402342 - RNA, 20 nt, Human
aucugggaguccccuuuucu

SEQ ID NO: 2402343 - RNA, 18 nt, Human
aucugggcauagaugcag

SEQ ID NO: 2402344 - RNA, 16 nt, Human
augagcuauguauuaa

SEQ ID NO: 2402345 - RNA, 15 nt, Human
augagcuauguauua

SEQ ID NO: 2402346 - RNA, 14 nt, Human
augagcuauguauu

SEQ ID NO: 2402347 - RNA, 22 nt, Human
augacucccuuaaaauagaaau

SEQ ID NO: 2402348 - RNA, 19 nt, Human
augagcuacgccugccucc

SEQ ID NO: 2402349 - RNA, 23 nt, Human
augagcuauuuccauuccagaau

SEQ ID NO: 2402350 - RNA, 22 nt, Human
augagcuauuuccauuccagaa

SEQ ID NO: 2402351 - RNA, 21 nt, Human
augagcuauuuccauuccaga

SEQ ID NO: 2402352 - RNA, 20 nt, Human
augagcuauuuccauuccag

SEQ ID NO: 2402353 - RNA, 13 nt, Human
augagcuccagac

SEQ ID NO: 2402354 - RNA, 13 nt, Human
augagccuggcaa

SEQ ID NO: 2402355 - RNA, 14 nt, Human
augagccuggcaag

SEQ ID NO: 2402356 - RNA, 14 nt, Human
aucuuuuuucaaaa

SEQ ID NO: 2402357 - RNA, 17 nt, Human
augaaaaaauauauauc

SEQ ID NO: 2402358 - RNA, 14 nt, Human
augaaaaaauauau

SEQ ID NO: 2402359 - RNA, 22 nt, Human
augaaaaaauauauaucaaaua

SEQ ID NO: 2402360 - RNA, 17 nt, Human
aucuuuuuucacaaauu

SEQ ID NO: 2402361 - RNA, 14 nt, Human
aucuuuuuucacaa

SEQ ID NO: 2402362 - RNA, 20 nt, Human
aucuuuuuuuuauuccacau

SEQ ID NO: 2402363 - RNA, 13 nt, Human
augaaaacaugua

SEQ ID NO: 2402364 - RNA, 17 nt, Human
augaaacccccacacac

SEQ ID NO: 2402365 - RNA, 18 nt, Human
augaaacccccacacaca

SEQ ID NO: 2402366 - RNA, 18 nt, Human
augaagcuuguguaucca

SEQ ID NO: 2402367 - RNA, 19 nt, Human
augaaacccccacacacac

SEQ ID NO: 2402368 - RNA, 15 nt, Human
augaaacccccacac

SEQ ID NO: 2402369 - RNA, 16 nt, Human
augaaacccccacaca

SEQ ID NO: 2402370 - RNA, 18 nt, Human
augaaacagaaacaaaaa

SEQ ID NO: 2402371 - RNA, 22 nt, Human
augaaacagaaacaaaaacacu

SEQ ID NO: 2402372 - RNA, 19 nt, Human
augaaacaccuucucugga

SEQ ID NO: 2402373 - RNA, 17 nt, Human
augaaacaccuucucug

SEQ ID NO: 2402374 - RNA, 13 nt, Human
augaaacagaaac

SEQ ID NO: 2402375 - RNA, 20 nt, Human
augaaacacucaguuguuca

SEQ ID NO: 2402376 - RNA, 16 nt, Human
augaaacaccuucucu

SEQ ID NO: 2402377 - RNA, 12 nt, Human
augaaacaccuu

SEQ ID NO: 2402378 - RNA, 14 nt, Human
augaaaauuguaug

SEQ ID NO: 2402379 - RNA, 16 nt, Human
augaaaaugucuugug

SEQ ID NO: 2402380 - RNA, 22 nt, Human
augaaaauacaacuuaaauaau

SEQ ID NO: 2402381 - RNA, 13 nt, Human
augaaaauacaac

SEQ ID NO: 2402382 - RNA, 17 nt, Human
augaaaauacaacuuaa

SEQ ID NO: 2402383 - RNA, 12 nt, Human
augaaaacucau

SEQ ID NO: 2402384 - RNA, 19 nt, Human
augaaaacguuuuauugug

SEQ ID NO: 2402385 - RNA, 12 nt, Human
augaaaacuuau

SEQ ID NO: 2402386 - RNA, 21 nt, Human
augaaaaaaggacaauuucaa

SEQ ID NO: 2402387 - RNA, 18 nt, Human
augaaaacguuuuauugu

SEQ ID NO: 2402388 - RNA, 20 nt, Human
augaaaacguuuuauugugu

SEQ ID NO: 2402389 - RNA, 21 nt, Human
augaagcuuuuaugugaaaca

SEQ ID NO: 2402390 - RNA, 20 nt, Human
augaagcuuuuaugugaaac

SEQ ID NO: 2402391 - RNA, 19 nt, Human
augaagcuuuuaugugaaa

SEQ ID NO: 2402392 - RNA, 18 nt, Human
augaagcuuuuaugugaa

SEQ ID NO: 2402393 - RNA, 18 nt, Human
augaccuaguuuuccaug

SEQ ID NO: 2402394 - RNA, 23 nt, Human
augacccugcgaaggggcccugg

SEQ ID NO: 2402395 - RNA, 18 nt, Human
augaccucuuccuuuagg

SEQ ID NO: 2402396 - RNA, 16 nt, Human
augaccucaugcaucu

SEQ ID NO: 2402397 - RNA, 12 nt, Human
augacccagugg

SEQ ID NO: 2402398 - RNA, 23 nt, Human
augaagcuuuauacguguagcua

SEQ ID NO: 2402399 - RNA, 19 nt, Human
augaagcuuguguauccau

SEQ ID NO: 2402400 - RNA, 22 nt, Human
augacccaggcugggcaaggag

SEQ ID NO: 2402401 - RNA, 11 nt, Human
augaccccucc

SEQ ID NO: 2402402 - RNA, 16 nt, Human
augacuccagaauuuc

SEQ ID NO: 2402403 - RNA, 12 nt, Human
augacuccagaa

SEQ ID NO: 2402404 - RNA, 16 nt, Human
augacucggggguggg

SEQ ID NO: 2402405 - RNA, 17 nt, Human
augacuccagaauuucc

SEQ ID NO: 2402406 - RNA, 22 nt, Human
augacuagaggcagggagggga

SEQ ID NO: 2402407 - RNA, 14 nt, Human
augaccuggauaac

SEQ ID NO: 2402408 - RNA, 19 nt, Human
augaccugugaccagcacu

SEQ ID NO: 2402409 - RNA, 21 nt, Human
augaccugugaccagcacugu

SEQ ID NO: 2402410 - RNA, 15 nt, Human
augacuagaggcagg

SEQ ID NO: 2402411 - RNA, 19 nt, Human
augacuagaggcagggagg

SEQ ID NO: 2402412 - RNA, 14 nt, Human
augacucagaauau

SEQ ID NO: 2402413 - RNA, 17 nt, Human
augacucacaugaugca

SEQ ID NO: 2402414 - RNA, 19 nt, Human
augacucaggacauccccc

SEQ ID NO: 2402415 - RNA, 12 nt, Human
aucaccugcccu

SEQ ID NO: 2402416 - RNA, 13 nt, Human
aucaccugcccug

SEQ ID NO: 2402417 - RNA, 12 nt, Human
aucaccuccccu

SEQ ID NO: 2402418 - RNA, 12 nt, Human
aucaccucaggc

SEQ ID NO: 2402419 - RNA, 15 nt, Human
aucaccucaggccag

SEQ ID NO: 2402420 - RNA, 15 nt, Human
aucaccuccccuccu

SEQ ID NO: 2402421 - RNA, 12 nt, Human
aucaccugaggu

SEQ ID NO: 2402422 - RNA, 14 nt, Human
aucagccaauuaug

SEQ ID NO: 2402423 - RNA, 15 nt, Human
aucagccaauuaugu

SEQ ID NO: 2402424 - RNA, 13 nt, Human
aucaccuccccuc

SEQ ID NO: 2402425 - RNA, 14 nt, Human
aucaccucaggcca

SEQ ID NO: 2402426 - RNA, 19 nt, Human
aucagccaauuauguuaaa

SEQ ID NO: 2402427 - RNA, 18 nt, Human
aucagccaauuauguuaa

SEQ ID NO: 2402428 - RNA, 16 nt, Human
aucagccaauuauguu

SEQ ID NO: 2402429 - RNA, 15 nt, Human
aucagccacauucua

SEQ ID NO: 2402430 - RNA, 20 nt, Human
aucagccuaggggucaggga

SEQ ID NO: 2402431 - RNA, 11 nt, Human
aucagccucuu

SEQ ID NO: 2402432 - RNA, 13 nt, Human
aucagccucuuaa

SEQ ID NO: 2402433 - RNA, 20 nt, Human
aucagccugagucuccugug

SEQ ID NO: 2402434 - RNA, 19 nt, Human
aucagccugagucuccugu

SEQ ID NO: 2402435 - RNA, 18 nt, Human
aucagccugagucuccug

SEQ ID NO: 2402436 - RNA, 17 nt, Human
aucagccugagucuccu

SEQ ID NO: 2402437 - RNA, 12 nt, Human
aucagccugagu

SEQ ID NO: 2402438 - RNA, 15 nt, Human
aucagccucuuaaag

SEQ ID NO: 2402439 - RNA, 11 nt, Human
aucagccuggg

SEQ ID NO: 2402440 - RNA, 20 nt, Human
aucagccugggcaaugugau

SEQ ID NO: 2402441 - RNA, 21 nt, Human
aucagccugggcaaugugaua

SEQ ID NO: 2402442 - RNA, 12 nt, Human
aucagcugcuac

SEQ ID NO: 2402443 - RNA, 22 nt, Human
aucagccugagucuccugugcc

SEQ ID NO: 2402444 - RNA, 17 nt, Human
aucagcugcugaaacaa

SEQ ID NO: 2402445 - RNA, 13 nt, Human
aucagcugcuacu

SEQ ID NO: 2402446 - RNA, 23 nt, Human
aucagcugcuacuacuccuguag

SEQ ID NO: 2402447 - RNA, 18 nt, Human
aucaucuauaaagaagaa

SEQ ID NO: 2402448 - RNA, 13 nt, Human
aucaucugccgug

SEQ ID NO: 2402449 - RNA, 16 nt, Human
aucaucugugugaaaa

SEQ ID NO: 2402450 - RNA, 13 nt, Human
aucaucuguguga

SEQ ID NO: 2402451 - RNA, 18 nt, Human
aucaucuguggaacccau

SEQ ID NO: 2402452 - RNA, 19 nt, Human
aucaucugugugaaaaugg

SEQ ID NO: 2402453 - RNA, 18 nt, Human
aucaucugugugaaaaug

SEQ ID NO: 2402454 - RNA, 12 nt, Human
aucauggaguga

SEQ ID NO: 2402455 - RNA, 19 nt, Human
aucauggagguuugaagau

SEQ ID NO: 2402456 - RNA, 20 nt, Human
aucaucuccugccuuccucc

SEQ ID NO: 2402457 - RNA, 23 nt, Human
aucaucuccugccuuccuccugg

SEQ ID NO: 2402458 - RNA, 21 nt, Human
aucaucuauugcuggcaaaga

SEQ ID NO: 2402459 - RNA, 16 nt, Human
aucaugguguaauaag

SEQ ID NO: 2402460 - RNA, 14 nt, Human
aucaugguguaaua

SEQ ID NO: 2402461 - RNA, 15 nt, Human
aucauggcuaucugu

SEQ ID NO: 2402462 - RNA, 21 nt, Human
aucauggauucauuacagcuu

SEQ ID NO: 2402463 - RNA, 20 nt, Human
aucauggauucauuacagcu

SEQ ID NO: 2402464 - RNA, 21 nt, Human
aucaugguguaauaagacaua

SEQ ID NO: 2402465 - RNA, 14 nt, Human
aucauguacauuuc

SEQ ID NO: 2402466 - RNA, 20 nt, Human
aucaugguguaauaagacau

SEQ ID NO: 2402467 - RNA, 19 nt, Human
aucaugguguaauaagaca

SEQ ID NO: 2402468 - RNA, 18 nt, Human
aucaugguguaauaagac

SEQ ID NO: 2402469 - RNA, 17 nt, Human
aucaugguguaauaaga

SEQ ID NO: 2402470 - RNA, 23 nt, Human
aucaugguguaauaagacauaac

SEQ ID NO: 2402471 - RNA, 13 nt, Human
aucauguacauuu

SEQ ID NO: 2402472 - RNA, 18 nt, Human
aucgcaccauucugacuc

SEQ ID NO: 2402473 - RNA, 17 nt, Human
aucgcaccauucugacu

SEQ ID NO: 2402474 - RNA, 20 nt, Human
aucgcaccacuguguauuua

SEQ ID NO: 2402475 - RNA, 13 nt, Human
auccuuucuaaca

SEQ ID NO: 2402476 - RNA, 15 nt, Human
auccuuucuauugaa

SEQ ID NO: 2402477 - RNA, 15 nt, Human
auccuuucuaaacaa

SEQ ID NO: 2402478 - RNA, 14 nt, Human
auccuccucagauc

SEQ ID NO: 2402479 - RNA, 19 nt, Human
auccuuucugccucucaac

SEQ ID NO: 2402480 - RNA, 17 nt, Human
auccuuucugccucuca

SEQ ID NO: 2402481 - RNA, 16 nt, Human
auccuuuuauguuauu

SEQ ID NO: 2402482 - RNA, 13 nt, Human
auccuuuuauguu

SEQ ID NO: 2402483 - RNA, 18 nt, Human
auccuuuuauguuauuua

SEQ ID NO: 2402484 - RNA, 17 nt, Human
auccuuuuauguuauuu

SEQ ID NO: 2402485 - RNA, 15 nt, Human
auccuuuucugcaga

SEQ ID NO: 2402486 - RNA, 13 nt, Human
aucgauggccuug

SEQ ID NO: 2402487 - RNA, 23 nt, Human
aucgaugggggagucugaagcag

SEQ ID NO: 2402488 - RNA, 22 nt, Human
auccuuuuuaaauucaguccua

SEQ ID NO: 2402489 - RNA, 15 nt, Human
aucgaggaaccagag

SEQ ID NO: 2402490 - RNA, 12 nt, Human
aucgauuggcuu

SEQ ID NO: 2402491 - RNA, 11 nt, Human
aucgauuggcu

SEQ ID NO: 2402492 - RNA, 20 nt, Human
aucgauuuuuaaaaauuaaa

SEQ ID NO: 2402493 - RNA, 15 nt, Human
aucgauguuauguaa

SEQ ID NO: 2402494 - RNA, 13 nt, Human
aucgauguuaugu

SEQ ID NO: 2402495 - RNA, 19 nt, Human
auccuuuuauguuauuuau

SEQ ID NO: 2402496 - RNA, 15 nt, Human
auccuuuuucuuuau

SEQ ID NO: 2402497 - RNA, 13 nt, Human
aucgaugcagugc

SEQ ID NO: 2402498 - RNA, 22 nt, Human
auccuccaggugcacaagcucc

SEQ ID NO: 2402499 - RNA, 19 nt, Human
auccuccaggugcacaagc

SEQ ID NO: 2402500 - RNA, 14 nt, Human
auccuccaggugca

SEQ ID NO: 2402501 - RNA, 13 nt, Human
auccuccaggugc

SEQ ID NO: 2402502 - RNA, 23 nt, Human
auccucauacccacccccaccca

SEQ ID NO: 2402503 - RNA, 12 nt, Human
auccucccaggc

SEQ ID NO: 2402504 - RNA, 11 nt, Human
auccuccccuu

SEQ ID NO: 2402505 - RNA, 13 nt, Human
auccuccccuucc

SEQ ID NO: 2402506 - RNA, 15 nt, Human
auccuccccuucccu

SEQ ID NO: 2402507 - RNA, 18 nt, Human
auccuccccuucccugca

SEQ ID NO: 2402508 - RNA, 11 nt, Human
auccuccucag

SEQ ID NO: 2402509 - RNA, 19 nt, Human
auccuccccuucccugcaa

SEQ ID NO: 2402510 - RNA, 15 nt, Human
auccuccguccagcc

SEQ ID NO: 2402511 - RNA, 16 nt, Human
auccuccguccagccg

SEQ ID NO: 2402512 - RNA, 14 nt, Human
auccacccagccca

SEQ ID NO: 2402513 - RNA, 13 nt, Human
auccacccagccc

SEQ ID NO: 2402514 - RNA, 15 nt, Human
auccacccagcccau

SEQ ID NO: 2402515 - RNA, 14 nt, Human
aucccgaaaaucuc

SEQ ID NO: 2402516 - RNA, 14 nt, Human
aucccgagcaccuc

SEQ ID NO: 2402517 - RNA, 17 nt, Human
aucccgagcaccuccac

SEQ ID NO: 2402518 - RNA, 19 nt, Human
aucccgagcaccuccacau

SEQ ID NO: 2402519 - RNA, 20 nt, Human
aucccgauucacccugucca

SEQ ID NO: 2402520 - RNA, 15 nt, Human
aucccgauucacccu

SEQ ID NO: 2402521 - RNA, 16 nt, Human
auccacccaccucagc

SEQ ID NO: 2402522 - RNA, 20 nt, Human
auccacccaccucagccucc

SEQ ID NO: 2402523 - RNA, 18 nt, Human
auccacccaccucagccu

SEQ ID NO: 2402524 - RNA, 22 nt, Human
auccucauacccacccccaccc

SEQ ID NO: 2402525 - RNA, 19 nt, Human
auccucauacccaccccca

SEQ ID NO: 2402526 - RNA, 17 nt, Human
aucccucaccuguagca

SEQ ID NO: 2402527 - RNA, 14 nt, Human
aucccucaccugua

SEQ ID NO: 2402528 - RNA, 18 nt, Human
auccucauacccaccccc

SEQ ID NO: 2402529 - RNA, 15 nt, Human
aucccuacuguaauu

SEQ ID NO: 2402530 - RNA, 14 nt, Human
aucccggcugcccu

SEQ ID NO: 2402531 - RNA, 16 nt, Human
aucccgccaccuaucu

SEQ ID NO: 2402532 - RNA, 22 nt, Human
aucccgccucuucuucuucaga

SEQ ID NO: 2402533 - RNA, 13 nt, Human
aucccucaccugu

SEQ ID NO: 2402534 - RNA, 17 nt, Human
aucccuaugggauucag

SEQ ID NO: 2402535 - RNA, 19 nt, Human
aucccuagucuucaagcag

SEQ ID NO: 2402536 - RNA, 21 nt, Human
aucccuagucuucaagcagau

SEQ ID NO: 2402537 - RNA, 14 nt, Human
aucccuaugcugcc

SEQ ID NO: 2402538 - RNA, 19 nt, Human
aucccuaugcugccuaggc

SEQ ID NO: 2402539 - RNA, 14 nt, Human
aucccuagcuguga

SEQ ID NO: 2402540 - RNA, 22 nt, Human
auguguacaaaaguuucauccu

SEQ ID NO: 2402541 - RNA, 22 nt, Human
auguguaaucaauaaacgauuu

SEQ ID NO: 2402542 - RNA, 16 nt, Human
auguguacgugugugu

SEQ ID NO: 2402543 - RNA, 22 nt, Human
auguguacauggcagaguuugu

SEQ ID NO: 2402544 - RNA, 16 nt, Human
auguguacauggcaga

SEQ ID NO: 2402545 - RNA, 14 nt, Human
auguguacauggca

SEQ ID NO: 2402546 - RNA, 21 nt, Human
auguguacaucccauguaaca

SEQ ID NO: 2402547 - RNA, 19 nt, Human
auguguacaucccauguaa

SEQ ID NO: 2402548 - RNA, 20 nt, Human
auguguauguacguuuguau

SEQ ID NO: 2402549 - RNA, 20 nt, Human
auguguaugggcaaaaaacu

SEQ ID NO: 2402550 - RNA, 18 nt, Human
auguguauuacaaauauu

SEQ ID NO: 2402551 - RNA, 20 nt, Human
auguguauuuccagugcaau

SEQ ID NO: 2402552 - RNA, 17 nt, Human
auguguauuuuauuaca

SEQ ID NO: 2402553 - RNA, 21 nt, Human
augugucacuacucacagucu

SEQ ID NO: 2402554 - RNA, 13 nt, Human
auguguccugguu

SEQ ID NO: 2402555 - RNA, 21 nt, Human
augugucaacuucaacauuua

SEQ ID NO: 2402556 - RNA, 18 nt, Human
auguucugaauaauuucu

SEQ ID NO: 2402557 - RNA, 16 nt, Human
auguucugaauaauuu

SEQ ID NO: 2402558 - RNA, 18 nt, Human
auguucucugaggacacu

SEQ ID NO: 2402559 - RNA, 20 nt, Human
auguuucuuuuguauguaaa

SEQ ID NO: 2402560 - RNA, 19 nt, Human
auguuucuuuuguauguaa

SEQ ID NO: 2402561 - RNA, 18 nt, Human
auguuucuuuuguaugua

SEQ ID NO: 2402562 - RNA, 21 nt, Human
auguuucuuuuguauguaaau

SEQ ID NO: 2402563 - RNA, 18 nt, Human
auguuucuuuguaaugaa

SEQ ID NO: 2402564 - RNA, 18 nt, Human
auguucugacauuaacag

SEQ ID NO: 2402565 - RNA, 19 nt, Human
auguucugacauuaacagu

SEQ ID NO: 2402566 - RNA, 20 nt, Human
auguucugacauuaacaguu

SEQ ID NO: 2402567 - RNA, 20 nt, Human
auguucuuucacccuuuucu

SEQ ID NO: 2402568 - RNA, 22 nt, Human
auguuucuucuagguucuaaaa

SEQ ID NO: 2402569 - RNA, 15 nt, Human
auguucuuaauucuu

SEQ ID NO: 2402570 - RNA, 20 nt, Human
auguucuuaguggauguucu

SEQ ID NO: 2402571 - RNA, 22 nt, Human
auguucugacccugcuucaaau

SEQ ID NO: 2402572 - RNA, 14 nt, Human
auguucugacauua

SEQ ID NO: 2402573 - RNA, 15 nt, Human
auguucugacauuaa

SEQ ID NO: 2402574 - RNA, 16 nt, Human
auguucugacauuaac

SEQ ID NO: 2402575 - RNA, 17 nt, Human
auguucugacauuaaca

SEQ ID NO: 2402576 - RNA, 14 nt, Human
auguucuuaauucu

SEQ ID NO: 2402577 - RNA, 22 nt, Human
auuaaaguguccauugacaugu

SEQ ID NO: 2402578 - RNA, 20 nt, Human
auuaaaguguccauugacau

SEQ ID NO: 2402579 - RNA, 19 nt, Human
auuaaaguguccauugaca

SEQ ID NO: 2402580 - RNA, 17 nt, Human
auuaaaguguccauuga

SEQ ID NO: 2402581 - RNA, 15 nt, Human
auuaaaguguccauu

SEQ ID NO: 2402582 - RNA, 21 nt, Human
auuaaaguucuguaaaauaua

SEQ ID NO: 2402583 - RNA, 19 nt, Human
auuaaaguucuagugaccg

SEQ ID NO: 2402584 - RNA, 12 nt, Human
auuaaaguucua

SEQ ID NO: 2402585 - RNA, 23 nt, Human
auuaaaguguccauugacaugua

SEQ ID NO: 2402586 - RNA, 18 nt, Human
auguuuuaauuccaugaa

SEQ ID NO: 2402587 - RNA, 17 nt, Human
auguuuuaauuccauga

SEQ ID NO: 2402588 - RNA, 16 nt, Human
auguuuuaauuccaug

SEQ ID NO: 2402589 - RNA, 15 nt, Human
auguuuuaauuccau

SEQ ID NO: 2402590 - RNA, 15 nt, Human
auguuuuaacaaaaa

SEQ ID NO: 2402591 - RNA, 16 nt, Human
auguuuuaacaaaaac

SEQ ID NO: 2402592 - RNA, 14 nt, Human
auguuuuaauucca

SEQ ID NO: 2402593 - RNA, 21 nt, Human
auguuuuaaacauagaaaguu

SEQ ID NO: 2402594 - RNA, 18 nt, Human
auguuuguggccucagaa

SEQ ID NO: 2402595 - RNA, 16 nt, Human
auguuugcacuuguga

SEQ ID NO: 2402596 - RNA, 18 nt, Human
auguuuuaagaggcaggg

SEQ ID NO: 2402597 - RNA, 16 nt, Human
auguuuuaagaggcag

SEQ ID NO: 2402598 - RNA, 15 nt, Human
auuaaaugcccagcc

SEQ ID NO: 2402599 - RNA, 14 nt, Human
auuaaaugcccagc

SEQ ID NO: 2402600 - RNA, 14 nt, Human
auuaaauucacaaa

SEQ ID NO: 2402601 - RNA, 16 nt, Human
auuaaauucacaaacu

SEQ ID NO: 2402602 - RNA, 17 nt, Human
auuaaauucacaaacuu

SEQ ID NO: 2402603 - RNA, 18 nt, Human
auuaaauucacaaacuuu

SEQ ID NO: 2402604 - RNA, 13 nt, Human
auuaaauucuugc

SEQ ID NO: 2402605 - RNA, 16 nt, Human
auuaaaugcccagccc

SEQ ID NO: 2402606 - RNA, 13 nt, Human
auuaaauucacaa

SEQ ID NO: 2402607 - RNA, 11 nt, Human
auuaaauuaug

SEQ ID NO: 2402608 - RNA, 16 nt, Human
auguggggccagguca

SEQ ID NO: 2402609 - RNA, 13 nt, Human
auguggggccagg

SEQ ID NO: 2402610 - RNA, 16 nt, Human
augugggggucugugu

SEQ ID NO: 2402611 - RNA, 20 nt, Human
augugggcuaguugggcuuc

SEQ ID NO: 2402612 - RNA, 22 nt, Human
augugguggcacaggcccccuu

SEQ ID NO: 2402613 - RNA, 18 nt, Human
augugguggcacaggccc

SEQ ID NO: 2402614 - RNA, 18 nt, Human
auguggugaggcaggcuu

SEQ ID NO: 2402615 - RNA, 17 nt, Human
augugggggucugugug

SEQ ID NO: 2402616 - RNA, 18 nt, Human
augugggggucugugugu

SEQ ID NO: 2402617 - RNA, 21 nt, Human
augugggguccccaucauccc

SEQ ID NO: 2402618 - RNA, 16 nt, Human
augugggucaaggaau

SEQ ID NO: 2402619 - RNA, 21 nt, Human
auguguaaucaauaaacgauu

SEQ ID NO: 2402620 - RNA, 20 nt, Human
auguguaaucaauaaacgau

SEQ ID NO: 2402621 - RNA, 17 nt, Human
auguguaaucaauaaac

SEQ ID NO: 2402622 - RNA, 16 nt, Human
auguguaaucaauaaa

SEQ ID NO: 2402623 - RNA, 13 nt, Human
augugguuuauag

SEQ ID NO: 2402624 - RNA, 14 nt, Human
auguguaaguauuc

SEQ ID NO: 2402625 - RNA, 13 nt, Human
auguggugccuga

SEQ ID NO: 2402626 - RNA, 15 nt, Human
augugguuacacacu

SEQ ID NO: 2402627 - RNA, 15 nt, Human
auguggugggacagg

SEQ ID NO: 2402628 - RNA, 21 nt, Human
auguggugggacagggaccca

SEQ ID NO: 2402629 - RNA, 19 nt, Human
augugguuuauagagggcc

SEQ ID NO: 2402630 - RNA, 18 nt, Human
augugguuauuucucuga

SEQ ID NO: 2402631 - RNA, 20 nt, Human
augugguugcaaggccgcug

SEQ ID NO: 2402632 - RNA, 15 nt, Human
augugguucuucaaa

SEQ ID NO: 2402633 - RNA, 17 nt, Human
augugguuauuucucug

SEQ ID NO: 2402634 - RNA, 23 nt, Human
augucuugaugcaugcacuguuc

SEQ ID NO: 2402635 - RNA, 13 nt, Human
augucuuggacac

SEQ ID NO: 2402636 - RNA, 20 nt, Human
augucuucuguauucacuua

SEQ ID NO: 2402637 - RNA, 19 nt, Human
augucuucugccuguuaua

SEQ ID NO: 2402638 - RNA, 17 nt, Human
augucuucugccuguua

SEQ ID NO: 2402639 - RNA, 15 nt, Human
augucuucugccugu

SEQ ID NO: 2402640 - RNA, 12 nt, Human
augucuucugcc

SEQ ID NO: 2402641 - RNA, 14 nt, Human
augucuucugccug

SEQ ID NO: 2402642 - RNA, 19 nt, Human
augucuuggacacuguaca

SEQ ID NO: 2402643 - RNA, 16 nt, Human
augucuuggacacugu

SEQ ID NO: 2402644 - RNA, 20 nt, Human
augucuuggacacuguacaa

SEQ ID NO: 2402645 - RNA, 19 nt, Human
augucuuggguaggcggga

SEQ ID NO: 2402646 - RNA, 22 nt, Human
augucuuguacauguguagccu

SEQ ID NO: 2402647 - RNA, 17 nt, Human
augucuuguacaugugu

SEQ ID NO: 2402648 - RNA, 14 nt, Human
augucuuguacaug

SEQ ID NO: 2402649 - RNA, 16 nt, Human
auguaauaaacuuuaa

SEQ ID NO: 2402650 - RNA, 15 nt, Human
auguaauaaacuuua

SEQ ID NO: 2402651 - RNA, 14 nt, Human
auguaauaaacuuu

SEQ ID NO: 2402652 - RNA, 18 nt, Human
auguaaguuuaccuaugu

SEQ ID NO: 2402653 - RNA, 16 nt, Human
auguaaucaauguuuc

SEQ ID NO: 2402654 - RNA, 15 nt, Human
auguaaucaauguuu

SEQ ID NO: 2402655 - RNA, 16 nt, Human
auguaauaaugugaau

SEQ ID NO: 2402656 - RNA, 17 nt, Human
auguaauaacugugaag

SEQ ID NO: 2402657 - RNA, 22 nt, Human
auguaauaagguugaacacuuu

SEQ ID NO: 2402658 - RNA, 19 nt, Human
auguaauaaaaaguauaug

SEQ ID NO: 2402659 - RNA, 14 nt, Human
auguaauaauguga

SEQ ID NO: 2402660 - RNA, 21 nt, Human
auguaagggaaacugccagca

SEQ ID NO: 2402661 - RNA, 22 nt, Human
auguaagggaaacugccagcaa

SEQ ID NO: 2402662 - RNA, 20 nt, Human
auguaagggaaacugccagc

SEQ ID NO: 2402663 - RNA, 17 nt, Human
auguaagcucuacugag

SEQ ID NO: 2402664 - RNA, 14 nt, Human
auggugaaaaugua

SEQ ID NO: 2402665 - RNA, 12 nt, Human
auggugaaaaug

SEQ ID NO: 2402666 - RNA, 17 nt, Human
auggucuucagccucuu

SEQ ID NO: 2402667 - RNA, 15 nt, Human
auggucuucagccuc

SEQ ID NO: 2402668 - RNA, 18 nt, Human
auggucucagaaaccaaa

SEQ ID NO: 2402669 - RNA, 14 nt, Human
auggucucagaaac

SEQ ID NO: 2402670 - RNA, 14 nt, Human
auguaacuuuugua

SEQ ID NO: 2402671 - RNA, 18 nt, Human
auggugagaugcagcugg

SEQ ID NO: 2402672 - RNA, 16 nt, Human
auguaacuuuuguaag

SEQ ID NO: 2402673 - RNA, 21 nt, Human
auggugagagaagccugugcc

SEQ ID NO: 2402674 - RNA, 17 nt, Human
auggugaaauuuauuag

SEQ ID NO: 2402675 - RNA, 23 nt, Human
auggugacuuuugaaaagaggug

SEQ ID NO: 2402676 - RNA, 17 nt, Human
auggugaaaauguacug

SEQ ID NO: 2402677 - RNA, 16 nt, Human
auggugaaaauguacu

SEQ ID NO: 2402678 - RNA, 24 nt, Human
auggugaaaccccgucucuacuaa

SEQ ID NO: 2402679 - RNA, 17 nt, Human
auguaacuuuuguaaga

SEQ ID NO: 2402680 - RNA, 18 nt, Human
auguaacuuuuguaagac

SEQ ID NO: 2402681 - RNA, 20 nt, Human
auguaagagcaccuuccuca

SEQ ID NO: 2402682 - RNA, 23 nt, Human
augucagcaaaaagcaaaaucau

SEQ ID NO: 2402683 - RNA, 22 nt, Human
augucagcaaaaagcaaaauca

SEQ ID NO: 2402684 - RNA, 16 nt, Human
augucagcaaaaagca

SEQ ID NO: 2402685 - RNA, 15 nt, Human
augucagcaaaaagc

SEQ ID NO: 2402686 - RNA, 13 nt, Human
augucagcaaaaa

SEQ ID NO: 2402687 - RNA, 18 nt, Human
augucagauacaauguau

SEQ ID NO: 2402688 - RNA, 16 nt, Human
augucagauacaaugu

SEQ ID NO: 2402689 - RNA, 14 nt, Human
augucagauacaau

SEQ ID NO: 2402690 - RNA, 23 nt, Human
augucagacauccauguuuguaa

SEQ ID NO: 2402691 - RNA, 16 nt, Human
augucagacuggcugg

SEQ ID NO: 2402692 - RNA, 16 nt, Human
augucacugugguccu

SEQ ID NO: 2402693 - RNA, 14 nt, Human
augucacugugguc

SEQ ID NO: 2402694 - RNA, 17 nt, Human
augucacaggcaggucc

SEQ ID NO: 2402695 - RNA, 16 nt, Human
augucacaggcagguc

SEQ ID NO: 2402696 - RNA, 14 nt, Human
augucacaggcagg

SEQ ID NO: 2402697 - RNA, 15 nt, Human
augucacaggcaggu

SEQ ID NO: 2402698 - RNA, 15 nt, Human
auguacaugagaagg

SEQ ID NO: 2402699 - RNA, 14 nt, Human
augucaacuucugg

SEQ ID NO: 2402700 - RNA, 17 nt, Human
augucaacugaccuaaa

SEQ ID NO: 2402701 - RNA, 20 nt, Human
augucaaagagaaaacuuau

SEQ ID NO: 2402702 - RNA, 18 nt, Human
augucaacuucuggcucc

SEQ ID NO: 2402703 - RNA, 17 nt, Human
augucaacuucuggcuc

SEQ ID NO: 2402704 - RNA, 19 nt, Human
augucaacuucuggcuccu

SEQ ID NO: 2402705 - RNA, 16 nt, Human
augucaaucagccuag

SEQ ID NO: 2402706 - RNA, 16 nt, Human
augucaaguaccaaaa

SEQ ID NO: 2402707 - RNA, 23 nt, Human
auguaaucugauggcuucuccag

SEQ ID NO: 2402708 - RNA, 19 nt, Human
auguaaucuugaauuguaa

SEQ ID NO: 2402709 - RNA, 23 nt, Human
auguacagagaacuaacacuauu

SEQ ID NO: 2402710 - RNA, 14 nt, Human
auguacaagaugaa

SEQ ID NO: 2402711 - RNA, 21 nt, Human
auguacagagaacuaacacua

SEQ ID NO: 2402712 - RNA, 20 nt, Human
auguacaguguucuguuuaa

SEQ ID NO: 2402713 - RNA, 17 nt, Human
auguacaguguucuguu

SEQ ID NO: 2402714 - RNA, 14 nt, Human
auguacaguguucu

SEQ ID NO: 2402715 - RNA, 11 nt, Human
auguacagugu

SEQ ID NO: 2402716 - RNA, 17 nt, Human
auguacagucugucaug

SEQ ID NO: 2402717 - RNA, 16 nt, Human
auguacagucugucau

SEQ ID NO: 2402718 - RNA, 15 nt, Human
auguacagucuguca

SEQ ID NO: 2402719 - RNA, 14 nt, Human
auguacagucuguc

SEQ ID NO: 2402720 - RNA, 13 nt, Human
auguacagucugu

SEQ ID NO: 2402721 - RNA, 21 nt, Human
augccuuuguacuuuagggaa

SEQ ID NO: 2402722 - RNA, 20 nt, Human
augccuuugagacaguuucu

SEQ ID NO: 2402723 - RNA, 19 nt, Human
augccuuugagacaguuuc

SEQ ID NO: 2402724 - RNA, 16 nt, Human
augccuuugagacagu

SEQ ID NO: 2402725 - RNA, 15 nt, Human
augccuuugagacag

SEQ ID NO: 2402726 - RNA, 22 nt, Human
augccuuugagacaguuucuua

SEQ ID NO: 2402727 - RNA, 21 nt, Human
augccuuugagacaguuucuu

SEQ ID NO: 2402728 - RNA, 23 nt, Human
augccuuugagacaguuucuuag

SEQ ID NO: 2402729 - RNA, 14 nt, Human
augccuuuuauuuc

SEQ ID NO: 2402730 - RNA, 17 nt, Human
augcaugcacuguuccc

SEQ ID NO: 2402731 - RNA, 20 nt, Human
augcaugcagccacugugcu

SEQ ID NO: 2402732 - RNA, 23 nt, Human
augcauggaaaccugaaaaaaag

SEQ ID NO: 2402733 - RNA, 20 nt, Human
augcauggaaaccugaaaaa

SEQ ID NO: 2402734 - RNA, 12 nt, Human
augcauggaaau

SEQ ID NO: 2402735 - RNA, 12 nt, Human
augcauggaaac

SEQ ID NO: 2402736 - RNA, 23 nt, Human
augcaugaaguaauaugcacaca

SEQ ID NO: 2402737 - RNA, 20 nt, Human
augcaugaaguaauaugcac

SEQ ID NO: 2402738 - RNA, 18 nt, Human
augcacauauggacucug

SEQ ID NO: 2402739 - RNA, 10 nt, Human
augcauuuga

SEQ ID NO: 2402740 - RNA, 12 nt, Human
augcauuugaaa

SEQ ID NO: 2402741 - RNA, 18 nt, Human
augcauuugaaaauuuug

SEQ ID NO: 2402742 - RNA, 15 nt, Human
augcauuguugaggu

SEQ ID NO: 2402743 - RNA, 16 nt, Human
augcauuguugaggug

SEQ ID NO: 2402744 - RNA, 22 nt, Human
augcauuguuguucugcucaau

SEQ ID NO: 2402745 - RNA, 13 nt, Human
augcauuugaggu

SEQ ID NO: 2402746 - RNA, 17 nt, Human
augcauuugaggucaag

SEQ ID NO: 2402747 - RNA, 17 nt, Human
augccugggcagaagga

SEQ ID NO: 2402748 - RNA, 16 nt, Human
augccuggucuuuccu

SEQ ID NO: 2402749 - RNA, 13 nt, Human
augccuggcuucg

SEQ ID NO: 2402750 - RNA, 18 nt, Human
augccuggucuuuccucu

SEQ ID NO: 2402751 - RNA, 23 nt, Human
augccuggauggggcugcaccgg

SEQ ID NO: 2402752 - RNA, 21 nt, Human
augccuggauggggcugcacc

SEQ ID NO: 2402753 - RNA, 14 nt, Human
augccuuugagaca

SEQ ID NO: 2402754 - RNA, 13 nt, Human
augccuuugagac

SEQ ID NO: 2402755 - RNA, 12 nt, Human
augccuuugaga

SEQ ID NO: 2402756 - RNA, 22 nt, Human
augccuuucuaguccuauucua

SEQ ID NO: 2402757 - RNA, 21 nt, Human
augccuuucuaguccuauucu

SEQ ID NO: 2402758 - RNA, 13 nt, Human
augccuuucuagu

SEQ ID NO: 2402759 - RNA, 21 nt, Human
augccuuuaaaucugugauga

SEQ ID NO: 2402760 - RNA, 17 nt, Human
augccugguggcagcug

SEQ ID NO: 2402761 - RNA, 16 nt, Human
augccugguggcagcu

SEQ ID NO: 2402762 - RNA, 15 nt, Human
augccugguggcagc

SEQ ID NO: 2402763 - RNA, 14 nt, Human
augcacagcuaaca

SEQ ID NO: 2402764 - RNA, 23 nt, Human
augcacagaguuguuacauuuuu

SEQ ID NO: 2402765 - RNA, 23 nt, Human
augcacacauuuuuuaaaugcac

SEQ ID NO: 2402766 - RNA, 19 nt, Human
augcaauuuauuaaaauga

SEQ ID NO: 2402767 - RNA, 21 nt, Human
augcacagcuaacauggaagu

SEQ ID NO: 2402768 - RNA, 19 nt, Human
augcacacauuuuuuaaau

SEQ ID NO: 2402769 - RNA, 22 nt, Human
augcacacauuuuuuaaaugca

SEQ ID NO: 2402770 - RNA, 17 nt, Human
augcacacauuuuuuaa

SEQ ID NO: 2402771 - RNA, 19 nt, Human
augcaaugacaucuucaaa

SEQ ID NO: 2402772 - RNA, 14 nt, Human
augcaaugugaagc

SEQ ID NO: 2402773 - RNA, 13 nt, Human
augcaaugugcua

SEQ ID NO: 2402774 - RNA, 16 nt, Human
augcaaugugcuacug

SEQ ID NO: 2402775 - RNA, 17 nt, Human
augcaaugugcuacuga

SEQ ID NO: 2402776 - RNA, 18 nt, Human
augcaaugugcuacugau

SEQ ID NO: 2402777 - RNA, 23 nt, Human
augauguauguugaagccuuugu

SEQ ID NO: 2402778 - RNA, 19 nt, Human
augauguccagaagaauau

SEQ ID NO: 2402779 - RNA, 18 nt, Human
augauguccagaagaaua

SEQ ID NO: 2402780 - RNA, 15 nt, Human
augauguccagaaga

SEQ ID NO: 2402781 - RNA, 14 nt, Human
augauguccagaag

SEQ ID NO: 2402782 - RNA, 16 nt, Human
augauguauuuuugua

SEQ ID NO: 2402783 - RNA, 15 nt, Human
augauguauuuuugu

SEQ ID NO: 2402784 - RNA, 16 nt, Human
augaugugccugggug

SEQ ID NO: 2402785 - RNA, 14 nt, Human
augaugugccuggg

SEQ ID NO: 2402786 - RNA, 23 nt, Human
augauguccagaagaauauucag

SEQ ID NO: 2402787 - RNA, 14 nt, Human
augcaauauguauu

SEQ ID NO: 2402788 - RNA, 19 nt, Human
augcaauauaucuaaauug

SEQ ID NO: 2402789 - RNA, 23 nt, Human
augauguggugccugaggucugu

SEQ ID NO: 2402790 - RNA, 15 nt, Human
augcaauauaucuaa

SEQ ID NO: 2402791 - RNA, 21 nt, Human
augcaauauaucuaaauugaa

SEQ ID NO: 2402792 - RNA, 20 nt, Human
augcaauauaucuaaauuga

SEQ ID NO: 2402793 - RNA, 22 nt, Human
augcaauauaucuaaauugaau

SEQ ID NO: 2402794 - RNA, 13 nt, Human
augcaauauguau

SEQ ID NO: 2402795 - RNA, 16 nt, Human
augaugugugaaaacu

SEQ ID NO: 2402796 - RNA, 20 nt, Human
augauguggugccugagguc

SEQ ID NO: 2402797 - RNA, 23 nt, Human
augauguggaguggggcaguaga

SEQ ID NO: 2402798 - RNA, 19 nt, Human
augauguguacccaaacgu

SEQ ID NO: 2402799 - RNA, 19 nt, Human
augauguggaguggggcag

SEQ ID NO: 2402800 - RNA, 19 nt, Human
augaugugggucaaggaau

SEQ ID NO: 2402801 - RNA, 15 nt, Human
augcuucuuccuuac

SEQ ID NO: 2402802 - RNA, 15 nt, Human
augcuucuucucagg

SEQ ID NO: 2402803 - RNA, 12 nt, Human
augcuucuugga

SEQ ID NO: 2402804 - RNA, 11 nt, Human
augcuugccua

SEQ ID NO: 2402805 - RNA, 16 nt, Human
augcuugccuagggcc

SEQ ID NO: 2402806 - RNA, 20 nt, Human
augcuugccuagggccuggu

SEQ ID NO: 2402807 - RNA, 21 nt, Human
augcuugccuagggccugguc

SEQ ID NO: 2402808 - RNA, 23 nt, Human
augcuugccuagggccuggucca

SEQ ID NO: 2402809 - RNA, 15 nt, Human
augcuugaaaaaugu

SEQ ID NO: 2402810 - RNA, 12 nt, Human
augcuugaaaaa

SEQ ID NO: 2402811 - RNA, 20 nt, Human
auggaaaugggcagagcaga

SEQ ID NO: 2402812 - RNA, 19 nt, Human
auggaaaugggcagagcag

SEQ ID NO: 2402813 - RNA, 20 nt, Human
auggaaauucccuucaucug

SEQ ID NO: 2402814 - RNA, 13 nt, Human
auggaaauguuua

SEQ ID NO: 2402815 - RNA, 17 nt, Human
augcuuuuaaaaaucua

SEQ ID NO: 2402816 - RNA, 22 nt, Human
augcuuugugugauugaaucug

SEQ ID NO: 2402817 - RNA, 16 nt, Human
augcuuugugugauug

SEQ ID NO: 2402818 - RNA, 20 nt, Human
augcuuuucugucucugccu

SEQ ID NO: 2402819 - RNA, 19 nt, Human
augcuuuucugucucugcc

SEQ ID NO: 2402820 - RNA, 22 nt, Human
augcuuuuauauuuuuuuaaaa

SEQ ID NO: 2402821 - RNA, 15 nt, Human
augcuuugugaacaa

SEQ ID NO: 2402822 - RNA, 22 nt, Human
augcuuuuuauuauuauuauuu

SEQ ID NO: 2402823 - RNA, 16 nt, Human
augcuuuuuauuucug

SEQ ID NO: 2402824 - RNA, 19 nt, Human
augcuuuuuauuucugcau

SEQ ID NO: 2402825 - RNA, 23 nt, Human
augcuuuuuauuucugcauaugu

SEQ ID NO: 2402826 - RNA, 14 nt, Human
auggaaaaaaugau

SEQ ID NO: 2402827 - RNA, 22 nt, Human
augcuuuuugaauguuauuugu

SEQ ID NO: 2402828 - RNA, 16 nt, Human
augcuuuuugaauguu

SEQ ID NO: 2402829 - RNA, 23 nt, Human
auggagcccaggcgggagcggug

SEQ ID NO: 2402830 - RNA, 14 nt, Human
auggagcccaggcg

SEQ ID NO: 2402831 - RNA, 13 nt, Human
auggagcccaggc

SEQ ID NO: 2402832 - RNA, 12 nt, Human
auggagcccagg

SEQ ID NO: 2402833 - RNA, 21 nt, Human
auggagccagcucugcauuau

SEQ ID NO: 2402834 - RNA, 23 nt, Human
auggagccagcucccucuauuua

SEQ ID NO: 2402835 - RNA, 22 nt, Human
auggagcucagagagggcaggc

SEQ ID NO: 2402836 - RNA, 14 nt, Human
auggagcucagaga

SEQ ID NO: 2402837 - RNA, 16 nt, Human
auggagccccagcccc

SEQ ID NO: 2402838 - RNA, 16 nt, Human
auggauccuggaggau

SEQ ID NO: 2402839 - RNA, 15 nt, Human
auggagccccagccc

SEQ ID NO: 2402840 - RNA, 12 nt, Human
auggagccccag

SEQ ID NO: 2402841 - RNA, 17 nt, Human
auggagcgcaccugccc

SEQ ID NO: 2402842 - RNA, 23 nt, Human
auggagcgcaccugcccccuggu

SEQ ID NO: 2402843 - RNA, 13 nt, Human
auggaugccaaua

SEQ ID NO: 2402844 - RNA, 22 nt, Human
auggaugccaauauuaaaucug

SEQ ID NO: 2402845 - RNA, 21 nt, Human
auggaugauucagaaauugga

SEQ ID NO: 2402846 - RNA, 23 nt, Human
auggaugccaauauuaaaucugc

SEQ ID NO: 2402847 - RNA, 18 nt, Human
auggaugauucagaaauu

SEQ ID NO: 2402848 - RNA, 13 nt, Human
auggaugauucag

SEQ ID NO: 2402849 - RNA, 13 nt, Human
auggagcuggccg

SEQ ID NO: 2402850 - RNA, 18 nt, Human
auggauucauuacagcuu

SEQ ID NO: 2402851 - RNA, 22 nt, Human
auggauguuuuagccauuguug

SEQ ID NO: 2402852 - RNA, 20 nt, Human
auggaugugggguccccauc

SEQ ID NO: 2402853 - RNA, 17 nt, Human
auggauguggggucccc

SEQ ID NO: 2402854 - RNA, 14 nt, Human
auggauggcuucua

SEQ ID NO: 2402855 - RNA, 12 nt, Human
auggaugugcuu

SEQ ID NO: 2402856 - RNA, 19 nt, Human
auggaugggggaacucaga

SEQ ID NO: 2402857 - RNA, 18 nt, Human
auggcucuaaaaaguuuu

SEQ ID NO: 2402858 - RNA, 21 nt, Human
auggcugaaggaaaccagugc

SEQ ID NO: 2402859 - RNA, 12 nt, Human
auggcucuucau

SEQ ID NO: 2402860 - RNA, 12 nt, Human
auggcuccucuc

SEQ ID NO: 2402861 - RNA, 13 nt, Human
auggcuccucuca

SEQ ID NO: 2402862 - RNA, 23 nt, Human
auggcugccaaugggagcucaug

SEQ ID NO: 2402863 - RNA, 17 nt, Human
augggaagacgaggccc

SEQ ID NO: 2402864 - RNA, 23 nt, Human
auggcugcugaagcugccugcuu

SEQ ID NO: 2402865 - RNA, 22 nt, Human
auggcugcugaagcugccugcu

SEQ ID NO: 2402866 - RNA, 19 nt, Human
auggcugcugaagcugccu

SEQ ID NO: 2402867 - RNA, 14 nt, Human
augggaagacauga

SEQ ID NO: 2402868 - RNA, 14 nt, Human
auggcugcugaagc

SEQ ID NO: 2402869 - RNA, 12 nt, Human
auggcugcugaa

SEQ ID NO: 2402870 - RNA, 22 nt, Human
auggcugaaggaaaccagugca

SEQ ID NO: 2402871 - RNA, 18 nt, Human
auggcugacuuugcucuu

SEQ ID NO: 2402872 - RNA, 15 nt, Human
augggaaugaauguc

SEQ ID NO: 2402873 - RNA, 21 nt, Human
augggaaugaaugucagugug

SEQ ID NO: 2402874 - RNA, 21 nt, Human
augggaaugaagcuuguguau

SEQ ID NO: 2402875 - RNA, 16 nt, Human
augggaaugaagcuug

SEQ ID NO: 2402876 - RNA, 15 nt, Human
augggaaugaagcuu

SEQ ID NO: 2402877 - RNA, 14 nt, Human
augggaaugaagcu

SEQ ID NO: 2402878 - RNA, 18 nt, Human
augggaaucaagauuuaa

SEQ ID NO: 2402879 - RNA, 13 nt, Human
augggaaugaagc

SEQ ID NO: 2402880 - RNA, 20 nt, Human
augggaagacgaggcccucg

SEQ ID NO: 2402881 - RNA, 19 nt, Human
augggaagacgaggcccuc

SEQ ID NO: 2402882 - RNA, 14 nt, Human
augggaaggaggga

SEQ ID NO: 2402883 - RNA, 17 nt, Human
augggaaggagggaggu

SEQ ID NO: 2402884 - RNA, 19 nt, Human
augggaaggagggagguau

SEQ ID NO: 2402885 - RNA, 22 nt, Human
agccuccugaccugaggcuccu

SEQ ID NO: 2402886 - RNA, 19 nt, Human
agccuccugaccugaggcu

SEQ ID NO: 2402887 - RNA, 20 nt, Human
agccgggucugccucuucug

SEQ ID NO: 2402888 - RNA, 21 nt, Human
agccgggucugccucuucugg

SEQ ID NO: 2402889 - RNA, 22 nt, Human
agccgggucugccucuucuggg

SEQ ID NO: 2402890 - RNA, 16 nt, Human
agccgucagccaaaug

SEQ ID NO: 2402891 - RNA, 19 nt, Human
agccucccaaagugcuggg

SEQ ID NO: 2402892 - RNA, 18 nt, Human
agccucccaaagugcugg

SEQ ID NO: 2402893 - RNA, 14 nt, Human
agccggccucucug

SEQ ID NO: 2402894 - RNA, 15 nt, Human
agccggcacaggguc

SEQ ID NO: 2402895 - RNA, 14 nt, Human
agccggcacagggu

SEQ ID NO: 2402896 - RNA, 23 nt, Human
agccggacuuucggaguuggggg

SEQ ID NO: 2402897 - RNA, 22 nt, Human
agccgcugugagccccuggucc

SEQ ID NO: 2402898 - RNA, 16 nt, Human
agccgggucugccucu

SEQ ID NO: 2402899 - RNA, 16 nt, Human
agccggcauggcuggg

SEQ ID NO: 2402900 - RNA, 21 nt, Human
agccggagccuccagcugccc

SEQ ID NO: 2402901 - RNA, 16 nt, Human
agccggcacagggucu

SEQ ID NO: 2402902 - RNA, 20 nt, Human
agccggggaguuucuuuccu

SEQ ID NO: 2402903 - RNA, 21 nt, Human
agccggggaguuucuuuccug

SEQ ID NO: 2402904 - RNA, 21 nt, Human
agccgagaucacgccacugca

SEQ ID NO: 2402905 - RNA, 19 nt, Human
agccgagauugcaccacug

SEQ ID NO: 2402906 - RNA, 16 nt, Human
agccgagccgggccug

SEQ ID NO: 2402907 - RNA, 20 nt, Human
agccgagauugcaccacugc

SEQ ID NO: 2402908 - RNA, 14 nt, Human
agccgcuggggcca

SEQ ID NO: 2402909 - RNA, 21 nt, Human
agccgagccgggccuggggcu

SEQ ID NO: 2402910 - RNA, 18 nt, Human
agccgagccgggccuggg

SEQ ID NO: 2402911 - RNA, 17 nt, Human
agccgagccgggccugg

SEQ ID NO: 2402912 - RNA, 18 nt, Human
agccgauucaccugagca

SEQ ID NO: 2402913 - RNA, 14 nt, Human
agccgcagccuccc

SEQ ID NO: 2402914 - RNA, 22 nt, Human
agccgcuggggccaguuggucc

SEQ ID NO: 2402915 - RNA, 18 nt, Human
agccgcagccucccucug

SEQ ID NO: 2402916 - RNA, 16 nt, Human
agccgcaucuucucca

SEQ ID NO: 2402917 - RNA, 19 nt, Human
agccgcugugagccccugg

SEQ ID NO: 2402918 - RNA, 16 nt, Human
agccgcugugagcccc

SEQ ID NO: 2402919 - RNA, 23 nt, Human
agccgagcucguguauccugggg

SEQ ID NO: 2402920 - RNA, 17 nt, Human
agccucccgaguagcug

SEQ ID NO: 2402921 - RNA, 22 nt, Human
agccucccgaauagcugggacu

SEQ ID NO: 2402922 - RNA, 20 nt, Human
agccucccgaauagcuggga

SEQ ID NO: 2402923 - RNA, 19 nt, Human
agccucccgaauagcuggg

SEQ ID NO: 2402924 - RNA, 16 nt, Human
agccuccccugccagg

SEQ ID NO: 2402925 - RNA, 17 nt, Human
agccuccccugccaggg

SEQ ID NO: 2402926 - RNA, 18 nt, Human
agccuccccugccagggc

SEQ ID NO: 2402927 - RNA, 19 nt, Human
agccuccccugccagggca

SEQ ID NO: 2402928 - RNA, 18 nt, Human
agccucccgaauagcugg

SEQ ID NO: 2402929 - RNA, 20 nt, Human
agccucccaaagugcuggga

SEQ ID NO: 2402930 - RNA, 14 nt, Human
agccuccccugcca

SEQ ID NO: 2402931 - RNA, 15 nt, Human
agccuccccugccag

SEQ ID NO: 2402932 - RNA, 17 nt, Human
agccucccaaagugcug

SEQ ID NO: 2402933 - RNA, 23 nt, Human
agccucccuauuuuuuuucuguu

SEQ ID NO: 2402934 - RNA, 20 nt, Human
agccuccccugccagggcag

SEQ ID NO: 2402935 - RNA, 22 nt, Human
agccuccccugccagggcaggg

SEQ ID NO: 2402936 - RNA, 22 nt, Human
agccucccgaguagcugggacu

SEQ ID NO: 2402937 - RNA, 13 nt, Human
agccucccugaag

SEQ ID NO: 2402938 - RNA, 12 nt, Human
agccucccugaa

SEQ ID NO: 2402939 - RNA, 22 nt, Human
agccucccucugaccugcaggc

SEQ ID NO: 2402940 - RNA, 11 nt, Human
agccucccuga

SEQ ID NO: 2402941 - RNA, 13 nt, Human
agccucccucuga

SEQ ID NO: 2402942 - RNA, 14 nt, Human
agccucccucugac

SEQ ID NO: 2402943 - RNA, 15 nt, Human
agccucccucugacc

SEQ ID NO: 2402944 - RNA, 21 nt, Human
agccucccucugaccugcagg

SEQ ID NO: 2402945 - RNA, 17 nt, Human
agccucccugaagacca

SEQ ID NO: 2402946 - RNA, 14 nt, Human
agccucccugaagc

SEQ ID NO: 2402947 - RNA, 15 nt, Human
agccucccugaagcc

SEQ ID NO: 2402948 - RNA, 16 nt, Human
agccuccuccugacca

SEQ ID NO: 2402949 - RNA, 18 nt, Human
agccuccucuggacggca

SEQ ID NO: 2402950 - RNA, 14 nt, Human
agccuccucuggac

SEQ ID NO: 2402951 - RNA, 13 nt, Human
agccuccucugga

SEQ ID NO: 2402952 - RNA, 12 nt, Human
agccuccucugg

SEQ ID NO: 2402953 - RNA, 11 nt, Human
agccuccucug

SEQ ID NO: 2402954 - RNA, 13 nt, Human
agccuccucucuc

SEQ ID NO: 2402955 - RNA, 19 nt, Human
agccuccuccugaccacgg

SEQ ID NO: 2402956 - RNA, 21 nt, Human
agccuccucugucugcccuuc

SEQ ID NO: 2402957 - RNA, 20 nt, Human
agccuccucugucugcccuu

SEQ ID NO: 2402958 - RNA, 19 nt, Human
agccuccucugucugcccu

SEQ ID NO: 2402959 - RNA, 18 nt, Human
agccuccucugucugccc

SEQ ID NO: 2402960 - RNA, 16 nt, Human
agccuccucugucugc

SEQ ID NO: 2402961 - RNA, 15 nt, Human
agccuccucugucug

SEQ ID NO: 2402962 - RNA, 12 nt, Human
agccuccucugu

SEQ ID NO: 2402963 - RNA, 19 nt, Human
agccuccucuggacggcag

SEQ ID NO: 2402964 - RNA, 18 nt, Human
agccuccugaccugaggc

SEQ ID NO: 2402965 - RNA, 17 nt, Human
agccuccugaccugagg

SEQ ID NO: 2402966 - RNA, 16 nt, Human
agccuccugaccugag

SEQ ID NO: 2402967 - RNA, 14 nt, Human
agccuccugaccug

SEQ ID NO: 2402968 - RNA, 11 nt, Human
agccuccugag

SEQ ID NO: 2402969 - RNA, 17 nt, Human
agcccaaguccaaaugu

SEQ ID NO: 2402970 - RNA, 14 nt, Human
agcccaaguccaaa

SEQ ID NO: 2402971 - RNA, 10 nt, Human
agcccaaguc

SEQ ID NO: 2402972 - RNA, 23 nt, Human
agcccaagguuuaaacuucucug

SEQ ID NO: 2402973 - RNA, 21 nt, Human
agcccaagggaucugguccua

SEQ ID NO: 2402974 - RNA, 22 nt, Human
agcccaagguuuaaacuucucu

SEQ ID NO: 2402975 - RNA, 22 nt, Human
agcccaagggaucugguccuac

SEQ ID NO: 2402976 - RNA, 16 nt, Human
agcccaagggaucugg

SEQ ID NO: 2402977 - RNA, 23 nt, Human
agcccaacagacaccaucuuuug

SEQ ID NO: 2402978 - RNA, 16 nt, Human
agcccaaagcuguugg

SEQ ID NO: 2402979 - RNA, 23 nt, Human
agcccaaagugguauagaaaugc

SEQ ID NO: 2402980 - RNA, 20 nt, Human
agcccaaagugguauagaaa

SEQ ID NO: 2402981 - RNA, 14 nt, Human
agccccaccccagg

SEQ ID NO: 2402982 - RNA, 12 nt, Human
agccccagagca

SEQ ID NO: 2402983 - RNA, 12 nt, Human
agccccagcacu

SEQ ID NO: 2402984 - RNA, 15 nt, Human
agccccagcacuaac

SEQ ID NO: 2402985 - RNA, 14 nt, Human
agccccagcccccu

SEQ ID NO: 2402986 - RNA, 18 nt, Human
agccccagcccccuuugg

SEQ ID NO: 2402987 - RNA, 11 nt, Human
agccccagccc

SEQ ID NO: 2402988 - RNA, 16 nt, Human
agccccagagcagggu

SEQ ID NO: 2402989 - RNA, 12 nt, Human
agccccagcccc

SEQ ID NO: 2402990 - RNA, 23 nt, Human
agccccauaauuuuuuuuuuccu

SEQ ID NO: 2402991 - RNA, 17 nt, Human
agccccaucagcuccag

SEQ ID NO: 2402992 - RNA, 23 nt, Human
agccccagggucuucccuaccuc

SEQ ID NO: 2402993 - RNA, 16 nt, Human
agccccagugcccaca

SEQ ID NO: 2402994 - RNA, 18 nt, Human
agccccaggccucugugu

SEQ ID NO: 2402995 - RNA, 16 nt, Human
agccccaggccucugu

SEQ ID NO: 2402996 - RNA, 15 nt, Human
agccccaggccucug

SEQ ID NO: 2402997 - RNA, 12 nt, Human
agccccaggccu

SEQ ID NO: 2402998 - RNA, 12 nt, Human
agccccagcuga

SEQ ID NO: 2402999 - RNA, 13 nt, Human
agccccaggcagg

SEQ ID NO: 2403000 - RNA, 16 nt, Human
agccccaggcaggcug

SEQ ID NO: 2403001 - RNA, 20 nt, Human
agccccaggcaggcugugcg

SEQ ID NO: 2403002 - RNA, 21 nt, Human
agccccaggccucuguguccu

SEQ ID NO: 2403003 - RNA, 18 nt, Human
agccccagggucuucccu

SEQ ID NO: 2403004 - RNA, 20 nt, Human
agccccagggucuucccuac

SEQ ID NO: 2403005 - RNA, 22 nt, Human
agccccagggucuucccuaccu

SEQ ID NO: 2403006 - RNA, 11 nt, Human
agccccauccu

SEQ ID NO: 2403007 - RNA, 20 nt, Human
agccccaucccaaacccuuc

SEQ ID NO: 2403008 - RNA, 14 nt, Human
agcccuagagccug

SEQ ID NO: 2403009 - RNA, 16 nt, Human
agcccuaaggaucucu

SEQ ID NO: 2403010 - RNA, 21 nt, Human
agcccuaaggaucucucagga

SEQ ID NO: 2403011 - RNA, 20 nt, Human
agccgagaucacgccacugc

SEQ ID NO: 2403012 - RNA, 19 nt, Human
agccgagaucacgccacug

SEQ ID NO: 2403013 - RNA, 21 nt, Human
agcccugaggugaaagggagc

SEQ ID NO: 2403014 - RNA, 22 nt, Human
agcccugaggugaaagggagcu

SEQ ID NO: 2403015 - RNA, 15 nt, Human
agcccugagcuuucu

SEQ ID NO: 2403016 - RNA, 17 nt, Human
agcccuagagccugccu

SEQ ID NO: 2403017 - RNA, 16 nt, Human
agcccuagagccugcc

SEQ ID NO: 2403018 - RNA, 15 nt, Human
agcccuagagccugc

SEQ ID NO: 2403019 - RNA, 22 nt, Human
agcccuagagccugccuggagc

SEQ ID NO: 2403020 - RNA, 20 nt, Human
agcccuagagccugccugga

SEQ ID NO: 2403021 - RNA, 16 nt, Human
agcccuaggguggaga

SEQ ID NO: 2403022 - RNA, 15 nt, Human
agcccuauggaugug

SEQ ID NO: 2403023 - RNA, 14 nt, Human
agcccuauggaugu

SEQ ID NO: 2403024 - RNA, 13 nt, Human
agcccuauggaug

SEQ ID NO: 2403025 - RNA, 12 nt, Human
agcccuauggau

SEQ ID NO: 2403026 - RNA, 17 nt, Human
agcccuaggguggagag

SEQ ID NO: 2403027 - RNA, 20 nt, Human
agcccuaggguggagagcca

SEQ ID NO: 2403028 - RNA, 19 nt, Human
agcccucuuccaucauguc

SEQ ID NO: 2403029 - RNA, 17 nt, Human
agcccucuuccaucaug

SEQ ID NO: 2403030 - RNA, 16 nt, Human
agcccuauggaugugg

SEQ ID NO: 2403031 - RNA, 16 nt, Human
agcccucuuccaucau

SEQ ID NO: 2403032 - RNA, 23 nt, Human
agcccucuuccaucaugucccca

SEQ ID NO: 2403033 - RNA, 13 nt, Human
agcccugacccug

SEQ ID NO: 2403034 - RNA, 17 nt, Human
agcccugacuggugcua

SEQ ID NO: 2403035 - RNA, 21 nt, Human
agcccugacccuguggaagca

SEQ ID NO: 2403036 - RNA, 17 nt, Human
agcccugacccugugga

SEQ ID NO: 2403037 - RNA, 15 nt, Human
agcccugacccugug

SEQ ID NO: 2403038 - RNA, 23 nt, Human
agcaguugaaaagacuccaaaga

SEQ ID NO: 2403039 - RNA, 21 nt, Human
agcaguugaaaagacuccaaa

SEQ ID NO: 2403040 - RNA, 22 nt, Human
agcagugagaaaaagcuccugu

SEQ ID NO: 2403041 - RNA, 21 nt, Human
agcagugagaaaaagcuccug

SEQ ID NO: 2403042 - RNA, 16 nt, Human
agcagugagaaaaagc

SEQ ID NO: 2403043 - RNA, 17 nt, Human
agcagugaaaacaagug

SEQ ID NO: 2403044 - RNA, 21 nt, Human
agcagugaaugauucaguguu

SEQ ID NO: 2403045 - RNA, 22 nt, Human
agcagugaaugauucaguguua

SEQ ID NO: 2403046 - RNA, 23 nt, Human
agcagugaguuacagcgagaggc

SEQ ID NO: 2403047 - RNA, 16 nt, Human
agcagugagucucuuc

SEQ ID NO: 2403048 - RNA, 14 nt, Human
agcagugagccgca

SEQ ID NO: 2403049 - RNA, 22 nt, Human
agcagugagccgcaucuucucc

SEQ ID NO: 2403050 - RNA, 20 nt, Human
agcagugaaugauucagugu

SEQ ID NO: 2403051 - RNA, 21 nt, Human
agcagucuacccaccucagcc

SEQ ID NO: 2403052 - RNA, 21 nt, Human
agcagucgugccuguguccau

SEQ ID NO: 2403053 - RNA, 19 nt, Human
agcagucgugccugugucc

SEQ ID NO: 2403054 - RNA, 23 nt, Human
agcagucuacccaccucagccuc

SEQ ID NO: 2403055 - RNA, 10 nt, Human
agcagccacg

SEQ ID NO: 2403056 - RNA, 13 nt, Human
agcagccacgagg

SEQ ID NO: 2403057 - RNA, 13 nt, Human
agcagccagcucu

SEQ ID NO: 2403058 - RNA, 14 nt, Human
agcagccagcucuc

SEQ ID NO: 2403059 - RNA, 15 nt, Human
agcagccagcucuca

SEQ ID NO: 2403060 - RNA, 19 nt, Human
agcagccaucauaggaagg

SEQ ID NO: 2403061 - RNA, 23 nt, Human
agcagccagcucucagccaacga

SEQ ID NO: 2403062 - RNA, 16 nt, Human
agcagccagcucucag

SEQ ID NO: 2403063 - RNA, 17 nt, Human
agcagccagcucucagc

SEQ ID NO: 2403064 - RNA, 18 nt, Human
agcagccagcucucagcc

SEQ ID NO: 2403065 - RNA, 19 nt, Human
agcagccagcucucagcca

SEQ ID NO: 2403066 - RNA, 21 nt, Human
agcagcccgcugaguggacug

SEQ ID NO: 2403067 - RNA, 20 nt, Human
agcagccaucauaggaaggg

SEQ ID NO: 2403068 - RNA, 18 nt, Human
agcagcccuaaggaucuc

SEQ ID NO: 2403069 - RNA, 14 nt, Human
agcagcccuaagga

SEQ ID NO: 2403070 - RNA, 12 nt, Human
agcagcccuccu

SEQ ID NO: 2403071 - RNA, 13 nt, Human
agcagcccuccuc

SEQ ID NO: 2403072 - RNA, 14 nt, Human
agcagcccuccuca

SEQ ID NO: 2403073 - RNA, 13 nt, Human
agcacuggccugc

SEQ ID NO: 2403074 - RNA, 12 nt, Human
agcacuggccug

SEQ ID NO: 2403075 - RNA, 23 nt, Human
agcacuggagugcagggaggaga

SEQ ID NO: 2403076 - RNA, 22 nt, Human
agcacuggagugcagggaggag

SEQ ID NO: 2403077 - RNA, 20 nt, Human
agcacuggagugcagggagg

SEQ ID NO: 2403078 - RNA, 19 nt, Human
agcacuggagugcagggag

SEQ ID NO: 2403079 - RNA, 17 nt, Human
agcacuggagugcaggg

SEQ ID NO: 2403080 - RNA, 16 nt, Human
agcacuggagugcagg

SEQ ID NO: 2403081 - RNA, 23 nt, Human
agcacugcuaggcgagugccagg

SEQ ID NO: 2403082 - RNA, 22 nt, Human
agcacugcuaggcgagugccag

SEQ ID NO: 2403083 - RNA, 21 nt, Human
agcacugcuaggcgagugcca

SEQ ID NO: 2403084 - RNA, 17 nt, Human
agcacugcuugaggaaa

SEQ ID NO: 2403085 - RNA, 20 nt, Human
agcacuggcucucuccagga

SEQ ID NO: 2403086 - RNA, 19 nt, Human
agcacuggcucucuccagg

SEQ ID NO: 2403087 - RNA, 18 nt, Human
agcacuggcucucuccag

SEQ ID NO: 2403088 - RNA, 17 nt, Human
agcacuggcucucucca

SEQ ID NO: 2403089 - RNA, 14 nt, Human
agcacuggcucucu

SEQ ID NO: 2403090 - RNA, 13 nt, Human
agcacuggcucuc

SEQ ID NO: 2403091 - RNA, 17 nt, Human
agcacuggccugcacgg

SEQ ID NO: 2403092 - RNA, 15 nt, Human
agcacuggccugcac

SEQ ID NO: 2403093 - RNA, 21 nt, Human
agcagccacauuccugaugcu

SEQ ID NO: 2403094 - RNA, 19 nt, Human
agcacuaaggugugcucug

SEQ ID NO: 2403095 - RNA, 16 nt, Human
agcacuaaagcagugg

SEQ ID NO: 2403096 - RNA, 17 nt, Human
agcacuaaagcagugga

SEQ ID NO: 2403097 - RNA, 20 nt, Human
agcacuaaagcaguggacac

SEQ ID NO: 2403098 - RNA, 23 nt, Human
agcacuaaagcaguggacaccag

SEQ ID NO: 2403099 - RNA, 12 nt, Human
agcacugcccaa

SEQ ID NO: 2403100 - RNA, 16 nt, Human
agcacuaacguaaaua

SEQ ID NO: 2403101 - RNA, 13 nt, Human
agcacuaaagcag

SEQ ID NO: 2403102 - RNA, 14 nt, Human
agcacuaaagcagu

SEQ ID NO: 2403103 - RNA, 14 nt, Human
agauguagaggaga

SEQ ID NO: 2403104 - RNA, 21 nt, Human
agaugggagaaucacuugaac

SEQ ID NO: 2403105 - RNA, 22 nt, Human
agauguaauuguuugucuuuaa

SEQ ID NO: 2403106 - RNA, 19 nt, Human
agaugggacugggagggcc

SEQ ID NO: 2403107 - RNA, 15 nt, Human
agaugggacugggag

SEQ ID NO: 2403108 - RNA, 23 nt, Human
agcaguugagucgucaucacuuu

SEQ ID NO: 2403109 - RNA, 13 nt, Human
agcaguuguguca

SEQ ID NO: 2403110 - RNA, 19 nt, Human
agccagauuuuccugaaaa

SEQ ID NO: 2403111 - RNA, 15 nt, Human
agccagauuuuccug

SEQ ID NO: 2403112 - RNA, 17 nt, Human
agccagauccucuuggu

SEQ ID NO: 2403113 - RNA, 22 nt, Human
agccagcaaugauguccagaag

SEQ ID NO: 2403114 - RNA, 23 nt, Human
agccagcaaugauguccagaaga

SEQ ID NO: 2403115 - RNA, 13 nt, Human
agccagcacacag

SEQ ID NO: 2403116 - RNA, 20 nt, Human
agccauuccugguacccagc

SEQ ID NO: 2403117 - RNA, 12 nt, Human
agccauuccugg

SEQ ID NO: 2403118 - RNA, 14 nt, Human
agccauucacugcc

SEQ ID NO: 2403119 - RNA, 24 nt, Human
agccagcaaugauguccagaagaa

SEQ ID NO: 2403120 - RNA, 23 nt, Human
agccauuccugguacccagccau

SEQ ID NO: 2403121 - RNA, 22 nt, Human
agccauuccugguacccagcca

SEQ ID NO: 2403122 - RNA, 17 nt, Human
agccauucugacucaua

SEQ ID NO: 2403123 - RNA, 18 nt, Human
agccauuaccauggagac

SEQ ID NO: 2403124 - RNA, 20 nt, Human
agccauuaccauggagacaa

SEQ ID NO: 2403125 - RNA, 18 nt, Human
agccauuguuggcuuucc

SEQ ID NO: 2403126 - RNA, 17 nt, Human
agccauugucuucggaa

SEQ ID NO: 2403127 - RNA, 12 nt, Human
agccauugucuu

SEQ ID NO: 2403128 - RNA, 22 nt, Human
agccauuggcuauuuaaaacuu

SEQ ID NO: 2403129 - RNA, 21 nt, Human
agccauuggcuauuuaaaacu

SEQ ID NO: 2403130 - RNA, 14 nt, Human
agccauuucuuguu

SEQ ID NO: 2403131 - RNA, 16 nt, Human
agcccaaagaaggaaa

SEQ ID NO: 2403132 - RNA, 14 nt, Human
agcccaaagaagga

SEQ ID NO: 2403133 - RNA, 22 nt, Human
agccagauggacuccagccugc

SEQ ID NO: 2403134 - RNA, 16 nt, Human
agccagauccucuugg

SEQ ID NO: 2403135 - RNA, 15 nt, Human
agccagauccucuug

SEQ ID NO: 2403136 - RNA, 14 nt, Human
agccagauccucuu

SEQ ID NO: 2403137 - RNA, 12 nt, Human
agccagauccuc

SEQ ID NO: 2403138 - RNA, 15 nt, Human
agccagaguuccugc

SEQ ID NO: 2403139 - RNA, 20 nt, Human
agccaagggaaaggggugcu

SEQ ID NO: 2403140 - RNA, 18 nt, Human
agccagaggcuggguuca

SEQ ID NO: 2403141 - RNA, 15 nt, Human
agccagaggcugggu

SEQ ID NO: 2403142 - RNA, 13 nt, Human
agccagaggucug

SEQ ID NO: 2403143 - RNA, 20 nt, Human
agccagaggagagaggaccc

SEQ ID NO: 2403144 - RNA, 14 nt, Human
agccagaggcuggg

SEQ ID NO: 2403145 - RNA, 11 nt, Human
agccagaggcu

SEQ ID NO: 2403146 - RNA, 23 nt, Human
agccaagggaaaggggugcuuuu

SEQ ID NO: 2403147 - RNA, 16 nt, Human
agccaagggaaagggg

SEQ ID NO: 2403148 - RNA, 20 nt, Human
agccaaggccaaaggaagca

SEQ ID NO: 2403149 - RNA, 22 nt, Human
agccaaggccaaaggaagcaca

SEQ ID NO: 2403150 - RNA, 23 nt, Human
agccaaggccaaaggaagcacau

SEQ ID NO: 2403151 - RNA, 23 nt, Human
agccaaggcccugaguuggcagu

SEQ ID NO: 2403152 - RNA, 22 nt, Human
agccaaggccgaagcucuggcu

SEQ ID NO: 2403153 - RNA, 20 nt, Human
agccaaggccgaagcucugg

SEQ ID NO: 2403154 - RNA, 14 nt, Human
agccaagggaaagg

SEQ ID NO: 2403155 - RNA, 23 nt, Human
agcaucuuggggggguggccgcu

SEQ ID NO: 2403156 - RNA, 21 nt, Human
agcaucuuggggggguggccg

SEQ ID NO: 2403157 - RNA, 19 nt, Human
agcaucuuggggggguggc

SEQ ID NO: 2403158 - RNA, 15 nt, Human
agcaucuucuggagu

SEQ ID NO: 2403159 - RNA, 13 nt, Human
agcaugaaaaagc

SEQ ID NO: 2403160 - RNA, 14 nt, Human
agcaugaaaaagca

SEQ ID NO: 2403161 - RNA, 18 nt, Human
agcaucuucacuucuaaa

SEQ ID NO: 2403162 - RNA, 20 nt, Human
agcaucuuccagaaguguga

SEQ ID NO: 2403163 - RNA, 17 nt, Human
agcaucuuccagaagug

SEQ ID NO: 2403164 - RNA, 20 nt, Human
agcaucuucacuucuaaaug

SEQ ID NO: 2403165 - RNA, 23 nt, Human
agcaucuucacuucuaaaugcau

SEQ ID NO: 2403166 - RNA, 23 nt, Human
agcaucuuccagaagugugauug

SEQ ID NO: 2403167 - RNA, 22 nt, Human
agcaucuuccagaagugugauu

SEQ ID NO: 2403168 - RNA, 12 nt, Human
agcaucuucugg

SEQ ID NO: 2403169 - RNA, 23 nt, Human
agccaaagcuaggccuggccaga

SEQ ID NO: 2403170 - RNA, 20 nt, Human
agccaaagcuaggccuggcc

SEQ ID NO: 2403171 - RNA, 19 nt, Human
agccaaagcuaggccuggc

SEQ ID NO: 2403172 - RNA, 12 nt, Human
agcaugccugga

SEQ ID NO: 2403173 - RNA, 14 nt, Human
agcaugcacaaauu

SEQ ID NO: 2403174 - RNA, 13 nt, Human
agcaugaggaacu

SEQ ID NO: 2403175 - RNA, 12 nt, Human
agagccugcugg

SEQ ID NO: 2403176 - RNA, 17 nt, Human
agagccugcugcauggg

SEQ ID NO: 2403177 - RNA, 24 nt, Human
agagccugcuggcacccaccgugg

SEQ ID NO: 2403178 - RNA, 19 nt, Human
agagccugcuggcacccac

SEQ ID NO: 2403179 - RNA, 13 nt, Human
agagccugcuggc

SEQ ID NO: 2403180 - RNA, 15 nt, Human
agagccugcugcaug

SEQ ID NO: 2403181 - RNA, 16 nt, Human
agagccuggagaagcu

SEQ ID NO: 2403182 - RNA, 15 nt, Human
agagccuggagaagc

SEQ ID NO: 2403183 - RNA, 14 nt, Human
agagccuggagaag

SEQ ID NO: 2403184 - RNA, 13 nt, Human
agagccuggagaa

SEQ ID NO: 2403185 - RNA, 17 nt, Human
agagccuggagaagcug

SEQ ID NO: 2403186 - RNA, 18 nt, Human
agagccuggugcugcugc

SEQ ID NO: 2403187 - RNA, 16 nt, Human
agagccuggugcugcu

SEQ ID NO: 2403188 - RNA, 13 nt, Human
agagccccagcug

SEQ ID NO: 2403189 - RNA, 17 nt, Human
agagccccacacggagg

SEQ ID NO: 2403190 - RNA, 22 nt, Human
agagaguccucuggauggcacc

SEQ ID NO: 2403191 - RNA, 16 nt, Human
agagaguccucuggau

SEQ ID NO: 2403192 - RNA, 15 nt, Human
agagccccacacgga

SEQ ID NO: 2403193 - RNA, 17 nt, Human
agagcccgggagcugcu

SEQ ID NO: 2403194 - RNA, 16 nt, Human
agagccccagcugaca

SEQ ID NO: 2403195 - RNA, 15 nt, Human
agagccccagcugac

SEQ ID NO: 2403196 - RNA, 14 nt, Human
agagccccagcuga

SEQ ID NO: 2403197 - RNA, 15 nt, Human
agagaguccucugga

SEQ ID NO: 2403198 - RNA, 23 nt, Human
agagagucccacugccucagguu

SEQ ID NO: 2403199 - RNA, 21 nt, Human
agagagucccacugccucagg

SEQ ID NO: 2403200 - RNA, 20 nt, Human
agagagucccacugccucag

SEQ ID NO: 2403201 - RNA, 18 nt, Human
agagagucccacugccuc

SEQ ID NO: 2403202 - RNA, 15 nt, Human
agagagucccacugc

SEQ ID NO: 2403203 - RNA, 22 nt, Human
agagaguaauggguuucauauu

SEQ ID NO: 2403204 - RNA, 16 nt, Human
agagaguggcuccucc

SEQ ID NO: 2403205 - RNA, 14 nt, Human
agagaguggcuccu

SEQ ID NO: 2403206 - RNA, 23 nt, Human
agagaggguggugaccucugccu

SEQ ID NO: 2403207 - RNA, 14 nt, Human
agagaggagaaaca

SEQ ID NO: 2403208 - RNA, 16 nt, Human
agagaggagaaacaca

SEQ ID NO: 2403209 - RNA, 13 nt, Human
agagaggagagga

SEQ ID NO: 2403210 - RNA, 18 nt, Human
agagaggagaaacacauc

SEQ ID NO: 2403211 - RNA, 15 nt, Human
agagaggagaggaga

SEQ ID NO: 2403212 - RNA, 22 nt, Human
agagaggucaagcccaggagga

SEQ ID NO: 2403213 - RNA, 20 nt, Human
agagagguuauagaguagaa

SEQ ID NO: 2403214 - RNA, 23 nt, Human
agagaggucaagcccaggaggac

SEQ ID NO: 2403215 - RNA, 20 nt, Human
agagaagccccuuccccaug

SEQ ID NO: 2403216 - RNA, 17 nt, Human
agagaagccccuucccc

SEQ ID NO: 2403217 - RNA, 13 nt, Human
agagaagccccuu

SEQ ID NO: 2403218 - RNA, 16 nt, Human
agagaagcaaguggug

SEQ ID NO: 2403219 - RNA, 13 nt, Human
agagaagccugug

SEQ ID NO: 2403220 - RNA, 23 nt, Human
agagaagccccuuccccauggga

SEQ ID NO: 2403221 - RNA, 12 nt, Human
agagaaggagcc

SEQ ID NO: 2403222 - RNA, 13 nt, Human
agagaaggagcca

SEQ ID NO: 2403223 - RNA, 20 nt, Human
agagaagcuaaaaccugagc

SEQ ID NO: 2403224 - RNA, 16 nt, Human
agagagcuucuguugc

SEQ ID NO: 2403225 - RNA, 17 nt, Human
agagagcuguucccaaa

SEQ ID NO: 2403226 - RNA, 15 nt, Human
agagaaggggaggag

SEQ ID NO: 2403227 - RNA, 12 nt, Human
agagaaggcagg

SEQ ID NO: 2403228 - RNA, 13 nt, Human
agagaaggcagga

SEQ ID NO: 2403229 - RNA, 20 nt, Human
agagaaggcaggaaugugug

SEQ ID NO: 2403230 - RNA, 18 nt, Human
agagaaggccucccuagc

SEQ ID NO: 2403231 - RNA, 12 nt, Human
agagaaggggag

SEQ ID NO: 2403232 - RNA, 20 nt, Human
agagagcuucuguugcugcc

SEQ ID NO: 2403233 - RNA, 23 nt, Human
agagagcuucuguugcugccuca

SEQ ID NO: 2403234 - RNA, 18 nt, Human
agagagcuuaaugauaau

SEQ ID NO: 2403235 - RNA, 23 nt, Human
agagaggaaagguuugagaagca

SEQ ID NO: 2403236 - RNA, 14 nt, Human
agagaggaaucaga

SEQ ID NO: 2403237 - RNA, 13 nt, Human
agagaggacagcu

SEQ ID NO: 2403238 - RNA, 17 nt, Human
agagaggaaucagacuu

SEQ ID NO: 2403239 - RNA, 18 nt, Human
agagaggacgugggcggc

SEQ ID NO: 2403240 - RNA, 12 nt, Human
agagaagaggcu

SEQ ID NO: 2403241 - RNA, 18 nt, Human
agagaaaguacuucucca

SEQ ID NO: 2403242 - RNA, 23 nt, Human
agagaaaggggagcccacugucc

SEQ ID NO: 2403243 - RNA, 12 nt, Human
agagaaagggga

SEQ ID NO: 2403244 - RNA, 10 nt, Human
agagaagaga

SEQ ID NO: 2403245 - RNA, 21 nt, Human
agagaagagauugugguuuca

SEQ ID NO: 2403246 - RNA, 13 nt, Human
agagaaagagaga

SEQ ID NO: 2403247 - RNA, 17 nt, Human
agagaaagaagagacag

SEQ ID NO: 2403248 - RNA, 16 nt, Human
agagaaagaagagaca

SEQ ID NO: 2403249 - RNA, 15 nt, Human
agagaaagaagagac

SEQ ID NO: 2403250 - RNA, 17 nt, Human
agacugcauuauauuua

SEQ ID NO: 2403251 - RNA, 22 nt, Human
agagaaagccaggcagguagcc

SEQ ID NO: 2403252 - RNA, 19 nt, Human
agagaaagccaggcaggua

SEQ ID NO: 2403253 - RNA, 17 nt, Human
agagaaagccaggcagg

SEQ ID NO: 2403254 - RNA, 16 nt, Human
agagaaagccaggcag

SEQ ID NO: 2403255 - RNA, 14 nt, Human
agagaaagccaggc

SEQ ID NO: 2403256 - RNA, 13 nt, Human
agagaaagccagg

SEQ ID NO: 2403257 - RNA, 18 nt, Human
agagaaagcacgugucuc

SEQ ID NO: 2403258 - RNA, 19 nt, Human
agagaaaggggagcccacu

SEQ ID NO: 2403259 - RNA, 21 nt, Human
agagaaaggggagcccacugu

SEQ ID NO: 2403260 - RNA, 18 nt, Human
agagaaaggggagcccac

SEQ ID NO: 2403261 - RNA, 23 nt, Human
agacugaguacguugugcauuug

SEQ ID NO: 2403262 - RNA, 13 nt, Human
agacaaugacuua

SEQ ID NO: 2403263 - RNA, 17 nt, Human
agacaaugacuuacugu

SEQ ID NO: 2403264 - RNA, 19 nt, Human
agacaaugacuuacuguac

SEQ ID NO: 2403265 - RNA, 15 nt, Human
agacaauuuauuaug

SEQ ID NO: 2403266 - RNA, 21 nt, Human
agacaauuuauuauggcacau

SEQ ID NO: 2403267 - RNA, 18 nt, Human
agacacaacaacuccuag

SEQ ID NO: 2403268 - RNA, 15 nt, Human
agacacaacaacucc

SEQ ID NO: 2403269 - RNA, 21 nt, Human
agaccaucccugaaggccccg

SEQ ID NO: 2403270 - RNA, 18 nt, Human
agaccaucccugaaggcc

SEQ ID NO: 2403271 - RNA, 17 nt, Human
agaccaucccugaaggc

SEQ ID NO: 2403272 - RNA, 14 nt, Human
agaccaucccugaa

SEQ ID NO: 2403273 - RNA, 20 nt, Human
agaccaguugggagcacugg

SEQ ID NO: 2403274 - RNA, 19 nt, Human
agaccaguugggagcacug

SEQ ID NO: 2403275 - RNA, 18 nt, Human
agaccaguugggagcacu

SEQ ID NO: 2403276 - RNA, 13 nt, Human
agaccaguuggga

SEQ ID NO: 2403277 - RNA, 14 nt, Human
agaccagucuggcc

SEQ ID NO: 2403278 - RNA, 17 nt, Human
agaccaggcaaagcaag

SEQ ID NO: 2403279 - RNA, 16 nt, Human
agaccaccaccucaga

SEQ ID NO: 2403280 - RNA, 13 nt, Human
agaccagcucuuc

SEQ ID NO: 2403281 - RNA, 16 nt, Human
agaccaggcaaagcaa

SEQ ID NO: 2403282 - RNA, 15 nt, Human
agaccagggagccuu

SEQ ID NO: 2403283 - RNA, 13 nt, Human
agaccaucccuga

SEQ ID NO: 2403284 - RNA, 22 nt, Human
agaccaguugggagcacuggag

SEQ ID NO: 2403285 - RNA, 21 nt, Human
agaccaguugggagcacugga

SEQ ID NO: 2403286 - RNA, 13 nt, Human
agaccauaauguu

SEQ ID NO: 2403287 - RNA, 23 nt, Human
agaccaguugggagcacuggagu

SEQ ID NO: 2403288 - RNA, 15 nt, Human
agaccauagugacca

SEQ ID NO: 2403289 - RNA, 17 nt, Human
agacagcccgggcucug

SEQ ID NO: 2403290 - RNA, 14 nt, Human
agacacaacuauuu

SEQ ID NO: 2403291 - RNA, 16 nt, Human
agacagcccgggcucu

SEQ ID NO: 2403292 - RNA, 20 nt, Human
agacagcccgggcucugccu

SEQ ID NO: 2403293 - RNA, 18 nt, Human
agacagcccgggcucugc

SEQ ID NO: 2403294 - RNA, 23 nt, Human
agaccacaucuuuaucuguucuu

SEQ ID NO: 2403295 - RNA, 13 nt, Human
agaccacaucuuu

SEQ ID NO: 2403296 - RNA, 15 nt, Human
agaccaccaccucag

SEQ ID NO: 2403297 - RNA, 16 nt, Human
agaccaccacuucgaa

SEQ ID NO: 2403298 - RNA, 16 nt, Human
agaccacaaaaauuga

SEQ ID NO: 2403299 - RNA, 21 nt, Human
agaccacaaauagugcucgcu

SEQ ID NO: 2403300 - RNA, 14 nt, Human
agaccacaaauagu

SEQ ID NO: 2403301 - RNA, 20 nt, Human
agaccacaggguucaaaaug

SEQ ID NO: 2403302 - RNA, 21 nt, Human
agaccacaggguucaaaaugu

SEQ ID NO: 2403303 - RNA, 14 nt, Human
agaccaaccugacc

SEQ ID NO: 2403304 - RNA, 13 nt, Human
agaccaagcuugu

SEQ ID NO: 2403305 - RNA, 19 nt, Human
agacacaacaacuccuagg

SEQ ID NO: 2403306 - RNA, 17 nt, Human
agaccaagacucugaaa

SEQ ID NO: 2403307 - RNA, 16 nt, Human
agaccaagcuugucca

SEQ ID NO: 2403308 - RNA, 14 nt, Human
agaccaaggcggga

SEQ ID NO: 2403309 - RNA, 17 nt, Human
agaccaaggcgggagca

SEQ ID NO: 2403310 - RNA, 23 nt, Human
agaccaaggcgggagcaucucuu

SEQ ID NO: 2403311 - RNA, 20 nt, Human
agacuagaauucuagugcug

SEQ ID NO: 2403312 - RNA, 20 nt, Human
agacggagucucgcucuguc

SEQ ID NO: 2403313 - RNA, 15 nt, Human
agacggagucucgcu

SEQ ID NO: 2403314 - RNA, 14 nt, Human
agacggauugcauu

SEQ ID NO: 2403315 - RNA, 16 nt, Human
agacggcacccaccca

SEQ ID NO: 2403316 - RNA, 19 nt, Human
agacggagucccaccuugg

SEQ ID NO: 2403317 - RNA, 18 nt, Human
agacgggggcagagaggg

SEQ ID NO: 2403318 - RNA, 14 nt, Human
agacguguuugugu

SEQ ID NO: 2403319 - RNA, 15 nt, Human
agacuaauuuaaaaa

SEQ ID NO: 2403320 - RNA, 19 nt, Human
agacuaauuccugcccugc

SEQ ID NO: 2403321 - RNA, 23 nt, Human
agacuaagcccugucgagacacu

SEQ ID NO: 2403322 - RNA, 14 nt, Human
agacuaauuuaaaa

SEQ ID NO: 2403323 - RNA, 19 nt, Human
agacuagaauucuagugcu

SEQ ID NO: 2403324 - RNA, 17 nt, Human
agacuagaauucuagug

SEQ ID NO: 2403325 - RNA, 14 nt, Human
agacuagaauucua

SEQ ID NO: 2403326 - RNA, 15 nt, Human
agacuaagcccuguc

SEQ ID NO: 2403327 - RNA, 14 nt, Human
agacuaagcccugu

SEQ ID NO: 2403328 - RNA, 13 nt, Human
agacuaagcccug

SEQ ID NO: 2403329 - RNA, 19 nt, Human
agacguguggcaauagugg

SEQ ID NO: 2403330 - RNA, 19 nt, Human
agaucuguccucagccuug

SEQ ID NO: 2403331 - RNA, 23 nt, Human
agaucuguccucagccuugccag

SEQ ID NO: 2403332 - RNA, 21 nt, Human
agaucuguuuugaaggcaaaa

SEQ ID NO: 2403333 - RNA, 14 nt, Human
agaucuguuuugaa

SEQ ID NO: 2403334 - RNA, 19 nt, Human
agaucugugccccaugccu

SEQ ID NO: 2403335 - RNA, 12 nt, Human
agaucugugccc

SEQ ID NO: 2403336 - RNA, 13 nt, Human
agaucugugcccc

SEQ ID NO: 2403337 - RNA, 14 nt, Human
agaucugugcccca

SEQ ID NO: 2403338 - RNA, 16 nt, Human
agaucugugccccaug

SEQ ID NO: 2403339 - RNA, 16 nt, Human
agaugagcuuuucuag

SEQ ID NO: 2403340 - RNA, 13 nt, Human
agaugagcuuuuc

SEQ ID NO: 2403341 - RNA, 18 nt, Human
agaugggaaugagguggg

SEQ ID NO: 2403342 - RNA, 13 nt, Human
agaugggaaugag

SEQ ID NO: 2403343 - RNA, 23 nt, Human
agaugggaaugaagcuuguguau

SEQ ID NO: 2403344 - RNA, 18 nt, Human
agaugggaaugaagcuug

SEQ ID NO: 2403345 - RNA, 17 nt, Human
agaugggaaugaagcuu

SEQ ID NO: 2403346 - RNA, 16 nt, Human
agaugggaaugaagcu

SEQ ID NO: 2403347 - RNA, 15 nt, Human
agaugggaaugaagc

SEQ ID NO: 2403348 - RNA, 14 nt, Human
agaugggaaugaag

SEQ ID NO: 2403349 - RNA, 23 nt, Human
agauggcugugccucugccuguc

SEQ ID NO: 2403350 - RNA, 14 nt, Human
agaugacugagucc

SEQ ID NO: 2403351 - RNA, 15 nt, Human
agaugacugaguccu

SEQ ID NO: 2403352 - RNA, 16 nt, Human
agaucuuaaauuuugu

SEQ ID NO: 2403353 - RNA, 14 nt, Human
agaucuuaaauuuu

SEQ ID NO: 2403354 - RNA, 13 nt, Human
agaucuuaaauuu

SEQ ID NO: 2403355 - RNA, 18 nt, Human
agaucuguuuugaaggca

SEQ ID NO: 2403356 - RNA, 14 nt, Human
agaugaccccuccc

SEQ ID NO: 2403357 - RNA, 16 nt, Human
agauagccaaggccaa

SEQ ID NO: 2403358 - RNA, 15 nt, Human
agauagccaaggcca

SEQ ID NO: 2403359 - RNA, 21 nt, Human
agauaggucagugcaaauacu

SEQ ID NO: 2403360 - RNA, 18 nt, Human
agauagcauugugaacug

SEQ ID NO: 2403361 - RNA, 17 nt, Human
agauagcauugugaacu

SEQ ID NO: 2403362 - RNA, 16 nt, Human
agauagcauugugaac

SEQ ID NO: 2403363 - RNA, 14 nt, Human
agauagcauuguga

SEQ ID NO: 2403364 - RNA, 22 nt, Human
agauagcauugugaacugacag

SEQ ID NO: 2403365 - RNA, 19 nt, Human
agauagcauugugaacuga

SEQ ID NO: 2403366 - RNA, 22 nt, Human
agauaguaucuagcaaucacaa

SEQ ID NO: 2403367 - RNA, 19 nt, Human
agauaguaucuagcaauca

SEQ ID NO: 2403368 - RNA, 15 nt, Human
agauagguaaauacc

SEQ ID NO: 2403369 - RNA, 14 nt, Human
agauaguacauaaa

SEQ ID NO: 2403370 - RNA, 18 nt, Human
agauaguacauaaaggug

SEQ ID NO: 2403371 - RNA, 17 nt, Human
agauaguagcauacauu

SEQ ID NO: 2403372 - RNA, 15 nt, Human
agauaguuacuauau

SEQ ID NO: 2403373 - RNA, 17 nt, Human
agaggagagccagagaa

SEQ ID NO: 2403374 - RNA, 16 nt, Human
agaggagagccagaga

SEQ ID NO: 2403375 - RNA, 15 nt, Human
agaggagagccagag

SEQ ID NO: 2403376 - RNA, 14 nt, Human
agaggagagccaga

SEQ ID NO: 2403377 - RNA, 13 nt, Human
agaggagagccag

SEQ ID NO: 2403378 - RNA, 23 nt, Human
agaggaguucaaugaucuagguu

SEQ ID NO: 2403379 - RNA, 19 nt, Human
agaggaguucaaugaucua

SEQ ID NO: 2403380 - RNA, 18 nt, Human
agaggaguucaaugaucu

SEQ ID NO: 2403381 - RNA, 17 nt, Human
agaggaguucaaugauc

SEQ ID NO: 2403382 - RNA, 16 nt, Human
agaggaguucaaugau

SEQ ID NO: 2403383 - RNA, 15 nt, Human
agaggaguucaauga

SEQ ID NO: 2403384 - RNA, 14 nt, Human
agaggaguucaaug

SEQ ID NO: 2403385 - RNA, 15 nt, Human
agaggagaggagaga

SEQ ID NO: 2403386 - RNA, 12 nt, Human
agaggagaggag

SEQ ID NO: 2403387 - RNA, 23 nt, Human
agaggagagccagagaagugaca

SEQ ID NO: 2403388 - RNA, 21 nt, Human
agaggagagccagagaaguga

SEQ ID NO: 2403389 - RNA, 17 nt, Human
agaggagaggagagagg

SEQ ID NO: 2403390 - RNA, 16 nt, Human
agaggagaggagagag

SEQ ID NO: 2403391 - RNA, 13 nt, Human
agaggagaggggc

SEQ ID NO: 2403392 - RNA, 18 nt, Human
agaggggaaaagagauga

SEQ ID NO: 2403393 - RNA, 17 nt, Human
agagggcuuuaauuuuu

SEQ ID NO: 2403394 - RNA, 13 nt, Human
agagggcuuccuc

SEQ ID NO: 2403395 - RNA, 22 nt, Human
agaggggaacagacuggaagca

SEQ ID NO: 2403396 - RNA, 16 nt, Human
agaggggaagagacuu

SEQ ID NO: 2403397 - RNA, 16 nt, Human
agaggggaagggccag

SEQ ID NO: 2403398 - RNA, 22 nt, Human
agaggggaagaguguacugggg

SEQ ID NO: 2403399 - RNA, 22 nt, Human
agaggggaaaccaguguagccu

SEQ ID NO: 2403400 - RNA, 20 nt, Human
agaggggacaaaacccaccu

SEQ ID NO: 2403401 - RNA, 19 nt, Human
agaggggaauaauagaaga

SEQ ID NO: 2403402 - RNA, 20 nt, Human
agaggggaauaauagaagaa

SEQ ID NO: 2403403 - RNA, 22 nt, Human
agagggcuuccucuagaagcca

SEQ ID NO: 2403404 - RNA, 20 nt, Human
agaggauuuuuuucugagcg

SEQ ID NO: 2403405 - RNA, 19 nt, Human
agaggauuuuuuucugagc

SEQ ID NO: 2403406 - RNA, 16 nt, Human
agaggggaaaagagau

SEQ ID NO: 2403407 - RNA, 22 nt, Human
agaggauggccagugucugucc

SEQ ID NO: 2403408 - RNA, 18 nt, Human
agaggauuuuuuucugag

SEQ ID NO: 2403409 - RNA, 18 nt, Human
agaggaugagagcccaga

SEQ ID NO: 2403410 - RNA, 17 nt, Human
agaggaugagagcccag

SEQ ID NO: 2403411 - RNA, 14 nt, Human
agaggaugagagcc

SEQ ID NO: 2403412 - RNA, 13 nt, Human
agaggaugagagc

SEQ ID NO: 2403413 - RNA, 22 nt, Human
agaggaugaauguaugugcacu

SEQ ID NO: 2403414 - RNA, 21 nt, Human
agaggaugaauguaugugcac

SEQ ID NO: 2403415 - RNA, 20 nt, Human
agaggaugaauguaugugca

SEQ ID NO: 2403416 - RNA, 18 nt, Human
agaggauggccagugucu

SEQ ID NO: 2403417 - RNA, 16 nt, Human
agaggauggccagugu

SEQ ID NO: 2403418 - RNA, 15 nt, Human
agaggauggccagug

SEQ ID NO: 2403419 - RNA, 22 nt, Human
agaggaugagagcccagaggua

SEQ ID NO: 2403420 - RNA, 20 nt, Human
agaggaugagcucuacccag

SEQ ID NO: 2403421 - RNA, 14 nt, Human
agaggauggccagu

SEQ ID NO: 2403422 - RNA, 20 nt, Human
agagguaacagaacagcuuc

SEQ ID NO: 2403423 - RNA, 22 nt, Human
agagguaacagaacagcuucag

SEQ ID NO: 2403424 - RNA, 16 nt, Human
agaguuaacaaugaua

SEQ ID NO: 2403425 - RNA, 23 nt, Human
agaguuaaauagaguauaugcac

SEQ ID NO: 2403426 - RNA, 18 nt, Human
agagguaacagaacagcu

SEQ ID NO: 2403427 - RNA, 17 nt, Human
agagguaacagaacagc

SEQ ID NO: 2403428 - RNA, 16 nt, Human
agagguaacagaacag

SEQ ID NO: 2403429 - RNA, 23 nt, Human
agagguaaaagugugagcaguga

SEQ ID NO: 2403430 - RNA, 22 nt, Human
agagguaaaagugugagcagug

SEQ ID NO: 2403431 - RNA, 20 nt, Human
agagguaaaagugugagcag

SEQ ID NO: 2403432 - RNA, 19 nt, Human
agagguaaaagugugagca

SEQ ID NO: 2403433 - RNA, 18 nt, Human
agagguaaaagugugagc

SEQ ID NO: 2403434 - RNA, 16 nt, Human
agagguaaaaguguga

SEQ ID NO: 2403435 - RNA, 13 nt, Human
agaggguuccugu

SEQ ID NO: 2403436 - RNA, 23 nt, Human
agaggguggugaccucugccuga

SEQ ID NO: 2403437 - RNA, 21 nt, Human
agaggggcugaauagcagaag

SEQ ID NO: 2403438 - RNA, 13 nt, Human
agaggggcugucc

SEQ ID NO: 2403439 - RNA, 15 nt, Human
agaggggcaggcccu

SEQ ID NO: 2403440 - RNA, 19 nt, Human
agaggggcagcccuugcuu

SEQ ID NO: 2403441 - RNA, 18 nt, Human
agaggggcagcccuugcu

SEQ ID NO: 2403442 - RNA, 16 nt, Human
agaggggcagcccuug

SEQ ID NO: 2403443 - RNA, 15 nt, Human
agaggggcagcccuu

SEQ ID NO: 2403444 - RNA, 14 nt, Human
agaggggcagcccu

SEQ ID NO: 2403445 - RNA, 13 nt, Human
agaggggcagccc

SEQ ID NO: 2403446 - RNA, 15 nt, Human
agaggggcagaacag

SEQ ID NO: 2403447 - RNA, 16 nt, Human
agaggggcagaacagc

SEQ ID NO: 2403448 - RNA, 12 nt, Human
agaggggcagcc

SEQ ID NO: 2403449 - RNA, 22 nt, Human
agauacuuggggggcugaggug

SEQ ID NO: 2403450 - RNA, 18 nt, Human
agaguuaagaagcuguug

SEQ ID NO: 2403451 - RNA, 17 nt, Human
agaguuaagaagcuguu

SEQ ID NO: 2403452 - RNA, 16 nt, Human
agaguuaagaagcugu

SEQ ID NO: 2403453 - RNA, 15 nt, Human
agaguuaagaagcug

SEQ ID NO: 2403454 - RNA, 14 nt, Human
agaguuaagaagcu

SEQ ID NO: 2403455 - RNA, 13 nt, Human
agaguuaagaagc

SEQ ID NO: 2403456 - RNA, 12 nt, Human
agaguuaagaag

SEQ ID NO: 2403457 - RNA, 22 nt, Human
agaguuaacaaugauauaugga

SEQ ID NO: 2403458 - RNA, 21 nt, Human
agaguuaagaagcuguuguac

SEQ ID NO: 2403459 - RNA, 20 nt, Human
agaguuaagaagcuguugua

SEQ ID NO: 2403460 - RNA, 20 nt, Human
agaguuaauauauagaaggg

SEQ ID NO: 2403461 - RNA, 13 nt, Human
agauagccaaggc

SEQ ID NO: 2403462 - RNA, 11 nt, Human
agauagaaaua

SEQ ID NO: 2403463 - RNA, 15 nt, Human
agauagaaauaaaua

SEQ ID NO: 2403464 - RNA, 18 nt, Human
agauagaaauaaauagcu

SEQ ID NO: 2403465 - RNA, 22 nt, Human
agauagaaauaaauagcuauau

SEQ ID NO: 2403466 - RNA, 17 nt, Human
aggggccgcugccaccc

SEQ ID NO: 2403467 - RNA, 21 nt, Human
agguaagcaggaggaggugcc

SEQ ID NO: 2403468 - RNA, 16 nt, Human
agguaaggugaaggug

SEQ ID NO: 2403469 - RNA, 19 nt, Human
agguaagcaggaggaggug

SEQ ID NO: 2403470 - RNA, 17 nt, Human
agguaaggaauaccugu

SEQ ID NO: 2403471 - RNA, 18 nt, Human
agguaauauaaaaagcuu

SEQ ID NO: 2403472 - RNA, 17 nt, Human
agguaaucgaccugccu

SEQ ID NO: 2403473 - RNA, 18 nt, Human
agguaaucgaccugccuc

SEQ ID NO: 2403474 - RNA, 19 nt, Human
agguaccuuucacauagag

SEQ ID NO: 2403475 - RNA, 16 nt, Human
agguaccuuucacaua

SEQ ID NO: 2403476 - RNA, 20 nt, Human
aggucccuaauaaagcugug

SEQ ID NO: 2403477 - RNA, 19 nt, Human
aggucccuaauaaagcugu

SEQ ID NO: 2403478 - RNA, 18 nt, Human
aggucccuaauaaagcug

SEQ ID NO: 2403479 - RNA, 23 nt, Human
agguaccagcugcgcuugcuuuu

SEQ ID NO: 2403480 - RNA, 21 nt, Human
agguaccccuuucuggcucuc

SEQ ID NO: 2403481 - RNA, 17 nt, Human
agguaccccuuucuggc

SEQ ID NO: 2403482 - RNA, 17 nt, Human
aggucccuaauaaagcu

SEQ ID NO: 2403483 - RNA, 21 nt, Human
agguaauccaagauauuuuaa

SEQ ID NO: 2403484 - RNA, 16 nt, Human
agguaccagcugcgcu

SEQ ID NO: 2403485 - RNA, 13 nt, Human
agguaccagcugc

SEQ ID NO: 2403486 - RNA, 22 nt, Human
agguaccagcaauauguaaaua

SEQ ID NO: 2403487 - RNA, 21 nt, Human
agguaccacugauuuggagau

SEQ ID NO: 2403488 - RNA, 16 nt, Human
agguuccucugccugc

SEQ ID NO: 2403489 - RNA, 15 nt, Human
agguuccucugccug

SEQ ID NO: 2403490 - RNA, 14 nt, Human
agguuccucugccu

SEQ ID NO: 2403491 - RNA, 16 nt, Human
agguucccucugagaa

SEQ ID NO: 2403492 - RNA, 13 nt, Human
agguuccucugcc

SEQ ID NO: 2403493 - RNA, 20 nt, Human
agguuccucugccugccccg

SEQ ID NO: 2403494 - RNA, 19 nt, Human
agguuccucugccugcccc

SEQ ID NO: 2403495 - RNA, 18 nt, Human
agguuccucugccugccc

SEQ ID NO: 2403496 - RNA, 17 nt, Human
agguuccucugccugcc

SEQ ID NO: 2403497 - RNA, 11 nt, Human
agguucuaaaa

SEQ ID NO: 2403498 - RNA, 16 nt, Human
agguucccagagauga

SEQ ID NO: 2403499 - RNA, 15 nt, Human
agguucccaagcuca

SEQ ID NO: 2403500 - RNA, 16 nt, Human
agguucccaagcucag

SEQ ID NO: 2403501 - RNA, 18 nt, Human
agguuccaacuguauaua

SEQ ID NO: 2403502 - RNA, 17 nt, Human
agguuccaacuguauau

SEQ ID NO: 2403503 - RNA, 14 nt, Human
agguucccaagcuc

SEQ ID NO: 2403504 - RNA, 13 nt, Human
agguucagcuugu

SEQ ID NO: 2403505 - RNA, 16 nt, Human
agguucacgugcagcu

SEQ ID NO: 2403506 - RNA, 13 nt, Human
agguucagccaag

SEQ ID NO: 2403507 - RNA, 16 nt, Human
agguucacuaaagcag

SEQ ID NO: 2403508 - RNA, 17 nt, Human
agguucaugcaaacuuu

SEQ ID NO: 2403509 - RNA, 19 nt, Human
agguucagccaagguuuua

SEQ ID NO: 2403510 - RNA, 15 nt, Human
agguucagccaaggu

SEQ ID NO: 2403511 - RNA, 21 nt, Human
agguucaugccaccauggcca

SEQ ID NO: 2403512 - RNA, 15 nt, Human
agguuacaacagauu

SEQ ID NO: 2403513 - RNA, 16 nt, Human
agguuaauauuuaaga

SEQ ID NO: 2403514 - RNA, 14 nt, Human
agguuacaacagau

SEQ ID NO: 2403515 - RNA, 17 nt, Human
agguucaaagauauuuu

SEQ ID NO: 2403516 - RNA, 22 nt, Human
agguuaauuccaauuauaugag

SEQ ID NO: 2403517 - RNA, 15 nt, Human
agguuaauuccaauu

SEQ ID NO: 2403518 - RNA, 14 nt, Human
agguuaauguucau

SEQ ID NO: 2403519 - RNA, 23 nt, Human
agguggcaucagugucuuuccac

SEQ ID NO: 2403520 - RNA, 13 nt, Human
agguuaauauuua

SEQ ID NO: 2403521 - RNA, 19 nt, Human
agguggcaggaccaggacu

SEQ ID NO: 2403522 - RNA, 15 nt, Human
agguuaauaaaguaa

SEQ ID NO: 2403523 - RNA, 22 nt, Human
agguggcaucagugucuuucca

SEQ ID NO: 2403524 - RNA, 17 nt, Human
agguggcaggaccagga

SEQ ID NO: 2403525 - RNA, 14 nt, Human
agguggcaggacca

SEQ ID NO: 2403526 - RNA, 15 nt, Human
agguggcagcccugu

SEQ ID NO: 2403527 - RNA, 23 nt, Human
agguggcacuuuuucauuugccu

SEQ ID NO: 2403528 - RNA, 19 nt, Human
agguggcacuuuuucauuu

SEQ ID NO: 2403529 - RNA, 18 nt, Human
agguggcacuuuuucauu

SEQ ID NO: 2403530 - RNA, 17 nt, Human
agguggcacuuuuucau

SEQ ID NO: 2403531 - RNA, 13 nt, Human
agguggcagcccu

SEQ ID NO: 2403532 - RNA, 14 nt, Human
agguggcagcccug

SEQ ID NO: 2403533 - RNA, 21 nt, Human
aggugcugcuacccucccugc

SEQ ID NO: 2403534 - RNA, 20 nt, Human
aggugcugcuacccucccug

SEQ ID NO: 2403535 - RNA, 21 nt, Human
aggugcugagcaaagggaaca

SEQ ID NO: 2403536 - RNA, 23 nt, Human
aggugcugcuacccucccugcug

SEQ ID NO: 2403537 - RNA, 22 nt, Human
aggugcugcuacccucccugcu

SEQ ID NO: 2403538 - RNA, 17 nt, Human
aggugcugccauccagg

SEQ ID NO: 2403539 - RNA, 17 nt, Human
aggugcugacggccagg

SEQ ID NO: 2403540 - RNA, 20 nt, Human
aggugcugacggccagggag

SEQ ID NO: 2403541 - RNA, 16 nt, Human
aggugcugacggccag

SEQ ID NO: 2403542 - RNA, 16 nt, Human
aggugcugccauccag

SEQ ID NO: 2403543 - RNA, 16 nt, Human
agguccuucugcugga

SEQ ID NO: 2403544 - RNA, 21 nt, Human
agguccugcagucuggcugag

SEQ ID NO: 2403545 - RNA, 20 nt, Human
agguccugcagucuggcuga

SEQ ID NO: 2403546 - RNA, 12 nt, Human
agguccuugccc

SEQ ID NO: 2403547 - RNA, 17 nt, Human
agguccuugcccuuugu

SEQ ID NO: 2403548 - RNA, 21 nt, Human
aggucgaccccaaagccccuu

SEQ ID NO: 2403549 - RNA, 14 nt, Human
aggucgaggcagga

SEQ ID NO: 2403550 - RNA, 15 nt, Human
agguggaaauaaacu

SEQ ID NO: 2403551 - RNA, 17 nt, Human
aggugcuggagguggga

SEQ ID NO: 2403552 - RNA, 14 nt, Human
aggugcuggaggug

SEQ ID NO: 2403553 - RNA, 23 nt, Human
aggugcuggaggugggagcagga

SEQ ID NO: 2403554 - RNA, 19 nt, Human
aggugcuggaggugggagc

SEQ ID NO: 2403555 - RNA, 12 nt, Human
aggugcugggag

SEQ ID NO: 2403556 - RNA, 13 nt, Human
aggugcugggagg

SEQ ID NO: 2403557 - RNA, 23 nt, Human
aggugcuguuauccauggggaag

SEQ ID NO: 2403558 - RNA, 19 nt, Human
aggugcuuaagcagaagca

SEQ ID NO: 2403559 - RNA, 21 nt, Human
aggugcuucaggauaccauau

SEQ ID NO: 2403560 - RNA, 20 nt, Human
aggugcuuaagcagaagcau

SEQ ID NO: 2403561 - RNA, 15 nt, Human
aggugcugggaggga

SEQ ID NO: 2403562 - RNA, 19 nt, Human
agguggaagaagggagaag

SEQ ID NO: 2403563 - RNA, 18 nt, Human
agguggaagaagggagaa

SEQ ID NO: 2403564 - RNA, 17 nt, Human
agguggaagaagggaga

SEQ ID NO: 2403565 - RNA, 16 nt, Human
agguggaagaagggag

SEQ ID NO: 2403566 - RNA, 16 nt, Human
agguggaagagggcug

SEQ ID NO: 2403567 - RNA, 13 nt, Human
agguggaaaaaca

SEQ ID NO: 2403568 - RNA, 15 nt, Human
agguggaagaaggga

SEQ ID NO: 2403569 - RNA, 18 nt, Human
agguggaaaaacaucuga

SEQ ID NO: 2403570 - RNA, 18 nt, Human
agguggcaaggcugugcu

SEQ ID NO: 2403571 - RNA, 16 nt, Human
agguggcaaggcugug

SEQ ID NO: 2403572 - RNA, 15 nt, Human
agguggcaaggcugu

SEQ ID NO: 2403573 - RNA, 14 nt, Human
agguggcaaggcug

SEQ ID NO: 2403574 - RNA, 15 nt, Human
agguggauggcccca

SEQ ID NO: 2403575 - RNA, 23 nt, Human
agguggauggccccagcacagcu

SEQ ID NO: 2403576 - RNA, 16 nt, Human
agguggauggccccag

SEQ ID NO: 2403577 - RNA, 15 nt, Human
agguggaagcccucc

SEQ ID NO: 2403578 - RNA, 16 nt, Human
agguggaagcccuccu

SEQ ID NO: 2403579 - RNA, 22 nt, Human
agguggaagaagggagaagaaa

SEQ ID NO: 2403580 - RNA, 11 nt, Human
agguggaagcc

SEQ ID NO: 2403581 - RNA, 13 nt, Human
agguggaagcccu

SEQ ID NO: 2403582 - RNA, 14 nt, Human
agguggaagcccuc

SEQ ID NO: 2403583 - RNA, 20 nt, Human
aggcagacacggaucugaga

SEQ ID NO: 2403584 - RNA, 18 nt, Human
aggcagacacggaucuga

SEQ ID NO: 2403585 - RNA, 11 nt, Human
aggcagacacg

SEQ ID NO: 2403586 - RNA, 13 nt, Human
aggcagacagcag

SEQ ID NO: 2403587 - RNA, 14 nt, Human
aggcagacagcagc

SEQ ID NO: 2403588 - RNA, 15 nt, Human
aggcagacagcagcu

SEQ ID NO: 2403589 - RNA, 18 nt, Human
aggcagacagcagcucag

SEQ ID NO: 2403590 - RNA, 19 nt, Human
aggcagacagcagcucagg

SEQ ID NO: 2403591 - RNA, 20 nt, Human
aggcagacagcagcucaggc

SEQ ID NO: 2403592 - RNA, 21 nt, Human
aggcagacagcagcucaggca

SEQ ID NO: 2403593 - RNA, 23 nt, Human
aggcuagugugguguuuccuggc

SEQ ID NO: 2403594 - RNA, 21 nt, Human
aggcuauggggauagaugugu

SEQ ID NO: 2403595 - RNA, 22 nt, Human
aggcuauggggauagaugugug

SEQ ID NO: 2403596 - RNA, 19 nt, Human
aggcuauggggauagaugu

SEQ ID NO: 2403597 - RNA, 22 nt, Human
aggcuauggacagggcaugcca

SEQ ID NO: 2403598 - RNA, 23 nt, Human
aggcuauacuugucuuguucacc

SEQ ID NO: 2403599 - RNA, 14 nt, Human
aggcucuucuccuu

SEQ ID NO: 2403600 - RNA, 15 nt, Human
aggcucuucugacua

SEQ ID NO: 2403601 - RNA, 15 nt, Human
aggcucuuucugggc

SEQ ID NO: 2403602 - RNA, 18 nt, Human
aggcucuuucugggccaa

SEQ ID NO: 2403603 - RNA, 20 nt, Human
aggcucuuucugggccaagu

SEQ ID NO: 2403604 - RNA, 22 nt, Human
aggcucuuuggggucagccagg

SEQ ID NO: 2403605 - RNA, 21 nt, Human
aggcucuuuggggucagccag

SEQ ID NO: 2403606 - RNA, 23 nt, Human
aggcucuuuggggucagccaggg

SEQ ID NO: 2403607 - RNA, 13 nt, Human
aggcugaaagagg

SEQ ID NO: 2403608 - RNA, 20 nt, Human
aggcugaacuuguuuucugg

SEQ ID NO: 2403609 - RNA, 21 nt, Human
aggcugaacuuguuuucuggg

SEQ ID NO: 2403610 - RNA, 18 nt, Human
aggcugaggcuggcacag

SEQ ID NO: 2403611 - RNA, 15 nt, Human
aggcugaccaagaga

SEQ ID NO: 2403612 - RNA, 17 nt, Human
aggcugaccaagagaga

SEQ ID NO: 2403613 - RNA, 14 nt, Human
aggcugaccaagag

SEQ ID NO: 2403614 - RNA, 16 nt, Human
aggcugaaagaggcca

SEQ ID NO: 2403615 - RNA, 17 nt, Human
aggcugaaagaggccaa

SEQ ID NO: 2403616 - RNA, 20 nt, Human
aggcugauaauuccaguggu

SEQ ID NO: 2403617 - RNA, 17 nt, Human
aggcugauaauuccagu

SEQ ID NO: 2403618 - RNA, 19 nt, Human
aggcugagguugcgccacu

SEQ ID NO: 2403619 - RNA, 14 nt, Human
aggcugaggugucu

SEQ ID NO: 2403620 - RNA, 22 nt, Human
aggcugaggggaggaucacugg

SEQ ID NO: 2403621 - RNA, 21 nt, Human
aggcugaugucaauuucugug

SEQ ID NO: 2403622 - RNA, 23 nt, Human
aggcugaugccaaguuguuugag

SEQ ID NO: 2403623 - RNA, 21 nt, Human
aggcugcaagguuuaggcugg

SEQ ID NO: 2403624 - RNA, 17 nt, Human
aggcugcagaaggccaa

SEQ ID NO: 2403625 - RNA, 22 nt, Human
aggcugcaagguuuaggcuggu

SEQ ID NO: 2403626 - RNA, 18 nt, Human
aggcugcagccaggccac

SEQ ID NO: 2403627 - RNA, 20 nt, Human
aggcugcagaaggccaagaa

SEQ ID NO: 2403628 - RNA, 18 nt, Human
aggcugcagaaggccaag

SEQ ID NO: 2403629 - RNA, 15 nt, Human
aggcugcagcgagcu

SEQ ID NO: 2403630 - RNA, 24 nt, Human
aggcugugcucccugguucugaug

SEQ ID NO: 2403631 - RNA, 20 nt, Human
aggcugugcucccugguucu

SEQ ID NO: 2403632 - RNA, 14 nt, Human
aggcugugcucccu

SEQ ID NO: 2403633 - RNA, 13 nt, Human
aggcugugcuccc

SEQ ID NO: 2403634 - RNA, 20 nt, Human
aggcugucuucucaggcucu

SEQ ID NO: 2403635 - RNA, 21 nt, Human
aggcugucuucucaggcucug

SEQ ID NO: 2403636 - RNA, 22 nt, Human
aggcugucuucucaggcucugc

SEQ ID NO: 2403637 - RNA, 23 nt, Human
aggcugucuucucaggcucugcc

SEQ ID NO: 2403638 - RNA, 16 nt, Human
aggcuguggucacagc

SEQ ID NO: 2403639 - RNA, 15 nt, Human
aggcugugggccuca

SEQ ID NO: 2403640 - RNA, 18 nt, Human
aggcugugggccucaagg

SEQ ID NO: 2403641 - RNA, 15 nt, Human
aggcugcccccggcc

SEQ ID NO: 2403642 - RNA, 12 nt, Human
aggcugcccccg

SEQ ID NO: 2403643 - RNA, 21 nt, Human
aggcugcagaaggccaagaau

SEQ ID NO: 2403644 - RNA, 22 nt, Human
aggcugcccccggcccccuggu

SEQ ID NO: 2403645 - RNA, 20 nt, Human
aggcugcccccggcccccug

SEQ ID NO: 2403646 - RNA, 18 nt, Human
aggcugccucucccauca

SEQ ID NO: 2403647 - RNA, 20 nt, Human
agggacagaggggguggccu

SEQ ID NO: 2403648 - RNA, 13 nt, Human
agggacagagggg

SEQ ID NO: 2403649 - RNA, 17 nt, Human
agggacagaggccccag

SEQ ID NO: 2403650 - RNA, 20 nt, Human
agggacagaggccccagccu

SEQ ID NO: 2403651 - RNA, 21 nt, Human
agggacagaggccccagccuc

SEQ ID NO: 2403652 - RNA, 22 nt, Human
agggacagaggccccagccucc

SEQ ID NO: 2403653 - RNA, 12 nt, Human
agggacagaggg

SEQ ID NO: 2403654 - RNA, 19 nt, Human
agggacucugaagccucug

SEQ ID NO: 2403655 - RNA, 14 nt, Human
agggacucugaagc

SEQ ID NO: 2403656 - RNA, 20 nt, Human
agggacucaauuucucccca

SEQ ID NO: 2403657 - RNA, 20 nt, Human
agggacuaugaaugggcaaa

SEQ ID NO: 2403658 - RNA, 17 nt, Human
agggacuaggagcacug

SEQ ID NO: 2403659 - RNA, 20 nt, Human
agggacucaucauuuccauu

SEQ ID NO: 2403660 - RNA, 21 nt, Human
agggacgcuacccgggaaggg

SEQ ID NO: 2403661 - RNA, 17 nt, Human
agggacgcuacccggga

SEQ ID NO: 2403662 - RNA, 18 nt, Human
agggcggcaggggccugg

SEQ ID NO: 2403663 - RNA, 16 nt, Human
agggcggcaggggccu

SEQ ID NO: 2403664 - RNA, 15 nt, Human
agggcggcaggggcc

SEQ ID NO: 2403665 - RNA, 13 nt, Human
agggcggcagggg

SEQ ID NO: 2403666 - RNA, 18 nt, Human
agggccuggccugagcug

SEQ ID NO: 2403667 - RNA, 23 nt, Human
agggcggcaggggccuggagauc

SEQ ID NO: 2403668 - RNA, 19 nt, Human
agggcggcaggggccugga

SEQ ID NO: 2403669 - RNA, 13 nt, Human
agggcggcacuca

SEQ ID NO: 2403670 - RNA, 19 nt, Human
agggcgggaggauguucug

SEQ ID NO: 2403671 - RNA, 21 nt, Human
aggggauagagagagaccacu

SEQ ID NO: 2403672 - RNA, 16 nt, Human
agggcgugacucaccc

SEQ ID NO: 2403673 - RNA, 17 nt, Human
aggggauugaagcccuc

SEQ ID NO: 2403674 - RNA, 18 nt, Human
aggggauuaauaugaaaa

SEQ ID NO: 2403675 - RNA, 19 nt, Human
aggggauguauccaugggg

SEQ ID NO: 2403676 - RNA, 22 nt, Human
aggggauguauccaugggggca

SEQ ID NO: 2403677 - RNA, 18 nt, Human
aggggauauaggagagga

SEQ ID NO: 2403678 - RNA, 17 nt, Human
aggggauauaggagagg

SEQ ID NO: 2403679 - RNA, 15 nt, Human
agggcgugacucacc

SEQ ID NO: 2403680 - RNA, 14 nt, Human
aggggaugggaggu

SEQ ID NO: 2403681 - RNA, 15 nt, Human
aggggccgcugccac

SEQ ID NO: 2403682 - RNA, 16 nt, Human
aggggccgcugccacc

SEQ ID NO: 2403683 - RNA, 22 nt, Human
aggggccgcugccacccaccuc

SEQ ID NO: 2403684 - RNA, 21 nt, Human
aggggcccguugucucccugg

SEQ ID NO: 2403685 - RNA, 20 nt, Human
aggggcccguugucucccug

SEQ ID NO: 2403686 - RNA, 12 nt, Human
aggggcccuggu

SEQ ID NO: 2403687 - RNA, 19 nt, Human
aggggcccgcuugccucgg

SEQ ID NO: 2403688 - RNA, 16 nt, Human
aggggcccgcuugccu

SEQ ID NO: 2403689 - RNA, 14 nt, Human
aggggcagcuucua

SEQ ID NO: 2403690 - RNA, 11 nt, Human
aggggcagcuu

SEQ ID NO: 2403691 - RNA, 15 nt, Human
aggggcagcugacca

SEQ ID NO: 2403692 - RNA, 14 nt, Human
aggggcagcugacc

SEQ ID NO: 2403693 - RNA, 20 nt, Human
aggggcccgcuugccucggc

SEQ ID NO: 2403694 - RNA, 13 nt, Human
aggggcccggcca

SEQ ID NO: 2403695 - RNA, 15 nt, Human
aggggcccggccagc

SEQ ID NO: 2403696 - RNA, 17 nt, Human
aggggcccggccagcca

SEQ ID NO: 2403697 - RNA, 19 nt, Human
aggggcccggccagccaug

SEQ ID NO: 2403698 - RNA, 21 nt, Human
aggggcccggccagccauguc

SEQ ID NO: 2403699 - RNA, 23 nt, Human
aggggcccggccagccaugucug

SEQ ID NO: 2403700 - RNA, 14 nt, Human
aggggcccguggga

SEQ ID NO: 2403701 - RNA, 15 nt, Human
aggggcacagggucu

SEQ ID NO: 2403702 - RNA, 14 nt, Human
aggggcagaacagc

SEQ ID NO: 2403703 - RNA, 19 nt, Human
aggggauugaagcccucca

SEQ ID NO: 2403704 - RNA, 19 nt, Human
aggggcacuucauugagag

SEQ ID NO: 2403705 - RNA, 17 nt, Human
aggggcagaaaaacucu

SEQ ID NO: 2403706 - RNA, 16 nt, Human
aggggcagcccuugcu

SEQ ID NO: 2403707 - RNA, 13 nt, Human
aggggcagcccuu

SEQ ID NO: 2403708 - RNA, 12 nt, Human
aggggcagcccu

SEQ ID NO: 2403709 - RNA, 22 nt, Human
agggcacagaaaauggaagaca

SEQ ID NO: 2403710 - RNA, 21 nt, Human
agggcacaccgggcacucaga

SEQ ID NO: 2403711 - RNA, 20 nt, Human
agggcacaccgggcacucag

SEQ ID NO: 2403712 - RNA, 17 nt, Human
agggccuggccugagcu

SEQ ID NO: 2403713 - RNA, 16 nt, Human
agggccuggccugagc

SEQ ID NO: 2403714 - RNA, 15 nt, Human
agggccuggccugag

SEQ ID NO: 2403715 - RNA, 17 nt, Human
agggcacaccgggcacu

SEQ ID NO: 2403716 - RNA, 14 nt, Human
agggcacacacugu

SEQ ID NO: 2403717 - RNA, 22 nt, Human
agggcaagggccaugcugaagg

SEQ ID NO: 2403718 - RNA, 23 nt, Human
agcuguacaaauauaagaauaaa

SEQ ID NO: 2403719 - RNA, 22 nt, Human
agcuguacaaauauaagaauaa

SEQ ID NO: 2403720 - RNA, 17 nt, Human
agcuguacaaauauaag

SEQ ID NO: 2403721 - RNA, 13 nt, Human
agcuguacaaaua

SEQ ID NO: 2403722 - RNA, 18 nt, Human
agcuguaaggcaugaagg

SEQ ID NO: 2403723 - RNA, 19 nt, Human
agcuguaaggcaugaagga

SEQ ID NO: 2403724 - RNA, 13 nt, Human
agcuguaaggcau

SEQ ID NO: 2403725 - RNA, 17 nt, Human
agcuguaaggcaugaag

SEQ ID NO: 2403726 - RNA, 14 nt, Human
agcuggugcccgga

SEQ ID NO: 2403727 - RNA, 22 nt, Human
agcuguaagaagagacugggaa

SEQ ID NO: 2403728 - RNA, 23 nt, Human
agcuguaagaagagacugggaag

SEQ ID NO: 2403729 - RNA, 14 nt, Human
agcuguaugauucc

SEQ ID NO: 2403730 - RNA, 23 nt, Human
agcuguaguagcccuuucugugu

SEQ ID NO: 2403731 - RNA, 21 nt, Human
agcuguaguagcccuuucugu

SEQ ID NO: 2403732 - RNA, 20 nt, Human
agcuguaguagcccuuucug

SEQ ID NO: 2403733 - RNA, 21 nt, Human
agcuguacuucgucuucuaau

SEQ ID NO: 2403734 - RNA, 19 nt, Human
agcuguacuucgucuucua

SEQ ID NO: 2403735 - RNA, 20 nt, Human
agcuguaggugugcgggacc

SEQ ID NO: 2403736 - RNA, 22 nt, Human
agcuguaguagcccuuucugug

SEQ ID NO: 2403737 - RNA, 18 nt, Human
aggaaaaagcacaagaag

SEQ ID NO: 2403738 - RNA, 15 nt, Human
aggaaaaagcacaag

SEQ ID NO: 2403739 - RNA, 18 nt, Human
agcuuuucccaaaagccc

SEQ ID NO: 2403740 - RNA, 17 nt, Human
aggaaaaagcacaagaa

SEQ ID NO: 2403741 - RNA, 15 nt, Human
aggaaauccagggug

SEQ ID NO: 2403742 - RNA, 17 nt, Human
aggaaauccaggguggu

SEQ ID NO: 2403743 - RNA, 14 nt, Human
aggaaaaaugugua

SEQ ID NO: 2403744 - RNA, 13 nt, Human
aggaaaaaugugu

SEQ ID NO: 2403745 - RNA, 14 nt, Human
aggaaaucucaccc

SEQ ID NO: 2403746 - RNA, 18 nt, Human
aggaaauggaauacugaa

SEQ ID NO: 2403747 - RNA, 22 nt, Human
aggaacguaaucguguccccua

SEQ ID NO: 2403748 - RNA, 16 nt, Human
aggaacgguaaauuuc

SEQ ID NO: 2403749 - RNA, 20 nt, Human
aggaaauggcuguggagugu

SEQ ID NO: 2403750 - RNA, 17 nt, Human
aggaaaugaaugugugu

SEQ ID NO: 2403751 - RNA, 15 nt, Human
aggaaaugaaugugu

SEQ ID NO: 2403752 - RNA, 14 nt, Human
aggaaaugaaugug

SEQ ID NO: 2403753 - RNA, 13 nt, Human
aggaaaugaaugu

SEQ ID NO: 2403754 - RNA, 19 nt, Human
aggaaaugaaaaugucuug

SEQ ID NO: 2403755 - RNA, 16 nt, Human
aggaaaucucacccca

SEQ ID NO: 2403756 - RNA, 15 nt, Human
aggaaaaacugauuu

SEQ ID NO: 2403757 - RNA, 13 nt, Human
aggaaaaacugau

SEQ ID NO: 2403758 - RNA, 15 nt, Human
agcuuuucccuuuuu

SEQ ID NO: 2403759 - RNA, 14 nt, Human
aggaaaaacagguc

SEQ ID NO: 2403760 - RNA, 16 nt, Human
agcuuuucccuucuuu

SEQ ID NO: 2403761 - RNA, 19 nt, Human
agcuuuuauuguauaaacu

SEQ ID NO: 2403762 - RNA, 21 nt, Human
agcuuuuaugugaaacauguu

SEQ ID NO: 2403763 - RNA, 15 nt, Human
agcuuuuauuguaua

SEQ ID NO: 2403764 - RNA, 17 nt, Human
agcuuuuauuguauaaa

SEQ ID NO: 2403765 - RNA, 13 nt, Human
agcuuuucccuuc

SEQ ID NO: 2403766 - RNA, 23 nt, Human
agcuucuguugcugccucaugcu

SEQ ID NO: 2403767 - RNA, 23 nt, Human
agcuucuauuauagccacauccc

SEQ ID NO: 2403768 - RNA, 17 nt, Human
agcuucuauuagccagu

SEQ ID NO: 2403769 - RNA, 16 nt, Human
agcuucuuaaaugaga

SEQ ID NO: 2403770 - RNA, 18 nt, Human
agcuucuuaaaugagaag

SEQ ID NO: 2403771 - RNA, 23 nt, Human
agcuucuuaauauaacugccuua

SEQ ID NO: 2403772 - RNA, 22 nt, Human
agcuucuuaauauaacugccuu

SEQ ID NO: 2403773 - RNA, 21 nt, Human
agcuucuuaauauaacugccu

SEQ ID NO: 2403774 - RNA, 20 nt, Human
agcuucuuaauauaacugcc

SEQ ID NO: 2403775 - RNA, 21 nt, Human
agcuucagaaguuuggcaaua

SEQ ID NO: 2403776 - RNA, 15 nt, Human
agcuucagccaggag

SEQ ID NO: 2403777 - RNA, 19 nt, Human
agcuuccuucugugaaagu

SEQ ID NO: 2403778 - RNA, 16 nt, Human
agcuucauacuucaug

SEQ ID NO: 2403779 - RNA, 17 nt, Human
agcuucauauaccagca

SEQ ID NO: 2403780 - RNA, 23 nt, Human
agcuucagguuaucgaaauaaca

SEQ ID NO: 2403781 - RNA, 13 nt, Human
agcuucagguuau

SEQ ID NO: 2403782 - RNA, 16 nt, Human
agcuucagaaguuugg

SEQ ID NO: 2403783 - RNA, 15 nt, Human
agcuucaguuuccug

SEQ ID NO: 2403784 - RNA, 19 nt, Human
agcuucaguuguuuucccg

SEQ ID NO: 2403785 - RNA, 11 nt, Human
agcuucagguu

SEQ ID NO: 2403786 - RNA, 20 nt, Human
agcuucagccaggagcuggg

SEQ ID NO: 2403787 - RNA, 19 nt, Human
agcuucagccaggagcugg

SEQ ID NO: 2403788 - RNA, 17 nt, Human
agcuucagccaggagcu

SEQ ID NO: 2403789 - RNA, 20 nt, Human
agcuucguuuauuuucaaga

SEQ ID NO: 2403790 - RNA, 18 nt, Human
agcuucuaccaugaacag

SEQ ID NO: 2403791 - RNA, 17 nt, Human
agcuucuaccaugaaca

SEQ ID NO: 2403792 - RNA, 18 nt, Human
agcuucuaucccaggagg

SEQ ID NO: 2403793 - RNA, 17 nt, Human
agcuucuaucccaggag

SEQ ID NO: 2403794 - RNA, 14 nt, Human
agcuucgcgugaga

SEQ ID NO: 2403795 - RNA, 23 nt, Human
agcuuccuuuguuuuuuuuuccu

SEQ ID NO: 2403796 - RNA, 15 nt, Human
agcuuccuuggcuuu

SEQ ID NO: 2403797 - RNA, 14 nt, Human
agcuuccuuggcuu

SEQ ID NO: 2403798 - RNA, 21 nt, Human
agcuucuguugcugccucaug

SEQ ID NO: 2403799 - RNA, 22 nt, Human
agcuucuguugcugccucaugc

SEQ ID NO: 2403800 - RNA, 20 nt, Human
agcuucuguugcugccucau

SEQ ID NO: 2403801 - RNA, 19 nt, Human
agcuucucauccugcaggc

SEQ ID NO: 2403802 - RNA, 21 nt, Human
agcuggucccacucaguccau

SEQ ID NO: 2403803 - RNA, 19 nt, Human
agcuggugcauuacagaga

SEQ ID NO: 2403804 - RNA, 20 nt, Human
agcuggugcauuacagagag

SEQ ID NO: 2403805 - RNA, 21 nt, Human
agcuggugcauuacagagagg

SEQ ID NO: 2403806 - RNA, 22 nt, Human
agcuggugcauuacagagagga

SEQ ID NO: 2403807 - RNA, 18 nt, Human
agcuguaagaagagacug

SEQ ID NO: 2403808 - RNA, 18 nt, Human
agcuggugagugaugcgg

SEQ ID NO: 2403809 - RNA, 20 nt, Human
agcuggguggcacugccaug

SEQ ID NO: 2403810 - RNA, 10 nt, Human
agcuggugca

SEQ ID NO: 2403811 - RNA, 12 nt, Human
agcuggugcauu

SEQ ID NO: 2403812 - RNA, 13 nt, Human
agcuggugcauua

SEQ ID NO: 2403813 - RNA, 14 nt, Human
agcuggugcauuac

SEQ ID NO: 2403814 - RNA, 17 nt, Human
agcuggugcauuacaga

SEQ ID NO: 2403815 - RNA, 18 nt, Human
agcuggugcauuacagag

SEQ ID NO: 2403816 - RNA, 22 nt, Human
agcugggugucaagagggucug

SEQ ID NO: 2403817 - RNA, 17 nt, Human
agcugggugucaagagg

SEQ ID NO: 2403818 - RNA, 16 nt, Human
agcugggucaggcagg

SEQ ID NO: 2403819 - RNA, 17 nt, Human
agcugggucaggcaggg

SEQ ID NO: 2403820 - RNA, 19 nt, Human
agcuggguggcacugccau

SEQ ID NO: 2403821 - RNA, 15 nt, Human
agcugcucuggaaaa

SEQ ID NO: 2403822 - RNA, 18 nt, Human
agcuggguggcacugcca

SEQ ID NO: 2403823 - RNA, 15 nt, Human
agcugggucaggcag

SEQ ID NO: 2403824 - RNA, 16 nt, Human
agcugcucugucuucu

SEQ ID NO: 2403825 - RNA, 14 nt, Human
agcugcucuggaaa

SEQ ID NO: 2403826 - RNA, 17 nt, Human
agcugcuccuagaggga

SEQ ID NO: 2403827 - RNA, 18 nt, Human
agcugcuccuagagggag

SEQ ID NO: 2403828 - RNA, 19 nt, Human
agcugcuccuagagggagg

SEQ ID NO: 2403829 - RNA, 23 nt, Human
agcugcucugaauuaguccuugc

SEQ ID NO: 2403830 - RNA, 14 nt, Human
agcugcucuauugu

SEQ ID NO: 2403831 - RNA, 20 nt, Human
agcugcuccuagagggaggg

SEQ ID NO: 2403832 - RNA, 22 nt, Human
agcugcuccuagagggaggggc

SEQ ID NO: 2403833 - RNA, 15 nt, Human
agcugcuccccuccc

SEQ ID NO: 2403834 - RNA, 13 nt, Human
agcugcuccccuc

SEQ ID NO: 2403835 - RNA, 14 nt, Human
agcugcuccccucc

SEQ ID NO: 2403836 - RNA, 19 nt, Human
agcugcuccccucccuccu

SEQ ID NO: 2403837 - RNA, 21 nt, Human
agcugauacaaauugcagacu

SEQ ID NO: 2403838 - RNA, 13 nt, Human
agcugauccagag

SEQ ID NO: 2403839 - RNA, 13 nt, Human
agcugcuccccag

SEQ ID NO: 2403840 - RNA, 17 nt, Human
agcugcuccccagcagc

SEQ ID NO: 2403841 - RNA, 20 nt, Human
agcugcuccccagcagcgga

SEQ ID NO: 2403842 - RNA, 12 nt, Human
agcugcuccccu

SEQ ID NO: 2403843 - RNA, 21 nt, Human
agcugaggccacacucagcac

SEQ ID NO: 2403844 - RNA, 22 nt, Human
agcugaggccacacucagcaca

SEQ ID NO: 2403845 - RNA, 22 nt, Human
agcugaggggggccgugcccag

SEQ ID NO: 2403846 - RNA, 13 nt, Human
agcugaggggggc

SEQ ID NO: 2403847 - RNA, 23 nt, Human
agcugaggggggccgugcccagg

SEQ ID NO: 2403848 - RNA, 18 nt, Human
agcugaggucucuugagg

SEQ ID NO: 2403849 - RNA, 15 nt, Human
agcugaccucuguug

SEQ ID NO: 2403850 - RNA, 12 nt, Human
agcugaccucug

SEQ ID NO: 2403851 - RNA, 23 nt, Human
agcugacccagccccuugagaaa

SEQ ID NO: 2403852 - RNA, 16 nt, Human
agcugacccagccccu

SEQ ID NO: 2403853 - RNA, 21 nt, Human
agcugaggucucuugagggag

SEQ ID NO: 2403854 - RNA, 23 nt, Human
agcugaggucucuugagggagcu

SEQ ID NO: 2403855 - RNA, 17 nt, Human
agcugaccacaggcagu

SEQ ID NO: 2403856 - RNA, 16 nt, Human
agcugaccacaggcag

SEQ ID NO: 2403857 - RNA, 14 nt, Human
agcugacauggaaa

SEQ ID NO: 2403858 - RNA, 12 nt, Human
agcugacaugga

SEQ ID NO: 2403859 - RNA, 16 nt, Human
agcugacaguccucuc

SEQ ID NO: 2403860 - RNA, 21 nt, Human
agcugacaguccucuccaccu

SEQ ID NO: 2403861 - RNA, 14 nt, Human
agcugacaguccuc

SEQ ID NO: 2403862 - RNA, 13 nt, Human
agcugacaguccu

SEQ ID NO: 2403863 - RNA, 23 nt, Human
agcugacacaaaccugccugggu

SEQ ID NO: 2403864 - RNA, 22 nt, Human
agcugacacaaaccugccuggg

SEQ ID NO: 2403865 - RNA, 21 nt, Human
agcugacacaaaccugccugg

SEQ ID NO: 2403866 - RNA, 20 nt, Human
agcugacacaaaccugccug

SEQ ID NO: 2403867 - RNA, 19 nt, Human
agcugacacaaaccugccu

SEQ ID NO: 2403868 - RNA, 13 nt, Human
agcuccuguccuc

SEQ ID NO: 2403869 - RNA, 12 nt, Human
agcuccuguccu

SEQ ID NO: 2403870 - RNA, 14 nt, Human
agcugacacaaacc

SEQ ID NO: 2403871 - RNA, 23 nt, Human
agcuccuccucccugcaucugac

SEQ ID NO: 2403872 - RNA, 21 nt, Human
agcuccuccucccugcaucug

SEQ ID NO: 2403873 - RNA, 15 nt, Human
agcuccucugggcag

SEQ ID NO: 2403874 - RNA, 17 nt, Human
agcuccucugggcagga

SEQ ID NO: 2403875 - RNA, 19 nt, Human
agcuccucugggcaggacc

SEQ ID NO: 2403876 - RNA, 20 nt, Human
agcuccucugggcaggaccu

SEQ ID NO: 2403877 - RNA, 13 nt, Human
agcuccucuuccu

SEQ ID NO: 2403878 - RNA, 23 nt, Human
agcuccugcuccacagccauccc

SEQ ID NO: 2403879 - RNA, 11 nt, Human
agcuccuguaa

SEQ ID NO: 2403880 - RNA, 22 nt, Human
agcuccuggucuugagaugucu

SEQ ID NO: 2403881 - RNA, 20 nt, Human
agcuccuggucuugagaugu

SEQ ID NO: 2403882 - RNA, 16 nt, Human
agcuccucccuuguuc

SEQ ID NO: 2403883 - RNA, 20 nt, Human
agcuccuccgugcuuccuca

SEQ ID NO: 2403884 - RNA, 20 nt, Human
agcuccucccuuguucucua

SEQ ID NO: 2403885 - RNA, 22 nt, Human
agcuccuccgugcuuccucagu

SEQ ID NO: 2403886 - RNA, 13 nt, Human
agcuccuccuccc

SEQ ID NO: 2403887 - RNA, 14 nt, Human
agcuccuccucccu

SEQ ID NO: 2403888 - RNA, 15 nt, Human
agcuccuccucccug

SEQ ID NO: 2403889 - RNA, 16 nt, Human
agcuccuccucccugc

SEQ ID NO: 2403890 - RNA, 17 nt, Human
agcuccuccucccugca

SEQ ID NO: 2403891 - RNA, 23 nt, Human
agcuccucaacucaccuaauguu

SEQ ID NO: 2403892 - RNA, 16 nt, Human
agcuccucaacucacc

SEQ ID NO: 2403893 - RNA, 21 nt, Human
agcuccucauccagggcucug

SEQ ID NO: 2403894 - RNA, 19 nt, Human
agcuccucauccagggcuc

SEQ ID NO: 2403895 - RNA, 12 nt, Human
agcuccucccac

SEQ ID NO: 2403896 - RNA, 18 nt, Human
agcuccucauccagggcu

SEQ ID NO: 2403897 - RNA, 15 nt, Human
agcuccucauccagg

SEQ ID NO: 2403898 - RNA, 13 nt, Human
aggcacugccuga

SEQ ID NO: 2403899 - RNA, 23 nt, Human
aggcacugagauaccagcgagga

SEQ ID NO: 2403900 - RNA, 21 nt, Human
aggcagacacagggacuugaa

SEQ ID NO: 2403901 - RNA, 15 nt, Human
aggcagacacaggga

SEQ ID NO: 2403902 - RNA, 14 nt, Human
aggcagacacaggg

SEQ ID NO: 2403903 - RNA, 11 nt, Human
aggcagacaca

SEQ ID NO: 2403904 - RNA, 21 nt, Human
aggcagaauccuggcccucug

SEQ ID NO: 2403905 - RNA, 20 nt, Human
aggcagaauccuggcccucu

SEQ ID NO: 2403906 - RNA, 23 nt, Human
aggcagaagaauugaacccagga

SEQ ID NO: 2403907 - RNA, 23 nt, Human
aggcacugggggcagcgggggcc

SEQ ID NO: 2403908 - RNA, 22 nt, Human
aggcagaagaauugaacccagg

SEQ ID NO: 2403909 - RNA, 14 nt, Human
aggcacugccugau

SEQ ID NO: 2403910 - RNA, 22 nt, Human
aggcacugcugcccagccucca

SEQ ID NO: 2403911 - RNA, 16 nt, Human
aggcacugcugcccag

SEQ ID NO: 2403912 - RNA, 14 nt, Human
aggcacugcugccc

SEQ ID NO: 2403913 - RNA, 14 nt, Human
aggauguugaaaaa

SEQ ID NO: 2403914 - RNA, 20 nt, Human
aggauguucugggacacagu

SEQ ID NO: 2403915 - RNA, 17 nt, Human
aggauguugaaaaaguu

SEQ ID NO: 2403916 - RNA, 14 nt, Human
aggagggucaggaa

SEQ ID NO: 2403917 - RNA, 17 nt, Human
aggagggucaggaagga

SEQ ID NO: 2403918 - RNA, 16 nt, Human
aggaggggcuguaaaa

SEQ ID NO: 2403919 - RNA, 20 nt, Human
aggaggggcccguugucucc

SEQ ID NO: 2403920 - RNA, 13 nt, Human
aggaggggccgcu

SEQ ID NO: 2403921 - RNA, 19 nt, Human
aggagaggagagccagaga

SEQ ID NO: 2403922 - RNA, 17 nt, Human
aggaggggauagagaga

SEQ ID NO: 2403923 - RNA, 12 nt, Human
aggauucuuccu

SEQ ID NO: 2403924 - RNA, 13 nt, Human
aggauucuaugag

SEQ ID NO: 2403925 - RNA, 15 nt, Human
aggauucuaugaggc

SEQ ID NO: 2403926 - RNA, 16 nt, Human
aggauucuaugaggca

SEQ ID NO: 2403927 - RNA, 19 nt, Human
aggaacucuggcuuccagg

SEQ ID NO: 2403928 - RNA, 21 nt, Human
aggaacucuggcuuccaggua

SEQ ID NO: 2403929 - RNA, 16 nt, Human
aggaacugcugggcuu

SEQ ID NO: 2403930 - RNA, 15 nt, Human
aggaacuacugagga

SEQ ID NO: 2403931 - RNA, 18 nt, Human
aggaacucuggcuuccag

SEQ ID NO: 2403932 - RNA, 16 nt, Human
aggaacucuggcuucc

SEQ ID NO: 2403933 - RNA, 13 nt, Human
aggaacucuggcu

SEQ ID NO: 2403934 - RNA, 23 nt, Human
aggaacucccagcaacacaagcu

SEQ ID NO: 2403935 - RNA, 14 nt, Human
aggaacucccagca

SEQ ID NO: 2403936 - RNA, 13 nt, Human
aggaacucccagc

SEQ ID NO: 2403937 - RNA, 20 nt, Human
aggaacgguaaauuucugug

SEQ ID NO: 2403938 - RNA, 13 nt, Human
aggaccagcucag

SEQ ID NO: 2403939 - RNA, 14 nt, Human
aggaccagcucagg

SEQ ID NO: 2403940 - RNA, 15 nt, Human
aggaccagcucagga

SEQ ID NO: 2403941 - RNA, 18 nt, Human
aggaccagcucaggacag

SEQ ID NO: 2403942 - RNA, 20 nt, Human
aggaccccuccaugugggcu

SEQ ID NO: 2403943 - RNA, 13 nt, Human
aggacccccuucc

SEQ ID NO: 2403944 - RNA, 16 nt, Human
aggacccccuuccccu

SEQ ID NO: 2403945 - RNA, 15 nt, Human
aggacccccuucccc

SEQ ID NO: 2403946 - RNA, 17 nt, Human
aggacccccuuccccua

SEQ ID NO: 2403947 - RNA, 13 nt, Human
aggaccccucacc

SEQ ID NO: 2403948 - RNA, 19 nt, Human
aggaccaagcaucuugggg

SEQ ID NO: 2403949 - RNA, 17 nt, Human
aggaccaagcaucuugg

SEQ ID NO: 2403950 - RNA, 14 nt, Human
aggacauuucucua

SEQ ID NO: 2403951 - RNA, 12 nt, Human
aggaccagcuca

SEQ ID NO: 2403952 - RNA, 12 nt, Human
aggaccacuccu

SEQ ID NO: 2403953 - RNA, 16 nt, Human
aggaccacuccuguac

SEQ ID NO: 2403954 - RNA, 22 nt, Human
aggaccacuccuguacacugaa

SEQ ID NO: 2403955 - RNA, 14 nt, Human
aggagaagccagga

SEQ ID NO: 2403956 - RNA, 15 nt, Human
aggagaagccaggaa

SEQ ID NO: 2403957 - RNA, 15 nt, Human
aggagagcuagcagc

SEQ ID NO: 2403958 - RNA, 15 nt, Human
aggagaggagagcca

SEQ ID NO: 2403959 - RNA, 14 nt, Human
aggagaggagagcc

SEQ ID NO: 2403960 - RNA, 13 nt, Human
aggagaggagagc

SEQ ID NO: 2403961 - RNA, 18 nt, Human
aggagaggagagaggcag

SEQ ID NO: 2403962 - RNA, 17 nt, Human
aggagaggagagaggca

SEQ ID NO: 2403963 - RNA, 16 nt, Human
aggagaggagagaggc

SEQ ID NO: 2403964 - RNA, 15 nt, Human
aggagaggagagagg

SEQ ID NO: 2403965 - RNA, 14 nt, Human
aggagaggagagag

SEQ ID NO: 2403966 - RNA, 20 nt, Human
aggagaggaaaaguaaggug

SEQ ID NO: 2403967 - RNA, 15 nt, Human
aggagaggaaaagua

SEQ ID NO: 2403968 - RNA, 13 nt, Human
aggagaggagaga

SEQ ID NO: 2403969 - RNA, 12 nt, Human
aggagaggaaag

SEQ ID NO: 2403970 - RNA, 20 nt, Human
aggagagccugcugcauggg

SEQ ID NO: 2403971 - RNA, 14 nt, Human
aggagaggggcaca

SEQ ID NO: 2403972 - RNA, 16 nt, Human
aggagaggggcacagg

SEQ ID NO: 2403973 - RNA, 18 nt, Human
aggagaggggcacagggu

SEQ ID NO: 2403974 - RNA, 17 nt, Human
aggagaggagagccaga

SEQ ID NO: 2403975 - RNA, 16 nt, Human
aggagaggagagccag

SEQ ID NO: 2403976 - RNA, 13 nt, Human
aggagaggggcag

SEQ ID NO: 2403977 - RNA, 18 nt, Human
aggagaggggcagaacag

SEQ ID NO: 2403978 - RNA, 19 nt, Human
aggagaggggcagaacagc

SEQ ID NO: 2403979 - RNA, 16 nt, Human
aggagaaccaaaucug

SEQ ID NO: 2403980 - RNA, 20 nt, Human
aggaccucugaaacccugga

SEQ ID NO: 2403981 - RNA, 22 nt, Human
aggagaaccaaaucuggaagcc

SEQ ID NO: 2403982 - RNA, 19 nt, Human
aggagaaccaaaucuggaa

SEQ ID NO: 2403983 - RNA, 14 nt, Human
aggagaaccacuac

SEQ ID NO: 2403984 - RNA, 15 nt, Human
aggagaaccacuaca

SEQ ID NO: 2403985 - RNA, 12 nt, Human
aggagaagccag

SEQ ID NO: 2403986 - RNA, 13 nt, Human
aggagaagccagg

SEQ ID NO: 2403987 - RNA, 11 nt, Human
aggagaagcca

SEQ ID NO: 2403988 - RNA, 14 nt, Human
aggaccucagguga

SEQ ID NO: 2403989 - RNA, 20 nt, Human
aggaccucaggugagaagca

SEQ ID NO: 2403990 - RNA, 17 nt, Human
aggacccggaggggccu

SEQ ID NO: 2403991 - RNA, 15 nt, Human
aggaccccucaccuu

SEQ ID NO: 2403992 - RNA, 23 nt, Human
aggaccccucaccuugcaacaca

SEQ ID NO: 2403993 - RNA, 18 nt, Human
aggaccucugaaacccug

SEQ ID NO: 2403994 - RNA, 12 nt, Human
ggaggcgcgagc

SEQ ID NO: 2403995 - RNA, 16 nt, Human
ggaggcuccagagggc

SEQ ID NO: 2403996 - RNA, 18 nt, Human
ggaggcuccagagggcac

SEQ ID NO: 2403997 - RNA, 15 nt, Human
ggaggcuccagaggg

SEQ ID NO: 2403998 - RNA, 15 nt, Human
ggaggcucagguccc

SEQ ID NO: 2403999 - RNA, 10 nt, Human
ggaggcugcc

SEQ ID NO: 2404000 - RNA, 12 nt, Human
ggaggcggagag

SEQ ID NO: 2404001 - RNA, 22 nt, Human
ggaggcggacguuccagccggc

SEQ ID NO: 2404002 - RNA, 19 nt, Human
ggaggcggacguuccagcc

SEQ ID NO: 2404003 - RNA, 20 nt, Human
ggaggcggauguugaaguga

SEQ ID NO: 2404004 - RNA, 20 nt, Human
ggaggcggagcuugcaguga

SEQ ID NO: 2404005 - RNA, 21 nt, Human
ggaggcucacccccuucucca

SEQ ID NO: 2404006 - RNA, 20 nt, Human
ggaggcggagaguacaguga

SEQ ID NO: 2404007 - RNA, 20 nt, Human
ggaggcuaaagcccagagac

SEQ ID NO: 2404008 - RNA, 13 nt, Human
ggaggggggaggu

SEQ ID NO: 2404009 - RNA, 14 nt, Human
ggagggggauccga

SEQ ID NO: 2404010 - RNA, 16 nt, Human
ggagggggcuugaagc

SEQ ID NO: 2404011 - RNA, 14 nt, Human
ggaggggggaggug

SEQ ID NO: 2404012 - RNA, 15 nt, Human
ggaggggggagccau

SEQ ID NO: 2404013 - RNA, 12 nt, Human
ggaggggggagc

SEQ ID NO: 2404014 - RNA, 21 nt, Human
ggagggggcuugaagccaaag

SEQ ID NO: 2404015 - RNA, 18 nt, Human
ggagggggcuugaagcca

SEQ ID NO: 2404016 - RNA, 14 nt, Human
ggagggucaggaag

SEQ ID NO: 2404017 - RNA, 21 nt, Human
ggaggcugcccccggcccccu

SEQ ID NO: 2404018 - RNA, 17 nt, Human
ggaggcugcccccggcc

SEQ ID NO: 2404019 - RNA, 13 nt, Human
ggaggcugccccc

SEQ ID NO: 2404020 - RNA, 12 nt, Human
ggaggcugcccc

SEQ ID NO: 2404021 - RNA, 22 nt, Human
ggaggcugcccccggcccccug

SEQ ID NO: 2404022 - RNA, 13 nt, Human
ggaggcuggcagg

SEQ ID NO: 2404023 - RNA, 16 nt, Human
ggaggcuggcuggggc

SEQ ID NO: 2404024 - RNA, 15 nt, Human
ggaggcuggcugggg

SEQ ID NO: 2404025 - RNA, 15 nt, Human
ggaggcuuccugcgu

SEQ ID NO: 2404026 - RNA, 16 nt, Human
ggaggcuugggaccgc

SEQ ID NO: 2404027 - RNA, 16 nt, Human
ggaggcuugucagagc

SEQ ID NO: 2404028 - RNA, 17 nt, Human
ggaggcuugucagagcu

SEQ ID NO: 2404029 - RNA, 18 nt, Human
ggaggcuugucagagcug

SEQ ID NO: 2404030 - RNA, 19 nt, Human
ggaggcuugucagagcugg

SEQ ID NO: 2404031 - RNA, 20 nt, Human
ggaggcuugucagagcuggg

SEQ ID NO: 2404032 - RNA, 22 nt, Human
ggaggcuugucagagcugggag

SEQ ID NO: 2404033 - RNA, 22 nt, Human
ggagguaaggaauaccuguccc

SEQ ID NO: 2404034 - RNA, 19 nt, Human
ggagggugggagagcccag

SEQ ID NO: 2404035 - RNA, 15 nt, Human
ggagguggcagcccu

SEQ ID NO: 2404036 - RNA, 17 nt, Human
ggagguggcagcccugu

SEQ ID NO: 2404037 - RNA, 21 nt, Human
ggagggugacgggggugaacu

SEQ ID NO: 2404038 - RNA, 21 nt, Human
ggagggucccaagcugggccc

SEQ ID NO: 2404039 - RNA, 15 nt, Human
ggaggguggcaggug

SEQ ID NO: 2404040 - RNA, 20 nt, Human
ggagggucccaagcugggcc

SEQ ID NO: 2404041 - RNA, 14 nt, Human
ggagggucccaagc

SEQ ID NO: 2404042 - RNA, 15 nt, Human
ggagggucaggaagg

SEQ ID NO: 2404043 - RNA, 16 nt, Human
ggagggucaggaagga

SEQ ID NO: 2404044 - RNA, 23 nt, Human
ggaggugggauccuccaggugca

SEQ ID NO: 2404045 - RNA, 22 nt, Human
ggaggugggauccuccaggugc

SEQ ID NO: 2404046 - RNA, 19 nt, Human
ggaggugggagcaggagau

SEQ ID NO: 2404047 - RNA, 16 nt, Human
ggaggugggagcagga

SEQ ID NO: 2404048 - RNA, 17 nt, Human
ggagguggggaugagaa

SEQ ID NO: 2404049 - RNA, 18 nt, Human
ggagguggcuauggccac

SEQ ID NO: 2404050 - RNA, 13 nt, Human
ggagguggcuggg

SEQ ID NO: 2404051 - RNA, 15 nt, Human
ggaggugucaggcug

SEQ ID NO: 2404052 - RNA, 14 nt, Human
ggaggugucaggcu

SEQ ID NO: 2404053 - RNA, 15 nt, Human
ggaguggccacagaa

SEQ ID NO: 2404054 - RNA, 12 nt, Human
ggagugggccca

SEQ ID NO: 2404055 - RNA, 16 nt, Human
ggaguggccacagaaa

SEQ ID NO: 2404056 - RNA, 22 nt, Human
ggagugggcccaaugcacuuug

SEQ ID NO: 2404057 - RNA, 12 nt, Human
ggagugggacag

SEQ ID NO: 2404058 - RNA, 18 nt, Human
ggagugggacagagucug

SEQ ID NO: 2404059 - RNA, 15 nt, Human
ggaguggggcaguag

SEQ ID NO: 2404060 - RNA, 12 nt, Human
ggaguuaucuaa

SEQ ID NO: 2404061 - RNA, 13 nt, Human
ggaguucaaugau

SEQ ID NO: 2404062 - RNA, 12 nt, Human
ggaguucaauga

SEQ ID NO: 2404063 - RNA, 23 nt, Human
ggaguuaagaccuggcagcucug

SEQ ID NO: 2404064 - RNA, 22 nt, Human
ggaguuacauuaauguuaauuc

SEQ ID NO: 2404065 - RNA, 15 nt, Human
ggaguuagaggccag

SEQ ID NO: 2404066 - RNA, 16 nt, Human
ggaguuagaggccagc

SEQ ID NO: 2404067 - RNA, 18 nt, Human
ggaguuagaggccagccu

SEQ ID NO: 2404068 - RNA, 19 nt, Human
ggaguuagaggccagccug

SEQ ID NO: 2404069 - RNA, 21 nt, Human
ggaguuagaggccagccuggc

SEQ ID NO: 2404070 - RNA, 16 nt, Human
ggaguuaagaccuggc

SEQ ID NO: 2404071 - RNA, 18 nt, Human
ggaguuaagaccuggcag

SEQ ID NO: 2404072 - RNA, 15 nt, Human
ggaguuaagaccugg

SEQ ID NO: 2404073 - RNA, 12 nt, Human
ggaguguucccc

SEQ ID NO: 2404074 - RNA, 20 nt, Human
ggaguguuccccuuccacug

SEQ ID NO: 2404075 - RNA, 18 nt, Human
ggaguguguauuguuccc

SEQ ID NO: 2404076 - RNA, 19 nt, Human
ggaguguguauuguuccca

SEQ ID NO: 2404077 - RNA, 11 nt, Human
ggaguguguaa

SEQ ID NO: 2404078 - RNA, 22 nt, Human
ggaguguguaauuuaaaauugu

SEQ ID NO: 2404079 - RNA, 22 nt, Human
ggaguguggcugaggaggccuc

SEQ ID NO: 2404080 - RNA, 16 nt, Human
ggaguguguauuguuc

SEQ ID NO: 2404081 - RNA, 17 nt, Human
ggaguguguauuguucc

SEQ ID NO: 2404082 - RNA, 16 nt, Human
ggaguggggcaguaga

SEQ ID NO: 2404083 - RNA, 17 nt, Human
ggagugggacagagucu

SEQ ID NO: 2404084 - RNA, 20 nt, Human
ggaguguaugacugcacaug

SEQ ID NO: 2404085 - RNA, 16 nt, Human
ggauuuaauuugauau

SEQ ID NO: 2404086 - RNA, 21 nt, Human
ggauuuaacagucauuuaaaa

SEQ ID NO: 2404087 - RNA, 22 nt, Human
ggauuuaacagaaauguacagc

SEQ ID NO: 2404088 - RNA, 16 nt, Human
ggauuuaacagaaaug

SEQ ID NO: 2404089 - RNA, 17 nt, Human
ggauuuaacagaaaugu

SEQ ID NO: 2404090 - RNA, 20 nt, Human
ggauuguccccgacccuugc

SEQ ID NO: 2404091 - RNA, 16 nt, Human
ggauuguccccgaccc

SEQ ID NO: 2404092 - RNA, 12 nt, Human
ggauuuaacaga

SEQ ID NO: 2404093 - RNA, 15 nt, Human
ggauuguuccuguca

SEQ ID NO: 2404094 - RNA, 13 nt, Human
ggauuguccccga

SEQ ID NO: 2404095 - RNA, 14 nt, Human
ggauuguaguccca

SEQ ID NO: 2404096 - RNA, 13 nt, Human
ggauggugcccug

SEQ ID NO: 2404097 - RNA, 20 nt, Human
ggaugguccuggggcucugu

SEQ ID NO: 2404098 - RNA, 22 nt, Human
ggaugguccuggggcucugugc

SEQ ID NO: 2404099 - RNA, 23 nt, Human
ggaugguacuagggggaagugac

SEQ ID NO: 2404100 - RNA, 14 nt, Human
ggaugguccugggg

SEQ ID NO: 2404101 - RNA, 16 nt, Human
ggaugguccuggggcu

SEQ ID NO: 2404102 - RNA, 15 nt, Human
ggaugggggaacuca

SEQ ID NO: 2404103 - RNA, 17 nt, Human
ggaugggggaacucaga

SEQ ID NO: 2404104 - RNA, 17 nt, Human
ggaugaaauuuucuaga

SEQ ID NO: 2404105 - RNA, 18 nt, Human
ggaugaaauaacuccuuc

SEQ ID NO: 2404106 - RNA, 16 nt, Human
ggaucuuuguggccaa

SEQ ID NO: 2404107 - RNA, 17 nt, Human
ggaucuuuguggccaag

SEQ ID NO: 2404108 - RNA, 21 nt, Human
ggaugggggaacucagaucca

SEQ ID NO: 2404109 - RNA, 22 nt, Human
ggaugggggaacucagauccag

SEQ ID NO: 2404110 - RNA, 22 nt, Human
ggaugggggcuggccucuggcu

SEQ ID NO: 2404111 - RNA, 20 nt, Human
ggaugggggaaauggugccu

SEQ ID NO: 2404112 - RNA, 23 nt, Human
ggaugggggaacucagauccagg

SEQ ID NO: 2404113 - RNA, 14 nt, Human
ggaugaaaaaauaa

SEQ ID NO: 2404114 - RNA, 22 nt, Human
ggaucuuuggacagaagcagcu

SEQ ID NO: 2404115 - RNA, 22 nt, Human
ggaucuugcauucccagugguc

SEQ ID NO: 2404116 - RNA, 17 nt, Human
ggaucuugcauucccag

SEQ ID NO: 2404117 - RNA, 15 nt, Human
ggaucuuuguggcca

SEQ ID NO: 2404118 - RNA, 23 nt, Human
ggauccugagccagauuucacuc

SEQ ID NO: 2404119 - RNA, 20 nt, Human
ggauccugagccagauuuca

SEQ ID NO: 2404120 - RNA, 19 nt, Human
ggauccugagccagauuuc

SEQ ID NO: 2404121 - RNA, 18 nt, Human
ggauccugagccagauuu

SEQ ID NO: 2404122 - RNA, 16 nt, Human
ggauccugagccagau

SEQ ID NO: 2404123 - RNA, 15 nt, Human
ggauccugagccaga

SEQ ID NO: 2404124 - RNA, 16 nt, Human
ggaguucaucuugaau

SEQ ID NO: 2404125 - RNA, 17 nt, Human
ggaguucaaugaucuag

SEQ ID NO: 2404126 - RNA, 16 nt, Human
ggaguucaaugaucua

SEQ ID NO: 2404127 - RNA, 15 nt, Human
ggaguucaaugaucu

SEQ ID NO: 2404128 - RNA, 14 nt, Human
ggaguucaaugauc

SEQ ID NO: 2404129 - RNA, 20 nt, Human
ggaguucaguggugugaucu

SEQ ID NO: 2404130 - RNA, 20 nt, Human
ggaguucaaugaucuagguu

SEQ ID NO: 2404131 - RNA, 18 nt, Human
ggaucucuugagccuggg

SEQ ID NO: 2404132 - RNA, 21 nt, Human
ggaucuccaaggaccagguua

SEQ ID NO: 2404133 - RNA, 14 nt, Human
ggaucuccaaggac

SEQ ID NO: 2404134 - RNA, 13 nt, Human
ggaucuccaagga

SEQ ID NO: 2404135 - RNA, 13 nt, Human
ggaucucaggggc

SEQ ID NO: 2404136 - RNA, 13 nt, Human
ggaucucucagga

SEQ ID NO: 2404137 - RNA, 16 nt, Human
ggaucucucaggagca

SEQ ID NO: 2404138 - RNA, 14 nt, Human
ggaucuccccacuc

SEQ ID NO: 2404139 - RNA, 16 nt, Human
ggaucuugcauuccca

SEQ ID NO: 2404140 - RNA, 21 nt, Human
ggaucuuuggacagaagcagc

SEQ ID NO: 2404141 - RNA, 22 nt, Human
ggaucucucaggagcacaggca

SEQ ID NO: 2404142 - RNA, 21 nt, Human
ggaucucucaggagcacaggc

SEQ ID NO: 2404143 - RNA, 19 nt, Human
ggaguuccaugaagaccac

SEQ ID NO: 2404144 - RNA, 15 nt, Human
ggaguuccaugaaga

SEQ ID NO: 2404145 - RNA, 14 nt, Human
ggaguuccaugaag

SEQ ID NO: 2404146 - RNA, 19 nt, Human
ggaucggaggcuugucaga

SEQ ID NO: 2404147 - RNA, 23 nt, Human
ggaucggaggcuugucagagcug

SEQ ID NO: 2404148 - RNA, 12 nt, Human
ggaucuaccagc

SEQ ID NO: 2404149 - RNA, 13 nt, Human
ggaucuaccagca

SEQ ID NO: 2404150 - RNA, 18 nt, Human
ggaucuaccagcauaaau

SEQ ID NO: 2404151 - RNA, 10 nt, Human
ggaucucagg

SEQ ID NO: 2404152 - RNA, 17 nt, Human
ggaucucauuggacccu

SEQ ID NO: 2404153 - RNA, 24 nt, Human
ggaucucauuggacccuuccaugg

SEQ ID NO: 2404154 - RNA, 18 nt, Human
ggcaaaacuuuggcacug

SEQ ID NO: 2404155 - RNA, 23 nt, Human
ggcaaaaggaucuuuguggccaa

SEQ ID NO: 2404156 - RNA, 12 nt, Human
ggcaaaacucua

SEQ ID NO: 2404157 - RNA, 15 nt, Human
ggcaaaaaaauuaaa

SEQ ID NO: 2404158 - RNA, 18 nt, Human
ggauuuauaaaugcuauu

SEQ ID NO: 2404159 - RNA, 16 nt, Human
ggauuuauaaaugcua

SEQ ID NO: 2404160 - RNA, 14 nt, Human
ggauuuauuuuucc

SEQ ID NO: 2404161 - RNA, 20 nt, Human
ggauuucaugauuucauuuc

SEQ ID NO: 2404162 - RNA, 14 nt, Human
ggauuucguggguc

SEQ ID NO: 2404163 - RNA, 19 nt, Human
ggauuuccagccagggcug

SEQ ID NO: 2404164 - RNA, 23 nt, Human
ggauuuccugcuuugggaagccg

SEQ ID NO: 2404165 - RNA, 13 nt, Human
ggauuugaagcaa

SEQ ID NO: 2404166 - RNA, 13 nt, Human
ggauuucucccag

SEQ ID NO: 2404167 - RNA, 15 nt, Human
ggcaaaaaggcagga

SEQ ID NO: 2404168 - RNA, 16 nt, Human
ggauuuuugucuugug

SEQ ID NO: 2404169 - RNA, 14 nt, Human
ggauuuuugucuug

SEQ ID NO: 2404170 - RNA, 21 nt, Human
ggcacacacugugcuuucuau

SEQ ID NO: 2404171 - RNA, 13 nt, Human
ggcacacacugug

SEQ ID NO: 2404172 - RNA, 18 nt, Human
ggcacaccgggcacucag

SEQ ID NO: 2404173 - RNA, 21 nt, Human
ggcacacaccuguagucccag

SEQ ID NO: 2404174 - RNA, 22 nt, Human
ggcacugcuggguggcccaucc

SEQ ID NO: 2404175 - RNA, 21 nt, Human
ggcacugcuggguggcccauc

SEQ ID NO: 2404176 - RNA, 20 nt, Human
ggcacugcuggguggcccau

SEQ ID NO: 2404177 - RNA, 19 nt, Human
ggcacugcuggguggccca

SEQ ID NO: 2404178 - RNA, 16 nt, Human
ggcacugcuggguggc

SEQ ID NO: 2404179 - RNA, 15 nt, Human
ggcacugcugggugg

SEQ ID NO: 2404180 - RNA, 14 nt, Human
ggcacugcugggug

SEQ ID NO: 2404181 - RNA, 12 nt, Human
ggcacugcuggg

SEQ ID NO: 2404182 - RNA, 16 nt, Human
ggcacugcuuccagug

SEQ ID NO: 2404183 - RNA, 21 nt, Human
ggcacauuuccccagaccuga

SEQ ID NO: 2404184 - RNA, 16 nt, Human
ggcaccaaagccacca

SEQ ID NO: 2404185 - RNA, 22 nt, Human
ggcaccacugcacuccagccug

SEQ ID NO: 2404186 - RNA, 18 nt, Human
ggcacauuuaagagacag

SEQ ID NO: 2404187 - RNA, 19 nt, Human
ggcacaugcugagucuccc

SEQ ID NO: 2404188 - RNA, 16 nt, Human
ggcacauuuccccaga

SEQ ID NO: 2404189 - RNA, 20 nt, Human
ggcacauuuccccagaccug

SEQ ID NO: 2404190 - RNA, 18 nt, Human
ggcacaucagcacgauuu

SEQ ID NO: 2404191 - RNA, 21 nt, Human
ggcacauccuaugcaauauau

SEQ ID NO: 2404192 - RNA, 18 nt, Human
ggcacauccuaugcaaua

SEQ ID NO: 2404193 - RNA, 14 nt, Human
ggcacauggaggag

SEQ ID NO: 2404194 - RNA, 19 nt, Human
ggcacacgccucccacugg

SEQ ID NO: 2404195 - RNA, 18 nt, Human
ggcacacgccucccacug

SEQ ID NO: 2404196 - RNA, 17 nt, Human
ggcacacgccucccacu

SEQ ID NO: 2404197 - RNA, 15 nt, Human
ggcacacgccuccca

SEQ ID NO: 2404198 - RNA, 12 nt, Human
ggcacacgccuc

SEQ ID NO: 2404199 - RNA, 21 nt, Human
ggcagccccauucugccugcc

SEQ ID NO: 2404200 - RNA, 20 nt, Human
ggcagccccauucugccugc

SEQ ID NO: 2404201 - RNA, 16 nt, Human
ggcagccccauucugc

SEQ ID NO: 2404202 - RNA, 16 nt, Human
ggcagccucuucaaaa

SEQ ID NO: 2404203 - RNA, 11 nt, Human
ggcagccugga

SEQ ID NO: 2404204 - RNA, 22 nt, Human
ggcagccccauucugccugccc

SEQ ID NO: 2404205 - RNA, 13 nt, Human
ggcagccaggcca

SEQ ID NO: 2404206 - RNA, 20 nt, Human
ggcacugcuuccagugaggc

SEQ ID NO: 2404207 - RNA, 16 nt, Human
ggcacugcugugcugu

SEQ ID NO: 2404208 - RNA, 14 nt, Human
ggcacugcugugcu

SEQ ID NO: 2404209 - RNA, 22 nt, Human
ggcagcagugugaggccagggc

SEQ ID NO: 2404210 - RNA, 19 nt, Human
ggcagccaaacccaugagg

SEQ ID NO: 2404211 - RNA, 20 nt, Human
ggcagccaaacccaugaggc

SEQ ID NO: 2404212 - RNA, 16 nt, Human
ggcagccaaacccaug

SEQ ID NO: 2404213 - RNA, 18 nt, Human
ggcagccaaacccaugag

SEQ ID NO: 2404214 - RNA, 17 nt, Human
ggcagcauagcaagaca

SEQ ID NO: 2404215 - RNA, 19 nt, Human
ggcagcauagcaagacaca

SEQ ID NO: 2404216 - RNA, 20 nt, Human
ggcagccuggacauagagag

SEQ ID NO: 2404217 - RNA, 15 nt, Human
ggcagcgccaagcaa

SEQ ID NO: 2404218 - RNA, 18 nt, Human
ggcaggaggaucacuuga

SEQ ID NO: 2404219 - RNA, 23 nt, Human
ggcagcgccaagcaaccuggguc

SEQ ID NO: 2404220 - RNA, 18 nt, Human
ggcagcgccaagcaaccu

SEQ ID NO: 2404221 - RNA, 14 nt, Human
ggcagcgccaggcu

SEQ ID NO: 2404222 - RNA, 24 nt, Human
ggcaggaggauugcuugagcccag

SEQ ID NO: 2404223 - RNA, 16 nt, Human
ggcaggauggccuggc

SEQ ID NO: 2404224 - RNA, 15 nt, Human
ggcaggauggccugg

SEQ ID NO: 2404225 - RNA, 19 nt, Human
ggcaggauggccuggccag

SEQ ID NO: 2404226 - RNA, 13 nt, Human
ggcaggcacagca

SEQ ID NO: 2404227 - RNA, 16 nt, Human
ggcaggcacagcacag

SEQ ID NO: 2404228 - RNA, 14 nt, Human
ggcaggagggcccu

SEQ ID NO: 2404229 - RNA, 15 nt, Human
ggcaggaugacccug

SEQ ID NO: 2404230 - RNA, 22 nt, Human
ggcaggcugucuggccaggccu

SEQ ID NO: 2404231 - RNA, 18 nt, Human
ggcagggaaaggcucuga

SEQ ID NO: 2404232 - RNA, 14 nt, Human
ggcagggaccacac

SEQ ID NO: 2404233 - RNA, 23 nt, Human
ggcagggaaggggaggcagccgg

SEQ ID NO: 2404234 - RNA, 19 nt, Human
ggcagggagggccugggcc

SEQ ID NO: 2404235 - RNA, 20 nt, Human
ggcagggagggccugggccc

SEQ ID NO: 2404236 - RNA, 15 nt, Human
ggcagggauuugagg

SEQ ID NO: 2404237 - RNA, 13 nt, Human
ggcagggagggga

SEQ ID NO: 2404238 - RNA, 17 nt, Human
ggcagggagggccuggg

SEQ ID NO: 2404239 - RNA, 18 nt, Human
ggcagggagggccugggc

SEQ ID NO: 2404240 - RNA, 10 nt, Human
ggcagggagg

SEQ ID NO: 2404241 - RNA, 22 nt, Human
ggcagggagcggccggccagcc

SEQ ID NO: 2404242 - RNA, 19 nt, Human
ggcagggccuagcugcuac

SEQ ID NO: 2404243 - RNA, 16 nt, Human
ggcagggccccaggca

SEQ ID NO: 2404244 - RNA, 17 nt, Human
ggcagggccagggggug

SEQ ID NO: 2404245 - RNA, 15 nt, Human
ggcagggcaucuccu

SEQ ID NO: 2404246 - RNA, 18 nt, Human
ggcagggccaacccuucu

SEQ ID NO: 2404247 - RNA, 17 nt, Human
ggcaggggccuggagau

SEQ ID NO: 2404248 - RNA, 16 nt, Human
ggcaggggccuggaga

SEQ ID NO: 2404249 - RNA, 14 nt, Human
ggcaggggccugga

SEQ ID NO: 2404250 - RNA, 21 nt, Human
ggcaucacaugcucaaugacu

SEQ ID NO: 2404251 - RNA, 18 nt, Human
ggcaucaccuuaggcagg

SEQ ID NO: 2404252 - RNA, 20 nt, Human
ggcaucaccuuaggcaggga

SEQ ID NO: 2404253 - RNA, 18 nt, Human
ggcaucagucccuaugua

SEQ ID NO: 2404254 - RNA, 16 nt, Human
ggcaucagcuggcguc

SEQ ID NO: 2404255 - RNA, 13 nt, Human
ggcaucagcuggc

SEQ ID NO: 2404256 - RNA, 23 nt, Human
ggcaucaccuuaggcagggaagu

SEQ ID NO: 2404257 - RNA, 22 nt, Human
ggcaucacagggcagagccggg

SEQ ID NO: 2404258 - RNA, 23 nt, Human
ggcaucacagggcagagccggga

SEQ ID NO: 2404259 - RNA, 21 nt, Human
ggcaucgcaccauucugacuc

SEQ ID NO: 2404260 - RNA, 18 nt, Human
ggcaucgcaccauucuga

SEQ ID NO: 2404261 - RNA, 20 nt, Human
ggcaucgcaauguaagacuc

SEQ ID NO: 2404262 - RNA, 16 nt, Human
ggcauccuucugccuu

SEQ ID NO: 2404263 - RNA, 23 nt, Human
ggcaucaugcaucuuacugaagg

SEQ ID NO: 2404264 - RNA, 14 nt, Human
ggcauuugcugaau

SEQ ID NO: 2404265 - RNA, 22 nt, Human
ggcaucuagagcuugaugccag

SEQ ID NO: 2404266 - RNA, 21 nt, Human
ggcaucuagagcuugaugcca

SEQ ID NO: 2404267 - RNA, 19 nt, Human
ggcauccuucugccuuuuu

SEQ ID NO: 2404268 - RNA, 15 nt, Human
ggcaucuccaggaag

SEQ ID NO: 2404269 - RNA, 14 nt, Human
ggcaucuccaggaa

SEQ ID NO: 2404270 - RNA, 13 nt, Human
ggcaucuccagga

SEQ ID NO: 2404271 - RNA, 12 nt, Human
ggcaucuccagg

SEQ ID NO: 2404272 - RNA, 11 nt, Human
ggcauuuccua

SEQ ID NO: 2404273 - RNA, 16 nt, Human
ggcaucuccaggaagg

SEQ ID NO: 2404274 - RNA, 14 nt, Human
ggcaucuccugugc

SEQ ID NO: 2404275 - RNA, 16 nt, Human
ggccaaaggaagcaca

SEQ ID NO: 2404276 - RNA, 14 nt, Human
ggccaaaggaagca

SEQ ID NO: 2404277 - RNA, 17 nt, Human
ggcauuuguuugaacug

SEQ ID NO: 2404278 - RNA, 13 nt, Human
ggccaaaggaagc

SEQ ID NO: 2404279 - RNA, 23 nt, Human
ggccaacuugagggcccagagca

SEQ ID NO: 2404280 - RNA, 22 nt, Human
ggccaacuugagggcccagagc

SEQ ID NO: 2404281 - RNA, 21 nt, Human
ggccaacuugagggcccagag

SEQ ID NO: 2404282 - RNA, 23 nt, Human
ggccaagacuuggcaacagaagc

SEQ ID NO: 2404283 - RNA, 15 nt, Human
ggccaagacuuggca

SEQ ID NO: 2404284 - RNA, 13 nt, Human
ggccaagaggcug

SEQ ID NO: 2404285 - RNA, 19 nt, Human
ggccaaaggaagcacaugc

SEQ ID NO: 2404286 - RNA, 23 nt, Human
ggccaacccuucuccucuuguaa

SEQ ID NO: 2404287 - RNA, 18 nt, Human
ggccagagacacaagccu

SEQ ID NO: 2404288 - RNA, 21 nt, Human
ggccagaggcccccagcccag

SEQ ID NO: 2404289 - RNA, 19 nt, Human
ggccagaggcccccagccc

SEQ ID NO: 2404290 - RNA, 18 nt, Human
ggccagagagccuggugc

SEQ ID NO: 2404291 - RNA, 21 nt, Human
ggccagagagccuggugcugc

SEQ ID NO: 2404292 - RNA, 19 nt, Human
ggccagagggagugacaga

SEQ ID NO: 2404293 - RNA, 17 nt, Human
ggccagagggagugaca

SEQ ID NO: 2404294 - RNA, 14 nt, Human
ggccaagcagggag

SEQ ID NO: 2404295 - RNA, 11 nt, Human
ggccaaggacu

SEQ ID NO: 2404296 - RNA, 13 nt, Human
ggccaaggacugc

SEQ ID NO: 2404297 - RNA, 15 nt, Human
ggccaaggacugccg

SEQ ID NO: 2404298 - RNA, 17 nt, Human
ggccaaggacugccgac

SEQ ID NO: 2404299 - RNA, 17 nt, Human
ggccagagacacaagcc

SEQ ID NO: 2404300 - RNA, 18 nt, Human
ggccagacaugccacaag

SEQ ID NO: 2404301 - RNA, 12 nt, Human
ggcaggggcgga

SEQ ID NO: 2404302 - RNA, 16 nt, Human
ggcaggggugggggug

SEQ ID NO: 2404303 - RNA, 14 nt, Human
ggcagggguggggg

SEQ ID NO: 2404304 - RNA, 13 nt, Human
ggcaggggugggg

SEQ ID NO: 2404305 - RNA, 12 nt, Human
ggccucccaccc

SEQ ID NO: 2404306 - RNA, 11 nt, Human
ggccucccacc

SEQ ID NO: 2404307 - RNA, 15 nt, Human
ggccucccacaguga

SEQ ID NO: 2404308 - RNA, 14 nt, Human
ggccucccacagug

SEQ ID NO: 2404309 - RNA, 13 nt, Human
ggccucccacagu

SEQ ID NO: 2404310 - RNA, 11 nt, Human
ggccucccaca

SEQ ID NO: 2404311 - RNA, 17 nt, Human
ggccucccacagacuca

SEQ ID NO: 2404312 - RNA, 16 nt, Human
ggccagaugcaccagc

SEQ ID NO: 2404313 - RNA, 15 nt, Human
ggccagaugcaccag

SEQ ID NO: 2404314 - RNA, 22 nt, Human
ggccagaggcccccagcccagg

SEQ ID NO: 2404315 - RNA, 11 nt, Human
ggccagaggcu

SEQ ID NO: 2404316 - RNA, 17 nt, Human
ggccagauccagccugg

SEQ ID NO: 2404317 - RNA, 18 nt, Human
ggccagauccagccuggg

SEQ ID NO: 2404318 - RNA, 16 nt, Human
ggccccagcccacccu

SEQ ID NO: 2404319 - RNA, 15 nt, Human
ggccccagcccaccc

SEQ ID NO: 2404320 - RNA, 14 nt, Human
ggccccagcccacc

SEQ ID NO: 2404321 - RNA, 13 nt, Human
ggccccagcccac

SEQ ID NO: 2404322 - RNA, 12 nt, Human
ggccccagccca

SEQ ID NO: 2404323 - RNA, 21 nt, Human
ggccccagccagaguuccugc

SEQ ID NO: 2404324 - RNA, 13 nt, Human
ggccccagccaga

SEQ ID NO: 2404325 - RNA, 12 nt, Human
ggccccagccag

SEQ ID NO: 2404326 - RNA, 23 nt, Human
ggccccagcccacccuccugucu

SEQ ID NO: 2404327 - RNA, 11 nt, Human
ggccccagccu

SEQ ID NO: 2404328 - RNA, 19 nt, Human
ggccccagcccacccuccu

SEQ ID NO: 2404329 - RNA, 13 nt, Human
ggccccagccucc

SEQ ID NO: 2404330 - RNA, 18 nt, Human
ggccccagcacagcuuga

SEQ ID NO: 2404331 - RNA, 15 nt, Human
ggccccagcacagcu

SEQ ID NO: 2404332 - RNA, 13 nt, Human
ggccccagcacua

SEQ ID NO: 2404333 - RNA, 16 nt, Human
ggccccagcacuaaag

SEQ ID NO: 2404334 - RNA, 11 nt, Human
ggccccagcca

SEQ ID NO: 2404335 - RNA, 21 nt, Human
ggccccagcacuaaagcagug

SEQ ID NO: 2404336 - RNA, 19 nt, Human
ggccccugccucucugcag

SEQ ID NO: 2404337 - RNA, 18 nt, Human
ggccccugccucucugca

SEQ ID NO: 2404338 - RNA, 17 nt, Human
ggccccugccucucugc

SEQ ID NO: 2404339 - RNA, 15 nt, Human
ggccccagccuggcc

SEQ ID NO: 2404340 - RNA, 14 nt, Human
ggccccagccuggc

SEQ ID NO: 2404341 - RNA, 13 nt, Human
ggccccagccugg

SEQ ID NO: 2404342 - RNA, 12 nt, Human
ggccccagccug

SEQ ID NO: 2404343 - RNA, 13 nt, Human
ggccccugccucu

SEQ ID NO: 2404344 - RNA, 24 nt, Human
ggcccguugucucccuggcccuca

SEQ ID NO: 2404345 - RNA, 23 nt, Human
ggcccguugucucccuggcccuc

SEQ ID NO: 2404346 - RNA, 22 nt, Human
ggcccguugucucccuggcccu

SEQ ID NO: 2404347 - RNA, 21 nt, Human
ggcccguugucucccuggccc

SEQ ID NO: 2404348 - RNA, 20 nt, Human
ggcccguugucucccuggcc

SEQ ID NO: 2404349 - RNA, 19 nt, Human
ggcccguugucucccuggc

SEQ ID NO: 2404350 - RNA, 18 nt, Human
ggcccguugucucccugg

SEQ ID NO: 2404351 - RNA, 19 nt, Human
ggcccucaaggccucccac

SEQ ID NO: 2404352 - RNA, 18 nt, Human
ggcccucaaggccuccca

SEQ ID NO: 2404353 - RNA, 16 nt, Human
ggcccucaaggccucc

SEQ ID NO: 2404354 - RNA, 22 nt, Human
ggcccuaccagcgcccgcuggg

SEQ ID NO: 2404355 - RNA, 21 nt, Human
ggcccuaccagcgcccgcugg

SEQ ID NO: 2404356 - RNA, 16 nt, Human
ggcccuaccagcgccc

SEQ ID NO: 2404357 - RNA, 21 nt, Human
ggccccugccucucugcaggu

SEQ ID NO: 2404358 - RNA, 15 nt, Human
ggcccgucauguucc

SEQ ID NO: 2404359 - RNA, 17 nt, Human
ggcccguugucucccug

SEQ ID NO: 2404360 - RNA, 22 nt, Human
ggcccguugaggaugaggccgc

SEQ ID NO: 2404361 - RNA, 20 nt, Human
ggcccguugaggaugaggcc

SEQ ID NO: 2404362 - RNA, 16 nt, Human
ggcccguugaggauga

SEQ ID NO: 2404363 - RNA, 17 nt, Human
ggccccagccuggccca

SEQ ID NO: 2404364 - RNA, 16 nt, Human
ggccccagccuggccc

SEQ ID NO: 2404365 - RNA, 13 nt, Human
ggcccgugacaga

SEQ ID NO: 2404366 - RNA, 22 nt, Human
ggccgcgccaaauaaugucucu

SEQ ID NO: 2404367 - RNA, 14 nt, Human
ggccgccucacccc

SEQ ID NO: 2404368 - RNA, 14 nt, Human
ggccgccgccucuu

SEQ ID NO: 2404369 - RNA, 13 nt, Human
ggccgccucaccc

SEQ ID NO: 2404370 - RNA, 12 nt, Human
ggccgccucacc

SEQ ID NO: 2404371 - RNA, 22 nt, Human
ggccgcccccugccccccagcc

SEQ ID NO: 2404372 - RNA, 19 nt, Human
ggccgcccccugcccccca

SEQ ID NO: 2404373 - RNA, 18 nt, Human
ggccgcccccugcccccc

SEQ ID NO: 2404374 - RNA, 16 nt, Human
ggccgcccccugcccc

SEQ ID NO: 2404375 - RNA, 23 nt, Human
ggcccucaaggccucccacagug

SEQ ID NO: 2404376 - RNA, 20 nt, Human
ggcccucaaggccucccaca

SEQ ID NO: 2404377 - RNA, 15 nt, Human
ggcccucaccccugc

SEQ ID NO: 2404378 - RNA, 18 nt, Human
ggcccucaccccugcccu

SEQ ID NO: 2404379 - RNA, 20 nt, Human
ggcccucaccccugcccugg

SEQ ID NO: 2404380 - RNA, 21 nt, Human
ggcccucaccccugcccuggg

SEQ ID NO: 2404381 - RNA, 20 nt, Human
ggccucagucucccuucucc

SEQ ID NO: 2404382 - RNA, 11 nt, Human
ggccucagucu

SEQ ID NO: 2404383 - RNA, 17 nt, Human
ggccucagguuugccug

SEQ ID NO: 2404384 - RNA, 17 nt, Human
ggccucagcugccucac

SEQ ID NO: 2404385 - RNA, 22 nt, Human
ggccucagcugccucacuuccu

SEQ ID NO: 2404386 - RNA, 21 nt, Human
ggccgcuagaggccugaggau

SEQ ID NO: 2404387 - RNA, 20 nt, Human
ggccgcuagaggccugagga

SEQ ID NO: 2404388 - RNA, 19 nt, Human
ggccgcuagaggccugagg

SEQ ID NO: 2404389 - RNA, 18 nt, Human
ggccgcuagaggccugag

SEQ ID NO: 2404390 - RNA, 17 nt, Human
ggccgcuagaggccuga

SEQ ID NO: 2404391 - RNA, 15 nt, Human
ggccgcuagaggccu

SEQ ID NO: 2404392 - RNA, 14 nt, Human
ggccgcuagaggcc

SEQ ID NO: 2404393 - RNA, 13 nt, Human
ggccgcuagaggc

SEQ ID NO: 2404394 - RNA, 19 nt, Human
ggccgcuagaugggcaugg

SEQ ID NO: 2404395 - RNA, 16 nt, Human
ggccgcuagaugggca

SEQ ID NO: 2404396 - RNA, 13 nt, Human
ggccucagcugcc

SEQ ID NO: 2404397 - RNA, 15 nt, Human
ggccucagcugccuc

SEQ ID NO: 2404398 - RNA, 16 nt, Human
ggccucagcugccuca

SEQ ID NO: 2404399 - RNA, 19 nt, Human
ggccucccaacucacccca

SEQ ID NO: 2404400 - RNA, 18 nt, Human
ggccucccaacucacccc

SEQ ID NO: 2404401 - RNA, 17 nt, Human
ggccucccaacucaccc

SEQ ID NO: 2404402 - RNA, 13 nt, Human
ggccucagugcca

SEQ ID NO: 2404403 - RNA, 22 nt, Human
ggccucccaacucaccccagcc

SEQ ID NO: 2404404 - RNA, 20 nt, Human
ggccucccaacucaccccag

SEQ ID NO: 2404405 - RNA, 23 nt, Human
ggccucccaacucaccccagccc

SEQ ID NO: 2404406 - RNA, 14 nt, Human
ggccucauguggcu

SEQ ID NO: 2404407 - RNA, 20 nt, Human
ggccucaguggacuuuccac

SEQ ID NO: 2404408 - RNA, 22 nt, Human
ggccucaguggacuuuccaccc

SEQ ID NO: 2404409 - RNA, 14 nt, Human
ggccucccacagac

SEQ ID NO: 2404410 - RNA, 16 nt, Human
ggccucccacagacuc

SEQ ID NO: 2404411 - RNA, 21 nt, Human
ggccugcacggugggccuugc

SEQ ID NO: 2404412 - RNA, 19 nt, Human
ggccugcacggugggccuu

SEQ ID NO: 2404413 - RNA, 17 nt, Human
ggccugcacggugggcc

SEQ ID NO: 2404414 - RNA, 14 nt, Human
ggccugcacaguga

SEQ ID NO: 2404415 - RNA, 20 nt, Human
ggccugcaggaccugccugu

SEQ ID NO: 2404416 - RNA, 21 nt, Human
ggccugcaggaccugccugua

SEQ ID NO: 2404417 - RNA, 17 nt, Human
ggccugcaggaccugcc

SEQ ID NO: 2404418 - RNA, 13 nt, Human
ggccugcacuaau

SEQ ID NO: 2404419 - RNA, 17 nt, Human
ggccugcccucagggau

SEQ ID NO: 2404420 - RNA, 16 nt, Human
ggccugcccucaggga

SEQ ID NO: 2404421 - RNA, 13 nt, Human
ggccugccagacg

SEQ ID NO: 2404422 - RNA, 16 nt, Human
ggccugcaagggagug

SEQ ID NO: 2404423 - RNA, 22 nt, Human
ggccugaugcucccuccccugc

SEQ ID NO: 2404424 - RNA, 23 nt, Human
ggccugaugcucccuccccugcc

SEQ ID NO: 2404425 - RNA, 15 nt, Human
ggccugaugcucccu

SEQ ID NO: 2404426 - RNA, 17 nt, Human
ggccugaugcucccucc

SEQ ID NO: 2404427 - RNA, 18 nt, Human
ggccugaugcucccuccc

SEQ ID NO: 2404428 - RNA, 20 nt, Human
ggccugaugcucccuccccu

SEQ ID NO: 2404429 - RNA, 14 nt, Human
ggccugaugcuccc

SEQ ID NO: 2404430 - RNA, 13 nt, Human
ggccugcuccaga

SEQ ID NO: 2404431 - RNA, 14 nt, Human
ggccugcuccagac

SEQ ID NO: 2404432 - RNA, 15 nt, Human
ggccugcuccagacc

SEQ ID NO: 2404433 - RNA, 16 nt, Human
ggccugcuccagaccu

SEQ ID NO: 2404434 - RNA, 17 nt, Human
ggccugcuccagaccug

SEQ ID NO: 2404435 - RNA, 18 nt, Human
ggccugcucccagcagcc

SEQ ID NO: 2404436 - RNA, 17 nt, Human
ggccugcucccagcagc

SEQ ID NO: 2404437 - RNA, 18 nt, Human
ggccugcuccagaccuga

SEQ ID NO: 2404438 - RNA, 20 nt, Human
ggccugccuccagggcugga

SEQ ID NO: 2404439 - RNA, 19 nt, Human
ggccugccuccagggcugg

SEQ ID NO: 2404440 - RNA, 18 nt, Human
ggccugccuccagggcug

SEQ ID NO: 2404441 - RNA, 11 nt, Human
ggccugccugu

SEQ ID NO: 2404442 - RNA, 18 nt, Human
ggccugccuugaagccac

SEQ ID NO: 2404443 - RNA, 22 nt, Human
ggccuggauucauuuccugccc

SEQ ID NO: 2404444 - RNA, 20 nt, Human
ggccuggauucauuuccugc

SEQ ID NO: 2404445 - RNA, 19 nt, Human
ggccuggauucauuuccug

SEQ ID NO: 2404446 - RNA, 17 nt, Human
ggccuggauucauuucc

SEQ ID NO: 2404447 - RNA, 16 nt, Human
ggccuggauucauuuc

SEQ ID NO: 2404448 - RNA, 21 nt, Human
ggccuggaucuccccacucua

SEQ ID NO: 2404449 - RNA, 19 nt, Human
ggccuggaggugggguugg

SEQ ID NO: 2404450 - RNA, 21 nt, Human
ggccuggagcaggccuugcgc

SEQ ID NO: 2404451 - RNA, 19 nt, Human
ggccuggagcaggccuugc

SEQ ID NO: 2404452 - RNA, 16 nt, Human
ggccuggagcaggccu

SEQ ID NO: 2404453 - RNA, 15 nt, Human
ggccuggagcaggcc

SEQ ID NO: 2404454 - RNA, 20 nt, Human
ggccuggagauccuccugca

SEQ ID NO: 2404455 - RNA, 17 nt, Human
ggccugcugggcucucc

SEQ ID NO: 2404456 - RNA, 19 nt, Human
ggccugcugggcucuccac

SEQ ID NO: 2404457 - RNA, 17 nt, Human
ggccuucagggagugag

SEQ ID NO: 2404458 - RNA, 17 nt, Human
ggccuggccaccucucu

SEQ ID NO: 2404459 - RNA, 16 nt, Human
ggccuggccaccucuc

SEQ ID NO: 2404460 - RNA, 14 nt, Human
ggccuggccaccuc

SEQ ID NO: 2404461 - RNA, 17 nt, Human
ggccuggcacaucagaa

SEQ ID NO: 2404462 - RNA, 21 nt, Human
ggccuguuuuagaagguucuc

SEQ ID NO: 2404463 - RNA, 16 nt, Human
ggccuggccagaugca

SEQ ID NO: 2404464 - RNA, 15 nt, Human
ggccuggccagaugc

SEQ ID NO: 2404465 - RNA, 12 nt, Human
ggccuggccaga

SEQ ID NO: 2404466 - RNA, 15 nt, Human
ggccuggcagccgug

SEQ ID NO: 2404467 - RNA, 14 nt, Human
ggccuggcagccgu

SEQ ID NO: 2404468 - RNA, 22 nt, Human
ggccuggcacagugucugggcu

SEQ ID NO: 2404469 - RNA, 12 nt, Human
ggccuggcacag

SEQ ID NO: 2404470 - RNA, 13 nt, Human
ggcuaccuuugua

SEQ ID NO: 2404471 - RNA, 12 nt, Human
ggcuacacaggg

SEQ ID NO: 2404472 - RNA, 23 nt, Human
ggcuacaauuuucucccaggaag

SEQ ID NO: 2404473 - RNA, 13 nt, Human
ggcuaauuuuugu

SEQ ID NO: 2404474 - RNA, 22 nt, Human
ggcuacaccuuagccugcccuc

SEQ ID NO: 2404475 - RNA, 15 nt, Human
ggcuacacagggaug

SEQ ID NO: 2404476 - RNA, 23 nt, Human
ggcuacaccuuagccugcccucc

SEQ ID NO: 2404477 - RNA, 23 nt, Human
ggcuaauucccagagugugaaac

SEQ ID NO: 2404478 - RNA, 19 nt, Human
ggcuaauucccagagugug

SEQ ID NO: 2404479 - RNA, 18 nt, Human
ggcuaauuuuuguuuugu

SEQ ID NO: 2404480 - RNA, 20 nt, Human
ggcuaagagcuagcgcugcc

SEQ ID NO: 2404481 - RNA, 14 nt, Human
ggcuaacuggaagc

SEQ ID NO: 2404482 - RNA, 19 nt, Human
ggcuaagaguguccuagga

SEQ ID NO: 2404483 - RNA, 15 nt, Human
ggcuaauuaaauaaa

SEQ ID NO: 2404484 - RNA, 22 nt, Human
ggcuaaggcguggagcugccug

SEQ ID NO: 2404485 - RNA, 19 nt, Human
ggcuaaggcguggagcugc

SEQ ID NO: 2404486 - RNA, 20 nt, Human
ggcuaagugauccucccacc

SEQ ID NO: 2404487 - RNA, 16 nt, Human
ggcuaauguacugcau

SEQ ID NO: 2404488 - RNA, 14 nt, Human
ggcuaccuuuguau

SEQ ID NO: 2404489 - RNA, 16 nt, Human
ggcuacucagcagccc

SEQ ID NO: 2404490 - RNA, 15 nt, Human
ggcuacucagcagcc

SEQ ID NO: 2404491 - RNA, 19 nt, Human
ggcuacccugagcugaggc

SEQ ID NO: 2404492 - RNA, 12 nt, Human
ggcuacccuccc

SEQ ID NO: 2404493 - RNA, 15 nt, Human
ggcuacugcagcuuu

SEQ ID NO: 2404494 - RNA, 19 nt, Human
ggcuacucuccucggcccc

SEQ ID NO: 2404495 - RNA, 17 nt, Human
ggcuacucagcagcccu

SEQ ID NO: 2404496 - RNA, 18 nt, Human
ggcuacucagcagcccuc

SEQ ID NO: 2404497 - RNA, 20 nt, Human
ggcuacucagcagcccuccu

SEQ ID NO: 2404498 - RNA, 21 nt, Human
ggcuacucagcagcccuccuc

SEQ ID NO: 2404499 - RNA, 13 nt, Human
ggcuagaaucugg

SEQ ID NO: 2404500 - RNA, 18 nt, Human
ggcuagaauauccuacuu

SEQ ID NO: 2404501 - RNA, 15 nt, Human
ggcuagaacuggaga

SEQ ID NO: 2404502 - RNA, 22 nt, Human
ggcuagaaccuguagagcuaga

SEQ ID NO: 2404503 - RNA, 14 nt, Human
ggcuagaaccuggc

SEQ ID NO: 2404504 - RNA, 18 nt, Human
ggcuagaaccuggagggc

SEQ ID NO: 2404505 - RNA, 16 nt, Human
ggcuagaaccuggagg

SEQ ID NO: 2404506 - RNA, 22 nt, Human
ggcuagaaccuggagagcuaga

SEQ ID NO: 2404507 - RNA, 16 nt, Human
ggcuagaaccuggaga

SEQ ID NO: 2404508 - RNA, 21 nt, Human
ggcuagaaccuagaagggcua

SEQ ID NO: 2404509 - RNA, 21 nt, Human
ggcuagaaccaagaagggcua

SEQ ID NO: 2404510 - RNA, 23 nt, Human
ggcuacugcagcuuuacaugcaa

SEQ ID NO: 2404511 - RNA, 18 nt, Human
ggcuacugcagcuuuaca

SEQ ID NO: 2404512 - RNA, 16 nt, Human
ggcuagagguucaaag

SEQ ID NO: 2404513 - RNA, 19 nt, Human
ggcucacuauggugccaau

SEQ ID NO: 2404514 - RNA, 22 nt, Human
ggcuagaaucuggagagcuaga

SEQ ID NO: 2404515 - RNA, 20 nt, Human
ggcuagaggccagccccacc

SEQ ID NO: 2404516 - RNA, 16 nt, Human
ggcuagaggccagccc

SEQ ID NO: 2404517 - RNA, 16 nt, Human
ggcuagaaucuggaga

SEQ ID NO: 2404518 - RNA, 14 nt, Human
ggcuagaaucugga

SEQ ID NO: 2404519 - RNA, 18 nt, Human
ggcuagaggccagcccca

SEQ ID NO: 2404520 - RNA, 15 nt, Human
ggcgaggcagaggac

SEQ ID NO: 2404521 - RNA, 13 nt, Human
ggcgaggcagagg

SEQ ID NO: 2404522 - RNA, 12 nt, Human
ggcgaggcagag

SEQ ID NO: 2404523 - RNA, 11 nt, Human
ggcgaggcaga

SEQ ID NO: 2404524 - RNA, 21 nt, Human
ggcgagcccuguggaugagcc

SEQ ID NO: 2404525 - RNA, 15 nt, Human
ggcgagaggaggggc

SEQ ID NO: 2404526 - RNA, 14 nt, Human
ggcgagaggagggg

SEQ ID NO: 2404527 - RNA, 14 nt, Human
ggccuuccugcccu

SEQ ID NO: 2404528 - RNA, 13 nt, Human
ggccuuccugccc

SEQ ID NO: 2404529 - RNA, 16 nt, Human
ggccuuccccagccuc

SEQ ID NO: 2404530 - RNA, 18 nt, Human
ggcgaucacaacgugcau

SEQ ID NO: 2404531 - RNA, 15 nt, Human
ggcgagugccaggac

SEQ ID NO: 2404532 - RNA, 15 nt, Human
ggcgagucacugccu

SEQ ID NO: 2404533 - RNA, 19 nt, Human
ggcgaggcagaggacagau

SEQ ID NO: 2404534 - RNA, 21 nt, Human
ggcgaggggaggguggcaggu

SEQ ID NO: 2404535 - RNA, 16 nt, Human
ggcgagucacugccuc

SEQ ID NO: 2404536 - RNA, 20 nt, Human
ggcgaucacaacgugcauug

SEQ ID NO: 2404537 - RNA, 17 nt, Human
ggcgauccaccugucuc

SEQ ID NO: 2404538 - RNA, 18 nt, Human
ggcgauccaccugucuca

SEQ ID NO: 2404539 - RNA, 22 nt, Human
ggcgauccaccugucucagccu

SEQ ID NO: 2404540 - RNA, 18 nt, Human
ggccuucggccuccaucc

SEQ ID NO: 2404541 - RNA, 22 nt, Human
ggccuucggccuccauccugag

SEQ ID NO: 2404542 - RNA, 16 nt, Human
ggccuucggccuccau

SEQ ID NO: 2404543 - RNA, 15 nt, Human
ggccuuccccagccu

SEQ ID NO: 2404544 - RNA, 17 nt, Human
ggccuuccccagccucu

SEQ ID NO: 2404545 - RNA, 20 nt, Human
ggcuaagcuucacuguaaaa

SEQ ID NO: 2404546 - RNA, 17 nt, Human
ggcuaacuauauuugcu

SEQ ID NO: 2404547 - RNA, 19 nt, Human
ggcuaagagcuagcgcugc

SEQ ID NO: 2404548 - RNA, 15 nt, Human
ggcuaacuggaagca

SEQ ID NO: 2404549 - RNA, 21 nt, Human
ggcuaaacauccaauauuuuc

SEQ ID NO: 2404550 - RNA, 11 nt, Human
ggcguuucuuu

SEQ ID NO: 2404551 - RNA, 17 nt, Human
ggcgugacucacccaag

SEQ ID NO: 2404552 - RNA, 17 nt, Human
ggcgugagaccugcccc

SEQ ID NO: 2404553 - RNA, 18 nt, Human
ggcgugagaccugccccu

SEQ ID NO: 2404554 - RNA, 12 nt, Human
ggcgugaucucg

SEQ ID NO: 2404555 - RNA, 15 nt, Human
ggcgugaggauggga

SEQ ID NO: 2404556 - RNA, 22 nt, Human
ggcgcaagccuguaaucccagc

SEQ ID NO: 2404557 - RNA, 15 nt, Human
ggcgugacucaccca

SEQ ID NO: 2404558 - RNA, 14 nt, Human
ggcgugagaccugc

SEQ ID NO: 2404559 - RNA, 16 nt, Human
ggcgugagaccugccc

SEQ ID NO: 2404560 - RNA, 21 nt, Human
ggcgucuguucccccuucaca

SEQ ID NO: 2404561 - RNA, 14 nt, Human
ggcgcaagccugua

SEQ ID NO: 2404562 - RNA, 16 nt, Human
ggcgagugccaggacu

SEQ ID NO: 2404563 - RNA, 21 nt, Human
ggcgaucgcggcggagcuggc

SEQ ID NO: 2404564 - RNA, 20 nt, Human
ggcuggccucccaaaugagc

SEQ ID NO: 2404565 - RNA, 19 nt, Human
ggcuggccucuggcucuca

SEQ ID NO: 2404566 - RNA, 21 nt, Human
ggcuggccuaggagauaucug

SEQ ID NO: 2404567 - RNA, 15 nt, Human
ggcuggccuggcccc

SEQ ID NO: 2404568 - RNA, 14 nt, Human
ggcuggccuggccc

SEQ ID NO: 2404569 - RNA, 13 nt, Human
ggcuggccuggcc

SEQ ID NO: 2404570 - RNA, 19 nt, Human
ggcuggccagccccacagc

SEQ ID NO: 2404571 - RNA, 22 nt, Human
ggcuggccaguccaggcugccg

SEQ ID NO: 2404572 - RNA, 17 nt, Human
ggcuggcccugcccugg

SEQ ID NO: 2404573 - RNA, 10 nt, Human
aaaaaaagag

SEQ ID NO: 2404574 - RNA, 14 nt, Human
aaaaaaagaucugu

SEQ ID NO: 2404575 - RNA, 13 nt, Human
aaaaaaagacaag

SEQ ID NO: 2404576 - RNA, 11 nt, Human
aaaaaaagaca

SEQ ID NO: 2404577 - RNA, 10 nt, Human
aaaaaaagaa

SEQ ID NO: 2404578 - RNA, 9 nt, Human
aaaaaaaga

SEQ ID NO: 2404579 - RNA, 11 nt, Human
aaaaaaagaaa

SEQ ID NO: 2404580 - RNA, 12 nt, Human
aaaaaaaguauu

SEQ ID NO: 2404581 - RNA, 14 nt, Human
aaaaaaaguauuau

SEQ ID NO: 2404582 - RNA, 11 nt, Human
aaaaaaaguua

SEQ ID NO: 2404583 - RNA, 13 nt, Human
aaaaaaauacuug

SEQ ID NO: 2404584 - RNA, 12 nt, Human
aaaaaaauaaua

SEQ ID NO: 2404585 - RNA, 14 nt, Human
aaaaaaaucugcag

SEQ ID NO: 2404586 - RNA, 12 nt, Human
aaaaaaaugaca

SEQ ID NO: 2404587 - RNA, 12 nt, Human
aaaaaaaugacu

SEQ ID NO: 2404588 - RNA, 11 nt, Human
aaaaaaaugcc

SEQ ID NO: 2404589 - RNA, 13 nt, Human
aaaaaaaugcuga

SEQ ID NO: 2404590 - RNA, 13 nt, Human
aaaaaaaugacua

SEQ ID NO: 2404591 - RNA, 11 nt, Human
aaaaaaauuua

SEQ ID NO: 2404592 - RNA, 22 nt, Human
aaaaaacugcugacuguuuucu

SEQ ID NO: 2404593 - RNA, 21 nt, Human
aaaaagcauguacaguguucu

SEQ ID NO: 2404594 - RNA, 18 nt, Human
aaaaagcauguacagugu

SEQ ID NO: 2404595 - RNA, 17 nt, Human
aaaaagcauguacagug

SEQ ID NO: 2404596 - RNA, 15 nt, Human
aaaaagcauguacag

SEQ ID NO: 2404597 - RNA, 14 nt, Human
aaaaagcauguaca

SEQ ID NO: 2404598 - RNA, 12 nt, Human
aaaaagcaugua

SEQ ID NO: 2404599 - RNA, 15 nt, Human
aaaaagcacaagaag

SEQ ID NO: 2404600 - RNA, 14 nt, Human
aaaaagcacaagaa

SEQ ID NO: 2404601 - RNA, 13 nt, Human
aaaaagcacaaga

SEQ ID NO: 2404602 - RNA, 13 nt, Human
aaaaagauuuguu

SEQ ID NO: 2404603 - RNA, 21 nt, Human
aaaaagcagcuaccagguguu

SEQ ID NO: 2404604 - RNA, 13 nt, Human
aaaaagcagcuac

SEQ ID NO: 2404605 - RNA, 19 nt, Human
aaaaaacucgaggacugua

SEQ ID NO: 2404606 - RNA, 11 nt, Human
aaaaaaauuug

SEQ ID NO: 2404607 - RNA, 9 nt, Human
aaaaaagaa

SEQ ID NO: 2404608 - RNA, 15 nt, Human
aaaaaacagaggcca

SEQ ID NO: 2404609 - RNA, 23 nt, Human
aaaaagauuuucagaaaauauua

SEQ ID NO: 2404610 - RNA, 20 nt, Human
aaaaagauguucagucauuu

SEQ ID NO: 2404611 - RNA, 13 nt, Human
aaaaauacaaaaa

SEQ ID NO: 2404612 - RNA, 14 nt, Human
aaaaauaaaacauu

SEQ ID NO: 2404613 - RNA, 23 nt, Human
aaaaaguuuugcccuuuuuaagg

SEQ ID NO: 2404614 - RNA, 17 nt, Human
aaaaaguuuuauuuuuc

SEQ ID NO: 2404615 - RNA, 21 nt, Human
aaaaauaaaaacugacuccuu

SEQ ID NO: 2404616 - RNA, 14 nt, Human
aaaaauacaugcau

SEQ ID NO: 2404617 - RNA, 14 nt, Human
aaaaauacauuuua

SEQ ID NO: 2404618 - RNA, 19 nt, Human
aaaaauaaucuauuucuau

SEQ ID NO: 2404619 - RNA, 10 nt, Human
aaaaauacuu

SEQ ID NO: 2404620 - RNA, 15 nt, Human
aaaaauacauuuuau

SEQ ID NO: 2404621 - RNA, 11 nt, Human
aaaaauacugc

SEQ ID NO: 2404622 - RNA, 20 nt, Human
ggcuggguuggcgcacccuc

SEQ ID NO: 2404623 - RNA, 19 nt, Human
ggcuggguuggcgcacccu

SEQ ID NO: 2404624 - RNA, 16 nt, Human
ggcuggguuggcgcac

SEQ ID NO: 2404625 - RNA, 15 nt, Human
aaaaauacuugucaa

SEQ ID NO: 2404626 - RNA, 22 nt, Human
aaaaauacuugucaauauuuaa

SEQ ID NO: 2404627 - RNA, 16 nt, Human
ggcugguagcucaggu

SEQ ID NO: 2404628 - RNA, 15 nt, Human
ggcugguagcucagg

SEQ ID NO: 2404629 - RNA, 19 nt, Human
ggcugguaacaguucaugu

SEQ ID NO: 2404630 - RNA, 21 nt, Human
ggcugguagcucaggugggcg

SEQ ID NO: 2404631 - RNA, 17 nt, Human
ggcugguagcucaggug

SEQ ID NO: 2404632 - RNA, 22 nt, Human
ggcuggguucuacccaggugcu

SEQ ID NO: 2404633 - RNA, 14 nt, Human
ggcuggguuggagg

SEQ ID NO: 2404634 - RNA, 16 nt, Human
aaaaaguuuuaguuuu

SEQ ID NO: 2404635 - RNA, 13 nt, Human
aaaaaguuuguuu

SEQ ID NO: 2404636 - RNA, 14 nt, Human
aaaaauaaaaaaca

SEQ ID NO: 2404637 - RNA, 19 nt, Human
aaaaaggcauauugcuuuu

SEQ ID NO: 2404638 - RNA, 17 nt, Human
aaaaaggcauuguuuga

SEQ ID NO: 2404639 - RNA, 17 nt, Human
aaaaaguuuacaagugu

SEQ ID NO: 2404640 - RNA, 19 nt, Human
aaaaaguuugguucugugu

SEQ ID NO: 2404641 - RNA, 18 nt, Human
aaaaaguuugccagaagu

SEQ ID NO: 2404642 - RNA, 14 nt, Human
aaaaaguuuccaua

SEQ ID NO: 2404643 - RNA, 17 nt, Human
aaaaaguuugccagaag

SEQ ID NO: 2404644 - RNA, 21 nt, Human
aaaaaggaugcacagaguugu

SEQ ID NO: 2404645 - RNA, 12 nt, Human
aaaaaggcagga

SEQ ID NO: 2404646 - RNA, 20 nt, Human
aaaaagcauguacaguguuc

SEQ ID NO: 2404647 - RNA, 17 nt, Human
aaaaagccuccagucca

SEQ ID NO: 2404648 - RNA, 20 nt, Human
aaaaagccugcaauuucaua

SEQ ID NO: 2404649 - RNA, 14 nt, Human
aaaaaggaggaaga

SEQ ID NO: 2404650 - RNA, 15 nt, Human
ggcucacugcagccu

SEQ ID NO: 2404651 - RNA, 14 nt, Human
ggcucacugcagcc

SEQ ID NO: 2404652 - RNA, 13 nt, Human
ggcucacugcagc

SEQ ID NO: 2404653 - RNA, 15 nt, Human
ggcucuuuccuugcu

SEQ ID NO: 2404654 - RNA, 14 nt, Human
ggcucuuuccuugc

SEQ ID NO: 2404655 - RNA, 13 nt, Human
ggcucuuuccuug

SEQ ID NO: 2404656 - RNA, 23 nt, Human
ggcucuugugcuggauggagccc

SEQ ID NO: 2404657 - RNA, 20 nt, Human
ggcucuugugcuggauggag

SEQ ID NO: 2404658 - RNA, 14 nt, Human
ggcucuucugacua

SEQ ID NO: 2404659 - RNA, 21 nt, Human
ggcucuugauaccccccucug

SEQ ID NO: 2404660 - RNA, 20 nt, Human
ggcucuugauaccccccucu

SEQ ID NO: 2404661 - RNA, 19 nt, Human
ggcucuugauaccccccuc

SEQ ID NO: 2404662 - RNA, 20 nt, Human
ggcucuugaacugagcuugg

SEQ ID NO: 2404663 - RNA, 18 nt, Human
ggcucuugaacugagcuu

SEQ ID NO: 2404664 - RNA, 19 nt, Human
ggcucuugaacugagcuug

SEQ ID NO: 2404665 - RNA, 23 nt, Human
ggcucuucuccuuucacaaccuu

SEQ ID NO: 2404666 - RNA, 19 nt, Human
ggcucuacaacugaguccu

SEQ ID NO: 2404667 - RNA, 13 nt, Human
ggcucuucugacu

SEQ ID NO: 2404668 - RNA, 18 nt, Human
ggcucuuccaggcuggga

SEQ ID NO: 2404669 - RNA, 17 nt, Human
ggcucuuccaggcuggg

SEQ ID NO: 2404670 - RNA, 15 nt, Human
ggcucuuccaggcug

SEQ ID NO: 2404671 - RNA, 18 nt, Human
ggcucuacaacugagucc

SEQ ID NO: 2404672 - RNA, 14 nt, Human
ggcucuuccaggcu

SEQ ID NO: 2404673 - RNA, 17 nt, Human
ggcucccugacugggag

SEQ ID NO: 2404674 - RNA, 18 nt, Human
ggcucccugacugggagu

SEQ ID NO: 2404675 - RNA, 11 nt, Human
ggcucccugga

SEQ ID NO: 2404676 - RNA, 20 nt, Human
ggcucccuguaaccucuuca

SEQ ID NO: 2404677 - RNA, 13 nt, Human
ggcucccuuccca

SEQ ID NO: 2404678 - RNA, 18 nt, Human
ggcucguugacuggcugu

SEQ ID NO: 2404679 - RNA, 17 nt, Human
ggcucgccaugccgggg

SEQ ID NO: 2404680 - RNA, 16 nt, Human
ggcucgccaugccggg

SEQ ID NO: 2404681 - RNA, 22 nt, Human
ggcucgauuuuguaucugcagg

SEQ ID NO: 2404682 - RNA, 20 nt, Human
ggcucgauuuuguaucugca

SEQ ID NO: 2404683 - RNA, 21 nt, Human
ggcucccuucaucuccaggga

SEQ ID NO: 2404684 - RNA, 21 nt, Human
ggcucccuguaaccucuucag

SEQ ID NO: 2404685 - RNA, 16 nt, Human
ggcucggaggcugccc

SEQ ID NO: 2404686 - RNA, 22 nt, Human
ggcucgccucaggaaugggcug

SEQ ID NO: 2404687 - RNA, 23 nt, Human
ggcucgccucaggaaugggcugu

SEQ ID NO: 2404688 - RNA, 17 nt, Human
ggcucggaggcugcccc

SEQ ID NO: 2404689 - RNA, 22 nt, Human
ggcucgucggggggacagcucc

SEQ ID NO: 2404690 - RNA, 24 nt, Human
ggcugacuagaagggccaguccug

SEQ ID NO: 2404691 - RNA, 19 nt, Human
ggcugacuagaagggccag

SEQ ID NO: 2404692 - RNA, 22 nt, Human
ggcugacuagaagggccagucc

SEQ ID NO: 2404693 - RNA, 20 nt, Human
ggcugaccuuccucgcagag

SEQ ID NO: 2404694 - RNA, 22 nt, Human
ggcugaccccaaagagccugga

SEQ ID NO: 2404695 - RNA, 22 nt, Human
ggcugacggugcagucugggug

SEQ ID NO: 2404696 - RNA, 23 nt, Human
ggcugaccuuccucgcagagagg

SEQ ID NO: 2404697 - RNA, 21 nt, Human
ggcugaccuugaacuccuggg

SEQ ID NO: 2404698 - RNA, 22 nt, Human
ggcugaccacagcacagccaac

SEQ ID NO: 2404699 - RNA, 17 nt, Human
ggcugacccagucccug

SEQ ID NO: 2404700 - RNA, 18 nt, Human
ggcugacccagucccugg

SEQ ID NO: 2404701 - RNA, 19 nt, Human
ggcugacccagucccuggg

SEQ ID NO: 2404702 - RNA, 20 nt, Human
ggcugaccccaaagagccug

SEQ ID NO: 2404703 - RNA, 19 nt, Human
ggcugaccccaaagagccu

SEQ ID NO: 2404704 - RNA, 18 nt, Human
ggcugaccccaaagagcc

SEQ ID NO: 2404705 - RNA, 22 nt, Human
ggcugacccagucccuggggga

SEQ ID NO: 2404706 - RNA, 24 nt, Human
ggcugaaagaacauggacuuguau

SEQ ID NO: 2404707 - RNA, 22 nt, Human
ggcucuuuggggucagccaggg

SEQ ID NO: 2404708 - RNA, 17 nt, Human
ggcucuuuccuugcuca

SEQ ID NO: 2404709 - RNA, 16 nt, Human
ggcucuuuccuugcuc

SEQ ID NO: 2404710 - RNA, 15 nt, Human
ggcugaccaugcuca

SEQ ID NO: 2404711 - RNA, 17 nt, Human
ggcugcccgcucccagu

SEQ ID NO: 2404712 - RNA, 16 nt, Human
ggcugcccgcucccag

SEQ ID NO: 2404713 - RNA, 14 nt, Human
ggcugcccgcuccc

SEQ ID NO: 2404714 - RNA, 13 nt, Human
ggcugcccgcucc

SEQ ID NO: 2404715 - RNA, 21 nt, Human
ggcugcccgcucccagugucu

SEQ ID NO: 2404716 - RNA, 18 nt, Human
ggcugcccgcucccagug

SEQ ID NO: 2404717 - RNA, 22 nt, Human
ggcugcccgcucccagugucuu

SEQ ID NO: 2404718 - RNA, 18 nt, Human
ggcugagacaggagaauc

SEQ ID NO: 2404719 - RNA, 15 nt, Human
ggcugagacaggaga

SEQ ID NO: 2404720 - RNA, 17 nt, Human
ggcugagaacccugcgu

SEQ ID NO: 2404721 - RNA, 14 nt, Human
ggcugagaacacug

SEQ ID NO: 2404722 - RNA, 21 nt, Human
ggcugagacugcgggaugguc

SEQ ID NO: 2404723 - RNA, 12 nt, Human
ggcugcccugcc

SEQ ID NO: 2404724 - RNA, 17 nt, Human
ggcugcccuggcccuga

SEQ ID NO: 2404725 - RNA, 16 nt, Human
ggcugcccuggcccug

SEQ ID NO: 2404726 - RNA, 15 nt, Human
ggcugcccuggcccu

SEQ ID NO: 2404727 - RNA, 14 nt, Human
ggcugcccuggccc

SEQ ID NO: 2404728 - RNA, 13 nt, Human
ggcugcccugcca

SEQ ID NO: 2404729 - RNA, 11 nt, Human
ggcugcccugg

SEQ ID NO: 2404730 - RNA, 12 nt, Human
ggcugcccuggc

SEQ ID NO: 2404731 - RNA, 23 nt, Human
ggcugccguggggccgccgccuc

SEQ ID NO: 2404732 - RNA, 16 nt, Human
ggcugccguggggccg

SEQ ID NO: 2404733 - RNA, 21 nt, Human
ggcugccggguucuagucucc

SEQ ID NO: 2404734 - RNA, 14 nt, Human
ggcugcccuuucug

SEQ ID NO: 2404735 - RNA, 18 nt, Human
ggcugcccuuucugggca

SEQ ID NO: 2404736 - RNA, 10 nt, Human
ggcugcccuu

SEQ ID NO: 2404737 - RNA, 11 nt, Human
ggcugcccuuu

SEQ ID NO: 2404738 - RNA, 22 nt, Human
ggcugcccuggcccugaggugu

SEQ ID NO: 2404739 - RNA, 21 nt, Human
ggcugcccuggcccugaggug

SEQ ID NO: 2404740 - RNA, 20 nt, Human
ggcugcccuggcccugaggu

SEQ ID NO: 2404741 - RNA, 19 nt, Human
ggcugcccuggcccugagg

SEQ ID NO: 2404742 - RNA, 12 nt, Human
ggcugcccuggu

SEQ ID NO: 2404743 - RNA, 18 nt, Human
ggcuggccagccccacag

SEQ ID NO: 2404744 - RNA, 17 nt, Human
ggcuggccagccccaca

SEQ ID NO: 2404745 - RNA, 15 nt, Human
ggcuggccagcccca

SEQ ID NO: 2404746 - RNA, 14 nt, Human
ggcuggccagcccc

SEQ ID NO: 2404747 - RNA, 13 nt, Human
ggcuggccagccc

SEQ ID NO: 2404748 - RNA, 12 nt, Human
ggcuggccagcc

SEQ ID NO: 2404749 - RNA, 11 nt, Human
ggcuggccagc

SEQ ID NO: 2404750 - RNA, 23 nt, Human
ggcuggccacugcacagagcucu

SEQ ID NO: 2404751 - RNA, 21 nt, Human
ggcuggccaguccaggcugcc

SEQ ID NO: 2404752 - RNA, 20 nt, Human
ggcuggccaguccaggcugc

SEQ ID NO: 2404753 - RNA, 20 nt, Human
ggcuggccagccccacagcc

SEQ ID NO: 2404754 - RNA, 16 nt, Human
ggcuggccaguccagg

SEQ ID NO: 2404755 - RNA, 17 nt, Human
ggcugccuccacuccca

SEQ ID NO: 2404756 - RNA, 16 nt, Human
ggcugccuccacuccc

SEQ ID NO: 2404757 - RNA, 12 nt, Human
ggcugccuccac

SEQ ID NO: 2404758 - RNA, 19 nt, Human
ggcugccuccacucccacu

SEQ ID NO: 2404759 - RNA, 14 nt, Human
ggcuggcagguaug

SEQ ID NO: 2404760 - RNA, 21 nt, Human
ggcuggccacugcacagagcu

SEQ ID NO: 2404761 - RNA, 19 nt, Human
ggcuggccacugcacagag

SEQ ID NO: 2404762 - RNA, 17 nt, Human
ggcuggccacugcacag

SEQ ID NO: 2404763 - RNA, 14 nt, Human
ggcuggccacugca

SEQ ID NO: 2404764 - RNA, 13 nt, Human
ggcuggccacugc

SEQ ID NO: 2404765 - RNA, 17 nt, Human
aaaauaauuuuuauauu

SEQ ID NO: 2404766 - RNA, 16 nt, Human
aaaauaauuuuuauau

SEQ ID NO: 2404767 - RNA, 14 nt, Human
aaaauacacacuca

SEQ ID NO: 2404768 - RNA, 17 nt, Human
aaaauacauaagaccau

SEQ ID NO: 2404769 - RNA, 12 nt, Human
aaaauacauuuu

SEQ ID NO: 2404770 - RNA, 13 nt, Human
aaaauacauuuua

SEQ ID NO: 2404771 - RNA, 21 nt, Human
aaaauacaguuugucacauga

SEQ ID NO: 2404772 - RNA, 13 nt, Human
aaaauaccaagga

SEQ ID NO: 2404773 - RNA, 20 nt, Human
aaaauacugccagaugcuga

SEQ ID NO: 2404774 - RNA, 19 nt, Human
aaaauacugccagaugcug

SEQ ID NO: 2404775 - RNA, 18 nt, Human
aaaauacugccagaugcu

SEQ ID NO: 2404776 - RNA, 15 nt, Human
aaaauacugccagau

SEQ ID NO: 2404777 - RNA, 14 nt, Human
aaaauacugccaga

SEQ ID NO: 2404778 - RNA, 14 nt, Human
aaaauacauuuuau

SEQ ID NO: 2404779 - RNA, 19 nt, Human
aaaauaaccggauauauac

SEQ ID NO: 2404780 - RNA, 15 nt, Human
aaaauaacuuauauc

SEQ ID NO: 2404781 - RNA, 14 nt, Human
aaaauaagaaaaga

SEQ ID NO: 2404782 - RNA, 15 nt, Human
aaaauaagaaaagau

SEQ ID NO: 2404783 - RNA, 12 nt, Human
aaaauaagaaaa

SEQ ID NO: 2404784 - RNA, 16 nt, Human
aaaauaacuucaagca

SEQ ID NO: 2404785 - RNA, 16 nt, Human
aaaauaagaauagaaa

SEQ ID NO: 2404786 - RNA, 22 nt, Human
aaaauaagaaaagauguagauu

SEQ ID NO: 2404787 - RNA, 13 nt, Human
aaaauaauaauaa

SEQ ID NO: 2404788 - RNA, 11 nt, Human
aaaauaauuuu

SEQ ID NO: 2404789 - RNA, 19 nt, Human
aaaauaauuuuaaacaaag

SEQ ID NO: 2404790 - RNA, 20 nt, Human
aaaauaauuuuaaacaaagg

SEQ ID NO: 2404791 - RNA, 22 nt, Human
aaaauaauugauuucaagaccu

SEQ ID NO: 2404792 - RNA, 16 nt, Human
aaaauaauugauuuca

SEQ ID NO: 2404793 - RNA, 23 nt, Human
aaaauaaucuauuucuaugagaa

SEQ ID NO: 2404794 - RNA, 21 nt, Human
aaaauaaucuauuucuaugag

SEQ ID NO: 2404795 - RNA, 14 nt, Human
aaaauaauucuaaa

SEQ ID NO: 2404796 - RNA, 13 nt, Human
aaaauaauucuaa

SEQ ID NO: 2404797 - RNA, 17 nt, Human
aaaaggcauuguuugag

SEQ ID NO: 2404798 - RNA, 16 nt, Human
aaaaggcaaaugugua

SEQ ID NO: 2404799 - RNA, 14 nt, Human
aaaaggcauuguuu

SEQ ID NO: 2404800 - RNA, 14 nt, Human
aaaaggccaaaccu

SEQ ID NO: 2404801 - RNA, 15 nt, Human
aaaaggccaaaccuc

SEQ ID NO: 2404802 - RNA, 19 nt, Human
aaaaggccaaaccucuguu

SEQ ID NO: 2404803 - RNA, 22 nt, Human
aaaaggccaaaccucuguucag

SEQ ID NO: 2404804 - RNA, 23 nt, Human
aaaaggccaaaccucuguucagu

SEQ ID NO: 2404805 - RNA, 11 nt, Human
aaaaggcagga

SEQ ID NO: 2404806 - RNA, 19 nt, Human
aaaaggaucuuuguggcca

SEQ ID NO: 2404807 - RNA, 20 nt, Human
aaaaggaucuuuguggccaa

SEQ ID NO: 2404808 - RNA, 18 nt, Human
aaaaggauuuuuaucuuu

SEQ ID NO: 2404809 - RNA, 23 nt, Human
aaaaggaucuuuguggccaagga

SEQ ID NO: 2404810 - RNA, 17 nt, Human
aaaagguuaauaaagua

SEQ ID NO: 2404811 - RNA, 19 nt, Human
aaaagguucacuaaagcag

SEQ ID NO: 2404812 - RNA, 22 nt, Human
aaaaggugccugugaggcaggg

SEQ ID NO: 2404813 - RNA, 20 nt, Human
aaaauaacccuuugguuuuu

SEQ ID NO: 2404814 - RNA, 15 nt, Human
aaaagguauuaaauu

SEQ ID NO: 2404815 - RNA, 20 nt, Human
aaaaggugccugugaggcag

SEQ ID NO: 2404816 - RNA, 16 nt, Human
aaaagguuaauaaagu

SEQ ID NO: 2404817 - RNA, 14 nt, Human
aaaaggaugcacag

SEQ ID NO: 2404818 - RNA, 15 nt, Human
aaaaggaugcacaga

SEQ ID NO: 2404819 - RNA, 19 nt, Human
aaaaggaugcacagaguug

SEQ ID NO: 2404820 - RNA, 22 nt, Human
aaaaggaugcacagaguuguua

SEQ ID NO: 2404821 - RNA, 23 nt, Human
ggcugguccagggcuagugacuu

SEQ ID NO: 2404822 - RNA, 13 nt, Human
ggcugguccaggg

SEQ ID NO: 2404823 - RNA, 16 nt, Human
aaaaggacaauuucaa

SEQ ID NO: 2404824 - RNA, 16 nt, Human
aaaaggacaccuuuua

SEQ ID NO: 2404825 - RNA, 13 nt, Human
aaaaggaugcaca

SEQ ID NO: 2404826 - RNA, 22 nt, Human
aaaaggagccaauuuaaagaaa

SEQ ID NO: 2404827 - RNA, 15 nt, Human
aaaauauuccugcau

SEQ ID NO: 2404828 - RNA, 22 nt, Human
aaaauaugaccacacuccagcu

SEQ ID NO: 2404829 - RNA, 14 nt, Human
aaaauaucuuuuga

SEQ ID NO: 2404830 - RNA, 17 nt, Human
aaaauaucuuuugaccu

SEQ ID NO: 2404831 - RNA, 13 nt, Human
aaaauaugauauu

SEQ ID NO: 2404832 - RNA, 16 nt, Human
aaaauauauuuaauga

SEQ ID NO: 2404833 - RNA, 18 nt, Human
aaaauaucugaaauguga

SEQ ID NO: 2404834 - RNA, 9 nt, Human
aaaauacuu

SEQ ID NO: 2404835 - RNA, 21 nt, Human
aaaauacuugucaauauuuaa

SEQ ID NO: 2404836 - RNA, 15 nt, Human
aaaauauauuuaaug

SEQ ID NO: 2404837 - RNA, 13 nt, Human
aaaauagacacuc

SEQ ID NO: 2404838 - RNA, 15 nt, Human
aaaauagaagcugua

SEQ ID NO: 2404839 - RNA, 14 nt, Human
aaaauagaagaaua

SEQ ID NO: 2404840 - RNA, 20 nt, Human
aaaauauuuucauacagcau

SEQ ID NO: 2404841 - RNA, 13 nt, Human
aaaauauuuucau

SEQ ID NO: 2404842 - RNA, 12 nt, Human
aaaauauuuuga

SEQ ID NO: 2404843 - RNA, 17 nt, Human
aaaaucucaauauuuca

SEQ ID NO: 2404844 - RNA, 16 nt, Human
aaaauauuuuccugcc

SEQ ID NO: 2404845 - RNA, 13 nt, Human
aaaauauuuuaua

SEQ ID NO: 2404846 - RNA, 17 nt, Human
aaaauauuuuauaauuu

SEQ ID NO: 2404847 - RNA, 12 nt, Human
aaaauauuuuca

SEQ ID NO: 2404848 - RNA, 18 nt, Human
aaaauauuuuauaauuuu

SEQ ID NO: 2404849 - RNA, 21 nt, Human
aaaauauuuauaaaacuucuc

SEQ ID NO: 2404850 - RNA, 11 nt, Human
aaaauauuuau

SEQ ID NO: 2404851 - RNA, 13 nt, Human
aaaauauuuauaa

SEQ ID NO: 2404852 - RNA, 15 nt, Human
aaaauauuuguacau

SEQ ID NO: 2404853 - RNA, 14 nt, Human
aaaauauuuaaagg

SEQ ID NO: 2404854 - RNA, 16 nt, Human
aaaauauggaacuucu

SEQ ID NO: 2404855 - RNA, 11 nt, Human
aaaauaugcau

SEQ ID NO: 2404856 - RNA, 12 nt, Human
aaaaugagaaau

SEQ ID NO: 2404857 - RNA, 11 nt, Human
aaaaugagaaa

SEQ ID NO: 2404858 - RNA, 12 nt, Human
aaaaucugucca

SEQ ID NO: 2404859 - RNA, 13 nt, Human
aaaaugacagaug

SEQ ID NO: 2404860 - RNA, 15 nt, Human
aaaaugacagauguu

SEQ ID NO: 2404861 - RNA, 17 nt, Human
aaaaugacagauguuga

SEQ ID NO: 2404862 - RNA, 14 nt, Human
aaaaugacauccca

SEQ ID NO: 2404863 - RNA, 19 nt, Human
aaaaugaccaguaauugug

SEQ ID NO: 2404864 - RNA, 18 nt, Human
aaaaugacagauguugaa

SEQ ID NO: 2404865 - RNA, 21 nt, Human
aaaaugacuaaaaauauuaua

SEQ ID NO: 2404866 - RNA, 23 nt, Human
aaaaucugaaaaugugaauaaaa

SEQ ID NO: 2404867 - RNA, 19 nt, Human
aaaaucugcagaaggaaaa

SEQ ID NO: 2404868 - RNA, 20 nt, Human
aaaaucugucacguagaacu

SEQ ID NO: 2404869 - RNA, 15 nt, Human
aaaaucugcuaggga

SEQ ID NO: 2404870 - RNA, 13 nt, Human
aaaaucugaaaau

SEQ ID NO: 2404871 - RNA, 13 nt, Human
aaaauauuuugaa

SEQ ID NO: 2404872 - RNA, 14 nt, Human
aaaaugcaaauccu

SEQ ID NO: 2404873 - RNA, 18 nt, Human
aaaaugcaaauccuaugu

SEQ ID NO: 2404874 - RNA, 20 nt, Human
aaaaugauuguaaaauagcu

SEQ ID NO: 2404875 - RNA, 14 nt, Human
aaaaugauuuuauc

SEQ ID NO: 2404876 - RNA, 19 nt, Human
aaaaugauuguaaaauagc

SEQ ID NO: 2404877 - RNA, 16 nt, Human
aaaaugauuguaaaau

SEQ ID NO: 2404878 - RNA, 16 nt, Human
aaaaugauguucauuu

SEQ ID NO: 2404879 - RNA, 23 nt, Human
aaaaugauguguacccaaacgug

SEQ ID NO: 2404880 - RNA, 23 nt, Human
aaaaugagagggcaguguuuccu

SEQ ID NO: 2404881 - RNA, 20 nt, Human
aaaaugaccaguaauuguga

SEQ ID NO: 2404882 - RNA, 22 nt, Human
aaaaugagacuaugcguuuuua

SEQ ID NO: 2404883 - RNA, 18 nt, Human
aaaaugcagcagggaugc

SEQ ID NO: 2404884 - RNA, 14 nt, Human
aaaaugcauuguau

SEQ ID NO: 2404885 - RNA, 20 nt, Human
aaaaugcaaauccuauguga

SEQ ID NO: 2404886 - RNA, 22 nt, Human
aaaaugcaaauccuaugugauu

SEQ ID NO: 2404887 - RNA, 14 nt, Human
aaaaugcacguagc

SEQ ID NO: 2404888 - RNA, 14 nt, Human
aaaaugcacauagc

SEQ ID NO: 2404889 - RNA, 18 nt, Human
aaaaugcaacaacaugua

SEQ ID NO: 2404890 - RNA, 21 nt, Human
aaaaugcuguauuagucacag

SEQ ID NO: 2404891 - RNA, 23 nt, Human
aaaaugcuguauuagucacagag

SEQ ID NO: 2404892 - RNA, 18 nt, Human
aaaaugcuuuuuauuucu

SEQ ID NO: 2404893 - RNA, 19 nt, Human
aaaaugcuuuuuauuucug

SEQ ID NO: 2404894 - RNA, 13 nt, Human
aaaaugcuuuuua

SEQ ID NO: 2404895 - RNA, 17 nt, Human
aaaaugccaagacauga

SEQ ID NO: 2404896 - RNA, 22 nt, Human
gggccacuucuggguggggcag

SEQ ID NO: 2404897 - RNA, 16 nt, Human
gggccagacaugccac

SEQ ID NO: 2404898 - RNA, 20 nt, Human
aaaauggaagacagcucuua

SEQ ID NO: 2404899 - RNA, 12 nt, Human
aaaauggaaaga

SEQ ID NO: 2404900 - RNA, 22 nt, Human
aaaaugcuuuuuauuucugcau

SEQ ID NO: 2404901 - RNA, 14 nt, Human
aaaauggaaagaau

SEQ ID NO: 2404902 - RNA, 13 nt, Human
aaaauggaaagaa

SEQ ID NO: 2404903 - RNA, 12 nt, Human
gggcuagaaucu

SEQ ID NO: 2404904 - RNA, 16 nt, Human
gggcuagaaccuggca

SEQ ID NO: 2404905 - RNA, 11 nt, Human
gggcucagccu

SEQ ID NO: 2404906 - RNA, 12 nt, Human
gggcucagccug

SEQ ID NO: 2404907 - RNA, 13 nt, Human
gggcucagccugg

SEQ ID NO: 2404908 - RNA, 19 nt, Human
gggcucagcggggacagcu

SEQ ID NO: 2404909 - RNA, 17 nt, Human
gggcucagcggggacag

SEQ ID NO: 2404910 - RNA, 18 nt, Human
gggcuaguugggcuuccu

SEQ ID NO: 2404911 - RNA, 22 nt, Human
gggcucagcaaaagaugcuucu

SEQ ID NO: 2404912 - RNA, 17 nt, Human
gggcuagaaccuggagg

SEQ ID NO: 2404913 - RNA, 17 nt, Human
gggcuagaaccuggaga

SEQ ID NO: 2404914 - RNA, 15 nt, Human
gggcuagaaccugga

SEQ ID NO: 2404915 - RNA, 14 nt, Human
gggcuagaaccugg

SEQ ID NO: 2404916 - RNA, 20 nt, Human
gggcuaggaaauccagggug

SEQ ID NO: 2404917 - RNA, 15 nt, Human
gggcuaguugggcuu

SEQ ID NO: 2404918 - RNA, 13 nt, Human
gggcuccagacac

SEQ ID NO: 2404919 - RNA, 10 nt, Human
gggcuccaga

SEQ ID NO: 2404920 - RNA, 17 nt, Human
gggcucagggaccacag

SEQ ID NO: 2404921 - RNA, 13 nt, Human
gggcucaggaaaa

SEQ ID NO: 2404922 - RNA, 16 nt, Human
gggcucagccuggugg

SEQ ID NO: 2404923 - RNA, 20 nt, Human
gggcucagccuggugggccu

SEQ ID NO: 2404924 - RNA, 21 nt, Human
gggcucagcggggacagcucc

SEQ ID NO: 2404925 - RNA, 19 nt, Human
gggcugcaccggcuggccu

SEQ ID NO: 2404926 - RNA, 17 nt, Human
gggcugcaccggcuggc

SEQ ID NO: 2404927 - RNA, 20 nt, Human
gggcucagggaccacagcaa

SEQ ID NO: 2404928 - RNA, 13 nt, Human
gggcucccgcccg

SEQ ID NO: 2404929 - RNA, 21 nt, Human
gggcugcaccggcuggccugg

SEQ ID NO: 2404930 - RNA, 20 nt, Human
gggcugcaccggcuggccug

SEQ ID NO: 2404931 - RNA, 21 nt, Human
gggcugccugggcuguuggca

SEQ ID NO: 2404932 - RNA, 19 nt, Human
gggcugccugggcuguugg

SEQ ID NO: 2404933 - RNA, 15 nt, Human
gggcugccugggcug

SEQ ID NO: 2404934 - RNA, 14 nt, Human
gggcugccugggcu

SEQ ID NO: 2404935 - RNA, 13 nt, Human
gggcugccugggc

SEQ ID NO: 2404936 - RNA, 12 nt, Human
gggcugccuggg

SEQ ID NO: 2404937 - RNA, 12 nt, Human
gggcucccugac

SEQ ID NO: 2404938 - RNA, 21 nt, Human
gggcugcccuggugcugccac

SEQ ID NO: 2404939 - RNA, 15 nt, Human
gggcugggcagagga

SEQ ID NO: 2404940 - RNA, 17 nt, Human
gggcugcuuccuccugg

SEQ ID NO: 2404941 - RNA, 12 nt, Human
gggcugcuuccu

SEQ ID NO: 2404942 - RNA, 12 nt, Human
gggcugggcaga

SEQ ID NO: 2404943 - RNA, 12 nt, Human
gggcugcuguga

SEQ ID NO: 2404944 - RNA, 17 nt, Human
gggcugcugaccuccac

SEQ ID NO: 2404945 - RNA, 15 nt, Human
gggcugcuccuccag

SEQ ID NO: 2404946 - RNA, 16 nt, Human
gggcugcuccuccagg

SEQ ID NO: 2404947 - RNA, 18 nt, Human
gggcugcuccuccagggc

SEQ ID NO: 2404948 - RNA, 19 nt, Human
gggcugcuccuccagggcc

SEQ ID NO: 2404949 - RNA, 11 nt, Human
gggcugcuccu

SEQ ID NO: 2404950 - RNA, 14 nt, Human
gggcugcuccucau

SEQ ID NO: 2404951 - RNA, 19 nt, Human
aaaauggccauuugcuuuu

SEQ ID NO: 2404952 - RNA, 22 nt, Human
gggcugggugcgaccccaucug

SEQ ID NO: 2404953 - RNA, 23 nt, Human
aaaauggccauuugcuuuuucac

SEQ ID NO: 2404954 - RNA, 17 nt, Human
gggcuggguucuaccca

SEQ ID NO: 2404955 - RNA, 14 nt, Human
gggcugggcagcua

SEQ ID NO: 2404956 - RNA, 14 nt, Human
gggcugggcagcug

SEQ ID NO: 2404957 - RNA, 13 nt, Human
gggcugggcagcu

SEQ ID NO: 2404958 - RNA, 16 nt, Human
aaaaugguuuaaaugg

SEQ ID NO: 2404959 - RNA, 18 nt, Human
aaaaugguuuaaaugguc

SEQ ID NO: 2404960 - RNA, 14 nt, Human
aaaauggugccuga

SEQ ID NO: 2404961 - RNA, 22 nt, Human
aaaaugggacuucuuuucacau

SEQ ID NO: 2404962 - RNA, 21 nt, Human
aaaaugggacuucuuuucaca

SEQ ID NO: 2404963 - RNA, 19 nt, Human
aaaaugggacuucuuuuca

SEQ ID NO: 2404964 - RNA, 15 nt, Human
aaaaugggacuucuu

SEQ ID NO: 2404965 - RNA, 24 nt, Human
gggccugcaggaccugccuguagc

SEQ ID NO: 2404966 - RNA, 21 nt, Human
gggccugcaggaccugccugu

SEQ ID NO: 2404967 - RNA, 18 nt, Human
gggccucuuaugggcugg

SEQ ID NO: 2404968 - RNA, 22 nt, Human
gggccucgguguggagaagcgg

SEQ ID NO: 2404969 - RNA, 23 nt, Human
gggccucugguuuggggcgaggc

SEQ ID NO: 2404970 - RNA, 16 nt, Human
gggccucgggaccuca

SEQ ID NO: 2404971 - RNA, 14 nt, Human
gggccucgggaccu

SEQ ID NO: 2404972 - RNA, 17 nt, Human
gggccucggagccucau

SEQ ID NO: 2404973 - RNA, 14 nt, Human
gggccucagugcca

SEQ ID NO: 2404974 - RNA, 13 nt, Human
gggccucagugcc

SEQ ID NO: 2404975 - RNA, 15 nt, Human
gggccucagugccac

SEQ ID NO: 2404976 - RNA, 20 nt, Human
gggccucaaaggcccgcucu

SEQ ID NO: 2404977 - RNA, 20 nt, Human
gggccguaccccacccucag

SEQ ID NO: 2404978 - RNA, 20 nt, Human
gggccucaccgagugggggc

SEQ ID NO: 2404979 - RNA, 16 nt, Human
gggccucaaggacuug

SEQ ID NO: 2404980 - RNA, 15 nt, Human
gggccucggagccuc

SEQ ID NO: 2404981 - RNA, 22 nt, Human
gggcuacccugagcugaggcag

SEQ ID NO: 2404982 - RNA, 20 nt, Human
gggcuacugcagcuuuacau

SEQ ID NO: 2404983 - RNA, 21 nt, Human
gggcuacccugagcugaggca

SEQ ID NO: 2404984 - RNA, 19 nt, Human
gggcguggucacugcuguc

SEQ ID NO: 2404985 - RNA, 13 nt, Human
gggcguggagggc

SEQ ID NO: 2404986 - RNA, 17 nt, Human
gggcgucuguucccccu

SEQ ID NO: 2404987 - RNA, 16 nt, Human
gggcgugacucaccca

SEQ ID NO: 2404988 - RNA, 18 nt, Human
gggcgugagaccugcccc

SEQ ID NO: 2404989 - RNA, 19 nt, Human
gggcgugagaccugccccu

SEQ ID NO: 2404990 - RNA, 21 nt, Human
gggcggugagaggggaacaga

SEQ ID NO: 2404991 - RNA, 14 nt, Human
gggccugcuccaga

SEQ ID NO: 2404992 - RNA, 15 nt, Human
gggccugcuccagac

SEQ ID NO: 2404993 - RNA, 17 nt, Human
gggccugcuccagaccu

SEQ ID NO: 2404994 - RNA, 18 nt, Human
gggccugcuccagaccug

SEQ ID NO: 2404995 - RNA, 13 nt, Human
gggccugcuccag

SEQ ID NO: 2404996 - RNA, 20 nt, Human
gggccaugcugaggccuggg

SEQ ID NO: 2404997 - RNA, 19 nt, Human
gggccaugcugaggccugg

SEQ ID NO: 2404998 - RNA, 23 nt, Human
gggccaggcaggugccuggacau

SEQ ID NO: 2404999 - RNA, 20 nt, Human
gggccaggcaggugccugga

SEQ ID NO: 2405000 - RNA, 13 nt, Human
gggccaggcaggu

SEQ ID NO: 2405001 - RNA, 12 nt, Human
gggccaggcagg

SEQ ID NO: 2405002 - RNA, 11 nt, Human
gggccaggcag

SEQ ID NO: 2405003 - RNA, 20 nt, Human
gggccagaguauuggucucc

SEQ ID NO: 2405004 - RNA, 18 nt, Human
gggccagauccagccugg

SEQ ID NO: 2405005 - RNA, 14 nt, Human
gggccaggagccuc

SEQ ID NO: 2405006 - RNA, 13 nt, Human
gggccaggagccu

SEQ ID NO: 2405007 - RNA, 13 nt, Human
gggccagauccag

SEQ ID NO: 2405008 - RNA, 14 nt, Human
gggccagauccagc

SEQ ID NO: 2405009 - RNA, 16 nt, Human
gggccagauccagccu

SEQ ID NO: 2405010 - RNA, 17 nt, Human
gggccagauccagccug

SEQ ID NO: 2405011 - RNA, 12 nt, Human
gggccaggagcc

SEQ ID NO: 2405012 - RNA, 11 nt, Human
gggccagagcc

SEQ ID NO: 2405013 - RNA, 12 nt, Human
gggccagagcca

SEQ ID NO: 2405014 - RNA, 13 nt, Human
gggccagagccag

SEQ ID NO: 2405015 - RNA, 14 nt, Human
gggccagagccagg

SEQ ID NO: 2405016 - RNA, 22 nt, Human
gggccagaggaacuguccagag

SEQ ID NO: 2405017 - RNA, 15 nt, Human
gggccagagccaggg

SEQ ID NO: 2405018 - RNA, 12 nt, Human
gggccagaggcu

SEQ ID NO: 2405019 - RNA, 23 nt, Human
gggccagaggaacuguccagaga

SEQ ID NO: 2405020 - RNA, 21 nt, Human
gggccaugcugaggccugggc

SEQ ID NO: 2405021 - RNA, 23 nt, Human
gggccaugcugaggccugggccg

SEQ ID NO: 2405022 - RNA, 16 nt, Human
gggccauucuccacag

SEQ ID NO: 2405023 - RNA, 18 nt, Human
gggccauucuccacagca

SEQ ID NO: 2405024 - RNA, 18 nt, Human
gggcccaagacagaugcc

SEQ ID NO: 2405025 - RNA, 16 nt, Human
gggcccaacccugucu

SEQ ID NO: 2405026 - RNA, 14 nt, Human
gggcccaacccugu

SEQ ID NO: 2405027 - RNA, 13 nt, Human
gggcccaaaggcc

SEQ ID NO: 2405028 - RNA, 12 nt, Human
gggccgcugcca

SEQ ID NO: 2405029 - RNA, 13 nt, Human
gggccgcugccac

SEQ ID NO: 2405030 - RNA, 14 nt, Human
gggccgcugccacc

SEQ ID NO: 2405031 - RNA, 15 nt, Human
gggccgcugccaccc

SEQ ID NO: 2405032 - RNA, 21 nt, Human
gggccgcugccacccaccucc

SEQ ID NO: 2405033 - RNA, 19 nt, Human
gggccgccgguuugaguga

SEQ ID NO: 2405034 - RNA, 17 nt, Human
gggccgccgccucuuuc

SEQ ID NO: 2405035 - RNA, 18 nt, Human
gggccguaccccacccuc

SEQ ID NO: 2405036 - RNA, 16 nt, Human
gggccguaccccaccc

SEQ ID NO: 2405037 - RNA, 15 nt, Human
gggccguaccccacc

SEQ ID NO: 2405038 - RNA, 15 nt, Human
gggccggccaggugg

SEQ ID NO: 2405039 - RNA, 14 nt, Human
gggccggccaggug

SEQ ID NO: 2405040 - RNA, 21 nt, Human
gggccggccaggugggcgggc

SEQ ID NO: 2405041 - RNA, 21 nt, Human
gguaacagaacagcuucaggu

SEQ ID NO: 2405042 - RNA, 16 nt, Human
gguaacuugcaccucu

SEQ ID NO: 2405043 - RNA, 23 nt, Human
gguaagaagccgggaacagacaa

SEQ ID NO: 2405044 - RNA, 20 nt, Human
gguaaggaauaccugucccc

SEQ ID NO: 2405045 - RNA, 16 nt, Human
gguaggaacugcuggg

SEQ ID NO: 2405046 - RNA, 20 nt, Human
gguaagcacuuaaugaauga

SEQ ID NO: 2405047 - RNA, 13 nt, Human
gguaaggugccuu

SEQ ID NO: 2405048 - RNA, 14 nt, Human
gguaggcagagccu

SEQ ID NO: 2405049 - RNA, 19 nt, Human
gguaggagguuuggauggg

SEQ ID NO: 2405050 - RNA, 18 nt, Human
gguaggaacugcugggcu

SEQ ID NO: 2405051 - RNA, 15 nt, Human
gguaggaggaugggc

SEQ ID NO: 2405052 - RNA, 19 nt, Human
gguaaguuguuaagagugg

SEQ ID NO: 2405053 - RNA, 19 nt, Human
gguagguucagccaagguu

SEQ ID NO: 2405054 - RNA, 18 nt, Human
gguagguucagccaaggu

SEQ ID NO: 2405055 - RNA, 20 nt, Human
gguauaaugguugacugggu

SEQ ID NO: 2405056 - RNA, 16 nt, Human
gguauauccaaaagcu

SEQ ID NO: 2405057 - RNA, 22 nt, Human
gguauaucauuauaacugaagg

SEQ ID NO: 2405058 - RNA, 14 nt, Human
gguaucaggugcug

SEQ ID NO: 2405059 - RNA, 13 nt, Human
gguauauucauuu

SEQ ID NO: 2405060 - RNA, 15 nt, Human
gguaucaagaaaguc

SEQ ID NO: 2405061 - RNA, 20 nt, Human
gguaggguaagugagagagg

SEQ ID NO: 2405062 - RNA, 11 nt, Human
gguaggguggg

SEQ ID NO: 2405063 - RNA, 23 nt, Human
gguagggugggccuucagggagu

SEQ ID NO: 2405064 - RNA, 17 nt, Human
gguagguucagccaagg

SEQ ID NO: 2405065 - RNA, 16 nt, Human
gguagguucagccaag

SEQ ID NO: 2405066 - RNA, 19 nt, Human
gguagguggcacacugggu

SEQ ID NO: 2405067 - RNA, 13 nt, Human
gguagguggcaca

SEQ ID NO: 2405068 - RNA, 15 nt, Human
gguagguucagccaa

SEQ ID NO: 2405069 - RNA, 13 nt, Human
gguauagaaaugc

SEQ ID NO: 2405070 - RNA, 22 nt, Human
aaacuugauguguuaucucuua

SEQ ID NO: 2405071 - RNA, 21 nt, Human
aaacuuuagaguagcaugaga

SEQ ID NO: 2405072 - RNA, 21 nt, Human
aaacuucccuuucugcuugug

SEQ ID NO: 2405073 - RNA, 17 nt, Human
aaacuuccccaucuucu

SEQ ID NO: 2405074 - RNA, 23 nt, Human
aaacuucccgucccauauccugc

SEQ ID NO: 2405075 - RNA, 23 nt, Human
aaacuuccaugaggccaaacguu

SEQ ID NO: 2405076 - RNA, 19 nt, Human
aaacuucucugaagggagg

SEQ ID NO: 2405077 - RNA, 18 nt, Human
aaacuucucugaagggag

SEQ ID NO: 2405078 - RNA, 16 nt, Human
gguccagcucuggagg

SEQ ID NO: 2405079 - RNA, 15 nt, Human
gguccagcucuggag

SEQ ID NO: 2405080 - RNA, 14 nt, Human
gguccagcucugga

SEQ ID NO: 2405081 - RNA, 13 nt, Human
gguccagcucugg

SEQ ID NO: 2405082 - RNA, 23 nt, Human
gguccagcccuggcugaaggacu

SEQ ID NO: 2405083 - RNA, 22 nt, Human
gguccagcccuggcugaaggac

SEQ ID NO: 2405084 - RNA, 21 nt, Human
gguccagcccuggcugaagga

SEQ ID NO: 2405085 - RNA, 20 nt, Human
gguccagcccuggcugaagg

SEQ ID NO: 2405086 - RNA, 12 nt, Human
gguccagcucug

SEQ ID NO: 2405087 - RNA, 11 nt, Human
gguccagcucu

SEQ ID NO: 2405088 - RNA, 22 nt, Human
gguccagcucuggaggggaggg

SEQ ID NO: 2405089 - RNA, 17 nt, Human
gguccagcuugcucuuc

SEQ ID NO: 2405090 - RNA, 18 nt, Human
gguccagcuugcucuuca

SEQ ID NO: 2405091 - RNA, 23 nt, Human
aaacuuccagugcaacacugaag

SEQ ID NO: 2405092 - RNA, 22 nt, Human
aaacuuccagugcaacacugaa

SEQ ID NO: 2405093 - RNA, 11 nt, Human
gguccaggaga

SEQ ID NO: 2405094 - RNA, 19 nt, Human
gguaucauuuucugcauuu

SEQ ID NO: 2405095 - RNA, 18 nt, Human
gguauccccccaucuugc

SEQ ID NO: 2405096 - RNA, 19 nt, Human
gguaucaggugcugccauc

SEQ ID NO: 2405097 - RNA, 14 nt, Human
gguaucuccaggau

SEQ ID NO: 2405098 - RNA, 13 nt, Human
gguaucuccagga

SEQ ID NO: 2405099 - RNA, 12 nt, Human
gguaucuccagg

SEQ ID NO: 2405100 - RNA, 23 nt, Human
gguaucuccaggauugaagagca

SEQ ID NO: 2405101 - RNA, 16 nt, Human
gguaucuccaggauug

SEQ ID NO: 2405102 - RNA, 16 nt, Human
gguaucuguucuuuaa

SEQ ID NO: 2405103 - RNA, 14 nt, Human
ggucagugcaaaua

SEQ ID NO: 2405104 - RNA, 16 nt, Human
ggucagucugguggga

SEQ ID NO: 2405105 - RNA, 19 nt, Human
ggucagugaggcccaggga

SEQ ID NO: 2405106 - RNA, 24 nt, Human
ggucaguguccaaagcagggucug

SEQ ID NO: 2405107 - RNA, 21 nt, Human
ggucauacuaucuacucuccu

SEQ ID NO: 2405108 - RNA, 16 nt, Human
ggucauagcagugcuu

SEQ ID NO: 2405109 - RNA, 23 nt, Human
ggucauagcccagaucagcuccu

SEQ ID NO: 2405110 - RNA, 22 nt, Human
ggucauacuaucuacucuccuc

SEQ ID NO: 2405111 - RNA, 19 nt, Human
gguccagcccuggcugaag

SEQ ID NO: 2405112 - RNA, 17 nt, Human
gguccagcccuggcuga

SEQ ID NO: 2405113 - RNA, 16 nt, Human
gguaaagacuggcuuu

SEQ ID NO: 2405114 - RNA, 15 nt, Human
gguaaagacuggcuu

SEQ ID NO: 2405115 - RNA, 16 nt, Human
gguaaacacgccugca

SEQ ID NO: 2405116 - RNA, 13 nt, Human
gguaaaauacuuc

SEQ ID NO: 2405117 - RNA, 23 nt, Human
gguaaaagugugagcagugaguu

SEQ ID NO: 2405118 - RNA, 18 nt, Human
gguaacagaacagcuuca

SEQ ID NO: 2405119 - RNA, 16 nt, Human
gguaacagaacagcuu

SEQ ID NO: 2405120 - RNA, 15 nt, Human
gguaacagaacagcu

SEQ ID NO: 2405121 - RNA, 14 nt, Human
gguaacagaacagc

SEQ ID NO: 2405122 - RNA, 22 nt, Human
gguaaauuuccccaacagugug

SEQ ID NO: 2405123 - RNA, 20 nt, Human
gguaaauuuccccaacagug

SEQ ID NO: 2405124 - RNA, 13 nt, Human
gguaaauuucugu

SEQ ID NO: 2405125 - RNA, 22 nt, Human
gguaaaucagacuaugaaguuu

SEQ ID NO: 2405126 - RNA, 13 nt, Human
gguaaaugaugug

SEQ ID NO: 2405127 - RNA, 15 nt, Human
gguaaauuaagacau

SEQ ID NO: 2405128 - RNA, 20 nt, Human
gguaaauaccaaguauuuau

SEQ ID NO: 2405129 - RNA, 18 nt, Human
gguaaauuuccccaacag

SEQ ID NO: 2405130 - RNA, 20 nt, Human
ggguuuugccauguuggcca

SEQ ID NO: 2405131 - RNA, 16 nt, Human
ggguuuuccacccugg

SEQ ID NO: 2405132 - RNA, 17 nt, Human
ggguuuuccacccugga

SEQ ID NO: 2405133 - RNA, 18 nt, Human
ggguuuuguauucucuga

SEQ ID NO: 2405134 - RNA, 12 nt, Human
ggguuuucuuaa

SEQ ID NO: 2405135 - RNA, 23 nt, Human
ggguuuugccauguuggccaggc

SEQ ID NO: 2405136 - RNA, 14 nt, Human
ggguggugcuggga

SEQ ID NO: 2405137 - RNA, 12 nt, Human
ggguggugcugg

SEQ ID NO: 2405138 - RNA, 13 nt, Human
gggugguggggag

SEQ ID NO: 2405139 - RNA, 18 nt, Human
ggguggugcugggacuga

SEQ ID NO: 2405140 - RNA, 12 nt, Human
ggguggugggga

SEQ ID NO: 2405141 - RNA, 15 nt, Human
gggugguggugauag

SEQ ID NO: 2405142 - RNA, 19 nt, Human
gggugguggggaggggcgc

SEQ ID NO: 2405143 - RNA, 18 nt, Human
ggguguaacaggucuccu

SEQ ID NO: 2405144 - RNA, 19 nt, Human
ggguguaacaggucuccuc

SEQ ID NO: 2405145 - RNA, 23 nt, Human
ggguguauuuauuuuccucccca

SEQ ID NO: 2405146 - RNA, 19 nt, Human
aaacuuaaucuaaauggaa

SEQ ID NO: 2405147 - RNA, 18 nt, Human
aaacuuagaauaaaauug

SEQ ID NO: 2405148 - RNA, 17 nt, Human
aaacuuagaauaaaauu

SEQ ID NO: 2405149 - RNA, 22 nt, Human
aaacuuagaauaaaauuguaaa

SEQ ID NO: 2405150 - RNA, 14 nt, Human
aaacuuacacacaa

SEQ ID NO: 2405151 - RNA, 22 nt, Human
aaacuuauuuuuuucugauugu

SEQ ID NO: 2405152 - RNA, 20 nt, Human
aaacuuauuuuuuucugauu

SEQ ID NO: 2405153 - RNA, 19 nt, Human
aaacuuauuuuuuucugau

SEQ ID NO: 2405154 - RNA, 13 nt, Human
aaacuuauuuuuu

SEQ ID NO: 2405155 - RNA, 14 nt, Human
aaacuuauuugagu

SEQ ID NO: 2405156 - RNA, 12 nt, Human
aaacuuauuuga

SEQ ID NO: 2405157 - RNA, 10 nt, Human
aaacuuauuu

SEQ ID NO: 2405158 - RNA, 21 nt, Human
aaacuuagugcggacaaguuu

SEQ ID NO: 2405159 - RNA, 18 nt, Human
gggugggacacccuguga

SEQ ID NO: 2405160 - RNA, 15 nt, Human
gggugggacacccug

SEQ ID NO: 2405161 - RNA, 16 nt, Human
ggguggcuagucagag

SEQ ID NO: 2405162 - RNA, 18 nt, Human
ggguggcuagucagagag

SEQ ID NO: 2405163 - RNA, 11 nt, Human
ggguggccucg

SEQ ID NO: 2405164 - RNA, 23 nt, Human
aaacuuauuuuuuucugauugua

SEQ ID NO: 2405165 - RNA, 18 nt, Human
aaacuaaaucucuaauau

SEQ ID NO: 2405166 - RNA, 17 nt, Human
aaacuaaaucucuaaua

SEQ ID NO: 2405167 - RNA, 13 nt, Human
aaacuaaaucucu

SEQ ID NO: 2405168 - RNA, 23 nt, Human
aaacuaaauagcauguauugugu

SEQ ID NO: 2405169 - RNA, 17 nt, Human
aaacuaaauagcaugua

SEQ ID NO: 2405170 - RNA, 16 nt, Human
aaacuaaauagcaugu

SEQ ID NO: 2405171 - RNA, 19 nt, Human
aaacuguuaauaguucagg

SEQ ID NO: 2405172 - RNA, 20 nt, Human
aaacuguucccaccugcugg

SEQ ID NO: 2405173 - RNA, 22 nt, Human
aaacuguugccagagauggagg

SEQ ID NO: 2405174 - RNA, 17 nt, Human
aaacuuaacauauuuac

SEQ ID NO: 2405175 - RNA, 16 nt, Human
aaacuguugccagaga

SEQ ID NO: 2405176 - RNA, 21 nt, Human
aaacuguucccaccugcugga

SEQ ID NO: 2405177 - RNA, 20 nt, Human
aaacguggcuuuuagacaga

SEQ ID NO: 2405178 - RNA, 16 nt, Human
aaacguuuuauugugu

SEQ ID NO: 2405179 - RNA, 17 nt, Human
aaacguguugccuugaa

SEQ ID NO: 2405180 - RNA, 21 nt, Human
aaacguuuuauuguguuuuua

SEQ ID NO: 2405181 - RNA, 21 nt, Human
aaacguggcugcuucaaggau

SEQ ID NO: 2405182 - RNA, 20 nt, Human
aaacgcauggaguguguauu

SEQ ID NO: 2405183 - RNA, 22 nt, Human
aaacgcuaaagagcccuugccu

SEQ ID NO: 2405184 - RNA, 21 nt, Human
aaacgauuuaauucucuugaa

SEQ ID NO: 2405185 - RNA, 21 nt, Human
ggggcccgcuugccucggcuc

SEQ ID NO: 2405186 - RNA, 20 nt, Human
ggggcccgcuugccucggcu

SEQ ID NO: 2405187 - RNA, 13 nt, Human
ggggcccggccag

SEQ ID NO: 2405188 - RNA, 20 nt, Human
ggggcccguugucucccugg

SEQ ID NO: 2405189 - RNA, 19 nt, Human
ggggcccguugucucccug

SEQ ID NO: 2405190 - RNA, 23 nt, Human
ggggcccgcuugccucggcuccu

SEQ ID NO: 2405191 - RNA, 15 nt, Human
ggggcccggccagcc

SEQ ID NO: 2405192 - RNA, 17 nt, Human
gggggaucacagccucu

SEQ ID NO: 2405193 - RNA, 23 nt, Human
ggggcccguugucucccuggccc

SEQ ID NO: 2405194 - RNA, 22 nt, Human
ggggcccguugucucccuggcc

SEQ ID NO: 2405195 - RNA, 21 nt, Human
ggggcccguugucucccuggc

SEQ ID NO: 2405196 - RNA, 15 nt, Human
ggggcccugccuccu

SEQ ID NO: 2405197 - RNA, 23 nt, Human
gggggcacaugcugagucuccca

SEQ ID NO: 2405198 - RNA, 23 nt, Human
gggggcaagaagaucacgcuccc

SEQ ID NO: 2405199 - RNA, 11 nt, Human
gggggcagagg

SEQ ID NO: 2405200 - RNA, 12 nt, Human
gggggcagaggg

SEQ ID NO: 2405201 - RNA, 13 nt, Human
gggggcagagggc

SEQ ID NO: 2405202 - RNA, 11 nt, Human
gggggcuggga

SEQ ID NO: 2405203 - RNA, 13 nt, Human
gggggcuggccua

SEQ ID NO: 2405204 - RNA, 12 nt, Human
gggggcuggccu

SEQ ID NO: 2405205 - RNA, 20 nt, Human
gggggcugccuggcccccag

SEQ ID NO: 2405206 - RNA, 14 nt, Human
gggggcagggcaug

SEQ ID NO: 2405207 - RNA, 15 nt, Human
gggggccaacaccag

SEQ ID NO: 2405208 - RNA, 17 nt, Human
gggggccaccuccccag

SEQ ID NO: 2405209 - RNA, 13 nt, Human
ggggguggccucc

SEQ ID NO: 2405210 - RNA, 18 nt, Human
ggggguuuuuacuccagu

SEQ ID NO: 2405211 - RNA, 13 nt, Human
ggggguggccgcu

SEQ ID NO: 2405212 - RNA, 18 nt, Human
ggggguugcggggggagg

SEQ ID NO: 2405213 - RNA, 22 nt, Human
gggguaaaauuccuuagcuuag

SEQ ID NO: 2405214 - RNA, 15 nt, Human
gggggcugggcagag

SEQ ID NO: 2405215 - RNA, 23 nt, Human
ggggguggccgcugaguggcagg

SEQ ID NO: 2405216 - RNA, 22 nt, Human
gggggcuucauacacaugagau

SEQ ID NO: 2405217 - RNA, 21 nt, Human
gggggcuggugccagccuucc

SEQ ID NO: 2405218 - RNA, 19 nt, Human
gggggcuggugccagccuu

SEQ ID NO: 2405219 - RNA, 14 nt, Human
gggggcuggugcca

SEQ ID NO: 2405220 - RNA, 13 nt, Human
gggggcuggugcc

SEQ ID NO: 2405221 - RNA, 21 nt, Human
ggggucacucuggcagcucag

SEQ ID NO: 2405222 - RNA, 22 nt, Human
gggguauuuaccacagcagcug

SEQ ID NO: 2405223 - RNA, 17 nt, Human
gggguaggcagagccuu

SEQ ID NO: 2405224 - RNA, 15 nt, Human
gggguagcagcugga

SEQ ID NO: 2405225 - RNA, 24 nt, Human
ggggguuuuuacuccaguggugaa

SEQ ID NO: 2405226 - RNA, 18 nt, Human
gggguagcuagaggaacc

SEQ ID NO: 2405227 - RNA, 19 nt, Human
gggguagcuagaggaacca

SEQ ID NO: 2405228 - RNA, 15 nt, Human
ggggucaggcuccau

SEQ ID NO: 2405229 - RNA, 22 nt, Human
ggggucagggaccaaggacccc

SEQ ID NO: 2405230 - RNA, 18 nt, Human
gggguauuuuaggcaggg

SEQ ID NO: 2405231 - RNA, 22 nt, Human
ggggucacucaauucugcagua

SEQ ID NO: 2405232 - RNA, 18 nt, Human
ggggucaugcccuccucu

SEQ ID NO: 2405233 - RNA, 19 nt, Human
ggggucaugcccuccucuc

SEQ ID NO: 2405234 - RNA, 18 nt, Human
gggguccacccagcaaag

SEQ ID NO: 2405235 - RNA, 21 nt, Human
ggggucaugcccuccucuccc

SEQ ID NO: 2405236 - RNA, 17 nt, Human
gggguccagggagcagg

SEQ ID NO: 2405237 - RNA, 18 nt, Human
aaaauguauguguaagua

SEQ ID NO: 2405238 - RNA, 20 nt, Human
aaaauguaaauauucuauau

SEQ ID NO: 2405239 - RNA, 11 nt, Human
aaaauguaaau

SEQ ID NO: 2405240 - RNA, 19 nt, Human
aaaauguaaaggagucaaa

SEQ ID NO: 2405241 - RNA, 13 nt, Human
ggggaccagagcu

SEQ ID NO: 2405242 - RNA, 12 nt, Human
ggggaccagagc

SEQ ID NO: 2405243 - RNA, 22 nt, Human
aaaaugucaaagagaaaacuua

SEQ ID NO: 2405244 - RNA, 12 nt, Human
aaaaugucugua

SEQ ID NO: 2405245 - RNA, 15 nt, Human
ggggacagggcuggc

SEQ ID NO: 2405246 - RNA, 14 nt, Human
ggggaccagagcug

SEQ ID NO: 2405247 - RNA, 19 nt, Human
ggggccaguuggucccccu

SEQ ID NO: 2405248 - RNA, 22 nt, Human
ggggccaugagcuccagacccc

SEQ ID NO: 2405249 - RNA, 14 nt, Human
ggggccaugaggcc

SEQ ID NO: 2405250 - RNA, 24 nt, Human
ggggacagggcuggcccagcccug

SEQ ID NO: 2405251 - RNA, 22 nt, Human
ggggacagggcuggcccagccc

SEQ ID NO: 2405252 - RNA, 19 nt, Human
ggggacagggcuggcccag

SEQ ID NO: 2405253 - RNA, 16 nt, Human
ggggacagggcuggcc

SEQ ID NO: 2405254 - RNA, 20 nt, Human
ggggccaugagcuccagacc

SEQ ID NO: 2405255 - RNA, 21 nt, Human
ggggccaugagcuccagaccc

SEQ ID NO: 2405256 - RNA, 19 nt, Human
ggggccccagucagccucu

SEQ ID NO: 2405257 - RNA, 10 nt, Human
ggggccccuu

SEQ ID NO: 2405258 - RNA, 21 nt, Human
ggggccccuuuuuacuccccu

SEQ ID NO: 2405259 - RNA, 22 nt, Human
ggggccccuuuuuacuccccuu

SEQ ID NO: 2405260 - RNA, 16 nt, Human
ggggcccgccuggcag

SEQ ID NO: 2405261 - RNA, 15 nt, Human
ggggcccgcuugccu

SEQ ID NO: 2405262 - RNA, 21 nt, Human
ggggcccgccuggcagaacug

SEQ ID NO: 2405263 - RNA, 23 nt, Human
ggggcccgccuggcagaacugag

SEQ ID NO: 2405264 - RNA, 19 nt, Human
ggggcccaaggcggccccu

SEQ ID NO: 2405265 - RNA, 16 nt, Human
ggggccaugaggccuc

SEQ ID NO: 2405266 - RNA, 18 nt, Human
ggggccccagucagccuc

SEQ ID NO: 2405267 - RNA, 16 nt, Human
ggggccccagucagcc

SEQ ID NO: 2405268 - RNA, 14 nt, Human
ggggccccagggcu

SEQ ID NO: 2405269 - RNA, 22 nt, Human
ggggcccaaggcggccccuccc

SEQ ID NO: 2405270 - RNA, 17 nt, Human
ggggcccaugaaagagg

SEQ ID NO: 2405271 - RNA, 19 nt, Human
aaaccaccagaagcccaga

SEQ ID NO: 2405272 - RNA, 23 nt, Human
aaaccaccagugcccaaagucug

SEQ ID NO: 2405273 - RNA, 16 nt, Human
aaaccacuagaacucu

SEQ ID NO: 2405274 - RNA, 12 nt, Human
aaaccagaagca

SEQ ID NO: 2405275 - RNA, 15 nt, Human
aaaccaccagaagcc

SEQ ID NO: 2405276 - RNA, 18 nt, Human
aaaccaccagaagcccag

SEQ ID NO: 2405277 - RNA, 21 nt, Human
aaacauuuuguggucauuaag

SEQ ID NO: 2405278 - RNA, 21 nt, Human
aaaccugggauucaggaaugu

SEQ ID NO: 2405279 - RNA, 18 nt, Human
aaaccugggauucaggaa

SEQ ID NO: 2405280 - RNA, 15 nt, Human
aaaccuggaugucac

SEQ ID NO: 2405281 - RNA, 17 nt, Human
aaaccugcccugccuga

SEQ ID NO: 2405282 - RNA, 16 nt, Human
aaaccugcccugccug

SEQ ID NO: 2405283 - RNA, 14 nt, Human
aaaccugcccugcc

SEQ ID NO: 2405284 - RNA, 12 nt, Human
aaaccugcccug

SEQ ID NO: 2405285 - RNA, 16 nt, Human
aaaccugccuggguuu

SEQ ID NO: 2405286 - RNA, 12 nt, Human
aaaccugccugg

SEQ ID NO: 2405287 - RNA, 14 nt, Human
aaaccugauguuaa

SEQ ID NO: 2405288 - RNA, 19 nt, Human
aaaccugauguuaaaauuc

SEQ ID NO: 2405289 - RNA, 22 nt, Human
aaaccugugucucugagaguag

SEQ ID NO: 2405290 - RNA, 19 nt, Human
aaaccuguuuaaauauuuc

SEQ ID NO: 2405291 - RNA, 16 nt, Human
aaaccuguuuaaauau

SEQ ID NO: 2405292 - RNA, 18 nt, Human
aaaccugucaaugauaca

SEQ ID NO: 2405293 - RNA, 17 nt, Human
aaaccuucacuuaggaa

SEQ ID NO: 2405294 - RNA, 19 nt, Human
aaaccuuauuuuuucccaa

SEQ ID NO: 2405295 - RNA, 18 nt, Human
aaaccuuauuguaccucu

SEQ ID NO: 2405296 - RNA, 21 nt, Human
aaaccuguuuaaauauuucaa

SEQ ID NO: 2405297 - RNA, 17 nt, Human
aaaccuuauuguaccuc

SEQ ID NO: 2405298 - RNA, 16 nt, Human
aaaccuuauuguaccu

SEQ ID NO: 2405299 - RNA, 19 nt, Human
aaacgauuuaauucucuug

SEQ ID NO: 2405300 - RNA, 18 nt, Human
aaacgauuuaauucucuu

SEQ ID NO: 2405301 - RNA, 19 nt, Human
aaacgcaaagggcugaaag

SEQ ID NO: 2405302 - RNA, 17 nt, Human
aaacgauuuaauucucu

SEQ ID NO: 2405303 - RNA, 16 nt, Human
aaacgauuuaauucuc

SEQ ID NO: 2405304 - RNA, 15 nt, Human
aaacgauuuaauucu

SEQ ID NO: 2405305 - RNA, 19 nt, Human
aaacgagucaauccccuca

SEQ ID NO: 2405306 - RNA, 23 nt, Human
aaaccuuuuuuaagauuuuucuc

SEQ ID NO: 2405307 - RNA, 22 nt, Human
aaaccuuuuuuaagauuuuucu

SEQ ID NO: 2405308 - RNA, 21 nt, Human
aaaccuuuuuuaagauuuuuc

SEQ ID NO: 2405309 - RNA, 20 nt, Human
aaaccuuuuuuaagauuuuu

SEQ ID NO: 2405310 - RNA, 19 nt, Human
aaaccuuuuuuaagauuuu

SEQ ID NO: 2405311 - RNA, 18 nt, Human
aaaccuuuuuuaagauuu

SEQ ID NO: 2405312 - RNA, 16 nt, Human
aaaccuuuagggcagc

SEQ ID NO: 2405313 - RNA, 22 nt, Human
aaaccuugguguaguugaacug

SEQ ID NO: 2405314 - RNA, 14 nt, Human
aaaccuugguguag

SEQ ID NO: 2405315 - RNA, 20 nt, Human
aaaccuuauuuuuucccaaa

SEQ ID NO: 2405316 - RNA, 14 nt, Human
aaaccuugccuuuc

SEQ ID NO: 2405317 - RNA, 20 nt, Human
gggucacucuggcagcucag

SEQ ID NO: 2405318 - RNA, 14 nt, Human
gggucacucuggca

SEQ ID NO: 2405319 - RNA, 19 nt, Human
gggguccuggagcagacca

SEQ ID NO: 2405320 - RNA, 13 nt, Human
ggggucccagugg

SEQ ID NO: 2405321 - RNA, 23 nt, Human
gggguccccaucaucccagcugc

SEQ ID NO: 2405322 - RNA, 11 nt, Human
gggguccuggc

SEQ ID NO: 2405323 - RNA, 13 nt, Human
gggguccuggcca

SEQ ID NO: 2405324 - RNA, 15 nt, Human
gggguccuguggcag

SEQ ID NO: 2405325 - RNA, 14 nt, Human
gggguccuggccau

SEQ ID NO: 2405326 - RNA, 19 nt, Human
gggguccuguggcaggcag

SEQ ID NO: 2405327 - RNA, 12 nt, Human
gggucaggcucc

SEQ ID NO: 2405328 - RNA, 18 nt, Human
gggucagggaccaaggac

SEQ ID NO: 2405329 - RNA, 22 nt, Human
gggucacucuggcagcucagag

SEQ ID NO: 2405330 - RNA, 12 nt, Human
gggucaaggaau

SEQ ID NO: 2405331 - RNA, 21 nt, Human
gggucaucuguaccucugccu

SEQ ID NO: 2405332 - RNA, 21 nt, Human
gggucagucuggugggaggac

SEQ ID NO: 2405333 - RNA, 18 nt, Human
gggucauucauggccugg

SEQ ID NO: 2405334 - RNA, 14 nt, Human
gggucaugcccucc

SEQ ID NO: 2405335 - RNA, 16 nt, Human
gggucaugcccuccuc

SEQ ID NO: 2405336 - RNA, 13 nt, Human
ggguccuggccau

SEQ ID NO: 2405337 - RNA, 15 nt, Human
ggguccuggccaucc

SEQ ID NO: 2405338 - RNA, 16 nt, Human
ggguccuggccauccc

SEQ ID NO: 2405339 - RNA, 17 nt, Human
ggguccuggccauccca

SEQ ID NO: 2405340 - RNA, 13 nt, Human
ggguccuggcucc

SEQ ID NO: 2405341 - RNA, 20 nt, Human
ggguccacccagcaaagagu

SEQ ID NO: 2405342 - RNA, 13 nt, Human
ggguccaaauaaa

SEQ ID NO: 2405343 - RNA, 12 nt, Human
ggguccaaauaa

SEQ ID NO: 2405344 - RNA, 21 nt, Human
gggucaugcccuccucuccca

SEQ ID NO: 2405345 - RNA, 16 nt, Human
gggucccugcuguguu

SEQ ID NO: 2405346 - RNA, 20 nt, Human
aaacauuuuaaauggacaga

SEQ ID NO: 2405347 - RNA, 15 nt, Human
aaacauuuuaaaugg

SEQ ID NO: 2405348 - RNA, 23 nt, Human
ggguccuucccucuccccaagac

SEQ ID NO: 2405349 - RNA, 19 nt, Human
ggguccuguggcaggcagc

SEQ ID NO: 2405350 - RNA, 18 nt, Human
ggguccuguggcaggcag

SEQ ID NO: 2405351 - RNA, 18 nt, Human
ggguccuggcuccugagg

SEQ ID NO: 2405352 - RNA, 23 nt, Human
ggguccuguggcaggcagcgcca

SEQ ID NO: 2405353 - RNA, 20 nt, Human
ggguccuguggcaggcagcg

SEQ ID NO: 2405354 - RNA, 16 nt, Human
ggguccuucccucucc

SEQ ID NO: 2405355 - RNA, 18 nt, Human
ggguccuucccucucccc

SEQ ID NO: 2405356 - RNA, 19 nt, Human
aaacauuuugucauauaag

SEQ ID NO: 2405357 - RNA, 13 nt, Human
aaacauuuucaca

SEQ ID NO: 2405358 - RNA, 14 nt, Human
aaacauuuucacac

SEQ ID NO: 2405359 - RNA, 16 nt, Human
aaacauuuucacacaa

SEQ ID NO: 2405360 - RNA, 22 nt, Human
aaacauuuucacacaauacaau

SEQ ID NO: 2405361 - RNA, 15 nt, Human
guaauuugugauaca

SEQ ID NO: 2405362 - RNA, 21 nt, Human
guaauuuguaucugaaggaga

SEQ ID NO: 2405363 - RNA, 15 nt, Human
guaauuuguaucuga

SEQ ID NO: 2405364 - RNA, 14 nt, Human
guaauuuguaucug

SEQ ID NO: 2405365 - RNA, 13 nt, Human
guaauuuguaucu

SEQ ID NO: 2405366 - RNA, 17 nt, Human
guaaucgaccugccucg

SEQ ID NO: 2405367 - RNA, 17 nt, Human
guaauuugugauacaau

SEQ ID NO: 2405368 - RNA, 20 nt, Human
guaauuugugauacaaugcu

SEQ ID NO: 2405369 - RNA, 14 nt, Human
guaaucaauguuuc

SEQ ID NO: 2405370 - RNA, 16 nt, Human
guaaucccagcuacuu

SEQ ID NO: 2405371 - RNA, 18 nt, Human
guaaucccgccaccuauc

SEQ ID NO: 2405372 - RNA, 20 nt, Human
guaaucccagcuacuuggga

SEQ ID NO: 2405373 - RNA, 20 nt, Human
guaaucauuucuugggcccu

SEQ ID NO: 2405374 - RNA, 22 nt, Human
guaauccucaagaaauaaaagg

SEQ ID NO: 2405375 - RNA, 15 nt, Human
guaaucgaccugccu

SEQ ID NO: 2405376 - RNA, 23 nt, Human
guaauccuagcacuuugggaggc

SEQ ID NO: 2405377 - RNA, 17 nt, Human
guacaaggcgaucccau

SEQ ID NO: 2405378 - RNA, 22 nt, Human
guacaauaaguguuuuuguauu

SEQ ID NO: 2405379 - RNA, 12 nt, Human
guacaauauuua

SEQ ID NO: 2405380 - RNA, 13 nt, Human
guacaauauuuaa

SEQ ID NO: 2405381 - RNA, 22 nt, Human
guacaaauauaagaauaaaaug

SEQ ID NO: 2405382 - RNA, 22 nt, Human
guacaaccuguucugcuuuccu

SEQ ID NO: 2405383 - RNA, 23 nt, Human
guacaaauauaagaauaaaaugu

SEQ ID NO: 2405384 - RNA, 20 nt, Human
guacaaauauaagaauaaaa

SEQ ID NO: 2405385 - RNA, 17 nt, Human
guacaaauauaagaaua

SEQ ID NO: 2405386 - RNA, 13 nt, Human
guacaaauauaag

SEQ ID NO: 2405387 - RNA, 20 nt, Human
guacaaauaaagucccaggu

SEQ ID NO: 2405388 - RNA, 21 nt, Human
guaauuuuuuuaucgucacug

SEQ ID NO: 2405389 - RNA, 19 nt, Human
guacaaaaaaaaaguuuua

SEQ ID NO: 2405390 - RNA, 16 nt, Human
guaauuuuuuucuuau

SEQ ID NO: 2405391 - RNA, 20 nt, Human
guacaaaaaaaaaguuuuau

SEQ ID NO: 2405392 - RNA, 12 nt, Human
guacaaaauaaa

SEQ ID NO: 2405393 - RNA, 14 nt, Human
guacaaaauaaaca

SEQ ID NO: 2405394 - RNA, 16 nt, Human
guacaaaauaaacaaa

SEQ ID NO: 2405395 - RNA, 20 nt, Human
guacaaaauccagcuaugaa

SEQ ID NO: 2405396 - RNA, 20 nt, Human
guaauauugacuuguauauu

SEQ ID NO: 2405397 - RNA, 19 nt, Human
guaauauugacuuguauau

SEQ ID NO: 2405398 - RNA, 19 nt, Human
guaauagaaaacugaaaau

SEQ ID NO: 2405399 - RNA, 16 nt, Human
guaauauugacuugua

SEQ ID NO: 2405400 - RNA, 15 nt, Human
guaauagagcaaaau

SEQ ID NO: 2405401 - RNA, 15 nt, Human
guaauagaaaacuga

SEQ ID NO: 2405402 - RNA, 19 nt, Human
guaauagagcaaaauugau

SEQ ID NO: 2405403 - RNA, 17 nt, Human
guaaucaauaaacgauu

SEQ ID NO: 2405404 - RNA, 13 nt, Human
guaaucaauaaac

SEQ ID NO: 2405405 - RNA, 20 nt, Human
guaaucaauaaacgauuuaa

SEQ ID NO: 2405406 - RNA, 18 nt, Human
guaaucaauaaacgauuu

SEQ ID NO: 2405407 - RNA, 18 nt, Human
guaauauuuauauauuua

SEQ ID NO: 2405408 - RNA, 16 nt, Human
guaauaaacuguguuu

SEQ ID NO: 2405409 - RNA, 23 nt, Human
guaauaagacauaacguuuuucc

SEQ ID NO: 2405410 - RNA, 19 nt, Human
guaauaaugcuaaagaaaa

SEQ ID NO: 2405411 - RNA, 16 nt, Human
guaauaaugugaauca

SEQ ID NO: 2405412 - RNA, 17 nt, Human
guaauaaugugaaucau

SEQ ID NO: 2405413 - RNA, 17 nt, Human
guaacguugcuguggga

SEQ ID NO: 2405414 - RNA, 21 nt, Human
guaagugugaguaagagcugg

SEQ ID NO: 2405415 - RNA, 17 nt, Human
guaacuaggcucagaga

SEQ ID NO: 2405416 - RNA, 20 nt, Human
guaagugugaguaagagcug

SEQ ID NO: 2405417 - RNA, 14 nt, Human
guaaguuucaggug

SEQ ID NO: 2405418 - RNA, 13 nt, Human
guaaguuucaggu

SEQ ID NO: 2405419 - RNA, 19 nt, Human
guaaguuuaugucuaaaga

SEQ ID NO: 2405420 - RNA, 22 nt, Human
guaaguuucaggugacauguga

SEQ ID NO: 2405421 - RNA, 16 nt, Human
guaaguuucaggugac

SEQ ID NO: 2405422 - RNA, 21 nt, Human
guaaguuuaaaggauguuggu

SEQ ID NO: 2405423 - RNA, 21 nt, Human
guaaguuccuacuaggcaaaa

SEQ ID NO: 2405424 - RNA, 14 nt, Human
guaaguuccuacua

SEQ ID NO: 2405425 - RNA, 23 nt, Human
guaaguugaauggccugccuuga

SEQ ID NO: 2405426 - RNA, 18 nt, Human
guaaccucuucagaggcc

SEQ ID NO: 2405427 - RNA, 20 nt, Human
guaaccucuucagaggcccu

SEQ ID NO: 2405428 - RNA, 17 nt, Human
guaaccucagcucuggg

SEQ ID NO: 2405429 - RNA, 15 nt, Human
guaaccucagcucug

SEQ ID NO: 2405430 - RNA, 12 nt, Human
guaaccucagcu

SEQ ID NO: 2405431 - RNA, 21 nt, Human
guaacccuggugguugcuguu

SEQ ID NO: 2405432 - RNA, 20 nt, Human
guaaccagccagauccucuu

SEQ ID NO: 2405433 - RNA, 13 nt, Human
guaaccagccaga

SEQ ID NO: 2405434 - RNA, 12 nt, Human
guaaccagccag

SEQ ID NO: 2405435 - RNA, 18 nt, Human
guaacccaacucuccugg

SEQ ID NO: 2405436 - RNA, 17 nt, Human
guaacccaacucuccug

SEQ ID NO: 2405437 - RNA, 23 nt, Human
guaacccagauuuugcuguauau

SEQ ID NO: 2405438 - RNA, 14 nt, Human
guaacccugguggu

SEQ ID NO: 2405439 - RNA, 17 nt, Human
guaacgcgucuuccuga

SEQ ID NO: 2405440 - RNA, 15 nt, Human
guaacguugcugugg

SEQ ID NO: 2405441 - RNA, 16 nt, Human
guaacgcgucuuccug

SEQ ID NO: 2405442 - RNA, 18 nt, Human
guaaccucagcucuggga

SEQ ID NO: 2405443 - RNA, 17 nt, Human
guaacauccuuucuauu

SEQ ID NO: 2405444 - RNA, 13 nt, Human
guaacauccuuuc

SEQ ID NO: 2405445 - RNA, 11 nt, Human
guaacauccuu

SEQ ID NO: 2405446 - RNA, 15 nt, Human
guaacaucagggacc

SEQ ID NO: 2405447 - RNA, 22 nt, Human
guaacauguuuacuuuucaggg

SEQ ID NO: 2405448 - RNA, 23 nt, Human
guaacauguguuaaguauuuuca

SEQ ID NO: 2405449 - RNA, 11 nt, Human
guaaccagcca

SEQ ID NO: 2405450 - RNA, 23 nt, Human
guaacauuggguccugggucuuu

SEQ ID NO: 2405451 - RNA, 18 nt, Human
guaacauuggguccuggg

SEQ ID NO: 2405452 - RNA, 12 nt, Human
guaacauguuua

SEQ ID NO: 2405453 - RNA, 21 nt, Human
guaacagcuccuugggaggaa

SEQ ID NO: 2405454 - RNA, 18 nt, Human
guaacagcuccuugggag

SEQ ID NO: 2405455 - RNA, 17 nt, Human
guaacagcuccuuggga

SEQ ID NO: 2405456 - RNA, 16 nt, Human
guaacagcuccuuggg

SEQ ID NO: 2405457 - RNA, 20 nt, Human
guaacaggaaaauuuuaaaa

SEQ ID NO: 2405458 - RNA, 22 nt, Human
guaacaguucauguuugcuuca

SEQ ID NO: 2405459 - RNA, 23 nt, Human
guaacagcuccuugggaggaagc

SEQ ID NO: 2405460 - RNA, 16 nt, Human
guaacagcugaggucu

SEQ ID NO: 2405461 - RNA, 21 nt, Human
guaacagaacagcuucagguu

SEQ ID NO: 2405462 - RNA, 18 nt, Human
guaacagaacagcuucag

SEQ ID NO: 2405463 - RNA, 15 nt, Human
guaacagaacagcuu

SEQ ID NO: 2405464 - RNA, 16 nt, Human
guaacaagccacccca

SEQ ID NO: 2405465 - RNA, 13 nt, Human
guaacagcuccuu

SEQ ID NO: 2405466 - RNA, 12 nt, Human
guaacagcuccu

SEQ ID NO: 2405467 - RNA, 16 nt, Human
guaacagacauuguuu

SEQ ID NO: 2405468 - RNA, 15 nt, Human
guaacagacauuguu

SEQ ID NO: 2405469 - RNA, 14 nt, Human
guaacagacauugu

SEQ ID NO: 2405470 - RNA, 13 nt, Human
guaacagacauug

SEQ ID NO: 2405471 - RNA, 12 nt, Human
guaacagacauu

SEQ ID NO: 2405472 - RNA, 22 nt, Human
guaacagaacagcuucagguua

SEQ ID NO: 2405473 - RNA, 19 nt, Human
guaacaggaaaauuuuaaa

SEQ ID NO: 2405474 - RNA, 16 nt, Human
guaaacucaaaauauu

SEQ ID NO: 2405475 - RNA, 23 nt, Human
guaaacucaaaauauuuguacau

SEQ ID NO: 2405476 - RNA, 12 nt, Human
guaaacuccugu

SEQ ID NO: 2405477 - RNA, 22 nt, Human
guaaacuaucuuggugaauuuu

SEQ ID NO: 2405478 - RNA, 15 nt, Human
guaaacuauuuaucu

SEQ ID NO: 2405479 - RNA, 21 nt, Human
guaaacucaaaacuuaacaua

SEQ ID NO: 2405480 - RNA, 15 nt, Human
guaaacucaaaacuu

SEQ ID NO: 2405481 - RNA, 16 nt, Human
guaaacuauuuaucug

SEQ ID NO: 2405482 - RNA, 21 nt, Human
guaaacuauuuaucuguguuu

SEQ ID NO: 2405483 - RNA, 15 nt, Human
guaaagcuagaaaug

SEQ ID NO: 2405484 - RNA, 20 nt, Human
guaaagcuaaaaugauuuua

SEQ ID NO: 2405485 - RNA, 16 nt, Human
guaaagcuagaaauga

SEQ ID NO: 2405486 - RNA, 18 nt, Human
guaaauuuuguaugaaaa

SEQ ID NO: 2405487 - RNA, 23 nt, Human
guaaauuuccccaacagugugaa

SEQ ID NO: 2405488 - RNA, 21 nt, Human
guaaauuuccccaacagugug

SEQ ID NO: 2405489 - RNA, 22 nt, Human
guaaaguaucaggauacuauau

SEQ ID NO: 2405490 - RNA, 21 nt, Human
guaaaguauguaaacaggaga

SEQ ID NO: 2405491 - RNA, 16 nt, Human
guaaaguauguaaaca

SEQ ID NO: 2405492 - RNA, 20 nt, Human
guaaauuuccccaacagugu

SEQ ID NO: 2405493 - RNA, 16 nt, Human
aaaguuaacagauuuu

SEQ ID NO: 2405494 - RNA, 22 nt, Human
aaaguuaaacauugaaguaaug

SEQ ID NO: 2405495 - RNA, 16 nt, Human
aaaguuaaacauugaa

SEQ ID NO: 2405496 - RNA, 22 nt, Human
aaauaaugugaaacuggauuaa

SEQ ID NO: 2405497 - RNA, 14 nt, Human
aaauaaugugaaac

SEQ ID NO: 2405498 - RNA, 17 nt, Human
aaaguuacaaauugcuu

SEQ ID NO: 2405499 - RNA, 16 nt, Human
aaaguguccauugaca

SEQ ID NO: 2405500 - RNA, 20 nt, Human
aaaguguuuauuuuucauau

SEQ ID NO: 2405501 - RNA, 18 nt, Human
aaaguguuuauuuuucau

SEQ ID NO: 2405502 - RNA, 17 nt, Human
aaaguguuuauuuuuca

SEQ ID NO: 2405503 - RNA, 19 nt, Human
aaaguguuggcuaaugaag

SEQ ID NO: 2405504 - RNA, 13 nt, Human
aaaguguuugccu

SEQ ID NO: 2405505 - RNA, 21 nt, Human
aaaguguuuauuuuucauauu

SEQ ID NO: 2405506 - RNA, 15 nt, Human
aaaguguuucuguua

SEQ ID NO: 2405507 - RNA, 22 nt, Human
aaaguguauuuuuuuacuaaua

SEQ ID NO: 2405508 - RNA, 14 nt, Human
aaauaauucuaaag

SEQ ID NO: 2405509 - RNA, 13 nt, Human
aaauaauucuaaa

SEQ ID NO: 2405510 - RNA, 15 nt, Human
aaauaauucuaaagg

SEQ ID NO: 2405511 - RNA, 18 nt, Human
guaaaauugccauauugc

SEQ ID NO: 2405512 - RNA, 16 nt, Human
guaaaauugccauauu

SEQ ID NO: 2405513 - RNA, 15 nt, Human
guaaaauugccauau

SEQ ID NO: 2405514 - RNA, 14 nt, Human
guaaaauugccaua

SEQ ID NO: 2405515 - RNA, 15 nt, Human
guaaaauguugaaua

SEQ ID NO: 2405516 - RNA, 16 nt, Human
guaaaauguugaauaa

SEQ ID NO: 2405517 - RNA, 16 nt, Human
guaaaauugaaaggca

SEQ ID NO: 2405518 - RNA, 20 nt, Human
guaaaauugccauauugcac

SEQ ID NO: 2405519 - RNA, 19 nt, Human
guaaaauugccauauugca

SEQ ID NO: 2405520 - RNA, 21 nt, Human
guaaaauugccauauugcaca

SEQ ID NO: 2405521 - RNA, 15 nt, Human
guaaaauuguauaga

SEQ ID NO: 2405522 - RNA, 22 nt, Human
guaaacacgccugcaaacgcug

SEQ ID NO: 2405523 - RNA, 23 nt, Human
guaaacaaaauuuaguuuuuguu

SEQ ID NO: 2405524 - RNA, 17 nt, Human
guaaacaaaauuuaguu

SEQ ID NO: 2405525 - RNA, 13 nt, Human
guaaaccuuuuau

SEQ ID NO: 2405526 - RNA, 20 nt, Human
guaaacgcugucccuaguaa

SEQ ID NO: 2405527 - RNA, 16 nt, Human
guaaacgcugucccua

SEQ ID NO: 2405528 - RNA, 22 nt, Human
aaauaucacuugucaauaaaau

SEQ ID NO: 2405529 - RNA, 15 nt, Human
aaauaucagacuagu

SEQ ID NO: 2405530 - RNA, 18 nt, Human
aaauaucaguuacucagc

SEQ ID NO: 2405531 - RNA, 20 nt, Human
aaauaucaguuacucagccc

SEQ ID NO: 2405532 - RNA, 18 nt, Human
aaauaucauuuauuuuuu

SEQ ID NO: 2405533 - RNA, 22 nt, Human
aaauauauuuuaagacgaaaca

SEQ ID NO: 2405534 - RNA, 16 nt, Human
aaauauauuuuaagac

SEQ ID NO: 2405535 - RNA, 15 nt, Human
aaauauauuuaauga

SEQ ID NO: 2405536 - RNA, 22 nt, Human
aaauauauuuaagauaauuaua

SEQ ID NO: 2405537 - RNA, 22 nt, Human
aaauauauaucuaaauuuagaa

SEQ ID NO: 2405538 - RNA, 15 nt, Human
aaauauauauauccu

SEQ ID NO: 2405539 - RNA, 20 nt, Human
aaauauauauauauauaaaa

SEQ ID NO: 2405540 - RNA, 19 nt, Human
aaauauauauauauauaaa

SEQ ID NO: 2405541 - RNA, 12 nt, Human
aaauauauauau

SEQ ID NO: 2405542 - RNA, 20 nt, Human
aaauauauauaaauauauau

SEQ ID NO: 2405543 - RNA, 19 nt, Human
aaauauauauaaauauaua

SEQ ID NO: 2405544 - RNA, 17 nt, Human
aaauauauauaaauaua

SEQ ID NO: 2405545 - RNA, 14 nt, Human
aaauauauaucaaa

SEQ ID NO: 2405546 - RNA, 18 nt, Human
aaauauaugcuaagucuu

SEQ ID NO: 2405547 - RNA, 23 nt, Human
aaauauaugauuaacuaauuuua

SEQ ID NO: 2405548 - RNA, 23 nt, Human
aaauauauauguguguguauguu

SEQ ID NO: 2405549 - RNA, 14 nt, Human
aaauauauuuaaug

SEQ ID NO: 2405550 - RNA, 21 nt, Human
aaauauauuuaagauaauuau

SEQ ID NO: 2405551 - RNA, 20 nt, Human
aaauauauuuaagauaauua

SEQ ID NO: 2405552 - RNA, 12 nt, Human
aaauauauuuaa

SEQ ID NO: 2405553 - RNA, 21 nt, Human
guacaaugacuuuauugcauc

SEQ ID NO: 2405554 - RNA, 20 nt, Human
guacaaugacuuuauugcau

SEQ ID NO: 2405555 - RNA, 14 nt, Human
guacaauauuuaaa

SEQ ID NO: 2405556 - RNA, 18 nt, Human
guacaauauuuaaaauuu

SEQ ID NO: 2405557 - RNA, 14 nt, Human
guacaaucucaaau

SEQ ID NO: 2405558 - RNA, 19 nt, Human
aaauaccagccaguaaaug

SEQ ID NO: 2405559 - RNA, 16 nt, Human
guacacacacauacac

SEQ ID NO: 2405560 - RNA, 20 nt, Human
aaauaccagccaguaaaugg

SEQ ID NO: 2405561 - RNA, 21 nt, Human
aaauaccagccaguaaauggg

SEQ ID NO: 2405562 - RNA, 21 nt, Human
aaauaccaugccauuuaaagc

SEQ ID NO: 2405563 - RNA, 18 nt, Human
aaauaccagugaaccaaa

SEQ ID NO: 2405564 - RNA, 21 nt, Human
aaauaccagugaaccaaagag

SEQ ID NO: 2405565 - RNA, 17 nt, Human
aaauaccagugugguuu

SEQ ID NO: 2405566 - RNA, 21 nt, Human
aaauauauauaaauauauaua

SEQ ID NO: 2405567 - RNA, 14 nt, Human
aaauauauauaaau

SEQ ID NO: 2405568 - RNA, 16 nt, Human
aaauauauauaaaccu

SEQ ID NO: 2405569 - RNA, 14 nt, Human
aaauauauauaaac

SEQ ID NO: 2405570 - RNA, 17 nt, Human
aaauauauaaauauaua

SEQ ID NO: 2405571 - RNA, 18 nt, Human
aaauauauaaauauauau

SEQ ID NO: 2405572 - RNA, 10 nt, Human
aaauauauau

SEQ ID NO: 2405573 - RNA, 16 nt, Human
aaauauauaaauauau

SEQ ID NO: 2405574 - RNA, 15 nt, Human
aaauauauaaauaua

SEQ ID NO: 2405575 - RNA, 14 nt, Human
aaauauauaaauau

SEQ ID NO: 2405576 - RNA, 12 nt, Human
aaauauauaaau

SEQ ID NO: 2405577 - RNA, 21 nt, Human
aaauauauaaaaagaaaagau

SEQ ID NO: 2405578 - RNA, 9 nt, Human
aaauauaua

SEQ ID NO: 2405579 - RNA, 21 nt, Human
aaauauagcuguacaaauaua

SEQ ID NO: 2405580 - RNA, 15 nt, Human
aaauauaggaacuua

SEQ ID NO: 2405581 - RNA, 19 nt, Human
aaauaccccaucauucaug

SEQ ID NO: 2405582 - RNA, 18 nt, Human
aaauaccccaucauucau

SEQ ID NO: 2405583 - RNA, 18 nt, Human
aaauauagaucaguuaua

SEQ ID NO: 2405584 - RNA, 20 nt, Human
aaauauagcuguacaaauau

SEQ ID NO: 2405585 - RNA, 17 nt, Human
aaauauagcuguacaaa

SEQ ID NO: 2405586 - RNA, 16 nt, Human
aaauauagcuguacaa

SEQ ID NO: 2405587 - RNA, 18 nt, Human
aaauaccucuuagcugag

SEQ ID NO: 2405588 - RNA, 12 nt, Human
aaauaucugaaa

SEQ ID NO: 2405589 - RNA, 14 nt, Human
aaauaucugaaaau

SEQ ID NO: 2405590 - RNA, 17 nt, Human
aaauaucugaaaaugua

SEQ ID NO: 2405591 - RNA, 18 nt, Human
aaauaucugaaaauguau

SEQ ID NO: 2405592 - RNA, 19 nt, Human
aaauaucugaaaauguaug

SEQ ID NO: 2405593 - RNA, 21 nt, Human
aaauaucugaaaauguaugug

SEQ ID NO: 2405594 - RNA, 22 nt, Human
aaauaucugaaaauguaugugu

SEQ ID NO: 2405595 - RNA, 23 nt, Human
aaauaucugaaaauguaugugua

SEQ ID NO: 2405596 - RNA, 13 nt, Human
aaauaugcaaagc

SEQ ID NO: 2405597 - RNA, 15 nt, Human
aaauaugcaaagcac

SEQ ID NO: 2405598 - RNA, 16 nt, Human
aaauaugcaaagcacu

SEQ ID NO: 2405599 - RNA, 17 nt, Human
aaauaugcaaagcacug

SEQ ID NO: 2405600 - RNA, 17 nt, Human
aaauaucuuuugaccug

SEQ ID NO: 2405601 - RNA, 22 nt, Human
aaauaucuguauuuaauuuuga

SEQ ID NO: 2405602 - RNA, 20 nt, Human
aaauaugaagacauaaaccc

SEQ ID NO: 2405603 - RNA, 17 nt, Human
aaauaugaagaacugag

SEQ ID NO: 2405604 - RNA, 23 nt, Human
aaauaugagugguuauugaaaau

SEQ ID NO: 2405605 - RNA, 12 nt, Human
aaauaugaaugc

SEQ ID NO: 2405606 - RNA, 12 nt, Human
aaauaugaagcu

SEQ ID NO: 2405607 - RNA, 16 nt, Human
aaauaucuuuugaccu

SEQ ID NO: 2405608 - RNA, 19 nt, Human
aaauaugauuuuauuugac

SEQ ID NO: 2405609 - RNA, 19 nt, Human
aaauaugauauugcauaug

SEQ ID NO: 2405610 - RNA, 15 nt, Human
aaauaucuugaaagg

SEQ ID NO: 2405611 - RNA, 15 nt, Human
aaauaucuguauuua

SEQ ID NO: 2405612 - RNA, 13 nt, Human
aaauaucuguauu

SEQ ID NO: 2405613 - RNA, 12 nt, Human
aaauaucuguau

SEQ ID NO: 2405614 - RNA, 16 nt, Human
aaauauguccuggggu

SEQ ID NO: 2405615 - RNA, 20 nt, Human
aaauauguuagcaaagaguu

SEQ ID NO: 2405616 - RNA, 21 nt, Human
aaauauguuuuuuagaucaaa

SEQ ID NO: 2405617 - RNA, 19 nt, Human
aaauauguuuuuuagauca

SEQ ID NO: 2405618 - RNA, 16 nt, Human
aaauauguugaugaaa

SEQ ID NO: 2405619 - RNA, 19 nt, Human
aaauauguugaugaaaaau

SEQ ID NO: 2405620 - RNA, 15 nt, Human
aaauauggacacuua

SEQ ID NO: 2405621 - RNA, 16 nt, Human
aaauauggacacuuaa

SEQ ID NO: 2405622 - RNA, 19 nt, Human
aaauauggcuauaaauaua

SEQ ID NO: 2405623 - RNA, 20 nt, Human
aaauauggacacuuaauacu

SEQ ID NO: 2405624 - RNA, 12 nt, Human
aaauauguacaa

SEQ ID NO: 2405625 - RNA, 16 nt, Human
aaauaugccuuuuuga

SEQ ID NO: 2405626 - RNA, 23 nt, Human
aaauaugccucuccuuuguauau

SEQ ID NO: 2405627 - RNA, 22 nt, Human
aaauaugccucuccuuuguaua

SEQ ID NO: 2405628 - RNA, 13 nt, Human
aaauauggaacuu

SEQ ID NO: 2405629 - RNA, 16 nt, Human
aaauauggaacuuaca

SEQ ID NO: 2405630 - RNA, 20 nt, Human
aaauauggaacuucuaauau

SEQ ID NO: 2405631 - RNA, 19 nt, Human
aaauauggaacuucuaaua

SEQ ID NO: 2405632 - RNA, 18 nt, Human
aaauauggaacuucuaau

SEQ ID NO: 2405633 - RNA, 17 nt, Human
aaauauggaacuucuaa

SEQ ID NO: 2405634 - RNA, 17 nt, Human
aaauauggaacuuacau

SEQ ID NO: 2405635 - RNA, 18 nt, Human
aaauauggaacuuacauu

SEQ ID NO: 2405636 - RNA, 16 nt, Human
aaauauggaacuucua

SEQ ID NO: 2405637 - RNA, 21 nt, Human
aaauauggaacuuacauuguu

SEQ ID NO: 2405638 - RNA, 14 nt, Human
aaauaugcagugau

SEQ ID NO: 2405639 - RNA, 20 nt, Human
aaauaugauuuuauuugaca

SEQ ID NO: 2405640 - RNA, 10 nt, Human
aaauaugcaa

SEQ ID NO: 2405641 - RNA, 21 nt, Human
aaauaugccucuccuuuguau

SEQ ID NO: 2405642 - RNA, 20 nt, Human
aaauaugccucuccuuugua

SEQ ID NO: 2405643 - RNA, 14 nt, Human
aaauaugccucucc

SEQ ID NO: 2405644 - RNA, 13 nt, Human
aaauaugccucuc

SEQ ID NO: 2405645 - RNA, 22 nt, Human
aaauaugcagugauauggcaga

SEQ ID NO: 2405646 - RNA, 18 nt, Human
aaauaugcagugauaugg

SEQ ID NO: 2405647 - RNA, 23 nt, Human
aaauaugcagugauauggcagaa

SEQ ID NO: 2405648 - RNA, 12 nt, Human
aaauaugcaucu

SEQ ID NO: 2405649 - RNA, 19 nt, Human
aaaucagccugcuccagcu

SEQ ID NO: 2405650 - RNA, 21 nt, Human
aaaucagccugcuccagcugu

SEQ ID NO: 2405651 - RNA, 20 nt, Human
aaauauuguguugugaaugu

SEQ ID NO: 2405652 - RNA, 23 nt, Human
aaaucagccugcuccagcuguuc

SEQ ID NO: 2405653 - RNA, 13 nt, Human
aaauauucuauau

SEQ ID NO: 2405654 - RNA, 20 nt, Human
aaauauuccugcauuuguga

SEQ ID NO: 2405655 - RNA, 23 nt, Human
aaauauguuuuuuagaucaaaua

SEQ ID NO: 2405656 - RNA, 19 nt, Human
aaauauuaagaaagacuau

SEQ ID NO: 2405657 - RNA, 18 nt, Human
aaauauucuauuuucauu

SEQ ID NO: 2405658 - RNA, 20 nt, Human
aaauauucuauaugaauuua

SEQ ID NO: 2405659 - RNA, 18 nt, Human
aaauauucuauaugaauu

SEQ ID NO: 2405660 - RNA, 14 nt, Human
aaauauucuauaug

SEQ ID NO: 2405661 - RNA, 22 nt, Human
aaauauucuauuuucauuuucu

SEQ ID NO: 2405662 - RNA, 13 nt, Human
aaauauugcuggg

SEQ ID NO: 2405663 - RNA, 23 nt, Human
gguggacuuagaaagcaggggcu

SEQ ID NO: 2405664 - RNA, 20 nt, Human
gguggacuuagaaagcaggg

SEQ ID NO: 2405665 - RNA, 19 nt, Human
gguggacuuagaaagcagg

SEQ ID NO: 2405666 - RNA, 16 nt, Human
gguggagaaagcacug

SEQ ID NO: 2405667 - RNA, 21 nt, Human
gguggacuuagaaagcagggg

SEQ ID NO: 2405668 - RNA, 21 nt, Human
gguggagaaagcacugaccug

SEQ ID NO: 2405669 - RNA, 18 nt, Human
gguggacuuagaaagcag

SEQ ID NO: 2405670 - RNA, 17 nt, Human
gguggacuuagaaagca

SEQ ID NO: 2405671 - RNA, 15 nt, Human
gguggacucgccugu

SEQ ID NO: 2405672 - RNA, 14 nt, Human
gguggacccaggga

SEQ ID NO: 2405673 - RNA, 14 nt, Human
gguggcaccagcag

SEQ ID NO: 2405674 - RNA, 20 nt, Human
gguggcaccagcagccugga

SEQ ID NO: 2405675 - RNA, 16 nt, Human
aaagcagaacagugau

SEQ ID NO: 2405676 - RNA, 22 nt, Human
aaagcacuuggacucuugcucu

SEQ ID NO: 2405677 - RNA, 21 nt, Human
aaagcacuuggacucuugcuc

SEQ ID NO: 2405678 - RNA, 16 nt, Human
gguggcacuuuuucau

SEQ ID NO: 2405679 - RNA, 19 nt, Human
aaagcacuuggacucuugc

SEQ ID NO: 2405680 - RNA, 22 nt, Human
aaagcagauaccucacccugcu

SEQ ID NO: 2405681 - RNA, 13 nt, Human
gguggcacugcca

SEQ ID NO: 2405682 - RNA, 20 nt, Human
gguggcacugagccccccca

SEQ ID NO: 2405683 - RNA, 16 nt, Human
gguggcacugagcccc

SEQ ID NO: 2405684 - RNA, 15 nt, Human
gguggcacugagccc

SEQ ID NO: 2405685 - RNA, 23 nt, Human
gguggcaccagcgaagggagugc

SEQ ID NO: 2405686 - RNA, 18 nt, Human
gguggcacaggcccccuu

SEQ ID NO: 2405687 - RNA, 12 nt, Human
gguggagaagcc

SEQ ID NO: 2405688 - RNA, 11 nt, Human
gguggagaagc

SEQ ID NO: 2405689 - RNA, 18 nt, Human
gguggcagcccuguaggg

SEQ ID NO: 2405690 - RNA, 15 nt, Human
gguggcagcccugua

SEQ ID NO: 2405691 - RNA, 12 nt, Human
aaacuuuaugcu

SEQ ID NO: 2405692 - RNA, 19 nt, Human
aaacuuuaugcuaagugaa

SEQ ID NO: 2405693 - RNA, 17 nt, Human
ggugcugccucuaccug

SEQ ID NO: 2405694 - RNA, 19 nt, Human
ggugcugcuacccucccug

SEQ ID NO: 2405695 - RNA, 17 nt, Human
ggugcugcuacccuccc

SEQ ID NO: 2405696 - RNA, 16 nt, Human
ggugcugcuacccucc

SEQ ID NO: 2405697 - RNA, 13 nt, Human
ggugcugcuaccc

SEQ ID NO: 2405698 - RNA, 22 nt, Human
ggugcugcuacccucccugcug

SEQ ID NO: 2405699 - RNA, 20 nt, Human
ggugcugcuacccucccugc

SEQ ID NO: 2405700 - RNA, 23 nt, Human
ggugcugcuacccucccugcugu

SEQ ID NO: 2405701 - RNA, 14 nt, Human
ggugcugcuucccu

SEQ ID NO: 2405702 - RNA, 19 nt, Human
ggugcugggacugagccag

SEQ ID NO: 2405703 - RNA, 14 nt, Human
ggugcugggacuga

SEQ ID NO: 2405704 - RNA, 12 nt, Human
ggugcugggacu

SEQ ID NO: 2405705 - RNA, 22 nt, Human
ggugcuggaggugggagcagga

SEQ ID NO: 2405706 - RNA, 24 nt, Human
ggugcugggacugagccaguccca

SEQ ID NO: 2405707 - RNA, 20 nt, Human
ggugcugggacugagccagu

SEQ ID NO: 2405708 - RNA, 21 nt, Human
ggugcugcuucccucugccug

SEQ ID NO: 2405709 - RNA, 21 nt, Human
ggugcuggaggugggagcagg

SEQ ID NO: 2405710 - RNA, 16 nt, Human
ggugcuggagguggga

SEQ ID NO: 2405711 - RNA, 16 nt, Human
ggugcuggauauuuuc

SEQ ID NO: 2405712 - RNA, 15 nt, Human
ggugcugggaggagg

SEQ ID NO: 2405713 - RNA, 14 nt, Human
gguggacaguccug

SEQ ID NO: 2405714 - RNA, 15 nt, Human
gguggacaguccugg

SEQ ID NO: 2405715 - RNA, 16 nt, Human
gguggacaguccuggg

SEQ ID NO: 2405716 - RNA, 17 nt, Human
gguggacaguccuggga

SEQ ID NO: 2405717 - RNA, 18 nt, Human
gguggacaguccugggag

SEQ ID NO: 2405718 - RNA, 15 nt, Human
gguggacauggcccc

SEQ ID NO: 2405719 - RNA, 13 nt, Human
gguggacacacaa

SEQ ID NO: 2405720 - RNA, 12 nt, Human
gguggacccagg

SEQ ID NO: 2405721 - RNA, 20 nt, Human
aaagcaggggaguaugcaaa

SEQ ID NO: 2405722 - RNA, 18 nt, Human
aaagcagcccuuggccag

SEQ ID NO: 2405723 - RNA, 12 nt, Human
aaagcagccacg

SEQ ID NO: 2405724 - RNA, 15 nt, Human
aaagcagccacgagg

SEQ ID NO: 2405725 - RNA, 13 nt, Human
aaagcagcaucug

SEQ ID NO: 2405726 - RNA, 13 nt, Human
aaagcagaaaaua

SEQ ID NO: 2405727 - RNA, 22 nt, Human
aaagcaggggcuacaagaggga

SEQ ID NO: 2405728 - RNA, 21 nt, Human
aaagcaggggcuacaagaggg

SEQ ID NO: 2405729 - RNA, 18 nt, Human
aaagcaggggcuacaaga

SEQ ID NO: 2405730 - RNA, 21 nt, Human
aaagcaggggaguaugcaaaa

SEQ ID NO: 2405731 - RNA, 17 nt, Human
aaagcagguggcaucuc

SEQ ID NO: 2405732 - RNA, 22 nt, Human
aaagcaguagaaauaauaugca

SEQ ID NO: 2405733 - RNA, 17 nt, Human
aaagcaguaacugacaa

SEQ ID NO: 2405734 - RNA, 16 nt, Human
aaagcuaggccuggcc

SEQ ID NO: 2405735 - RNA, 14 nt, Human
aaagcuaggccugg

SEQ ID NO: 2405736 - RNA, 13 nt, Human
aaagcagugcaug

SEQ ID NO: 2405737 - RNA, 13 nt, Human
aaagcuagaaaug

SEQ ID NO: 2405738 - RNA, 14 nt, Human
aaagcuagaaauga

SEQ ID NO: 2405739 - RNA, 13 nt, Human
aaagcugccagcc

SEQ ID NO: 2405740 - RNA, 12 nt, Human
aaagcugccagc

SEQ ID NO: 2405741 - RNA, 14 nt, Human
aaagcuguguggca

SEQ ID NO: 2405742 - RNA, 23 nt, Human
aaagcuguggccagcuuguuauu

SEQ ID NO: 2405743 - RNA, 22 nt, Human
aaagcugccagccgagauagcc

SEQ ID NO: 2405744 - RNA, 20 nt, Human
aaagcugaucugguuugacu

SEQ ID NO: 2405745 - RNA, 19 nt, Human
gguggggaccucaggccug

SEQ ID NO: 2405746 - RNA, 18 nt, Human
ggugggcugagcccuggc

SEQ ID NO: 2405747 - RNA, 15 nt, Human
ggugggcugagcccu

SEQ ID NO: 2405748 - RNA, 17 nt, Human
ggugggcugagcccugg

SEQ ID NO: 2405749 - RNA, 13 nt, Human
ggugggagcagga

SEQ ID NO: 2405750 - RNA, 15 nt, Human
ggugggccuugcugg

SEQ ID NO: 2405751 - RNA, 15 nt, Human
ggugggagagcccag

SEQ ID NO: 2405752 - RNA, 16 nt, Human
ggugggagagcccagc

SEQ ID NO: 2405753 - RNA, 21 nt, Human
ggugggcguggucacugcugu

SEQ ID NO: 2405754 - RNA, 20 nt, Human
ggugggcgggcagcacagca

SEQ ID NO: 2405755 - RNA, 20 nt, Human
ggugggcggcacagccuucu

SEQ ID NO: 2405756 - RNA, 16 nt, Human
ggugggagcaggagau

SEQ ID NO: 2405757 - RNA, 16 nt, Human
ggugggcucugugcag

SEQ ID NO: 2405758 - RNA, 13 nt, Human
ggugggcucugug

SEQ ID NO: 2405759 - RNA, 13 nt, Human
ggugggcugagcc

SEQ ID NO: 2405760 - RNA, 16 nt, Human
ggugggacacccugug

SEQ ID NO: 2405761 - RNA, 13 nt, Human
ggugggacacccu

SEQ ID NO: 2405762 - RNA, 17 nt, Human
ggugggacacccuguga

SEQ ID NO: 2405763 - RNA, 20 nt, Human
ggugggaggaucucuugagc

SEQ ID NO: 2405764 - RNA, 23 nt, Human
aaaguaaagcuaaaaugauuuua

SEQ ID NO: 2405765 - RNA, 13 nt, Human
aaaguaaagcuaa

SEQ ID NO: 2405766 - RNA, 22 nt, Human
ggugggaaaugguaugagcuga

SEQ ID NO: 2405767 - RNA, 21 nt, Human
ggugggaaccaugaagacagg

SEQ ID NO: 2405768 - RNA, 12 nt, Human
gguggcuggguu

SEQ ID NO: 2405769 - RNA, 18 nt, Human
gguggcuggguuggaggg

SEQ ID NO: 2405770 - RNA, 21 nt, Human
aaaguaaaaacaaagaaauua

SEQ ID NO: 2405771 - RNA, 18 nt, Human
aaagguuuuauuuuguaa

SEQ ID NO: 2405772 - RNA, 12 nt, Human
aaaguaaagcua

SEQ ID NO: 2405773 - RNA, 16 nt, Human
aaagguuuuauuuugu

SEQ ID NO: 2405774 - RNA, 17 nt, Human
aaagguuuuauuuugua

SEQ ID NO: 2405775 - RNA, 14 nt, Human
aaagguuuuccucu

SEQ ID NO: 2405776 - RNA, 13 nt, Human
aaagcuuauuaaa

SEQ ID NO: 2405777 - RNA, 15 nt, Human
aaagcuuagcaggag

SEQ ID NO: 2405778 - RNA, 16 nt, Human
aaagcuguugauggua

SEQ ID NO: 2405779 - RNA, 20 nt, Human
aaagggcccagagagggugg

SEQ ID NO: 2405780 - RNA, 23 nt, Human
aaagggcccacagugacuuuugc

SEQ ID NO: 2405781 - RNA, 19 nt, Human
aaagggauuacccaagcaa

SEQ ID NO: 2405782 - RNA, 16 nt, Human
aaagggcucuuuagcc

SEQ ID NO: 2405783 - RNA, 20 nt, Human
aaagggcagggcaucuccug

SEQ ID NO: 2405784 - RNA, 22 nt, Human
aaagggcuguuauaaucuuuca

SEQ ID NO: 2405785 - RNA, 20 nt, Human
aaagggcuguuauaaucuuu

SEQ ID NO: 2405786 - RNA, 14 nt, Human
aaaggggagagccu

SEQ ID NO: 2405787 - RNA, 19 nt, Human
aaaggggagagccugcugg

SEQ ID NO: 2405788 - RNA, 16 nt, Human
aaaggggagagccugc

SEQ ID NO: 2405789 - RNA, 18 nt, Human
aaaggggcagaaaaacuc

SEQ ID NO: 2405790 - RNA, 23 nt, Human
aaagggggucccagugggagggg

SEQ ID NO: 2405791 - RNA, 21 nt, Human
aaagggggucccagugggagg

SEQ ID NO: 2405792 - RNA, 20 nt, Human
aaagggggucccagugggag

SEQ ID NO: 2405793 - RNA, 16 nt, Human
aaagggggucccagug

SEQ ID NO: 2405794 - RNA, 20 nt, Human
aaaggugaguuugagcugcc

SEQ ID NO: 2405795 - RNA, 24 nt, Human
aaaggugaaggaauauauggcaga

SEQ ID NO: 2405796 - RNA, 22 nt, Human
aaaggugaccuugcaacuucau

SEQ ID NO: 2405797 - RNA, 22 nt, Human
aaaggugaguuugagcugccuu

SEQ ID NO: 2405798 - RNA, 21 nt, Human
aaaggugaguuugagcugccu

SEQ ID NO: 2405799 - RNA, 23 nt, Human
aaaggugaguuugagcugccuuc

SEQ ID NO: 2405800 - RNA, 24 nt, Human
aaaggggucggcugaccaugcuca

SEQ ID NO: 2405801 - RNA, 23 nt, Human
aaaggggucggcugaccaugcuc

SEQ ID NO: 2405802 - RNA, 21 nt, Human
aaaggugaaggaauauauggc

SEQ ID NO: 2405803 - RNA, 16 nt, Human
aaaggugaaggaauau

SEQ ID NO: 2405804 - RNA, 15 nt, Human
aaaggugaaggaaua

SEQ ID NO: 2405805 - RNA, 18 nt, Human
aaaggggucccauagagg

SEQ ID NO: 2405806 - RNA, 17 nt, Human
aaaggugguaugugugu

SEQ ID NO: 2405807 - RNA, 19 nt, Human
aaaggugguaugugugugu

SEQ ID NO: 2405808 - RNA, 21 nt, Human
aaaggugguauguguguguau

SEQ ID NO: 2405809 - RNA, 18 nt, Human
aaagguggugaggcaaua

SEQ ID NO: 2405810 - RNA, 12 nt, Human
aaaggugucuuc

SEQ ID NO: 2405811 - RNA, 22 nt, Human
aaaggugguauguguguguaug

SEQ ID NO: 2405812 - RNA, 14 nt, Human
aaaggugauaucca

SEQ ID NO: 2405813 - RNA, 21 nt, Human
aaaggugccugugaggcaggg

SEQ ID NO: 2405814 - RNA, 19 nt, Human
aaagguggacuggaagggg

SEQ ID NO: 2405815 - RNA, 18 nt, Human
aaagguucaugcaaacuu

SEQ ID NO: 2405816 - RNA, 18 nt, Human
aaaggugucuuccuccca

SEQ ID NO: 2405817 - RNA, 16 nt, Human
aaaggugucuuccucc

SEQ ID NO: 2405818 - RNA, 14 nt, Human
aaagguguuguccc

SEQ ID NO: 2405819 - RNA, 18 nt, Human
aaagguguugucccuucu

SEQ ID NO: 2405820 - RNA, 17 nt, Human
aaagguucacuaaagca

SEQ ID NO: 2405821 - RNA, 20 nt, Human
gguuuguaaauuaacuuuua

SEQ ID NO: 2405822 - RNA, 13 nt, Human
gguuuguauauug

SEQ ID NO: 2405823 - RNA, 15 nt, Human
gguuuggucugggac

SEQ ID NO: 2405824 - RNA, 17 nt, Human
gguuucguuucuguaua

SEQ ID NO: 2405825 - RNA, 19 nt, Human
gguuuggggagcagagaca

SEQ ID NO: 2405826 - RNA, 22 nt, Human
gguuuguuuagaagaagugugu

SEQ ID NO: 2405827 - RNA, 19 nt, Human
gguuuguguuugaguuuua

SEQ ID NO: 2405828 - RNA, 17 nt, Human
gguuuuaaguuguuugc

SEQ ID NO: 2405829 - RNA, 16 nt, Human
gguuuuaaagugauua

SEQ ID NO: 2405830 - RNA, 12 nt, Human
gguuuuaaugua

SEQ ID NO: 2405831 - RNA, 16 nt, Human
gguuuuauacugaagg

SEQ ID NO: 2405832 - RNA, 20 nt, Human
gguuuuauuuuguaauuauu

SEQ ID NO: 2405833 - RNA, 19 nt, Human
aaaguaagcccuugaagau

SEQ ID NO: 2405834 - RNA, 19 nt, Human
aaaguaaguaccacucagg

SEQ ID NO: 2405835 - RNA, 19 nt, Human
gguuuuauuguuuaaaauc

SEQ ID NO: 2405836 - RNA, 21 nt, Human
gguuuuaggucucuuccccuc

SEQ ID NO: 2405837 - RNA, 17 nt, Human
gguuuuauaaggcugau

SEQ ID NO: 2405838 - RNA, 15 nt, Human
gguuuuauauuuuua

SEQ ID NO: 2405839 - RNA, 15 nt, Human
gguuucagaaaugug

SEQ ID NO: 2405840 - RNA, 17 nt, Human
gguuucauauuucuuau

SEQ ID NO: 2405841 - RNA, 17 nt, Human
gguuucauacucuagau

SEQ ID NO: 2405842 - RNA, 12 nt, Human
gguuuccaaagg

SEQ ID NO: 2405843 - RNA, 12 nt, Human
gguuuccugccc

SEQ ID NO: 2405844 - RNA, 13 nt, Human
gguuuccugcccu

SEQ ID NO: 2405845 - RNA, 15 nt, Human
gguuuccugcccugg

SEQ ID NO: 2405846 - RNA, 16 nt, Human
gguuucuaaagcugcc

SEQ ID NO: 2405847 - RNA, 16 nt, Human
gguuuccugcccuggg

SEQ ID NO: 2405848 - RNA, 19 nt, Human
gguuuccugcccugggagg

SEQ ID NO: 2405849 - RNA, 22 nt, Human
gguuucuaaagcugccagccga

SEQ ID NO: 2405850 - RNA, 15 nt, Human
gguuucgagaagcug

SEQ ID NO: 2405851 - RNA, 14 nt, Human
gguuugggaccccu

SEQ ID NO: 2405852 - RNA, 21 nt, Human
aaaguaucccuacuguaauuu

SEQ ID NO: 2405853 - RNA, 20 nt, Human
aaaguagaagucuuagaugu

SEQ ID NO: 2405854 - RNA, 22 nt, Human
aaaguagaagucuuagauguau

SEQ ID NO: 2405855 - RNA, 19 nt, Human
aaaguacacuguuucaaac

SEQ ID NO: 2405856 - RNA, 18 nt, Human
aaaguacacuguuucaaa

SEQ ID NO: 2405857 - RNA, 14 nt, Human
aaaguaaggugcag

SEQ ID NO: 2405858 - RNA, 17 nt, Human
aaaguauguuagugcaa

SEQ ID NO: 2405859 - RNA, 17 nt, Human
aaagugggcuugauucu

SEQ ID NO: 2405860 - RNA, 20 nt, Human
aaaguauguaaaguauguaa

SEQ ID NO: 2405861 - RNA, 19 nt, Human
aaaguauguaaaguaugua

SEQ ID NO: 2405862 - RNA, 19 nt, Human
aaaguaugguauugaaacu

SEQ ID NO: 2405863 - RNA, 14 nt, Human
aaaguagauuaaga

SEQ ID NO: 2405864 - RNA, 12 nt, Human
aaaguaugaauc

SEQ ID NO: 2405865 - RNA, 21 nt, Human
aaaguauccugcuucugauau

SEQ ID NO: 2405866 - RNA, 14 nt, Human
aaaguguauuuuuu

SEQ ID NO: 2405867 - RNA, 21 nt, Human
aaaguguauuuuuuuacuaau

SEQ ID NO: 2405868 - RNA, 20 nt, Human
aaagugguauagaaaugcug

SEQ ID NO: 2405869 - RNA, 17 nt, Human
aaagugguauagaaaug

SEQ ID NO: 2405870 - RNA, 21 nt, Human
aaaguggguuauucuggaguu

SEQ ID NO: 2405871 - RNA, 16 nt, Human
aaagugguauagaaau

SEQ ID NO: 2405872 - RNA, 15 nt, Human
gguuccagccugcca

SEQ ID NO: 2405873 - RNA, 16 nt, Human
gguuccagccugccac

SEQ ID NO: 2405874 - RNA, 17 nt, Human
gguguuuuaaaaaaucu

SEQ ID NO: 2405875 - RNA, 14 nt, Human
gguuccagccugcc

SEQ ID NO: 2405876 - RNA, 18 nt, Human
gguuccaugccugagggu

SEQ ID NO: 2405877 - RNA, 16 nt, Human
gguuccaugccugagg

SEQ ID NO: 2405878 - RNA, 13 nt, Human
gguucccaagcuc

SEQ ID NO: 2405879 - RNA, 15 nt, Human
gguuccaugccugag

SEQ ID NO: 2405880 - RNA, 14 nt, Human
gguuccaugccuga

SEQ ID NO: 2405881 - RNA, 13 nt, Human
gguuccaugccug

SEQ ID NO: 2405882 - RNA, 17 nt, Human
gguucccauuugcuccu

SEQ ID NO: 2405883 - RNA, 17 nt, Human
gguguuuccuggcacug

SEQ ID NO: 2405884 - RNA, 19 nt, Human
gguguuuccuggcacugcu

SEQ ID NO: 2405885 - RNA, 23 nt, Human
gguguuucucccucucacugucu

SEQ ID NO: 2405886 - RNA, 22 nt, Human
gguguuucucccucucacuguc

SEQ ID NO: 2405887 - RNA, 21 nt, Human
gguguuucuagcacuggccug

SEQ ID NO: 2405888 - RNA, 18 nt, Human
gguguuucuagcacuggc

SEQ ID NO: 2405889 - RNA, 17 nt, Human
gguguuguaugccuuua

SEQ ID NO: 2405890 - RNA, 15 nt, Human
gguguuguaugccuu

SEQ ID NO: 2405891 - RNA, 13 nt, Human
gguguuuauacag

SEQ ID NO: 2405892 - RNA, 22 nt, Human
gguucccuuuuuuggcugcuga

SEQ ID NO: 2405893 - RNA, 21 nt, Human
gguuccgcuuggagcagaggg

SEQ ID NO: 2405894 - RNA, 22 nt, Human
gguuccgcuuggagcagagggg

SEQ ID NO: 2405895 - RNA, 15 nt, Human
gguuccgcuuggagc

SEQ ID NO: 2405896 - RNA, 14 nt, Human
gguucccccagccc

SEQ ID NO: 2405897 - RNA, 15 nt, Human
gguucccccagcccu

SEQ ID NO: 2405898 - RNA, 23 nt, Human
gguucccuuugacgccaucccag

SEQ ID NO: 2405899 - RNA, 16 nt, Human
gguucccaagcucaga

SEQ ID NO: 2405900 - RNA, 12 nt, Human
gguuccccaccg

SEQ ID NO: 2405901 - RNA, 13 nt, Human
gguucccccagcc

SEQ ID NO: 2405902 - RNA, 16 nt, Human
gguucuauuuggaauu

SEQ ID NO: 2405903 - RNA, 13 nt, Human
gguucuauuugga

SEQ ID NO: 2405904 - RNA, 23 nt, Human
gguucuagucuccuuugcacuga

SEQ ID NO: 2405905 - RNA, 23 nt, Human
gguucguggaaagggugcugcuu

SEQ ID NO: 2405906 - RNA, 20 nt, Human
gguucggauuugggguggau

SEQ ID NO: 2405907 - RNA, 23 nt, Human
gguuccgcuuggagcagaggggc

SEQ ID NO: 2405908 - RNA, 21 nt, Human
gguuccggaauccuguccuca

SEQ ID NO: 2405909 - RNA, 14 nt, Human
ggugggcuucccag

SEQ ID NO: 2405910 - RNA, 20 nt, Human
ggugggcuucccaguggcug

SEQ ID NO: 2405911 - RNA, 13 nt, Human
gguggggaauguu

SEQ ID NO: 2405912 - RNA, 16 nt, Human
gguggggcgggaaagc

SEQ ID NO: 2405913 - RNA, 17 nt, Human
gguggggcgggaaagcc

SEQ ID NO: 2405914 - RNA, 13 nt, Human
gguggggcugcuc

SEQ ID NO: 2405915 - RNA, 17 nt, Human
gguggggcugcuccucc

SEQ ID NO: 2405916 - RNA, 18 nt, Human
gguggggcugcuccucca

SEQ ID NO: 2405917 - RNA, 22 nt, Human
gguggggcugcuccuccagggc

SEQ ID NO: 2405918 - RNA, 16 nt, Human
gguggggggcuucaua

SEQ ID NO: 2405919 - RNA, 18 nt, Human
gguggggggcuucauaca

SEQ ID NO: 2405920 - RNA, 13 nt, Human
ggugggggccucg

SEQ ID NO: 2405921 - RNA, 14 nt, Human
gguguggagaagcg

SEQ ID NO: 2405922 - RNA, 23 nt, Human
gguguggagaagcggcuggcagc

SEQ ID NO: 2405923 - RNA, 20 nt, Human
gguggggggaucacaagguc

SEQ ID NO: 2405924 - RNA, 12 nt, Human
gguguggagaag

SEQ ID NO: 2405925 - RNA, 18 nt, Human
gguguggcccugccaucu

SEQ ID NO: 2405926 - RNA, 15 nt, Human
gguguggcccugcca

SEQ ID NO: 2405927 - RNA, 16 nt, Human
gguguggagccgaggc

SEQ ID NO: 2405928 - RNA, 12 nt, Human
gguguggcuccu

SEQ ID NO: 2405929 - RNA, 19 nt, Human
gguguggcccugccaucuu

SEQ ID NO: 2405930 - RNA, 11 nt, Human
gguguggggga

SEQ ID NO: 2405931 - RNA, 13 nt, Human
ggugugggggaag

SEQ ID NO: 2405932 - RNA, 12 nt, Human
ggugugucugcu

SEQ ID NO: 2405933 - RNA, 23 nt, Human
ggugugucccccucuguccaggc

SEQ ID NO: 2405934 - RNA, 15 nt, Human
gguguggugcagugu

SEQ ID NO: 2405935 - RNA, 17 nt, Human
gguguggugcaguguga

SEQ ID NO: 2405936 - RNA, 19 nt, Human
gguguguuccaacugcccc

SEQ ID NO: 2405937 - RNA, 18 nt, Human
gguguguuccaacugccc

SEQ ID NO: 2405938 - RNA, 18 nt, Human
gguguguggagaugcaga

SEQ ID NO: 2405939 - RNA, 14 nt, Human
gguguguguagcca

SEQ ID NO: 2405940 - RNA, 21 nt, Human
gguguuaucaccgugggcucc

SEQ ID NO: 2405941 - RNA, 23 nt, Human
gguguuccgaaaccaaagaagaa

SEQ ID NO: 2405942 - RNA, 22 nt, Human
gguguugccaaauauguccugg

SEQ ID NO: 2405943 - RNA, 21 nt, Human
gguguugccaaauauguccug

SEQ ID NO: 2405944 - RNA, 17 nt, Human
gguguugacaugugcuu

SEQ ID NO: 2405945 - RNA, 16 nt, Human
gcugagaggagagaga

SEQ ID NO: 2405946 - RNA, 22 nt, Human
gcugagaggcagacuucccuga

SEQ ID NO: 2405947 - RNA, 13 nt, Human
gcugagaggggcu

SEQ ID NO: 2405948 - RNA, 21 nt, Human
gcugagccccuaccccacacc

SEQ ID NO: 2405949 - RNA, 20 nt, Human
gcugagccccuaccccacac

SEQ ID NO: 2405950 - RNA, 17 nt, Human
gcugagccccuacccca

SEQ ID NO: 2405951 - RNA, 14 nt, Human
gcugagccccuacc

SEQ ID NO: 2405952 - RNA, 17 nt, Human
gcugagcaccaggggau

SEQ ID NO: 2405953 - RNA, 22 nt, Human
gcugaggccggaugcgguggcu

SEQ ID NO: 2405954 - RNA, 18 nt, Human
gcugagggugagugggug

SEQ ID NO: 2405955 - RNA, 19 nt, Human
gcugaggccacacucagca

SEQ ID NO: 2405956 - RNA, 21 nt, Human
gcugaggccacacucagcaca

SEQ ID NO: 2405957 - RNA, 23 nt, Human
gcugagggugagugggugaauaa

SEQ ID NO: 2405958 - RNA, 14 nt, Human
gcugaggugggagg

SEQ ID NO: 2405959 - RNA, 22 nt, Human
gcugaggccccuucuagguggc

SEQ ID NO: 2405960 - RNA, 17 nt, Human
gcugaggucucuugagg

SEQ ID NO: 2405961 - RNA, 23 nt, Human
gcugaggcagcagugugaggcca

SEQ ID NO: 2405962 - RNA, 16 nt, Human
gcugaggcagaagaau

SEQ ID NO: 2405963 - RNA, 15 nt, Human
gcugaggcaggagga

SEQ ID NO: 2405964 - RNA, 13 nt, Human
gcugaggcagcag

SEQ ID NO: 2405965 - RNA, 13 nt, Human
gcugaggcagaag

SEQ ID NO: 2405966 - RNA, 15 nt, Human
gcugaggcagaagaa

SEQ ID NO: 2405967 - RNA, 15 nt, Human
gcugaggcaauucua

SEQ ID NO: 2405968 - RNA, 13 nt, Human
gcugagccccugu

SEQ ID NO: 2405969 - RNA, 15 nt, Human
gcugagccccugucu

SEQ ID NO: 2405970 - RNA, 22 nt, Human
gcugagccccugucuagagagg

SEQ ID NO: 2405971 - RNA, 23 nt, Human
gcugagccccugucuagagaggg

SEQ ID NO: 2405972 - RNA, 11 nt, Human
gcugagcccug

SEQ ID NO: 2405973 - RNA, 12 nt, Human
gcugagcccugg

SEQ ID NO: 2405974 - RNA, 16 nt, Human
gcugaggagugaggaa

SEQ ID NO: 2405975 - RNA, 21 nt, Human
gcugaggaggccuccaucuca

SEQ ID NO: 2405976 - RNA, 18 nt, Human
gcugaggagugaggaaua

SEQ ID NO: 2405977 - RNA, 18 nt, Human
gcugaggauuucaagccu

SEQ ID NO: 2405978 - RNA, 19 nt, Human
gcugaggauuucaagccug

SEQ ID NO: 2405979 - RNA, 20 nt, Human
gcugaggauuucaagccugc

SEQ ID NO: 2405980 - RNA, 14 nt, Human
gcugaggcaauucu

SEQ ID NO: 2405981 - RNA, 23 nt, Human
gcugcagaggggcaggcccugca

SEQ ID NO: 2405982 - RNA, 22 nt, Human
gcugcagaggggcaggcccugc

SEQ ID NO: 2405983 - RNA, 20 nt, Human
gcugcaccaacccagccgcu

SEQ ID NO: 2405984 - RNA, 21 nt, Human
gcugcagaggggcaggcccug

SEQ ID NO: 2405985 - RNA, 13 nt, Human
gcugcaccggcug

SEQ ID NO: 2405986 - RNA, 18 nt, Human
gcugcacccucaggcagg

SEQ ID NO: 2405987 - RNA, 19 nt, Human
gcugcacccucaggcaggu

SEQ ID NO: 2405988 - RNA, 19 nt, Human
gcugcaccaacccagccgc

SEQ ID NO: 2405989 - RNA, 18 nt, Human
gcugcaccaacccagccg

SEQ ID NO: 2405990 - RNA, 17 nt, Human
gcugcaccaacccagcc

SEQ ID NO: 2405991 - RNA, 16 nt, Human
gcugcaccaacccagc

SEQ ID NO: 2405992 - RNA, 13 nt, Human
gcugcaccaaccc

SEQ ID NO: 2405993 - RNA, 23 nt, Human
gcugcacagggcagcugggccca

SEQ ID NO: 2405994 - RNA, 21 nt, Human
gcugcacagggcagcugggcc

SEQ ID NO: 2405995 - RNA, 20 nt, Human
gcugcacagggcagcugggc

SEQ ID NO: 2405996 - RNA, 19 nt, Human
gcugcacagggcagcuggg

SEQ ID NO: 2405997 - RNA, 18 nt, Human
gcugcacagggcagcugg

SEQ ID NO: 2405998 - RNA, 17 nt, Human
gcugcacagggcagcug

SEQ ID NO: 2405999 - RNA, 22 nt, Human
gcugcaagguggcuccagcacc

SEQ ID NO: 2406000 - RNA, 19 nt, Human
gcugcaaggccuuucugug

SEQ ID NO: 2406001 - RNA, 23 nt, Human
gcugcaagguggcuccagcacca

SEQ ID NO: 2406002 - RNA, 12 nt, Human
gcugcaagguuu

SEQ ID NO: 2406003 - RNA, 19 nt, Human
gcugcaagguuuaggcugg

SEQ ID NO: 2406004 - RNA, 21 nt, Human
gcugcaagguuuaggcuggug

SEQ ID NO: 2406005 - RNA, 20 nt, Human
gcugcaagugacaucucuuu

SEQ ID NO: 2406006 - RNA, 16 nt, Human
gcugcaaggccuuucu

SEQ ID NO: 2406007 - RNA, 14 nt, Human
gcugcaaggccuuu

SEQ ID NO: 2406008 - RNA, 14 nt, Human
gcugccuccacucc

SEQ ID NO: 2406009 - RNA, 12 nt, Human
gcugccuccacu

SEQ ID NO: 2406010 - RNA, 14 nt, Human
gcugccucauuuag

SEQ ID NO: 2406011 - RNA, 21 nt, Human
gcugccucauuuagagaggaa

SEQ ID NO: 2406012 - RNA, 13 nt, Human
gcugccucaugcu

SEQ ID NO: 2406013 - RNA, 18 nt, Human
gcugccuccacucccacu

SEQ ID NO: 2406014 - RNA, 17 nt, Human
gcugccuccacucccac

SEQ ID NO: 2406015 - RNA, 16 nt, Human
gcugccuccacuccca

SEQ ID NO: 2406016 - RNA, 15 nt, Human
gcugccuccacuccc

SEQ ID NO: 2406017 - RNA, 21 nt, Human
gcugccuccacucccacuucc

SEQ ID NO: 2406018 - RNA, 20 nt, Human
gcugccuccacucccacuuc

SEQ ID NO: 2406019 - RNA, 13 nt, Human
gcugccuccccaa

SEQ ID NO: 2406020 - RNA, 21 nt, Human
gcugccuccccucuccuuccu

SEQ ID NO: 2406021 - RNA, 21 nt, Human
gcugccuccccaacccugccc

SEQ ID NO: 2406022 - RNA, 23 nt, Human
gcugccuccccaacccugccccu

SEQ ID NO: 2406023 - RNA, 15 nt, Human
gcugccuccccaacc

SEQ ID NO: 2406024 - RNA, 17 nt, Human
gcugccuccccaacccu

SEQ ID NO: 2406025 - RNA, 19 nt, Human
gcugccuccccaacccugc

SEQ ID NO: 2406026 - RNA, 20 nt, Human
gcugccuccccaacccugcc

SEQ ID NO: 2406027 - RNA, 20 nt, Human
gcugccugggaucccucauc

SEQ ID NO: 2406028 - RNA, 13 nt, Human
gcugccucuucug

SEQ ID NO: 2406029 - RNA, 21 nt, Human
gcugccucuaccugacacucc

SEQ ID NO: 2406030 - RNA, 18 nt, Human
gcugccucucgguggcca

SEQ ID NO: 2406031 - RNA, 16 nt, Human
gcugccucucccauca

SEQ ID NO: 2406032 - RNA, 13 nt, Human
gcugccuguucag

SEQ ID NO: 2406033 - RNA, 12 nt, Human
gcugccuguuca

SEQ ID NO: 2406034 - RNA, 23 nt, Human
gcugcucuugaacuccugaccuc

SEQ ID NO: 2406035 - RNA, 13 nt, Human
gcugccugugugg

SEQ ID NO: 2406036 - RNA, 12 nt, Human
gcugcucuggaa

SEQ ID NO: 2406037 - RNA, 20 nt, Human
gcugccuguaguuaggaaau

SEQ ID NO: 2406038 - RNA, 17 nt, Human
gcugccuguucagcucc

SEQ ID NO: 2406039 - RNA, 21 nt, Human
gcugccugggaucccucaucc

SEQ ID NO: 2406040 - RNA, 13 nt, Human
gcugccugggcug

SEQ ID NO: 2406041 - RNA, 12 nt, Human
gcugccugggcu

SEQ ID NO: 2406042 - RNA, 13 nt, Human
gcugccugcccac

SEQ ID NO: 2406043 - RNA, 19 nt, Human
gcugccugggcuguuggca

SEQ ID NO: 2406044 - RNA, 18 nt, Human
gcugccugggcuguuggc

SEQ ID NO: 2406045 - RNA, 16 nt, Human
gcugccugggcuguug

SEQ ID NO: 2406046 - RNA, 14 nt, Human
gcugccugggcugu

SEQ ID NO: 2406047 - RNA, 23 nt, Human
gcugccugggcuguuggcacuca

SEQ ID NO: 2406048 - RNA, 22 nt, Human
gcugccugggcuguuggcacuc

SEQ ID NO: 2406049 - RNA, 12 nt, Human
gcugccuguagu

SEQ ID NO: 2406050 - RNA, 13 nt, Human
gcugccuguaguu

SEQ ID NO: 2406051 - RNA, 15 nt, Human
gcugccuguaguuag

SEQ ID NO: 2406052 - RNA, 16 nt, Human
gcugccuguaguuagg

SEQ ID NO: 2406053 - RNA, 19 nt, Human
gcugccuguaguuaggaaa

SEQ ID NO: 2406054 - RNA, 12 nt, Human
gcugccucacuu

SEQ ID NO: 2406055 - RNA, 19 nt, Human
gcugcccuccaucccgaca

SEQ ID NO: 2406056 - RNA, 21 nt, Human
gcugcccuccaucccgacaug

SEQ ID NO: 2406057 - RNA, 14 nt, Human
gcugcccuccaucc

SEQ ID NO: 2406058 - RNA, 16 nt, Human
gcugcccuaggcuccg

SEQ ID NO: 2406059 - RNA, 15 nt, Human
gcugcccuccauccc

SEQ ID NO: 2406060 - RNA, 15 nt, Human
gcugcccuaggcucc

SEQ ID NO: 2406061 - RNA, 21 nt, Human
gcugcccgucuucagccuagc

SEQ ID NO: 2406062 - RNA, 19 nt, Human
gcugcccggcgcccucugu

SEQ ID NO: 2406063 - RNA, 18 nt, Human
gcugcccggcgcccucug

SEQ ID NO: 2406064 - RNA, 17 nt, Human
gcugcccggcgcccucu

SEQ ID NO: 2406065 - RNA, 20 nt, Human
gcugcccgcucccagugucu

SEQ ID NO: 2406066 - RNA, 19 nt, Human
gcugcccgcucccaguguc

SEQ ID NO: 2406067 - RNA, 16 nt, Human
gcugcccgcucccagu

SEQ ID NO: 2406068 - RNA, 15 nt, Human
gcugcccgcucccag

SEQ ID NO: 2406069 - RNA, 14 nt, Human
gcugcccgcuccca

SEQ ID NO: 2406070 - RNA, 23 nt, Human
gcugcccggcgcccucuguccug

SEQ ID NO: 2406071 - RNA, 20 nt, Human
gcugcccggcgcccucuguc

SEQ ID NO: 2406072 - RNA, 16 nt, Human
gcugcccgucuucagc

SEQ ID NO: 2406073 - RNA, 19 nt, Human
gcugcccgucuucagccua

SEQ ID NO: 2406074 - RNA, 20 nt, Human
gcugcccgucuucagccuag

SEQ ID NO: 2406075 - RNA, 19 nt, Human
gcugccccuggcagccccu

SEQ ID NO: 2406076 - RNA, 18 nt, Human
gcugccccuggcagcccc

SEQ ID NO: 2406077 - RNA, 20 nt, Human
gcugccccuggcagccccug

SEQ ID NO: 2406078 - RNA, 12 nt, Human
gcugcccgcucc

SEQ ID NO: 2406079 - RNA, 13 nt, Human
gcugcccgcuccc

SEQ ID NO: 2406080 - RNA, 17 nt, Human
gcugccccuggcucuga

SEQ ID NO: 2406081 - RNA, 21 nt, Human
gcugcagcagcgguggccucu

SEQ ID NO: 2406082 - RNA, 20 nt, Human
gcugcagcagcgguggccuc

SEQ ID NO: 2406083 - RNA, 12 nt, Human
gcugcagcagcg

SEQ ID NO: 2406084 - RNA, 18 nt, Human
gcugcagcagaggcacug

SEQ ID NO: 2406085 - RNA, 15 nt, Human
gcugcagccaggcca

SEQ ID NO: 2406086 - RNA, 16 nt, Human
gcugcagcagaggcac

SEQ ID NO: 2406087 - RNA, 14 nt, Human
gcugcagcagaggc

SEQ ID NO: 2406088 - RNA, 21 nt, Human
gcugcagauuugggcuggaac

SEQ ID NO: 2406089 - RNA, 18 nt, Human
gcugcagauuugggcugg

SEQ ID NO: 2406090 - RNA, 17 nt, Human
gcugcagauuugggcug

SEQ ID NO: 2406091 - RNA, 15 nt, Human
gcugcccccaccccg

SEQ ID NO: 2406092 - RNA, 22 nt, Human
gcugcagcauguugcugaggag

SEQ ID NO: 2406093 - RNA, 12 nt, Human
gcugcagcaugu

SEQ ID NO: 2406094 - RNA, 23 nt, Human
gcugcagccaggccacuggcccc

SEQ ID NO: 2406095 - RNA, 22 nt, Human
gcugccccucaucucucugccc

SEQ ID NO: 2406096 - RNA, 23 nt, Human
gcugcccccggcccccuggucuc

SEQ ID NO: 2406097 - RNA, 20 nt, Human
gcugcccccggcccccuggu

SEQ ID NO: 2406098 - RNA, 20 nt, Human
gcugcccccaccccggggac

SEQ ID NO: 2406099 - RNA, 19 nt, Human
gcugcccccggcccccugg

SEQ ID NO: 2406100 - RNA, 18 nt, Human
gcugcccccggcccccug

SEQ ID NO: 2406101 - RNA, 14 nt, Human
gcugcccccggccc

SEQ ID NO: 2406102 - RNA, 19 nt, Human
gcugguaggcuccugccag

SEQ ID NO: 2406103 - RNA, 19 nt, Human
gcugguaggcauuccagcu

SEQ ID NO: 2406104 - RNA, 13 nt, Human
gcugguaguuagu

SEQ ID NO: 2406105 - RNA, 16 nt, Human
gcuggguuggugcaca

SEQ ID NO: 2406106 - RNA, 19 nt, Human
gcugguagcucaggugggc

SEQ ID NO: 2406107 - RNA, 16 nt, Human
gcugguagcucaggug

SEQ ID NO: 2406108 - RNA, 15 nt, Human
gcugguagcucaggu

SEQ ID NO: 2406109 - RNA, 14 nt, Human
gcugguagcucagg

SEQ ID NO: 2406110 - RNA, 13 nt, Human
gcugguagcucag

SEQ ID NO: 2406111 - RNA, 21 nt, Human
gcugguagagauggaggagga

SEQ ID NO: 2406112 - RNA, 23 nt, Human
gcugguagagauggaggaggagg

SEQ ID NO: 2406113 - RNA, 17 nt, Human
gcuggguucuacccagg

SEQ ID NO: 2406114 - RNA, 18 nt, Human
gcuggguucuacccaggu

SEQ ID NO: 2406115 - RNA, 23 nt, Human
gcugggguggggaccucaggccu

SEQ ID NO: 2406116 - RNA, 22 nt, Human
gcugggguggggaccucaggcc

SEQ ID NO: 2406117 - RNA, 21 nt, Human
gcuggguucuacccaggugcu

SEQ ID NO: 2406118 - RNA, 20 nt, Human
gcuggguucuacccaggugc

SEQ ID NO: 2406119 - RNA, 17 nt, Human
gcuggguuggugcacag

SEQ ID NO: 2406120 - RNA, 13 nt, Human
gcugguaacaguu

SEQ ID NO: 2406121 - RNA, 15 nt, Human
gcugguaaacuauuu

SEQ ID NO: 2406122 - RNA, 14 nt, Human
gcugguaaacuauu

SEQ ID NO: 2406123 - RNA, 22 nt, Human
gcugguaacaguucauguuugc

SEQ ID NO: 2406124 - RNA, 16 nt, Human
gcugguaacaguucau

SEQ ID NO: 2406125 - RNA, 23 nt, Human
gcugguaauuuguaucugaagga

SEQ ID NO: 2406126 - RNA, 14 nt, Human
gcugguagagaugg

SEQ ID NO: 2406127 - RNA, 15 nt, Human
gcugguagagaugga

SEQ ID NO: 2406128 - RNA, 17 nt, Human
gcugguagagauggagg

SEQ ID NO: 2406129 - RNA, 18 nt, Human
gcugguagagauggagga

SEQ ID NO: 2406130 - RNA, 19 nt, Human
gcugggguggggaccucag

SEQ ID NO: 2406131 - RNA, 17 nt, Human
gcugggguggggaccuc

SEQ ID NO: 2406132 - RNA, 24 nt, Human
gcugggccccagcccacccuccug

SEQ ID NO: 2406133 - RNA, 20 nt, Human
gcugggccccugccucucug

SEQ ID NO: 2406134 - RNA, 18 nt, Human
gcugggccccugccucuc

SEQ ID NO: 2406135 - RNA, 14 nt, Human
gcugggccccugcc

SEQ ID NO: 2406136 - RNA, 13 nt, Human
gcugggccccugc

SEQ ID NO: 2406137 - RNA, 12 nt, Human
gcugggccccug

SEQ ID NO: 2406138 - RNA, 21 nt, Human
gcugggccccagcccacccuc

SEQ ID NO: 2406139 - RNA, 20 nt, Human
gcugggccccagcccacccu

SEQ ID NO: 2406140 - RNA, 19 nt, Human
gcugggccccagcccaccc

SEQ ID NO: 2406141 - RNA, 17 nt, Human
gcugggccccagcccac

SEQ ID NO: 2406142 - RNA, 16 nt, Human
gcugggccccagccca

SEQ ID NO: 2406143 - RNA, 15 nt, Human
gcugggccccagccc

SEQ ID NO: 2406144 - RNA, 14 nt, Human
gcugggccccagcc

SEQ ID NO: 2406145 - RNA, 23 nt, Human
gcuggcuguuggcugggggccuc

SEQ ID NO: 2406146 - RNA, 20 nt, Human
gcuggcuguuggcugggggc

SEQ ID NO: 2406147 - RNA, 15 nt, Human
gcugggaacugcaga

SEQ ID NO: 2406148 - RNA, 23 nt, Human
gcugggaacucaccuggggcugc

SEQ ID NO: 2406149 - RNA, 21 nt, Human
gcugggaacucaccuggggcu

SEQ ID NO: 2406150 - RNA, 18 nt, Human
gcugggaacucaccuggg

SEQ ID NO: 2406151 - RNA, 16 nt, Human
gcugggaacucaccug

SEQ ID NO: 2406152 - RNA, 19 nt, Human
gcuggcugcccagaccccu

SEQ ID NO: 2406153 - RNA, 14 nt, Human
gcugggcaguuuuu

SEQ ID NO: 2406154 - RNA, 19 nt, Human
gcugggaacugcagaccug

SEQ ID NO: 2406155 - RNA, 20 nt, Human
gcugggaauaagugccagga

SEQ ID NO: 2406156 - RNA, 14 nt, Human
gcugggcagguugg

SEQ ID NO: 2406157 - RNA, 19 nt, Human
gcugggcaguuuuucugua

SEQ ID NO: 2406158 - RNA, 20 nt, Human
gcugggcccaacccugucug

SEQ ID NO: 2406159 - RNA, 19 nt, Human
gcugggcccaacccugucu

SEQ ID NO: 2406160 - RNA, 14 nt, Human
gcugggcccagaag

SEQ ID NO: 2406161 - RNA, 13 nt, Human
gcugggccccagc

SEQ ID NO: 2406162 - RNA, 11 nt, Human
gcuggcugccu

SEQ ID NO: 2406163 - RNA, 13 nt, Human
gcuggcugcagug

SEQ ID NO: 2406164 - RNA, 14 nt, Human
gcuggcugcaguga

SEQ ID NO: 2406165 - RNA, 20 nt, Human
gcuggcugccuuagaaccuu

SEQ ID NO: 2406166 - RNA, 14 nt, Human
gcuggcugccuuag

SEQ ID NO: 2406167 - RNA, 19 nt, Human
gcuggcuguuggcuggggg

SEQ ID NO: 2406168 - RNA, 18 nt, Human
gcuggcuguuggcugggg

SEQ ID NO: 2406169 - RNA, 13 nt, Human
gcuggcucugagc

SEQ ID NO: 2406170 - RNA, 21 nt, Human
gcuggagacuccuaggcagga

SEQ ID NO: 2406171 - RNA, 20 nt, Human
gcuggcggcuacucagcagc

SEQ ID NO: 2406172 - RNA, 16 nt, Human
gcuggcucugagcgcc

SEQ ID NO: 2406173 - RNA, 13 nt, Human
gcuggcucuucug

SEQ ID NO: 2406174 - RNA, 18 nt, Human
gcuggcucuucugcccaa

SEQ ID NO: 2406175 - RNA, 16 nt, Human
gcuggcucuucugccc

SEQ ID NO: 2406176 - RNA, 14 nt, Human
gcuggcucuucugc

SEQ ID NO: 2406177 - RNA, 21 nt, Human
gcuggcggcuacucagcagcc

SEQ ID NO: 2406178 - RNA, 18 nt, Human
gcuggcgugcaguggugc

SEQ ID NO: 2406179 - RNA, 15 nt, Human
gcuggcgugcagugg

SEQ ID NO: 2406180 - RNA, 20 nt, Human
gcuggagaccaugcagagcg

SEQ ID NO: 2406181 - RNA, 17 nt, Human
gcuggagaccaugcaga

SEQ ID NO: 2406182 - RNA, 15 nt, Human
gcuggagaccaugca

SEQ ID NO: 2406183 - RNA, 16 nt, Human
gcuggagaagcucacc

SEQ ID NO: 2406184 - RNA, 12 nt, Human
gcuggagaagcu

SEQ ID NO: 2406185 - RNA, 21 nt, Human
gcuggagaagagaggagagga

SEQ ID NO: 2406186 - RNA, 20 nt, Human
gcuggagaagagaggagagg

SEQ ID NO: 2406187 - RNA, 18 nt, Human
gcuggagaagagaggaga

SEQ ID NO: 2406188 - RNA, 17 nt, Human
gcuggagaagagaggag

SEQ ID NO: 2406189 - RNA, 16 nt, Human
gcuggagaagagagga

SEQ ID NO: 2406190 - RNA, 15 nt, Human
gcuggagaagagagg

SEQ ID NO: 2406191 - RNA, 14 nt, Human
gcuggagaagagag

SEQ ID NO: 2406192 - RNA, 13 nt, Human
gcuggagaagaga

SEQ ID NO: 2406193 - RNA, 12 nt, Human
gcuggagaagag

SEQ ID NO: 2406194 - RNA, 13 nt, Human
gcuggagacuccu

SEQ ID NO: 2406195 - RNA, 18 nt, Human
gcuggagacgggugggcg

SEQ ID NO: 2406196 - RNA, 22 nt, Human
gcuggagaccaugcagagcgcc

SEQ ID NO: 2406197 - RNA, 21 nt, Human
gcuggagaccaugcagagcgc

SEQ ID NO: 2406198 - RNA, 20 nt, Human
gcuggagacuccuaggcagg

SEQ ID NO: 2406199 - RNA, 18 nt, Human
gcuggagacuccuaggca

SEQ ID NO: 2406200 - RNA, 14 nt, Human
gcuggcgugcagug

SEQ ID NO: 2406201 - RNA, 13 nt, Human
gcuggacuuggag

SEQ ID NO: 2406202 - RNA, 20 nt, Human
gcugcugaagcugccugcuu

SEQ ID NO: 2406203 - RNA, 16 nt, Human
gcugcugaagcugccu

SEQ ID NO: 2406204 - RNA, 13 nt, Human
gcugcugaagcug

SEQ ID NO: 2406205 - RNA, 15 nt, Human
gcugcugaagaugaa

SEQ ID NO: 2406206 - RNA, 23 nt, Human
gcugcugaagcugccugcuuuuc

SEQ ID NO: 2406207 - RNA, 12 nt, Human
gcugcugaaggc

SEQ ID NO: 2406208 - RNA, 13 nt, Human
gcugcugaaacaa

SEQ ID NO: 2406209 - RNA, 18 nt, Human
gcugcucuggaauuugca

SEQ ID NO: 2406210 - RNA, 14 nt, Human
gcugcucuggaaaa

SEQ ID NO: 2406211 - RNA, 19 nt, Human
gcuguaucccaugagccuc

SEQ ID NO: 2406212 - RNA, 17 nt, Human
gcuguaucccaugagcc

SEQ ID NO: 2406213 - RNA, 18 nt, Human
gcuguauaaaaucagcca

SEQ ID NO: 2406214 - RNA, 14 nt, Human
gcuguauaaaauca

SEQ ID NO: 2406215 - RNA, 21 nt, Human
gcuguaguagcccuuucugug

SEQ ID NO: 2406216 - RNA, 20 nt, Human
gcuguaguccucauaaaaag

SEQ ID NO: 2406217 - RNA, 20 nt, Human
gcuguaguagcccuuucugu

SEQ ID NO: 2406218 - RNA, 13 nt, Human
gcuguaggugugc

SEQ ID NO: 2406219 - RNA, 20 nt, Human
gcuguaggacucgcagucag

SEQ ID NO: 2406220 - RNA, 18 nt, Human
gcuguauuuuaaaagaau

SEQ ID NO: 2406221 - RNA, 20 nt, Human
gcuguauuuuaaaagaauga

SEQ ID NO: 2406222 - RNA, 21 nt, Human
gcuguauuuuaaaagaaugau

SEQ ID NO: 2406223 - RNA, 22 nt, Human
gcuguauaaaaucagccaauua

SEQ ID NO: 2406224 - RNA, 20 nt, Human
gcuguauaaaaucagccaau

SEQ ID NO: 2406225 - RNA, 14 nt, Human
gcugugagccuugg

SEQ ID NO: 2406226 - RNA, 17 nt, Human
gcugugaggcuguccug

SEQ ID NO: 2406227 - RNA, 16 nt, Human
gcugugaggcuguccu

SEQ ID NO: 2406228 - RNA, 15 nt, Human
gcugugaggcugucc

SEQ ID NO: 2406229 - RNA, 14 nt, Human
gcugugaggcuguc

SEQ ID NO: 2406230 - RNA, 22 nt, Human
gcugugaggccccuggacaagc

SEQ ID NO: 2406231 - RNA, 18 nt, Human
gcugugaggccccuggac

SEQ ID NO: 2406232 - RNA, 16 nt, Human
gcugugaggccccugg

SEQ ID NO: 2406233 - RNA, 17 nt, Human
gcugugagccuuggcug

SEQ ID NO: 2406234 - RNA, 13 nt, Human
gcugugaggcugu

SEQ ID NO: 2406235 - RNA, 12 nt, Human
gcugugaggcug

SEQ ID NO: 2406236 - RNA, 18 nt, Human
gcugugaggcuguccugu

SEQ ID NO: 2406237 - RNA, 18 nt, Human
gcugugaguguaagugug

SEQ ID NO: 2406238 - RNA, 22 nt, Human
gcugugaguguaagugugagua

SEQ ID NO: 2406239 - RNA, 21 nt, Human
gcuguuuaaauguuuuucuau

SEQ ID NO: 2406240 - RNA, 20 nt, Human
gcuguuggcugggggccuca

SEQ ID NO: 2406241 - RNA, 16 nt, Human
gcuguuggcugggggc

SEQ ID NO: 2406242 - RNA, 16 nt, Human
gcugugcugcccugcc

SEQ ID NO: 2406243 - RNA, 15 nt, Human
gcugugcugcccugc

SEQ ID NO: 2406244 - RNA, 17 nt, Human
gcugugcugcccugccc

SEQ ID NO: 2406245 - RNA, 15 nt, Human
gcuguuggcuggggg

SEQ ID NO: 2406246 - RNA, 16 nt, Human
gcugugcucuggacag

SEQ ID NO: 2406247 - RNA, 15 nt, Human
gcugugcucuggaca

SEQ ID NO: 2406248 - RNA, 14 nt, Human
gcugugcugcccug

SEQ ID NO: 2406249 - RNA, 18 nt, Human
gcugugcggaucucugga

SEQ ID NO: 2406250 - RNA, 18 nt, Human
gcugugcucuggacaggc

SEQ ID NO: 2406251 - RNA, 13 nt, Human
gcugugcucugga

SEQ ID NO: 2406252 - RNA, 16 nt, Human
gcugugcggaucucug

SEQ ID NO: 2406253 - RNA, 14 nt, Human
gcugugcuaugaau

SEQ ID NO: 2406254 - RNA, 15 nt, Human
gcugugcuaugaauu

SEQ ID NO: 2406255 - RNA, 16 nt, Human
gcugugcuaugaauuu

SEQ ID NO: 2406256 - RNA, 15 nt, Human
gcugugccucugccu

SEQ ID NO: 2406257 - RNA, 14 nt, Human
gcugugccucugcc

SEQ ID NO: 2406258 - RNA, 16 nt, Human
gcugugccucugccug

SEQ ID NO: 2406259 - RNA, 21 nt, Human
gcugugcgcugacaaccaccg

SEQ ID NO: 2406260 - RNA, 21 nt, Human
ggaagccagcaggcucucagg

SEQ ID NO: 2406261 - RNA, 23 nt, Human
ggaagccagcaggcucucaggcc

SEQ ID NO: 2406262 - RNA, 22 nt, Human
ggaagccagcaggcucucaggc

SEQ ID NO: 2406263 - RNA, 18 nt, Human
ggaagccgcuggggccag

SEQ ID NO: 2406264 - RNA, 20 nt, Human
ggaagccggaggguguuuau

SEQ ID NO: 2406265 - RNA, 16 nt, Human
ggaagccagcuuuccc

SEQ ID NO: 2406266 - RNA, 19 nt, Human
ggaaaucaggguuaguauu

SEQ ID NO: 2406267 - RNA, 23 nt, Human
ggaaaucaccgaaaacguggcug

SEQ ID NO: 2406268 - RNA, 16 nt, Human
ggaaauccaggguggu

SEQ ID NO: 2406269 - RNA, 20 nt, Human
ggaaaggccagcuggcagca

SEQ ID NO: 2406270 - RNA, 22 nt, Human
ggaaaggccagcuggcagcaga

SEQ ID NO: 2406271 - RNA, 12 nt, Human
ggaaaggcucag

SEQ ID NO: 2406272 - RNA, 18 nt, Human
ggaaaucucaccccaucc

SEQ ID NO: 2406273 - RNA, 19 nt, Human
ggacaugcgguagccagca

SEQ ID NO: 2406274 - RNA, 21 nt, Human
ggacaugcgguagccagcaca

SEQ ID NO: 2406275 - RNA, 19 nt, Human
ggacaugcugaagccaaag

SEQ ID NO: 2406276 - RNA, 16 nt, Human
ggacaugcugaagcca

SEQ ID NO: 2406277 - RNA, 15 nt, Human
ggacaucucuuugaa

SEQ ID NO: 2406278 - RNA, 16 nt, Human
ggacaugcgguagcca

SEQ ID NO: 2406279 - RNA, 16 nt, Human
ggacauccuccuccca

SEQ ID NO: 2406280 - RNA, 14 nt, Human
ggacauccucuucu

SEQ ID NO: 2406281 - RNA, 13 nt, Human
ggacauggacaag

SEQ ID NO: 2406282 - RNA, 14 nt, Human
ggacauauucauuu

SEQ ID NO: 2406283 - RNA, 13 nt, Human
ggacauccuccuc

SEQ ID NO: 2406284 - RNA, 22 nt, Human
ggacauagagagggagaagaag

SEQ ID NO: 2406285 - RNA, 14 nt, Human
ggacaucagcuggu

SEQ ID NO: 2406286 - RNA, 20 nt, Human
ggacauccccccgccaaaag

SEQ ID NO: 2406287 - RNA, 19 nt, Human
ggacauaaugggguccugg

SEQ ID NO: 2406288 - RNA, 23 nt, Human
ggacauaaugggguccuggccau

SEQ ID NO: 2406289 - RNA, 20 nt, Human
ggacauagagagggagaaga

SEQ ID NO: 2406290 - RNA, 15 nt, Human
ggacauagagaggga

SEQ ID NO: 2406291 - RNA, 18 nt, Human
ggacauagcgaauacaaa

SEQ ID NO: 2406292 - RNA, 22 nt, Human
ggacaguugcuuuucagcaugg

SEQ ID NO: 2406293 - RNA, 14 nt, Human
ggacagugcuucag

SEQ ID NO: 2406294 - RNA, 19 nt, Human
ggacaguccugggagaacc

SEQ ID NO: 2406295 - RNA, 16 nt, Human
ggacagugcuucagcc

SEQ ID NO: 2406296 - RNA, 17 nt, Human
ggacagugcuucagccu

SEQ ID NO: 2406297 - RNA, 13 nt, Human
ggacaguccuggg

SEQ ID NO: 2406298 - RNA, 14 nt, Human
ggacaguccuggga

SEQ ID NO: 2406299 - RNA, 15 nt, Human
ggacaguccugggag

SEQ ID NO: 2406300 - RNA, 16 nt, Human
ggacaguccugggaga

SEQ ID NO: 2406301 - RNA, 18 nt, Human
ggacagugcuucagccug

SEQ ID NO: 2406302 - RNA, 19 nt, Human
ggacagugcuucagccuga

SEQ ID NO: 2406303 - RNA, 20 nt, Human
ggacagugcuucagccugag

SEQ ID NO: 2406304 - RNA, 21 nt, Human
ggacagugcuucagccugagg

SEQ ID NO: 2406305 - RNA, 22 nt, Human
ggacagugcuucagccugaggc

SEQ ID NO: 2406306 - RNA, 23 nt, Human
ggacagugcuucagccugaggcu

SEQ ID NO: 2406307 - RNA, 18 nt, Human
ggacagucaccucaugga

SEQ ID NO: 2406308 - RNA, 17 nt, Human
ggacagucaccucaugg

SEQ ID NO: 2406309 - RNA, 21 nt, Human
ggacagucaccucauggaauu

SEQ ID NO: 2406310 - RNA, 19 nt, Human
ggacaguauuuguggggag

SEQ ID NO: 2406311 - RNA, 14 nt, Human
ggacagggucccug

SEQ ID NO: 2406312 - RNA, 18 nt, Human
ggacagggcuggcccagc

SEQ ID NO: 2406313 - RNA, 16 nt, Human
ggacagggcuggccca

SEQ ID NO: 2406314 - RNA, 15 nt, Human
ggacagggcuggccc

SEQ ID NO: 2406315 - RNA, 22 nt, Human
ggacagggaugagcauggagcu

SEQ ID NO: 2406316 - RNA, 22 nt, Human
ggacagggcauggccagguggc

SEQ ID NO: 2406317 - RNA, 15 nt, Human
ggacaggcuggcucc

SEQ ID NO: 2406318 - RNA, 23 nt, Human
ggacaggcuggcuccagaugcag

SEQ ID NO: 2406319 - RNA, 15 nt, Human
ggacagggcauggcc

SEQ ID NO: 2406320 - RNA, 23 nt, Human
ggacagggcuggcccagcccugc

SEQ ID NO: 2406321 - RNA, 22 nt, Human
ggacagggcuggcccagcccug

SEQ ID NO: 2406322 - RNA, 21 nt, Human
ggacagggcuggcccagcccu

SEQ ID NO: 2406323 - RNA, 20 nt, Human
ggacagggcuggcccagccc

SEQ ID NO: 2406324 - RNA, 17 nt, Human
ggacaggggcaggagga

SEQ ID NO: 2406325 - RNA, 18 nt, Human
ggacaguauuugugggga

SEQ ID NO: 2406326 - RNA, 20 nt, Human
ggacaggugugccgacagaa

SEQ ID NO: 2406327 - RNA, 17 nt, Human
ggacagggaggugaccc

SEQ ID NO: 2406328 - RNA, 13 nt, Human
ggacaggcuggcu

SEQ ID NO: 2406329 - RNA, 22 nt, Human
ggacaggcccggcgcgguggcu

SEQ ID NO: 2406330 - RNA, 14 nt, Human
ggacaccugcccug

SEQ ID NO: 2406331 - RNA, 15 nt, Human
ggacaccugcccugc

SEQ ID NO: 2406332 - RNA, 23 nt, Human
ggacaggcauguucucugaggac

SEQ ID NO: 2406333 - RNA, 21 nt, Human
ggacaccccuuauccaggacu

SEQ ID NO: 2406334 - RNA, 11 nt, Human
ggacaggcccg

SEQ ID NO: 2406335 - RNA, 23 nt, Human
ggacacccugugauggggcccug

SEQ ID NO: 2406336 - RNA, 13 nt, Human
ggacacccuguga

SEQ ID NO: 2406337 - RNA, 15 nt, Human
ggacaccgggccagu

SEQ ID NO: 2406338 - RNA, 20 nt, Human
ggacaccccuuauccaggac

SEQ ID NO: 2406339 - RNA, 19 nt, Human
ggacaccccuuauccagga

SEQ ID NO: 2406340 - RNA, 15 nt, Human
ggacacccccucgcu

SEQ ID NO: 2406341 - RNA, 17 nt, Human
ggaauaugggagaaaua

SEQ ID NO: 2406342 - RNA, 13 nt, Human
ggaauaguuuuuu

SEQ ID NO: 2406343 - RNA, 13 nt, Human
ggaauaugagcuu

SEQ ID NO: 2406344 - RNA, 14 nt, Human
ggaauauuugaauc

SEQ ID NO: 2406345 - RNA, 13 nt, Human
ggaauauuugaau

SEQ ID NO: 2406346 - RNA, 11 nt, Human
ggaauauuuga

SEQ ID NO: 2406347 - RNA, 22 nt, Human
ggaauauuccccuaucucuaga

SEQ ID NO: 2406348 - RNA, 16 nt, Human
ggaauauauaaccagu

SEQ ID NO: 2406349 - RNA, 16 nt, Human
ggaauaguugagcccc

SEQ ID NO: 2406350 - RNA, 22 nt, Human
ggaauaguauccuccagguuuu

SEQ ID NO: 2406351 - RNA, 21 nt, Human
ggaauaguauccuccagguuu

SEQ ID NO: 2406352 - RNA, 20 nt, Human
ggaauaguauccuccagguu

SEQ ID NO: 2406353 - RNA, 20 nt, Human
ggaauaguugagccccaagu

SEQ ID NO: 2406354 - RNA, 17 nt, Human
ggaauaguugagcccca

SEQ ID NO: 2406355 - RNA, 23 nt, Human
ggaauauaaggaaagcaauaaau

SEQ ID NO: 2406356 - RNA, 19 nt, Human
ggaauaccugucccccuga

SEQ ID NO: 2406357 - RNA, 16 nt, Human
ggaauaccuguccccc

SEQ ID NO: 2406358 - RNA, 12 nt, Human
ggaauacuuuuu

SEQ ID NO: 2406359 - RNA, 18 nt, Human
ggaauacuagggagaagg

SEQ ID NO: 2406360 - RNA, 12 nt, Human
ggaauacagugu

SEQ ID NO: 2406361 - RNA, 17 nt, Human
ggaauacuuuuuguuau

SEQ ID NO: 2406362 - RNA, 19 nt, Human
ggaauaguauccuccaggu

SEQ ID NO: 2406363 - RNA, 18 nt, Human
ggaauaguauccuccagg

SEQ ID NO: 2406364 - RNA, 17 nt, Human
ggaauaguauccuccag

SEQ ID NO: 2406365 - RNA, 21 nt, Human
ggaagcucagggccuggcuca

SEQ ID NO: 2406366 - RNA, 22 nt, Human
ggaagcucagggccuggcucag

SEQ ID NO: 2406367 - RNA, 20 nt, Human
ggaagcgcgagggccucaaa

SEQ ID NO: 2406368 - RNA, 20 nt, Human
ggaagcggagguugcaggga

SEQ ID NO: 2406369 - RNA, 15 nt, Human
ggaauaccugucccc

SEQ ID NO: 2406370 - RNA, 15 nt, Human
ggaauacaauguaau

SEQ ID NO: 2406371 - RNA, 13 nt, Human
ggaauaauuauuu

SEQ ID NO: 2406372 - RNA, 21 nt, Human
ggaauaauuauuuauuuaaua

SEQ ID NO: 2406373 - RNA, 22 nt, Human
ggaauaaugggcuuagagcagu

SEQ ID NO: 2406374 - RNA, 15 nt, Human
ggaauaauagaagaa

SEQ ID NO: 2406375 - RNA, 17 nt, Human
ggaagcucagggccugg

SEQ ID NO: 2406376 - RNA, 16 nt, Human
ggaagcucagggccug

SEQ ID NO: 2406377 - RNA, 20 nt, Human
ggaagccgugcucgccccag

SEQ ID NO: 2406378 - RNA, 20 nt, Human
ggaagccggcggcccaagcc

SEQ ID NO: 2406379 - RNA, 16 nt, Human
ggaagccggcggccca

SEQ ID NO: 2406380 - RNA, 16 nt, Human
ggaagccgugcccugc

SEQ ID NO: 2406381 - RNA, 14 nt, Human
ggaagccugcaguc

SEQ ID NO: 2406382 - RNA, 23 nt, Human
ggaagcgaugaauuuggagacuc

SEQ ID NO: 2406383 - RNA, 19 nt, Human
ggaaugaaugucaguguga

SEQ ID NO: 2406384 - RNA, 16 nt, Human
ggaaugaagcuugugu

SEQ ID NO: 2406385 - RNA, 15 nt, Human
ggaaugaagcuugug

SEQ ID NO: 2406386 - RNA, 12 nt, Human
ggaaugaagcuu

SEQ ID NO: 2406387 - RNA, 15 nt, Human
ggaaucacucuugug

SEQ ID NO: 2406388 - RNA, 18 nt, Human
ggaaugaagcaaugcuuc

SEQ ID NO: 2406389 - RNA, 23 nt, Human
ggaaucaagagcugcccuccuug

SEQ ID NO: 2406390 - RNA, 19 nt, Human
ggaaucaagagcugcccuc

SEQ ID NO: 2406391 - RNA, 17 nt, Human
ggaaucaagagcugccc

SEQ ID NO: 2406392 - RNA, 12 nt, Human
ggaaucaagauu

SEQ ID NO: 2406393 - RNA, 22 nt, Human
ggaaucaagaugucagacuggc

SEQ ID NO: 2406394 - RNA, 20 nt, Human
ggaauauuugaaucuugucu

SEQ ID NO: 2406395 - RNA, 15 nt, Human
ggaauauuugaaucu

SEQ ID NO: 2406396 - RNA, 16 nt, Human
ggaaucaagagcugcc

SEQ ID NO: 2406397 - RNA, 12 nt, Human
ggacacagcucu

SEQ ID NO: 2406398 - RNA, 13 nt, Human
ggacacacaaggu

SEQ ID NO: 2406399 - RNA, 20 nt, Human
ggaaugaggcuugcugagag

SEQ ID NO: 2406400 - RNA, 21 nt, Human
ggacacacaaggugcaaauca

SEQ ID NO: 2406401 - RNA, 21 nt, Human
ggaaugaggugggagguggaa

SEQ ID NO: 2406402 - RNA, 16 nt, Human
ggacaauucaugaacu

SEQ ID NO: 2406403 - RNA, 21 nt, Human
ggaaugaggcuugcugagagg

SEQ ID NO: 2406404 - RNA, 18 nt, Human
ggaaugaagcuuguguau

SEQ ID NO: 2406405 - RNA, 19 nt, Human
ggacaccagccaggcucug

SEQ ID NO: 2406406 - RNA, 18 nt, Human
ggacaccagccaggcucu

SEQ ID NO: 2406407 - RNA, 17 nt, Human
ggacaccagccaggcuc

SEQ ID NO: 2406408 - RNA, 16 nt, Human
ggacaccagccaggcu

SEQ ID NO: 2406409 - RNA, 14 nt, Human
ggacaccagccagg

SEQ ID NO: 2406410 - RNA, 13 nt, Human
ggacaccagccag

SEQ ID NO: 2406411 - RNA, 22 nt, Human
ggacaccacacccagccucagu

SEQ ID NO: 2406412 - RNA, 21 nt, Human
ggacaccacacccagccucag

SEQ ID NO: 2406413 - RNA, 20 nt, Human
ggacaccacacccagccuca

SEQ ID NO: 2406414 - RNA, 19 nt, Human
ggacaccacacccagccuc

SEQ ID NO: 2406415 - RNA, 18 nt, Human
ggacaccacacccagccu

SEQ ID NO: 2406416 - RNA, 17 nt, Human
ggacaccacacccagcc

SEQ ID NO: 2406417 - RNA, 22 nt, Human
ggacacauucaacccuggagag

SEQ ID NO: 2406418 - RNA, 21 nt, Human
ggacacauucaacccuggaga

SEQ ID NO: 2406419 - RNA, 12 nt, Human
ggacacccugug

SEQ ID NO: 2406420 - RNA, 22 nt, Human
ggacaccagccaggcucugugc

SEQ ID NO: 2406421 - RNA, 20 nt, Human
ggacaccagccaggcucugu

SEQ ID NO: 2406422 - RNA, 13 nt, Human
ggacaccaggagu

SEQ ID NO: 2406423 - RNA, 16 nt, Human
ggacacagaugaaaca

SEQ ID NO: 2406424 - RNA, 12 nt, Human
ggacacacuaau

SEQ ID NO: 2406425 - RNA, 13 nt, Human
ggacacagcucuu

SEQ ID NO: 2406426 - RNA, 21 nt, Human
gcuuuucccuuuuuuuaagua

SEQ ID NO: 2406427 - RNA, 22 nt, Human
gcuuuuccucaaagggagagag

SEQ ID NO: 2406428 - RNA, 15 nt, Human
gcuuuuccucccuug

SEQ ID NO: 2406429 - RNA, 22 nt, Human
gcuuuuccuauuuguuuucaug

SEQ ID NO: 2406430 - RNA, 22 nt, Human
gcuuuuccccggucccuugaga

SEQ ID NO: 2406431 - RNA, 20 nt, Human
gcuuuucccuuuuuuuaagu

SEQ ID NO: 2406432 - RNA, 16 nt, Human
gcuuuucccaaaagcc

SEQ ID NO: 2406433 - RNA, 18 nt, Human
gcuuuuccccggucccuu

SEQ ID NO: 2406434 - RNA, 19 nt, Human
gcuuuucccuaagccaagg

SEQ ID NO: 2406435 - RNA, 13 nt, Human
gcuuuugaaaucu

SEQ ID NO: 2406436 - RNA, 17 nt, Human
gcuuuucuuucuaccaa

SEQ ID NO: 2406437 - RNA, 14 nt, Human
gcuuuucuguauuu

SEQ ID NO: 2406438 - RNA, 22 nt, Human
gcuuuucugcccuggcugcugc

SEQ ID NO: 2406439 - RNA, 19 nt, Human
gcuuuucugcccuggcugc

SEQ ID NO: 2406440 - RNA, 18 nt, Human
gcuuuucugcccuggcug

SEQ ID NO: 2406441 - RNA, 17 nt, Human
gcuuuucugcccuggcu

SEQ ID NO: 2406442 - RNA, 22 nt, Human
gcuuuugcuggucacugccaug

SEQ ID NO: 2406443 - RNA, 21 nt, Human
gcuuuugcuggucacugccau

SEQ ID NO: 2406444 - RNA, 19 nt, Human
gcuuuugcuggucacugcc

SEQ ID NO: 2406445 - RNA, 18 nt, Human
gcuuuucugucucugccu

SEQ ID NO: 2406446 - RNA, 18 nt, Human
gcuuuucuguauuuuauu

SEQ ID NO: 2406447 - RNA, 15 nt, Human
gcuuuugcuggucac

SEQ ID NO: 2406448 - RNA, 17 nt, Human
ggaaagaguaggaagac

SEQ ID NO: 2406449 - RNA, 16 nt, Human
ggaaagaguaggaaga

SEQ ID NO: 2406450 - RNA, 19 nt, Human
ggaaagcaaaggagauugg

SEQ ID NO: 2406451 - RNA, 15 nt, Human
ggaaagcaauaaaug

SEQ ID NO: 2406452 - RNA, 14 nt, Human
ggaaagaggcucug

SEQ ID NO: 2406453 - RNA, 20 nt, Human
ggaaagacuuuuccaacccu

SEQ ID NO: 2406454 - RNA, 18 nt, Human
ggaaacuguugccagaga

SEQ ID NO: 2406455 - RNA, 12 nt, Human
ggaaacugaaug

SEQ ID NO: 2406456 - RNA, 17 nt, Human
ggaaacuguugccagag

SEQ ID NO: 2406457 - RNA, 15 nt, Human
ggaaagaaaguugca

SEQ ID NO: 2406458 - RNA, 16 nt, Human
ggaaagaaagaaggaa

SEQ ID NO: 2406459 - RNA, 22 nt, Human
ggaaagacauccauaaagaagc

SEQ ID NO: 2406460 - RNA, 15 nt, Human
ggaaagaagagccgg

SEQ ID NO: 2406461 - RNA, 18 nt, Human
ggaaagaagagccggagc

SEQ ID NO: 2406462 - RNA, 14 nt, Human
ggaaagcagcucaa

SEQ ID NO: 2406463 - RNA, 11 nt, Human
ggaaagcaggu

SEQ ID NO: 2406464 - RNA, 19 nt, Human
ggaaagcagguggcaucuc

SEQ ID NO: 2406465 - RNA, 22 nt, Human
ggaaagcagcucaaaggcacag

SEQ ID NO: 2406466 - RNA, 17 nt, Human
ggaaagcacaggugggc

SEQ ID NO: 2406467 - RNA, 16 nt, Human
ggaaagcacagguggg

SEQ ID NO: 2406468 - RNA, 15 nt, Human
ggaaagcagcucaaa

SEQ ID NO: 2406469 - RNA, 19 nt, Human
ggaaagcagcucaaaggca

SEQ ID NO: 2406470 - RNA, 23 nt, Human
ggaaagccaccucucccucaaca

SEQ ID NO: 2406471 - RNA, 20 nt, Human
ggaaagccaccucucccuca

SEQ ID NO: 2406472 - RNA, 21 nt, Human
ggaaagcagguggcaucucua

SEQ ID NO: 2406473 - RNA, 18 nt, Human
ggaaagccaccucucccu

SEQ ID NO: 2406474 - RNA, 18 nt, Human
ggaaagcaucaccucagg

SEQ ID NO: 2406475 - RNA, 19 nt, Human
ggaaagcaucaccucaggc

SEQ ID NO: 2406476 - RNA, 19 nt, Human
ggaaagccagugacuccag

SEQ ID NO: 2406477 - RNA, 18 nt, Human
ggaaagccagugacucca

SEQ ID NO: 2406478 - RNA, 21 nt, Human
ggaaagccagugacuccagga

SEQ ID NO: 2406479 - RNA, 13 nt, Human
ggaaagccucugc

SEQ ID NO: 2406480 - RNA, 24 nt, Human
ggaaaggaagugggacuggcacua

SEQ ID NO: 2406481 - RNA, 18 nt, Human
ggaaagcuccuagcagag

SEQ ID NO: 2406482 - RNA, 23 nt, Human
ggaaagcucagcuacugauuuuu

SEQ ID NO: 2406483 - RNA, 14 nt, Human
ggaaagccucugcu

SEQ ID NO: 2406484 - RNA, 16 nt, Human
ggaaagccucugcugc

SEQ ID NO: 2406485 - RNA, 15 nt, Human
ggaaaggccagcugg

SEQ ID NO: 2406486 - RNA, 18 nt, Human
ggaaaggccagcuggcag

SEQ ID NO: 2406487 - RNA, 20 nt, Human
ggaaaggcaaaugcccaagg

SEQ ID NO: 2406488 - RNA, 18 nt, Human
ggaaaggcaaaugcccaa

SEQ ID NO: 2406489 - RNA, 16 nt, Human
ggaaaggauauuuucu

SEQ ID NO: 2406490 - RNA, 15 nt, Human
ggaaaggagaggaaa

SEQ ID NO: 2406491 - RNA, 12 nt, Human
ggaaaggaauug

SEQ ID NO: 2406492 - RNA, 21 nt, Human
ggaaaggaguagaaaaagcag

SEQ ID NO: 2406493 - RNA, 21 nt, Human
ggaaaccacagcugcuggaga

SEQ ID NO: 2406494 - RNA, 19 nt, Human
ggaaaccacagcugcugga

SEQ ID NO: 2406495 - RNA, 18 nt, Human
ggaaaccacagcugcugg

SEQ ID NO: 2406496 - RNA, 21 nt, Human
ggaaacuaggugcauauuuau

SEQ ID NO: 2406497 - RNA, 21 nt, Human
ggaaacuccacaucugccuua

SEQ ID NO: 2406498 - RNA, 20 nt, Human
ggaaacuccacaucugccuu

SEQ ID NO: 2406499 - RNA, 22 nt, Human
ggaaacucaccugcuggccccu

SEQ ID NO: 2406500 - RNA, 18 nt, Human
ggaaacuccacaucugcc

SEQ ID NO: 2406501 - RNA, 21 nt, Human
ggaaacucaccugcuggcccc

SEQ ID NO: 2406502 - RNA, 13 nt, Human
ggaaacugccagc

SEQ ID NO: 2406503 - RNA, 18 nt, Human
ggaaacuggguuccugca

SEQ ID NO: 2406504 - RNA, 17 nt, Human
ggaaacucuuaucucag

SEQ ID NO: 2406505 - RNA, 17 nt, Human
ggaaacuggaugagguc

SEQ ID NO: 2406506 - RNA, 15 nt, Human
ggaaacccagcucug

SEQ ID NO: 2406507 - RNA, 16 nt, Human
ggaaaccacagcugcu

SEQ ID NO: 2406508 - RNA, 15 nt, Human
ggaaaccacagcugc

SEQ ID NO: 2406509 - RNA, 15 nt, Human
ggaaaaaagagaagu

SEQ ID NO: 2406510 - RNA, 15 nt, Human
ggaaacaggaccaca

SEQ ID NO: 2406511 - RNA, 20 nt, Human
ggaaacagcuaaugggacac

SEQ ID NO: 2406512 - RNA, 14 nt, Human
ggaaaaaaaugacu

SEQ ID NO: 2406513 - RNA, 19 nt, Human
ggaaaaaaaucguccaggg

SEQ ID NO: 2406514 - RNA, 13 nt, Human
ggaaacagaggcu

SEQ ID NO: 2406515 - RNA, 16 nt, Human
ggaaaaaauaacaaug

SEQ ID NO: 2406516 - RNA, 24 nt, Human
gcuuuuuuuuucucuuucucuccu

SEQ ID NO: 2406517 - RNA, 15 nt, Human
gcuuuuuuuuucucu

SEQ ID NO: 2406518 - RNA, 13 nt, Human
gcuuuugugcauu

SEQ ID NO: 2406519 - RNA, 19 nt, Human
gcuuuugugcauuaucuag

SEQ ID NO: 2406520 - RNA, 15 nt, Human
gcuuuuuaauauuga

SEQ ID NO: 2406521 - RNA, 18 nt, Human
gcuuugccagcugcugcu

SEQ ID NO: 2406522 - RNA, 15 nt, Human
gcuuugccagcugcu

SEQ ID NO: 2406523 - RNA, 14 nt, Human
gcuuugccagcugc

SEQ ID NO: 2406524 - RNA, 21 nt, Human
gcuuugcauuuuaaaaaugaa

SEQ ID NO: 2406525 - RNA, 19 nt, Human
gcuuugccagcugcugcug

SEQ ID NO: 2406526 - RNA, 20 nt, Human
gcuuugcccaacaccagccc

SEQ ID NO: 2406527 - RNA, 23 nt, Human
gcuuugcccaacaccagccccug

SEQ ID NO: 2406528 - RNA, 22 nt, Human
gcuuugcccaacaccagccccu

SEQ ID NO: 2406529 - RNA, 12 nt, Human
gcuuugcccagc

SEQ ID NO: 2406530 - RNA, 15 nt, Human
gcuuugcugcuacag

SEQ ID NO: 2406531 - RNA, 12 nt, Human
gcuuugcugcua

SEQ ID NO: 2406532 - RNA, 13 nt, Human
gcuuugcucugcc

SEQ ID NO: 2406533 - RNA, 16 nt, Human
gcuuugcugcuacagg

SEQ ID NO: 2406534 - RNA, 12 nt, Human
gcuuugcugcug

SEQ ID NO: 2406535 - RNA, 18 nt, Human
gcuuugcugcugaaggcu

SEQ ID NO: 2406536 - RNA, 19 nt, Human
gcuuugcugcugaaggcuc

SEQ ID NO: 2406537 - RNA, 16 nt, Human
gcuuugcuaccaaagc

SEQ ID NO: 2406538 - RNA, 12 nt, Human
gcuuugcucugc

SEQ ID NO: 2406539 - RNA, 22 nt, Human
gcuuugccuuccacgcugucuc

SEQ ID NO: 2406540 - RNA, 13 nt, Human
gcuuugccuucca

SEQ ID NO: 2406541 - RNA, 18 nt, Human
gcuuugccuuccacgcug

SEQ ID NO: 2406542 - RNA, 24 nt, Human
gcuuugccuuccacgcugucucca

SEQ ID NO: 2406543 - RNA, 19 nt, Human
gcuuugcuuucugcucagc

SEQ ID NO: 2406544 - RNA, 18 nt, Human
gcuuugcuuucugcucag

SEQ ID NO: 2406545 - RNA, 21 nt, Human
gcuuugcuuaugguaauaaaa

SEQ ID NO: 2406546 - RNA, 16 nt, Human
gcuuggggaccagagc

SEQ ID NO: 2406547 - RNA, 23 nt, Human
gcuugggcuucauccuccucaga

SEQ ID NO: 2406548 - RNA, 19 nt, Human
gcuugaccgugaggccaga

SEQ ID NO: 2406549 - RNA, 18 nt, Human
gcuugaccgugaggccag

SEQ ID NO: 2406550 - RNA, 17 nt, Human
gcuugaccgugaggcca

SEQ ID NO: 2406551 - RNA, 23 nt, Human
gcuucuucagagacuccugcagg

SEQ ID NO: 2406552 - RNA, 16 nt, Human
gcuugaccgugaggcc

SEQ ID NO: 2406553 - RNA, 21 nt, Human
gcuucuucagagacuccugca

SEQ ID NO: 2406554 - RNA, 19 nt, Human
gcuucuucagagacuccug

SEQ ID NO: 2406555 - RNA, 16 nt, Human
gcuuaacuucacauau

SEQ ID NO: 2406556 - RNA, 16 nt, Human
gcuguuuauuuuauau

SEQ ID NO: 2406557 - RNA, 13 nt, Human
gcuguuuccauag

SEQ ID NO: 2406558 - RNA, 13 nt, Human
gcuguuugaggau

SEQ ID NO: 2406559 - RNA, 11 nt, Human
gcuguuuccuu

SEQ ID NO: 2406560 - RNA, 15 nt, Human
gcuguuuacuaggga

SEQ ID NO: 2406561 - RNA, 14 nt, Human
gcuguuuauggccu

SEQ ID NO: 2406562 - RNA, 15 nt, Human
gcuguuuauggccuc

SEQ ID NO: 2406563 - RNA, 16 nt, Human
gcuguuuauggccuca

SEQ ID NO: 2406564 - RNA, 23 nt, Human
gcuguuuauggccucagcugccu

SEQ ID NO: 2406565 - RNA, 17 nt, Human
gcuguuuauggccucag

SEQ ID NO: 2406566 - RNA, 22 nt, Human
gcuguuuauggccucagcugcc

SEQ ID NO: 2406567 - RNA, 17 nt, Human
gcuuaacuucacauauu

SEQ ID NO: 2406568 - RNA, 15 nt, Human
gcuuaagcagaagca

SEQ ID NO: 2406569 - RNA, 20 nt, Human
gcuuaagaaaucuaguauuu

SEQ ID NO: 2406570 - RNA, 16 nt, Human
gcuucuucagagacuc

SEQ ID NO: 2406571 - RNA, 16 nt, Human
gcuuaagcagaagcau

SEQ ID NO: 2406572 - RNA, 21 nt, Human
gcuuggggaccagagcugcca

SEQ ID NO: 2406573 - RNA, 20 nt, Human
gcuuggggaccagagcugcc

SEQ ID NO: 2406574 - RNA, 18 nt, Human
gcuuggggaccagagcug

SEQ ID NO: 2406575 - RNA, 17 nt, Human
gcuuggggaccagagcu

SEQ ID NO: 2406576 - RNA, 12 nt, Human
gcuuuccugccc

SEQ ID NO: 2406577 - RNA, 11 nt, Human
gcuuuccugcc

SEQ ID NO: 2406578 - RNA, 12 nt, Human
gcuuuccugaau

SEQ ID NO: 2406579 - RNA, 22 nt, Human
gcuuuccugaauccaaacuaau

SEQ ID NO: 2406580 - RNA, 17 nt, Human
gcuuuccugccccaggc

SEQ ID NO: 2406581 - RNA, 14 nt, Human
gcuuuccugcccca

SEQ ID NO: 2406582 - RNA, 19 nt, Human
gcuuuccugccccaggccu

SEQ ID NO: 2406583 - RNA, 22 nt, Human
gcuuggggaccagagcugccac

SEQ ID NO: 2406584 - RNA, 11 nt, Human
gcuuuccugaa

SEQ ID NO: 2406585 - RNA, 23 nt, Human
gcuugggcuuccauuugugugug

SEQ ID NO: 2406586 - RNA, 22 nt, Human
gcuuucuacccagcgagcccug

SEQ ID NO: 2406587 - RNA, 19 nt, Human
gcuuucuacccagcgagcc

SEQ ID NO: 2406588 - RNA, 16 nt, Human
gcuuucgaacugcuag

SEQ ID NO: 2406589 - RNA, 13 nt, Human
gcuuucuacccag

SEQ ID NO: 2406590 - RNA, 17 nt, Human
gcuuuccuuuuuuaaaa

SEQ ID NO: 2406591 - RNA, 19 nt, Human
gcuuucgucuccagccccu

SEQ ID NO: 2406592 - RNA, 23 nt, Human
gcuuuccuuuuuuaaaaaugcaa

SEQ ID NO: 2406593 - RNA, 18 nt, Human
gcuuugauuaauccagaa

SEQ ID NO: 2406594 - RNA, 12 nt, Human
gcuuugauucau

SEQ ID NO: 2406595 - RNA, 23 nt, Human
gcuuucuacccagcgagcccugg

SEQ ID NO: 2406596 - RNA, 18 nt, Human
gcuuugcauguuccacua

SEQ ID NO: 2406597 - RNA, 17 nt, Human
gcuuugcauguuccacu

SEQ ID NO: 2406598 - RNA, 12 nt, Human
gcuuugcaguga

SEQ ID NO: 2406599 - RNA, 23 nt, Human
gcuuugcauguuccacuaacccc

SEQ ID NO: 2406600 - RNA, 20 nt, Human
gcuuugcauguuccacuaac

SEQ ID NO: 2406601 - RNA, 20 nt, Human
gcuuugcauuccuacaaaga

SEQ ID NO: 2406602 - RNA, 22 nt, Human
gcuuugcauuccuacaaagaug

SEQ ID NO: 2406603 - RNA, 15 nt, Human
gcuuugauucauagu

SEQ ID NO: 2406604 - RNA, 20 nt, Human
gcuuugauucauaguaacuu

SEQ ID NO: 2406605 - RNA, 21 nt, Human
gcuuugauuaauccagaauaa

SEQ ID NO: 2406606 - RNA, 18 nt, Human
gcuaagugaaaaggucau

SEQ ID NO: 2406607 - RNA, 17 nt, Human
gcuaaguauuucccagc

SEQ ID NO: 2406608 - RNA, 13 nt, Human
gcuaagugaaaag

SEQ ID NO: 2406609 - RNA, 21 nt, Human
gcuaaggcguggagcugccug

SEQ ID NO: 2406610 - RNA, 20 nt, Human
gcuaaggcguggagcugccu

SEQ ID NO: 2406611 - RNA, 22 nt, Human
gcuaaggcguggagcugccuga

SEQ ID NO: 2406612 - RNA, 22 nt, Human
gcuaagugauccucccaccuca

SEQ ID NO: 2406613 - RNA, 18 nt, Human
gcuaagugauccucccac

SEQ ID NO: 2406614 - RNA, 21 nt, Human
gcuaggaauuguguuuauaau

SEQ ID NO: 2406615 - RNA, 12 nt, Human
gcuaggaaugaa

SEQ ID NO: 2406616 - RNA, 13 nt, Human
gcuaggaaugaaa

SEQ ID NO: 2406617 - RNA, 18 nt, Human
gcuaggaaugaaauccug

SEQ ID NO: 2406618 - RNA, 20 nt, Human
gcuaggaccccuccaugugg

SEQ ID NO: 2406619 - RNA, 21 nt, Human
gcuaggcgagugccaggacuc

SEQ ID NO: 2406620 - RNA, 17 nt, Human
gcuagggaaacuucccg

SEQ ID NO: 2406621 - RNA, 22 nt, Human
gcuaggaccccuccaugugggc

SEQ ID NO: 2406622 - RNA, 17 nt, Human
gcuauuagccaggauca

SEQ ID NO: 2406623 - RNA, 13 nt, Human
gcuauuagccagg

SEQ ID NO: 2406624 - RNA, 15 nt, Human
gcuauuacugucugg

SEQ ID NO: 2406625 - RNA, 23 nt, Human
gcuauuacuaaggaguaaucugu

SEQ ID NO: 2406626 - RNA, 19 nt, Human
gcuauuagccaggaucaug

SEQ ID NO: 2406627 - RNA, 18 nt, Human
gcuauuagccaggaucau

SEQ ID NO: 2406628 - RNA, 17 nt, Human
gcuauuauuuucacugu

SEQ ID NO: 2406629 - RNA, 18 nt, Human
gcuauuauuuucacugua

SEQ ID NO: 2406630 - RNA, 21 nt, Human
gcuauuauuuucacuguagaa

SEQ ID NO: 2406631 - RNA, 18 nt, Human
gcuauucaguaauaacuc

SEQ ID NO: 2406632 - RNA, 18 nt, Human
gcuauuuccauuccagaa

SEQ ID NO: 2406633 - RNA, 21 nt, Human
gcuauuagccaggaucauggu

SEQ ID NO: 2406634 - RNA, 23 nt, Human
gcucaaaauuugaagaaugaaca

SEQ ID NO: 2406635 - RNA, 12 nt, Human
gcucaaaggcac

SEQ ID NO: 2406636 - RNA, 14 nt, Human
gcucaaaggcacag

SEQ ID NO: 2406637 - RNA, 16 nt, Human
gcucaaaggcacagug

SEQ ID NO: 2406638 - RNA, 22 nt, Human
gcucaaaucuauucagacaagc

SEQ ID NO: 2406639 - RNA, 20 nt, Human
gcucaaaucuauucagacaa

SEQ ID NO: 2406640 - RNA, 18 nt, Human
gcucaaaucuauucagac

SEQ ID NO: 2406641 - RNA, 17 nt, Human
gcucaaaucuauucaga

SEQ ID NO: 2406642 - RNA, 14 nt, Human
gcucaaaucuauuc

SEQ ID NO: 2406643 - RNA, 21 nt, Human
gcucaaaggcacagugaaggc

SEQ ID NO: 2406644 - RNA, 20 nt, Human
gcuaggugggccagccccuc

SEQ ID NO: 2406645 - RNA, 21 nt, Human
gcuaggugggccagccccucc

SEQ ID NO: 2406646 - RNA, 17 nt, Human
gcuaggugggccagccc

SEQ ID NO: 2406647 - RNA, 18 nt, Human
gcuaggugggccagcccc

SEQ ID NO: 2406648 - RNA, 19 nt, Human
gcuaggugggccagccccu

SEQ ID NO: 2406649 - RNA, 15 nt, Human
gcuaggguggcccuu

SEQ ID NO: 2406650 - RNA, 14 nt, Human
gcuaggugggccag

SEQ ID NO: 2406651 - RNA, 14 nt, Human
gcuaggggagcagg

SEQ ID NO: 2406652 - RNA, 18 nt, Human
gcuagggaaacuucccgu

SEQ ID NO: 2406653 - RNA, 14 nt, Human
gcuaggguggcccu

SEQ ID NO: 2406654 - RNA, 16 nt, Human
gcuaguugggcuuccu

SEQ ID NO: 2406655 - RNA, 14 nt, Human
gcuaguugggcuuc

SEQ ID NO: 2406656 - RNA, 19 nt, Human
gcuauguuuugacauuuuu

SEQ ID NO: 2406657 - RNA, 20 nt, Human
gcuaggcgagugccaggacu

SEQ ID NO: 2406658 - RNA, 20 nt, Human
gcucagggccuggcucaggu

SEQ ID NO: 2406659 - RNA, 18 nt, Human
gcucagaggcgcacugug

SEQ ID NO: 2406660 - RNA, 19 nt, Human
gcucagaggcgcacuguga

SEQ ID NO: 2406661 - RNA, 20 nt, Human
gcucagaggcgcacugugac

SEQ ID NO: 2406662 - RNA, 21 nt, Human
gcucagaggcgcacugugacc

SEQ ID NO: 2406663 - RNA, 16 nt, Human
gcucagagcaguguuu

SEQ ID NO: 2406664 - RNA, 22 nt, Human
gcucagaauccaagugaacacu

SEQ ID NO: 2406665 - RNA, 18 nt, Human
gcucagaauccaagugaa

SEQ ID NO: 2406666 - RNA, 15 nt, Human
gcucagaauccaagu

SEQ ID NO: 2406667 - RNA, 18 nt, Human
gcucagaaguuucuucuu

SEQ ID NO: 2406668 - RNA, 21 nt, Human
gcucagaaggcucuucugacu

SEQ ID NO: 2406669 - RNA, 23 nt, Human
gcucacugccaggccagccuccg

SEQ ID NO: 2406670 - RNA, 19 nt, Human
gcucaagcaggaaguucaa

SEQ ID NO: 2406671 - RNA, 21 nt, Human
gcucacugccaggccagccuc

SEQ ID NO: 2406672 - RNA, 23 nt, Human
gcucaagcagcgaccgcccccuc

SEQ ID NO: 2406673 - RNA, 22 nt, Human
gcucaagcagcgaccgcccccu

SEQ ID NO: 2406674 - RNA, 21 nt, Human
gcucaagcagcgaccgccccc

SEQ ID NO: 2406675 - RNA, 15 nt, Human
gcucaagcagcgacc

SEQ ID NO: 2406676 - RNA, 21 nt, Human
gcucaagaagacauggagacu

SEQ ID NO: 2406677 - RNA, 12 nt, Human
gcucaaccuaac

SEQ ID NO: 2406678 - RNA, 23 nt, Human
gcucaaaucuauucagacaagca

SEQ ID NO: 2406679 - RNA, 15 nt, Human
gcucacuucugggcu

SEQ ID NO: 2406680 - RNA, 23 nt, Human
gcucacuucugggcuucaucugg

SEQ ID NO: 2406681 - RNA, 18 nt, Human
gcucacuguggugucugu

SEQ ID NO: 2406682 - RNA, 19 nt, Human
gcucacuguggugucugug

SEQ ID NO: 2406683 - RNA, 21 nt, Human
gcucacugcuaagaauauuug

SEQ ID NO: 2406684 - RNA, 17 nt, Human
gcucacuguggugucug

SEQ ID NO: 2406685 - RNA, 22 nt, Human
gcucacugccaggccagccucc

SEQ ID NO: 2406686 - RNA, 22 nt, Human
gcucaggagcccugggaggcuc

SEQ ID NO: 2406687 - RNA, 23 nt, Human
gcucaggagcccugggaggcucu

SEQ ID NO: 2406688 - RNA, 18 nt, Human
gcucagagaugugcaccc

SEQ ID NO: 2406689 - RNA, 13 nt, Human
gcucaggaggcuu

SEQ ID NO: 2406690 - RNA, 15 nt, Human
gcucaggaggcuugg

SEQ ID NO: 2406691 - RNA, 19 nt, Human
gcucagggccuggcucagg

SEQ ID NO: 2406692 - RNA, 18 nt, Human
gcucagggccuggcucag

SEQ ID NO: 2406693 - RNA, 13 nt, Human
gcucaggaguuug

SEQ ID NO: 2406694 - RNA, 16 nt, Human
gcucaggaggcuugga

SEQ ID NO: 2406695 - RNA, 17 nt, Human
gcucaggaggcuuggaa

SEQ ID NO: 2406696 - RNA, 13 nt, Human
gcggauggccgga

SEQ ID NO: 2406697 - RNA, 20 nt, Human
gcggaucucuggagugagcu

SEQ ID NO: 2406698 - RNA, 17 nt, Human
gcggcagcagccaucau

SEQ ID NO: 2406699 - RNA, 12 nt, Human
gcggcacagccu

SEQ ID NO: 2406700 - RNA, 14 nt, Human
gcggcagcagccau

SEQ ID NO: 2406701 - RNA, 12 nt, Human
gcggcagagagg

SEQ ID NO: 2406702 - RNA, 22 nt, Human
gcggcugagagccccagcugac

SEQ ID NO: 2406703 - RNA, 21 nt, Human
gcggcugagagccccagcuga

SEQ ID NO: 2406704 - RNA, 18 nt, Human
gcggcugagagccccagc

SEQ ID NO: 2406705 - RNA, 16 nt, Human
gcggcugagagcccca

SEQ ID NO: 2406706 - RNA, 12 nt, Human
gcggcugagagc

SEQ ID NO: 2406707 - RNA, 15 nt, Human
gcggcuggacuugga

SEQ ID NO: 2406708 - RNA, 23 nt, Human
gcggcugagagccccagcugaca

SEQ ID NO: 2406709 - RNA, 22 nt, Human
gcggcugagucaugaucucccu

SEQ ID NO: 2406710 - RNA, 17 nt, Human
gcggcugcugugugccu

SEQ ID NO: 2406711 - RNA, 23 nt, Human
gcggcugagucaugaucucccug

SEQ ID NO: 2406712 - RNA, 21 nt, Human
gcggcuacucagcagcccucc

SEQ ID NO: 2406713 - RNA, 22 nt, Human
gcggcuacucagcagcccuccu

SEQ ID NO: 2406714 - RNA, 13 nt, Human
gcggcuacucagc

SEQ ID NO: 2406715 - RNA, 19 nt, Human
gcggcuacucagcagcccu

SEQ ID NO: 2406716 - RNA, 20 nt, Human
gcggcuacucagcagcccuc

SEQ ID NO: 2406717 - RNA, 16 nt, Human
gcggcaggggccugga

SEQ ID NO: 2406718 - RNA, 15 nt, Human
gcggcaggggccugg

SEQ ID NO: 2406719 - RNA, 19 nt, Human
gcggcaggggccuggagau

SEQ ID NO: 2406720 - RNA, 16 nt, Human
gcggcauuaaagccau

SEQ ID NO: 2406721 - RNA, 21 nt, Human
gcggccagccccggcccuggg

SEQ ID NO: 2406722 - RNA, 19 nt, Human
gcggccagccccggcccug

SEQ ID NO: 2406723 - RNA, 18 nt, Human
gcggccagccccggcccu

SEQ ID NO: 2406724 - RNA, 17 nt, Human
gcggccagccccggccc

SEQ ID NO: 2406725 - RNA, 13 nt, Human
gcggccagccccg

SEQ ID NO: 2406726 - RNA, 11 nt, Human
gcggccagccc

SEQ ID NO: 2406727 - RNA, 16 nt, Human
gcggccuuuggcuuca

SEQ ID NO: 2406728 - RNA, 20 nt, Human
gcggccagccccggcccugg

SEQ ID NO: 2406729 - RNA, 16 nt, Human
gcggcggagcuggccc

SEQ ID NO: 2406730 - RNA, 20 nt, Human
gcggcggagcuggccccgcc

SEQ ID NO: 2406731 - RNA, 18 nt, Human
gcggcggagcuggccccg

SEQ ID NO: 2406732 - RNA, 15 nt, Human
gcguggagcugccug

SEQ ID NO: 2406733 - RNA, 12 nt, Human
gcguggagcugc

SEQ ID NO: 2406734 - RNA, 18 nt, Human
gcguggacucugcacaug

SEQ ID NO: 2406735 - RNA, 17 nt, Human
gcguggacucugcacau

SEQ ID NO: 2406736 - RNA, 15 nt, Human
gcguguuugcacguu

SEQ ID NO: 2406737 - RNA, 14 nt, Human
gcguguuugcacgu

SEQ ID NO: 2406738 - RNA, 22 nt, Human
gcguuaaaggcucgauuuugua

SEQ ID NO: 2406739 - RNA, 18 nt, Human
gcguggagggcguggagg

SEQ ID NO: 2406740 - RNA, 16 nt, Human
gcguggagcugccuga

SEQ ID NO: 2406741 - RNA, 18 nt, Human
gcguuccaugaugcuggg

SEQ ID NO: 2406742 - RNA, 17 nt, Human
gcguuccaugaugcugg

SEQ ID NO: 2406743 - RNA, 22 nt, Human
gcguuauuggucggcagccuuc

SEQ ID NO: 2406744 - RNA, 18 nt, Human
gcguuagaaugaggagga

SEQ ID NO: 2406745 - RNA, 16 nt, Human
gcguuacuaauuggcc

SEQ ID NO: 2406746 - RNA, 22 nt, Human
gcguuagaaugaggaggaagga

SEQ ID NO: 2406747 - RNA, 18 nt, Human
gcuaaggcguggagcugc

SEQ ID NO: 2406748 - RNA, 17 nt, Human
gcuaaggcguggagcug

SEQ ID NO: 2406749 - RNA, 16 nt, Human
gcuaaggcguggagcu

SEQ ID NO: 2406750 - RNA, 16 nt, Human
gcggcuggacuuggag

SEQ ID NO: 2406751 - RNA, 15 nt, Human
gcggcuggcagccca

SEQ ID NO: 2406752 - RNA, 22 nt, Human
gcggcugugcagccuguccugg

SEQ ID NO: 2406753 - RNA, 17 nt, Human
gcgggaaagccagugac

SEQ ID NO: 2406754 - RNA, 23 nt, Human
gcgggaaaagcagcccuuggcca

SEQ ID NO: 2406755 - RNA, 14 nt, Human
gcgggaaaagcagc

SEQ ID NO: 2406756 - RNA, 13 nt, Human
gcgggaaggaggg

SEQ ID NO: 2406757 - RNA, 14 nt, Human
gcgggaaggagggu

SEQ ID NO: 2406758 - RNA, 21 nt, Human
gcgggagccaugcgcccccuc

SEQ ID NO: 2406759 - RNA, 21 nt, Human
gcgggacgucccugcccaugu

SEQ ID NO: 2406760 - RNA, 23 nt, Human
gcgggacgagacccuacaggaga

SEQ ID NO: 2406761 - RNA, 15 nt, Human
gcgggaccuguggcu

SEQ ID NO: 2406762 - RNA, 14 nt, Human
gcgggaccuguggc

SEQ ID NO: 2406763 - RNA, 19 nt, Human
gcgggaccgguacagaaag

SEQ ID NO: 2406764 - RNA, 20 nt, Human
gcgggaccgguacagaaagg

SEQ ID NO: 2406765 - RNA, 14 nt, Human
gcgggacccaggca

SEQ ID NO: 2406766 - RNA, 19 nt, Human
gcgggaauggcagcugcca

SEQ ID NO: 2406767 - RNA, 14 nt, Human
gcguggacaggugu

SEQ ID NO: 2406768 - RNA, 19 nt, Human
gcgugcuccagccuggcuc

SEQ ID NO: 2406769 - RNA, 18 nt, Human
gcgugcuccagccuggcu

SEQ ID NO: 2406770 - RNA, 21 nt, Human
gcgugcucaguucagaaucac

SEQ ID NO: 2406771 - RNA, 14 nt, Human
gcguggacucugca

SEQ ID NO: 2406772 - RNA, 13 nt, Human
gcguggacucugc

SEQ ID NO: 2406773 - RNA, 21 nt, Human
gcgggagcgguggcccugucc

SEQ ID NO: 2406774 - RNA, 18 nt, Human
gcgggagcgguggcccug

SEQ ID NO: 2406775 - RNA, 23 nt, Human
gccuugaccauucuccaccugcc

SEQ ID NO: 2406776 - RNA, 22 nt, Human
gccuugaauauccccucccagu

SEQ ID NO: 2406777 - RNA, 21 nt, Human
gccuugaauauccccucccag

SEQ ID NO: 2406778 - RNA, 17 nt, Human
gcgauucuucugcuuca

SEQ ID NO: 2406779 - RNA, 23 nt, Human
gccuugcagcacucacacaggac

SEQ ID NO: 2406780 - RNA, 21 nt, Human
gccuugcagcacucacacagg

SEQ ID NO: 2406781 - RNA, 12 nt, Human
gccuugccagag

SEQ ID NO: 2406782 - RNA, 22 nt, Human
gcgauucuucugcuucagccuc

SEQ ID NO: 2406783 - RNA, 22 nt, Human
gccuugaccauucuccaccugc

SEQ ID NO: 2406784 - RNA, 21 nt, Human
gccuugaccauucuccaccug

SEQ ID NO: 2406785 - RNA, 16 nt, Human
gccuugaccauucucc

SEQ ID NO: 2406786 - RNA, 23 nt, Human
gccuugaacuuugaccucugcag

SEQ ID NO: 2406787 - RNA, 19 nt, Human
gccuugaaccacuucccuc

SEQ ID NO: 2406788 - RNA, 14 nt, Human
gccuugaagccacu

SEQ ID NO: 2406789 - RNA, 17 nt, Human
gccuugaauauccccuc

SEQ ID NO: 2406790 - RNA, 22 nt, Human
gccuucuuugcuugccucucug

SEQ ID NO: 2406791 - RNA, 15 nt, Human
gccuugaagccacug

SEQ ID NO: 2406792 - RNA, 23 nt, Human
gcgauucuucugcuucagccucc

SEQ ID NO: 2406793 - RNA, 12 nt, Human
gcgcaagccugu

SEQ ID NO: 2406794 - RNA, 13 nt, Human
gcgcaagccugua

SEQ ID NO: 2406795 - RNA, 20 nt, Human
gcgcagcauauucaggaagc

SEQ ID NO: 2406796 - RNA, 21 nt, Human
gcgcagcauauucaggaagcu

SEQ ID NO: 2406797 - RNA, 14 nt, Human
gcgcaggcuggccc

SEQ ID NO: 2406798 - RNA, 21 nt, Human
gcgcaagccuguaaucccagc

SEQ ID NO: 2406799 - RNA, 22 nt, Human
gcgcaagccuguaaucccagcu

SEQ ID NO: 2406800 - RNA, 15 nt, Human
gcgcaggcuggcccu

SEQ ID NO: 2406801 - RNA, 16 nt, Human
gcgcaggcuggcccug

SEQ ID NO: 2406802 - RNA, 22 nt, Human
gccuggcucccacaggcagcuu

SEQ ID NO: 2406803 - RNA, 21 nt, Human
gccuggcucccacaggcagcu

SEQ ID NO: 2406804 - RNA, 23 nt, Human
gccuggcucccacaggcagcuuu

SEQ ID NO: 2406805 - RNA, 20 nt, Human
gccuggcucccacaggcagc

SEQ ID NO: 2406806 - RNA, 19 nt, Human
gccuggcucccacaggcag

SEQ ID NO: 2406807 - RNA, 23 nt, Human
gccuggcuccaaacccucgaggc

SEQ ID NO: 2406808 - RNA, 21 nt, Human
gccuggcucuugugcuggaug

SEQ ID NO: 2406809 - RNA, 19 nt, Human
gccuggcucuugugcugga

SEQ ID NO: 2406810 - RNA, 10 nt, Human
gccuggcucu

SEQ ID NO: 2406811 - RNA, 16 nt, Human
gccuggcuccguccag

SEQ ID NO: 2406812 - RNA, 22 nt, Human
gccucuguccccuucucucauc

SEQ ID NO: 2406813 - RNA, 21 nt, Human
gccucuguccccuucucucau

SEQ ID NO: 2406814 - RNA, 20 nt, Human
gccucuguccccuucucuca

SEQ ID NO: 2406815 - RNA, 19 nt, Human
gccucuguccccuucucuc

SEQ ID NO: 2406816 - RNA, 18 nt, Human
gccucuguccccuucucu

SEQ ID NO: 2406817 - RNA, 15 nt, Human
gccucuguccccuuc

SEQ ID NO: 2406818 - RNA, 23 nt, Human
gccucugguuuggggcgaggcag

SEQ ID NO: 2406819 - RNA, 20 nt, Human
gccucugucacugcaggcac

SEQ ID NO: 2406820 - RNA, 17 nt, Human
gccucuggucugggugc

SEQ ID NO: 2406821 - RNA, 13 nt, Human
gccucugggucag

SEQ ID NO: 2406822 - RNA, 22 nt, Human
gccucugggucagugguccaca

SEQ ID NO: 2406823 - RNA, 12 nt, Human
gccucuggguca

SEQ ID NO: 2406824 - RNA, 20 nt, Human
gccuccugcccaguccccca

SEQ ID NO: 2406825 - RNA, 23 nt, Human
gccugggaucccucauccucaua

SEQ ID NO: 2406826 - RNA, 16 nt, Human
gccuggcuucuccuuu

SEQ ID NO: 2406827 - RNA, 13 nt, Human
gccuggcuucucc

SEQ ID NO: 2406828 - RNA, 11 nt, Human
gccugggcaga

SEQ ID NO: 2406829 - RNA, 16 nt, Human
gccugggcaacagagc

SEQ ID NO: 2406830 - RNA, 19 nt, Human
gccugggcaacagagcaag

SEQ ID NO: 2406831 - RNA, 20 nt, Human
gccugggcaacagagcaaga

SEQ ID NO: 2406832 - RNA, 20 nt, Human
gccugggcaacacagcgaga

SEQ ID NO: 2406833 - RNA, 12 nt, Human
gccugggcaaga

SEQ ID NO: 2406834 - RNA, 14 nt, Human
gccugugcugcccg

SEQ ID NO: 2406835 - RNA, 15 nt, Human
gccugugcugcccgu

SEQ ID NO: 2406836 - RNA, 19 nt, Human
gccugugccucugggacug

SEQ ID NO: 2406837 - RNA, 19 nt, Human
gccuguggaaucuggagug

SEQ ID NO: 2406838 - RNA, 22 nt, Human
gccuguggcaucuuugccuugg

SEQ ID NO: 2406839 - RNA, 24 nt, Human
gccuguggaaucuggagugagggg

SEQ ID NO: 2406840 - RNA, 16 nt, Human
gccugugcugcccguc

SEQ ID NO: 2406841 - RNA, 23 nt, Human
gccugugcugcccgucuucagcc

SEQ ID NO: 2406842 - RNA, 17 nt, Human
gccuguucagcuccagc

SEQ ID NO: 2406843 - RNA, 16 nt, Human
gccuguucagcuccag

SEQ ID NO: 2406844 - RNA, 16 nt, Human
gccuguggccuguguc

SEQ ID NO: 2406845 - RNA, 14 nt, Human
gccuguggccugug

SEQ ID NO: 2406846 - RNA, 14 nt, Human
gccuguucagcucc

SEQ ID NO: 2406847 - RNA, 15 nt, Human
gccuguucagcucca

SEQ ID NO: 2406848 - RNA, 17 nt, Human
gccuucucaugauccaa

SEQ ID NO: 2406849 - RNA, 15 nt, Human
gccuucuaaaggugu

SEQ ID NO: 2406850 - RNA, 19 nt, Human
gccuucgucuuucccaugg

SEQ ID NO: 2406851 - RNA, 17 nt, Human
gccuguggccugugucc

SEQ ID NO: 2406852 - RNA, 16 nt, Human
gccuucucugaaggac

SEQ ID NO: 2406853 - RNA, 15 nt, Human
gccuucucugaagga

SEQ ID NO: 2406854 - RNA, 19 nt, Human
gccuucuuugcuugccucu

SEQ ID NO: 2406855 - RNA, 18 nt, Human
gccuucuuugcuugccuc

SEQ ID NO: 2406856 - RNA, 22 nt, Human
gccuucuuuugauuauguuuuu

SEQ ID NO: 2406857 - RNA, 18 nt, Human
gccuugaaccacuucccu

SEQ ID NO: 2406858 - RNA, 14 nt, Human
gccuugaacuuuga

SEQ ID NO: 2406859 - RNA, 15 nt, Human
gccuucuuuugauua

SEQ ID NO: 2406860 - RNA, 15 nt, Human
gccuucuuugcuugc

SEQ ID NO: 2406861 - RNA, 21 nt, Human
gccuucuucuuuuugcuguug

SEQ ID NO: 2406862 - RNA, 20 nt, Human
gccuucuucuuuuugcuguu

SEQ ID NO: 2406863 - RNA, 18 nt, Human
gccuucuucuuuuugcug

SEQ ID NO: 2406864 - RNA, 17 nt, Human
gccuucuucuuuuugcu

SEQ ID NO: 2406865 - RNA, 11 nt, Human
gccuucuucuu

SEQ ID NO: 2406866 - RNA, 22 nt, Human
gccuucuuccaucccaggacac

SEQ ID NO: 2406867 - RNA, 20 nt, Human
gccuucuuccaucccaggac

SEQ ID NO: 2406868 - RNA, 22 nt, Human
gccuucuucggggaacuccugg

SEQ ID NO: 2406869 - RNA, 23 nt, Human
gccuucuucggggaacuccugga

SEQ ID NO: 2406870 - RNA, 19 nt, Human
gccuucuggauucuuggcc

SEQ ID NO: 2406871 - RNA, 19 nt, Human
gccuucugaggacauucca

SEQ ID NO: 2406872 - RNA, 16 nt, Human
gccuucucuguucauu

SEQ ID NO: 2406873 - RNA, 14 nt, Human
gccuucuccucccc

SEQ ID NO: 2406874 - RNA, 13 nt, Human
gccuucuccuccc

SEQ ID NO: 2406875 - RNA, 23 nt, Human
gccuucucccccccggggcuggg

SEQ ID NO: 2406876 - RNA, 17 nt, Human
gccuucucccccccggg

SEQ ID NO: 2406877 - RNA, 14 nt, Human
gccuucucuguuca

SEQ ID NO: 2406878 - RNA, 16 nt, Human
gccuucuguccuggug

SEQ ID NO: 2406879 - RNA, 21 nt, Human
gccuucuggauucuuggcccg

SEQ ID NO: 2406880 - RNA, 18 nt, Human
gccuucuuauucucacuc

SEQ ID NO: 2406881 - RNA, 18 nt, Human
gccuucuguccugguguc

SEQ ID NO: 2406882 - RNA, 19 nt, Human
gccuucuuauucucacucc

SEQ ID NO: 2406883 - RNA, 17 nt, Human
gccuucuuccaucccag

SEQ ID NO: 2406884 - RNA, 14 nt, Human
gccuucuuccaucc

SEQ ID NO: 2406885 - RNA, 17 nt, Human
gccuucuucacccagcu

SEQ ID NO: 2406886 - RNA, 20 nt, Human
gccuucuuauucucacucca

SEQ ID NO: 2406887 - RNA, 21 nt, Human
gccuucuuauucucacuccac

SEQ ID NO: 2406888 - RNA, 15 nt, Human
gccuucuucacccag

SEQ ID NO: 2406889 - RNA, 23 nt, Human
gccuucuuauucucacuccacca

SEQ ID NO: 2406890 - RNA, 17 nt, Human
gccccuggcagccccug

SEQ ID NO: 2406891 - RNA, 16 nt, Human
gccccuggcagccccu

SEQ ID NO: 2406892 - RNA, 13 nt, Human
gcccgucucagug

SEQ ID NO: 2406893 - RNA, 18 nt, Human
gcccguccugccuguggc

SEQ ID NO: 2406894 - RNA, 17 nt, Human
gcccguccugccugugg

SEQ ID NO: 2406895 - RNA, 16 nt, Human
gcccguccugccugug

SEQ ID NO: 2406896 - RNA, 15 nt, Human
gcccguccugccugu

SEQ ID NO: 2406897 - RNA, 13 nt, Human
gcccgugacagac

SEQ ID NO: 2406898 - RNA, 17 nt, Human
gcccgucucucucccau

SEQ ID NO: 2406899 - RNA, 17 nt, Human
gcccgucuucagccuag

SEQ ID NO: 2406900 - RNA, 18 nt, Human
gcccgucuucagccuagc

SEQ ID NO: 2406901 - RNA, 19 nt, Human
gcccgucucucucccaugg

SEQ ID NO: 2406902 - RNA, 13 nt, Human
gcccgucucucuc

SEQ ID NO: 2406903 - RNA, 14 nt, Human
gcccguccugccug

SEQ ID NO: 2406904 - RNA, 14 nt, Human
gcccgucucagugu

SEQ ID NO: 2406905 - RNA, 16 nt, Human
gcccgucucucuccca

SEQ ID NO: 2406906 - RNA, 15 nt, Human
gcccgucucucuccc

SEQ ID NO: 2406907 - RNA, 14 nt, Human
gcccgucuucagcc

SEQ ID NO: 2406908 - RNA, 15 nt, Human
gcccgucuucagccu

SEQ ID NO: 2406909 - RNA, 16 nt, Human
gcccgucuucagccua

SEQ ID NO: 2406910 - RNA, 21 nt, Human
gcccugccacucacuaggccc

SEQ ID NO: 2406911 - RNA, 20 nt, Human
gcccugccacucacuaggcc

SEQ ID NO: 2406912 - RNA, 19 nt, Human
gcccugccacucacuaggc

SEQ ID NO: 2406913 - RNA, 13 nt, Human
gcccugccacuca

SEQ ID NO: 2406914 - RNA, 12 nt, Human
gcccugccacuc

SEQ ID NO: 2406915 - RNA, 11 nt, Human
gcccugccacu

SEQ ID NO: 2406916 - RNA, 22 nt, Human
gcccuuaccugccaggaagcca

SEQ ID NO: 2406917 - RNA, 21 nt, Human
gcccuuaccugccaggaagcc

SEQ ID NO: 2406918 - RNA, 17 nt, Human
gcccugugggcccccaa

SEQ ID NO: 2406919 - RNA, 16 nt, Human
gcccugugggccccca

SEQ ID NO: 2406920 - RNA, 13 nt, Human
gcccuuaccuucc

SEQ ID NO: 2406921 - RNA, 17 nt, Human
gcccuuauuuucaagaa

SEQ ID NO: 2406922 - RNA, 18 nt, Human
gcccuuauuuucaagaaa

SEQ ID NO: 2406923 - RNA, 20 nt, Human
gcccuuauuuucaagaaacu

SEQ ID NO: 2406924 - RNA, 19 nt, Human
gcccuuaucugugcucagg

SEQ ID NO: 2406925 - RNA, 20 nt, Human
gcccuuaucugugcucagga

SEQ ID NO: 2406926 - RNA, 23 nt, Human
gcccuuaccugccaggaagccag

SEQ ID NO: 2406927 - RNA, 14 nt, Human
gcccuuaccuuccc

SEQ ID NO: 2406928 - RNA, 22 nt, Human
gcccuguggaugagcccucaga

SEQ ID NO: 2406929 - RNA, 23 nt, Human
gcccugccugagggccccucugc

SEQ ID NO: 2406930 - RNA, 22 nt, Human
gcccugccugagggccccucug

SEQ ID NO: 2406931 - RNA, 20 nt, Human
gcccugccugagggccccuc

SEQ ID NO: 2406932 - RNA, 19 nt, Human
gcccugccugagggccccu

SEQ ID NO: 2406933 - RNA, 19 nt, Human
gcccugccaucuucccagc

SEQ ID NO: 2406934 - RNA, 18 nt, Human
gcccugccaucuucccag

SEQ ID NO: 2406935 - RNA, 15 nt, Human
gcccugcccaccugg

SEQ ID NO: 2406936 - RNA, 14 nt, Human
gcccugcccaccug

SEQ ID NO: 2406937 - RNA, 16 nt, Human
gcccugcuccucccug

SEQ ID NO: 2406938 - RNA, 15 nt, Human
gcccugcuccucccu

SEQ ID NO: 2406939 - RNA, 14 nt, Human
gcccugcuccuccc

SEQ ID NO: 2406940 - RNA, 18 nt, Human
gcccugcgguagauggga

SEQ ID NO: 2406941 - RNA, 15 nt, Human
gcccugcggccccgu

SEQ ID NO: 2406942 - RNA, 20 nt, Human
gcccugcgggucacaggagg

SEQ ID NO: 2406943 - RNA, 21 nt, Human
gcccugcuccucccuggcugc

SEQ ID NO: 2406944 - RNA, 19 nt, Human
gcccugcuccucccuggcu

SEQ ID NO: 2406945 - RNA, 18 nt, Human
gcccugcuccucccuggc

SEQ ID NO: 2406946 - RNA, 17 nt, Human
gcccugcuccucccugg

SEQ ID NO: 2406947 - RNA, 23 nt, Human
gcccugcuccucccuggcugccc

SEQ ID NO: 2406948 - RNA, 22 nt, Human
gcccugcuccucccuggcugcc

SEQ ID NO: 2406949 - RNA, 16 nt, Human
gcccuguggaagggac

SEQ ID NO: 2406950 - RNA, 21 nt, Human
gcccuguggaugagcccucag

SEQ ID NO: 2406951 - RNA, 17 nt, Human
gcccuguggaagggacu

SEQ ID NO: 2406952 - RNA, 23 nt, Human
gcccuguggaagggacuaggagc

SEQ ID NO: 2406953 - RNA, 16 nt, Human
gccggagucagugcca

SEQ ID NO: 2406954 - RNA, 15 nt, Human
gccggagucagugcc

SEQ ID NO: 2406955 - RNA, 19 nt, Human
gccggaguccacucccagu

SEQ ID NO: 2406956 - RNA, 16 nt, Human
gccggaguccacuccc

SEQ ID NO: 2406957 - RNA, 18 nt, Human
gccggcaaccccaguucu

SEQ ID NO: 2406958 - RNA, 11 nt, Human
gccggcaaccc

SEQ ID NO: 2406959 - RNA, 21 nt, Human
gccggcaaaacuuuggcacug

SEQ ID NO: 2406960 - RNA, 16 nt, Human
gccggaugugcuuuuc

SEQ ID NO: 2406961 - RNA, 15 nt, Human
gccggaugugcuuuu

SEQ ID NO: 2406962 - RNA, 21 nt, Human
gccggaguccacucccagugc

SEQ ID NO: 2406963 - RNA, 15 nt, Human
gccgcuccaggggug

SEQ ID NO: 2406964 - RNA, 22 nt, Human
gccgcuccugucugccagccag

SEQ ID NO: 2406965 - RNA, 20 nt, Human
gccgcuccugucugccagcc

SEQ ID NO: 2406966 - RNA, 21 nt, Human
gccgcuccugucugccagcca

SEQ ID NO: 2406967 - RNA, 12 nt, Human
gccgcuccaggg

SEQ ID NO: 2406968 - RNA, 15 nt, Human
gccgcuccugucugc

SEQ ID NO: 2406969 - RNA, 19 nt, Human
gccgcuccugucugccagc

SEQ ID NO: 2406970 - RNA, 23 nt, Human
gccggcaaccccaguucugcucc

SEQ ID NO: 2406971 - RNA, 21 nt, Human
gccggcaaccccaguucugcu

SEQ ID NO: 2406972 - RNA, 20 nt, Human
gccggcaaccccaguucugc

SEQ ID NO: 2406973 - RNA, 19 nt, Human
gccggcaaccccaguucug

SEQ ID NO: 2406974 - RNA, 13 nt, Human
gccggcacagggu

SEQ ID NO: 2406975 - RNA, 21 nt, Human
gccggcacagggucugcucuu

SEQ ID NO: 2406976 - RNA, 22 nt, Human
gccggcacccacaagugccacu

SEQ ID NO: 2406977 - RNA, 16 nt, Human
gccuacaggagugagc

SEQ ID NO: 2406978 - RNA, 14 nt, Human
gccuaaucccuggg

SEQ ID NO: 2406979 - RNA, 16 nt, Human
gccuaaucccugggca

SEQ ID NO: 2406980 - RNA, 23 nt, Human
gccuaaucccugggcauugcuuu

SEQ ID NO: 2406981 - RNA, 21 nt, Human
gcccuuccaugucgccucugc

SEQ ID NO: 2406982 - RNA, 12 nt, Human
gcccuuccaugu

SEQ ID NO: 2406983 - RNA, 20 nt, Human
gcccuucacugccuuugcuc

SEQ ID NO: 2406984 - RNA, 19 nt, Human
gcccuucacugccuuugcu

SEQ ID NO: 2406985 - RNA, 21 nt, Human
gcccuucaccccaguggccac

SEQ ID NO: 2406986 - RNA, 15 nt, Human
gcccuucaccccagu

SEQ ID NO: 2406987 - RNA, 16 nt, Human
gcccuucacaguguuu

SEQ ID NO: 2406988 - RNA, 18 nt, Human
gcccuucccugucccucu

SEQ ID NO: 2406989 - RNA, 16 nt, Human
gcccuucccugucccu

SEQ ID NO: 2406990 - RNA, 15 nt, Human
gcccuucccuguccc

SEQ ID NO: 2406991 - RNA, 12 nt, Human
gcccuuccucuc

SEQ ID NO: 2406992 - RNA, 13 nt, Human
gcccuucccuguc

SEQ ID NO: 2406993 - RNA, 12 nt, Human
gcccuucccugu

SEQ ID NO: 2406994 - RNA, 16 nt, Human
gcccuucccacuggag

SEQ ID NO: 2406995 - RNA, 12 nt, Human
gcccuucccacu

SEQ ID NO: 2406996 - RNA, 22 nt, Human
gcccuuccaugucgccucugca

SEQ ID NO: 2406997 - RNA, 17 nt, Human
gccgcuagaggccugag

SEQ ID NO: 2406998 - RNA, 16 nt, Human
gccgcuagaggccuga

SEQ ID NO: 2406999 - RNA, 15 nt, Human
gccgcuagaggccug

SEQ ID NO: 2407000 - RNA, 13 nt, Human
gccgcuagaggcc

SEQ ID NO: 2407001 - RNA, 23 nt, Human
gccgcuagaugggcauggggugg

SEQ ID NO: 2407002 - RNA, 18 nt, Human
gccgcuagaugggcaugg

SEQ ID NO: 2407003 - RNA, 19 nt, Human
gccgcuagaggccugagga

SEQ ID NO: 2407004 - RNA, 18 nt, Human
gccgcuagaggccugagg

SEQ ID NO: 2407005 - RNA, 15 nt, Human
gcccuuccucuccac

SEQ ID NO: 2407006 - RNA, 14 nt, Human
gcccuuccucucca

SEQ ID NO: 2407007 - RNA, 23 nt, Human
gcccuuccucuccacccucccag

SEQ ID NO: 2407008 - RNA, 22 nt, Human
gcccuuccucuccacccuccca

SEQ ID NO: 2407009 - RNA, 13 nt, Human
gcccuuccucucc

SEQ ID NO: 2407010 - RNA, 17 nt, Human
gcccuucccugucccuc

SEQ ID NO: 2407011 - RNA, 17 nt, Human
gccgcgucgcccuccca

SEQ ID NO: 2407012 - RNA, 17 nt, Human
gccuacaggagugagca

SEQ ID NO: 2407013 - RNA, 23 nt, Human
gccuacagcuuugaucccugaca

SEQ ID NO: 2407014 - RNA, 22 nt, Human
gccuacagcuuugaucccugac

SEQ ID NO: 2407015 - RNA, 22 nt, Human
gccuaaucccugggcauugcuu

SEQ ID NO: 2407016 - RNA, 17 nt, Human
gccuagauccacacaca

SEQ ID NO: 2407017 - RNA, 20 nt, Human
gccuagauccacacacagag

SEQ ID NO: 2407018 - RNA, 23 nt, Human
gccuagauccacacacagaggaa

SEQ ID NO: 2407019 - RNA, 12 nt, Human
gccuagcauacg

SEQ ID NO: 2407020 - RNA, 19 nt, Human
gccuagcauacguacacau

SEQ ID NO: 2407021 - RNA, 22 nt, Human
gccucauguccacugguucuuc

SEQ ID NO: 2407022 - RNA, 14 nt, Human
gccucauguggcug

SEQ ID NO: 2407023 - RNA, 13 nt, Human
gccucauguggcu

SEQ ID NO: 2407024 - RNA, 22 nt, Human
gccucauccgaggcagggucag

SEQ ID NO: 2407025 - RNA, 19 nt, Human
gccucaugcuaagacucag

SEQ ID NO: 2407026 - RNA, 22 nt, Human
gccuccuuugugaggaagccgc

SEQ ID NO: 2407027 - RNA, 13 nt, Human
gccucgaacuggc

SEQ ID NO: 2407028 - RNA, 16 nt, Human
gccucgaacuggcugc

SEQ ID NO: 2407029 - RNA, 17 nt, Human
gccuccugcccaguccc

SEQ ID NO: 2407030 - RNA, 15 nt, Human
gccuccugcccaguc

SEQ ID NO: 2407031 - RNA, 16 nt, Human
gccucgaaacacagaa

SEQ ID NO: 2407032 - RNA, 14 nt, Human
gccucugggacugg

SEQ ID NO: 2407033 - RNA, 12 nt, Human
gccuccugccca

SEQ ID NO: 2407034 - RNA, 23 nt, Human
gccuccugaguagcugggacuac

SEQ ID NO: 2407035 - RNA, 21 nt, Human
gccuccugaccugaggcuccu

SEQ ID NO: 2407036 - RNA, 17 nt, Human
gccuccugaccugaggc

SEQ ID NO: 2407037 - RNA, 16 nt, Human
gccuccugaccugagg

SEQ ID NO: 2407038 - RNA, 19 nt, Human
gccuccucugucugcccuu

SEQ ID NO: 2407039 - RNA, 17 nt, Human
gccuccucugucugccc

SEQ ID NO: 2407040 - RNA, 20 nt, Human
gccuccucuggacggcaggc

SEQ ID NO: 2407041 - RNA, 19 nt, Human
gccuccugaguagcuggga

SEQ ID NO: 2407042 - RNA, 23 nt, Human
gccuccucucucaguuuuuauau

SEQ ID NO: 2407043 - RNA, 17 nt, Human
gccuccucuggacggca

SEQ ID NO: 2407044 - RNA, 21 nt, Human
gccuccucugucugcccuuca

SEQ ID NO: 2407045 - RNA, 13 nt, Human
gccuccucugucc

SEQ ID NO: 2407046 - RNA, 16 nt, Human
gccuccucuguccagg

SEQ ID NO: 2407047 - RNA, 18 nt, Human
gccuccacucccacuucc

SEQ ID NO: 2407048 - RNA, 16 nt, Human
gccuccacucccacuu

SEQ ID NO: 2407049 - RNA, 15 nt, Human
gccuccacucccacu

SEQ ID NO: 2407050 - RNA, 14 nt, Human
gccuccacucccac

SEQ ID NO: 2407051 - RNA, 22 nt, Human
gccuccacucccacuucccuga

SEQ ID NO: 2407052 - RNA, 21 nt, Human
gccuccacucccacuucccug

SEQ ID NO: 2407053 - RNA, 12 nt, Human
gccuccagaacu

SEQ ID NO: 2407054 - RNA, 13 nt, Human
gccuccauccuga

SEQ ID NO: 2407055 - RNA, 14 nt, Human
gccuccauccugag

SEQ ID NO: 2407056 - RNA, 15 nt, Human
gccuccauccugagg

SEQ ID NO: 2407057 - RNA, 16 nt, Human
gccuccaccaccacug

SEQ ID NO: 2407058 - RNA, 15 nt, Human
gccuccaccaccacu

SEQ ID NO: 2407059 - RNA, 14 nt, Human
gccuccaccaccac

SEQ ID NO: 2407060 - RNA, 12 nt, Human
gccuccaccacc

SEQ ID NO: 2407061 - RNA, 16 nt, Human
gccucauguggcugga

SEQ ID NO: 2407062 - RNA, 15 nt, Human
gccucauguggcugg

SEQ ID NO: 2407063 - RNA, 17 nt, Human
gccucauguggcuggaa

SEQ ID NO: 2407064 - RNA, 22 nt, Human
gccucaucuauaacaugcauuu

SEQ ID NO: 2407065 - RNA, 23 nt, Human
gccuccaccaccacuggccacca

SEQ ID NO: 2407066 - RNA, 21 nt, Human
gccuccaccaccacuggccac

SEQ ID NO: 2407067 - RNA, 20 nt, Human
gccuccaccaccacuggcca

SEQ ID NO: 2407068 - RNA, 18 nt, Human
gccuccaccaccacuggc

SEQ ID NO: 2407069 - RNA, 15 nt, Human
gccuccacccucuga

SEQ ID NO: 2407070 - RNA, 14 nt, Human
gccuccacccucug

SEQ ID NO: 2407071 - RNA, 12 nt, Human
gccuccacccuc

SEQ ID NO: 2407072 - RNA, 18 nt, Human
gccuccaccccccagaac

SEQ ID NO: 2407073 - RNA, 19 nt, Human
gccuccacccucugagcuu

SEQ ID NO: 2407074 - RNA, 18 nt, Human
gccuccacccucugagcu

SEQ ID NO: 2407075 - RNA, 17 nt, Human
gccuccacccucugagc

SEQ ID NO: 2407076 - RNA, 16 nt, Human
gccuccacccucugag

SEQ ID NO: 2407077 - RNA, 22 nt, Human
gccuccacccucugagcuuugc

SEQ ID NO: 2407078 - RNA, 12 nt, Human
gccuccaccgcu

SEQ ID NO: 2407079 - RNA, 12 nt, Human
gccuccacuccc

SEQ ID NO: 2407080 - RNA, 18 nt, Human
gccuccaccgcugccuaa

SEQ ID NO: 2407081 - RNA, 20 nt, Human
gccccaaaacucuccucugc

SEQ ID NO: 2407082 - RNA, 11 nt, Human
gccccaaaagg

SEQ ID NO: 2407083 - RNA, 21 nt, Human
gccccaaaacucuccucugcu

SEQ ID NO: 2407084 - RNA, 17 nt, Human
gccccaaacaaauaugc

SEQ ID NO: 2407085 - RNA, 19 nt, Human
gccccaaacaaauaugcaa

SEQ ID NO: 2407086 - RNA, 18 nt, Human
gccccaaacaaauaugca

SEQ ID NO: 2407087 - RNA, 20 nt, Human
gccccaaaggaaaaagcaca

SEQ ID NO: 2407088 - RNA, 14 nt, Human
gccccaaaggaaaa

SEQ ID NO: 2407089 - RNA, 20 nt, Human
gccccaaacgggcugcccug

SEQ ID NO: 2407090 - RNA, 13 nt, Human
gccccaaccugcu

SEQ ID NO: 2407091 - RNA, 19 nt, Human
gccccaacccccagcaccc

SEQ ID NO: 2407092 - RNA, 17 nt, Human
gccccaacccccagcac

SEQ ID NO: 2407093 - RNA, 16 nt, Human
gccccaacccccagca

SEQ ID NO: 2407094 - RNA, 14 nt, Human
gccccaacccccag

SEQ ID NO: 2407095 - RNA, 15 nt, Human
gccccaaccugcuga

SEQ ID NO: 2407096 - RNA, 14 nt, Human
gccccaaccugcug

SEQ ID NO: 2407097 - RNA, 14 nt, Human
gccccaacuccugg

SEQ ID NO: 2407098 - RNA, 15 nt, Human
gccccaacuccugga

SEQ ID NO: 2407099 - RNA, 16 nt, Human
gccccaacuccuggaa

SEQ ID NO: 2407100 - RNA, 17 nt, Human
gccccaacuccuggaag

SEQ ID NO: 2407101 - RNA, 13 nt, Human
gccccacagccca

SEQ ID NO: 2407102 - RNA, 23 nt, Human
gccccacagcccacguccuguca

SEQ ID NO: 2407103 - RNA, 17 nt, Human
gccccacagcccacguc

SEQ ID NO: 2407104 - RNA, 14 nt, Human
gccccacagcccac

SEQ ID NO: 2407105 - RNA, 18 nt, Human
gccccacagcccacgucc

SEQ ID NO: 2407106 - RNA, 11 nt, Human
gccccaccacc

SEQ ID NO: 2407107 - RNA, 13 nt, Human
gccccaccaccua

SEQ ID NO: 2407108 - RNA, 14 nt, Human
gccccaccaccuag

SEQ ID NO: 2407109 - RNA, 15 nt, Human
gccccaccaccuagg

SEQ ID NO: 2407110 - RNA, 18 nt, Human
gccccaccaccuaggcca

SEQ ID NO: 2407111 - RNA, 20 nt, Human
gccccaccaccuaggccacu

SEQ ID NO: 2407112 - RNA, 23 nt, Human
gccccaccaccuaggccacuccu

SEQ ID NO: 2407113 - RNA, 13 nt, Human
gccccacccagau

SEQ ID NO: 2407114 - RNA, 12 nt, Human
gccccacccaga

SEQ ID NO: 2407115 - RNA, 11 nt, Human
gccccacccag

SEQ ID NO: 2407116 - RNA, 16 nt, Human
gcccccacuugccucu

SEQ ID NO: 2407117 - RNA, 14 nt, Human
gcccccacuugccu

SEQ ID NO: 2407118 - RNA, 12 nt, Human
gccccacccagg

SEQ ID NO: 2407119 - RNA, 15 nt, Human
gccccacccaggagg

SEQ ID NO: 2407120 - RNA, 21 nt, Human
gcccccacuugccucuuccuu

SEQ ID NO: 2407121 - RNA, 17 nt, Human
gcccccacuugccucuu

SEQ ID NO: 2407122 - RNA, 22 nt, Human
gccccacccagaugggggaaag

SEQ ID NO: 2407123 - RNA, 12 nt, Human
gcccccagacgc

SEQ ID NO: 2407124 - RNA, 22 nt, Human
gcccccagcccagggcuccugc

SEQ ID NO: 2407125 - RNA, 21 nt, Human
gcccccagcccagggcuccug

SEQ ID NO: 2407126 - RNA, 18 nt, Human
gcccccagcccagggcuc

SEQ ID NO: 2407127 - RNA, 17 nt, Human
gcccccagcccagggcu

SEQ ID NO: 2407128 - RNA, 18 nt, Human
gcccccagagcgccccuc

SEQ ID NO: 2407129 - RNA, 21 nt, Human
gcccccagccccggggugagu

SEQ ID NO: 2407130 - RNA, 20 nt, Human
gcccccagccccggggugag

SEQ ID NO: 2407131 - RNA, 15 nt, Human
gcccccagcuaagaa

SEQ ID NO: 2407132 - RNA, 16 nt, Human
gcccccaggacugggc

SEQ ID NO: 2407133 - RNA, 15 nt, Human
gcccccaggacuggg

SEQ ID NO: 2407134 - RNA, 14 nt, Human
gcccccaggacugg

SEQ ID NO: 2407135 - RNA, 13 nt, Human
gcccccaggacug

SEQ ID NO: 2407136 - RNA, 15 nt, Human
gcccccucugcccug

SEQ ID NO: 2407137 - RNA, 16 nt, Human
gcccccucugcccugc

SEQ ID NO: 2407138 - RNA, 21 nt, Human
gcccccagcuaagaaccugga

SEQ ID NO: 2407139 - RNA, 22 nt, Human
gcccccagcuaagaaccuggaa

SEQ ID NO: 2407140 - RNA, 13 nt, Human
gcccccagcuggc

SEQ ID NO: 2407141 - RNA, 12 nt, Human
gcccccagcugg

SEQ ID NO: 2407142 - RNA, 23 nt, Human
gcccccagcuaagaaccuggaac

SEQ ID NO: 2407143 - RNA, 12 nt, Human
gcccccaggacu

SEQ ID NO: 2407144 - RNA, 15 nt, Human
gcccccagcuggccc

SEQ ID NO: 2407145 - RNA, 14 nt, Human
gcccccagcuggcc

SEQ ID NO: 2407146 - RNA, 18 nt, Human
gcccccagcuguggguac

SEQ ID NO: 2407147 - RNA, 15 nt, Human
gccccuggcagcccc

SEQ ID NO: 2407148 - RNA, 12 nt, Human
gccccuggcagc

SEQ ID NO: 2407149 - RNA, 16 nt, Human
gccccugcugguucag

SEQ ID NO: 2407150 - RNA, 15 nt, Human
gccccugcugguuca

SEQ ID NO: 2407151 - RNA, 18 nt, Human
gcccccugaaacuuauuu

SEQ ID NO: 2407152 - RNA, 17 nt, Human
gcccccucugcccugcg

SEQ ID NO: 2407153 - RNA, 12 nt, Human
gccccugcuggu

SEQ ID NO: 2407154 - RNA, 11 nt, Human
gcccccugccc

SEQ ID NO: 2407155 - RNA, 22 nt, Human
gcccaggccccugccacccugg

SEQ ID NO: 2407156 - RNA, 18 nt, Human
gcccaggccccugccacc

SEQ ID NO: 2407157 - RNA, 23 nt, Human
gcccaggccaucuuccagguggg

SEQ ID NO: 2407158 - RNA, 21 nt, Human
gcccaggccccugccacccug

SEQ ID NO: 2407159 - RNA, 20 nt, Human
gcccaggccccugccacccu

SEQ ID NO: 2407160 - RNA, 12 nt, Human
gcccaggccccu

SEQ ID NO: 2407161 - RNA, 11 nt, Human
gcccaggcccc

SEQ ID NO: 2407162 - RNA, 22 nt, Human
gcccaggccaucuuccaggugg

SEQ ID NO: 2407163 - RNA, 19 nt, Human
gcccaggccaucuuccagg

SEQ ID NO: 2407164 - RNA, 18 nt, Human
gcccaggccaucuuccag

SEQ ID NO: 2407165 - RNA, 13 nt, Human
gcccaggccaucu

SEQ ID NO: 2407166 - RNA, 14 nt, Human
gcccaggcaggcca

SEQ ID NO: 2407167 - RNA, 14 nt, Human
gcccaggagagaga

SEQ ID NO: 2407168 - RNA, 13 nt, Human
gcccaggagagag

SEQ ID NO: 2407169 - RNA, 12 nt, Human
gcccaggagaga

SEQ ID NO: 2407170 - RNA, 23 nt, Human
gcccaggacggggccggccaggu

SEQ ID NO: 2407171 - RNA, 10 nt, Human
gcccaggaga

SEQ ID NO: 2407172 - RNA, 11 nt, Human
gcccaggagac

SEQ ID NO: 2407173 - RNA, 20 nt, Human
gcccaggagagagaaagcca

SEQ ID NO: 2407174 - RNA, 17 nt, Human
gcccaggagagagaaag

SEQ ID NO: 2407175 - RNA, 16 nt, Human
gcccaggagagagaaa

SEQ ID NO: 2407176 - RNA, 15 nt, Human
gcccaggagagagaa

SEQ ID NO: 2407177 - RNA, 23 nt, Human
gcccaggagagagaaagccaggc

SEQ ID NO: 2407178 - RNA, 22 nt, Human
gcccaggagagagaaagccagg

SEQ ID NO: 2407179 - RNA, 21 nt, Human
gcccaggacggggccggccag

SEQ ID NO: 2407180 - RNA, 20 nt, Human
gcccaggacggggccggcca

SEQ ID NO: 2407181 - RNA, 19 nt, Human
gcccaggacggggccggcc

SEQ ID NO: 2407182 - RNA, 18 nt, Human
gcccaggacggggccggc

SEQ ID NO: 2407183 - RNA, 18 nt, Human
gcccaggaccaucauccu

SEQ ID NO: 2407184 - RNA, 19 nt, Human
gcccaggaccagcuggggc

SEQ ID NO: 2407185 - RNA, 18 nt, Human
gcccaggaccagcugggg

SEQ ID NO: 2407186 - RNA, 17 nt, Human
gcccaggaccagcuggg

SEQ ID NO: 2407187 - RNA, 16 nt, Human
gcccaggaccagcugg

SEQ ID NO: 2407188 - RNA, 15 nt, Human
gcccaggaccagcug

SEQ ID NO: 2407189 - RNA, 14 nt, Human
gcccaggaccagcu

SEQ ID NO: 2407190 - RNA, 13 nt, Human
gcccaggaccagc

SEQ ID NO: 2407191 - RNA, 15 nt, Human
gcccaggagagccag

SEQ ID NO: 2407192 - RNA, 11 nt, Human
gcccaggcagg

SEQ ID NO: 2407193 - RNA, 15 nt, Human
gcccaggauggcuuu

SEQ ID NO: 2407194 - RNA, 23 nt, Human
gcccaggaaaggcuccaggagca

SEQ ID NO: 2407195 - RNA, 22 nt, Human
gcccaggaaaggcuccaggagc

SEQ ID NO: 2407196 - RNA, 24 nt, Human
gcccaggaaaggcuccaggagcag

SEQ ID NO: 2407197 - RNA, 17 nt, Human
gcccacuguccugggcc

SEQ ID NO: 2407198 - RNA, 18 nt, Human
gcccacuguccugggccu

SEQ ID NO: 2407199 - RNA, 21 nt, Human
gcccacuguccugggccugca

SEQ ID NO: 2407200 - RNA, 23 nt, Human
gcccacuguccugggccugcaga

SEQ ID NO: 2407201 - RNA, 21 nt, Human
gcccacuguccugggcgcccu

SEQ ID NO: 2407202 - RNA, 19 nt, Human
gcccacuguccugggcgcc

SEQ ID NO: 2407203 - RNA, 23 nt, Human
gcccacuguccugggcgcccugg

SEQ ID NO: 2407204 - RNA, 17 nt, Human
gcccacuguccugggcg

SEQ ID NO: 2407205 - RNA, 16 nt, Human
gcccacuguccugggc

SEQ ID NO: 2407206 - RNA, 24 nt, Human
gcccacuguccugggccugcagaa

SEQ ID NO: 2407207 - RNA, 23 nt, Human
gcccacuucaggguucuccucuc

SEQ ID NO: 2407208 - RNA, 13 nt, Human
gcccacuucaggg

SEQ ID NO: 2407209 - RNA, 13 nt, Human
gcccacuucugcc

SEQ ID NO: 2407210 - RNA, 14 nt, Human
gcccacuguccugg

SEQ ID NO: 2407211 - RNA, 13 nt, Human
gcccacuguccug

SEQ ID NO: 2407212 - RNA, 15 nt, Human
gcccacuguccuggg

SEQ ID NO: 2407213 - RNA, 20 nt, Human
gcccacugcccacccccuca

SEQ ID NO: 2407214 - RNA, 19 nt, Human
gcccacugcccacccccuc

SEQ ID NO: 2407215 - RNA, 23 nt, Human
gcccacugcccacccccucaagc

SEQ ID NO: 2407216 - RNA, 22 nt, Human
gcccacuguacuugcucuugau

SEQ ID NO: 2407217 - RNA, 20 nt, Human
gcccacuguacuugcucuug

SEQ ID NO: 2407218 - RNA, 15 nt, Human
gcccacuguacuugc

SEQ ID NO: 2407219 - RNA, 21 nt, Human
gcccacgcuggagugcaguga

SEQ ID NO: 2407220 - RNA, 19 nt, Human
gcccacgcuggagugcagu

SEQ ID NO: 2407221 - RNA, 22 nt, Human
gccauugucuucggaaaccuug

SEQ ID NO: 2407222 - RNA, 21 nt, Human
gccauugucuucggaaaccuu

SEQ ID NO: 2407223 - RNA, 20 nt, Human
gccauuggcuauuuaaaacu

SEQ ID NO: 2407224 - RNA, 23 nt, Human
gcccacgcuggagugcagugagc

SEQ ID NO: 2407225 - RNA, 21 nt, Human
gcccacgcccccacuggugac

SEQ ID NO: 2407226 - RNA, 17 nt, Human
gcccacgcccccacugg

SEQ ID NO: 2407227 - RNA, 16 nt, Human
gcccacgcccccacug

SEQ ID NO: 2407228 - RNA, 15 nt, Human
gcccacgcccccacu

SEQ ID NO: 2407229 - RNA, 17 nt, Human
gccauugacuucuuccc

SEQ ID NO: 2407230 - RNA, 14 nt, Human
gccauugcacucca

SEQ ID NO: 2407231 - RNA, 15 nt, Human
gccauugcacuccag

SEQ ID NO: 2407232 - RNA, 18 nt, Human
gccauugcacuccagccu

SEQ ID NO: 2407233 - RNA, 19 nt, Human
gccauugcacuccagccug

SEQ ID NO: 2407234 - RNA, 21 nt, Human
gccauugcacuccagccuggg

SEQ ID NO: 2407235 - RNA, 17 nt, Human
gccauugccaccaggag

SEQ ID NO: 2407236 - RNA, 18 nt, Human
gccauugccaccaggaga

SEQ ID NO: 2407237 - RNA, 19 nt, Human
gccauugccaccaggagaa

SEQ ID NO: 2407238 - RNA, 22 nt, Human
gccauuaucccugaaucccccu

SEQ ID NO: 2407239 - RNA, 18 nt, Human
gccauuaccauggagaca

SEQ ID NO: 2407240 - RNA, 13 nt, Human
gcauuuagaugua

SEQ ID NO: 2407241 - RNA, 19 nt, Human
gcauuuaggccaugggaca

SEQ ID NO: 2407242 - RNA, 12 nt, Human
gcauuuagaugu

SEQ ID NO: 2407243 - RNA, 18 nt, Human
gcauuuacuuuguguuca

SEQ ID NO: 2407244 - RNA, 13 nt, Human
gccauuaccaugg

SEQ ID NO: 2407245 - RNA, 16 nt, Human
gccauuaccauggaga

SEQ ID NO: 2407246 - RNA, 17 nt, Human
gcauuuacuuugaauuu

SEQ ID NO: 2407247 - RNA, 19 nt, Human
gcauuuaauguagccaugg

SEQ ID NO: 2407248 - RNA, 16 nt, Human
gcauuuaauguagcca

SEQ ID NO: 2407249 - RNA, 20 nt, Human
gcacucagaagacacugaug

SEQ ID NO: 2407250 - RNA, 19 nt, Human
gcaagugagagcugggugu

SEQ ID NO: 2407251 - RNA, 18 nt, Human
gcaagugagagcugggug

SEQ ID NO: 2407252 - RNA, 19 nt, Human
gcacuuuguucuggcucuu

SEQ ID NO: 2407253 - RNA, 18 nt, Human
gcacuuuguucuggcucu

SEQ ID NO: 2407254 - RNA, 15 nt, Human
gcacuccccugcugg

SEQ ID NO: 2407255 - RNA, 12 nt, Human
gcacuccccugc

SEQ ID NO: 2407256 - RNA, 14 nt, Human
gcacuccccugcug

SEQ ID NO: 2407257 - RNA, 13 nt, Human
gcacuccccugcu

SEQ ID NO: 2407258 - RNA, 14 nt, Human
gcacuccagccugg

SEQ ID NO: 2407259 - RNA, 15 nt, Human
gcagaaaacauuguu

SEQ ID NO: 2407260 - RNA, 14 nt, Human
gcagaaaacauugu

SEQ ID NO: 2407261 - RNA, 13 nt, Human
gcagaaaacauug

SEQ ID NO: 2407262 - RNA, 12 nt, Human
gcagaaaacauu

SEQ ID NO: 2407263 - RNA, 18 nt, Human
gcagaaaaaugucauuga

SEQ ID NO: 2407264 - RNA, 15 nt, Human
gcagaaaagcaccug

SEQ ID NO: 2407265 - RNA, 16 nt, Human
gcagaaaagcaccugc

SEQ ID NO: 2407266 - RNA, 17 nt, Human
gcagaaaagcaccugcc

SEQ ID NO: 2407267 - RNA, 18 nt, Human
gcagaaaagcaccugccg

SEQ ID NO: 2407268 - RNA, 22 nt, Human
gcacuuuguucuggcucuucca

SEQ ID NO: 2407269 - RNA, 20 nt, Human
gcacuuuuucauuugccuau

SEQ ID NO: 2407270 - RNA, 14 nt, Human
gcacuuuuucauuu

SEQ ID NO: 2407271 - RNA, 20 nt, Human
gcacuuuuuaauucaccaaa

SEQ ID NO: 2407272 - RNA, 16 nt, Human
gcacuuuuuaauucac

SEQ ID NO: 2407273 - RNA, 12 nt, Human
gcacuccagccu

SEQ ID NO: 2407274 - RNA, 12 nt, Human
gcagaacaguga

SEQ ID NO: 2407275 - RNA, 13 nt, Human
gcagaacagugau

SEQ ID NO: 2407276 - RNA, 21 nt, Human
gcagaaaagcaccugccgacc

SEQ ID NO: 2407277 - RNA, 22 nt, Human
gcagaaaaucuuuuacuagugu

SEQ ID NO: 2407278 - RNA, 20 nt, Human
gcagaaaagcaccugccgac

SEQ ID NO: 2407279 - RNA, 14 nt, Human
gcagaaaauugcac

SEQ ID NO: 2407280 - RNA, 16 nt, Human
gcagaaaauugccuaa

SEQ ID NO: 2407281 - RNA, 23 nt, Human
gcagaaagcaaaugugaccugug

SEQ ID NO: 2407282 - RNA, 20 nt, Human
gcagaaagcaaaauuauguu

SEQ ID NO: 2407283 - RNA, 18 nt, Human
gcagaacagugauuacca

SEQ ID NO: 2407284 - RNA, 22 nt, Human
gcagaacagugauuaccaggga

SEQ ID NO: 2407285 - RNA, 19 nt, Human
gcagaacuaaacucauuua

SEQ ID NO: 2407286 - RNA, 21 nt, Human
gcagaacuaaacucauuuaua

SEQ ID NO: 2407287 - RNA, 14 nt, Human
gcagaacugagcuc

SEQ ID NO: 2407288 - RNA, 16 nt, Human
gcagaacugagcuccu

SEQ ID NO: 2407289 - RNA, 13 nt, Human
gcagaacggagcc

SEQ ID NO: 2407290 - RNA, 24 nt, Human
gcagaacggagccccaggccucug

SEQ ID NO: 2407291 - RNA, 21 nt, Human
gcagaacguauugguccagcu

SEQ ID NO: 2407292 - RNA, 23 nt, Human
gcagaacagccgcuccugucugc

SEQ ID NO: 2407293 - RNA, 23 nt, Human
gcagagcuggcucugagcgccuc

SEQ ID NO: 2407294 - RNA, 17 nt, Human
gcagagcuggcucugag

SEQ ID NO: 2407295 - RNA, 15 nt, Human
gcagagcuggcucug

SEQ ID NO: 2407296 - RNA, 14 nt, Human
gcagagcuggcucu

SEQ ID NO: 2407297 - RNA, 13 nt, Human
gcagagcuggcuc

SEQ ID NO: 2407298 - RNA, 12 nt, Human
gcagagcuggcu

SEQ ID NO: 2407299 - RNA, 17 nt, Human
gcagagcugcgggcugg

SEQ ID NO: 2407300 - RNA, 19 nt, Human
gcagagcugcgggcugggu

SEQ ID NO: 2407301 - RNA, 18 nt, Human
gcagaacugagcuccucu

SEQ ID NO: 2407302 - RNA, 20 nt, Human
gcagaggaaagcaaaggaga

SEQ ID NO: 2407303 - RNA, 18 nt, Human
gcagaggaaagcaaagga

SEQ ID NO: 2407304 - RNA, 14 nt, Human
gcagaggaaagcaa

SEQ ID NO: 2407305 - RNA, 13 nt, Human
gcagaggaaagca

SEQ ID NO: 2407306 - RNA, 11 nt, Human
gcagaggacag

SEQ ID NO: 2407307 - RNA, 17 nt, Human
gcagagcuuggacugga

SEQ ID NO: 2407308 - RNA, 16 nt, Human
gcagagcuucuuccag

SEQ ID NO: 2407309 - RNA, 22 nt, Human
gcagagcuucuuccaggugccc

SEQ ID NO: 2407310 - RNA, 21 nt, Human
gcagaggaaagcaaaggagau

SEQ ID NO: 2407311 - RNA, 12 nt, Human
gcagaggagggg

SEQ ID NO: 2407312 - RNA, 14 nt, Human
gcagaggaggggcc

SEQ ID NO: 2407313 - RNA, 21 nt, Human
gcagaggaggggccgcugcca

SEQ ID NO: 2407314 - RNA, 12 nt, Human
gcagaggccaga

SEQ ID NO: 2407315 - RNA, 12 nt, Human
gcagaggcacug

SEQ ID NO: 2407316 - RNA, 15 nt, Human
gcagaggaggggccg

SEQ ID NO: 2407317 - RNA, 12 nt, Human
gcagaggcagcg

SEQ ID NO: 2407318 - RNA, 23 nt, Human
gcagcauauucaggaagcucagg

SEQ ID NO: 2407319 - RNA, 19 nt, Human
gcagcauauucaggaagcu

SEQ ID NO: 2407320 - RNA, 18 nt, Human
gcagcauauucaggaagc

SEQ ID NO: 2407321 - RNA, 17 nt, Human
gcagcauauucaggaag

SEQ ID NO: 2407322 - RNA, 12 nt, Human
gcagccaaggga

SEQ ID NO: 2407323 - RNA, 23 nt, Human
gcagccaaggccgaagcucuggc

SEQ ID NO: 2407324 - RNA, 22 nt, Human
gcagcauguugcugaggaguga

SEQ ID NO: 2407325 - RNA, 13 nt, Human
gcagccaagcucc

SEQ ID NO: 2407326 - RNA, 17 nt, Human
gcagccaagcuccuugg

SEQ ID NO: 2407327 - RNA, 22 nt, Human
gcagccaaggccgaagcucugg

SEQ ID NO: 2407328 - RNA, 21 nt, Human
gcagccaaggccgaagcucug

SEQ ID NO: 2407329 - RNA, 12 nt, Human
gcagccaaggcc

SEQ ID NO: 2407330 - RNA, 20 nt, Human
gcagccaagcuccuugggag

SEQ ID NO: 2407331 - RNA, 15 nt, Human
gcagcaucugcuaau

SEQ ID NO: 2407332 - RNA, 15 nt, Human
gcagcaucuucaaac

SEQ ID NO: 2407333 - RNA, 19 nt, Human
gcagcaucuucacuucuaa

SEQ ID NO: 2407334 - RNA, 21 nt, Human
gcagccaaacccaugaggcaa

SEQ ID NO: 2407335 - RNA, 20 nt, Human
gcagcauguugcugaggagu

SEQ ID NO: 2407336 - RNA, 21 nt, Human
gcagcaucuucaaacauguac

SEQ ID NO: 2407337 - RNA, 17 nt, Human
gcagcaugaccugugac

SEQ ID NO: 2407338 - RNA, 15 nt, Human
gcagcagugugaggc

SEQ ID NO: 2407339 - RNA, 19 nt, Human
gcagcagugugaggccagg

SEQ ID NO: 2407340 - RNA, 20 nt, Human
gcagcagugugaggccaggg

SEQ ID NO: 2407341 - RNA, 21 nt, Human
gcagcagugugaggccagggc

SEQ ID NO: 2407342 - RNA, 22 nt, Human
gcagcagugugaggccagggca

SEQ ID NO: 2407343 - RNA, 23 nt, Human
gcagcagugugaggccagggcag

SEQ ID NO: 2407344 - RNA, 12 nt, Human
gcagcauaaagg

SEQ ID NO: 2407345 - RNA, 15 nt, Human
gcagcauaaaggccu

SEQ ID NO: 2407346 - RNA, 14 nt, Human
gcagcauaugagga

SEQ ID NO: 2407347 - RNA, 11 nt, Human
gcagaggggca

SEQ ID NO: 2407348 - RNA, 16 nt, Human
gcagcagugaaaacaa

SEQ ID NO: 2407349 - RNA, 15 nt, Human
gcagcagugaaaaca

SEQ ID NO: 2407350 - RNA, 14 nt, Human
gcagcagugaaaac

SEQ ID NO: 2407351 - RNA, 20 nt, Human
gcagcagguggcagaauggg

SEQ ID NO: 2407352 - RNA, 21 nt, Human
gcagcagugaaaacaagugcu

SEQ ID NO: 2407353 - RNA, 18 nt, Human
gcagcagugaaaacaagu

SEQ ID NO: 2407354 - RNA, 17 nt, Human
gcagcagugagucucuu

SEQ ID NO: 2407355 - RNA, 21 nt, Human
gcagcagugagucucuucaga

SEQ ID NO: 2407356 - RNA, 14 nt, Human
gcagagggcacaga

SEQ ID NO: 2407357 - RNA, 22 nt, Human
gcagaggcuggaggcagggccu

SEQ ID NO: 2407358 - RNA, 16 nt, Human
gcagagggcagaggcu

SEQ ID NO: 2407359 - RNA, 18 nt, Human
gcagagggcagaggcugg

SEQ ID NO: 2407360 - RNA, 19 nt, Human
gcagagggcagaggcugga

SEQ ID NO: 2407361 - RNA, 15 nt, Human
gcagaggccagaggc

SEQ ID NO: 2407362 - RNA, 11 nt, Human
gcagaggcugg

SEQ ID NO: 2407363 - RNA, 19 nt, Human
gcagaggcuggaggcaggg

SEQ ID NO: 2407364 - RNA, 21 nt, Human
gcagaggcuggaggcagggcc

SEQ ID NO: 2407365 - RNA, 18 nt, Human
gcagcccaccccucaaca

SEQ ID NO: 2407366 - RNA, 20 nt, Human
gcagccaggccacuggcccc

SEQ ID NO: 2407367 - RNA, 15 nt, Human
gcagccagcucucag

SEQ ID NO: 2407368 - RNA, 16 nt, Human
gcagccagcucucagc

SEQ ID NO: 2407369 - RNA, 17 nt, Human
gcagccagcucucagcc

SEQ ID NO: 2407370 - RNA, 18 nt, Human
gcagccagcucucagcca

SEQ ID NO: 2407371 - RNA, 12 nt, Human
gcagccaggcug

SEQ ID NO: 2407372 - RNA, 13 nt, Human
gcagccaggcugc

SEQ ID NO: 2407373 - RNA, 14 nt, Human
gcagccaggcugcc

SEQ ID NO: 2407374 - RNA, 17 nt, Human
gcagccaggcugccaag

SEQ ID NO: 2407375 - RNA, 15 nt, Human
gcagccacauuccug

SEQ ID NO: 2407376 - RNA, 13 nt, Human
gcagccagcccag

SEQ ID NO: 2407377 - RNA, 15 nt, Human
gcagccagcccagcc

SEQ ID NO: 2407378 - RNA, 16 nt, Human
gcagccagcccagccc

SEQ ID NO: 2407379 - RNA, 17 nt, Human
gcagccagcccagccca

SEQ ID NO: 2407380 - RNA, 13 nt, Human
gcagccagcucuc

SEQ ID NO: 2407381 - RNA, 21 nt, Human
gcagccagcccagcccagcug

SEQ ID NO: 2407382 - RNA, 23 nt, Human
gcagccagcccagcccagcuggu

SEQ ID NO: 2407383 - RNA, 21 nt, Human
gcagcucaucucugucccacu

SEQ ID NO: 2407384 - RNA, 19 nt, Human
gcagcucaucucuguccca

SEQ ID NO: 2407385 - RNA, 21 nt, Human
gcagcucuccagucaggaggc

SEQ ID NO: 2407386 - RNA, 15 nt, Human
gcagcucuccaguca

SEQ ID NO: 2407387 - RNA, 14 nt, Human
gcagcucuccaguc

SEQ ID NO: 2407388 - RNA, 14 nt, Human
gcagcucaucucug

SEQ ID NO: 2407389 - RNA, 22 nt, Human
gcagugagaaaaagcuccuguc

SEQ ID NO: 2407390 - RNA, 23 nt, Human
gcagugagaaaaagcuccugucc

SEQ ID NO: 2407391 - RNA, 21 nt, Human
gcagugagaaaaagcuccugu

SEQ ID NO: 2407392 - RNA, 21 nt, Human
gcagugaauugugaccaaguu

SEQ ID NO: 2407393 - RNA, 20 nt, Human
gcagugaaugauucaguguu

SEQ ID NO: 2407394 - RNA, 18 nt, Human
gcagugaaagacaagcug

SEQ ID NO: 2407395 - RNA, 14 nt, Human
gcagugaauuguga

SEQ ID NO: 2407396 - RNA, 18 nt, Human
gcagugacgugcaccugu

SEQ ID NO: 2407397 - RNA, 20 nt, Human
gcagugagaaaaagcuccug

SEQ ID NO: 2407398 - RNA, 19 nt, Human
gcagugaguuacagcgaga

SEQ ID NO: 2407399 - RNA, 21 nt, Human
gcagugagugagccuggcucu

SEQ ID NO: 2407400 - RNA, 20 nt, Human
gcagugagugagccuggcuc

SEQ ID NO: 2407401 - RNA, 19 nt, Human
gcagugagugagccuggcu

SEQ ID NO: 2407402 - RNA, 18 nt, Human
gcagugagugagccuggc

SEQ ID NO: 2407403 - RNA, 17 nt, Human
gcagugagugagccugg

SEQ ID NO: 2407404 - RNA, 15 nt, Human
gcagugagugagccu

SEQ ID NO: 2407405 - RNA, 18 nt, Human
gcagugagucucuucaga

SEQ ID NO: 2407406 - RNA, 14 nt, Human
gcagugagcggaga

SEQ ID NO: 2407407 - RNA, 21 nt, Human
gcagugagccgcaucuucucc

SEQ ID NO: 2407408 - RNA, 14 nt, Human
gcagugagcugaga

SEQ ID NO: 2407409 - RNA, 20 nt, Human
gcagugagccaagauugcgc

SEQ ID NO: 2407410 - RNA, 17 nt, Human
gcagucugauccaggag

SEQ ID NO: 2407411 - RNA, 18 nt, Human
gcagucucggguggcuag

SEQ ID NO: 2407412 - RNA, 21 nt, Human
gcagugaaaacaagugcuggc

SEQ ID NO: 2407413 - RNA, 12 nt, Human
gcagucuggagg

SEQ ID NO: 2407414 - RNA, 13 nt, Human
gcagucuggaggg

SEQ ID NO: 2407415 - RNA, 14 nt, Human
gcagucuggagggg

SEQ ID NO: 2407416 - RNA, 15 nt, Human
gcagucuggaggggc

SEQ ID NO: 2407417 - RNA, 19 nt, Human
gcagucuggcugagcccug

SEQ ID NO: 2407418 - RNA, 16 nt, Human
gcagucuggaggggca

SEQ ID NO: 2407419 - RNA, 21 nt, Human
gcagcugauguuggaagagaa

SEQ ID NO: 2407420 - RNA, 16 nt, Human
gcagcugauacaaauu

SEQ ID NO: 2407421 - RNA, 14 nt, Human
gcagcugccagaga

SEQ ID NO: 2407422 - RNA, 15 nt, Human
gcagcugccagagaa

SEQ ID NO: 2407423 - RNA, 14 nt, Human
gcagcugauuuuaa

SEQ ID NO: 2407424 - RNA, 15 nt, Human
gcagcugauuuuaac

SEQ ID NO: 2407425 - RNA, 17 nt, Human
gcagcugauuuuaacaa

SEQ ID NO: 2407426 - RNA, 18 nt, Human
gcagcugauuuuaacaau

SEQ ID NO: 2407427 - RNA, 19 nt, Human
gcagucgugccugugucca

SEQ ID NO: 2407428 - RNA, 18 nt, Human
gcagucgugccugugucc

SEQ ID NO: 2407429 - RNA, 17 nt, Human
gcagucgugccuguguc

SEQ ID NO: 2407430 - RNA, 16 nt, Human
gcagucgugccugugu

SEQ ID NO: 2407431 - RNA, 20 nt, Human
gcagucuauauguuuguaua

SEQ ID NO: 2407432 - RNA, 16 nt, Human
gcagucuacccaccuc

SEQ ID NO: 2407433 - RNA, 23 nt, Human
gcagcucuugcuaaucagugucu

SEQ ID NO: 2407434 - RNA, 14 nt, Human
gcagcugaccucug

SEQ ID NO: 2407435 - RNA, 22 nt, Human
gcagcugaaauaugcuggcugg

SEQ ID NO: 2407436 - RNA, 19 nt, Human
gcagcugaaauaugcuggc

SEQ ID NO: 2407437 - RNA, 22 nt, Human
gcagcucuugcuaaucaguguc

SEQ ID NO: 2407438 - RNA, 13 nt, Human
gcagcucuugcua

SEQ ID NO: 2407439 - RNA, 18 nt, Human
gcagcugaaauaugcugg

SEQ ID NO: 2407440 - RNA, 23 nt, Human
gcagcucuugcccuucccugucc

SEQ ID NO: 2407441 - RNA, 20 nt, Human
gcagcucuugcccuucccug

SEQ ID NO: 2407442 - RNA, 19 nt, Human
gcagcucuugcccuucccu

SEQ ID NO: 2407443 - RNA, 18 nt, Human
gcagcucuugcccuuccc

SEQ ID NO: 2407444 - RNA, 17 nt, Human
gcagcucuugcccuucc

SEQ ID NO: 2407445 - RNA, 16 nt, Human
gcagcucuugcccuuc

SEQ ID NO: 2407446 - RNA, 15 nt, Human
gcagcucuugcccuu

SEQ ID NO: 2407447 - RNA, 14 nt, Human
gcagcucuugcccu

SEQ ID NO: 2407448 - RNA, 20 nt, Human
gcagcucuggacagccccac

SEQ ID NO: 2407449 - RNA, 12 nt, Human
gcagcucucccc

SEQ ID NO: 2407450 - RNA, 13 nt, Human
gcagugaugucac

SEQ ID NO: 2407451 - RNA, 21 nt, Human
gcagugauauggcagaagaca

SEQ ID NO: 2407452 - RNA, 19 nt, Human
gcagugauauggcagaaga

SEQ ID NO: 2407453 - RNA, 16 nt, Human
gcagugauauggcaga

SEQ ID NO: 2407454 - RNA, 20 nt, Human
gcagugaguuacagcgagag

SEQ ID NO: 2407455 - RNA, 22 nt, Human
gcagugauauggcagaagacac

SEQ ID NO: 2407456 - RNA, 21 nt, Human
gcagugaugcuggaugcuccu

SEQ ID NO: 2407457 - RNA, 22 nt, Human
gcaguuguugcccacagcugua

SEQ ID NO: 2407458 - RNA, 14 nt, Human
gcaguuggccagag

SEQ ID NO: 2407459 - RNA, 22 nt, Human
gcaguuggccagagagccuggu

SEQ ID NO: 2407460 - RNA, 16 nt, Human
gcauacguacacauuu

SEQ ID NO: 2407461 - RNA, 17 nt, Human
gcauacguacacauuuu

SEQ ID NO: 2407462 - RNA, 15 nt, Human
gcauacguacacauu

SEQ ID NO: 2407463 - RNA, 13 nt, Human
gcaguugugucag

SEQ ID NO: 2407464 - RNA, 14 nt, Human
gcaguuuaucauuc

SEQ ID NO: 2407465 - RNA, 18 nt, Human
gcauacguacacauuuua

SEQ ID NO: 2407466 - RNA, 18 nt, Human
gcaucccugaggagccag

SEQ ID NO: 2407467 - RNA, 20 nt, Human
gcauccccuuggcugugagg

SEQ ID NO: 2407468 - RNA, 21 nt, Human
gcauccccuuggcugugaggc

SEQ ID NO: 2407469 - RNA, 19 nt, Human
gcauccccuuggcugugag

SEQ ID NO: 2407470 - RNA, 13 nt, Human
gcaucccagggga

SEQ ID NO: 2407471 - RNA, 14 nt, Human
gcaucccaggggac

SEQ ID NO: 2407472 - RNA, 15 nt, Human
gcaucccaggggacc

SEQ ID NO: 2407473 - RNA, 16 nt, Human
gcaucccaggggacca

SEQ ID NO: 2407474 - RNA, 19 nt, Human
gcaucccaggggaccacac

SEQ ID NO: 2407475 - RNA, 21 nt, Human
gcaucccaggggaccacaccu

SEQ ID NO: 2407476 - RNA, 14 nt, Human
gcaucccaguggcc

SEQ ID NO: 2407477 - RNA, 15 nt, Human
gcaucccaguggccu

SEQ ID NO: 2407478 - RNA, 16 nt, Human
gcaucccaguggccuc

SEQ ID NO: 2407479 - RNA, 17 nt, Human
gcaucccaguggccuca

SEQ ID NO: 2407480 - RNA, 23 nt, Human
gcaucccaguggccucaacccuc

SEQ ID NO: 2407481 - RNA, 20 nt, Human
gcaucccaguggccucaacc

SEQ ID NO: 2407482 - RNA, 18 nt, Human
gcaucccuugaccaggcc

SEQ ID NO: 2407483 - RNA, 20 nt, Human
gcaucccuugaccaggccug

SEQ ID NO: 2407484 - RNA, 22 nt, Human
gcaucccuugaccaggccuggg

SEQ ID NO: 2407485 - RNA, 17 nt, Human
gcauccguaguucccug

SEQ ID NO: 2407486 - RNA, 18 nt, Human
gcauccuccacaauagca

SEQ ID NO: 2407487 - RNA, 19 nt, Human
gcauccuccaagaaucuau

SEQ ID NO: 2407488 - RNA, 15 nt, Human
gcauccuccaagaau

SEQ ID NO: 2407489 - RNA, 14 nt, Human
gcauccuccaagaa

SEQ ID NO: 2407490 - RNA, 18 nt, Human
gcauccguaguucccuga

SEQ ID NO: 2407491 - RNA, 19 nt, Human
gcauccguaguucccugaa

SEQ ID NO: 2407492 - RNA, 23 nt, Human
gcauccuagucucuaucauuaaa

SEQ ID NO: 2407493 - RNA, 11 nt, Human
gcauccuaguc

SEQ ID NO: 2407494 - RNA, 17 nt, Human
gcauccaguaucuugaa

SEQ ID NO: 2407495 - RNA, 14 nt, Human
gcauccaguaucuu

SEQ ID NO: 2407496 - RNA, 17 nt, Human
gcauccauguguggacu

SEQ ID NO: 2407497 - RNA, 12 nt, Human
gcauccauuccu

SEQ ID NO: 2407498 - RNA, 14 nt, Human
gcauccauuccuca

SEQ ID NO: 2407499 - RNA, 15 nt, Human
gcauccauuccucag

SEQ ID NO: 2407500 - RNA, 16 nt, Human
gcauccauuccucagg

SEQ ID NO: 2407501 - RNA, 18 nt, Human
gcauccauuccucaggga

SEQ ID NO: 2407502 - RNA, 21 nt, Human
gcauccauuccucagggacag

SEQ ID NO: 2407503 - RNA, 18 nt, Human
gcauccaguaucuugaag

SEQ ID NO: 2407504 - RNA, 20 nt, Human
gcaucuagcaugucgucaaa

SEQ ID NO: 2407505 - RNA, 21 nt, Human
gcaucuagaggcuuccuucau

SEQ ID NO: 2407506 - RNA, 13 nt, Human
gcaucguggagac

SEQ ID NO: 2407507 - RNA, 22 nt, Human
gcaucuagaggcuuccuucauu

SEQ ID NO: 2407508 - RNA, 23 nt, Human
gcaucuagaggcuuccuucauuu

SEQ ID NO: 2407509 - RNA, 17 nt, Human
gcauggcccuggggucc

SEQ ID NO: 2407510 - RNA, 16 nt, Human
gcauggcccugggguc

SEQ ID NO: 2407511 - RNA, 17 nt, Human
gcauggcuccagaaaug

SEQ ID NO: 2407512 - RNA, 22 nt, Human
gcauggcccuggggucccacga

SEQ ID NO: 2407513 - RNA, 19 nt, Human
gcauggcuccagaaauguc

SEQ ID NO: 2407514 - RNA, 18 nt, Human
gcauggcuccagaaaugu

SEQ ID NO: 2407515 - RNA, 13 nt, Human
gcauggcuccagu

SEQ ID NO: 2407516 - RNA, 14 nt, Human
gcauggcuccaguc

SEQ ID NO: 2407517 - RNA, 23 nt, Human
gcauccugccuuagagccaggca

SEQ ID NO: 2407518 - RNA, 21 nt, Human
gcauccugccuuagagccagg

SEQ ID NO: 2407519 - RNA, 17 nt, Human
gcauccuccgccucccg

SEQ ID NO: 2407520 - RNA, 13 nt, Human
gcauccuggcacc

SEQ ID NO: 2407521 - RNA, 21 nt, Human
gcauggcugccaaugggagcu

SEQ ID NO: 2407522 - RNA, 19 nt, Human
gcaugggaaagccaccucu

SEQ ID NO: 2407523 - RNA, 18 nt, Human
gcaugggaaagccaccuc

SEQ ID NO: 2407524 - RNA, 15 nt, Human
gcauggcuccagucu

SEQ ID NO: 2407525 - RNA, 21 nt, Human
gcauggcuccagucugcugcc

SEQ ID NO: 2407526 - RNA, 15 nt, Human
gcauggcugugagga

SEQ ID NO: 2407527 - RNA, 22 nt, Human
gcauggcuccagucugcugccc

SEQ ID NO: 2407528 - RNA, 18 nt, Human
gcauggucacacacugau

SEQ ID NO: 2407529 - RNA, 15 nt, Human
gcauggucacacacu

SEQ ID NO: 2407530 - RNA, 19 nt, Human
gcauggggugggccucugg

SEQ ID NO: 2407531 - RNA, 21 nt, Human
gcaugggugaagggagagcca

SEQ ID NO: 2407532 - RNA, 18 nt, Human
gcauggggugggccucug

SEQ ID NO: 2407533 - RNA, 15 nt, Human
gcauggggugggccu

SEQ ID NO: 2407534 - RNA, 20 nt, Human
gcaugggaaagccaccucuc

SEQ ID NO: 2407535 - RNA, 16 nt, Human
gcauggugccccagga

SEQ ID NO: 2407536 - RNA, 17 nt, Human
gcauggugccccaggac

SEQ ID NO: 2407537 - RNA, 18 nt, Human
gcauggugccccaggacc

SEQ ID NO: 2407538 - RNA, 19 nt, Human
gcauggugccccaggacca

SEQ ID NO: 2407539 - RNA, 13 nt, Human
gcauggugcaguu

SEQ ID NO: 2407540 - RNA, 15 nt, Human
gcauggugccccagg

SEQ ID NO: 2407541 - RNA, 19 nt, Human
gcaugguggcgcaagccug

SEQ ID NO: 2407542 - RNA, 20 nt, Human
gcauggugccccaggaccag

SEQ ID NO: 2407543 - RNA, 21 nt, Human
gcauggugccccaggaccagc

SEQ ID NO: 2407544 - RNA, 23 nt, Human
gcauggugccccaggaccagcuc

SEQ ID NO: 2407545 - RNA, 15 nt, Human
gcaugguggcaccag

SEQ ID NO: 2407546 - RNA, 15 nt, Human
gcauugugggaaggg

SEQ ID NO: 2407547 - RNA, 13 nt, Human
gcauugugggaag

SEQ ID NO: 2407548 - RNA, 17 nt, Human
gcauguggccuguggcc

SEQ ID NO: 2407549 - RNA, 12 nt, Human
gcauguggccug

SEQ ID NO: 2407550 - RNA, 20 nt, Human
gcauguacaguguucuguuu

SEQ ID NO: 2407551 - RNA, 13 nt, Human
gcauguacagugu

SEQ ID NO: 2407552 - RNA, 21 nt, Human
gcaugugaugagaggaaauca

SEQ ID NO: 2407553 - RNA, 11 nt, Human
gcauguacagu

SEQ ID NO: 2407554 - RNA, 18 nt, Human
gcaugugaugagaggaaa

SEQ ID NO: 2407555 - RNA, 19 nt, Human
gcaugugaugagaggaaau

SEQ ID NO: 2407556 - RNA, 17 nt, Human
gcauguaaacacgccug

SEQ ID NO: 2407557 - RNA, 19 nt, Human
gcauguaaacacgccugca

SEQ ID NO: 2407558 - RNA, 15 nt, Human
gcauguaaacacgcc

SEQ ID NO: 2407559 - RNA, 18 nt, Human
gcauugugggaaggggag

SEQ ID NO: 2407560 - RNA, 16 nt, Human
gcauugugggaagggg

SEQ ID NO: 2407561 - RNA, 16 nt, Human
gcauuuaaaagauaca

SEQ ID NO: 2407562 - RNA, 17 nt, Human
gcauuuaaaagauacag

SEQ ID NO: 2407563 - RNA, 18 nt, Human
gcauuuaaaagauacagu

SEQ ID NO: 2407564 - RNA, 22 nt, Human
gcauuuaaaagauacaguuacu

SEQ ID NO: 2407565 - RNA, 15 nt, Human
gcauuuacuuugugu

SEQ ID NO: 2407566 - RNA, 16 nt, Human
gcauguggccuguggc

SEQ ID NO: 2407567 - RNA, 12 nt, Human
gcauguguauuu

SEQ ID NO: 2407568 - RNA, 20 nt, Human
gcauguguauuuccagugca

SEQ ID NO: 2407569 - RNA, 13 nt, Human
gauggaaugaugg

SEQ ID NO: 2407570 - RNA, 18 nt, Human
gauggaaccgcaggaagc

SEQ ID NO: 2407571 - RNA, 19 nt, Human
gauggaaccgcaggaagcu

SEQ ID NO: 2407572 - RNA, 20 nt, Human
gauggaaccgcaggaagcug

SEQ ID NO: 2407573 - RNA, 22 nt, Human
gauggaaccgcaggaagcugcu

SEQ ID NO: 2407574 - RNA, 15 nt, Human
gauggaagcuuccag

SEQ ID NO: 2407575 - RNA, 21 nt, Human
gauggaaguugcagugagcug

SEQ ID NO: 2407576 - RNA, 18 nt, Human
gauuuuuuuuuccuucag

SEQ ID NO: 2407577 - RNA, 17 nt, Human
gauuuuuuuuuccuuca

SEQ ID NO: 2407578 - RNA, 12 nt, Human
gauuucacucuc

SEQ ID NO: 2407579 - RNA, 16 nt, Human
gauuuuuuuuuccuuc

SEQ ID NO: 2407580 - RNA, 15 nt, Human
gauuuaauucucuug

SEQ ID NO: 2407581 - RNA, 13 nt, Human
gauuuaauucucu

SEQ ID NO: 2407582 - RNA, 12 nt, Human
gauuuaauucuc

SEQ ID NO: 2407583 - RNA, 23 nt, Human
gauuuaauuugauaucacagucu

SEQ ID NO: 2407584 - RNA, 19 nt, Human
gauuuaauuugauaucaca

SEQ ID NO: 2407585 - RNA, 19 nt, Human
gauuuacagccucacuuga

SEQ ID NO: 2407586 - RNA, 16 nt, Human
gauuuacacugggaga

SEQ ID NO: 2407587 - RNA, 11 nt, Human
gauuucacucu

SEQ ID NO: 2407588 - RNA, 18 nt, Human
gauuuauuucaucauauu

SEQ ID NO: 2407589 - RNA, 22 nt, Human
gauuuauuucaucauauuauac

SEQ ID NO: 2407590 - RNA, 13 nt, Human
gcaaaaagcaaaa

SEQ ID NO: 2407591 - RNA, 17 nt, Human
gcaaaagaugcuucuca

SEQ ID NO: 2407592 - RNA, 20 nt, Human
gcaaaaggaucuuuguggcc

SEQ ID NO: 2407593 - RNA, 21 nt, Human
gcaaaaggaucuuuguggcca

SEQ ID NO: 2407594 - RNA, 14 nt, Human
gcaaaaauauuuau

SEQ ID NO: 2407595 - RNA, 23 nt, Human
gcaaaaauauuuauaaaacuucu

SEQ ID NO: 2407596 - RNA, 22 nt, Human
gcaaaagaugcuucucacugcc

SEQ ID NO: 2407597 - RNA, 14 nt, Human
gcaaaaaggcagga

SEQ ID NO: 2407598 - RNA, 21 nt, Human
gauuuuuuuuuccuucagugc

SEQ ID NO: 2407599 - RNA, 15 nt, Human
gauuucaagccugcc

SEQ ID NO: 2407600 - RNA, 17 nt, Human
gauuuaacagaaaugua

SEQ ID NO: 2407601 - RNA, 18 nt, Human
gauuuaacagaaauguac

SEQ ID NO: 2407602 - RNA, 16 nt, Human
gauuuaacagaaaugu

SEQ ID NO: 2407603 - RNA, 20 nt, Human
gauucuucugcuucagccuc

SEQ ID NO: 2407604 - RNA, 21 nt, Human
gauuuaauuaaucaugaaugu

SEQ ID NO: 2407605 - RNA, 22 nt, Human
gauuuaauaguguuaaucaauu

SEQ ID NO: 2407606 - RNA, 21 nt, Human
gauuuaauaguguuaaucaau

SEQ ID NO: 2407607 - RNA, 23 nt, Human
gauuuaauaguguuaaucaauuu

SEQ ID NO: 2407608 - RNA, 20 nt, Human
gauuuaauaguguuaaucaa

SEQ ID NO: 2407609 - RNA, 19 nt, Human
gauuuaauaguguuaauca

SEQ ID NO: 2407610 - RNA, 18 nt, Human
gauuuaauaguguuaauc

SEQ ID NO: 2407611 - RNA, 17 nt, Human
gauuuaauaguguuaau

SEQ ID NO: 2407612 - RNA, 16 nt, Human
gauuuaauaguguuaa

SEQ ID NO: 2407613 - RNA, 15 nt, Human
gauuuaauaguguua

SEQ ID NO: 2407614 - RNA, 23 nt, Human
gauuuaauaaaauaauucuaaag

SEQ ID NO: 2407615 - RNA, 14 nt, Human
gauuuaauaguguu

SEQ ID NO: 2407616 - RNA, 19 nt, Human
gauuuaacagaaauguaca

SEQ ID NO: 2407617 - RNA, 22 nt, Human
gauuuaauaaaauaauucuaaa

SEQ ID NO: 2407618 - RNA, 19 nt, Human
gauuuaauaaaauaauucu

SEQ ID NO: 2407619 - RNA, 15 nt, Human
gauucuucugcuuca

SEQ ID NO: 2407620 - RNA, 13 nt, Human
gauucuucugcuu

SEQ ID NO: 2407621 - RNA, 12 nt, Human
gauucuucugcu

SEQ ID NO: 2407622 - RNA, 15 nt, Human
gcaagugagagcugg

SEQ ID NO: 2407623 - RNA, 16 nt, Human
gcaagugagagcuggg

SEQ ID NO: 2407624 - RNA, 24 nt, Human
gcaaccccaguucugcuccucucc

SEQ ID NO: 2407625 - RNA, 22 nt, Human
gcaaccccaguucugcuccucu

SEQ ID NO: 2407626 - RNA, 21 nt, Human
gcaaccccaguucugcuccuc

SEQ ID NO: 2407627 - RNA, 16 nt, Human
gcaaccucuuggccug

SEQ ID NO: 2407628 - RNA, 23 nt, Human
gcaaccucuuggccugaucagac

SEQ ID NO: 2407629 - RNA, 20 nt, Human
gcaaccuccgccucuugggu

SEQ ID NO: 2407630 - RNA, 20 nt, Human
gcaaccuucgccaccugggu

SEQ ID NO: 2407631 - RNA, 19 nt, Human
gcaaccuggguccaaauaa

SEQ ID NO: 2407632 - RNA, 18 nt, Human
gcaaccuggguccaaaua

SEQ ID NO: 2407633 - RNA, 14 nt, Human
gcaaccugggucca

SEQ ID NO: 2407634 - RNA, 20 nt, Human
gcaaccccaguucugcuccu

SEQ ID NO: 2407635 - RNA, 19 nt, Human
gcaaccccaguucugcucc

SEQ ID NO: 2407636 - RNA, 18 nt, Human
gcaaccccaguucugcuc

SEQ ID NO: 2407637 - RNA, 16 nt, Human
gcaaccccaguucugc

SEQ ID NO: 2407638 - RNA, 19 nt, Human
gcaaccuccgccucuuggg

SEQ ID NO: 2407639 - RNA, 16 nt, Human
gcaacccccagccugc

SEQ ID NO: 2407640 - RNA, 15 nt, Human
gcaacccccagccug

SEQ ID NO: 2407641 - RNA, 14 nt, Human
gcaacccacgugua

SEQ ID NO: 2407642 - RNA, 20 nt, Human
gcaacccaaggacugaggga

SEQ ID NO: 2407643 - RNA, 19 nt, Human
gcaaccccaggcugaagca

SEQ ID NO: 2407644 - RNA, 16 nt, Human
gcaacccaaggacuga

SEQ ID NO: 2407645 - RNA, 14 nt, Human
gcaacccccagccu

SEQ ID NO: 2407646 - RNA, 14 nt, Human
gcaaccacuaagaa

SEQ ID NO: 2407647 - RNA, 20 nt, Human
gcaaccacaggcagcauuua

SEQ ID NO: 2407648 - RNA, 18 nt, Human
gcaaccaguuggcuaggg

SEQ ID NO: 2407649 - RNA, 16 nt, Human
gcaaccaguuggcuag

SEQ ID NO: 2407650 - RNA, 14 nt, Human
gcaaccaguuggcu

SEQ ID NO: 2407651 - RNA, 19 nt, Human
gcaacagcaaaucacgacc

SEQ ID NO: 2407652 - RNA, 22 nt, Human
gcaacagaucuggaaccucagc

SEQ ID NO: 2407653 - RNA, 16 nt, Human
gcaaaauucccaggga

SEQ ID NO: 2407654 - RNA, 13 nt, Human
gcaacaggcuggg

SEQ ID NO: 2407655 - RNA, 15 nt, Human
gcaacaggcugggcu

SEQ ID NO: 2407656 - RNA, 14 nt, Human
gcaacaggcugggc

SEQ ID NO: 2407657 - RNA, 13 nt, Human
gcaaaaugugaau

SEQ ID NO: 2407658 - RNA, 17 nt, Human
gcaaaaugaggaaugua

SEQ ID NO: 2407659 - RNA, 23 nt, Human
gcaaaaucauuuuauaugucaaa

SEQ ID NO: 2407660 - RNA, 20 nt, Human
gcaaaaucauggaaugguua

SEQ ID NO: 2407661 - RNA, 13 nt, Human
gcaaaaucaugga

SEQ ID NO: 2407662 - RNA, 20 nt, Human
gcaaaauaauuuuaaacaaa

SEQ ID NO: 2407663 - RNA, 13 nt, Human
gcaaaauagcauu

SEQ ID NO: 2407664 - RNA, 13 nt, Human
gcaaaauaauuuu

SEQ ID NO: 2407665 - RNA, 15 nt, Human
gcaaaauaauuuuaa

SEQ ID NO: 2407666 - RNA, 19 nt, Human
gcaaaaguucugacuugac

SEQ ID NO: 2407667 - RNA, 18 nt, Human
gcaaaaguucugacuuga

SEQ ID NO: 2407668 - RNA, 17 nt, Human
gcaaaagggugucugag

SEQ ID NO: 2407669 - RNA, 23 nt, Human
gcaaaaggaucuuuguggccaag

SEQ ID NO: 2407670 - RNA, 21 nt, Human
gcaaaagguucacuaaagcag

SEQ ID NO: 2407671 - RNA, 20 nt, Human
gcaaaagguucacuaaagca

SEQ ID NO: 2407672 - RNA, 19 nt, Human
gcaacaggcugggcuucag

SEQ ID NO: 2407673 - RNA, 16 nt, Human
gcaacaggcugggcuu

SEQ ID NO: 2407674 - RNA, 17 nt, Human
gcaacagcauaacaagg

SEQ ID NO: 2407675 - RNA, 20 nt, Human
gcaacagcacuggcucucuc

SEQ ID NO: 2407676 - RNA, 18 nt, Human
gcaacagcacuggcucuc

SEQ ID NO: 2407677 - RNA, 13 nt, Human
gcaacagcacugg

SEQ ID NO: 2407678 - RNA, 21 nt, Human
gcaacaggaaucaagagcugc

SEQ ID NO: 2407679 - RNA, 18 nt, Human
gcaacaggaaucaagagc

SEQ ID NO: 2407680 - RNA, 22 nt, Human
gcaacaggguauggacuaucug

SEQ ID NO: 2407681 - RNA, 13 nt, Human
gcaacauccaaaa

SEQ ID NO: 2407682 - RNA, 17 nt, Human
gcaacauccaaaauagu

SEQ ID NO: 2407683 - RNA, 13 nt, Human
gcaacagguuuua

SEQ ID NO: 2407684 - RNA, 20 nt, Human
gcaacagguuuuauaauuuu

SEQ ID NO: 2407685 - RNA, 17 nt, Human
gcaacaguagcauagga

SEQ ID NO: 2407686 - RNA, 18 nt, Human
gcaaccaccaccaaccac

SEQ ID NO: 2407687 - RNA, 16 nt, Human
gcaaccaccaccaacc

SEQ ID NO: 2407688 - RNA, 13 nt, Human
gcaaccaccacca

SEQ ID NO: 2407689 - RNA, 18 nt, Human
gcaacaucuagcaaaugu

SEQ ID NO: 2407690 - RNA, 20 nt, Human
gaugaucagcuguuugucau

SEQ ID NO: 2407691 - RNA, 22 nt, Human
gaugauccaugaguuugcccug

SEQ ID NO: 2407692 - RNA, 23 nt, Human
gaugauccaugaguuugcccugg

SEQ ID NO: 2407693 - RNA, 19 nt, Human
gaugaucagcuguuuguca

SEQ ID NO: 2407694 - RNA, 22 nt, Human
gaugauuggaggggggaggugg

SEQ ID NO: 2407695 - RNA, 16 nt, Human
gaugauccggauuuaa

SEQ ID NO: 2407696 - RNA, 21 nt, Human
gaugauccggauuuaauuuga

SEQ ID NO: 2407697 - RNA, 17 nt, Human
gaugauuuaaaagggaa

SEQ ID NO: 2407698 - RNA, 13 nt, Human
gaugauccuaggc

SEQ ID NO: 2407699 - RNA, 14 nt, Human
gaugauccuaggca

SEQ ID NO: 2407700 - RNA, 20 nt, Human
gaugcuucuucagagacucc

SEQ ID NO: 2407701 - RNA, 17 nt, Human
gaugcuucuucagagac

SEQ ID NO: 2407702 - RNA, 21 nt, Human
gaugcuucuucagagacuccu

SEQ ID NO: 2407703 - RNA, 14 nt, Human
gaugauuuuuguca

SEQ ID NO: 2407704 - RNA, 22 nt, Human
gaugauuucuugaaaagggugu

SEQ ID NO: 2407705 - RNA, 15 nt, Human
gaugcuucugggaga

SEQ ID NO: 2407706 - RNA, 24 nt, Human
gaugcuugccuagggccuggucca

SEQ ID NO: 2407707 - RNA, 17 nt, Human
gauggaacacggccaca

SEQ ID NO: 2407708 - RNA, 21 nt, Human
gauggaacaggcucagaucuc

SEQ ID NO: 2407709 - RNA, 20 nt, Human
gauggaacccuuuuggcccc

SEQ ID NO: 2407710 - RNA, 22 nt, Human
gauggaacccuuuuggcccccg

SEQ ID NO: 2407711 - RNA, 17 nt, Human
gauggaaccgcaggaag

SEQ ID NO: 2407712 - RNA, 17 nt, Human
gauggaaaaggaagacu

SEQ ID NO: 2407713 - RNA, 15 nt, Human
gauggaaaaggaaga

SEQ ID NO: 2407714 - RNA, 18 nt, Human
gaugauacauccaaagca

SEQ ID NO: 2407715 - RNA, 22 nt, Human
gauggaaaaaccacccccaaau

SEQ ID NO: 2407716 - RNA, 20 nt, Human
gaucugcagggggugugucu

SEQ ID NO: 2407717 - RNA, 13 nt, Human
gaucugccccucc

SEQ ID NO: 2407718 - RNA, 12 nt, Human
gaucuggaaccc

SEQ ID NO: 2407719 - RNA, 14 nt, Human
gaucuggaacccag

SEQ ID NO: 2407720 - RNA, 20 nt, Human
gaucugccccucccugcuuc

SEQ ID NO: 2407721 - RNA, 14 nt, Human
gaucugccccuccc

SEQ ID NO: 2407722 - RNA, 15 nt, Human
gaucuggaacccaga

SEQ ID NO: 2407723 - RNA, 16 nt, Human
gaucuggaacccagac

SEQ ID NO: 2407724 - RNA, 17 nt, Human
gaucuggaacccagacu

SEQ ID NO: 2407725 - RNA, 18 nt, Human
gaucuggaacccagacuc

SEQ ID NO: 2407726 - RNA, 20 nt, Human
gaucuggaacccagacucag

SEQ ID NO: 2407727 - RNA, 12 nt, Human
gaucuggaaccu

SEQ ID NO: 2407728 - RNA, 16 nt, Human
gaucuggaaccucagc

SEQ ID NO: 2407729 - RNA, 17 nt, Human
gaucuggaaccucagcc

SEQ ID NO: 2407730 - RNA, 18 nt, Human
gaucuggaaccucagccu

SEQ ID NO: 2407731 - RNA, 19 nt, Human
gaucuggaaccucagccug

SEQ ID NO: 2407732 - RNA, 20 nt, Human
gaucuggaaccucagccugg

SEQ ID NO: 2407733 - RNA, 23 nt, Human
gaucccaggggcccaaggcggcc

SEQ ID NO: 2407734 - RNA, 24 nt, Human
gaucccaucuugauaagaccacca

SEQ ID NO: 2407735 - RNA, 16 nt, Human
gaucucucaggagcac

SEQ ID NO: 2407736 - RNA, 14 nt, Human
gaucucucaggagc

SEQ ID NO: 2407737 - RNA, 13 nt, Human
gaucucucaggag

SEQ ID NO: 2407738 - RNA, 12 nt, Human
gaucucucagga

SEQ ID NO: 2407739 - RNA, 15 nt, Human
gaucucuaacuucac

SEQ ID NO: 2407740 - RNA, 22 nt, Human
gaucccaccccauuuucugugg

SEQ ID NO: 2407741 - RNA, 17 nt, Human
gauccagccucuccccu

SEQ ID NO: 2407742 - RNA, 17 nt, Human
gaucccagcucacguca

SEQ ID NO: 2407743 - RNA, 19 nt, Human
gaucccagcucacgucaca

SEQ ID NO: 2407744 - RNA, 14 nt, Human
gauccagagcacag

SEQ ID NO: 2407745 - RNA, 12 nt, Human
gauccagccugg

SEQ ID NO: 2407746 - RNA, 23 nt, Human
gauccagcccugaguuccuagcc

SEQ ID NO: 2407747 - RNA, 14 nt, Human
gauccaccugucuc

SEQ ID NO: 2407748 - RNA, 18 nt, Human
gauccaccugucucagcc

SEQ ID NO: 2407749 - RNA, 19 nt, Human
gauccaccugucucagccu

SEQ ID NO: 2407750 - RNA, 24 nt, Human
gaucucucaggagcacaggcagcu

SEQ ID NO: 2407751 - RNA, 22 nt, Human
gaucucucaggagcacaggcag

SEQ ID NO: 2407752 - RNA, 21 nt, Human
gaucucucaggagcacaggca

SEQ ID NO: 2407753 - RNA, 20 nt, Human
gaucucucaggagcacaggc

SEQ ID NO: 2407754 - RNA, 19 nt, Human
gaucucucaggagcacagg

SEQ ID NO: 2407755 - RNA, 18 nt, Human
gaucucucaggagcacag

SEQ ID NO: 2407756 - RNA, 17 nt, Human
gaucucucaggagcaca

SEQ ID NO: 2407757 - RNA, 23 nt, Human
gaucucucaggagcacaggcagc

SEQ ID NO: 2407758 - RNA, 12 nt, Human
gaucucugcagg

SEQ ID NO: 2407759 - RNA, 18 nt, Human
gaucucuugagccuggga

SEQ ID NO: 2407760 - RNA, 23 nt, Human
gaucucugcaggaaauggcugug

SEQ ID NO: 2407761 - RNA, 15 nt, Human
gaucugagucccagg

SEQ ID NO: 2407762 - RNA, 17 nt, Human
gaucugaugcaagcaag

SEQ ID NO: 2407763 - RNA, 18 nt, Human
gaucugagaaucuuuauu

SEQ ID NO: 2407764 - RNA, 15 nt, Human
gaucugagaaucuuu

SEQ ID NO: 2407765 - RNA, 21 nt, Human
gaucugacaugauuccuuccu

SEQ ID NO: 2407766 - RNA, 22 nt, Human
gaucugacaugauuccuuccug

SEQ ID NO: 2407767 - RNA, 14 nt, Human
gaucugagaaucuu

SEQ ID NO: 2407768 - RNA, 19 nt, Human
gaucucuugagccugggag

SEQ ID NO: 2407769 - RNA, 17 nt, Human
gaucugacaugauuccu

SEQ ID NO: 2407770 - RNA, 19 nt, Human
gaucugacaugauuccuuc

SEQ ID NO: 2407771 - RNA, 12 nt, Human
gaucugaacaga

SEQ ID NO: 2407772 - RNA, 19 nt, Human
gaucugaacagaaauacca

SEQ ID NO: 2407773 - RNA, 19 nt, Human
gauacagucccuaaagaaa

SEQ ID NO: 2407774 - RNA, 18 nt, Human
gauacagucccuaaagaa

SEQ ID NO: 2407775 - RNA, 18 nt, Human
gauacauaugagugugga

SEQ ID NO: 2407776 - RNA, 20 nt, Human
gauacauaugaguguggaag

SEQ ID NO: 2407777 - RNA, 17 nt, Human
gauacauccaaagcaga

SEQ ID NO: 2407778 - RNA, 20 nt, Human
gauacauccaaagcagacag

SEQ ID NO: 2407779 - RNA, 21 nt, Human
gauacauccaaagcagacagc

SEQ ID NO: 2407780 - RNA, 23 nt, Human
gauacauccaaagcagacagcuc

SEQ ID NO: 2407781 - RNA, 21 nt, Human
gauacauacaccagcauuccu

SEQ ID NO: 2407782 - RNA, 12 nt, Human
gauacaugugcc

SEQ ID NO: 2407783 - RNA, 13 nt, Human
gauaccagcugga

SEQ ID NO: 2407784 - RNA, 22 nt, Human
gauaccagcgaggaggcuccag

SEQ ID NO: 2407785 - RNA, 15 nt, Human
gauaccagcgaggag

SEQ ID NO: 2407786 - RNA, 19 nt, Human
gauacaguuacucagaauu

SEQ ID NO: 2407787 - RNA, 23 nt, Human
gauacaguuacucagaauucucu

SEQ ID NO: 2407788 - RNA, 16 nt, Human
gauacaguuacucaga

SEQ ID NO: 2407789 - RNA, 21 nt, Human
gauacugcagggccaggacug

SEQ ID NO: 2407790 - RNA, 18 nt, Human
gauacugcagggccagga

SEQ ID NO: 2407791 - RNA, 15 nt, Human
gauacugcccggggc

SEQ ID NO: 2407792 - RNA, 18 nt, Human
gauaccauauacagcuca

SEQ ID NO: 2407793 - RNA, 12 nt, Human
gauaccagcccc

SEQ ID NO: 2407794 - RNA, 17 nt, Human
gauaccagguugaaaga

SEQ ID NO: 2407795 - RNA, 20 nt, Human
gauaccagguugaaagaccu

SEQ ID NO: 2407796 - RNA, 13 nt, Human
gauacucugucag

SEQ ID NO: 2407797 - RNA, 17 nt, Human
gauacucugucagaugg

SEQ ID NO: 2407798 - RNA, 20 nt, Human
gauacugcgacuuucugccu

SEQ ID NO: 2407799 - RNA, 19 nt, Human
gauacugcgacuuucugcc

SEQ ID NO: 2407800 - RNA, 18 nt, Human
gauacugcgacuuucugc

SEQ ID NO: 2407801 - RNA, 17 nt, Human
gauacugcgacuuucug

SEQ ID NO: 2407802 - RNA, 23 nt, Human
gauacugcgacuuucugccugga

SEQ ID NO: 2407803 - RNA, 21 nt, Human
gauacugcgacuuucugccug

SEQ ID NO: 2407804 - RNA, 23 nt, Human
gauacugcuacuguaauuuuaua

SEQ ID NO: 2407805 - RNA, 14 nt, Human
gauacuggaaguuu

SEQ ID NO: 2407806 - RNA, 17 nt, Human
gauacuguaucaugaca

SEQ ID NO: 2407807 - RNA, 21 nt, Human
gauacuguaucaugacaaaga

SEQ ID NO: 2407808 - RNA, 20 nt, Human
gauacuggaaguuuugcauu

SEQ ID NO: 2407809 - RNA, 16 nt, Human
gauacuggaaguuuug

SEQ ID NO: 2407810 - RNA, 19 nt, Human
gauacuggaaguuuugcau

SEQ ID NO: 2407811 - RNA, 16 nt, Human
gauacuguaacacuuu

SEQ ID NO: 2407812 - RNA, 17 nt, Human
gauacugucucuuucau

SEQ ID NO: 2407813 - RNA, 19 nt, Human
gauccaagcuggucccacu

SEQ ID NO: 2407814 - RNA, 17 nt, Human
gauccaagcugguccca

SEQ ID NO: 2407815 - RNA, 16 nt, Human
gauccaagcugguccc

SEQ ID NO: 2407816 - RNA, 12 nt, Human
gauccaagcugg

SEQ ID NO: 2407817 - RNA, 19 nt, Human
gauccaacuaaugccuuac

SEQ ID NO: 2407818 - RNA, 20 nt, Human
gauccaacuaaugccuuacu

SEQ ID NO: 2407819 - RNA, 23 nt, Human
gauccaaaagaagcccccagcua

SEQ ID NO: 2407820 - RNA, 16 nt, Human
gauccaaaagaagccc

SEQ ID NO: 2407821 - RNA, 19 nt, Human
gauccaaaagaagccccca

SEQ ID NO: 2407822 - RNA, 20 nt, Human
gauccaaaagaagcccccag

SEQ ID NO: 2407823 - RNA, 22 nt, Human
gauccaaaagaagcccccagcu

SEQ ID NO: 2407824 - RNA, 23 nt, Human
gaucauuuucuuaucuucugcaa

SEQ ID NO: 2407825 - RNA, 13 nt, Human
gauccaaaagaag

SEQ ID NO: 2407826 - RNA, 20 nt, Human
gaucaacaucuuuucuugcc

SEQ ID NO: 2407827 - RNA, 17 nt, Human
gaucaacaucuuuucuu

SEQ ID NO: 2407828 - RNA, 16 nt, Human
gaucaacaucuuuucu

SEQ ID NO: 2407829 - RNA, 14 nt, Human
gaucaacaucuuuu

SEQ ID NO: 2407830 - RNA, 23 nt, Human
gaucaaauucauuuuuuucacug

SEQ ID NO: 2407831 - RNA, 19 nt, Human
gauccacccaccucagccu

SEQ ID NO: 2407832 - RNA, 18 nt, Human
gauccacccaccucagcc

SEQ ID NO: 2407833 - RNA, 21 nt, Human
gauccaagcuggucccacuca

SEQ ID NO: 2407834 - RNA, 18 nt, Human
gaucaaccagcuaagaaa

SEQ ID NO: 2407835 - RNA, 19 nt, Human
gauccaaguuuacucaacc

SEQ ID NO: 2407836 - RNA, 14 nt, Human
gauccacacacaga

SEQ ID NO: 2407837 - RNA, 15 nt, Human
gauccacacacagag

SEQ ID NO: 2407838 - RNA, 21 nt, Human
gauccacccaccucagccucc

SEQ ID NO: 2407839 - RNA, 20 nt, Human
gauccacccaccucagccuc

SEQ ID NO: 2407840 - RNA, 22 nt, Human
gauccacccaccucagccuccc

SEQ ID NO: 2407841 - RNA, 18 nt, Human
gauccacacacagaggaa

SEQ ID NO: 2407842 - RNA, 16 nt, Human
gauccacacacagagg

SEQ ID NO: 2407843 - RNA, 17 nt, Human
gauccacacacagagga

SEQ ID NO: 2407844 - RNA, 19 nt, Human
gauccacacacagaggaag

SEQ ID NO: 2407845 - RNA, 15 nt, Human
gauauuuucugugcc

SEQ ID NO: 2407846 - RNA, 21 nt, Human
gauauuuucugugccugaaua

SEQ ID NO: 2407847 - RNA, 23 nt, Human
gauauuuucaacgcagcccugcu

SEQ ID NO: 2407848 - RNA, 22 nt, Human
gauauuuucaacgcagcccugc

SEQ ID NO: 2407849 - RNA, 21 nt, Human
gauauuuucaacgcagcccug

SEQ ID NO: 2407850 - RNA, 17 nt, Human
gauauuuuuuucuuuuc

SEQ ID NO: 2407851 - RNA, 15 nt, Human
gauauuuugcuuugu

SEQ ID NO: 2407852 - RNA, 20 nt, Human
gaucaaaagguuaauaaagu

SEQ ID NO: 2407853 - RNA, 20 nt, Human
gaucaaaauaaaaagugaca

SEQ ID NO: 2407854 - RNA, 17 nt, Human
gaucaaaauaaaaagug

SEQ ID NO: 2407855 - RNA, 20 nt, Human
gauauuuucuuccaagcaaa

SEQ ID NO: 2407856 - RNA, 23 nt, Human
gaucaaaagguuaauaaaguaau

SEQ ID NO: 2407857 - RNA, 22 nt, Human
gaucaaaauaaaaagugacaca

SEQ ID NO: 2407858 - RNA, 22 nt, Human
gaucaaaccccgaccaccugcc

SEQ ID NO: 2407859 - RNA, 19 nt, Human
gaucaaauacuuuaaagga

SEQ ID NO: 2407860 - RNA, 17 nt, Human
gaucaaauacuuuaaag

SEQ ID NO: 2407861 - RNA, 16 nt, Human
gaucaaauacuuuaaa

SEQ ID NO: 2407862 - RNA, 14 nt, Human
gaucaaauacuuua

SEQ ID NO: 2407863 - RNA, 17 nt, Human
gaucaaaggcacacagc

SEQ ID NO: 2407864 - RNA, 14 nt, Human
gauagaaauaaaua

SEQ ID NO: 2407865 - RNA, 16 nt, Human
gauagaaauaaauagc

SEQ ID NO: 2407866 - RNA, 20 nt, Human
gauagaaauaaauagcuaua

SEQ ID NO: 2407867 - RNA, 14 nt, Human
gauagaagaacugc

SEQ ID NO: 2407868 - RNA, 16 nt, Human
gauagaagaacugcaa

SEQ ID NO: 2407869 - RNA, 22 nt, Human
gauacuguaacacuuuacaaug

SEQ ID NO: 2407870 - RNA, 17 nt, Human
gauacuugaaaauuaac

SEQ ID NO: 2407871 - RNA, 18 nt, Human
gauacuuugauauuuuca

SEQ ID NO: 2407872 - RNA, 13 nt, Human
gauacuuuacaug

SEQ ID NO: 2407873 - RNA, 23 nt, Human
gauauuucuauuuccuggaaugg

SEQ ID NO: 2407874 - RNA, 19 nt, Human
gauauuuauggggggagaa

SEQ ID NO: 2407875 - RNA, 17 nt, Human
gauauugugaaguacau

SEQ ID NO: 2407876 - RNA, 13 nt, Human
gauauuuauauau

SEQ ID NO: 2407877 - RNA, 16 nt, Human
gauauugugaaguaca

SEQ ID NO: 2407878 - RNA, 16 nt, Human
gauauuuauauauauu

SEQ ID NO: 2407879 - RNA, 23 nt, Human
gauauuuauauuuuuauuuuauu

SEQ ID NO: 2407880 - RNA, 19 nt, Human
gauauuuucaacgcagccc

SEQ ID NO: 2407881 - RNA, 12 nt, Human
gauauuuucaaa

SEQ ID NO: 2407882 - RNA, 18 nt, Human
gauauuuucaaauuguau

SEQ ID NO: 2407883 - RNA, 19 nt, Human
gauauuuucaaauuguauc

SEQ ID NO: 2407884 - RNA, 20 nt, Human
gauauuuucaaauuguaucu

SEQ ID NO: 2407885 - RNA, 22 nt, Human
gauauuucccuccccuggggac

SEQ ID NO: 2407886 - RNA, 21 nt, Human
gauauuuuaccucuuauugca

SEQ ID NO: 2407887 - RNA, 24 nt, Human
gaauauugcugauggugcaaugac

SEQ ID NO: 2407888 - RNA, 22 nt, Human
gaauauugcuuuggucauauga

SEQ ID NO: 2407889 - RNA, 23 nt, Human
gaauauugcugauggugcaauga

SEQ ID NO: 2407890 - RNA, 22 nt, Human
gaauauugcugauggugcaaug

SEQ ID NO: 2407891 - RNA, 13 nt, Human
gaauauugcugau

SEQ ID NO: 2407892 - RNA, 12 nt, Human
gaauauugcuga

SEQ ID NO: 2407893 - RNA, 11 nt, Human
gaauauugcug

SEQ ID NO: 2407894 - RNA, 18 nt, Human
gaauauucccaagcccau

SEQ ID NO: 2407895 - RNA, 18 nt, Human
gaauaugggagaaauagu

SEQ ID NO: 2407896 - RNA, 12 nt, Human
gaauauucagga

SEQ ID NO: 2407897 - RNA, 15 nt, Human
gaauauucaggacuu

SEQ ID NO: 2407898 - RNA, 18 nt, Human
gaauaugauuaguaaaga

SEQ ID NO: 2407899 - RNA, 16 nt, Human
gaauauccaugaccua

SEQ ID NO: 2407900 - RNA, 17 nt, Human
gaauauccccucccagu

SEQ ID NO: 2407901 - RNA, 22 nt, Human
gaauauccccucccagucaccu

SEQ ID NO: 2407902 - RNA, 14 nt, Human
gaauaucugggauu

SEQ ID NO: 2407903 - RNA, 19 nt, Human
gaauaugacggaagaacau

SEQ ID NO: 2407904 - RNA, 19 nt, Human
gaauaugagcuuuauguaa

SEQ ID NO: 2407905 - RNA, 22 nt, Human
gaauaugaacggugagcauugu

SEQ ID NO: 2407906 - RNA, 14 nt, Human
gaauaugacagcug

SEQ ID NO: 2407907 - RNA, 15 nt, Human
gaauaugacggaaga

SEQ ID NO: 2407908 - RNA, 17 nt, Human
gaauaugacggaagaac

SEQ ID NO: 2407909 - RNA, 17 nt, Human
gaauaugggagaaauag

SEQ ID NO: 2407910 - RNA, 19 nt, Human
gaauaugauuaguaaagaa

SEQ ID NO: 2407911 - RNA, 22 nt, Human
gaauauauggcagaguuguaaa

SEQ ID NO: 2407912 - RNA, 21 nt, Human
gaauauauggcagaguuguaa

SEQ ID NO: 2407913 - RNA, 20 nt, Human
gaauauauggcagaguugua

SEQ ID NO: 2407914 - RNA, 15 nt, Human
gaauauauggcagag

SEQ ID NO: 2407915 - RNA, 23 nt, Human
gaauauauggcagaguuguaaau

SEQ ID NO: 2407916 - RNA, 11 nt, Human
gaauauauuau

SEQ ID NO: 2407917 - RNA, 12 nt, Human
gaauauauuaua

SEQ ID NO: 2407918 - RNA, 15 nt, Human
gaauauauaaccagu

SEQ ID NO: 2407919 - RNA, 21 nt, Human
gaauauaccccuuaguguuug

SEQ ID NO: 2407920 - RNA, 22 nt, Human
gaauauacagcaggugcucaau

SEQ ID NO: 2407921 - RNA, 14 nt, Human
gaaugaauggcuaa

SEQ ID NO: 2407922 - RNA, 23 nt, Human
gacacagcagcuucaccagagca

SEQ ID NO: 2407923 - RNA, 22 nt, Human
gacacagcagcuucaccagagc

SEQ ID NO: 2407924 - RNA, 21 nt, Human
gacacagcucuucuccaggcu

SEQ ID NO: 2407925 - RNA, 20 nt, Human
gacacagcucuucuccaggc

SEQ ID NO: 2407926 - RNA, 19 nt, Human
gacacagcucuucuccagg

SEQ ID NO: 2407927 - RNA, 21 nt, Human
gacacagcagcuucaccagag

SEQ ID NO: 2407928 - RNA, 20 nt, Human
gacacagcagcuucaccaga

SEQ ID NO: 2407929 - RNA, 19 nt, Human
gacacagcagcuucaccag

SEQ ID NO: 2407930 - RNA, 18 nt, Human
gacacagcagcuucacca

SEQ ID NO: 2407931 - RNA, 15 nt, Human
gacacagcagcuuca

SEQ ID NO: 2407932 - RNA, 11 nt, Human
gacacagcagc

SEQ ID NO: 2407933 - RNA, 15 nt, Human
gacacagaugaaaca

SEQ ID NO: 2407934 - RNA, 12 nt, Human
gacacagcucuu

SEQ ID NO: 2407935 - RNA, 20 nt, Human
gacaaauacucauguguaug

SEQ ID NO: 2407936 - RNA, 15 nt, Human
gacaaaucaaagcag

SEQ ID NO: 2407937 - RNA, 19 nt, Human
gacacagaaaauguugaga

SEQ ID NO: 2407938 - RNA, 21 nt, Human
gacacagaaaauguugagaau

SEQ ID NO: 2407939 - RNA, 15 nt, Human
gacaaagucaagcca

SEQ ID NO: 2407940 - RNA, 19 nt, Human
gacaaauacucauguguau

SEQ ID NO: 2407941 - RNA, 18 nt, Human
gacaaauacucaugugua

SEQ ID NO: 2407942 - RNA, 17 nt, Human
gacaaauacucaugugu

SEQ ID NO: 2407943 - RNA, 18 nt, Human
gacaaagguuuuccucuu

SEQ ID NO: 2407944 - RNA, 23 nt, Human
gacaaaguuacugauucacugca

SEQ ID NO: 2407945 - RNA, 13 nt, Human
gaauuauuuuaaa

SEQ ID NO: 2407946 - RNA, 16 nt, Human
gaauuauuuuaaaaga

SEQ ID NO: 2407947 - RNA, 18 nt, Human
gaauuauuuuaaaagaua

SEQ ID NO: 2407948 - RNA, 16 nt, Human
gaauucaaacuggggc

SEQ ID NO: 2407949 - RNA, 18 nt, Human
gaauucaaacuggggccu

SEQ ID NO: 2407950 - RNA, 21 nt, Human
gaauucaaacuggggccucca

SEQ ID NO: 2407951 - RNA, 22 nt, Human
gaauucaaacuggggccuccag

SEQ ID NO: 2407952 - RNA, 20 nt, Human
gaauuuuuuucaucuucucu

SEQ ID NO: 2407953 - RNA, 16 nt, Human
gaauuuuuuucaucuu

SEQ ID NO: 2407954 - RNA, 22 nt, Human
gaauuaccuuagauuagcucug

SEQ ID NO: 2407955 - RNA, 18 nt, Human
gaauuagaaacauaaaua

SEQ ID NO: 2407956 - RNA, 16 nt, Human
gaauuaguccuugcuu

SEQ ID NO: 2407957 - RNA, 22 nt, Human
gaauuuuuuucaucuucucugg

SEQ ID NO: 2407958 - RNA, 22 nt, Human
gaauuuuuuuuuccuagcccuc

SEQ ID NO: 2407959 - RNA, 16 nt, Human
gacaaaaacagccuca

SEQ ID NO: 2407960 - RNA, 17 nt, Human
gacaaaaacagccucac

SEQ ID NO: 2407961 - RNA, 18 nt, Human
gacaaaaacagccucaca

SEQ ID NO: 2407962 - RNA, 20 nt, Human
gacaaaaacagccucacaga

SEQ ID NO: 2407963 - RNA, 19 nt, Human
gacaaacaccucccaggag

SEQ ID NO: 2407964 - RNA, 17 nt, Human
gacaaacaccucccagg

SEQ ID NO: 2407965 - RNA, 22 nt, Human
gacaaacaccucccaggagaca

SEQ ID NO: 2407966 - RNA, 14 nt, Human
gacaaacagcucag

SEQ ID NO: 2407967 - RNA, 15 nt, Human
gacaaaccagaagca

SEQ ID NO: 2407968 - RNA, 13 nt, Human
gacaaaggcaagc

SEQ ID NO: 2407969 - RNA, 17 nt, Human
gacaaaggacauuuguu

SEQ ID NO: 2407970 - RNA, 23 nt, Human
gacaaagcuuggaagagccugca

SEQ ID NO: 2407971 - RNA, 23 nt, Human
gacaaagaugauuuaaaagggaa

SEQ ID NO: 2407972 - RNA, 20 nt, Human
gacaaagccaaacucugcca

SEQ ID NO: 2407973 - RNA, 20 nt, Human
gacaaacugccaguuuuguu

SEQ ID NO: 2407974 - RNA, 17 nt, Human
gacaaacugccaguuuu

SEQ ID NO: 2407975 - RNA, 19 nt, Human
gacaaacugcauauguacu

SEQ ID NO: 2407976 - RNA, 14 nt, Human
gacaaagacaaauu

SEQ ID NO: 2407977 - RNA, 21 nt, Human
gacaaagacaaauucuguuuc

SEQ ID NO: 2407978 - RNA, 22 nt, Human
gacaaagaugauuuaaaaggga

SEQ ID NO: 2407979 - RNA, 15 nt, Human
gaaugaauggcuaag

SEQ ID NO: 2407980 - RNA, 20 nt, Human
gaaugaauggcuaagcaaaa

SEQ ID NO: 2407981 - RNA, 16 nt, Human
gaaugaucucuucuuu

SEQ ID NO: 2407982 - RNA, 22 nt, Human
gaaugaggugggagguggaaga

SEQ ID NO: 2407983 - RNA, 15 nt, Human
gaaugaggugggagg

SEQ ID NO: 2407984 - RNA, 14 nt, Human
gaaugauuaugaau

SEQ ID NO: 2407985 - RNA, 14 nt, Human
gaaugauuaauuaa

SEQ ID NO: 2407986 - RNA, 14 nt, Human
gaaugaugccauga

SEQ ID NO: 2407987 - RNA, 20 nt, Human
gaaugaugauccuaggcauu

SEQ ID NO: 2407988 - RNA, 22 nt, Human
gaaugauuaugaauuacauuug

SEQ ID NO: 2407989 - RNA, 17 nt, Human
gaaugaucucuucuuuu

SEQ ID NO: 2407990 - RNA, 18 nt, Human
gaaugaucuuucuuuccu

SEQ ID NO: 2407991 - RNA, 15 nt, Human
gaaugauucaguguu

SEQ ID NO: 2407992 - RNA, 18 nt, Human
gaaugcacaaacagaggc

SEQ ID NO: 2407993 - RNA, 13 nt, Human
gaaugaugaagcu

SEQ ID NO: 2407994 - RNA, 23 nt, Human
gaaugauucuaauuuuuaagcaa

SEQ ID NO: 2407995 - RNA, 14 nt, Human
gaaugauuucaugc

SEQ ID NO: 2407996 - RNA, 16 nt, Human
gaaugauuuccaaaga

SEQ ID NO: 2407997 - RNA, 20 nt, Human
gaaugauuuccaaagagaaa

SEQ ID NO: 2407998 - RNA, 17 nt, Human
gaauguuugccucugcc

SEQ ID NO: 2407999 - RNA, 16 nt, Human
gaauguuugccucugc

SEQ ID NO: 2408000 - RNA, 19 nt, Human
gaaugcacaaacagaggcc

SEQ ID NO: 2408001 - RNA, 15 nt, Human
gaauguuugccucug

SEQ ID NO: 2408002 - RNA, 16 nt, Human
gaaugauuuuuagaug

SEQ ID NO: 2408003 - RNA, 14 nt, Human
gaaugauuuuuaga

SEQ ID NO: 2408004 - RNA, 22 nt, Human
gaaugauuuccaaagagaaaaa

SEQ ID NO: 2408005 - RNA, 19 nt, Human
gaauguuugccucugccuc

SEQ ID NO: 2408006 - RNA, 18 nt, Human
gaauguuugccucugccu

SEQ ID NO: 2408007 - RNA, 14 nt, Human
gaauguuugucuca

SEQ ID NO: 2408008 - RNA, 15 nt, Human
gaauguuuuaaauuc

SEQ ID NO: 2408009 - RNA, 16 nt, Human
gaauguuuuaaauucu

SEQ ID NO: 2408010 - RNA, 14 nt, Human
gaauuaacacauga

SEQ ID NO: 2408011 - RNA, 15 nt, Human
gaauuaacacaugau

SEQ ID NO: 2408012 - RNA, 22 nt, Human
gaauuaaaguggaccaauaggg

SEQ ID NO: 2408013 - RNA, 12 nt, Human
gaauuaaauaaa

SEQ ID NO: 2408014 - RNA, 20 nt, Human
gaauuaaauaaacccuuccu

SEQ ID NO: 2408015 - RNA, 20 nt, Human
gaauuaaauuaggaauaaau

SEQ ID NO: 2408016 - RNA, 21 nt, Human
gaauuaaauuaggaauaaaua

SEQ ID NO: 2408017 - RNA, 18 nt, Human
gaauuacauuuguauaaa

SEQ ID NO: 2408018 - RNA, 15 nt, Human
gaauuacauuuguau

SEQ ID NO: 2408019 - RNA, 20 nt, Human
gaauuacauuuguauaaaau

SEQ ID NO: 2408020 - RNA, 22 nt, Human
gaauuacauguaaaacauuauc

SEQ ID NO: 2408021 - RNA, 13 nt, Human
gaauuacauuugu

SEQ ID NO: 2408022 - RNA, 21 nt, Human
gaauuaaucaucuauaaagaa

SEQ ID NO: 2408023 - RNA, 15 nt, Human
gaauuaauagcuuuu

SEQ ID NO: 2408024 - RNA, 22 nt, Human
gaauuaauaucccuacauguau

SEQ ID NO: 2408025 - RNA, 21 nt, Human
gaauuacauguaaaacauuau

SEQ ID NO: 2408026 - RNA, 19 nt, Human
gaauuaaugacagagccag

SEQ ID NO: 2408027 - RNA, 13 nt, Human
gaauuaaauuuaa

SEQ ID NO: 2408028 - RNA, 15 nt, Human
gaauuaaccuggugc

SEQ ID NO: 2408029 - RNA, 16 nt, Human
gaauuaaccuggugcu

SEQ ID NO: 2408030 - RNA, 18 nt, Human
gaauuaaccuggugcugg

SEQ ID NO: 2408031 - RNA, 19 nt, Human
gaauuaaccuggugcugga

SEQ ID NO: 2408032 - RNA, 22 nt, Human
gaauuaaccuggugcuggauau

SEQ ID NO: 2408033 - RNA, 17 nt, Human
gaauuaacuccauucca

SEQ ID NO: 2408034 - RNA, 20 nt, Human
gaauuaaguuaucuuuaaaa

SEQ ID NO: 2408035 - RNA, 15 nt, Human
gaauuaaguuaucuu

SEQ ID NO: 2408036 - RNA, 21 nt, Human
gaauuaauaucccuacaugua

SEQ ID NO: 2408037 - RNA, 21 nt, Human
gaauuaaguuagggaauggca

SEQ ID NO: 2408038 - RNA, 18 nt, Human
gaauuaaguuagggaaug

SEQ ID NO: 2408039 - RNA, 23 nt, Human
gacauuugggagacaugugacau

SEQ ID NO: 2408040 - RNA, 22 nt, Human
gacauuugggagacaugugaca

SEQ ID NO: 2408041 - RNA, 23 nt, Human
gacauugcuuuacugucaaaaua

SEQ ID NO: 2408042 - RNA, 15 nt, Human
gacauuuugccaaaa

SEQ ID NO: 2408043 - RNA, 15 nt, Human
gacauuuucuucaga

SEQ ID NO: 2408044 - RNA, 18 nt, Human
gacauugcuaagaugcuc

SEQ ID NO: 2408045 - RNA, 12 nt, Human
gacauugcuaag

SEQ ID NO: 2408046 - RNA, 23 nt, Human
gacauuggcaccuaauccaggca

SEQ ID NO: 2408047 - RNA, 23 nt, Human
gacauguuuugauaaaguaguaa

SEQ ID NO: 2408048 - RNA, 20 nt, Human
gacauguuuugauaaaguag

SEQ ID NO: 2408049 - RNA, 14 nt, Human
gacauguuuuuguu

SEQ ID NO: 2408050 - RNA, 14 nt, Human
gacauugcguuuga

SEQ ID NO: 2408051 - RNA, 21 nt, Human
gacauugcguuugaccuuuua

SEQ ID NO: 2408052 - RNA, 23 nt, Human
gacauugcggacagccacggcca

SEQ ID NO: 2408053 - RNA, 17 nt, Human
gacauugcggacagcca

SEQ ID NO: 2408054 - RNA, 18 nt, Human
gacagucaccucauggaa

SEQ ID NO: 2408055 - RNA, 11 nt, Human
gacagcucuua

SEQ ID NO: 2408056 - RNA, 16 nt, Human
gacaguccagccugga

SEQ ID NO: 2408057 - RNA, 15 nt, Human
gacaguccagccugg

SEQ ID NO: 2408058 - RNA, 12 nt, Human
gacagucccugc

SEQ ID NO: 2408059 - RNA, 10 nt, Human
gacagcucuu

SEQ ID NO: 2408060 - RNA, 19 nt, Human
gacagccccagagcagggu

SEQ ID NO: 2408061 - RNA, 18 nt, Human
gacagccccagagcaggg

SEQ ID NO: 2408062 - RNA, 20 nt, Human
gacagccccagagcagggug

SEQ ID NO: 2408063 - RNA, 15 nt, Human
gacagcucugccugu

SEQ ID NO: 2408064 - RNA, 12 nt, Human
gacagcucugca

SEQ ID NO: 2408065 - RNA, 19 nt, Human
gacagcuccuucuguccua

SEQ ID NO: 2408066 - RNA, 20 nt, Human
gacagucccugccaauggac

SEQ ID NO: 2408067 - RNA, 16 nt, Human
gacagucccugccaau

SEQ ID NO: 2408068 - RNA, 15 nt, Human
gacagucccugccaa

SEQ ID NO: 2408069 - RNA, 14 nt, Human
gacagucccugcca

SEQ ID NO: 2408070 - RNA, 16 nt, Human
gacauguuuugauaaa

SEQ ID NO: 2408071 - RNA, 14 nt, Human
gacauguuuugaua

SEQ ID NO: 2408072 - RNA, 17 nt, Human
gacauguuuuccgugaa

SEQ ID NO: 2408073 - RNA, 18 nt, Human
gacauguuauauauuuuu

SEQ ID NO: 2408074 - RNA, 15 nt, Human
gacauguuauauauu

SEQ ID NO: 2408075 - RNA, 23 nt, Human
gacauguuuuagacaaauacuca

SEQ ID NO: 2408076 - RNA, 17 nt, Human
gacauguggggccaggu

SEQ ID NO: 2408077 - RNA, 14 nt, Human
gacaugugguggga

SEQ ID NO: 2408078 - RNA, 16 nt, Human
gacauguggugggaca

SEQ ID NO: 2408079 - RNA, 22 nt, Human
gacauguggugggacagggacc

SEQ ID NO: 2408080 - RNA, 23 nt, Human
gacaugugaaaccuuuuuuaaga

SEQ ID NO: 2408081 - RNA, 12 nt, Human
gacaugugacau

SEQ ID NO: 2408082 - RNA, 19 nt, Human
gacaguccagccuggagau

SEQ ID NO: 2408083 - RNA, 17 nt, Human
gacaguccagccuggag

SEQ ID NO: 2408084 - RNA, 15 nt, Human
gacaguccucuccac

SEQ ID NO: 2408085 - RNA, 20 nt, Human
gacaugugacauuuauauau

SEQ ID NO: 2408086 - RNA, 16 nt, Human
gacaugugacauuuau

SEQ ID NO: 2408087 - RNA, 13 nt, Human
gacauguggaaag

SEQ ID NO: 2408088 - RNA, 18 nt, Human
gacauguggaaagugaau

SEQ ID NO: 2408089 - RNA, 19 nt, Human
gacauguggaaagugaauu

SEQ ID NO: 2408090 - RNA, 23 nt, Human
gacauguggaaagugaauuugaa

SEQ ID NO: 2408091 - RNA, 17 nt, Human
gacagccccagagcagg

SEQ ID NO: 2408092 - RNA, 16 nt, Human
gacagccccagagcag

SEQ ID NO: 2408093 - RNA, 14 nt, Human
gacagccccagagc

SEQ ID NO: 2408094 - RNA, 14 nt, Human
gacagccccacccu

SEQ ID NO: 2408095 - RNA, 15 nt, Human
gacagccccacccug

SEQ ID NO: 2408096 - RNA, 14 nt, Human
gacagcccgggcuc

SEQ ID NO: 2408097 - RNA, 20 nt, Human
gacacuuugaaauguguuuc

SEQ ID NO: 2408098 - RNA, 19 nt, Human
gacacuuugaaauguguuu

SEQ ID NO: 2408099 - RNA, 18 nt, Human
gacacuuugaaauguguu

SEQ ID NO: 2408100 - RNA, 15 nt, Human
gacacuuugaaaugu

SEQ ID NO: 2408101 - RNA, 22 nt, Human
gacacuuugaaauguguuucug

SEQ ID NO: 2408102 - RNA, 21 nt, Human
gacacuuugaaauguguuucu

SEQ ID NO: 2408103 - RNA, 23 nt, Human
gacacuuuaauuaccaaccuguu

SEQ ID NO: 2408104 - RNA, 23 nt, Human
gacacuugccuucuucacccagc

SEQ ID NO: 2408105 - RNA, 14 nt, Human
gacacuugucccca

SEQ ID NO: 2408106 - RNA, 15 nt, Human
gacacuuccugccua

SEQ ID NO: 2408107 - RNA, 14 nt, Human
gacacuuccugccu

SEQ ID NO: 2408108 - RNA, 22 nt, Human
gacacuugccuucuucacccag

SEQ ID NO: 2408109 - RNA, 15 nt, Human
gacacuugccuucuu

SEQ ID NO: 2408110 - RNA, 18 nt, Human
gacagcuccuucuguccu

SEQ ID NO: 2408111 - RNA, 17 nt, Human
gacagcuccuucugucc

SEQ ID NO: 2408112 - RNA, 16 nt, Human
gacagcccgggcucug

SEQ ID NO: 2408113 - RNA, 16 nt, Human
gacagcuccuucuguc

SEQ ID NO: 2408114 - RNA, 20 nt, Human
gacacugcggggcuuggcug

SEQ ID NO: 2408115 - RNA, 19 nt, Human
gacacugcggggcuuggcu

SEQ ID NO: 2408116 - RNA, 14 nt, Human
gacacuggccccuc

SEQ ID NO: 2408117 - RNA, 13 nt, Human
gacacuggccccu

SEQ ID NO: 2408118 - RNA, 22 nt, Human
gacacugcggggcuuggcugag

SEQ ID NO: 2408119 - RNA, 12 nt, Human
gacacuggcaug

SEQ ID NO: 2408120 - RNA, 16 nt, Human
gacacugcggggcuug

SEQ ID NO: 2408121 - RNA, 20 nt, Human
gacacuucccucuguuucuc

SEQ ID NO: 2408122 - RNA, 19 nt, Human
gacacuucccucuguuucu

SEQ ID NO: 2408123 - RNA, 18 nt, Human
gacacuucccucuguuuc

SEQ ID NO: 2408124 - RNA, 17 nt, Human
gacacuucccucuguuu

SEQ ID NO: 2408125 - RNA, 13 nt, Human
gacacuuccugcc

SEQ ID NO: 2408126 - RNA, 12 nt, Human
gacacuuccugc

SEQ ID NO: 2408127 - RNA, 21 nt, Human
gacacuucccucuguuucucu

SEQ ID NO: 2408128 - RNA, 15 nt, Human
gacacuucagagagc

SEQ ID NO: 2408129 - RNA, 17 nt, Human
gacacuucagagagcug

SEQ ID NO: 2408130 - RNA, 18 nt, Human
gacacuucagagagcugg

SEQ ID NO: 2408131 - RNA, 19 nt, Human
gacacuucagagagcuggu

SEQ ID NO: 2408132 - RNA, 20 nt, Human
gacacuucagagagcuggua

SEQ ID NO: 2408133 - RNA, 23 nt, Human
gacacuucagagagcugguaguu

SEQ ID NO: 2408134 - RNA, 15 nt, Human
gacacuggccccuca

SEQ ID NO: 2408135 - RNA, 17 nt, Human
gacacuggcugccagcu

SEQ ID NO: 2408136 - RNA, 23 nt, Human
gacacuggcucauauuccugcag

SEQ ID NO: 2408137 - RNA, 19 nt, Human
gacacugguuuacacuuua

SEQ ID NO: 2408138 - RNA, 23 nt, Human
gacacugguuuacacuuuaugcc

SEQ ID NO: 2408139 - RNA, 20 nt, Human
gacacugguauuccugccuc

SEQ ID NO: 2408140 - RNA, 22 nt, Human
gacacuggcugccagcuauuuu

SEQ ID NO: 2408141 - RNA, 19 nt, Human
gacacugguauuccugccu

SEQ ID NO: 2408142 - RNA, 14 nt, Human
gacgcucucuggcc

SEQ ID NO: 2408143 - RNA, 23 nt, Human
gacgcuacccgggaagggggcug

SEQ ID NO: 2408144 - RNA, 22 nt, Human
gacgccugcccuccccagagca

SEQ ID NO: 2408145 - RNA, 20 nt, Human
gacgccugcccuccccagag

SEQ ID NO: 2408146 - RNA, 23 nt, Human
gacgccugcccuccccagagcac

SEQ ID NO: 2408147 - RNA, 22 nt, Human
gacgcuacccgggaagggggcu

SEQ ID NO: 2408148 - RNA, 17 nt, Human
gacgcugugcugcccug

SEQ ID NO: 2408149 - RNA, 16 nt, Human
gacgcugugcugcccu

SEQ ID NO: 2408150 - RNA, 18 nt, Human
gacgcugugcugcccugc

SEQ ID NO: 2408151 - RNA, 17 nt, Human
gacgcucccugcuccac

SEQ ID NO: 2408152 - RNA, 15 nt, Human
gacgcugugcugccc

SEQ ID NO: 2408153 - RNA, 21 nt, Human
gacgccaucccagccccaaug

SEQ ID NO: 2408154 - RNA, 14 nt, Human
gacgccacccagca

SEQ ID NO: 2408155 - RNA, 13 nt, Human
gacgccacccagc

SEQ ID NO: 2408156 - RNA, 15 nt, Human
gacgccaucccagcc

SEQ ID NO: 2408157 - RNA, 13 nt, Human
gacgccugagcuc

SEQ ID NO: 2408158 - RNA, 22 nt, Human
gacgccggggacagaggccugc

SEQ ID NO: 2408159 - RNA, 13 nt, Human
gacgccugaggaa

SEQ ID NO: 2408160 - RNA, 18 nt, Human
gacgccugcccuccccag

SEQ ID NO: 2408161 - RNA, 17 nt, Human
gacgccugagcucacuc

SEQ ID NO: 2408162 - RNA, 14 nt, Human
gacgccugaggaac

SEQ ID NO: 2408163 - RNA, 21 nt, Human
gacgccggggacagaggccug

SEQ ID NO: 2408164 - RNA, 19 nt, Human
gacgccaucccagccccaa

SEQ ID NO: 2408165 - RNA, 13 nt, Human
gacgccaucccag

SEQ ID NO: 2408166 - RNA, 12 nt, Human
gacgccauccca

SEQ ID NO: 2408167 - RNA, 13 nt, Human
gaccucugccuga

SEQ ID NO: 2408168 - RNA, 12 nt, Human
gacgccacccag

SEQ ID NO: 2408169 - RNA, 16 nt, Human
gacgccaccauuccug

SEQ ID NO: 2408170 - RNA, 15 nt, Human
gacgccaccauuccu

SEQ ID NO: 2408171 - RNA, 14 nt, Human
gacgccaccauucc

SEQ ID NO: 2408172 - RNA, 13 nt, Human
gaccucguccucc

SEQ ID NO: 2408173 - RNA, 21 nt, Human
gaccucgagcagaugaugcca

SEQ ID NO: 2408174 - RNA, 14 nt, Human
gaccuccugccucc

SEQ ID NO: 2408175 - RNA, 12 nt, Human
gaccuccugccu

SEQ ID NO: 2408176 - RNA, 16 nt, Human
gaccuccccagccccu

SEQ ID NO: 2408177 - RNA, 14 nt, Human
gaccuccccagccc

SEQ ID NO: 2408178 - RNA, 13 nt, Human
gaccuccccagcc

SEQ ID NO: 2408179 - RNA, 17 nt, Human
gaccuccuaacaaguag

SEQ ID NO: 2408180 - RNA, 16 nt, Human
gaccucugcagcaaua

SEQ ID NO: 2408181 - RNA, 18 nt, Human
gaccucugcagcaauaaa

SEQ ID NO: 2408182 - RNA, 22 nt, Human
gaccucugcagcaauaaagcag

SEQ ID NO: 2408183 - RNA, 23 nt, Human
gaccucccagcccuauggaugug

SEQ ID NO: 2408184 - RNA, 22 nt, Human
gaccucccagcccuauggaugu

SEQ ID NO: 2408185 - RNA, 21 nt, Human
gaccucccagcccuauggaug

SEQ ID NO: 2408186 - RNA, 15 nt, Human
gaccucccagcccua

SEQ ID NO: 2408187 - RNA, 14 nt, Human
gaccucccagcccu

SEQ ID NO: 2408188 - RNA, 16 nt, Human
gaccuccccugaggcu

SEQ ID NO: 2408189 - RNA, 21 nt, Human
gaccucaugcaucuccaccug

SEQ ID NO: 2408190 - RNA, 17 nt, Human
gaccucaugcaucucca

SEQ ID NO: 2408191 - RNA, 23 nt, Human
gaccucaucaggaugaacccagg

SEQ ID NO: 2408192 - RNA, 19 nt, Human
gaccucaucaggaugaacc

SEQ ID NO: 2408193 - RNA, 22 nt, Human
gaccucaugcaucuccaccugc

SEQ ID NO: 2408194 - RNA, 13 nt, Human
gaccucaucagga

SEQ ID NO: 2408195 - RNA, 10 nt, Human
gaccucauca

SEQ ID NO: 2408196 - RNA, 21 nt, Human
gaccucaguuuuaucauuuuc

SEQ ID NO: 2408197 - RNA, 20 nt, Human
gaccucaguuuuaucauuuu

SEQ ID NO: 2408198 - RNA, 16 nt, Human
gacccucugccaccag

SEQ ID NO: 2408199 - RNA, 15 nt, Human
gacccucugccacca

SEQ ID NO: 2408200 - RNA, 20 nt, Human
gacccucugccaccagagac

SEQ ID NO: 2408201 - RNA, 16 nt, Human
gacccugaaggggcca

SEQ ID NO: 2408202 - RNA, 14 nt, Human
gaccucaggccugg

SEQ ID NO: 2408203 - RNA, 15 nt, Human
gacccucuccacccc

SEQ ID NO: 2408204 - RNA, 16 nt, Human
gacccucuccacccca

SEQ ID NO: 2408205 - RNA, 15 nt, Human
gacccucugaauggu

SEQ ID NO: 2408206 - RNA, 17 nt, Human
gacccucuccaccccau

SEQ ID NO: 2408207 - RNA, 23 nt, Human
gacccucugaaugguccaggguu

SEQ ID NO: 2408208 - RNA, 20 nt, Human
gacccucugaaugguccagg

SEQ ID NO: 2408209 - RNA, 14 nt, Human
gacccucugccacc

SEQ ID NO: 2408210 - RNA, 21 nt, Human
gaccucaggugauccacccac

SEQ ID NO: 2408211 - RNA, 20 nt, Human
gaccucaggugauccaccca

SEQ ID NO: 2408212 - RNA, 19 nt, Human
gaccucaggugauccaccc

SEQ ID NO: 2408213 - RNA, 21 nt, Human
gaccucaggugagaagcagag

SEQ ID NO: 2408214 - RNA, 19 nt, Human
gaccucaggccugggggcu

SEQ ID NO: 2408215 - RNA, 22 nt, Human
gaccucagguaaucgaccugcc

SEQ ID NO: 2408216 - RNA, 23 nt, Human
gaccucagguaaucgaccugccu

SEQ ID NO: 2408217 - RNA, 18 nt, Human
gaccucaggugagaagca

SEQ ID NO: 2408218 - RNA, 19 nt, Human
gaccucaggugagaagcag

SEQ ID NO: 2408219 - RNA, 22 nt, Human
gacccggagcuaacacuggccc

SEQ ID NO: 2408220 - RNA, 20 nt, Human
gaccccucuggccaggaugg

SEQ ID NO: 2408221 - RNA, 16 nt, Human
gaccccucuggccagg

SEQ ID NO: 2408222 - RNA, 18 nt, Human
gaccccucuggccaggau

SEQ ID NO: 2408223 - RNA, 17 nt, Human
gacccggaggggccugg

SEQ ID NO: 2408224 - RNA, 14 nt, Human
gacccggaggccac

SEQ ID NO: 2408225 - RNA, 13 nt, Human
gacccggaggcca

SEQ ID NO: 2408226 - RNA, 11 nt, Human
gacccggaggc

SEQ ID NO: 2408227 - RNA, 23 nt, Human
gacccggagcuaacacuggcccc

SEQ ID NO: 2408228 - RNA, 16 nt, Human
gaccccuccucccuuu

SEQ ID NO: 2408229 - RNA, 12 nt, Human
gaccccuccucc

SEQ ID NO: 2408230 - RNA, 23 nt, Human
gaccccuccucacuggccauccc

SEQ ID NO: 2408231 - RNA, 19 nt, Human
gaccccuccucacuggcca

SEQ ID NO: 2408232 - RNA, 17 nt, Human
gaccccuccucacuggc

SEQ ID NO: 2408233 - RNA, 16 nt, Human
gaccccugagcuugca

SEQ ID NO: 2408234 - RNA, 14 nt, Human
gaccccuccucccu

SEQ ID NO: 2408235 - RNA, 13 nt, Human
gaccccuccuccc

SEQ ID NO: 2408236 - RNA, 13 nt, Human
gaccccucuggcc

SEQ ID NO: 2408237 - RNA, 15 nt, Human
gaccccucuggccag

SEQ ID NO: 2408238 - RNA, 17 nt, Human
gacccggaggccacaug

SEQ ID NO: 2408239 - RNA, 15 nt, Human
gacccggaggccaca

SEQ ID NO: 2408240 - RNA, 23 nt, Human
gacccggaggccacaugaguccc

SEQ ID NO: 2408241 - RNA, 20 nt, Human
gacccggaggggccuggcag

SEQ ID NO: 2408242 - RNA, 19 nt, Human
gacccggaggggccuggca

SEQ ID NO: 2408243 - RNA, 18 nt, Human
gacccggaggggccuggc

SEQ ID NO: 2408244 - RNA, 15 nt, Human
gaccccuccucacug

SEQ ID NO: 2408245 - RNA, 14 nt, Human
gaccccuccucacu

SEQ ID NO: 2408246 - RNA, 13 nt, Human
gaccccuccucac

SEQ ID NO: 2408247 - RNA, 12 nt, Human
gaccccuccuca

SEQ ID NO: 2408248 - RNA, 11 nt, Human
gaccccuccuc

SEQ ID NO: 2408249 - RNA, 12 nt, Human
gagcuggagccu

SEQ ID NO: 2408250 - RNA, 20 nt, Human
gagcuggagccuggugcccu

SEQ ID NO: 2408251 - RNA, 15 nt, Human
gagcuggagccuggu

SEQ ID NO: 2408252 - RNA, 14 nt, Human
gagcuggagccugg

SEQ ID NO: 2408253 - RNA, 13 nt, Human
gagcccuggcagg

SEQ ID NO: 2408254 - RNA, 23 nt, Human
gagcccuggcaggaugacccugc

SEQ ID NO: 2408255 - RNA, 14 nt, Human
gagcccugguggca

SEQ ID NO: 2408256 - RNA, 13 nt, Human
gagcccugguggc

SEQ ID NO: 2408257 - RNA, 20 nt, Human
gagcuguucacagccagacu

SEQ ID NO: 2408258 - RNA, 12 nt, Human
gagcuggcucug

SEQ ID NO: 2408259 - RNA, 16 nt, Human
gagcuggcgucugucu

SEQ ID NO: 2408260 - RNA, 20 nt, Human
gagcuggccgugggccuggg

SEQ ID NO: 2408261 - RNA, 19 nt, Human
gagcuggccgugggccugg

SEQ ID NO: 2408262 - RNA, 17 nt, Human
gagcuggccgugggccu

SEQ ID NO: 2408263 - RNA, 20 nt, Human
gagcuggcaaagguggcucu

SEQ ID NO: 2408264 - RNA, 23 nt, Human
gagcuggccgcgccaaauaaugu

SEQ ID NO: 2408265 - RNA, 17 nt, Human
gagcuggccccgccgcc

SEQ ID NO: 2408266 - RNA, 16 nt, Human
gagcuggccccgccgc

SEQ ID NO: 2408267 - RNA, 14 nt, Human
gagcuggccccgcc

SEQ ID NO: 2408268 - RNA, 13 nt, Human
gagcuggccccgc

SEQ ID NO: 2408269 - RNA, 16 nt, Human
gagcuguugccucagu

SEQ ID NO: 2408270 - RNA, 18 nt, Human
gagcuguuuauggccuca

SEQ ID NO: 2408271 - RNA, 22 nt, Human
gagcuguucacagccagacugg

SEQ ID NO: 2408272 - RNA, 17 nt, Human
gagcuguuuacuaggga

SEQ ID NO: 2408273 - RNA, 16 nt, Human
gagcuguuuauggccu

SEQ ID NO: 2408274 - RNA, 17 nt, Human
gagcuguuuauggccuc

SEQ ID NO: 2408275 - RNA, 13 nt, Human
gagcaggggcagg

SEQ ID NO: 2408276 - RNA, 21 nt, Human
gagcagggcucagcggggaca

SEQ ID NO: 2408277 - RNA, 14 nt, Human
gagcagucaggaaa

SEQ ID NO: 2408278 - RNA, 16 nt, Human
gagcaggguguuggga

SEQ ID NO: 2408279 - RNA, 16 nt, Human
gagcagggugcugugg

SEQ ID NO: 2408280 - RNA, 16 nt, Human
gagcaguaucaugaag

SEQ ID NO: 2408281 - RNA, 20 nt, Human
gagcagggguccuuggugug

SEQ ID NO: 2408282 - RNA, 15 nt, Human
gagcaggggcgugga

SEQ ID NO: 2408283 - RNA, 16 nt, Human
gagcaggggcagggug

SEQ ID NO: 2408284 - RNA, 14 nt, Human
gagcaucaggccag

SEQ ID NO: 2408285 - RNA, 17 nt, Human
gagcaguaucaugaagc

SEQ ID NO: 2408286 - RNA, 16 nt, Human
gagcaguccugccuca

SEQ ID NO: 2408287 - RNA, 20 nt, Human
gagcaguccugccucagccu

SEQ ID NO: 2408288 - RNA, 21 nt, Human
gagcaugccuggauggggcug

SEQ ID NO: 2408289 - RNA, 13 nt, Human
gagcaucugacuc

SEQ ID NO: 2408290 - RNA, 13 nt, Human
gagcaugccugga

SEQ ID NO: 2408291 - RNA, 19 nt, Human
gagcaucucuugaggccag

SEQ ID NO: 2408292 - RNA, 20 nt, Human
gagcaucucuugaggccagg

SEQ ID NO: 2408293 - RNA, 22 nt, Human
gagcaucucuugaggccaggag

SEQ ID NO: 2408294 - RNA, 23 nt, Human
gagcaucucuugaggccaggagu

SEQ ID NO: 2408295 - RNA, 16 nt, Human
gagcaucaggccaggc

SEQ ID NO: 2408296 - RNA, 15 nt, Human
gagcaucaggccagg

SEQ ID NO: 2408297 - RNA, 13 nt, Human
gagcaucaggcca

SEQ ID NO: 2408298 - RNA, 14 nt, Human
gagcauccaccucc

SEQ ID NO: 2408299 - RNA, 18 nt, Human
gagcauccaccuccuucu

SEQ ID NO: 2408300 - RNA, 17 nt, Human
gagcauccaccuccuuc

SEQ ID NO: 2408301 - RNA, 18 nt, Human
gagcaucucuugaggcca

SEQ ID NO: 2408302 - RNA, 20 nt, Human
gagcccugggaggcucugga

SEQ ID NO: 2408303 - RNA, 19 nt, Human
gagcccugggaggcucugg

SEQ ID NO: 2408304 - RNA, 18 nt, Human
gagcccugggaggcucug

SEQ ID NO: 2408305 - RNA, 16 nt, Human
gagcccugggaggcuc

SEQ ID NO: 2408306 - RNA, 21 nt, Human
gagccccuuccuugcucugca

SEQ ID NO: 2408307 - RNA, 19 nt, Human
gagccccuuccuugcucug

SEQ ID NO: 2408308 - RNA, 17 nt, Human
gagccccuucugcucag

SEQ ID NO: 2408309 - RNA, 20 nt, Human
gagccccuucugcucagcuc

SEQ ID NO: 2408310 - RNA, 21 nt, Human
gagccccuucugcucagcucu

SEQ ID NO: 2408311 - RNA, 14 nt, Human
gagccccugguccu

SEQ ID NO: 2408312 - RNA, 13 nt, Human
gagccccuggucc

SEQ ID NO: 2408313 - RNA, 20 nt, Human
gagccccugguccugagggu

SEQ ID NO: 2408314 - RNA, 20 nt, Human
gagccccugucuagagaggg

SEQ ID NO: 2408315 - RNA, 13 nt, Human
gagccccuuccuu

SEQ ID NO: 2408316 - RNA, 11 nt, Human
gagccccuucc

SEQ ID NO: 2408317 - RNA, 21 nt, Human
gagccccugucuagagaggga

SEQ ID NO: 2408318 - RNA, 22 nt, Human
gagccccugucuagagagggag

SEQ ID NO: 2408319 - RNA, 15 nt, Human
gagcccucagaaccc

SEQ ID NO: 2408320 - RNA, 12 nt, Human
gagcccugggag

SEQ ID NO: 2408321 - RNA, 17 nt, Human
gagccccgaggccuucu

SEQ ID NO: 2408322 - RNA, 22 nt, Human
gagccccgcagaccuccccagc

SEQ ID NO: 2408323 - RNA, 18 nt, Human
gagccccgcagaccuccc

SEQ ID NO: 2408324 - RNA, 13 nt, Human
gagccccgcagac

SEQ ID NO: 2408325 - RNA, 12 nt, Human
gagccccugguc

SEQ ID NO: 2408326 - RNA, 19 nt, Human
gagccccuggguggguggu

SEQ ID NO: 2408327 - RNA, 14 nt, Human
gagccccugggugg

SEQ ID NO: 2408328 - RNA, 13 nt, Human
gagccccugggug

SEQ ID NO: 2408329 - RNA, 12 nt, Human
gagccccugggu

SEQ ID NO: 2408330 - RNA, 20 nt, Human
gagccccuaccccacaccag

SEQ ID NO: 2408331 - RNA, 17 nt, Human
gagccccuaccccacac

SEQ ID NO: 2408332 - RNA, 15 nt, Human
gagccccuaccccac

SEQ ID NO: 2408333 - RNA, 23 nt, Human
gagccccgcagaccuccccagcc

SEQ ID NO: 2408334 - RNA, 14 nt, Human
gagccccgaggccu

SEQ ID NO: 2408335 - RNA, 13 nt, Human
gagccccgaggcc

SEQ ID NO: 2408336 - RNA, 22 nt, Human
gagccccacacuggggugccgc

SEQ ID NO: 2408337 - RNA, 17 nt, Human
gagccccaaguccugaa

SEQ ID NO: 2408338 - RNA, 15 nt, Human
gagccccaaguccug

SEQ ID NO: 2408339 - RNA, 13 nt, Human
gagccccaagucc

SEQ ID NO: 2408340 - RNA, 11 nt, Human
gagccccaagu

SEQ ID NO: 2408341 - RNA, 21 nt, Human
gagccccaaguccugaagagg

SEQ ID NO: 2408342 - RNA, 14 nt, Human
gagccccacacgga

SEQ ID NO: 2408343 - RNA, 12 nt, Human
gagccccacacu

SEQ ID NO: 2408344 - RNA, 16 nt, Human
gagccccacacggagg

SEQ ID NO: 2408345 - RNA, 15 nt, Human
gaggggcagcccuug

SEQ ID NO: 2408346 - RNA, 14 nt, Human
gaggggcagcccuu

SEQ ID NO: 2408347 - RNA, 18 nt, Human
gaggggcagaacagccgc

SEQ ID NO: 2408348 - RNA, 13 nt, Human
gaggggcagcccu

SEQ ID NO: 2408349 - RNA, 20 nt, Human
gagggccguaccccacccuc

SEQ ID NO: 2408350 - RNA, 18 nt, Human
gagggccguaccccaccc

SEQ ID NO: 2408351 - RNA, 22 nt, Human
gagggccucaaaggcccgcucu

SEQ ID NO: 2408352 - RNA, 15 nt, Human
gagggccugaggucu

SEQ ID NO: 2408353 - RNA, 21 nt, Human
gagggccguaccccacccuca

SEQ ID NO: 2408354 - RNA, 22 nt, Human
gagggccugaggucuggcugcu

SEQ ID NO: 2408355 - RNA, 12 nt, Human
gagggccugggc

SEQ ID NO: 2408356 - RNA, 22 nt, Human
gaggggacuauuuaugaaggca

SEQ ID NO: 2408357 - RNA, 11 nt, Human
gaggggagggg

SEQ ID NO: 2408358 - RNA, 21 nt, Human
gaggggaggaucacuggagcc

SEQ ID NO: 2408359 - RNA, 12 nt, Human
gaggggagaagc

SEQ ID NO: 2408360 - RNA, 21 nt, Human
gaggggacgcugguagagaug

SEQ ID NO: 2408361 - RNA, 21 nt, Human
gagggccugcaagggagugag

SEQ ID NO: 2408362 - RNA, 17 nt, Human
gagggccugcaagggag

SEQ ID NO: 2408363 - RNA, 14 nt, Human
gagggccugcaagg

SEQ ID NO: 2408364 - RNA, 17 nt, Human
gagggccguaccccacc

SEQ ID NO: 2408365 - RNA, 16 nt, Human
gagggccgagugagag

SEQ ID NO: 2408366 - RNA, 22 nt, Human
gagggcccugguguuucuagca

SEQ ID NO: 2408367 - RNA, 12 nt, Human
gagggcccuggu

SEQ ID NO: 2408368 - RNA, 17 nt, Human
gagggcccugagcugag

SEQ ID NO: 2408369 - RNA, 22 nt, Human
gagggccccucugcccagcuug

SEQ ID NO: 2408370 - RNA, 15 nt, Human
gagggcccuaccuga

SEQ ID NO: 2408371 - RNA, 15 nt, Human
gaggcuccacuuggu

SEQ ID NO: 2408372 - RNA, 12 nt, Human
gaggcuccacuu

SEQ ID NO: 2408373 - RNA, 21 nt, Human
gaggcauuuguuugaacugau

SEQ ID NO: 2408374 - RNA, 21 nt, Human
gaggcaugugaugagaggaaa

SEQ ID NO: 2408375 - RNA, 20 nt, Human
gaggcaugugaugagaggaa

SEQ ID NO: 2408376 - RNA, 22 nt, Human
gaggcaugugaugagaggaaau

SEQ ID NO: 2408377 - RNA, 19 nt, Human
gaggcauuuguuugaacug

SEQ ID NO: 2408378 - RNA, 17 nt, Human
gaggcuccacuuggucu

SEQ ID NO: 2408379 - RNA, 18 nt, Human
gaggcugagaugggagaa

SEQ ID NO: 2408380 - RNA, 20 nt, Human
gaggcucuggagcccacugu

SEQ ID NO: 2408381 - RNA, 20 nt, Human
gaggcugaaagaggccaaug

SEQ ID NO: 2408382 - RNA, 16 nt, Human
gaggcugaggcaagag

SEQ ID NO: 2408383 - RNA, 14 nt, Human
gaggcugagacagg

SEQ ID NO: 2408384 - RNA, 12 nt, Human
gaggccaaggug

SEQ ID NO: 2408385 - RNA, 16 nt, Human
gaggcucuuucugggc

SEQ ID NO: 2408386 - RNA, 12 nt, Human
gaggcugaggca

SEQ ID NO: 2408387 - RNA, 13 nt, Human
gaggcugaggcag

SEQ ID NO: 2408388 - RNA, 14 nt, Human
gagggcccagagca

SEQ ID NO: 2408389 - RNA, 13 nt, Human
gagggcccagagc

SEQ ID NO: 2408390 - RNA, 16 nt, Human
gaggcugagacaggag

SEQ ID NO: 2408391 - RNA, 16 nt, Human
gagggccacgggucug

SEQ ID NO: 2408392 - RNA, 20 nt, Human
gagggccccucugcccagcu

SEQ ID NO: 2408393 - RNA, 18 nt, Human
gagggccccucugcccag

SEQ ID NO: 2408394 - RNA, 17 nt, Human
gagggccccucugccca

SEQ ID NO: 2408395 - RNA, 16 nt, Human
gagggccccucugccc

SEQ ID NO: 2408396 - RNA, 15 nt, Human
gagggccccucugcc

SEQ ID NO: 2408397 - RNA, 12 nt, Human
gagggccccucu

SEQ ID NO: 2408398 - RNA, 11 nt, Human
gagggccccuc

SEQ ID NO: 2408399 - RNA, 22 nt, Human
gagggcccagagcaggaagcau

SEQ ID NO: 2408400 - RNA, 20 nt, Human
gagggcccagagcaggaagc

SEQ ID NO: 2408401 - RNA, 18 nt, Human
gagggcccagagcaggaa

SEQ ID NO: 2408402 - RNA, 16 nt, Human
gagggcccagagcagg

SEQ ID NO: 2408403 - RNA, 15 nt, Human
gagggcccagagcag

SEQ ID NO: 2408404 - RNA, 13 nt, Human
gagggcccaggca

SEQ ID NO: 2408405 - RNA, 16 nt, Human
gagggcccaggcaggc

SEQ ID NO: 2408406 - RNA, 22 nt, Human
gaggacaguauuuguggggagg

SEQ ID NO: 2408407 - RNA, 21 nt, Human
gaggacauguuuuuguuuucu

SEQ ID NO: 2408408 - RNA, 20 nt, Human
gaggacauaaugggguccug

SEQ ID NO: 2408409 - RNA, 18 nt, Human
gaggacaugauggagcgc

SEQ ID NO: 2408410 - RNA, 21 nt, Human
gaggacgcucucuggccuucg

SEQ ID NO: 2408411 - RNA, 20 nt, Human
gaggacgcucucuggccuuc

SEQ ID NO: 2408412 - RNA, 16 nt, Human
gaggacccagacccag

SEQ ID NO: 2408413 - RNA, 14 nt, Human
gaggacccagaccc

SEQ ID NO: 2408414 - RNA, 19 nt, Human
gaggaccagggcagggcca

SEQ ID NO: 2408415 - RNA, 13 nt, Human
gaggacccagacc

SEQ ID NO: 2408416 - RNA, 13 nt, Human
gaggaccacuccu

SEQ ID NO: 2408417 - RNA, 22 nt, Human
gaggaccacuccuguacacuga

SEQ ID NO: 2408418 - RNA, 18 nt, Human
gaggacucacuugcccac

SEQ ID NO: 2408419 - RNA, 18 nt, Human
gaggacuagaaccuggag

SEQ ID NO: 2408420 - RNA, 16 nt, Human
gaggacuagaaccugg

SEQ ID NO: 2408421 - RNA, 18 nt, Human
gaggacuguauuugugac

SEQ ID NO: 2408422 - RNA, 13 nt, Human
gaggacuguauuu

SEQ ID NO: 2408423 - RNA, 21 nt, Human
gaggacuguagggagggcggc

SEQ ID NO: 2408424 - RNA, 20 nt, Human
gaggacuguagggagggcgg

SEQ ID NO: 2408425 - RNA, 23 nt, Human
gaggacugccccgugcagacugg

SEQ ID NO: 2408426 - RNA, 22 nt, Human
gaggacgugggcggcagagagg

SEQ ID NO: 2408427 - RNA, 20 nt, Human
gaggacgugggcggcagaga

SEQ ID NO: 2408428 - RNA, 18 nt, Human
gaggacgugggcggcaga

SEQ ID NO: 2408429 - RNA, 16 nt, Human
gaggacgugggcggca

SEQ ID NO: 2408430 - RNA, 16 nt, Human
gaggacggugcaaccc

SEQ ID NO: 2408431 - RNA, 20 nt, Human
gaggacggugcaacccaagg

SEQ ID NO: 2408432 - RNA, 17 nt, Human
gaggacggugcaaccca

SEQ ID NO: 2408433 - RNA, 15 nt, Human
gaggacgugggcggc

SEQ ID NO: 2408434 - RNA, 23 nt, Human
gaggacuuuucuuuguggcuucc

SEQ ID NO: 2408435 - RNA, 20 nt, Human
gaggacuuuucuuuguggcu

SEQ ID NO: 2408436 - RNA, 16 nt, Human
gaggacuuuucuuugu

SEQ ID NO: 2408437 - RNA, 16 nt, Human
gaggacuugugucucu

SEQ ID NO: 2408438 - RNA, 17 nt, Human
gaggacuugugucucug

SEQ ID NO: 2408439 - RNA, 14 nt, Human
gaggacuugugucu

SEQ ID NO: 2408440 - RNA, 23 nt, Human
gaggacuguugacauccaagcuu

SEQ ID NO: 2408441 - RNA, 15 nt, Human
gaggagagaggaccc

SEQ ID NO: 2408442 - RNA, 14 nt, Human
gaggagagaggacc

SEQ ID NO: 2408443 - RNA, 11 nt, Human
gaggagagagg

SEQ ID NO: 2408444 - RNA, 21 nt, Human
gaggagagagcagcuucugcc

SEQ ID NO: 2408445 - RNA, 20 nt, Human
gaggagagagcagcuucugc

SEQ ID NO: 2408446 - RNA, 21 nt, Human
gaggagagaagaaugagccua

SEQ ID NO: 2408447 - RNA, 15 nt, Human
gaggagagaagaaug

SEQ ID NO: 2408448 - RNA, 14 nt, Human
gaggagagaagaau

SEQ ID NO: 2408449 - RNA, 13 nt, Human
gaggagagaagaa

SEQ ID NO: 2408450 - RNA, 12 nt, Human
gaggagagaaga

SEQ ID NO: 2408451 - RNA, 12 nt, Human
gaggagagagga

SEQ ID NO: 2408452 - RNA, 12 nt, Human
gaggagaaacug

SEQ ID NO: 2408453 - RNA, 14 nt, Human
gaggagaaacugga

SEQ ID NO: 2408454 - RNA, 18 nt, Human
gaggacuugugucucugu

SEQ ID NO: 2408455 - RNA, 22 nt, Human
gaggacuugugucucugugcuu

SEQ ID NO: 2408456 - RNA, 13 nt, Human
gaggagaaacaca

SEQ ID NO: 2408457 - RNA, 9 nt, Human
gaggagaaa

SEQ ID NO: 2408458 - RNA, 12 nt, Human
gaggagaagaau

SEQ ID NO: 2408459 - RNA, 20 nt, Human
gaggagaagaauuuucagac

SEQ ID NO: 2408460 - RNA, 22 nt, Human
gaggagacuagauuuaugaaua

SEQ ID NO: 2408461 - RNA, 15 nt, Human
gaggagacauuggcu

SEQ ID NO: 2408462 - RNA, 22 nt, Human
gaggagaagaauuuucagaccc

SEQ ID NO: 2408463 - RNA, 17 nt, Human
gaggagagucccagagc

SEQ ID NO: 2408464 - RNA, 15 nt, Human
gaggagagucccaga

SEQ ID NO: 2408465 - RNA, 14 nt, Human
gaggagagucccag

SEQ ID NO: 2408466 - RNA, 20 nt, Human
gaggagaggggaagggccag

SEQ ID NO: 2408467 - RNA, 16 nt, Human
gaggagcaaaggcuga

SEQ ID NO: 2408468 - RNA, 17 nt, Human
gaggagaugcuccuugg

SEQ ID NO: 2408469 - RNA, 18 nt, Human
gaggcagggucucacucu

SEQ ID NO: 2408470 - RNA, 13 nt, Human
gaggagagccaga

SEQ ID NO: 2408471 - RNA, 16 nt, Human
gaggagagaggcagag

SEQ ID NO: 2408472 - RNA, 17 nt, Human
gaggagagaggcagaga

SEQ ID NO: 2408473 - RNA, 15 nt, Human
gaggagagaggcaga

SEQ ID NO: 2408474 - RNA, 14 nt, Human
gaggagagaggcag

SEQ ID NO: 2408475 - RNA, 13 nt, Human
gaggagagaggca

SEQ ID NO: 2408476 - RNA, 12 nt, Human
gaggagagaggc

SEQ ID NO: 2408477 - RNA, 17 nt, Human
gaggagaggagagaggc

SEQ ID NO: 2408478 - RNA, 16 nt, Human
gaggagaggagagagg

SEQ ID NO: 2408479 - RNA, 14 nt, Human
gaggagaggagaga

SEQ ID NO: 2408480 - RNA, 23 nt, Human
gaggagagccagagaagugacag

SEQ ID NO: 2408481 - RNA, 22 nt, Human
gaggagagccagagaagugaca

SEQ ID NO: 2408482 - RNA, 17 nt, Human
gaggagagccagagaag

SEQ ID NO: 2408483 - RNA, 13 nt, Human
gaggagaggagag

SEQ ID NO: 2408484 - RNA, 20 nt, Human
gaggcagggucucacucugu

SEQ ID NO: 2408485 - RNA, 19 nt, Human
gaggcagggucucacucug

SEQ ID NO: 2408486 - RNA, 18 nt, Human
gaggcauggcccuggggu

SEQ ID NO: 2408487 - RNA, 17 nt, Human
gaggcauggcccugggg

SEQ ID NO: 2408488 - RNA, 15 nt, Human
gaggcauggcccugg

SEQ ID NO: 2408489 - RNA, 14 nt, Human
gaggcauggcccug

SEQ ID NO: 2408490 - RNA, 13 nt, Human
gaggcauggcccu

SEQ ID NO: 2408491 - RNA, 17 nt, Human
gaggcaucgcaauguaa

SEQ ID NO: 2408492 - RNA, 15 nt, Human
gaggagcagugcagg

SEQ ID NO: 2408493 - RNA, 22 nt, Human
gaggcagggucucacucugucg

SEQ ID NO: 2408494 - RNA, 14 nt, Human
gagaaggagagaaa

SEQ ID NO: 2408495 - RNA, 12 nt, Human
gagaaggagaga

SEQ ID NO: 2408496 - RNA, 11 nt, Human
gagaaggagcc

SEQ ID NO: 2408497 - RNA, 23 nt, Human
gagaaggacccggaggggccugg

SEQ ID NO: 2408498 - RNA, 15 nt, Human
gagaaggggaggagg

SEQ ID NO: 2408499 - RNA, 23 nt, Human
gagaaggcaggaauguguggcag

SEQ ID NO: 2408500 - RNA, 15 nt, Human
gagaagggauggagg

SEQ ID NO: 2408501 - RNA, 11 nt, Human
gagaaggcagc

SEQ ID NO: 2408502 - RNA, 15 nt, Human
gagaaggagagaaag

SEQ ID NO: 2408503 - RNA, 17 nt, Human
gagaaggaucuagaaug

SEQ ID NO: 2408504 - RNA, 16 nt, Human
gagaaggcagccacca

SEQ ID NO: 2408505 - RNA, 12 nt, Human
gagaaggcagcc

SEQ ID NO: 2408506 - RNA, 12 nt, Human
gagaaggcagga

SEQ ID NO: 2408507 - RNA, 13 nt, Human
gagaaggcaggaa

SEQ ID NO: 2408508 - RNA, 16 nt, Human
gagaaguauacauaag

SEQ ID NO: 2408509 - RNA, 23 nt, Human
gagaagguggguuuucaucaaga

SEQ ID NO: 2408510 - RNA, 15 nt, Human
gagaagguccuuaau

SEQ ID NO: 2408511 - RNA, 15 nt, Human
gagaagugccccugc

SEQ ID NO: 2408512 - RNA, 16 nt, Human
gagaagugccccugcu

SEQ ID NO: 2408513 - RNA, 17 nt, Human
gagaagugccccugcug

SEQ ID NO: 2408514 - RNA, 20 nt, Human
gagaagugccccugcugccu

SEQ ID NO: 2408515 - RNA, 22 nt, Human
gagaagugccccugcugccucc

SEQ ID NO: 2408516 - RNA, 15 nt, Human
gagaccgagugaacc

SEQ ID NO: 2408517 - RNA, 14 nt, Human
gagaccgagugaac

SEQ ID NO: 2408518 - RNA, 16 nt, Human
gagaccgagccucugu

SEQ ID NO: 2408519 - RNA, 13 nt, Human
gagaaucuuuauu

SEQ ID NO: 2408520 - RNA, 19 nt, Human
gagaaucuuuauugagaaa

SEQ ID NO: 2408521 - RNA, 21 nt, Human
gagacccugucucaaaaaaag

SEQ ID NO: 2408522 - RNA, 23 nt, Human
gagaaugaaagggcccagagagg

SEQ ID NO: 2408523 - RNA, 15 nt, Human
gagaaugaaagggcc

SEQ ID NO: 2408524 - RNA, 15 nt, Human
gagaaucuauauuua

SEQ ID NO: 2408525 - RNA, 22 nt, Human
gagaaucuauauuuaacaagau

SEQ ID NO: 2408526 - RNA, 21 nt, Human
gagaaucuacccccagaucca

SEQ ID NO: 2408527 - RNA, 20 nt, Human
gagaaucccacuuucuauag

SEQ ID NO: 2408528 - RNA, 19 nt, Human
gagaauauuuuaaguauug

SEQ ID NO: 2408529 - RNA, 14 nt, Human
gagaauauauacau

SEQ ID NO: 2408530 - RNA, 21 nt, Human
gagaauauuuuaaguauugca

SEQ ID NO: 2408531 - RNA, 12 nt, Human
gagaauauauac

SEQ ID NO: 2408532 - RNA, 20 nt, Human
gagaauaagagagucauaaa

SEQ ID NO: 2408533 - RNA, 23 nt, Human
gagaauauuagcuuuacuguuug

SEQ ID NO: 2408534 - RNA, 22 nt, Human
gagaauaagagaaagaaaauga

SEQ ID NO: 2408535 - RNA, 16 nt, Human
gagaaguuuuguuuuu

SEQ ID NO: 2408536 - RNA, 18 nt, Human
gagaauaagagaaagaaa

SEQ ID NO: 2408537 - RNA, 18 nt, Human
gagaauaggcagccccca

SEQ ID NO: 2408538 - RNA, 19 nt, Human
gagaaguuuuguacagaga

SEQ ID NO: 2408539 - RNA, 18 nt, Human
gagaaguuuuguacagag

SEQ ID NO: 2408540 - RNA, 17 nt, Human
gagaaguuuuguacaga

SEQ ID NO: 2408541 - RNA, 21 nt, Human
gagaaguuucuggcccuggcu

SEQ ID NO: 2408542 - RNA, 17 nt, Human
gagaaguuucuggcccu

SEQ ID NO: 2408543 - RNA, 16 nt, Human
gagaaguuucuggccc

SEQ ID NO: 2408544 - RNA, 23 nt, Human
gagaagugccccugcugccuccc

SEQ ID NO: 2408545 - RNA, 18 nt, Human
gagacgggggcagagagg

SEQ ID NO: 2408546 - RNA, 16 nt, Human
gagacgggaccgggcc

SEQ ID NO: 2408547 - RNA, 19 nt, Human
gagaccuggcacuggaugc

SEQ ID NO: 2408548 - RNA, 19 nt, Human
gagacggagucccaccuug

SEQ ID NO: 2408549 - RNA, 16 nt, Human
gagacggagucccacc

SEQ ID NO: 2408550 - RNA, 15 nt, Human
gagaccguccucacc

SEQ ID NO: 2408551 - RNA, 14 nt, Human
gagaccguccucac

SEQ ID NO: 2408552 - RNA, 13 nt, Human
gagaccguccuca

SEQ ID NO: 2408553 - RNA, 20 nt, Human
gagaccgggguauccugggg

SEQ ID NO: 2408554 - RNA, 17 nt, Human
gagaccuaccucagguu

SEQ ID NO: 2408555 - RNA, 16 nt, Human
gagaccuaccucaggu

SEQ ID NO: 2408556 - RNA, 14 nt, Human
gagaccuaccucag

SEQ ID NO: 2408557 - RNA, 22 nt, Human
gagaccguccucaccccugucc

SEQ ID NO: 2408558 - RNA, 16 nt, Human
gagaccguccucaccc

SEQ ID NO: 2408559 - RNA, 14 nt, Human
gagacggaguccca

SEQ ID NO: 2408560 - RNA, 23 nt, Human
gagaccuaccucagguugcuggu

SEQ ID NO: 2408561 - RNA, 13 nt, Human
gagaccugccccu

SEQ ID NO: 2408562 - RNA, 21 nt, Human
gagaccuaccucagguugcug

SEQ ID NO: 2408563 - RNA, 18 nt, Human
gagaccuaccucagguug

SEQ ID NO: 2408564 - RNA, 20 nt, Human
gacuuuuccaacccucauca

SEQ ID NO: 2408565 - RNA, 16 nt, Human
gacuuuuugcauuuaa

SEQ ID NO: 2408566 - RNA, 11 nt, Human
gagaaaaacaa

SEQ ID NO: 2408567 - RNA, 19 nt, Human
gacuuuuuuuuuuuauaau

SEQ ID NO: 2408568 - RNA, 15 nt, Human
gagaaaacagaccua

SEQ ID NO: 2408569 - RNA, 19 nt, Human
gagaaaaagcuccuguccu

SEQ ID NO: 2408570 - RNA, 17 nt, Human
gagaaaaagcuccuguc

SEQ ID NO: 2408571 - RNA, 22 nt, Human
gacuuuuuauggcacuaguauu

SEQ ID NO: 2408572 - RNA, 19 nt, Human
gacuuuuccaacccucauc

SEQ ID NO: 2408573 - RNA, 14 nt, Human
gacuuuuccaaccc

SEQ ID NO: 2408574 - RNA, 18 nt, Human
gacuuuuauuuccaguga

SEQ ID NO: 2408575 - RNA, 12 nt, Human
gacuuuguucac

SEQ ID NO: 2408576 - RNA, 21 nt, Human
gagauugugccccugcacucc

SEQ ID NO: 2408577 - RNA, 14 nt, Human
gagauuggaaggaa

SEQ ID NO: 2408578 - RNA, 23 nt, Human
gagauuguuguuugccauacuuu

SEQ ID NO: 2408579 - RNA, 21 nt, Human
gagauugugccacuucacucc

SEQ ID NO: 2408580 - RNA, 17 nt, Human
gagauuggacggccuga

SEQ ID NO: 2408581 - RNA, 21 nt, Human
gagauguuuuuaaaaguuuca

SEQ ID NO: 2408582 - RNA, 19 nt, Human
gagauguuuuuaaaaguuu

SEQ ID NO: 2408583 - RNA, 18 nt, Human
gagauguuuuuaaaaguu

SEQ ID NO: 2408584 - RNA, 17 nt, Human
gagauguuuuuaaaagu

SEQ ID NO: 2408585 - RNA, 14 nt, Human
gagauguuuuuaaa

SEQ ID NO: 2408586 - RNA, 14 nt, Human
gagauguuuuagag

SEQ ID NO: 2408587 - RNA, 16 nt, Human
gagauuagagggaggu

SEQ ID NO: 2408588 - RNA, 15 nt, Human
gagauuaccuccuga

SEQ ID NO: 2408589 - RNA, 15 nt, Human
gagauuauguucuuu

SEQ ID NO: 2408590 - RNA, 14 nt, Human
gagauucagacugu

SEQ ID NO: 2408591 - RNA, 14 nt, Human
gagaugugcaccca

SEQ ID NO: 2408592 - RNA, 22 nt, Human
gagaugucuucguacaguucuu

SEQ ID NO: 2408593 - RNA, 16 nt, Human
gagaugcuggagaaga

SEQ ID NO: 2408594 - RNA, 15 nt, Human
gagaugcuggagaag

SEQ ID NO: 2408595 - RNA, 20 nt, Human
gagaugcuagaacucccuuu

SEQ ID NO: 2408596 - RNA, 16 nt, Human
gagaugcuagaacucc

SEQ ID NO: 2408597 - RNA, 14 nt, Human
gagagggagagaga

SEQ ID NO: 2408598 - RNA, 18 nt, Human
gagagggaggcaagcccu

SEQ ID NO: 2408599 - RNA, 20 nt, Human
gagaugccuccaccgcugcc

SEQ ID NO: 2408600 - RNA, 22 nt, Human
gagaugccuccaccgcugccua

SEQ ID NO: 2408601 - RNA, 23 nt, Human
gagaugccuccaccgcugccuaa

SEQ ID NO: 2408602 - RNA, 20 nt, Human
gagagcugggugucaagagg

SEQ ID NO: 2408603 - RNA, 16 nt, Human
gagagcuggagccugg

SEQ ID NO: 2408604 - RNA, 14 nt, Human
gagagcuggagccu

SEQ ID NO: 2408605 - RNA, 21 nt, Human
gagagcuggagccuggugccc

SEQ ID NO: 2408606 - RNA, 14 nt, Human
gagagcuggggaag

SEQ ID NO: 2408607 - RNA, 13 nt, Human
gagagcuggugcc

SEQ ID NO: 2408608 - RNA, 14 nt, Human
gagagcuggugccc

SEQ ID NO: 2408609 - RNA, 12 nt, Human
gagaggaaauca

SEQ ID NO: 2408610 - RNA, 22 nt, Human
gagagcuucuguugcugccuca

SEQ ID NO: 2408611 - RNA, 17 nt, Human
gagagcuggugcccgga

SEQ ID NO: 2408612 - RNA, 23 nt, Human
gagagcuggggaagcuucuuaaa

SEQ ID NO: 2408613 - RNA, 18 nt, Human
gagagcuguucccaaauu

SEQ ID NO: 2408614 - RNA, 15 nt, Human
gagaggacccccuga

SEQ ID NO: 2408615 - RNA, 16 nt, Human
gagagcuuaaugauaa

SEQ ID NO: 2408616 - RNA, 20 nt, Human
gagaggaaaaguaaggugca

SEQ ID NO: 2408617 - RNA, 23 nt, Human
gagagcuuucuguccuuuuggca

SEQ ID NO: 2408618 - RNA, 21 nt, Human
gagaggaaauauugcuggggu

SEQ ID NO: 2408619 - RNA, 20 nt, Human
gagaggaaauauugcugggg

SEQ ID NO: 2408620 - RNA, 19 nt, Human
gagaggaaugccuguguga

SEQ ID NO: 2408621 - RNA, 15 nt, Human
gagaggagagaggca

SEQ ID NO: 2408622 - RNA, 12 nt, Human
gagaggagagag

SEQ ID NO: 2408623 - RNA, 11 nt, Human
gagaggagaga

SEQ ID NO: 2408624 - RNA, 20 nt, Human
gagaggacuguagggagggc

SEQ ID NO: 2408625 - RNA, 14 nt, Human
gagaggagaaacac

SEQ ID NO: 2408626 - RNA, 15 nt, Human
gagaggagaaacaca

SEQ ID NO: 2408627 - RNA, 18 nt, Human
gagaggacagcuugagcc

SEQ ID NO: 2408628 - RNA, 15 nt, Human
gagaggacagcuuga

SEQ ID NO: 2408629 - RNA, 10 nt, Human
gagaggacag

SEQ ID NO: 2408630 - RNA, 17 nt, Human
gagaggacgugggcggc

SEQ ID NO: 2408631 - RNA, 16 nt, Human
gagaggacgugggcgg

SEQ ID NO: 2408632 - RNA, 18 nt, Human
gagaggagaggagagagg

SEQ ID NO: 2408633 - RNA, 19 nt, Human
gagaggagagccagagaag

SEQ ID NO: 2408634 - RNA, 16 nt, Human
gagaggagagccagag

SEQ ID NO: 2408635 - RNA, 15 nt, Human
gagaggagagccaga

SEQ ID NO: 2408636 - RNA, 13 nt, Human
gagaggagagcca

SEQ ID NO: 2408637 - RNA, 19 nt, Human
gagaggagagaggcagaga

SEQ ID NO: 2408638 - RNA, 18 nt, Human
gagaggagagaggcagag

SEQ ID NO: 2408639 - RNA, 16 nt, Human
gagaggaguucaauga

SEQ ID NO: 2408640 - RNA, 15 nt, Human
gagaggaguucaaug

SEQ ID NO: 2408641 - RNA, 13 nt, Human
gagaggaggcaac

SEQ ID NO: 2408642 - RNA, 13 nt, Human
gagaggaguucaa

SEQ ID NO: 2408643 - RNA, 22 nt, Human
gagaggagcgggaccuguggcu

SEQ ID NO: 2408644 - RNA, 21 nt, Human
gagaggagcgggaccuguggc

SEQ ID NO: 2408645 - RNA, 19 nt, Human
gagaggagcgggaccugug

SEQ ID NO: 2408646 - RNA, 16 nt, Human
gagaggaugagagccc

SEQ ID NO: 2408647 - RNA, 14 nt, Human
gagaggaugagagc

SEQ ID NO: 2408648 - RNA, 21 nt, Human
gagaggaugaauguaugugca

SEQ ID NO: 2408649 - RNA, 14 nt, Human
gagaggaugaaugu

SEQ ID NO: 2408650 - RNA, 12 nt, Human
gagaggaugaau

SEQ ID NO: 2408651 - RNA, 19 nt, Human
gagaggaguucaaugaucu

SEQ ID NO: 2408652 - RNA, 18 nt, Human
gagaggaguucaaugauc

SEQ ID NO: 2408653 - RNA, 17 nt, Human
gagaggaguucaaugau

SEQ ID NO: 2408654 - RNA, 21 nt, Human
gagaggaugagagcccagagg

SEQ ID NO: 2408655 - RNA, 19 nt, Human
gagaggaugagagcccaga

SEQ ID NO: 2408656 - RNA, 18 nt, Human
gagaggaugagagcccag

SEQ ID NO: 2408657 - RNA, 15 nt, Human
gagaggcaauggcca

SEQ ID NO: 2408658 - RNA, 14 nt, Human
gagaggcaaugauu

SEQ ID NO: 2408659 - RNA, 18 nt, Human
gagaggccuuuuggaaug

SEQ ID NO: 2408660 - RNA, 12 nt, Human
gagaggcuggga

SEQ ID NO: 2408661 - RNA, 23 nt, Human
gagagggagaagaagucagagag

SEQ ID NO: 2408662 - RNA, 15 nt, Human
gagagggagaagaag

SEQ ID NO: 2408663 - RNA, 14 nt, Human
gagagggagaagaa

SEQ ID NO: 2408664 - RNA, 10 nt, Human
gagagggaga

SEQ ID NO: 2408665 - RNA, 20 nt, Human
gagaggcccucuggaguggc

SEQ ID NO: 2408666 - RNA, 23 nt, Human
gagaggcccucuggaguggccac

SEQ ID NO: 2408667 - RNA, 15 nt, Human
gagaggccuuuugga

SEQ ID NO: 2408668 - RNA, 21 nt, Human
gagaggccaggugcagguugg

SEQ ID NO: 2408669 - RNA, 14 nt, Human
gagaggccaggugc

SEQ ID NO: 2408670 - RNA, 16 nt, Human
gagaggcccucuggag

SEQ ID NO: 2408671 - RNA, 12 nt, Human
gagaggccauga

SEQ ID NO: 2408672 - RNA, 20 nt, Human
gagaggaugagagcccagag

SEQ ID NO: 2408673 - RNA, 16 nt, Human
gagagccuuccagggg

SEQ ID NO: 2408674 - RNA, 15 nt, Human
gagagccuuccaggg

SEQ ID NO: 2408675 - RNA, 14 nt, Human
gagacuccugcagg

SEQ ID NO: 2408676 - RNA, 13 nt, Human
gagacuccugcag

SEQ ID NO: 2408677 - RNA, 15 nt, Human
gagacguguacauag

SEQ ID NO: 2408678 - RNA, 18 nt, Human
gagacgggugggcggcug

SEQ ID NO: 2408679 - RNA, 15 nt, Human
gagacggucgagcag

SEQ ID NO: 2408680 - RNA, 15 nt, Human
gagacucagagggag

SEQ ID NO: 2408681 - RNA, 14 nt, Human
gagacucagacagg

SEQ ID NO: 2408682 - RNA, 18 nt, Human
gagacuccgucucaagga

SEQ ID NO: 2408683 - RNA, 16 nt, Human
gagacuccaugagaag

SEQ ID NO: 2408684 - RNA, 16 nt, Human
gagacguguacauagu

SEQ ID NO: 2408685 - RNA, 17 nt, Human
gagacucagggccccag

SEQ ID NO: 2408686 - RNA, 21 nt, Human
gagacucagggccccagcacu

SEQ ID NO: 2408687 - RNA, 19 nt, Human
gagagcuagaaccuggagg

SEQ ID NO: 2408688 - RNA, 20 nt, Human
gagagcuagaaccuggagag

SEQ ID NO: 2408689 - RNA, 13 nt, Human
gagagcuggagcc

SEQ ID NO: 2408690 - RNA, 13 nt, Human
gagagcugggugu

SEQ ID NO: 2408691 - RNA, 15 nt, Human
gagagcuagcagcag

SEQ ID NO: 2408692 - RNA, 21 nt, Human
gagagcuagcagcagggaggg

SEQ ID NO: 2408693 - RNA, 20 nt, Human
gagagccuuccagggguggg

SEQ ID NO: 2408694 - RNA, 18 nt, Human
gagagccuuccaggggug

SEQ ID NO: 2408695 - RNA, 19 nt, Human
gagagcuagaaccuggaga

SEQ ID NO: 2408696 - RNA, 18 nt, Human
gagagcuagaaccuggag

SEQ ID NO: 2408697 - RNA, 16 nt, Human
gagagcuagaaccugg

SEQ ID NO: 2408698 - RNA, 17 nt, Human
gagagcuagaaccuaga

SEQ ID NO: 2408699 - RNA, 20 nt, Human
gagagcuagaacccggcagg

SEQ ID NO: 2408700 - RNA, 19 nt, Human
gagagcuagaacccggcag

SEQ ID NO: 2408701 - RNA, 23 nt, Human
gagagcgugcuccagccuggcuc

SEQ ID NO: 2408702 - RNA, 22 nt, Human
gagagcgugcuccagccuggcu

SEQ ID NO: 2408703 - RNA, 21 nt, Human
gagagcgugcuccagccuggc

SEQ ID NO: 2408704 - RNA, 21 nt, Human
gagagcggucucaggcuggug

SEQ ID NO: 2408705 - RNA, 14 nt, Human
gagagcggucucag

SEQ ID NO: 2408706 - RNA, 22 nt, Human
gagagcgccugccccucccaga

SEQ ID NO: 2408707 - RNA, 16 nt, Human
gagagcgccugccccu

SEQ ID NO: 2408708 - RNA, 16 nt, Human
gagacuccuaggcagg

SEQ ID NO: 2408709 - RNA, 17 nt, Human
cuucugacccaugcugc

SEQ ID NO: 2408710 - RNA, 16 nt, Human
cuucugacccaugcug

SEQ ID NO: 2408711 - RNA, 18 nt, Human
cuucugacccaugcugcc

SEQ ID NO: 2408712 - RNA, 23 nt, Human
cuucugaacuuggcgcugccccu

SEQ ID NO: 2408713 - RNA, 15 nt, Human
cuucuuacaugcauu

SEQ ID NO: 2408714 - RNA, 14 nt, Human
cuucuuacaugcau

SEQ ID NO: 2408715 - RNA, 13 nt, Human
cuucuuauacauu

SEQ ID NO: 2408716 - RNA, 16 nt, Human
cuucuuauacauuuga

SEQ ID NO: 2408717 - RNA, 19 nt, Human
cuucuuauggaauugauuu

SEQ ID NO: 2408718 - RNA, 23 nt, Human
cuucuuauggaauugauuugcau

SEQ ID NO: 2408719 - RNA, 22 nt, Human
cuucuuauggaauugauuugca

SEQ ID NO: 2408720 - RNA, 14 nt, Human
cuucuuauucucac

SEQ ID NO: 2408721 - RNA, 13 nt, Human
cuucuucucaggc

SEQ ID NO: 2408722 - RNA, 21 nt, Human
cuucuucggggaacuccugga

SEQ ID NO: 2408723 - RNA, 22 nt, Human
cuucuugaacacucaugcugaa

SEQ ID NO: 2408724 - RNA, 21 nt, Human
cuucuugaacacucaugcuga

SEQ ID NO: 2408725 - RNA, 12 nt, Human
cuucuugaaggu

SEQ ID NO: 2408726 - RNA, 20 nt, Human
cuucuugaacacucaugcug

SEQ ID NO: 2408727 - RNA, 19 nt, Human
cuucuugaacacucaugcu

SEQ ID NO: 2408728 - RNA, 22 nt, Human
cuucuugaaauuuuaaccuaug

SEQ ID NO: 2408729 - RNA, 17 nt, Human
cuucuucuuuuugcugu

SEQ ID NO: 2408730 - RNA, 21 nt, Human
cuucuucuuuugagcaacuuu

SEQ ID NO: 2408731 - RNA, 18 nt, Human
cuucuucuuuuugcuguu

SEQ ID NO: 2408732 - RNA, 13 nt, Human
cuucuucuucaga

SEQ ID NO: 2408733 - RNA, 15 nt, Human
cuucuucuuucuaca

SEQ ID NO: 2408734 - RNA, 14 nt, Human
cuucuucuucagaa

SEQ ID NO: 2408735 - RNA, 18 nt, Human
cuucuucuccuaugugua

SEQ ID NO: 2408736 - RNA, 19 nt, Human
cuucuucuccuauguguaa

SEQ ID NO: 2408737 - RNA, 12 nt, Human
cuucuucuccua

SEQ ID NO: 2408738 - RNA, 13 nt, Human
cuucuucuccccc

SEQ ID NO: 2408739 - RNA, 12 nt, Human
cuucuucucccc

SEQ ID NO: 2408740 - RNA, 12 nt, Human
cuuccucccucc

SEQ ID NO: 2408741 - RNA, 13 nt, Human
cuuccucccuccc

SEQ ID NO: 2408742 - RNA, 14 nt, Human
cuuccucccucccu

SEQ ID NO: 2408743 - RNA, 18 nt, Human
cuuccucccucccucuuu

SEQ ID NO: 2408744 - RNA, 21 nt, Human
cuucuaauauuuauugcuuua

SEQ ID NO: 2408745 - RNA, 20 nt, Human
cuucuaauauuuauugcuuu

SEQ ID NO: 2408746 - RNA, 17 nt, Human
cuucuaauauuuauugc

SEQ ID NO: 2408747 - RNA, 22 nt, Human
cuuccucugcagcugaccucug

SEQ ID NO: 2408748 - RNA, 20 nt, Human
cuuccucugcagcugaccuc

SEQ ID NO: 2408749 - RNA, 13 nt, Human
cuuccucugcuga

SEQ ID NO: 2408750 - RNA, 12 nt, Human
cuuccucugcug

SEQ ID NO: 2408751 - RNA, 19 nt, Human
cuuccucugcagcugaccu

SEQ ID NO: 2408752 - RNA, 14 nt, Human
cuuccucugcagcu

SEQ ID NO: 2408753 - RNA, 15 nt, Human
cuuccucccucauuc

SEQ ID NO: 2408754 - RNA, 11 nt, Human
cuuccucugcu

SEQ ID NO: 2408755 - RNA, 21 nt, Human
cuuccucuccacugccuucga

SEQ ID NO: 2408756 - RNA, 19 nt, Human
cuuccucuccacugccuuc

SEQ ID NO: 2408757 - RNA, 17 nt, Human
cuuccucuccacugccu

SEQ ID NO: 2408758 - RNA, 16 nt, Human
cuuccucuccacugcc

SEQ ID NO: 2408759 - RNA, 22 nt, Human
cuucugaacuuggcgcugcccc

SEQ ID NO: 2408760 - RNA, 15 nt, Human
cuucugacccaugcu

SEQ ID NO: 2408761 - RNA, 17 nt, Human
cuucugaacucaaacug

SEQ ID NO: 2408762 - RNA, 18 nt, Human
cuucugaacucaaacuga

SEQ ID NO: 2408763 - RNA, 22 nt, Human
cuucugaacucaaacugaggaa

SEQ ID NO: 2408764 - RNA, 19 nt, Human
cuucugaacuuggcgcugc

SEQ ID NO: 2408765 - RNA, 20 nt, Human
cuucucuggagccaagucca

SEQ ID NO: 2408766 - RNA, 19 nt, Human
cuucucuggaaagggggga

SEQ ID NO: 2408767 - RNA, 12 nt, Human
cuucucugcugc

SEQ ID NO: 2408768 - RNA, 21 nt, Human
cuucucugcuccaccacaucc

SEQ ID NO: 2408769 - RNA, 22 nt, Human
cuucucugcuccaccacauccu

SEQ ID NO: 2408770 - RNA, 22 nt, Human
cuucucuggagccaaguccaga

SEQ ID NO: 2408771 - RNA, 21 nt, Human
cuucucuggagccaaguccag

SEQ ID NO: 2408772 - RNA, 16 nt, Human
cuucuaguuucccaca

SEQ ID NO: 2408773 - RNA, 11 nt, Human
cuucucugcuc

SEQ ID NO: 2408774 - RNA, 12 nt, Human
cuucucugcucc

SEQ ID NO: 2408775 - RNA, 13 nt, Human
cuucucugcucca

SEQ ID NO: 2408776 - RNA, 14 nt, Human
cuucucugcuccac

SEQ ID NO: 2408777 - RNA, 15 nt, Human
cuucucugcuccacc

SEQ ID NO: 2408778 - RNA, 16 nt, Human
cuucucugcuccacca

SEQ ID NO: 2408779 - RNA, 17 nt, Human
cuucuaccucuuggcug

SEQ ID NO: 2408780 - RNA, 17 nt, Human
cuucuaccaugaacaga

SEQ ID NO: 2408781 - RNA, 23 nt, Human
cuucuaccugccacucacacagc

SEQ ID NO: 2408782 - RNA, 14 nt, Human
cuucuaccugccac

SEQ ID NO: 2408783 - RNA, 13 nt, Human
cuucuaccugcca

SEQ ID NO: 2408784 - RNA, 12 nt, Human
cuucuaccugcc

SEQ ID NO: 2408785 - RNA, 17 nt, Human
cuucuaccuuaaaaugu

SEQ ID NO: 2408786 - RNA, 17 nt, Human
cuucuaccugccacuca

SEQ ID NO: 2408787 - RNA, 16 nt, Human
cuucuaccugccacuc

SEQ ID NO: 2408788 - RNA, 15 nt, Human
cuucuaccugccacu

SEQ ID NO: 2408789 - RNA, 18 nt, Human
cuucuacugagccuucag

SEQ ID NO: 2408790 - RNA, 22 nt, Human
cuucucugacuucugccuggag

SEQ ID NO: 2408791 - RNA, 19 nt, Human
cuucuauuauagccacauc

SEQ ID NO: 2408792 - RNA, 18 nt, Human
cuucuauuagccagucuu

SEQ ID NO: 2408793 - RNA, 23 nt, Human
cuucuauggacugguuguugcca

SEQ ID NO: 2408794 - RNA, 15 nt, Human
cuucuaucccaggag

SEQ ID NO: 2408795 - RNA, 19 nt, Human
cuucccaaaggacuccacc

SEQ ID NO: 2408796 - RNA, 18 nt, Human
cuucccaaaggacuccac

SEQ ID NO: 2408797 - RNA, 21 nt, Human
cuucccaaaggacuccaccca

SEQ ID NO: 2408798 - RNA, 14 nt, Human
cuucccaaaggacu

SEQ ID NO: 2408799 - RNA, 14 nt, Human
cuuccauuugcaag

SEQ ID NO: 2408800 - RNA, 16 nt, Human
cuuccauuugugugug

SEQ ID NO: 2408801 - RNA, 13 nt, Human
cuuccauuugcaa

SEQ ID NO: 2408802 - RNA, 17 nt, Human
cuuccaugagaacagca

SEQ ID NO: 2408803 - RNA, 12 nt, Human
cuuccauuuaua

SEQ ID NO: 2408804 - RNA, 22 nt, Human
cuuccaucuuuccugauggcag

SEQ ID NO: 2408805 - RNA, 18 nt, Human
cuuccaucuuuccugaug

SEQ ID NO: 2408806 - RNA, 18 nt, Human
cuuccauguggagaaagg

SEQ ID NO: 2408807 - RNA, 15 nt, Human
cuuccauguggagaa

SEQ ID NO: 2408808 - RNA, 18 nt, Human
cuuacaguuuuaaauucu

SEQ ID NO: 2408809 - RNA, 23 nt, Human
cuuacagugagggcuauacaugg

SEQ ID NO: 2408810 - RNA, 23 nt, Human
cuuacaguaggagcccagcucug

SEQ ID NO: 2408811 - RNA, 16 nt, Human
cuuacaguaggagccc

SEQ ID NO: 2408812 - RNA, 23 nt, Human
cuuacagcuggguggcacugcca

SEQ ID NO: 2408813 - RNA, 22 nt, Human
cuuaaagaaagucgaauuaaua

SEQ ID NO: 2408814 - RNA, 22 nt, Human
cuuacagcuggguggcacugcc

SEQ ID NO: 2408815 - RNA, 22 nt, Human
cuuacauaauuuuuuauucaag

SEQ ID NO: 2408816 - RNA, 12 nt, Human
cuuacaugauuc

SEQ ID NO: 2408817 - RNA, 16 nt, Human
cuuacauaauuuuuua

SEQ ID NO: 2408818 - RNA, 18 nt, Human
cuuacaugcauuacugca

SEQ ID NO: 2408819 - RNA, 19 nt, Human
cuuacaugcauuacugcau

SEQ ID NO: 2408820 - RNA, 14 nt, Human
cuuacauguuuucu

SEQ ID NO: 2408821 - RNA, 21 nt, Human
cuuacauguuuucuuugcuuu

SEQ ID NO: 2408822 - RNA, 22 nt, Human
cuuccaucccaggacaccacac

SEQ ID NO: 2408823 - RNA, 15 nt, Human
cuuccaucucgccac

SEQ ID NO: 2408824 - RNA, 17 nt, Human
cuuccaucccuaccccc

SEQ ID NO: 2408825 - RNA, 19 nt, Human
cuuccaucccuacccccua

SEQ ID NO: 2408826 - RNA, 12 nt, Human
cuuccaucccua

SEQ ID NO: 2408827 - RNA, 14 nt, Human
cuuccaucccuacc

SEQ ID NO: 2408828 - RNA, 15 nt, Human
cuuccaucccuaccc

SEQ ID NO: 2408829 - RNA, 16 nt, Human
cuuccaucccuacccc

SEQ ID NO: 2408830 - RNA, 17 nt, Human
cuuccaucccaggacac

SEQ ID NO: 2408831 - RNA, 14 nt, Human
cuuccaucccagga

SEQ ID NO: 2408832 - RNA, 14 nt, Human
cuuccaucccagag

SEQ ID NO: 2408833 - RNA, 14 nt, Human
cuuccaucaugucc

SEQ ID NO: 2408834 - RNA, 17 nt, Human
cuuccaucaugucccca

SEQ ID NO: 2408835 - RNA, 13 nt, Human
cuuccaucauguc

SEQ ID NO: 2408836 - RNA, 12 nt, Human
cuuccaucaugu

SEQ ID NO: 2408837 - RNA, 20 nt, Human
cuuacauuagcaguuugcuu

SEQ ID NO: 2408838 - RNA, 21 nt, Human
cuuccauaugaccucaugcau

SEQ ID NO: 2408839 - RNA, 14 nt, Human
cuuacaugcauuug

SEQ ID NO: 2408840 - RNA, 17 nt, Human
cuuucaauaggaaaaac

SEQ ID NO: 2408841 - RNA, 18 nt, Human
cuuucaauaggaaaaacu

SEQ ID NO: 2408842 - RNA, 16 nt, Human
cuuucacaaccuucug

SEQ ID NO: 2408843 - RNA, 14 nt, Human
cuuucacacuucca

SEQ ID NO: 2408844 - RNA, 15 nt, Human
cuuucacacuuccac

SEQ ID NO: 2408845 - RNA, 14 nt, Human
cuuucacagcuccu

SEQ ID NO: 2408846 - RNA, 13 nt, Human
cuuucacagcucc

SEQ ID NO: 2408847 - RNA, 16 nt, Human
cuuucacacuuccacc

SEQ ID NO: 2408848 - RNA, 19 nt, Human
cuuucacacuuccaccagc

SEQ ID NO: 2408849 - RNA, 20 nt, Human
cuuucacacuuccaccagcc

SEQ ID NO: 2408850 - RNA, 21 nt, Human
cuuucacacuuccaccagccu

SEQ ID NO: 2408851 - RNA, 18 nt, Human
cuuucacagcuccuccca

SEQ ID NO: 2408852 - RNA, 15 nt, Human
cuuucacagcuccuc

SEQ ID NO: 2408853 - RNA, 23 nt, Human
cuuucacacuuccaccagccugc

SEQ ID NO: 2408854 - RNA, 16 nt, Human
cuuucaccccagggcc

SEQ ID NO: 2408855 - RNA, 21 nt, Human
cuuucaccccagggccugagc

SEQ ID NO: 2408856 - RNA, 15 nt, Human
cuuucaccccagggc

SEQ ID NO: 2408857 - RNA, 17 nt, Human
cuuucacauagagauca

SEQ ID NO: 2408858 - RNA, 16 nt, Human
cuuucacauagauguc

SEQ ID NO: 2408859 - RNA, 20 nt, Human
cuuuaaugucacaggcaggu

SEQ ID NO: 2408860 - RNA, 19 nt, Human
cuuuaaugucacaggcagg

SEQ ID NO: 2408861 - RNA, 18 nt, Human
cuuuaaugucacaggcag

SEQ ID NO: 2408862 - RNA, 17 nt, Human
cuuuaaugucacaggca

SEQ ID NO: 2408863 - RNA, 15 nt, Human
cuuucaauaggaaaa

SEQ ID NO: 2408864 - RNA, 14 nt, Human
cuuucaauaggaaa

SEQ ID NO: 2408865 - RNA, 23 nt, Human
cuuuaaugcaucuagauuaugga

SEQ ID NO: 2408866 - RNA, 12 nt, Human
cuuuaaugcuuu

SEQ ID NO: 2408867 - RNA, 22 nt, Human
cuuuaaugucacaggcaggucc

SEQ ID NO: 2408868 - RNA, 22 nt, Human
cuugucuuuggacccugaggcc

SEQ ID NO: 2408869 - RNA, 21 nt, Human
cuugucuuuggacccugaggc

SEQ ID NO: 2408870 - RNA, 19 nt, Human
cuuuaacuuaauugcuaug

SEQ ID NO: 2408871 - RNA, 14 nt, Human
cuuuaagacauacu

SEQ ID NO: 2408872 - RNA, 18 nt, Human
cuuuaagcagcucuugcu

SEQ ID NO: 2408873 - RNA, 17 nt, Human
cuuuaagcagcucuugc

SEQ ID NO: 2408874 - RNA, 16 nt, Human
cuuuaagcagcucuug

SEQ ID NO: 2408875 - RNA, 14 nt, Human
cuuuaagcagcucu

SEQ ID NO: 2408876 - RNA, 20 nt, Human
cuuuaagcacuacauaaacu

SEQ ID NO: 2408877 - RNA, 19 nt, Human
cuuuaagcacuacauaaac

SEQ ID NO: 2408878 - RNA, 14 nt, Human
cuuuaagaggacau

SEQ ID NO: 2408879 - RNA, 15 nt, Human
cuuuaagacugagca

SEQ ID NO: 2408880 - RNA, 23 nt, Human
cuuuaagacauacuccuuccauc

SEQ ID NO: 2408881 - RNA, 21 nt, Human
cuuuaagcagcucuugcuaau

SEQ ID NO: 2408882 - RNA, 12 nt, Human
cuuuaaggaaaa

SEQ ID NO: 2408883 - RNA, 19 nt, Human
cuuuaagcagcucuugcua

SEQ ID NO: 2408884 - RNA, 13 nt, Human
cuuuaaugcaucu

SEQ ID NO: 2408885 - RNA, 14 nt, Human
cuuuaaugcaucua

SEQ ID NO: 2408886 - RNA, 12 nt, Human
cuuuaaugcauc

SEQ ID NO: 2408887 - RNA, 15 nt, Human
cuugguccugcugca

SEQ ID NO: 2408888 - RNA, 20 nt, Human
cuugguccugcugcaguugc

SEQ ID NO: 2408889 - RNA, 18 nt, Human
cuugguccugcugcaguu

SEQ ID NO: 2408890 - RNA, 17 nt, Human
cuugguccugcugcagu

SEQ ID NO: 2408891 - RNA, 16 nt, Human
cuugguccugcugcag

SEQ ID NO: 2408892 - RNA, 17 nt, Human
cuugguuccagccugcc

SEQ ID NO: 2408893 - RNA, 19 nt, Human
cuugguuccagccugccac

SEQ ID NO: 2408894 - RNA, 16 nt, Human
cuugguucccauuugc

SEQ ID NO: 2408895 - RNA, 22 nt, Human
cuugguucauaaaugaauuuua

SEQ ID NO: 2408896 - RNA, 17 nt, Human
cuugguucauaaaugaa

SEQ ID NO: 2408897 - RNA, 13 nt, Human
cuugguuccccca

SEQ ID NO: 2408898 - RNA, 20 nt, Human
cuugguuccagccugccacu

SEQ ID NO: 2408899 - RNA, 20 nt, Human
cuugguucccauuugcuccu

SEQ ID NO: 2408900 - RNA, 23 nt, Human
cuuggucucagugucaaugcagc

SEQ ID NO: 2408901 - RNA, 22 nt, Human
cuugguccugcugcaguugcca

SEQ ID NO: 2408902 - RNA, 16 nt, Human
cuugguucauaaauga

SEQ ID NO: 2408903 - RNA, 21 nt, Human
cuugguuauuuguuuaccacu

SEQ ID NO: 2408904 - RNA, 14 nt, Human
cuugguucauaaau

SEQ ID NO: 2408905 - RNA, 19 nt, Human
cuuggugugacccucugaa

SEQ ID NO: 2408906 - RNA, 20 nt, Human
cuuggucugauuucaggaua

SEQ ID NO: 2408907 - RNA, 13 nt, Human
cuugucuguagau

SEQ ID NO: 2408908 - RNA, 23 nt, Human
cuugucugauuggcucacccaag

SEQ ID NO: 2408909 - RNA, 12 nt, Human
cuugucugagau

SEQ ID NO: 2408910 - RNA, 14 nt, Human
cuugucucugggcu

SEQ ID NO: 2408911 - RNA, 13 nt, Human
cuugucucugggc

SEQ ID NO: 2408912 - RNA, 20 nt, Human
cuugucuuuggacccugagg

SEQ ID NO: 2408913 - RNA, 14 nt, Human
cuugucuuguucac

SEQ ID NO: 2408914 - RNA, 16 nt, Human
cuugguucccccacug

SEQ ID NO: 2408915 - RNA, 19 nt, Human
cuugguucccccacugauc

SEQ ID NO: 2408916 - RNA, 17 nt, Human
cuugguucccuugugug

SEQ ID NO: 2408917 - RNA, 14 nt, Human
cuugguuggcuggc

SEQ ID NO: 2408918 - RNA, 16 nt, Human
cuugguugaggaaaca

SEQ ID NO: 2408919 - RNA, 14 nt, Human
cuugguugaggaaa

SEQ ID NO: 2408920 - RNA, 15 nt, Human
cuugguugaggaaac

SEQ ID NO: 2408921 - RNA, 20 nt, Human
cuugucucccagcucagggc

SEQ ID NO: 2408922 - RNA, 17 nt, Human
cuugccucaaugccagu

SEQ ID NO: 2408923 - RNA, 22 nt, Human
cuuggcgcugccccuggcagcc

SEQ ID NO: 2408924 - RNA, 21 nt, Human
cuuggcgcugccccuggcagc

SEQ ID NO: 2408925 - RNA, 18 nt, Human
cuuggcggcagcagccau

SEQ ID NO: 2408926 - RNA, 17 nt, Human
cuuggcggcagcagcca

SEQ ID NO: 2408927 - RNA, 15 nt, Human
cuuggcggcagcagc

SEQ ID NO: 2408928 - RNA, 14 nt, Human
cuuggcggcagcag

SEQ ID NO: 2408929 - RNA, 23 nt, Human
cuuggcgcugccccuggcagccc

SEQ ID NO: 2408930 - RNA, 18 nt, Human
cuuggcccgcacagagcu

SEQ ID NO: 2408931 - RNA, 14 nt, Human
cuugccucucuguu

SEQ ID NO: 2408932 - RNA, 20 nt, Human
cuuggauuguccccgacccu

SEQ ID NO: 2408933 - RNA, 18 nt, Human
cuuggauuguccccgacc

SEQ ID NO: 2408934 - RNA, 17 nt, Human
cuugccucuguccccuu

SEQ ID NO: 2408935 - RNA, 13 nt, Human
cuugccucucugu

SEQ ID NO: 2408936 - RNA, 23 nt, Human
cuugccucggcuccugcugcacc

SEQ ID NO: 2408937 - RNA, 22 nt, Human
cuugccucggcuccugcugcac

SEQ ID NO: 2408938 - RNA, 21 nt, Human
cuugccucggcuccugcugca

SEQ ID NO: 2408939 - RNA, 20 nt, Human
cuugccucggcuccugcugc

SEQ ID NO: 2408940 - RNA, 19 nt, Human
cuugccucggcuccugcug

SEQ ID NO: 2408941 - RNA, 18 nt, Human
cuugccucggcuccugcu

SEQ ID NO: 2408942 - RNA, 17 nt, Human
cuugccucggcuccugc

SEQ ID NO: 2408943 - RNA, 15 nt, Human
cuuggauuguccccg

SEQ ID NO: 2408944 - RNA, 14 nt, Human
cuugccuccccauu

SEQ ID NO: 2408945 - RNA, 16 nt, Human
cuugcccuugcccuga

SEQ ID NO: 2408946 - RNA, 12 nt, Human
cuugccucccca

SEQ ID NO: 2408947 - RNA, 13 nt, Human
cuugccuccugga

SEQ ID NO: 2408948 - RNA, 12 nt, Human
cuugccuccugg

SEQ ID NO: 2408949 - RNA, 20 nt, Human
cuugccuccccauuucccau

SEQ ID NO: 2408950 - RNA, 16 nt, Human
cuugccucggcuccug

SEQ ID NO: 2408951 - RNA, 15 nt, Human
cuugccucggcuccu

SEQ ID NO: 2408952 - RNA, 12 nt, Human
cuugccuccugu

SEQ ID NO: 2408953 - RNA, 15 nt, Human
cuugccuccugugua

SEQ ID NO: 2408954 - RNA, 21 nt, Human
cuugauggcuccgaacacccu

SEQ ID NO: 2408955 - RNA, 15 nt, Human
cuugauguguuaucu

SEQ ID NO: 2408956 - RNA, 22 nt, Human
cuugauguggugaggcaggcuu

SEQ ID NO: 2408957 - RNA, 12 nt, Human
cuugaugugccu

SEQ ID NO: 2408958 - RNA, 22 nt, Human
cuugaugugccauuuuaaaaaa

SEQ ID NO: 2408959 - RNA, 15 nt, Human
cuugaugugccauuu

SEQ ID NO: 2408960 - RNA, 13 nt, Human
cuugaugccuggc

SEQ ID NO: 2408961 - RNA, 17 nt, Human
cuugauucugcaguaaa

SEQ ID NO: 2408962 - RNA, 20 nt, Human
cuugauucugcaguaaaucu

SEQ ID NO: 2408963 - RNA, 13 nt, Human
cuugauucugcag

SEQ ID NO: 2408964 - RNA, 19 nt, Human
cuugauucauaaugacuua

SEQ ID NO: 2408965 - RNA, 21 nt, Human
cuugauucugcaguaaaucuu

SEQ ID NO: 2408966 - RNA, 22 nt, Human
cuugauucugcaguaaaucuuu

SEQ ID NO: 2408967 - RNA, 17 nt, Human
cuugcccuugcccugac

SEQ ID NO: 2408968 - RNA, 15 nt, Human
cuugcccuugcccug

SEQ ID NO: 2408969 - RNA, 23 nt, Human
cuugcccuucccugucccucuaa

SEQ ID NO: 2408970 - RNA, 18 nt, Human
cuugccgucuaccugagg

SEQ ID NO: 2408971 - RNA, 23 nt, Human
cuugccgaaccaggagcugcuca

SEQ ID NO: 2408972 - RNA, 18 nt, Human
cuugccgcgucgcccucc

SEQ ID NO: 2408973 - RNA, 21 nt, Human
cuugccgcgucgcccucccag

SEQ ID NO: 2408974 - RNA, 19 nt, Human
cuugccgucuaccugaggg

SEQ ID NO: 2408975 - RNA, 18 nt, Human
cuugccucaaugccagua

SEQ ID NO: 2408976 - RNA, 23 nt, Human
cuugccgcgucgcccucccaggc

SEQ ID NO: 2408977 - RNA, 19 nt, Human
cuuuuauuguauaaacuau

SEQ ID NO: 2408978 - RNA, 13 nt, Human
cuuuuauuguaua

SEQ ID NO: 2408979 - RNA, 16 nt, Human
cuuuuauuguauaaac

SEQ ID NO: 2408980 - RNA, 18 nt, Human
cuuuuaugugaaacaugu

SEQ ID NO: 2408981 - RNA, 19 nt, Human
cuuuuaugugaaacauguu

SEQ ID NO: 2408982 - RNA, 20 nt, Human
cuuuuauguuauuuauauau

SEQ ID NO: 2408983 - RNA, 16 nt, Human
cuuuuauuaaugcacu

SEQ ID NO: 2408984 - RNA, 14 nt, Human
cuuuuauuaaugca

SEQ ID NO: 2408985 - RNA, 17 nt, Human
cuuuuauucauuugagu

SEQ ID NO: 2408986 - RNA, 18 nt, Human
cuuuuauguuauuuauau

SEQ ID NO: 2408987 - RNA, 19 nt, Human
cuuuuauuaaugcacuuuc

SEQ ID NO: 2408988 - RNA, 17 nt, Human
cuuuuauugacacagaa

SEQ ID NO: 2408989 - RNA, 18 nt, Human
cuuuuauugacacagaaa

SEQ ID NO: 2408990 - RNA, 14 nt, Human
gaaacaaaaacacu

SEQ ID NO: 2408991 - RNA, 19 nt, Human
gaaacaaaaacacuaaaaa

SEQ ID NO: 2408992 - RNA, 23 nt, Human
gaaacaaaaacacuaaaaauaaa

SEQ ID NO: 2408993 - RNA, 18 nt, Human
gaaaauuuugauguuuua

SEQ ID NO: 2408994 - RNA, 14 nt, Human
gaaaauuuuaaaaa

SEQ ID NO: 2408995 - RNA, 12 nt, Human
gaaacaaagaag

SEQ ID NO: 2408996 - RNA, 15 nt, Human
gaaaacuuauuugag

SEQ ID NO: 2408997 - RNA, 14 nt, Human
gaaaacuuauuuga

SEQ ID NO: 2408998 - RNA, 23 nt, Human
gaaaacuuaugaccucuuccuuu

SEQ ID NO: 2408999 - RNA, 18 nt, Human
gaaaacugaaaaucuaau

SEQ ID NO: 2409000 - RNA, 20 nt, Human
gaaaacugaaaaucuaauau

SEQ ID NO: 2409001 - RNA, 16 nt, Human
gaaaacugacagagga

SEQ ID NO: 2409002 - RNA, 19 nt, Human
gaaaacugcaacuuguaaa

SEQ ID NO: 2409003 - RNA, 21 nt, Human
gaaaaaauguuggauuuauaa

SEQ ID NO: 2409004 - RNA, 18 nt, Human
gaaaaaauguuggauuua

SEQ ID NO: 2409005 - RNA, 14 nt, Human
gaaaaaauguugga

SEQ ID NO: 2409006 - RNA, 19 nt, Human
gaaaaaaugauguucauuu

SEQ ID NO: 2409007 - RNA, 20 nt, Human
gaaaacuccuuuagcaggug

SEQ ID NO: 2409008 - RNA, 17 nt, Human
gaaaacucauuacuuuu

SEQ ID NO: 2409009 - RNA, 16 nt, Human
gaaaacugaaaaucua

SEQ ID NO: 2409010 - RNA, 20 nt, Human
gaaaagacuccaaagaaaug

SEQ ID NO: 2409011 - RNA, 18 nt, Human
gaaaagacuccaaagaaa

SEQ ID NO: 2409012 - RNA, 21 nt, Human
gaaaagacuccaaagaaaugu

SEQ ID NO: 2409013 - RNA, 16 nt, Human
gaaaacuuauuugagu

SEQ ID NO: 2409014 - RNA, 16 nt, Human
gaaaacuucuuuuaaa

SEQ ID NO: 2409015 - RNA, 15 nt, Human
gaaaagagauauuuu

SEQ ID NO: 2409016 - RNA, 19 nt, Human
gaaaagagauauuuuaaaa

SEQ ID NO: 2409017 - RNA, 16 nt, Human
gaaaagcaccugccga

SEQ ID NO: 2409018 - RNA, 19 nt, Human
gaaaagcagcccuuggcca

SEQ ID NO: 2409019 - RNA, 17 nt, Human
gaaaagcaccugccgac

SEQ ID NO: 2409020 - RNA, 14 nt, Human
gaaaagcagcucuc

SEQ ID NO: 2409021 - RNA, 17 nt, Human
gaaaagcagcucucccc

SEQ ID NO: 2409022 - RNA, 20 nt, Human
gaaaagcagcccuuggccag

SEQ ID NO: 2409023 - RNA, 21 nt, Human
gaaaagccucugugucacugg

SEQ ID NO: 2409024 - RNA, 14 nt, Human
gaaaagccucugug

SEQ ID NO: 2409025 - RNA, 13 nt, Human
gaaaagccucugu

SEQ ID NO: 2409026 - RNA, 18 nt, Human
gaaaagcggacaucagcu

SEQ ID NO: 2409027 - RNA, 22 nt, Human
gaaaauuaggauuucaugauuu

SEQ ID NO: 2409028 - RNA, 18 nt, Human
gaaaauuaggauuucaug

SEQ ID NO: 2409029 - RNA, 20 nt, Human
gaaaauguuuuucugccagg

SEQ ID NO: 2409030 - RNA, 13 nt, Human
gaaaauuaacacu

SEQ ID NO: 2409031 - RNA, 15 nt, Human
gaaaauuaacacugc

SEQ ID NO: 2409032 - RNA, 14 nt, Human
gaaaauuaacauga

SEQ ID NO: 2409033 - RNA, 21 nt, Human
gaaaauguugagaaucccaaa

SEQ ID NO: 2409034 - RNA, 15 nt, Human
gaaaagccucugugu

SEQ ID NO: 2409035 - RNA, 20 nt, Human
gaaaagcggacaucagcugg

SEQ ID NO: 2409036 - RNA, 18 nt, Human
cuuuugccguuauuaaaa

SEQ ID NO: 2409037 - RNA, 11 nt, Human
cuuuugcuuuu

SEQ ID NO: 2409038 - RNA, 14 nt, Human
cuuuugcuuuauuc

SEQ ID NO: 2409039 - RNA, 22 nt, Human
cuuuugcucuuagcugucugcu

SEQ ID NO: 2409040 - RNA, 23 nt, Human
cuuuuguauguaaaugugcauuc

SEQ ID NO: 2409041 - RNA, 21 nt, Human
cuuuuguauguaaaugugcau

SEQ ID NO: 2409042 - RNA, 20 nt, Human
cuuuuguauguaaaugugca

SEQ ID NO: 2409043 - RNA, 18 nt, Human
cuuuuguauguaaaugug

SEQ ID NO: 2409044 - RNA, 17 nt, Human
cuuuuguauguaaaugu

SEQ ID NO: 2409045 - RNA, 16 nt, Human
cuuuuguauguaaaug

SEQ ID NO: 2409046 - RNA, 15 nt, Human
cuuuuguauguaaau

SEQ ID NO: 2409047 - RNA, 13 nt, Human
cuuuuguauguaa

SEQ ID NO: 2409048 - RNA, 14 nt, Human
cuuuuguauaguug

SEQ ID NO: 2409049 - RNA, 14 nt, Human
cuuuugucccagaa

SEQ ID NO: 2409050 - RNA, 17 nt, Human
cuuuugucuaugggacu

SEQ ID NO: 2409051 - RNA, 16 nt, Human
cuuuuggucuguguga

SEQ ID NO: 2409052 - RNA, 15 nt, Human
cuuuuggucugugug

SEQ ID NO: 2409053 - RNA, 15 nt, Human
cuuuugcuuuuggca

SEQ ID NO: 2409054 - RNA, 17 nt, Human
cuuuugcuuuuggcaaa

SEQ ID NO: 2409055 - RNA, 21 nt, Human
cuuuugguaaagacuggcuuu

SEQ ID NO: 2409056 - RNA, 20 nt, Human
cuuuugguaaagacuggcuu

SEQ ID NO: 2409057 - RNA, 14 nt, Human
cuuuuuuuucuuua

SEQ ID NO: 2409058 - RNA, 15 nt, Human
cuuuuuuuucuuuaa

SEQ ID NO: 2409059 - RNA, 18 nt, Human
cuuuuuuuuaaugugcug

SEQ ID NO: 2409060 - RNA, 17 nt, Human
cuuuuuuuuaaugugcu

SEQ ID NO: 2409061 - RNA, 21 nt, Human
cuuuuuuuuccccccuagaaa

SEQ ID NO: 2409062 - RNA, 14 nt, Human
cuuuuuuuuaaguu

SEQ ID NO: 2409063 - RNA, 14 nt, Human
cuuuugugcauuau

SEQ ID NO: 2409064 - RNA, 18 nt, Human
cuuuugugcauuaucuag

SEQ ID NO: 2409065 - RNA, 23 nt, Human
cuuuuguguacaguguguaaagu

SEQ ID NO: 2409066 - RNA, 14 nt, Human
cuuuuguguacagu

SEQ ID NO: 2409067 - RNA, 15 nt, Human
gaaaaaaaaagaaaa

SEQ ID NO: 2409068 - RNA, 16 nt, Human
gaaaaaaaaagaaaaa

SEQ ID NO: 2409069 - RNA, 17 nt, Human
gaaaaaaaaagaaaaaa

SEQ ID NO: 2409070 - RNA, 18 nt, Human
gaaaaaaaaagaaaaaag

SEQ ID NO: 2409071 - RNA, 15 nt, Human
gaaaaaauacauuuu

SEQ ID NO: 2409072 - RNA, 17 nt, Human
gaaaaaauacauuuuau

SEQ ID NO: 2409073 - RNA, 10 nt, Human
gaaaaaauac

SEQ ID NO: 2409074 - RNA, 21 nt, Human
gaaaaaauaauugauuucaag

SEQ ID NO: 2409075 - RNA, 13 nt, Human
gaaaaaauacauu

SEQ ID NO: 2409076 - RNA, 14 nt, Human
gaaaaaauacauuu

SEQ ID NO: 2409077 - RNA, 14 nt, Human
gaaaaaauauauau

SEQ ID NO: 2409078 - RNA, 19 nt, Human
gaaaaaauauuuuccugcc

SEQ ID NO: 2409079 - RNA, 18 nt, Human
gaaaaaaaaaaugcugaa

SEQ ID NO: 2409080 - RNA, 19 nt, Human
gaaaaaaaaaaugcugaac

SEQ ID NO: 2409081 - RNA, 20 nt, Human
gaaaaaaaaaaugcugaaca

SEQ ID NO: 2409082 - RNA, 12 nt, Human
gaaaaaaaaaga

SEQ ID NO: 2409083 - RNA, 13 nt, Human
gaaaaaaaaagaa

SEQ ID NO: 2409084 - RNA, 21 nt, Human
cuuuuuuuuuuuuuuugacaa

SEQ ID NO: 2409085 - RNA, 15 nt, Human
cuuuuuuuuguaugu

SEQ ID NO: 2409086 - RNA, 18 nt, Human
gaacaaggcaaggcuguc

SEQ ID NO: 2409087 - RNA, 17 nt, Human
gaacaaggcaaggcugu

SEQ ID NO: 2409088 - RNA, 15 nt, Human
gaacaaggcaaggcu

SEQ ID NO: 2409089 - RNA, 14 nt, Human
gaacaaggcaaggc

SEQ ID NO: 2409090 - RNA, 21 nt, Human
gaacaaggcaaggcugucaau

SEQ ID NO: 2409091 - RNA, 23 nt, Human
gaaacuucagcgguuuauauaag

SEQ ID NO: 2409092 - RNA, 17 nt, Human
gaaacuuauuuuuuucu

SEQ ID NO: 2409093 - RNA, 12 nt, Human
gaaacuuauuuu

SEQ ID NO: 2409094 - RNA, 11 nt, Human
gaaacuuauuu

SEQ ID NO: 2409095 - RNA, 20 nt, Human
gaaacuuauuuuuuucugau

SEQ ID NO: 2409096 - RNA, 19 nt, Human
gaaacuuauuuuuuucuga

SEQ ID NO: 2409097 - RNA, 21 nt, Human
gaaacuuauuuuuuucugauu

SEQ ID NO: 2409098 - RNA, 14 nt, Human
gaaacuuacacaca

SEQ ID NO: 2409099 - RNA, 15 nt, Human
gaaacuuacacacaa

SEQ ID NO: 2409100 - RNA, 15 nt, Human
gaaacuguugccaga

SEQ ID NO: 2409101 - RNA, 17 nt, Human
gaaacuguugccagaga

SEQ ID NO: 2409102 - RNA, 21 nt, Human
gaaacuguugccagagaugga

SEQ ID NO: 2409103 - RNA, 23 nt, Human
gaaacuguugccagagauggagg

SEQ ID NO: 2409104 - RNA, 20 nt, Human
gaaacuguucccaccugcug

SEQ ID NO: 2409105 - RNA, 18 nt, Human
gaaacuguagucucagga

SEQ ID NO: 2409106 - RNA, 21 nt, Human
gaaacuguucccaccugcugg

SEQ ID NO: 2409107 - RNA, 22 nt, Human
gaaacuguucccaccugcugga

SEQ ID NO: 2409108 - RNA, 12 nt, Human
gaaacuuggcuc

SEQ ID NO: 2409109 - RNA, 11 nt, Human
gaaacuuggau

SEQ ID NO: 2409110 - RNA, 18 nt, Human
gaaagaaguggggacaga

SEQ ID NO: 2409111 - RNA, 11 nt, Human
gaaagaagaga

SEQ ID NO: 2409112 - RNA, 19 nt, Human
gaaagaagagccggagccu

SEQ ID NO: 2409113 - RNA, 15 nt, Human
gaaagaagagacagg

SEQ ID NO: 2409114 - RNA, 11 nt, Human
gaaagaaggaa

SEQ ID NO: 2409115 - RNA, 16 nt, Human
gaaagacagagcuggg

SEQ ID NO: 2409116 - RNA, 14 nt, Human
gaaagacagagcug

SEQ ID NO: 2409117 - RNA, 19 nt, Human
gaaagaaugaaagaguaaa

SEQ ID NO: 2409118 - RNA, 16 nt, Human
gaaagaaugaaagagu

SEQ ID NO: 2409119 - RNA, 16 nt, Human
gaaagaaggcaaaguc

SEQ ID NO: 2409120 - RNA, 18 nt, Human
gaaaggcuccaggagcag

SEQ ID NO: 2409121 - RNA, 17 nt, Human
gaaaggcuccaggagca

SEQ ID NO: 2409122 - RNA, 19 nt, Human
gaaaggcuccaggagcagc

SEQ ID NO: 2409123 - RNA, 15 nt, Human
gaaagguucugcccg

SEQ ID NO: 2409124 - RNA, 14 nt, Human
gaaagguucugccc

SEQ ID NO: 2409125 - RNA, 14 nt, Human
gaaagguuuacauu

SEQ ID NO: 2409126 - RNA, 18 nt, Human
gaaagacuaucuaaaugu

SEQ ID NO: 2409127 - RNA, 21 nt, Human
gaaagacggauugcauuagaa

SEQ ID NO: 2409128 - RNA, 16 nt, Human
gaaaggcuccaggagc

SEQ ID NO: 2409129 - RNA, 23 nt, Human
gaaagacauccauaaagaagcaa

SEQ ID NO: 2409130 - RNA, 21 nt, Human
gaaagacauccauaaagaagc

SEQ ID NO: 2409131 - RNA, 22 nt, Human
gaaagacauccauaaagaagca

SEQ ID NO: 2409132 - RNA, 16 nt, Human
gaaagaccauuuuucc

SEQ ID NO: 2409133 - RNA, 17 nt, Human
gaaagacagcuucucau

SEQ ID NO: 2409134 - RNA, 16 nt, Human
gaaagacagcuucuca

SEQ ID NO: 2409135 - RNA, 16 nt, Human
gaaaucaaauaugcaa

SEQ ID NO: 2409136 - RNA, 19 nt, Human
gaaaucaaagagagaaaau

SEQ ID NO: 2409137 - RNA, 21 nt, Human
gaaaucaaauaugcaaagcac

SEQ ID NO: 2409138 - RNA, 17 nt, Human
gaaaucaaauaugcaaa

SEQ ID NO: 2409139 - RNA, 19 nt, Human
gaaauauuuauuuuuuuaa

SEQ ID NO: 2409140 - RNA, 21 nt, Human
gaaaguacuucuccacccugc

SEQ ID NO: 2409141 - RNA, 20 nt, Human
gaaagguuugagaagcacug

SEQ ID NO: 2409142 - RNA, 16 nt, Human
gaaagguuuacauugu

SEQ ID NO: 2409143 - RNA, 17 nt, Human
gaaaugaaagcagggac

SEQ ID NO: 2409144 - RNA, 17 nt, Human
gaaaucaccgaaaacgu

SEQ ID NO: 2409145 - RNA, 23 nt, Human
gaaaucaaauaugcaaagcacug

SEQ ID NO: 2409146 - RNA, 16 nt, Human
gaaaucacagaaucau

SEQ ID NO: 2409147 - RNA, 15 nt, Human
gaaaucacagaauca

SEQ ID NO: 2409148 - RNA, 13 nt, Human
gaaaugaauaauu

SEQ ID NO: 2409149 - RNA, 18 nt, Human
gaaauuuuuauuaaauua

SEQ ID NO: 2409150 - RNA, 18 nt, Human
gaaaugaaagcagggacu

SEQ ID NO: 2409151 - RNA, 17 nt, Human
gaacaaauuuacagaga

SEQ ID NO: 2409152 - RNA, 18 nt, Human
gaacaaauuuacagagac

SEQ ID NO: 2409153 - RNA, 22 nt, Human
gaaauuuuucagaugcuucugg

SEQ ID NO: 2409154 - RNA, 17 nt, Human
gaaauuuuucagaugcu

SEQ ID NO: 2409155 - RNA, 20 nt, Human
gaaauuuuucagaugcuucu

SEQ ID NO: 2409156 - RNA, 14 nt, Human
gaaaugaauaauuu

SEQ ID NO: 2409157 - RNA, 18 nt, Human
gaaaugaauaauuuccca

SEQ ID NO: 2409158 - RNA, 17 nt, Human
gaaauuuuuauuuuucu

SEQ ID NO: 2409159 - RNA, 19 nt, Human
gaaauuuuuauuaaauuau

SEQ ID NO: 2409160 - RNA, 23 nt, Human
gaacaaauuuacagagacagaaa

SEQ ID NO: 2409161 - RNA, 15 nt, Human
gaacaacuacuguga

SEQ ID NO: 2409162 - RNA, 19 nt, Human
gaacaacuaggcuucagca

SEQ ID NO: 2409163 - RNA, 21 nt, Human
gaacaacuaggcuucagcaua

SEQ ID NO: 2409164 - RNA, 13 nt, Human
gaacaagccuaaa

SEQ ID NO: 2409165 - RNA, 16 nt, Human
gaacaagcauucuccu

SEQ ID NO: 2409166 - RNA, 16 nt, Human
cugcuucaaggauccu

SEQ ID NO: 2409167 - RNA, 14 nt, Human
cugcuucaaggauc

SEQ ID NO: 2409168 - RNA, 19 nt, Human
cugcuucaaggauccugag

SEQ ID NO: 2409169 - RNA, 20 nt, Human
cugcuucaaggauccugagc

SEQ ID NO: 2409170 - RNA, 20 nt, Human
cugcuuccaccucaccccac

SEQ ID NO: 2409171 - RNA, 19 nt, Human
cugcuuccaccucacccca

SEQ ID NO: 2409172 - RNA, 18 nt, Human
cugcuuccaccucacccc

SEQ ID NO: 2409173 - RNA, 17 nt, Human
cugcuuccaccucaccc

SEQ ID NO: 2409174 - RNA, 16 nt, Human
cugcuuccaccucacc

SEQ ID NO: 2409175 - RNA, 21 nt, Human
cugcuucaugcucagcccuga

SEQ ID NO: 2409176 - RNA, 24 nt, Human
cugcuuccaauuuucuggaauaca

SEQ ID NO: 2409177 - RNA, 14 nt, Human
cugcuuccagugag

SEQ ID NO: 2409178 - RNA, 15 nt, Human
cugcuucaugacauu

SEQ ID NO: 2409179 - RNA, 12 nt, Human
cugcuucagugg

SEQ ID NO: 2409180 - RNA, 21 nt, Human
cugcuucaguguauggaaaua

SEQ ID NO: 2409181 - RNA, 19 nt, Human
cugcuucaguguauggaaa

SEQ ID NO: 2409182 - RNA, 23 nt, Human
cugcuucagccucccgaguagcu

SEQ ID NO: 2409183 - RNA, 14 nt, Human
cuggaaaagaggag

SEQ ID NO: 2409184 - RNA, 22 nt, Human
cugcuuccaccucaccccacuu

SEQ ID NO: 2409185 - RNA, 23 nt, Human
cuggaaaaguauguuagugcaaa

SEQ ID NO: 2409186 - RNA, 18 nt, Human
cuggaaaaugugacccag

SEQ ID NO: 2409187 - RNA, 19 nt, Human
cuggaaaagggucuuggga

SEQ ID NO: 2409188 - RNA, 15 nt, Human
cuggaaaagaggagu

SEQ ID NO: 2409189 - RNA, 22 nt, Human
cuggaaaagggucuugggaaau

SEQ ID NO: 2409190 - RNA, 20 nt, Human
cuggaaaauuccuauugauu

SEQ ID NO: 2409191 - RNA, 16 nt, Human
cuggaaaccacagucc

SEQ ID NO: 2409192 - RNA, 22 nt, Human
cuggaguuacauuaauguuaau

SEQ ID NO: 2409193 - RNA, 16 nt, Human
cuggaguuacauuaau

SEQ ID NO: 2409194 - RNA, 22 nt, Human
cuggaguguggcugaggaggcc

SEQ ID NO: 2409195 - RNA, 21 nt, Human
cuggaguguggcugaggaggc

SEQ ID NO: 2409196 - RNA, 20 nt, Human
cuggaguguggcugaggagg

SEQ ID NO: 2409197 - RNA, 19 nt, Human
cuggaguguggcugaggag

SEQ ID NO: 2409198 - RNA, 18 nt, Human
cuggaguguggcugagga

SEQ ID NO: 2409199 - RNA, 17 nt, Human
cuggauccaucaggcca

SEQ ID NO: 2409200 - RNA, 13 nt, Human
cuggaucaguccu

SEQ ID NO: 2409201 - RNA, 17 nt, Human
cuggaucaguccuuuga

SEQ ID NO: 2409202 - RNA, 20 nt, Human
cuggaucaguccuuugauca

SEQ ID NO: 2409203 - RNA, 21 nt, Human
cuggaucaguccuuugaucag

SEQ ID NO: 2409204 - RNA, 15 nt, Human
cuggagaagagagga

SEQ ID NO: 2409205 - RNA, 14 nt, Human
cuggagaagagagg

SEQ ID NO: 2409206 - RNA, 12 nt, Human
cuggagaagaga

SEQ ID NO: 2409207 - RNA, 23 nt, Human
cuggagaacuagaaccuggaggg

SEQ ID NO: 2409208 - RNA, 22 nt, Human
cuggagaacuagaaccuggagg

SEQ ID NO: 2409209 - RNA, 19 nt, Human
cuggagaacuagaaccugg

SEQ ID NO: 2409210 - RNA, 19 nt, Human
cuggagaagacccuccccg

SEQ ID NO: 2409211 - RNA, 24 nt, Human
cuggaguggccacuaagcagagga

SEQ ID NO: 2409212 - RNA, 13 nt, Human
cuggaguggccac

SEQ ID NO: 2409213 - RNA, 14 nt, Human
cuggaguggccacu

SEQ ID NO: 2409214 - RNA, 19 nt, Human
cuggagugguguucagcca

SEQ ID NO: 2409215 - RNA, 23 nt, Human
cuggaguggccacuaagcagagg

SEQ ID NO: 2409216 - RNA, 13 nt, Human
cuggagaacuaga

SEQ ID NO: 2409217 - RNA, 23 nt, Human
cuggaaaggggggagcuggggaa

SEQ ID NO: 2409218 - RNA, 15 nt, Human
cuggagaacuagaga

SEQ ID NO: 2409219 - RNA, 14 nt, Human
cuggagaacuagag

SEQ ID NO: 2409220 - RNA, 23 nt, Human
cuggaaaggggagagccugcugg

SEQ ID NO: 2409221 - RNA, 22 nt, Human
cuggaaaggggagagccugcug

SEQ ID NO: 2409222 - RNA, 21 nt, Human
cuggaaaggggagagccugcu

SEQ ID NO: 2409223 - RNA, 20 nt, Human
cuggaaaggggagagccugc

SEQ ID NO: 2409224 - RNA, 20 nt, Human
cuggaaaggggggagcuggg

SEQ ID NO: 2409225 - RNA, 19 nt, Human
cuggaaaggggggagcugg

SEQ ID NO: 2409226 - RNA, 20 nt, Human
cuggacuccucuguccaggc

SEQ ID NO: 2409227 - RNA, 19 nt, Human
cuggaaaggggagagccug

SEQ ID NO: 2409228 - RNA, 18 nt, Human
cuggaaaggggagagccu

SEQ ID NO: 2409229 - RNA, 17 nt, Human
cuggaaaggggagagcc

SEQ ID NO: 2409230 - RNA, 16 nt, Human
cuggaaaggggagagc

SEQ ID NO: 2409231 - RNA, 15 nt, Human
cuggaaaggggagag

SEQ ID NO: 2409232 - RNA, 13 nt, Human
cuggaaaggggag

SEQ ID NO: 2409233 - RNA, 23 nt, Human
cuggaaaggcucagucucaggag

SEQ ID NO: 2409234 - RNA, 13 nt, Human
cuggaaaggcuca

SEQ ID NO: 2409235 - RNA, 14 nt, Human
cuggaaaggcucag

SEQ ID NO: 2409236 - RNA, 15 nt, Human
cuggaaaggcucagu

SEQ ID NO: 2409237 - RNA, 17 nt, Human
cuggaaaggcucagucu

SEQ ID NO: 2409238 - RNA, 20 nt, Human
cuggaaaggcucagucucag

SEQ ID NO: 2409239 - RNA, 21 nt, Human
cuggaaaggcucagucucagg

SEQ ID NO: 2409240 - RNA, 22 nt, Human
cuggaaaggcucagucucagga

SEQ ID NO: 2409241 - RNA, 18 nt, Human
cuggacucucagucucug

SEQ ID NO: 2409242 - RNA, 19 nt, Human
cuggacucucagucucuga

SEQ ID NO: 2409243 - RNA, 20 nt, Human
cuggacucucagucucugag

SEQ ID NO: 2409244 - RNA, 21 nt, Human
cuggacucucagucucugagc

SEQ ID NO: 2409245 - RNA, 21 nt, Human
cuggagaaaauggacguguua

SEQ ID NO: 2409246 - RNA, 14 nt, Human
cuggacucucaguc

SEQ ID NO: 2409247 - RNA, 17 nt, Human
cuggacucucagucucu

SEQ ID NO: 2409248 - RNA, 23 nt, Human
cuggacuccucuguccaggcacu

SEQ ID NO: 2409249 - RNA, 22 nt, Human
cuggacuccucuguccaggcac

SEQ ID NO: 2409250 - RNA, 17 nt, Human
cuggaugcagccucaca

SEQ ID NO: 2409251 - RNA, 16 nt, Human
cuggaugcagccucac

SEQ ID NO: 2409252 - RNA, 20 nt, Human
cuggaucuccauucucucag

SEQ ID NO: 2409253 - RNA, 19 nt, Human
cuggauccuagccuuaucc

SEQ ID NO: 2409254 - RNA, 15 nt, Human
cuggauccugaaaua

SEQ ID NO: 2409255 - RNA, 19 nt, Human
cuggauccaucaggccacu

SEQ ID NO: 2409256 - RNA, 23 nt, Human
cuggauccuagccuuauccucug

SEQ ID NO: 2409257 - RNA, 15 nt, Human
cuggaugcagccuca

SEQ ID NO: 2409258 - RNA, 18 nt, Human
cuggaugcagccucacag

SEQ ID NO: 2409259 - RNA, 22 nt, Human
cuggcagaguugaagacagagc

SEQ ID NO: 2409260 - RNA, 23 nt, Human
cuggcagccccuguucuggcaga

SEQ ID NO: 2409261 - RNA, 13 nt, Human
cuggcagccgugc

SEQ ID NO: 2409262 - RNA, 21 nt, Human
cuggcagaguugaagacagag

SEQ ID NO: 2409263 - RNA, 20 nt, Human
cuggcagaguugaagacaga

SEQ ID NO: 2409264 - RNA, 15 nt, Human
cuggcucuuccaggc

SEQ ID NO: 2409265 - RNA, 14 nt, Human
cuggcucuuccagg

SEQ ID NO: 2409266 - RNA, 13 nt, Human
cuggcucuuccag

SEQ ID NO: 2409267 - RNA, 14 nt, Human
cuggcucccucuug

SEQ ID NO: 2409268 - RNA, 17 nt, Human
cugggacuacaggugug

SEQ ID NO: 2409269 - RNA, 21 nt, Human
cugggacuacaggcacccacc

SEQ ID NO: 2409270 - RNA, 17 nt, Human
cugggacuacaggcacc

SEQ ID NO: 2409271 - RNA, 18 nt, Human
cuggccggcaaccccagu

SEQ ID NO: 2409272 - RNA, 23 nt, Human
cuggccggagucagugccagguc

SEQ ID NO: 2409273 - RNA, 18 nt, Human
cuggccggagucagugcc

SEQ ID NO: 2409274 - RNA, 22 nt, Human
cuggccggagcaaacucugcug

SEQ ID NO: 2409275 - RNA, 21 nt, Human
cuggccggagcaaacucugcu

SEQ ID NO: 2409276 - RNA, 18 nt, Human
cuggcucccacaggcccu

SEQ ID NO: 2409277 - RNA, 19 nt, Human
cuggcucccacaggcccuu

SEQ ID NO: 2409278 - RNA, 22 nt, Human
cuggcucccacaggcccuuccu

SEQ ID NO: 2409279 - RNA, 19 nt, Human
cuggccgccucacccccuc

SEQ ID NO: 2409280 - RNA, 18 nt, Human
cuggccgccucacccccu

SEQ ID NO: 2409281 - RNA, 16 nt, Human
cuggccgccucacccc

SEQ ID NO: 2409282 - RNA, 14 nt, Human
cuggccgccucacc

SEQ ID NO: 2409283 - RNA, 18 nt, Human
cuggccgcgccaaauaau

SEQ ID NO: 2409284 - RNA, 22 nt, Human
cuggccgcccccugccccccag

SEQ ID NO: 2409285 - RNA, 14 nt, Human
cuggccgcccccug

SEQ ID NO: 2409286 - RNA, 13 nt, Human
cuggccgcccccu

SEQ ID NO: 2409287 - RNA, 16 nt, Human
cuggccgaguccaagc

SEQ ID NO: 2409288 - RNA, 17 nt, Human
cuggccgaguccaagcu

SEQ ID NO: 2409289 - RNA, 18 nt, Human
cuggccgaguccaagcug

SEQ ID NO: 2409290 - RNA, 20 nt, Human
cuggccgaguccaagcuggg

SEQ ID NO: 2409291 - RNA, 23 nt, Human
cuggccgaguccaagcugggaga

SEQ ID NO: 2409292 - RNA, 16 nt, Human
cuggcccucaguuucc

SEQ ID NO: 2409293 - RNA, 19 nt, Human
cuggcccucaccccugccc

SEQ ID NO: 2409294 - RNA, 21 nt, Human
cuggcccucaccccugcccug

SEQ ID NO: 2409295 - RNA, 22 nt, Human
cuggcccucaccccugcccugg

SEQ ID NO: 2409296 - RNA, 23 nt, Human
cuggcccucaccccugcccuggg

SEQ ID NO: 2409297 - RNA, 19 nt, Human
cuggcagcucagagagggu

SEQ ID NO: 2409298 - RNA, 17 nt, Human
cuggcagcucagagagg

SEQ ID NO: 2409299 - RNA, 16 nt, Human
cuggcagcucagagag

SEQ ID NO: 2409300 - RNA, 18 nt, Human
cuggcagccgugccuuca

SEQ ID NO: 2409301 - RNA, 17 nt, Human
cuggcagccgugccuuc

SEQ ID NO: 2409302 - RNA, 16 nt, Human
cuggcccucaaggccu

SEQ ID NO: 2409303 - RNA, 23 nt, Human
cuggcccuaugcuuccggccucc

SEQ ID NO: 2409304 - RNA, 21 nt, Human
cuggcccucaaggccucccac

SEQ ID NO: 2409305 - RNA, 19 nt, Human
cuggcccucaaggccuccc

SEQ ID NO: 2409306 - RNA, 18 nt, Human
cuggcccucaaggccucc

SEQ ID NO: 2409307 - RNA, 17 nt, Human
cuggcccucaaggccuc

SEQ ID NO: 2409308 - RNA, 23 nt, Human
cuggcccucaaggccucccacag

SEQ ID NO: 2409309 - RNA, 22 nt, Human
cuggcccucaaggccucccaca

SEQ ID NO: 2409310 - RNA, 24 nt, Human
cuggcccucaaggccucccacagu

SEQ ID NO: 2409311 - RNA, 17 nt, Human
cuggcccucaccccugc

SEQ ID NO: 2409312 - RNA, 23 nt, Human
cuggcccgugacagacuccugag

SEQ ID NO: 2409313 - RNA, 19 nt, Human
cuggcccgugacagacucc

SEQ ID NO: 2409314 - RNA, 18 nt, Human
cuggcccgugacagacuc

SEQ ID NO: 2409315 - RNA, 16 nt, Human
cuggcccgugacagac

SEQ ID NO: 2409316 - RNA, 21 nt, Human
cuggcccgucauguuccucaa

SEQ ID NO: 2409317 - RNA, 15 nt, Human
cuggcccgugacaga

SEQ ID NO: 2409318 - RNA, 22 nt, Human
cuggcccgucauguuccucaaa

SEQ ID NO: 2409319 - RNA, 12 nt, Human
cuggcagcucuc

SEQ ID NO: 2409320 - RNA, 12 nt, Human
cugccuccugcc

SEQ ID NO: 2409321 - RNA, 13 nt, Human
cugccuccugccu

SEQ ID NO: 2409322 - RNA, 14 nt, Human
cugccuccuuugug

SEQ ID NO: 2409323 - RNA, 17 nt, Human
cugccuccugccugccc

SEQ ID NO: 2409324 - RNA, 16 nt, Human
cugccuccugccugcc

SEQ ID NO: 2409325 - RNA, 15 nt, Human
cugccuccugccugc

SEQ ID NO: 2409326 - RNA, 19 nt, Human
cugccuccugccugccccu

SEQ ID NO: 2409327 - RNA, 21 nt, Human
cugccuccuuugugaggaagc

SEQ ID NO: 2409328 - RNA, 17 nt, Human
cugccuccuuugugagg

SEQ ID NO: 2409329 - RNA, 23 nt, Human
cugccuccuuugugaggaagccg

SEQ ID NO: 2409330 - RNA, 14 nt, Human
cugccucgaacugg

SEQ ID NO: 2409331 - RNA, 13 nt, Human
cugccugucuguc

SEQ ID NO: 2409332 - RNA, 19 nt, Human
cugccugucccucucaggc

SEQ ID NO: 2409333 - RNA, 20 nt, Human
cugccugucccucucaggca

SEQ ID NO: 2409334 - RNA, 23 nt, Human
cugccugucccucucaggcaugc

SEQ ID NO: 2409335 - RNA, 12 nt, Human
cugccugucucc

SEQ ID NO: 2409336 - RNA, 16 nt, Human
cugccugucccucuca

SEQ ID NO: 2409337 - RNA, 18 nt, Human
cugccugucccucucagg

SEQ ID NO: 2409338 - RNA, 22 nt, Human
cugccuguaguuaggaaauaaa

SEQ ID NO: 2409339 - RNA, 17 nt, Human
cugccuguaguuaggaa

SEQ ID NO: 2409340 - RNA, 16 nt, Human
cugccuguaguuagga

SEQ ID NO: 2409341 - RNA, 18 nt, Human
cugccuguaguuaggaaa

SEQ ID NO: 2409342 - RNA, 19 nt, Human
cugccuguaguuaggaaau

SEQ ID NO: 2409343 - RNA, 20 nt, Human
cugccuguaguuaggaaaua

SEQ ID NO: 2409344 - RNA, 21 nt, Human
cugccuguaguuaggaaauaa

SEQ ID NO: 2409345 - RNA, 20 nt, Human
cugccucgaacuggcugcaa

SEQ ID NO: 2409346 - RNA, 15 nt, Human
cugccucgaaacaca

SEQ ID NO: 2409347 - RNA, 18 nt, Human
cugccucgaaacacagaa

SEQ ID NO: 2409348 - RNA, 19 nt, Human
cugccucgaacuggcugca

SEQ ID NO: 2409349 - RNA, 19 nt, Human
cugccucgaaacacagaaa

SEQ ID NO: 2409350 - RNA, 17 nt, Human
cugccucgggaaccuca

SEQ ID NO: 2409351 - RNA, 22 nt, Human
cugccucucaucaacugaauga

SEQ ID NO: 2409352 - RNA, 18 nt, Human
cugcugagggaccagcca

SEQ ID NO: 2409353 - RNA, 17 nt, Human
cugcugagggaccagcc

SEQ ID NO: 2409354 - RNA, 15 nt, Human
cugcugagagaccca

SEQ ID NO: 2409355 - RNA, 16 nt, Human
cugcugagagacccaa

SEQ ID NO: 2409356 - RNA, 21 nt, Human
cugcugagagacccaaggagg

SEQ ID NO: 2409357 - RNA, 22 nt, Human
cugcugagagacccaaggagga

SEQ ID NO: 2409358 - RNA, 23 nt, Human
cugcucaagaagacauggagacu

SEQ ID NO: 2409359 - RNA, 20 nt, Human
cugcucaagaagacauggag

SEQ ID NO: 2409360 - RNA, 17 nt, Human
cugcuaucaaagagguu

SEQ ID NO: 2409361 - RNA, 16 nt, Human
cugcuauccugccaaa

SEQ ID NO: 2409362 - RNA, 18 nt, Human
cugcugaaggcucgagca

SEQ ID NO: 2409363 - RNA, 23 nt, Human
cugcugaaggcucgagcaugccu

SEQ ID NO: 2409364 - RNA, 24 nt, Human
cugcugaaggcucgagcaugccug

SEQ ID NO: 2409365 - RNA, 15 nt, Human
cugcugaauuuucac

SEQ ID NO: 2409366 - RNA, 14 nt, Human
cugcugaauuuuca

SEQ ID NO: 2409367 - RNA, 17 nt, Human
cugcugaauuuucacau

SEQ ID NO: 2409368 - RNA, 15 nt, Human
cugcucaauacaucu

SEQ ID NO: 2409369 - RNA, 16 nt, Human
cugcugaauaauaaac

SEQ ID NO: 2409370 - RNA, 22 nt, Human
cugcugaaugauuuccaaagag

SEQ ID NO: 2409371 - RNA, 23 nt, Human
cugcugaaugauuuccaaagaga

SEQ ID NO: 2409372 - RNA, 15 nt, Human
cugccugucugucuc

SEQ ID NO: 2409373 - RNA, 19 nt, Human
cugccuguucccauucuug

SEQ ID NO: 2409374 - RNA, 15 nt, Human
cugccuguucccauu

SEQ ID NO: 2409375 - RNA, 15 nt, Human
cugccugucugaagc

SEQ ID NO: 2409376 - RNA, 13 nt, Human
cugccugucuccu

SEQ ID NO: 2409377 - RNA, 23 nt, Human
cugccuguucagcuccagcucac

SEQ ID NO: 2409378 - RNA, 20 nt, Human
cugccuguucagcuccagcu

SEQ ID NO: 2409379 - RNA, 17 nt, Human
cugcuacuggcaaaagg

SEQ ID NO: 2409380 - RNA, 18 nt, Human
cugcuacuguaauuuuau

SEQ ID NO: 2409381 - RNA, 14 nt, Human
cugcuagcacuugg

SEQ ID NO: 2409382 - RNA, 21 nt, Human
cugcuagcacuuggagccaag

SEQ ID NO: 2409383 - RNA, 16 nt, Human
cugcuagagccagcaa

SEQ ID NO: 2409384 - RNA, 18 nt, Human
cugcuaccucacuggggu

SEQ ID NO: 2409385 - RNA, 20 nt, Human
cugcuacguuccuauuguca

SEQ ID NO: 2409386 - RNA, 21 nt, Human
cugcuacguuccuauugucau

SEQ ID NO: 2409387 - RNA, 17 nt, Human
cugcuacucuguuccuu

SEQ ID NO: 2409388 - RNA, 18 nt, Human
cugcuacucuguuccuuc

SEQ ID NO: 2409389 - RNA, 22 nt, Human
cugcuacucuguuccuucacau

SEQ ID NO: 2409390 - RNA, 14 nt, Human
cugcccccugcugg

SEQ ID NO: 2409391 - RNA, 20 nt, Human
cugcccccugaaacuuauuu

SEQ ID NO: 2409392 - RNA, 18 nt, Human
cugcccccugaaacuuau

SEQ ID NO: 2409393 - RNA, 17 nt, Human
cugcccccugaaacuua

SEQ ID NO: 2409394 - RNA, 16 nt, Human
cugcccccugaaacuu

SEQ ID NO: 2409395 - RNA, 19 nt, Human
cugcccccugcuggcucuu

SEQ ID NO: 2409396 - RNA, 17 nt, Human
cugcccccugcuggcuc

SEQ ID NO: 2409397 - RNA, 15 nt, Human
cugcccccugcuggc

SEQ ID NO: 2409398 - RNA, 12 nt, Human
cugcccccuggu

SEQ ID NO: 2409399 - RNA, 13 nt, Human
cugcccccuggug

SEQ ID NO: 2409400 - RNA, 14 nt, Human
cugcccccuggugg

SEQ ID NO: 2409401 - RNA, 22 nt, Human
cugcccccugguggacaguccu

SEQ ID NO: 2409402 - RNA, 14 nt, Human
cugcccccuucucc

SEQ ID NO: 2409403 - RNA, 16 nt, Human
cugcccccuucuccca

SEQ ID NO: 2409404 - RNA, 17 nt, Human
cugcccccuucucccac

SEQ ID NO: 2409405 - RNA, 18 nt, Human
cugcccccuucucccaca

SEQ ID NO: 2409406 - RNA, 15 nt, Human
cugcccuggugcugc

SEQ ID NO: 2409407 - RNA, 23 nt, Human
cugcccugguccagggaagcugg

SEQ ID NO: 2409408 - RNA, 14 nt, Human
cugcccuggugcug

SEQ ID NO: 2409409 - RNA, 13 nt, Human
cugcccuggugcu

SEQ ID NO: 2409410 - RNA, 12 nt, Human
cugcccuggugc

SEQ ID NO: 2409411 - RNA, 20 nt, Human
cugcccugguccagggaagc

SEQ ID NO: 2409412 - RNA, 21 nt, Human
cugcccugguccagggaagcu

SEQ ID NO: 2409413 - RNA, 19 nt, Human
cugcccccuucucccacac

SEQ ID NO: 2409414 - RNA, 20 nt, Human
cugcccccuucucccacacu

SEQ ID NO: 2409415 - RNA, 24 nt, Human
cugcccugggauguccacagaugc

SEQ ID NO: 2409416 - RNA, 14 nt, Human
cugcccugguccag

SEQ ID NO: 2409417 - RNA, 15 nt, Human
cugcccugguccagg

SEQ ID NO: 2409418 - RNA, 24 nt, Human
cugcccugugaguacuacaguccu

SEQ ID NO: 2409419 - RNA, 21 nt, Human
cugcccugguuuccugcccug

SEQ ID NO: 2409420 - RNA, 18 nt, Human
cugcccugguuuccugcc

SEQ ID NO: 2409421 - RNA, 19 nt, Human
cugcccugguuuccugccc

SEQ ID NO: 2409422 - RNA, 17 nt, Human
cugcccugguuuccugc

SEQ ID NO: 2409423 - RNA, 23 nt, Human
cugcccuggugcugccacacuuc

SEQ ID NO: 2409424 - RNA, 19 nt, Human
cugcccuuaccugccagga

SEQ ID NO: 2409425 - RNA, 20 nt, Human
cugcccugguuuccugcccu

SEQ ID NO: 2409426 - RNA, 12 nt, Human
cugcccuguggg

SEQ ID NO: 2409427 - RNA, 11 nt, Human
cugcccugugg

SEQ ID NO: 2409428 - RNA, 23 nt, Human
cugcccuuaccugccaggaagcc

SEQ ID NO: 2409429 - RNA, 22 nt, Human
cugcccuuaccugccaggaagc

SEQ ID NO: 2409430 - RNA, 17 nt, Human
cugcccuucaccccagu

SEQ ID NO: 2409431 - RNA, 16 nt, Human
cugcccuucaccccag

SEQ ID NO: 2409432 - RNA, 21 nt, Human
cugcccuucaccccaguggcc

SEQ ID NO: 2409433 - RNA, 12 nt, Human
cuguucagcugg

SEQ ID NO: 2409434 - RNA, 22 nt, Human
cuguucagcuccagcucaccag

SEQ ID NO: 2409435 - RNA, 19 nt, Human
cuguucagcuccagcucac

SEQ ID NO: 2409436 - RNA, 18 nt, Human
cuguucagcuccagcuca

SEQ ID NO: 2409437 - RNA, 16 nt, Human
cuguucagcuccagcu

SEQ ID NO: 2409438 - RNA, 19 nt, Human
cuguuaugcugugacacau

SEQ ID NO: 2409439 - RNA, 12 nt, Human
cuguucacagcc

SEQ ID NO: 2409440 - RNA, 19 nt, Human
cuguucacagccagacugg

SEQ ID NO: 2409441 - RNA, 22 nt, Human
cuguuauauaaaugguuaaaag

SEQ ID NO: 2409442 - RNA, 19 nt, Human
cuguuaucaaaacuuucuu

SEQ ID NO: 2409443 - RNA, 19 nt, Human
cuguuaucccugccugguc

SEQ ID NO: 2409444 - RNA, 13 nt, Human
cuguucacucuac

SEQ ID NO: 2409445 - RNA, 15 nt, Human
cuguucagcuccagc

SEQ ID NO: 2409446 - RNA, 22 nt, Human
cuguucacagccagacuggcac

SEQ ID NO: 2409447 - RNA, 12 nt, Human
cuguucacccac

SEQ ID NO: 2409448 - RNA, 14 nt, Human
cuguucacccacag

SEQ ID NO: 2409449 - RNA, 18 nt, Human
cuguucacccacagggcu

SEQ ID NO: 2409450 - RNA, 14 nt, Human
cuguuaugcuguga

SEQ ID NO: 2409451 - RNA, 13 nt, Human
cuguuauccaugg

SEQ ID NO: 2409452 - RNA, 19 nt, Human
cugugcucuggacaggcau

SEQ ID NO: 2409453 - RNA, 18 nt, Human
cugugcucuggacaggca

SEQ ID NO: 2409454 - RNA, 14 nt, Human
cugugagcccagcu

SEQ ID NO: 2409455 - RNA, 19 nt, Human
cugugagcaucacaguuuu

SEQ ID NO: 2409456 - RNA, 21 nt, Human
cugugagauuuugcuuuucca

SEQ ID NO: 2409457 - RNA, 19 nt, Human
cuguguauuccaagacaug

SEQ ID NO: 2409458 - RNA, 15 nt, Human
cuguguauuccaaga

SEQ ID NO: 2409459 - RNA, 16 nt, Human
cuguguauucauugaa

SEQ ID NO: 2409460 - RNA, 15 nt, Human
cuguguauuugcuuu

SEQ ID NO: 2409461 - RNA, 14 nt, Human
cuguguauuugcuu

SEQ ID NO: 2409462 - RNA, 16 nt, Human
cuguguauuugcuuuu

SEQ ID NO: 2409463 - RNA, 22 nt, Human
cugugucagguggggcagcuug

SEQ ID NO: 2409464 - RNA, 21 nt, Human
cuguguccaugcgcucagggc

SEQ ID NO: 2409465 - RNA, 19 nt, Human
cuguguccaugcgcucagg

SEQ ID NO: 2409466 - RNA, 18 nt, Human
cuguguccaugcgcucag

SEQ ID NO: 2409467 - RNA, 13 nt, Human
cuguguccaugcg

SEQ ID NO: 2409468 - RNA, 13 nt, Human
cuguguagcuggg

SEQ ID NO: 2409469 - RNA, 17 nt, Human
cugugucccaugaccca

SEQ ID NO: 2409470 - RNA, 15 nt, Human
cugugucccaugacc

SEQ ID NO: 2409471 - RNA, 13 nt, Human
cugugucccauga

SEQ ID NO: 2409472 - RNA, 23 nt, Human
cuguguccaugcgcucagggcca

SEQ ID NO: 2409473 - RNA, 22 nt, Human
cuguguccaugcgcucagggcc

SEQ ID NO: 2409474 - RNA, 17 nt, Human
cuguuacugucuucagu

SEQ ID NO: 2409475 - RNA, 14 nt, Human
cuguuauauaaaug

SEQ ID NO: 2409476 - RNA, 15 nt, Human
cuguuauauaaaugg

SEQ ID NO: 2409477 - RNA, 13 nt, Human
cuguuauauaaau

SEQ ID NO: 2409478 - RNA, 15 nt, Human
cuguuagcagacagg

SEQ ID NO: 2409479 - RNA, 17 nt, Human
cuguuagccauguggcu

SEQ ID NO: 2409480 - RNA, 15 nt, Human
cuguuagcuguuauu

SEQ ID NO: 2409481 - RNA, 16 nt, Human
cuguuagcuguuauuu

SEQ ID NO: 2409482 - RNA, 21 nt, Human
cuguuacuugaaauaccagug

SEQ ID NO: 2409483 - RNA, 18 nt, Human
cuguuacuugaaauacca

SEQ ID NO: 2409484 - RNA, 19 nt, Human
cuguuacuuaccuaaacag

SEQ ID NO: 2409485 - RNA, 15 nt, Human
cuguuacuuaccuaa

SEQ ID NO: 2409486 - RNA, 13 nt, Human
cuguuagcagaca

SEQ ID NO: 2409487 - RNA, 23 nt, Human
cugugaaguuuacauuguaaaua

SEQ ID NO: 2409488 - RNA, 18 nt, Human
cugugaaguuuacauugu

SEQ ID NO: 2409489 - RNA, 13 nt, Human
cugugaacugaac

SEQ ID NO: 2409490 - RNA, 15 nt, Human
cugugaacugaacuc

SEQ ID NO: 2409491 - RNA, 16 nt, Human
cugugaacugaacucu

SEQ ID NO: 2409492 - RNA, 18 nt, Human
cugugaacgauuuagaaa

SEQ ID NO: 2409493 - RNA, 15 nt, Human
cugugcucuggacag

SEQ ID NO: 2409494 - RNA, 17 nt, Human
cugugcucuggacaggc

SEQ ID NO: 2409495 - RNA, 23 nt, Human
cugugagaugcuagaacucccuu

SEQ ID NO: 2409496 - RNA, 13 nt, Human
cugugagauuuug

SEQ ID NO: 2409497 - RNA, 17 nt, Human
cugugacaggcagcaga

SEQ ID NO: 2409498 - RNA, 16 nt, Human
cugugacaggcagcag

SEQ ID NO: 2409499 - RNA, 16 nt, Human
cugugagcaucacagu

SEQ ID NO: 2409500 - RNA, 15 nt, Human
cugugagcaagaagu

SEQ ID NO: 2409501 - RNA, 21 nt, Human
cugugaaugccacugccuucg

SEQ ID NO: 2409502 - RNA, 20 nt, Human
cugugaaugccacugccuuc

SEQ ID NO: 2409503 - RNA, 14 nt, Human
cugugaauucagau

SEQ ID NO: 2409504 - RNA, 15 nt, Human
cugugaauucagauu

SEQ ID NO: 2409505 - RNA, 16 nt, Human
cugugaaugccacugc

SEQ ID NO: 2409506 - RNA, 15 nt, Human
cugugaaugccacug

SEQ ID NO: 2409507 - RNA, 18 nt, Human
cugugaaucaccuagggg

SEQ ID NO: 2409508 - RNA, 22 nt, Human
cugugaacgauuuagaaagaag

SEQ ID NO: 2409509 - RNA, 18 nt, Human
cugugacaggcagcagag

SEQ ID NO: 2409510 - RNA, 21 nt, Human
cugugagaugcuagaacuccc

SEQ ID NO: 2409511 - RNA, 15 nt, Human
cugugacaggcagca

SEQ ID NO: 2409512 - RNA, 19 nt, Human
cugugaauuuguguaagga

SEQ ID NO: 2409513 - RNA, 15 nt, Human
cuguuguccuccccu

SEQ ID NO: 2409514 - RNA, 14 nt, Human
cuguuguccucccc

SEQ ID NO: 2409515 - RNA, 20 nt, Human
cuguuguccuccccuugggc

SEQ ID NO: 2409516 - RNA, 19 nt, Human
cuguugugaccugaaguuc

SEQ ID NO: 2409517 - RNA, 21 nt, Human
cuguuguguauagaugcaaga

SEQ ID NO: 2409518 - RNA, 20 nt, Human
cuguugugaccugaaguuca

SEQ ID NO: 2409519 - RNA, 22 nt, Human
cuguuguguacguggagaggga

SEQ ID NO: 2409520 - RNA, 15 nt, Human
cuguuggccagugug

SEQ ID NO: 2409521 - RNA, 15 nt, Human
cuguugucauugcug

SEQ ID NO: 2409522 - RNA, 22 nt, Human
cuguuggcagugagugagccug

SEQ ID NO: 2409523 - RNA, 21 nt, Human
cuguuggcagugagugagccu

SEQ ID NO: 2409524 - RNA, 14 nt, Human
cuguuggcagugag

SEQ ID NO: 2409525 - RNA, 16 nt, Human
cuguuguccuauggga

SEQ ID NO: 2409526 - RNA, 17 nt, Human
cuguugucauugcuguu

SEQ ID NO: 2409527 - RNA, 17 nt, Human
cuguugucccucugcua

SEQ ID NO: 2409528 - RNA, 22 nt, Human
cuguugcucaaaucuauucaga

SEQ ID NO: 2409529 - RNA, 21 nt, Human
cuguugcucaaaucuauucag

SEQ ID NO: 2409530 - RNA, 15 nt, Human
cuguugcugaauagg

SEQ ID NO: 2409531 - RNA, 16 nt, Human
cuguugcugaauaggc

SEQ ID NO: 2409532 - RNA, 23 nt, Human
cuguuggcacucacagaccugga

SEQ ID NO: 2409533 - RNA, 22 nt, Human
cuguuggcacucacagaccugg

SEQ ID NO: 2409534 - RNA, 21 nt, Human
cuguuggcacucacagaccug

SEQ ID NO: 2409535 - RNA, 18 nt, Human
cuguuggcacucacagac

SEQ ID NO: 2409536 - RNA, 19 nt, Human
cuguuggcaggcuggccag

SEQ ID NO: 2409537 - RNA, 18 nt, Human
cuguuggcaggcuggcca

SEQ ID NO: 2409538 - RNA, 16 nt, Human
cuguuggcaggcuggc

SEQ ID NO: 2409539 - RNA, 15 nt, Human
cuguuggcaggcugg

SEQ ID NO: 2409540 - RNA, 12 nt, Human
cuguuggccagu

SEQ ID NO: 2409541 - RNA, 11 nt, Human
cuguugcucaa

SEQ ID NO: 2409542 - RNA, 18 nt, Human
cuguugcguaacuggcug

SEQ ID NO: 2409543 - RNA, 23 nt, Human
cuguugcuaagccccagcaagca

SEQ ID NO: 2409544 - RNA, 22 nt, Human
cuguugcuaagccccagcaagc

SEQ ID NO: 2409545 - RNA, 21 nt, Human
cuguugcuaagccccagcaag

SEQ ID NO: 2409546 - RNA, 23 nt, Human
cuguugcguaacuggcuguguuc

SEQ ID NO: 2409547 - RNA, 12 nt, Human
cuguugcuaagc

SEQ ID NO: 2409548 - RNA, 12 nt, Human
cuguugccucau

SEQ ID NO: 2409549 - RNA, 14 nt, Human
cuguugccucaucu

SEQ ID NO: 2409550 - RNA, 18 nt, Human
cuguugcccaggcuggcg

SEQ ID NO: 2409551 - RNA, 19 nt, Human
cuuaaaauaacuuauauca

SEQ ID NO: 2409552 - RNA, 13 nt, Human
cuuaaaauaacuu

SEQ ID NO: 2409553 - RNA, 17 nt, Human
cuguuguuguuaaugaa

SEQ ID NO: 2409554 - RNA, 22 nt, Human
cuguuguuguuaaugaaaaugu

SEQ ID NO: 2409555 - RNA, 14 nt, Human
cuuaaaaccaaaga

SEQ ID NO: 2409556 - RNA, 21 nt, Human
cuuaaaaccaaagagggcuuc

SEQ ID NO: 2409557 - RNA, 15 nt, Human
cuuaaaaccaaagag

SEQ ID NO: 2409558 - RNA, 13 nt, Human
cuuaaaaaugguu

SEQ ID NO: 2409559 - RNA, 20 nt, Human
cuuaaaaaugguuuaaaugg

SEQ ID NO: 2409560 - RNA, 12 nt, Human
cuuaaaaauggu

SEQ ID NO: 2409561 - RNA, 13 nt, Human
cuguuguuguuaa

SEQ ID NO: 2409562 - RNA, 17 nt, Human
cuguuguuauggaaacu

SEQ ID NO: 2409563 - RNA, 13 nt, Human
cuuaaauaaugug

SEQ ID NO: 2409564 - RNA, 14 nt, Human
cuuaaauaauguga

SEQ ID NO: 2409565 - RNA, 16 nt, Human
cuuaaauaaugugaaa

SEQ ID NO: 2409566 - RNA, 19 nt, Human
cuuaaauaaugugaaacug

SEQ ID NO: 2409567 - RNA, 23 nt, Human
cuuaaaccuucaguuaugauuuu

SEQ ID NO: 2409568 - RNA, 15 nt, Human
cuuaaaccuucaguu

SEQ ID NO: 2409569 - RNA, 14 nt, Human
cuuaaaccugggag

SEQ ID NO: 2409570 - RNA, 21 nt, Human
cuuaaagaaagucgaauuaau

SEQ ID NO: 2409571 - RNA, 12 nt, Human
cuuaaagaaagu

SEQ ID NO: 2409572 - RNA, 18 nt, Human
cuuaaagaaaacccaccc

SEQ ID NO: 2409573 - RNA, 14 nt, Human
cuuaaacugugugg

SEQ ID NO: 2409574 - RNA, 15 nt, Human
cuuaaacugugugga

SEQ ID NO: 2409575 - RNA, 23 nt, Human
cuuaaacuguguggacugugaug

SEQ ID NO: 2409576 - RNA, 18 nt, Human
cuuaaaauagaaauaagu

SEQ ID NO: 2409577 - RNA, 22 nt, Human
cuuaaaauagcaacacucuaua

SEQ ID NO: 2409578 - RNA, 13 nt, Human
cuuaaaauagaaa

SEQ ID NO: 2409579 - RNA, 22 nt, Human
cuuaaacagggcaucuccagga

SEQ ID NO: 2409580 - RNA, 14 nt, Human
cuuaaacagggcau

SEQ ID NO: 2409581 - RNA, 14 nt, Human
cuuaaacaaaugua

SEQ ID NO: 2409582 - RNA, 23 nt, Human
cuggugaccccuuuucagcuucu

SEQ ID NO: 2409583 - RNA, 14 nt, Human
cuggucuguaggga

SEQ ID NO: 2409584 - RNA, 16 nt, Human
cuggucugggugcccc

SEQ ID NO: 2409585 - RNA, 22 nt, Human
cuggucuguagaagagggauaa

SEQ ID NO: 2409586 - RNA, 22 nt, Human
cuggugacaugucuuuucuugc

SEQ ID NO: 2409587 - RNA, 22 nt, Human
cuggugaccuuccaagagccug

SEQ ID NO: 2409588 - RNA, 23 nt, Human
cuggugaccuuccaagagccuga

SEQ ID NO: 2409589 - RNA, 21 nt, Human
cuggucucgaacuccugaccu

SEQ ID NO: 2409590 - RNA, 18 nt, Human
cuggucucuaggcugggg

SEQ ID NO: 2409591 - RNA, 17 nt, Human
cuggucucuaggcuggg

SEQ ID NO: 2409592 - RNA, 14 nt, Human
cuggucucuccuug

SEQ ID NO: 2409593 - RNA, 16 nt, Human
cuggucucuaggcugg

SEQ ID NO: 2409594 - RNA, 14 nt, Human
cuggucucuaggcu

SEQ ID NO: 2409595 - RNA, 18 nt, Human
cuggucuuauuuguaaag

SEQ ID NO: 2409596 - RNA, 20 nt, Human
cuggucucuaggcuggggaa

SEQ ID NO: 2409597 - RNA, 12 nt, Human
cuggucucuggu

SEQ ID NO: 2409598 - RNA, 12 nt, Human
cuggucugaggg

SEQ ID NO: 2409599 - RNA, 20 nt, Human
cugguuuuguaagaugcugg

SEQ ID NO: 2409600 - RNA, 19 nt, Human
cugguuuuguaagaugcug

SEQ ID NO: 2409601 - RNA, 15 nt, Human
cugguuuuguaagau

SEQ ID NO: 2409602 - RNA, 13 nt, Human
cugguuuuguaag

SEQ ID NO: 2409603 - RNA, 14 nt, Human
cugguuuugcuauu

SEQ ID NO: 2409604 - RNA, 13 nt, Human
cugguuuugcuau

SEQ ID NO: 2409605 - RNA, 20 nt, Human
cugguuuucuggaugguucc

SEQ ID NO: 2409606 - RNA, 13 nt, Human
cugguuuuaacaa

SEQ ID NO: 2409607 - RNA, 18 nt, Human
cugguuuuccuaaaugca

SEQ ID NO: 2409608 - RNA, 15 nt, Human
cugguuuuuguagcc

SEQ ID NO: 2409609 - RNA, 20 nt, Human
cugguuuuuaaccauugucu

SEQ ID NO: 2409610 - RNA, 22 nt, Human
cugguuuuguaagaugcugggu

SEQ ID NO: 2409611 - RNA, 21 nt, Human
cugguuuuguaagaugcuggg

SEQ ID NO: 2409612 - RNA, 16 nt, Human
cugguuuuucaguuuu

SEQ ID NO: 2409613 - RNA, 15 nt, Human
cugguuuuucaguuu

SEQ ID NO: 2409614 - RNA, 14 nt, Human
cugguuuuucaguu

SEQ ID NO: 2409615 - RNA, 20 nt, Human
cuguacuugcucuugaugcc

SEQ ID NO: 2409616 - RNA, 19 nt, Human
cuguacuugcucuugaugc

SEQ ID NO: 2409617 - RNA, 16 nt, Human
cuguacuugcucuuga

SEQ ID NO: 2409618 - RNA, 17 nt, Human
cuguacuucacugucag

SEQ ID NO: 2409619 - RNA, 14 nt, Human
cuguacuucacugu

SEQ ID NO: 2409620 - RNA, 20 nt, Human
cuguacuucaaguuaaagug

SEQ ID NO: 2409621 - RNA, 22 nt, Human
cuguacuucacugucaggaaga

SEQ ID NO: 2409622 - RNA, 17 nt, Human
cuguacuugaugacaga

SEQ ID NO: 2409623 - RNA, 13 nt, Human
cuguagauucugu

SEQ ID NO: 2409624 - RNA, 20 nt, Human
cuguagauucuguggaacaa

SEQ ID NO: 2409625 - RNA, 15 nt, Human
cuguagauucugugg

SEQ ID NO: 2409626 - RNA, 16 nt, Human
cuguagcacuuacugg

SEQ ID NO: 2409627 - RNA, 12 nt, Human
cuguagcaucuu

SEQ ID NO: 2409628 - RNA, 21 nt, Human
cuguagcagugagaaaaagcu

SEQ ID NO: 2409629 - RNA, 20 nt, Human
cuguagcagugagaaaaagc

SEQ ID NO: 2409630 - RNA, 15 nt, Human
cuguagagugggagc

SEQ ID NO: 2409631 - RNA, 21 nt, Human
cuguaacacagcugagagacu

SEQ ID NO: 2409632 - RNA, 15 nt, Human
cuguaacacagcuga

SEQ ID NO: 2409633 - RNA, 22 nt, Human
cuguaacacaagccacagaagc

SEQ ID NO: 2409634 - RNA, 21 nt, Human
cuguaacacaagccacagaag

SEQ ID NO: 2409635 - RNA, 20 nt, Human
cuguaagaaaauaucacuug

SEQ ID NO: 2409636 - RNA, 21 nt, Human
cuguaagacucauucccuaga

SEQ ID NO: 2409637 - RNA, 23 nt, Human
cuguaagaagagacugggaagau

SEQ ID NO: 2409638 - RNA, 17 nt, Human
cuguaagaagagacugg

SEQ ID NO: 2409639 - RNA, 20 nt, Human
cuguaagaagagacugggaa

SEQ ID NO: 2409640 - RNA, 22 nt, Human
cuguaagaagagacugggaaga

SEQ ID NO: 2409641 - RNA, 19 nt, Human
cuguaaaaaaaaaaaaguu

SEQ ID NO: 2409642 - RNA, 21 nt, Human
cuguaaaaagagagaaaacuu

SEQ ID NO: 2409643 - RNA, 23 nt, Human
cuguaaagagaccuaccucaggu

SEQ ID NO: 2409644 - RNA, 15 nt, Human
cuguaaaaacugugg

SEQ ID NO: 2409645 - RNA, 17 nt, Human
cuguaaaugguguacau

SEQ ID NO: 2409646 - RNA, 21 nt, Human
cuguaaaugguguacauaaug

SEQ ID NO: 2409647 - RNA, 18 nt, Human
cuguaaaugguguacaua

SEQ ID NO: 2409648 - RNA, 20 nt, Human
cuguaacacaagccacagaa

SEQ ID NO: 2409649 - RNA, 19 nt, Human
cuguaacacaagccacaga

SEQ ID NO: 2409650 - RNA, 18 nt, Human
cuguaacacaagccacag

SEQ ID NO: 2409651 - RNA, 17 nt, Human
cuguaacacaagccaca

SEQ ID NO: 2409652 - RNA, 23 nt, Human
cuguaaaugguguacauaaugua

SEQ ID NO: 2409653 - RNA, 16 nt, Human
cugucaggagagcagc

SEQ ID NO: 2409654 - RNA, 18 nt, Human
cugucaggaagaaaucac

SEQ ID NO: 2409655 - RNA, 17 nt, Human
cugucaggaagaaauca

SEQ ID NO: 2409656 - RNA, 14 nt, Human
cugucaggaagaaa

SEQ ID NO: 2409657 - RNA, 13 nt, Human
cugucaggaagaa

SEQ ID NO: 2409658 - RNA, 13 nt, Human
cugucagucacag

SEQ ID NO: 2409659 - RNA, 14 nt, Human
cugucagucacagc

SEQ ID NO: 2409660 - RNA, 15 nt, Human
cugucagucacagcc

SEQ ID NO: 2409661 - RNA, 17 nt, Human
cugucagucacagccac

SEQ ID NO: 2409662 - RNA, 16 nt, Human
cugucaguaugacauu

SEQ ID NO: 2409663 - RNA, 18 nt, Human
cuguagcuuguucccugu

SEQ ID NO: 2409664 - RNA, 13 nt, Human
cuguagccuucug

SEQ ID NO: 2409665 - RNA, 20 nt, Human
cuguagcccacucugcucgc

SEQ ID NO: 2409666 - RNA, 21 nt, Human
cuguagcccacucugcucgcc

SEQ ID NO: 2409667 - RNA, 16 nt, Human
cuguagcccacucugc

SEQ ID NO: 2409668 - RNA, 18 nt, Human
cuguagcauuacaguggg

SEQ ID NO: 2409669 - RNA, 18 nt, Human
cuguagcaucuucuggag

SEQ ID NO: 2409670 - RNA, 17 nt, Human
cuguagcaucuucugga

SEQ ID NO: 2409671 - RNA, 16 nt, Human
cuguagcaucuucugg

SEQ ID NO: 2409672 - RNA, 15 nt, Human
cuguagcaucuucug

SEQ ID NO: 2409673 - RNA, 20 nt, Human
cuguagcaucuucuggaguc

SEQ ID NO: 2409674 - RNA, 19 nt, Human
cuguagcaucuucuggagu

SEQ ID NO: 2409675 - RNA, 17 nt, Human
cuguagcauuacagugg

SEQ ID NO: 2409676 - RNA, 23 nt, Human
cugucauucccaccacccugagg

SEQ ID NO: 2409677 - RNA, 20 nt, Human
cuguccugggagugagcugg

SEQ ID NO: 2409678 - RNA, 14 nt, Human
cuguccugggagug

SEQ ID NO: 2409679 - RNA, 13 nt, Human
cuguccugggagu

SEQ ID NO: 2409680 - RNA, 17 nt, Human
cugucaugccccccuca

SEQ ID NO: 2409681 - RNA, 13 nt, Human
cugucaugccccc

SEQ ID NO: 2409682 - RNA, 20 nt, Human
cugucaugaacauguuccug

SEQ ID NO: 2409683 - RNA, 19 nt, Human
cugucaugaacauguuccu

SEQ ID NO: 2409684 - RNA, 16 nt, Human
cugucauucagaaaaa

SEQ ID NO: 2409685 - RNA, 18 nt, Human
cugucaugccccccucaa

SEQ ID NO: 2409686 - RNA, 14 nt, Human
cugucauuugagca

SEQ ID NO: 2409687 - RNA, 21 nt, Human
cugucaucugugcacugccca

SEQ ID NO: 2409688 - RNA, 15 nt, Human
cugucaugaacaugu

SEQ ID NO: 2409689 - RNA, 14 nt, Human
cugucagugccgcc

SEQ ID NO: 2409690 - RNA, 15 nt, Human
cugucaucugugcac

SEQ ID NO: 2409691 - RNA, 14 nt, Human
cugucaucugugca

SEQ ID NO: 2409692 - RNA, 18 nt, Human
cugucagugcagcccgug

SEQ ID NO: 2409693 - RNA, 19 nt, Human
cugucagugcagcccgugu

SEQ ID NO: 2409694 - RNA, 18 nt, Human
cugucagucacagccacc

SEQ ID NO: 2409695 - RNA, 15 nt, Human
cugucagugcagccc

SEQ ID NO: 2409696 - RNA, 17 nt, Human
cuguccuucagauggaa

SEQ ID NO: 2409697 - RNA, 16 nt, Human
cuguccuugcacacuc

SEQ ID NO: 2409698 - RNA, 23 nt, Human
cuguccuucucucaccuccuaaa

SEQ ID NO: 2409699 - RNA, 20 nt, Human
cuguccuucucucaccuccu

SEQ ID NO: 2409700 - RNA, 18 nt, Human
cuguccuguguagugauu

SEQ ID NO: 2409701 - RNA, 12 nt, Human
cuguccuuaccc

SEQ ID NO: 2409702 - RNA, 17 nt, Human
cuguccuuacccaucug

SEQ ID NO: 2409703 - RNA, 19 nt, Human
cuguccuuacccaucugca

SEQ ID NO: 2409704 - RNA, 16 nt, Human
cuguccuucagaugga

SEQ ID NO: 2409705 - RNA, 14 nt, Human
cuguccuucagaug

SEQ ID NO: 2409706 - RNA, 15 nt, Human
cuguccuucucucac

SEQ ID NO: 2409707 - RNA, 13 nt, Human
cugucuaacugcu

SEQ ID NO: 2409708 - RNA, 17 nt, Human
cugucuaaccugugacc

SEQ ID NO: 2409709 - RNA, 16 nt, Human
cugucuaaccugugac

SEQ ID NO: 2409710 - RNA, 22 nt, Human
cugucuaaugaaaccugugucu

SEQ ID NO: 2409711 - RNA, 15 nt, Human
cugucuaaccuguga

SEQ ID NO: 2409712 - RNA, 13 nt, Human
cugucuaaaaaac

SEQ ID NO: 2409713 - RNA, 12 nt, Human
auuucuguuuag

SEQ ID NO: 2409714 - RNA, 17 nt, Human
auuucuccucccuuccu

SEQ ID NO: 2409715 - RNA, 14 nt, Human
auuucuccucccuu

SEQ ID NO: 2409716 - RNA, 12 nt, Human
auuucuccuccc

SEQ ID NO: 2409717 - RNA, 12 nt, Human
auuucuccccag

SEQ ID NO: 2409718 - RNA, 19 nt, Human
auuucuccucccuuccuuu

SEQ ID NO: 2409719 - RNA, 14 nt, Human
auuucuguuuagau

SEQ ID NO: 2409720 - RNA, 16 nt, Human
auuucuguuuagauaa

SEQ ID NO: 2409721 - RNA, 11 nt, Human
auuucuguguu

SEQ ID NO: 2409722 - RNA, 15 nt, Human
auuucuccuuugaua

SEQ ID NO: 2409723 - RNA, 15 nt, Human
auuucuguguugcca

SEQ ID NO: 2409724 - RNA, 23 nt, Human
auuucuguguugccaagcuccaa

SEQ ID NO: 2409725 - RNA, 14 nt, Human
auuucucauguuuu

SEQ ID NO: 2409726 - RNA, 16 nt, Human
auuucucagacuuugg

SEQ ID NO: 2409727 - RNA, 21 nt, Human
auuucucagacuuuggaaaau

SEQ ID NO: 2409728 - RNA, 15 nt, Human
auuucuccauacgca

SEQ ID NO: 2409729 - RNA, 20 nt, Human
auuucuccuccaugggagaa

SEQ ID NO: 2409730 - RNA, 18 nt, Human
auuucucagacuuuggaa

SEQ ID NO: 2409731 - RNA, 11 nt, Human
auuucucccag

SEQ ID NO: 2409732 - RNA, 20 nt, Human
auuucuaugaaauauuaugu

SEQ ID NO: 2409733 - RNA, 14 nt, Human
auuucucacugaga

SEQ ID NO: 2409734 - RNA, 20 nt, Human
auuucucaacaaagcacagu

SEQ ID NO: 2409735 - RNA, 22 nt, Human
auuucucaacaaagcacagugu

SEQ ID NO: 2409736 - RNA, 12 nt, Human
auuucuauuuuu

SEQ ID NO: 2409737 - RNA, 20 nt, Human
auuucaucuauuucugagaa

SEQ ID NO: 2409738 - RNA, 19 nt, Human
auuucucaacaaagcacag

SEQ ID NO: 2409739 - RNA, 18 nt, Human
auuucuauuuuuguagaa

SEQ ID NO: 2409740 - RNA, 18 nt, Human
auuucuaugaaauauuau

SEQ ID NO: 2409741 - RNA, 15 nt, Human
auuucuaugaaauau

SEQ ID NO: 2409742 - RNA, 17 nt, Human
auuucaucugcucuccu

SEQ ID NO: 2409743 - RNA, 16 nt, Human
auuucaucugcucucc

SEQ ID NO: 2409744 - RNA, 15 nt, Human
auuucaucugcucuc

SEQ ID NO: 2409745 - RNA, 14 nt, Human
auuucaucugcucu

SEQ ID NO: 2409746 - RNA, 14 nt, Human
auuucaucuauuuu

SEQ ID NO: 2409747 - RNA, 11 nt, Human
auuucaucugc

SEQ ID NO: 2409748 - RNA, 18 nt, Human
auuucaucuauuucugag

SEQ ID NO: 2409749 - RNA, 19 nt, Human
auuucaucuauuucugaga

SEQ ID NO: 2409750 - RNA, 15 nt, Human
auuuaauauuuugca

SEQ ID NO: 2409751 - RNA, 14 nt, Human
auuuaaugaaagac

SEQ ID NO: 2409752 - RNA, 22 nt, Human
auuuaaugauaaguaaaugcua

SEQ ID NO: 2409753 - RNA, 18 nt, Human
auuuaaucuuuuuuaugu

SEQ ID NO: 2409754 - RNA, 14 nt, Human
auuuaauguagcca

SEQ ID NO: 2409755 - RNA, 21 nt, Human
auuuaauggccggcuggaaau

SEQ ID NO: 2409756 - RNA, 16 nt, Human
auuuaauguagccaug

SEQ ID NO: 2409757 - RNA, 14 nt, Human
auuuaauguuuuca

SEQ ID NO: 2409758 - RNA, 19 nt, Human
auuuaauuaaucaugaaug

SEQ ID NO: 2409759 - RNA, 13 nt, Human
auuuaauuaaaaa

SEQ ID NO: 2409760 - RNA, 23 nt, Human
auuuauaaucacuuuuuuccaca

SEQ ID NO: 2409761 - RNA, 18 nt, Human
auuuauacaaauuagaaa

SEQ ID NO: 2409762 - RNA, 16 nt, Human
auuuaauuagugcuaa

SEQ ID NO: 2409763 - RNA, 15 nt, Human
auuuaauuagugcua

SEQ ID NO: 2409764 - RNA, 14 nt, Human
auuuauaauguuug

SEQ ID NO: 2409765 - RNA, 13 nt, Human
auuuaauauuuau

SEQ ID NO: 2409766 - RNA, 19 nt, Human
auuuaauauagcuauuuuu

SEQ ID NO: 2409767 - RNA, 14 nt, Human
auuuaauauagcua

SEQ ID NO: 2409768 - RNA, 16 nt, Human
auuuaauauagcuauu

SEQ ID NO: 2409769 - RNA, 17 nt, Human
auuuaauauagcuauuu

SEQ ID NO: 2409770 - RNA, 22 nt, Human
auuucaaguuccaaguugcuaa

SEQ ID NO: 2409771 - RNA, 23 nt, Human
auuucaaguuccaaguugcuaau

SEQ ID NO: 2409772 - RNA, 11 nt, Human
auuucaaguuc

SEQ ID NO: 2409773 - RNA, 16 nt, Human
auuucaaguuccaagu

SEQ ID NO: 2409774 - RNA, 16 nt, Human
auuucagagaggccuu

SEQ ID NO: 2409775 - RNA, 23 nt, Human
auuucagacucccauuccugaag

SEQ ID NO: 2409776 - RNA, 15 nt, Human
auuucaauucucaaa

SEQ ID NO: 2409777 - RNA, 14 nt, Human
auuucaauucucaa

SEQ ID NO: 2409778 - RNA, 18 nt, Human
auuucagacucccauucc

SEQ ID NO: 2409779 - RNA, 22 nt, Human
auuucagagaggccuuuuggaa

SEQ ID NO: 2409780 - RNA, 18 nt, Human
auuucaucauauuauaca

SEQ ID NO: 2409781 - RNA, 20 nt, Human
auuucaucauauuauacaga

SEQ ID NO: 2409782 - RNA, 13 nt, Human
auuucaucuauuu

SEQ ID NO: 2409783 - RNA, 14 nt, Human
auuucaucuauuuc

SEQ ID NO: 2409784 - RNA, 15 nt, Human
auuucaucuauuucu

SEQ ID NO: 2409785 - RNA, 16 nt, Human
auuucaucuauuucug

SEQ ID NO: 2409786 - RNA, 18 nt, Human
auuucagauucccagagc

SEQ ID NO: 2409787 - RNA, 15 nt, Human
auuucagauuuguga

SEQ ID NO: 2409788 - RNA, 20 nt, Human
auuucaagagauuuaauuaa

SEQ ID NO: 2409789 - RNA, 19 nt, Human
auuucaagagauuuaauua

SEQ ID NO: 2409790 - RNA, 21 nt, Human
auuucaagacauuaaaucuau

SEQ ID NO: 2409791 - RNA, 17 nt, Human
auuuaucagugacagag

SEQ ID NO: 2409792 - RNA, 15 nt, Human
auuucaagagauuua

SEQ ID NO: 2409793 - RNA, 15 nt, Human
auuucaagaccuucu

SEQ ID NO: 2409794 - RNA, 18 nt, Human
auuuaucaaucaguauaa

SEQ ID NO: 2409795 - RNA, 17 nt, Human
auuuaucaaucaguaua

SEQ ID NO: 2409796 - RNA, 17 nt, Human
auuuaucaaaucaguca

SEQ ID NO: 2409797 - RNA, 14 nt, Human
auuuaucaaaucag

SEQ ID NO: 2409798 - RNA, 13 nt, Human
auuuaucaaauca

SEQ ID NO: 2409799 - RNA, 12 nt, Human
auuuaucaaauc

SEQ ID NO: 2409800 - RNA, 16 nt, Human
auuuaucacacuucug

SEQ ID NO: 2409801 - RNA, 14 nt, Human
auuuaucagugaca

SEQ ID NO: 2409802 - RNA, 15 nt, Human
auuuaucagugacag

SEQ ID NO: 2409803 - RNA, 19 nt, Human
auuuauauuuuuaaaauau

SEQ ID NO: 2409804 - RNA, 13 nt, Human
auuuauauuucac

SEQ ID NO: 2409805 - RNA, 18 nt, Human
auuuauauuuuuauuuua

SEQ ID NO: 2409806 - RNA, 13 nt, Human
auuuauauuuuug

SEQ ID NO: 2409807 - RNA, 14 nt, Human
auuuauaguuugua

SEQ ID NO: 2409808 - RNA, 12 nt, Human
auuuauaguuug

SEQ ID NO: 2409809 - RNA, 14 nt, Human
auuuauacuauuua

SEQ ID NO: 2409810 - RNA, 20 nt, Human
auuuauacucuuuuuucaug

SEQ ID NO: 2409811 - RNA, 14 nt, Human
auuuauacaaauua

SEQ ID NO: 2409812 - RNA, 17 nt, Human
auuuauacuguauauau

SEQ ID NO: 2409813 - RNA, 19 nt, Human
auuguuucaaaauaaaaac

SEQ ID NO: 2409814 - RNA, 19 nt, Human
auuguuuauuuaucaguga

SEQ ID NO: 2409815 - RNA, 21 nt, Human
auuguuuauuuaucagugaca

SEQ ID NO: 2409816 - RNA, 14 nt, Human
auuguuuauucuuu

SEQ ID NO: 2409817 - RNA, 15 nt, Human
auuguuuauuuauca

SEQ ID NO: 2409818 - RNA, 17 nt, Human
auuguuuauuuaucagu

SEQ ID NO: 2409819 - RNA, 18 nt, Human
auuguuuauuuaucagug

SEQ ID NO: 2409820 - RNA, 19 nt, Human
auuguuuaaaaucauuucu

SEQ ID NO: 2409821 - RNA, 16 nt, Human
auuguuuaaagcaacu

SEQ ID NO: 2409822 - RNA, 22 nt, Human
auuguuuaaagcaacugucuau

SEQ ID NO: 2409823 - RNA, 20 nt, Human
auuguuuaaagcaacugucu

SEQ ID NO: 2409824 - RNA, 21 nt, Human
auuguuuaaguguuguaaaua

SEQ ID NO: 2409825 - RNA, 21 nt, Human
auuguucccagugacacuuca

SEQ ID NO: 2409826 - RNA, 13 nt, Human
auuguuccuguca

SEQ ID NO: 2409827 - RNA, 19 nt, Human
auuguucuuaguuugcagu

SEQ ID NO: 2409828 - RNA, 24 nt, Human
auuguuccagcaguuuucaaguca

SEQ ID NO: 2409829 - RNA, 16 nt, Human
auuguucccagugaca

SEQ ID NO: 2409830 - RNA, 19 nt, Human
auuguucccagugacacuu

SEQ ID NO: 2409831 - RNA, 19 nt, Human
auuguacaguuuguuuaca

SEQ ID NO: 2409832 - RNA, 18 nt, Human
auuguacaguuuguuuac

SEQ ID NO: 2409833 - RNA, 21 nt, Human
auuguacaguuuguuuacaca

SEQ ID NO: 2409834 - RNA, 22 nt, Human
auuguuccaagacauugucaau

SEQ ID NO: 2409835 - RNA, 21 nt, Human
auuguaauaaugcuaaagaaa

SEQ ID NO: 2409836 - RNA, 17 nt, Human
auuguacaguuuguuua

SEQ ID NO: 2409837 - RNA, 16 nt, Human
auuguacaguuuguuu

SEQ ID NO: 2409838 - RNA, 14 nt, Human
auuguacaguuugu

SEQ ID NO: 2409839 - RNA, 20 nt, Human
auuguacagcuguuuaagau

SEQ ID NO: 2409840 - RNA, 21 nt, Human
auuguuccaagacauugucaa

SEQ ID NO: 2409841 - RNA, 17 nt, Human
auuguacagcuguuuaa

SEQ ID NO: 2409842 - RNA, 16 nt, Human
auuguacagcuguuua

SEQ ID NO: 2409843 - RNA, 14 nt, Human
auuguacagcuguu

SEQ ID NO: 2409844 - RNA, 14 nt, Human
auuguacacuuuuu

SEQ ID NO: 2409845 - RNA, 12 nt, Human
auuguacacuuu

SEQ ID NO: 2409846 - RNA, 19 nt, Human
auuguacacaccuuauauu

SEQ ID NO: 2409847 - RNA, 14 nt, Human
auuguaaaugugcu

SEQ ID NO: 2409848 - RNA, 15 nt, Human
auuguaaaugugcuu

SEQ ID NO: 2409849 - RNA, 16 nt, Human
auuguaaauauguuuu

SEQ ID NO: 2409850 - RNA, 22 nt, Human
auuguaaaauagcuuguauagu

SEQ ID NO: 2409851 - RNA, 21 nt, Human
auuguaaaauagcuuguauag

SEQ ID NO: 2409852 - RNA, 19 nt, Human
auuguaaaauagcuuguau

SEQ ID NO: 2409853 - RNA, 15 nt, Human
auuguaaaauagcuu

SEQ ID NO: 2409854 - RNA, 17 nt, Human
auuguaaaugugcuuuu

SEQ ID NO: 2409855 - RNA, 15 nt, Human
auuguaaggaaugau

SEQ ID NO: 2409856 - RNA, 16 nt, Human
auuguaaauugaauca

SEQ ID NO: 2409857 - RNA, 17 nt, Human
auuguaaauugaaucag

SEQ ID NO: 2409858 - RNA, 18 nt, Human
auuguaagcaugcacaaa

SEQ ID NO: 2409859 - RNA, 16 nt, Human
auuguaaggaaugauu

SEQ ID NO: 2409860 - RNA, 19 nt, Human
auugauccagaaagaaaac

SEQ ID NO: 2409861 - RNA, 18 nt, Human
auugauccagaaagaaaa

SEQ ID NO: 2409862 - RNA, 22 nt, Human
auugauccagaaagaaaacuug

SEQ ID NO: 2409863 - RNA, 23 nt, Human
auugaucggagccuccucucuca

SEQ ID NO: 2409864 - RNA, 21 nt, Human
auugaucauuuuccccccacu

SEQ ID NO: 2409865 - RNA, 19 nt, Human
auugaucauuuucccccca

SEQ ID NO: 2409866 - RNA, 20 nt, Human
auugaucauuuuccccccac

SEQ ID NO: 2409867 - RNA, 13 nt, Human
auuguaaaauggu

SEQ ID NO: 2409868 - RNA, 19 nt, Human
auugaucggagccuccucu

SEQ ID NO: 2409869 - RNA, 18 nt, Human
auugaugggauuugguca

SEQ ID NO: 2409870 - RNA, 21 nt, Human
auuguaaaaccugucaaugau

SEQ ID NO: 2409871 - RNA, 17 nt, Human
auuguaaaacugaggca

SEQ ID NO: 2409872 - RNA, 20 nt, Human
auuguaaaaccugucaauga

SEQ ID NO: 2409873 - RNA, 17 nt, Human
auucacaaacuuuuaua

SEQ ID NO: 2409874 - RNA, 18 nt, Human
auucaauuguaaauugaa

SEQ ID NO: 2409875 - RNA, 22 nt, Human
auucaagaaaacaacuucaaua

SEQ ID NO: 2409876 - RNA, 19 nt, Human
auucaagaaaaguaagccc

SEQ ID NO: 2409877 - RNA, 16 nt, Human
auucaacccuggagag

SEQ ID NO: 2409878 - RNA, 15 nt, Human
auucaacccuggaga

SEQ ID NO: 2409879 - RNA, 13 nt, Human
auucaacuaaaaa

SEQ ID NO: 2409880 - RNA, 14 nt, Human
auucaacuaaaaaa

SEQ ID NO: 2409881 - RNA, 14 nt, Human
auucaacucagacu

SEQ ID NO: 2409882 - RNA, 23 nt, Human
auucaacuaaaaaaaaaaaagua

SEQ ID NO: 2409883 - RNA, 11 nt, Human
auuauguuaaa

SEQ ID NO: 2409884 - RNA, 18 nt, Human
auucacaagacccaaaag

SEQ ID NO: 2409885 - RNA, 22 nt, Human
auucacaaacuuuuauacucuu

SEQ ID NO: 2409886 - RNA, 14 nt, Human
auucacaaacuuuu

SEQ ID NO: 2409887 - RNA, 13 nt, Human
auucacaaacuuu

SEQ ID NO: 2409888 - RNA, 21 nt, Human
auucaauuguaaauugaauca

SEQ ID NO: 2409889 - RNA, 22 nt, Human
auucaauuguaaauugaaucag

SEQ ID NO: 2409890 - RNA, 19 nt, Human
auucaauuuauucaagaaa

SEQ ID NO: 2409891 - RNA, 18 nt, Human
auuaaauuuugaguucua

SEQ ID NO: 2409892 - RNA, 20 nt, Human
auuaaauucuugcaaaguau

SEQ ID NO: 2409893 - RNA, 14 nt, Human
auuaaauucuugca

SEQ ID NO: 2409894 - RNA, 18 nt, Human
auuaaauucuugcaaagu

SEQ ID NO: 2409895 - RNA, 21 nt, Human
auuauguguguuuuaaaauga

SEQ ID NO: 2409896 - RNA, 20 nt, Human
auuauguguguuuuaaaaug

SEQ ID NO: 2409897 - RNA, 15 nt, Human
auuauguguguuuua

SEQ ID NO: 2409898 - RNA, 20 nt, Human
auuaaauuuugaguucuaca

SEQ ID NO: 2409899 - RNA, 15 nt, Human
auuaaauuuaauuag

SEQ ID NO: 2409900 - RNA, 23 nt, Human
auuaugugccagauuuaugcaua

SEQ ID NO: 2409901 - RNA, 19 nt, Human
auucaucaaauggaagaca

SEQ ID NO: 2409902 - RNA, 20 nt, Human
auucauauuuucuuucaaaa

SEQ ID NO: 2409903 - RNA, 16 nt, Human
auucaucccaacuguc

SEQ ID NO: 2409904 - RNA, 16 nt, Human
auucauauuuucuuuc

SEQ ID NO: 2409905 - RNA, 20 nt, Human
auucauauuuacuucuuaua

SEQ ID NO: 2409906 - RNA, 18 nt, Human
auucauauuuacuucuua

SEQ ID NO: 2409907 - RNA, 19 nt, Human
auucauauuuacuucuuau

SEQ ID NO: 2409908 - RNA, 21 nt, Human
auucauuuuaacaucugagaa

SEQ ID NO: 2409909 - RNA, 19 nt, Human
auucauuugaguuauuuua

SEQ ID NO: 2409910 - RNA, 13 nt, Human
auucauuuuuaau

SEQ ID NO: 2409911 - RNA, 20 nt, Human
auuccaaagaguagaauugc

SEQ ID NO: 2409912 - RNA, 22 nt, Human
auuccucugggaauguuacauu

SEQ ID NO: 2409913 - RNA, 13 nt, Human
auuccucugggaa

SEQ ID NO: 2409914 - RNA, 20 nt, Human
auuccucuacuaacaaucag

SEQ ID NO: 2409915 - RNA, 12 nt, Human
auuccucuggga

SEQ ID NO: 2409916 - RNA, 16 nt, Human
auucaugcuacugcca

SEQ ID NO: 2409917 - RNA, 13 nt, Human
auucaugccuggc

SEQ ID NO: 2409918 - RNA, 14 nt, Human
auucaugccuggcu

SEQ ID NO: 2409919 - RNA, 21 nt, Human
auucaugcuacugccaaccug

SEQ ID NO: 2409920 - RNA, 22 nt, Human
auucauuucaaagggagagaga

SEQ ID NO: 2409921 - RNA, 14 nt, Human
auucauuuccugcc

SEQ ID NO: 2409922 - RNA, 13 nt, Human
auucauuuccugc

SEQ ID NO: 2409923 - RNA, 12 nt, Human
auucauuuccug

SEQ ID NO: 2409924 - RNA, 15 nt, Human
auucauuuccugccc

SEQ ID NO: 2409925 - RNA, 18 nt, Human
auucauuuuaacaucuga

SEQ ID NO: 2409926 - RNA, 15 nt, Human
auucaucuuuuguau

SEQ ID NO: 2409927 - RNA, 17 nt, Human
auucaucuuguguuuua

SEQ ID NO: 2409928 - RNA, 20 nt, Human
auucaucuguuuuucuuuuu

SEQ ID NO: 2409929 - RNA, 17 nt, Human
auucaugaacuucgcau

SEQ ID NO: 2409930 - RNA, 13 nt, Human
auucaugaacuuc

SEQ ID NO: 2409931 - RNA, 22 nt, Human
auucaucucucuuuaauauaaa

SEQ ID NO: 2409932 - RNA, 17 nt, Human
auucaucccaacugucu

SEQ ID NO: 2409933 - RNA, 17 nt, Human
auucaucucucuuuaau

SEQ ID NO: 2409934 - RNA, 21 nt, Human
auugagaaagagcacuuaaga

SEQ ID NO: 2409935 - RNA, 18 nt, Human
auugagaaagagcacuua

SEQ ID NO: 2409936 - RNA, 17 nt, Human
auugagaaagagcacuu

SEQ ID NO: 2409937 - RNA, 12 nt, Human
auugagaaagag

SEQ ID NO: 2409938 - RNA, 16 nt, Human
auugagaaagaaacua

SEQ ID NO: 2409939 - RNA, 18 nt, Human
auugacuuuuuauggcac

SEQ ID NO: 2409940 - RNA, 13 nt, Human
auugagaaggaga

SEQ ID NO: 2409941 - RNA, 22 nt, Human
auugagaacugcauauguuucg

SEQ ID NO: 2409942 - RNA, 14 nt, Human
auugagaacugcau

SEQ ID NO: 2409943 - RNA, 18 nt, Human
auugagaacugcauaugu

SEQ ID NO: 2409944 - RNA, 16 nt, Human
auugagaaggagagaa

SEQ ID NO: 2409945 - RNA, 15 nt, Human
auugagaaggagaga

SEQ ID NO: 2409946 - RNA, 14 nt, Human
auugagaaggagag

SEQ ID NO: 2409947 - RNA, 22 nt, Human
auugagaaagagcacuuaagag

SEQ ID NO: 2409948 - RNA, 17 nt, Human
auugagaaggagagaaa

SEQ ID NO: 2409949 - RNA, 20 nt, Human
auugagaaguuuuguacaga

SEQ ID NO: 2409950 - RNA, 13 nt, Human
auugagaauuuua

SEQ ID NO: 2409951 - RNA, 15 nt, Human
auugagcucucucau

SEQ ID NO: 2409952 - RNA, 20 nt, Human
auugagaguuuugucuugaa

SEQ ID NO: 2409953 - RNA, 16 nt, Human
auugagaguuuugucu

SEQ ID NO: 2409954 - RNA, 19 nt, Human
auugagauuagagggaggu

SEQ ID NO: 2409955 - RNA, 14 nt, Human
auugagaguuuugu

SEQ ID NO: 2409956 - RNA, 20 nt, Human
auugagaguaacuuaaguua

SEQ ID NO: 2409957 - RNA, 17 nt, Human
auugagaauuuuaaauu

SEQ ID NO: 2409958 - RNA, 21 nt, Human
auugagaauuuuaaauuauaa

SEQ ID NO: 2409959 - RNA, 22 nt, Human
auugagagaauggaaaacagac

SEQ ID NO: 2409960 - RNA, 17 nt, Human
auugauccagaaagaaa

SEQ ID NO: 2409961 - RNA, 16 nt, Human
auugauccagaaagaa

SEQ ID NO: 2409962 - RNA, 18 nt, Human
auugaucauuuucccccc

SEQ ID NO: 2409963 - RNA, 17 nt, Human
auugaucaaauucauuu

SEQ ID NO: 2409964 - RNA, 15 nt, Human
auugaucaaauucau

SEQ ID NO: 2409965 - RNA, 22 nt, Human
auucuuuccugaggcugggcuc

SEQ ID NO: 2409966 - RNA, 17 nt, Human
auucuuuccugaggcug

SEQ ID NO: 2409967 - RNA, 22 nt, Human
auucuuggcccgcacagagcug

SEQ ID NO: 2409968 - RNA, 17 nt, Human
auucuugguugaggaaa

SEQ ID NO: 2409969 - RNA, 18 nt, Human
auucuugguugaggaaac

SEQ ID NO: 2409970 - RNA, 20 nt, Human
auucuugguuggcuggccuu

SEQ ID NO: 2409971 - RNA, 17 nt, Human
auucuugguuggcuggc

SEQ ID NO: 2409972 - RNA, 21 nt, Human
auucuuggcccgcacagagcu

SEQ ID NO: 2409973 - RNA, 14 nt, Human
auucuuugauguua

SEQ ID NO: 2409974 - RNA, 13 nt, Human
auucuuugauguu

SEQ ID NO: 2409975 - RNA, 15 nt, Human
auucuuucuguauug

SEQ ID NO: 2409976 - RNA, 15 nt, Human
auucuuucugauaac

SEQ ID NO: 2409977 - RNA, 19 nt, Human
auucuuugaccuguuggga

SEQ ID NO: 2409978 - RNA, 14 nt, Human
auucuugucaaaaa

SEQ ID NO: 2409979 - RNA, 12 nt, Human
auucuuguauau

SEQ ID NO: 2409980 - RNA, 17 nt, Human
auucuugccaaauauaa

SEQ ID NO: 2409981 - RNA, 14 nt, Human
auucugauuacaca

SEQ ID NO: 2409982 - RNA, 13 nt, Human
auucugauuccac

SEQ ID NO: 2409983 - RNA, 15 nt, Human
auucugauuacacaa

SEQ ID NO: 2409984 - RNA, 13 nt, Human
auucugagagcug

SEQ ID NO: 2409985 - RNA, 14 nt, Human
auucugagagcugu

SEQ ID NO: 2409986 - RNA, 20 nt, Human
auucugacucgguuucucca

SEQ ID NO: 2409987 - RNA, 18 nt, Human
auucugacucgguuucuc

SEQ ID NO: 2409988 - RNA, 16 nt, Human
auucucuccuguaccu

SEQ ID NO: 2409989 - RNA, 14 nt, Human
auuccugcagccug

SEQ ID NO: 2409990 - RNA, 15 nt, Human
auuccugcagccugg

SEQ ID NO: 2409991 - RNA, 10 nt, Human
auucucucuc

SEQ ID NO: 2409992 - RNA, 11 nt, Human
auucucugagc

SEQ ID NO: 2409993 - RNA, 16 nt, Human
auucucucuccugucc

SEQ ID NO: 2409994 - RNA, 17 nt, Human
auucucucuccugucca

SEQ ID NO: 2409995 - RNA, 15 nt, Human
auucucucuccugua

SEQ ID NO: 2409996 - RNA, 12 nt, Human
auucucucuccu

SEQ ID NO: 2409997 - RNA, 15 nt, Human
auucucucuccuguc

SEQ ID NO: 2409998 - RNA, 19 nt, Human
auucucuccuguaccucuu

SEQ ID NO: 2409999 - RNA, 21 nt, Human
auucucuccuguaccucuuga

SEQ ID NO: 2410000 - RNA, 21 nt, Human
auuccugaugcuucuucagag

SEQ ID NO: 2410001 - RNA, 19 nt, Human
auuccugauaugauuuaaa

SEQ ID NO: 2410002 - RNA, 16 nt, Human
auuccugauaugauuu

SEQ ID NO: 2410003 - RNA, 22 nt, Human
auuccugauaugauuuaaaaca

SEQ ID NO: 2410004 - RNA, 20 nt, Human
auuccugauaugauuuaaaa

SEQ ID NO: 2410005 - RNA, 23 nt, Human
auuccugauaugauuuaaaacau

SEQ ID NO: 2410006 - RNA, 13 nt, Human
auuccugcagccu

SEQ ID NO: 2410007 - RNA, 17 nt, Human
auuccugacccaggccg

SEQ ID NO: 2410008 - RNA, 16 nt, Human
auuccugacccaggcc

SEQ ID NO: 2410009 - RNA, 15 nt, Human
auuccugacccaggc

SEQ ID NO: 2410010 - RNA, 14 nt, Human
auuccugacccagg

SEQ ID NO: 2410011 - RNA, 22 nt, Human
auuccugacccaggccgcagcu

SEQ ID NO: 2410012 - RNA, 21 nt, Human
auuccugacccaggccgcagc

SEQ ID NO: 2410013 - RNA, 16 nt, Human
auuccugaagaaccag

SEQ ID NO: 2410014 - RNA, 19 nt, Human
auuccugaagaaccagucc

SEQ ID NO: 2410015 - RNA, 12 nt, Human
auuccugaccca

SEQ ID NO: 2410016 - RNA, 11 nt, Human
auuccugaccc

SEQ ID NO: 2410017 - RNA, 17 nt, Human
auuccugaaugaaauau

SEQ ID NO: 2410018 - RNA, 19 nt, Human
auuccugaaugaaauauca

SEQ ID NO: 2410019 - RNA, 15 nt, Human
auuccugaagaacca

SEQ ID NO: 2410020 - RNA, 13 nt, Human
auuccugaaagaa

SEQ ID NO: 2410021 - RNA, 13 nt, Human
auuccucuuugcu

SEQ ID NO: 2410022 - RNA, 14 nt, Human
auuccucuuugcuu

SEQ ID NO: 2410023 - RNA, 15 nt, Human
auuccucuuugcuuu

SEQ ID NO: 2410024 - RNA, 16 nt, Human
auuccucuuugcuuug

SEQ ID NO: 2410025 - RNA, 17 nt, Human
auuccucuuugcuuugc

SEQ ID NO: 2410026 - RNA, 18 nt, Human
auuccucuuugcuuugcu

SEQ ID NO: 2410027 - RNA, 17 nt, Human
auuuuuaaaguauauau

SEQ ID NO: 2410028 - RNA, 19 nt, Human
auuuuuaaauguaaaacau

SEQ ID NO: 2410029 - RNA, 19 nt, Human
auuuuuaagauaauaauau

SEQ ID NO: 2410030 - RNA, 18 nt, Human
auuuuuaagauaauaaua

SEQ ID NO: 2410031 - RNA, 22 nt, Human
auuuuuaagauaauaauauaug

SEQ ID NO: 2410032 - RNA, 20 nt, Human
auuuuuaagauaauaauaua

SEQ ID NO: 2410033 - RNA, 21 nt, Human
auuuuuaagcaaaauauuauu

SEQ ID NO: 2410034 - RNA, 23 nt, Human
auuuugagugacucgaggguugg

SEQ ID NO: 2410035 - RNA, 14 nt, Human
auuuugagugacuc

SEQ ID NO: 2410036 - RNA, 13 nt, Human
auuuugagugacu

SEQ ID NO: 2410037 - RNA, 21 nt, Human
auuuugaguaucucggaccuu

SEQ ID NO: 2410038 - RNA, 21 nt, Human
auuuugagcugaaaugcugca

SEQ ID NO: 2410039 - RNA, 14 nt, Human
auuuugaggcuuuc

SEQ ID NO: 2410040 - RNA, 18 nt, Human
auuuugauccaagcuggu

SEQ ID NO: 2410041 - RNA, 14 nt, Human
auuuucuuucaaaa

SEQ ID NO: 2410042 - RNA, 18 nt, Human
auuuucuuuaaugcuuuu

SEQ ID NO: 2410043 - RNA, 19 nt, Human
auuuucuuuaaugcuuuua

SEQ ID NO: 2410044 - RNA, 16 nt, Human
auuuucuuucuguaac

SEQ ID NO: 2410045 - RNA, 21 nt, Human
auuuucuuucucuacuuugag

SEQ ID NO: 2410046 - RNA, 15 nt, Human
auuuucuuugaaauu

SEQ ID NO: 2410047 - RNA, 20 nt, Human
auuuucuuuucuuucaacuu

SEQ ID NO: 2410048 - RNA, 23 nt, Human
auuuucuuuguguagcuuugcuc

SEQ ID NO: 2410049 - RNA, 16 nt, Human
auuuucuuuuguaaau

SEQ ID NO: 2410050 - RNA, 17 nt, Human
auuuucuuuuguaaaug

SEQ ID NO: 2410051 - RNA, 22 nt, Human
auuuugagaaagucuuauuuau

SEQ ID NO: 2410052 - RNA, 17 nt, Human
auuuugaccuacucuca

SEQ ID NO: 2410053 - RNA, 18 nt, Human
auuuugaccuacucucau

SEQ ID NO: 2410054 - RNA, 19 nt, Human
auuuucuuuuguaaauguu

SEQ ID NO: 2410055 - RNA, 13 nt, Human
auuuucuuuucuu

SEQ ID NO: 2410056 - RNA, 19 nt, Human
auuuugacacuauaucugu

SEQ ID NO: 2410057 - RNA, 18 nt, Human
auuuugacacuauaucug

SEQ ID NO: 2410058 - RNA, 19 nt, Human
auuuucuuuaaaagaaugg

SEQ ID NO: 2410059 - RNA, 15 nt, Human
auuuucuuuaaaaga

SEQ ID NO: 2410060 - RNA, 12 nt, Human
auuuucuuuaau

SEQ ID NO: 2410061 - RNA, 15 nt, Human
auuuucuuuaaugcu

SEQ ID NO: 2410062 - RNA, 19 nt, Human
auuuuaucuuucgcacagc

SEQ ID NO: 2410063 - RNA, 13 nt, Human
auuuucuuuaaaa

SEQ ID NO: 2410064 - RNA, 21 nt, Human
auuuucuucaugcaaugacau

SEQ ID NO: 2410065 - RNA, 22 nt, Human
auuuuaucuuugauucuccuuc

SEQ ID NO: 2410066 - RNA, 21 nt, Human
auuuucuuccaagcaaaggug

SEQ ID NO: 2410067 - RNA, 21 nt, Human
auuuuaucuuugauucuccuu

SEQ ID NO: 2410068 - RNA, 20 nt, Human
auuuuaucuuugauucuccu

SEQ ID NO: 2410069 - RNA, 15 nt, Human
auuuuaucuuugauu

SEQ ID NO: 2410070 - RNA, 13 nt, Human
auuuuaucuuuga

SEQ ID NO: 2410071 - RNA, 15 nt, Human
auuuuaucugugaau

SEQ ID NO: 2410072 - RNA, 14 nt, Human
auuuuaucugugaa

SEQ ID NO: 2410073 - RNA, 13 nt, Human
auuuuaucuguga

SEQ ID NO: 2410074 - RNA, 20 nt, Human
auuuuaucccucaccuguag

SEQ ID NO: 2410075 - RNA, 15 nt, Human
auuuuaucucuuauu

SEQ ID NO: 2410076 - RNA, 13 nt, Human
auuuguuugaacu

SEQ ID NO: 2410077 - RNA, 16 nt, Human
auuuuauaaaucgcuu

SEQ ID NO: 2410078 - RNA, 17 nt, Human
auuuuauaaaucgcuuu

SEQ ID NO: 2410079 - RNA, 15 nt, Human
auuuuauaaaucgcu

SEQ ID NO: 2410080 - RNA, 14 nt, Human
auuuguuugaacug

SEQ ID NO: 2410081 - RNA, 16 nt, Human
auuuguuugaacugau

SEQ ID NO: 2410082 - RNA, 19 nt, Human
auuuuauauuagaaguguu

SEQ ID NO: 2410083 - RNA, 20 nt, Human
auuuuauauuagaaguguua

SEQ ID NO: 2410084 - RNA, 18 nt, Human
auuuuauauuaaaauaag

SEQ ID NO: 2410085 - RNA, 16 nt, Human
auuuuauaugucaaag

SEQ ID NO: 2410086 - RNA, 15 nt, Human
auuuuauaugucaaa

SEQ ID NO: 2410087 - RNA, 12 nt, Human
auuuuauaauuu

SEQ ID NO: 2410088 - RNA, 23 nt, Human
auuuuauaugcuuacugauauau

SEQ ID NO: 2410089 - RNA, 15 nt, Human
auuuuauacauuaac

SEQ ID NO: 2410090 - RNA, 20 nt, Human
auuuuauaaaucgcuuuuga

SEQ ID NO: 2410091 - RNA, 21 nt, Human
auuuuauaaaucgcuuuugau

SEQ ID NO: 2410092 - RNA, 23 nt, Human
auuuuauaaaucgcuuuugauaa

SEQ ID NO: 2410093 - RNA, 18 nt, Human
auuuuauaugcuuacuga

SEQ ID NO: 2410094 - RNA, 20 nt, Human
caaagaucaaaauaaaaagu

SEQ ID NO: 2410095 - RNA, 18 nt, Human
caaagaucaaaauaaaaa

SEQ ID NO: 2410096 - RNA, 17 nt, Human
caaagaucaaaauaaaa

SEQ ID NO: 2410097 - RNA, 16 nt, Human
caaagaucaaaauaaa

SEQ ID NO: 2410098 - RNA, 15 nt, Human
caaagaucaaaauaa

SEQ ID NO: 2410099 - RNA, 14 nt, Human
caaagaucaaaaua

SEQ ID NO: 2410100 - RNA, 15 nt, Human
caaaccaccagaagc

SEQ ID NO: 2410101 - RNA, 16 nt, Human
caaaccaccagaagcc

SEQ ID NO: 2410102 - RNA, 20 nt, Human
caaaccaccagaagcccaga

SEQ ID NO: 2410103 - RNA, 22 nt, Human
caaaccaccagaagcccagaau

SEQ ID NO: 2410104 - RNA, 14 nt, Human
caaaaguggccucu

SEQ ID NO: 2410105 - RNA, 16 nt, Human
caaaaguggccucuuu

SEQ ID NO: 2410106 - RNA, 17 nt, Human
caaaaguggccucuuug

SEQ ID NO: 2410107 - RNA, 18 nt, Human
caaaaguggccucuuugu

SEQ ID NO: 2410108 - RNA, 19 nt, Human
caaaagucaaaaggugccu

SEQ ID NO: 2410109 - RNA, 20 nt, Human
caaaaguauuuuccuguaaa

SEQ ID NO: 2410110 - RNA, 17 nt, Human
caaaccaaaucacugaa

SEQ ID NO: 2410111 - RNA, 20 nt, Human
caaaaguggccucuuugucu

SEQ ID NO: 2410112 - RNA, 14 nt, Human
caaaccacacugga

SEQ ID NO: 2410113 - RNA, 19 nt, Human
caaaaguauuuuccuguaa

SEQ ID NO: 2410114 - RNA, 17 nt, Human
caaaaguauuuuccugu

SEQ ID NO: 2410115 - RNA, 16 nt, Human
caaaaguauuuuccug

SEQ ID NO: 2410116 - RNA, 15 nt, Human
caaaaguauuuuccu

SEQ ID NO: 2410117 - RNA, 14 nt, Human
caaaaguauuuucc

SEQ ID NO: 2410118 - RNA, 13 nt, Human
caaaaguauuuuc

SEQ ID NO: 2410119 - RNA, 15 nt, Human
caaaagcugggcagg

SEQ ID NO: 2410120 - RNA, 20 nt, Human
caaaagguucacuaaagcag

SEQ ID NO: 2410121 - RNA, 14 nt, Human
caaaagcugcucag

SEQ ID NO: 2410122 - RNA, 15 nt, Human
caaaccacacuggac

SEQ ID NO: 2410123 - RNA, 16 nt, Human
auuuuuuuuuccuuca

SEQ ID NO: 2410124 - RNA, 13 nt, Human
auuuuuuuuuccu

SEQ ID NO: 2410125 - RNA, 12 nt, Human
auuuuuuuuucc

SEQ ID NO: 2410126 - RNA, 17 nt, Human
auuuuuacauucugaau

SEQ ID NO: 2410127 - RNA, 20 nt, Human
auuuuuaccuuuuuccuucc

SEQ ID NO: 2410128 - RNA, 23 nt, Human
auuuuuaauggggguagcagcug

SEQ ID NO: 2410129 - RNA, 15 nt, Human
auuuuuaaugggggu

SEQ ID NO: 2410130 - RNA, 12 nt, Human
auuuuuaauggg

SEQ ID NO: 2410131 - RNA, 11 nt, Human
auuuuuaaugg

SEQ ID NO: 2410132 - RNA, 17 nt, Human
auuuuuaaucaugaaau

SEQ ID NO: 2410133 - RNA, 16 nt, Human
auuuuuaaucaugaaa

SEQ ID NO: 2410134 - RNA, 14 nt, Human
auuuuuaaggacuu

SEQ ID NO: 2410135 - RNA, 13 nt, Human
auuuuuaagugcu

SEQ ID NO: 2410136 - RNA, 16 nt, Human
auuuuuacauucugaa

SEQ ID NO: 2410137 - RNA, 14 nt, Human
auuuuuacaauaaa

SEQ ID NO: 2410138 - RNA, 13 nt, Human
auuuuuacaauaa

SEQ ID NO: 2410139 - RNA, 19 nt, Human
auuuuuacaauaaauaauc

SEQ ID NO: 2410140 - RNA, 18 nt, Human
caaaaaaauauauuuaau

SEQ ID NO: 2410141 - RNA, 23 nt, Human
caaaaaaauacugccagaugcug

SEQ ID NO: 2410142 - RNA, 15 nt, Human
caaaaaaauacugcc

SEQ ID NO: 2410143 - RNA, 13 nt, Human
caaaaaaauacug

SEQ ID NO: 2410144 - RNA, 20 nt, Human
caaaagcccauucauuccau

SEQ ID NO: 2410145 - RNA, 22 nt, Human
caaaagcccauucauuccauuc

SEQ ID NO: 2410146 - RNA, 12 nt, Human
caaaagcugcuc

SEQ ID NO: 2410147 - RNA, 20 nt, Human
caaaaaaaaaguuuuauuuu

SEQ ID NO: 2410148 - RNA, 19 nt, Human
caaaaaaaaaguuuuauuu

SEQ ID NO: 2410149 - RNA, 17 nt, Human
caaaaaaaaaguuuuau

SEQ ID NO: 2410150 - RNA, 16 nt, Human
caaaaaaaaaguuuua

SEQ ID NO: 2410151 - RNA, 22 nt, Human
caaaaaaaaaguuuuauuuuuc

SEQ ID NO: 2410152 - RNA, 16 nt, Human
caaaaaaacacuaguu

SEQ ID NO: 2410153 - RNA, 13 nt, Human
caaaaaaacacua

SEQ ID NO: 2410154 - RNA, 17 nt, Human
auuuuuuuuuccuucag

SEQ ID NO: 2410155 - RNA, 19 nt, Human
caaaaaaaaaaaaaugcac

SEQ ID NO: 2410156 - RNA, 19 nt, Human
auuuuuaccguuucuuccc

SEQ ID NO: 2410157 - RNA, 22 nt, Human
caaaaaaaaaaaaaagcaucua

SEQ ID NO: 2410158 - RNA, 17 nt, Human
auuuuuuuuuccuagcc

SEQ ID NO: 2410159 - RNA, 21 nt, Human
auuuuuacuagaacacagaaa

SEQ ID NO: 2410160 - RNA, 21 nt, Human
caacuaucucauuuccaagca

SEQ ID NO: 2410161 - RNA, 23 nt, Human
caaccccacacgcuccucccucu

SEQ ID NO: 2410162 - RNA, 17 nt, Human
caacuaugauuuggaaa

SEQ ID NO: 2410163 - RNA, 20 nt, Human
caacuauuuuuccaaaauaa

SEQ ID NO: 2410164 - RNA, 22 nt, Human
caacuaugauuuggaaaauaaa

SEQ ID NO: 2410165 - RNA, 19 nt, Human
caacuaugauuuggaaaau

SEQ ID NO: 2410166 - RNA, 18 nt, Human
caacuaugauuuggaaaa

SEQ ID NO: 2410167 - RNA, 17 nt, Human
caacccccagccugcua

SEQ ID NO: 2410168 - RNA, 16 nt, Human
caacccccagccugcu

SEQ ID NO: 2410169 - RNA, 15 nt, Human
caacccccagccugc

SEQ ID NO: 2410170 - RNA, 15 nt, Human
caaccccaacuccag

SEQ ID NO: 2410171 - RNA, 12 nt, Human
caaccccagccg

SEQ ID NO: 2410172 - RNA, 15 nt, Human
caacccauuagccau

SEQ ID NO: 2410173 - RNA, 22 nt, Human
caacccaggagcauccaccucc

SEQ ID NO: 2410174 - RNA, 22 nt, Human
caacccaugaugagcuccucuu

SEQ ID NO: 2410175 - RNA, 18 nt, Human
caacccagccgcugcccg

SEQ ID NO: 2410176 - RNA, 17 nt, Human
caacccagccgcugccc

SEQ ID NO: 2410177 - RNA, 16 nt, Human
caacccagccgcugcc

SEQ ID NO: 2410178 - RNA, 14 nt, Human
caacccagccgcug

SEQ ID NO: 2410179 - RNA, 22 nt, Human
caacccaaggacugagggacuc

SEQ ID NO: 2410180 - RNA, 19 nt, Human
caacccaaggacugaggga

SEQ ID NO: 2410181 - RNA, 11 nt, Human
caacccagccg

SEQ ID NO: 2410182 - RNA, 15 nt, Human
caacccaaggacuga

SEQ ID NO: 2410183 - RNA, 19 nt, Human
caacccaaauguucaucaa

SEQ ID NO: 2410184 - RNA, 14 nt, Human
caaccauuccccau

SEQ ID NO: 2410185 - RNA, 22 nt, Human
caaccacuggucuguagggauu

SEQ ID NO: 2410186 - RNA, 14 nt, Human
caaccacuggucug

SEQ ID NO: 2410187 - RNA, 21 nt, Human
caaccacuaagaauucaaacu

SEQ ID NO: 2410188 - RNA, 22 nt, Human
caaccaccgcuccccagcccag

SEQ ID NO: 2410189 - RNA, 23 nt, Human
caaccacuggucuguagggauuu

SEQ ID NO: 2410190 - RNA, 14 nt, Human
caaccacuguaaaa

SEQ ID NO: 2410191 - RNA, 17 nt, Human
caaccacuguaaaauga

SEQ ID NO: 2410192 - RNA, 21 nt, Human
caaccacuguaaaaugaaauu

SEQ ID NO: 2410193 - RNA, 13 nt, Human
caaccauuccaga

SEQ ID NO: 2410194 - RNA, 14 nt, Human
caaccauuccagac

SEQ ID NO: 2410195 - RNA, 16 nt, Human
caaccauuccagacug

SEQ ID NO: 2410196 - RNA, 22 nt, Human
caaccauuccagacugcuucca

SEQ ID NO: 2410197 - RNA, 19 nt, Human
caaccacuguaaaaugaaa

SEQ ID NO: 2410198 - RNA, 18 nt, Human
caagaauaaucacgcuuu

SEQ ID NO: 2410199 - RNA, 17 nt, Human
caagaauaaucacgcuu

SEQ ID NO: 2410200 - RNA, 15 nt, Human
caagaaguuuaagga

SEQ ID NO: 2410201 - RNA, 22 nt, Human
caagaaggguuuuccacccugg

SEQ ID NO: 2410202 - RNA, 23 nt, Human
caagaagggcuagaaccuggagg

SEQ ID NO: 2410203 - RNA, 22 nt, Human
caacuaugauaugguaaaaguu

SEQ ID NO: 2410204 - RNA, 14 nt, Human
caagaagugauuag

SEQ ID NO: 2410205 - RNA, 23 nt, Human
caagaaggguuuuccacccugga

SEQ ID NO: 2410206 - RNA, 19 nt, Human
caagaagucaaaguaaaac

SEQ ID NO: 2410207 - RNA, 15 nt, Human
caacucaccccagcc

SEQ ID NO: 2410208 - RNA, 13 nt, Human
caacucaccccag

SEQ ID NO: 2410209 - RNA, 16 nt, Human
caacucaccccagccc

SEQ ID NO: 2410210 - RNA, 19 nt, Human
caagacccuugugguccca

SEQ ID NO: 2410211 - RNA, 18 nt, Human
caagacccuugugguccc

SEQ ID NO: 2410212 - RNA, 22 nt, Human
caagacccuuguggucccaccc

SEQ ID NO: 2410213 - RNA, 14 nt, Human
caagauuaaaugua

SEQ ID NO: 2410214 - RNA, 15 nt, Human
caagacacaucccua

SEQ ID NO: 2410215 - RNA, 17 nt, Human
caagacagaagcugaag

SEQ ID NO: 2410216 - RNA, 13 nt, Human
caagacacugugg

SEQ ID NO: 2410217 - RNA, 13 nt, Human
caagacagaugcc

SEQ ID NO: 2410218 - RNA, 18 nt, Human
caagacagaagcugaagu

SEQ ID NO: 2410219 - RNA, 22 nt, Human
caagacagaugccccagagcug

SEQ ID NO: 2410220 - RNA, 16 nt, Human
caagacagaugcccca

SEQ ID NO: 2410221 - RNA, 21 nt, Human
caagacagaugccccagagcu

SEQ ID NO: 2410222 - RNA, 13 nt, Human
caagacacaguga

SEQ ID NO: 2410223 - RNA, 22 nt, Human
caagaauuugaucguuccaguu

SEQ ID NO: 2410224 - RNA, 22 nt, Human
caagaauuucuugguaagaagc

SEQ ID NO: 2410225 - RNA, 23 nt, Human
caagaauuucuugguaagaagcc

SEQ ID NO: 2410226 - RNA, 18 nt, Human
caaccacugcgaccacaa

SEQ ID NO: 2410227 - RNA, 16 nt, Human
caaccaccuuucagau

SEQ ID NO: 2410228 - RNA, 20 nt, Human
caaccaccgcuccccagccc

SEQ ID NO: 2410229 - RNA, 21 nt, Human
caaccaccgcuccccagccca

SEQ ID NO: 2410230 - RNA, 19 nt, Human
caaccaccgcuccccagcc

SEQ ID NO: 2410231 - RNA, 17 nt, Human
caaccaccgcuccccag

SEQ ID NO: 2410232 - RNA, 22 nt, Human
caacaccucugcacaagcugca

SEQ ID NO: 2410233 - RNA, 20 nt, Human
caacaccuuguuucccucuc

SEQ ID NO: 2410234 - RNA, 15 nt, Human
caacacgagcaggcu

SEQ ID NO: 2410235 - RNA, 20 nt, Human
caaauccuugugggaaaaga

SEQ ID NO: 2410236 - RNA, 13 nt, Human
caaaucauagcug

SEQ ID NO: 2410237 - RNA, 22 nt, Human
caaaucaguuacuaagaagaaa

SEQ ID NO: 2410238 - RNA, 21 nt, Human
caaaucaguuacuaagaagaa

SEQ ID NO: 2410239 - RNA, 20 nt, Human
caaaucaguuacuaagaaga

SEQ ID NO: 2410240 - RNA, 14 nt, Human
caaaucaguuacua

SEQ ID NO: 2410241 - RNA, 23 nt, Human
caaaucagucagugcaaauguca

SEQ ID NO: 2410242 - RNA, 13 nt, Human
caaaucagucagu

SEQ ID NO: 2410243 - RNA, 22 nt, Human
caaauccagccugcugccugcu

SEQ ID NO: 2410244 - RNA, 23 nt, Human
caaaguauuuuuuuaucuuggga

SEQ ID NO: 2410245 - RNA, 22 nt, Human
caaaguauuuuuuuaucuuggg

SEQ ID NO: 2410246 - RNA, 16 nt, Human
caaagucaagccacau

SEQ ID NO: 2410247 - RNA, 17 nt, Human
caaaucagcugcuacua

SEQ ID NO: 2410248 - RNA, 21 nt, Human
caaaguacacuguuucaaacu

SEQ ID NO: 2410249 - RNA, 16 nt, Human
caaaguacacuguuuc

SEQ ID NO: 2410250 - RNA, 20 nt, Human
caaaguacacuguuucaaac

SEQ ID NO: 2410251 - RNA, 15 nt, Human
caaagaucacuuguu

SEQ ID NO: 2410252 - RNA, 12 nt, Human
caaagaucacuu

SEQ ID NO: 2410253 - RNA, 20 nt, Human
caaagaucuguccucagccu

SEQ ID NO: 2410254 - RNA, 21 nt, Human
caaagaucuguccucagccuu

SEQ ID NO: 2410255 - RNA, 13 nt, Human
caaagaugcagcc

SEQ ID NO: 2410256 - RNA, 14 nt, Human
caaagaugcagccg

SEQ ID NO: 2410257 - RNA, 21 nt, Human
caaaguaaaacuugcugccug

SEQ ID NO: 2410258 - RNA, 23 nt, Human
caaaugcagggauugcugccacu

SEQ ID NO: 2410259 - RNA, 21 nt, Human
caaauuuugaugccaagaaag

SEQ ID NO: 2410260 - RNA, 22 nt, Human
caaaugcagggauugcugccac

SEQ ID NO: 2410261 - RNA, 20 nt, Human
caaaugcagggauugcugcc

SEQ ID NO: 2410262 - RNA, 19 nt, Human
caaaugcagggauugcugc

SEQ ID NO: 2410263 - RNA, 13 nt, Human
caaaugcagcuuu

SEQ ID NO: 2410264 - RNA, 22 nt, Human
caaaugagggucuugguuccag

SEQ ID NO: 2410265 - RNA, 13 nt, Human
caaaugagccaug

SEQ ID NO: 2410266 - RNA, 22 nt, Human
caaaucuauucagacaagcaac

SEQ ID NO: 2410267 - RNA, 20 nt, Human
caaaucuauucagacaagca

SEQ ID NO: 2410268 - RNA, 16 nt, Human
caaaucuauucagaca

SEQ ID NO: 2410269 - RNA, 21 nt, Human
caaaucugcuuuuuaaagaau

SEQ ID NO: 2410270 - RNA, 21 nt, Human
caaaucguccagcgaccuucc

SEQ ID NO: 2410271 - RNA, 19 nt, Human
caaaucguccagcgaccuu

SEQ ID NO: 2410272 - RNA, 14 nt, Human
caaaucuauucaga

SEQ ID NO: 2410273 - RNA, 13 nt, Human
caaaucuauucag

SEQ ID NO: 2410274 - RNA, 23 nt, Human
caacaaaccuguuucugcagcca

SEQ ID NO: 2410275 - RNA, 17 nt, Human
caacaaaaagcuucccc

SEQ ID NO: 2410276 - RNA, 16 nt, Human
caacaaaaagcuuccc

SEQ ID NO: 2410277 - RNA, 15 nt, Human
caaauuuuggccaaa

SEQ ID NO: 2410278 - RNA, 13 nt, Human
caaauuuuggcca

SEQ ID NO: 2410279 - RNA, 14 nt, Human
caacaauuuaugaa

SEQ ID NO: 2410280 - RNA, 16 nt, Human
caacaauuuaugaauu

SEQ ID NO: 2410281 - RNA, 17 nt, Human
caacaauuuaugaauug

SEQ ID NO: 2410282 - RNA, 18 nt, Human
caacaauuuaugaauuga

SEQ ID NO: 2410283 - RNA, 13 nt, Human
caacaauuucuac

SEQ ID NO: 2410284 - RNA, 18 nt, Human
caacaauuucuacuuuga

SEQ ID NO: 2410285 - RNA, 19 nt, Human
caacaauuucuacuuugaa

SEQ ID NO: 2410286 - RNA, 20 nt, Human
caacaauuucuacuuugaag

SEQ ID NO: 2410287 - RNA, 23 nt, Human
caaguaauucugcugucucagcc

SEQ ID NO: 2410288 - RNA, 16 nt, Human
caaguaauucugcugu

SEQ ID NO: 2410289 - RNA, 22 nt, Human
caaguaauccaccugccucggc

SEQ ID NO: 2410290 - RNA, 20 nt, Human
caagauuagaagcugaaaac

SEQ ID NO: 2410291 - RNA, 17 nt, Human
caagauucacaccugac

SEQ ID NO: 2410292 - RNA, 12 nt, Human
caagauuagaag

SEQ ID NO: 2410293 - RNA, 19 nt, Human
caagauucacaccugacuc

SEQ ID NO: 2410294 - RNA, 18 nt, Human
caagauucacaccugacu

SEQ ID NO: 2410295 - RNA, 13 nt, Human
caagauucccaga

SEQ ID NO: 2410296 - RNA, 14 nt, Human
caagauucccagag

SEQ ID NO: 2410297 - RNA, 15 nt, Human
caagauucccagaga

SEQ ID NO: 2410298 - RNA, 16 nt, Human
caagauucccagagac

SEQ ID NO: 2410299 - RNA, 17 nt, Human
caagauucccagagaca

SEQ ID NO: 2410300 - RNA, 18 nt, Human
caagauucccagagacag

SEQ ID NO: 2410301 - RNA, 19 nt, Human
caagauucccagagacagg

SEQ ID NO: 2410302 - RNA, 23 nt, Human
caagauucccagagacaggaaaa

SEQ ID NO: 2410303 - RNA, 11 nt, Human
caaguaauugu

SEQ ID NO: 2410304 - RNA, 23 nt, Human
caaguaauugugaaaaaguuaaa

SEQ ID NO: 2410305 - RNA, 16 nt, Human
caaguacugcuguaaa

SEQ ID NO: 2410306 - RNA, 20 nt, Human
caaguacauggcuagcuuuu

SEQ ID NO: 2410307 - RNA, 13 nt, Human
caaguacugcugu

SEQ ID NO: 2410308 - RNA, 14 nt, Human
caaguacugcugua

SEQ ID NO: 2410309 - RNA, 14 nt, Human
caaguauuagaaua

SEQ ID NO: 2410310 - RNA, 20 nt, Human
caaguauuagaauaccacag

SEQ ID NO: 2410311 - RNA, 23 nt, Human
caaguauuagggguaauauauug

SEQ ID NO: 2410312 - RNA, 20 nt, Human
caaguauuagggguaauaua

SEQ ID NO: 2410313 - RNA, 22 nt, Human
caaguaugugggcagauuuuca

SEQ ID NO: 2410314 - RNA, 17 nt, Human
caaguauguuuuagcau

SEQ ID NO: 2410315 - RNA, 19 nt, Human
caaguucuagagaagaggc

SEQ ID NO: 2410316 - RNA, 18 nt, Human
caaguucuagagaagagg

SEQ ID NO: 2410317 - RNA, 16 nt, Human
caaguucuagagaaga

SEQ ID NO: 2410318 - RNA, 13 nt, Human
caaguucuagaga

SEQ ID NO: 2410319 - RNA, 23 nt, Human
caaguucuagagaagaggcuggu

SEQ ID NO: 2410320 - RNA, 21 nt, Human
caaguucuagagaagaggcug

SEQ ID NO: 2410321 - RNA, 15 nt, Human
caaguugaauugagg

SEQ ID NO: 2410322 - RNA, 13 nt, Human
caaguugugcuug

SEQ ID NO: 2410323 - RNA, 17 nt, Human
caaguuguggugcugac

SEQ ID NO: 2410324 - RNA, 17 nt, Human
caaguugugcuuguuua

SEQ ID NO: 2410325 - RNA, 15 nt, Human
caaguugcuaauaca

SEQ ID NO: 2410326 - RNA, 13 nt, Human
caaguuuugugua

SEQ ID NO: 2410327 - RNA, 21 nt, Human
caaguuguggugcugacaaag

SEQ ID NO: 2410328 - RNA, 20 nt, Human
caaguuguggugcugacaaa

SEQ ID NO: 2410329 - RNA, 12 nt, Human
caauaaagagau

SEQ ID NO: 2410330 - RNA, 13 nt, Human
caauaaagaagag

SEQ ID NO: 2410331 - RNA, 22 nt, Human
caauaaagaguuagaaugaaaa

SEQ ID NO: 2410332 - RNA, 13 nt, Human
caauaaaccaggu

SEQ ID NO: 2410333 - RNA, 18 nt, Human
caauaaaauuuuuuuuca

SEQ ID NO: 2410334 - RNA, 23 nt, Human
caauaaaccagguuuagacagua

SEQ ID NO: 2410335 - RNA, 19 nt, Human
caauaaaauuuuuuuucau

SEQ ID NO: 2410336 - RNA, 17 nt, Human
caauaaaccucuuuucu

SEQ ID NO: 2410337 - RNA, 18 nt, Human
caauaaacgauuuaauuc

SEQ ID NO: 2410338 - RNA, 17 nt, Human
caauaaacgauuuaauu

SEQ ID NO: 2410339 - RNA, 16 nt, Human
caauaaacgauuuaau

SEQ ID NO: 2410340 - RNA, 12 nt, Human
caauaaacgauu

SEQ ID NO: 2410341 - RNA, 21 nt, Human
caauaaacgauuuaauucucu

SEQ ID NO: 2410342 - RNA, 19 nt, Human
caauaaacgauuuaauucu

SEQ ID NO: 2410343 - RNA, 22 nt, Human
caauaaaauuuuuuuucauguu

SEQ ID NO: 2410344 - RNA, 22 nt, Human
caauaaaaauggcucagaugcc

SEQ ID NO: 2410345 - RNA, 17 nt, Human
caauaaaaauggcucag

SEQ ID NO: 2410346 - RNA, 13 nt, Human
caauaaaaauguu

SEQ ID NO: 2410347 - RNA, 14 nt, Human
caauaaaaaucaua

SEQ ID NO: 2410348 - RNA, 16 nt, Human
caauaaaaauggcuca

SEQ ID NO: 2410349 - RNA, 23 nt, Human
caaugcuguauuuuaaaagaaug

SEQ ID NO: 2410350 - RNA, 14 nt, Human
caaugcuguauuuu

SEQ ID NO: 2410351 - RNA, 23 nt, Human
caaugcuggcuguuggcuggggg

SEQ ID NO: 2410352 - RNA, 22 nt, Human
caaugcuggcuguuggcugggg

SEQ ID NO: 2410353 - RNA, 21 nt, Human
caauauuucagauaaucacaa

SEQ ID NO: 2410354 - RNA, 20 nt, Human
caauauuucagauaaucaca

SEQ ID NO: 2410355 - RNA, 12 nt, Human
caauauuucaga

SEQ ID NO: 2410356 - RNA, 19 nt, Human
caauauuuauuauuuucac

SEQ ID NO: 2410357 - RNA, 17 nt, Human
caauggaaccuccuuuc

SEQ ID NO: 2410358 - RNA, 16 nt, Human
caauggaaccuccuuu

SEQ ID NO: 2410359 - RNA, 14 nt, Human
caauggaaccuccu

SEQ ID NO: 2410360 - RNA, 17 nt, Human
caauggaaacugaaugc

SEQ ID NO: 2410361 - RNA, 16 nt, Human
caauggaaacugaaug

SEQ ID NO: 2410362 - RNA, 15 nt, Human
caauggaaacugaau

SEQ ID NO: 2410363 - RNA, 13 nt, Human
caauggaaacuga

SEQ ID NO: 2410364 - RNA, 17 nt, Human
caauucuccugccucag

SEQ ID NO: 2410365 - RNA, 16 nt, Human
caauucuccugccuca

SEQ ID NO: 2410366 - RNA, 22 nt, Human
caaugcugugcccuaaagugua

SEQ ID NO: 2410367 - RNA, 21 nt, Human
caaugcuuugccccugagaca

SEQ ID NO: 2410368 - RNA, 17 nt, Human
caauucuucccuaucuu

SEQ ID NO: 2410369 - RNA, 24 nt, Human
caauuguugacaguucugaagaau

SEQ ID NO: 2410370 - RNA, 23 nt, Human
caauuguugacaguucugaagaa

SEQ ID NO: 2410371 - RNA, 21 nt, Human
caauuguugacaguucugaag

SEQ ID NO: 2410372 - RNA, 14 nt, Human
caauuguugacagu

SEQ ID NO: 2410373 - RNA, 19 nt, Human
caauucuccugccucagcc

SEQ ID NO: 2410374 - RNA, 17 nt, Human
caauucucuuuaguucu

SEQ ID NO: 2410375 - RNA, 19 nt, Human
caauucuuacaaacaugug

SEQ ID NO: 2410376 - RNA, 18 nt, Human
caauucuuacaaacaugu

SEQ ID NO: 2410377 - RNA, 22 nt, Human
caauucuguuuuagguuaaaaa

SEQ ID NO: 2410378 - RNA, 14 nt, Human
caauucuguuuuag

SEQ ID NO: 2410379 - RNA, 17 nt, Human
caauucuuacaaacaug

SEQ ID NO: 2410380 - RNA, 15 nt, Human
cacaagccacagaag

SEQ ID NO: 2410381 - RNA, 12 nt, Human
cacaagccacag

SEQ ID NO: 2410382 - RNA, 17 nt, Human
cacaagccacagaagcc

SEQ ID NO: 2410383 - RNA, 14 nt, Human
cacaagccuucggc

SEQ ID NO: 2410384 - RNA, 16 nt, Human
cacaagacccuugugg

SEQ ID NO: 2410385 - RNA, 14 nt, Human
cacaagacccuugu

SEQ ID NO: 2410386 - RNA, 12 nt, Human
caauuuaaaaaa

SEQ ID NO: 2410387 - RNA, 18 nt, Human
caauuuaaacccauuuua

SEQ ID NO: 2410388 - RNA, 16 nt, Human
caauuuaaacccauuu

SEQ ID NO: 2410389 - RNA, 15 nt, Human
caauuuaaacccauu

SEQ ID NO: 2410390 - RNA, 22 nt, Human
caauuguuugggguugaaaauu

SEQ ID NO: 2410391 - RNA, 15 nt, Human
cacaagauucccaga

SEQ ID NO: 2410392 - RNA, 16 nt, Human
cacaagauucccagag

SEQ ID NO: 2410393 - RNA, 17 nt, Human
cacaagauucccagaga

SEQ ID NO: 2410394 - RNA, 18 nt, Human
cacaagauucccagagac

SEQ ID NO: 2410395 - RNA, 19 nt, Human
cacaagauucccagagaca

SEQ ID NO: 2410396 - RNA, 22 nt, Human
cacaagcaaaaaaaaaaaaaag

SEQ ID NO: 2410397 - RNA, 22 nt, Human
cacaagauucccagagacagga

SEQ ID NO: 2410398 - RNA, 16 nt, Human
cacaagacugcacauc

SEQ ID NO: 2410399 - RNA, 22 nt, Human
caauuuaaacccauuuuaguca

SEQ ID NO: 2410400 - RNA, 20 nt, Human
caauuuaaacccauuuuagu

SEQ ID NO: 2410401 - RNA, 23 nt, Human
cacccaggagccccgaggccuuc

SEQ ID NO: 2410402 - RNA, 20 nt, Human
cacccaggagccccgaggcc

SEQ ID NO: 2410403 - RNA, 19 nt, Human
cacccagcccacuucugcc

SEQ ID NO: 2410404 - RNA, 22 nt, Human
caccaggcuggcgcagccaagg

SEQ ID NO: 2410405 - RNA, 20 nt, Human
caccaggcuggcgcagccaa

SEQ ID NO: 2410406 - RNA, 19 nt, Human
caccaggcuggcgcagcca

SEQ ID NO: 2410407 - RNA, 18 nt, Human
caccaggcuggcgcagcc

SEQ ID NO: 2410408 - RNA, 23 nt, Human
caccaggcuggcgcagccaaggc

SEQ ID NO: 2410409 - RNA, 12 nt, Human
cacccagcccau

SEQ ID NO: 2410410 - RNA, 13 nt, Human
cacccagcccauu

SEQ ID NO: 2410411 - RNA, 24 nt, Human
cacccaggagccccgaggccuucu

SEQ ID NO: 2410412 - RNA, 15 nt, Human
cacccagcccauucu

SEQ ID NO: 2410413 - RNA, 11 nt, Human
cacccaggagg

SEQ ID NO: 2410414 - RNA, 21 nt, Human
caccagcccuuagcagggaaa

SEQ ID NO: 2410415 - RNA, 15 nt, Human
caccagcagccugga

SEQ ID NO: 2410416 - RNA, 15 nt, Human
caccagcuccucccu

SEQ ID NO: 2410417 - RNA, 12 nt, Human
caccagcuccuc

SEQ ID NO: 2410418 - RNA, 21 nt, Human
caccagcguuugaggggcugg

SEQ ID NO: 2410419 - RNA, 19 nt, Human
caccagcguuugaggggcu

SEQ ID NO: 2410420 - RNA, 14 nt, Human
caccagcauuccuu

SEQ ID NO: 2410421 - RNA, 14 nt, Human
caccagccugcacu

SEQ ID NO: 2410422 - RNA, 20 nt, Human
caccagccuuucucccaggc

SEQ ID NO: 2410423 - RNA, 22 nt, Human
caccagccuuucucccaggcca

SEQ ID NO: 2410424 - RNA, 15 nt, Human
caccagcauuccuuu

SEQ ID NO: 2410425 - RNA, 13 nt, Human
caccagccugcac

SEQ ID NO: 2410426 - RNA, 23 nt, Human
caccaacauacucccaucuguga

SEQ ID NO: 2410427 - RNA, 14 nt, Human
caccagcagccugg

SEQ ID NO: 2410428 - RNA, 12 nt, Human
caccagcagccu

SEQ ID NO: 2410429 - RNA, 14 nt, Human
caccaggccaccuc

SEQ ID NO: 2410430 - RNA, 13 nt, Human
caccaggccaccu

SEQ ID NO: 2410431 - RNA, 19 nt, Human
caccagcuucuccaggcuc

SEQ ID NO: 2410432 - RNA, 19 nt, Human
caccaggccaccuccccag

SEQ ID NO: 2410433 - RNA, 15 nt, Human
caccaggccaccucc

SEQ ID NO: 2410434 - RNA, 22 nt, Human
caccaggccaccuccccagcau

SEQ ID NO: 2410435 - RNA, 15 nt, Human
caccagcugccucuu

SEQ ID NO: 2410436 - RNA, 14 nt, Human
caccagcugccucu

SEQ ID NO: 2410437 - RNA, 17 nt, Human
caccagcuccucccuug

SEQ ID NO: 2410438 - RNA, 12 nt, Human
caccagcugccu

SEQ ID NO: 2410439 - RNA, 17 nt, Human
caccagcuucuccaggc

SEQ ID NO: 2410440 - RNA, 16 nt, Human
caccagcuucuccagg

SEQ ID NO: 2410441 - RNA, 22 nt, Human
caccagcuguucugucccuugg

SEQ ID NO: 2410442 - RNA, 17 nt, Human
caccagcugccucuucu

SEQ ID NO: 2410443 - RNA, 16 nt, Human
caccagcugccucuuc

SEQ ID NO: 2410444 - RNA, 21 nt, Human
caccaggccguccucccgggc

SEQ ID NO: 2410445 - RNA, 16 nt, Human
caccaggccguccucc

SEQ ID NO: 2410446 - RNA, 17 nt, Human
caccaggcuggcgcagc

SEQ ID NO: 2410447 - RNA, 16 nt, Human
caccaggcuggcgcag

SEQ ID NO: 2410448 - RNA, 15 nt, Human
caccaggcuggcgca

SEQ ID NO: 2410449 - RNA, 13 nt, Human
caccaggcuggcg

SEQ ID NO: 2410450 - RNA, 21 nt, Human
caccaggcugcucagggcugg

SEQ ID NO: 2410451 - RNA, 14 nt, Human
caccaggcugcuca

SEQ ID NO: 2410452 - RNA, 17 nt, Human
cacccagcccacuucug

SEQ ID NO: 2410453 - RNA, 16 nt, Human
cacccagcccacuucu

SEQ ID NO: 2410454 - RNA, 13 nt, Human
cacauuuuucuua

SEQ ID NO: 2410455 - RNA, 14 nt, Human
cacauuuuucuuag

SEQ ID NO: 2410456 - RNA, 17 nt, Human
cacauuuuuuaaaugca

SEQ ID NO: 2410457 - RNA, 21 nt, Human
cacauuuuuuaaaugcaccug

SEQ ID NO: 2410458 - RNA, 21 nt, Human
caccaacauacucccaucugu

SEQ ID NO: 2410459 - RNA, 20 nt, Human
caccaacauacucccaucug

SEQ ID NO: 2410460 - RNA, 17 nt, Human
caccaacauacucccau

SEQ ID NO: 2410461 - RNA, 18 nt, Human
cacauuuuucagauauaa

SEQ ID NO: 2410462 - RNA, 18 nt, Human
cacaucuugcucugcuga

SEQ ID NO: 2410463 - RNA, 19 nt, Human
cacaucuugcucugcugac

SEQ ID NO: 2410464 - RNA, 17 nt, Human
cacaucuaagccugaag

SEQ ID NO: 2410465 - RNA, 18 nt, Human
cacauuuccccagaccug

SEQ ID NO: 2410466 - RNA, 17 nt, Human
cacauuuggaauacuuu

SEQ ID NO: 2410467 - RNA, 19 nt, Human
cacauuuggaauacuuuuu

SEQ ID NO: 2410468 - RNA, 16 nt, Human
cacauuuggaauacuu

SEQ ID NO: 2410469 - RNA, 17 nt, Human
cacauuugauucugugu

SEQ ID NO: 2410470 - RNA, 15 nt, Human
cacauuuuauuuuau

SEQ ID NO: 2410471 - RNA, 18 nt, Human
cacauuuuccuuuucaaa

SEQ ID NO: 2410472 - RNA, 21 nt, Human
cacauuuuguauaauuguauc

SEQ ID NO: 2410473 - RNA, 16 nt, Human
cacauuuuguauaauu

SEQ ID NO: 2410474 - RNA, 15 nt, Human
cacauuuuguauaau

SEQ ID NO: 2410475 - RNA, 13 nt, Human
cacauuuuguaua

SEQ ID NO: 2410476 - RNA, 12 nt, Human
cacauuuuguau

SEQ ID NO: 2410477 - RNA, 22 nt, Human
cacauuuuguauaauuguaucg

SEQ ID NO: 2410478 - RNA, 14 nt, Human
cacauuuuucagau

SEQ ID NO: 2410479 - RNA, 20 nt, Human
cacaucagcacgauuucugu

SEQ ID NO: 2410480 - RNA, 21 nt, Human
cacaucagcacgauuucuguu

SEQ ID NO: 2410481 - RNA, 17 nt, Human
cacaucuugcucugcug

SEQ ID NO: 2410482 - RNA, 16 nt, Human
cacaucuugcucugcu

SEQ ID NO: 2410483 - RNA, 17 nt, Human
cacaucuaaccucaucu

SEQ ID NO: 2410484 - RNA, 13 nt, Human
cacaucuaagccu

SEQ ID NO: 2410485 - RNA, 14 nt, Human
cacaucuaagccug

SEQ ID NO: 2410486 - RNA, 15 nt, Human
cacauccuuucuaaa

SEQ ID NO: 2410487 - RNA, 22 nt, Human
cacauccuccacguucugcuca

SEQ ID NO: 2410488 - RNA, 14 nt, Human
cacauccuccgucc

SEQ ID NO: 2410489 - RNA, 18 nt, Human
cacauccuccguccagcc

SEQ ID NO: 2410490 - RNA, 17 nt, Human
cacauccuguguuucua

SEQ ID NO: 2410491 - RNA, 19 nt, Human
cacauccuaugcaauauau

SEQ ID NO: 2410492 - RNA, 22 nt, Human
cacaucagcacgauuucuguuu

SEQ ID NO: 2410493 - RNA, 22 nt, Human
cacaucccaggcuucacccuga

SEQ ID NO: 2410494 - RNA, 12 nt, Human
cacaucccaggc

SEQ ID NO: 2410495 - RNA, 24 nt, Human
cacaucagcuccacuuucagugaa

SEQ ID NO: 2410496 - RNA, 13 nt, Human
cacaguagucuug

SEQ ID NO: 2410497 - RNA, 19 nt, Human
cacaguauuacuucugcua

SEQ ID NO: 2410498 - RNA, 18 nt, Human
cacaguauuacuucugcu

SEQ ID NO: 2410499 - RNA, 14 nt, Human
cacaggucuuuccu

SEQ ID NO: 2410500 - RNA, 16 nt, Human
cacaguagucuugaug

SEQ ID NO: 2410501 - RNA, 16 nt, Human
cacaguauuacuucug

SEQ ID NO: 2410502 - RNA, 14 nt, Human
cacagaagccagga

SEQ ID NO: 2410503 - RNA, 18 nt, Human
cacagaagccaggagcaa

SEQ ID NO: 2410504 - RNA, 16 nt, Human
cacagaagccaggagc

SEQ ID NO: 2410505 - RNA, 23 nt, Human
cacagaagccaggagcaaauguu

SEQ ID NO: 2410506 - RNA, 22 nt, Human
cacagacacacacacgcacgca

SEQ ID NO: 2410507 - RNA, 20 nt, Human
cacagacacacacacgcacg

SEQ ID NO: 2410508 - RNA, 18 nt, Human
cacagacacacacacgca

SEQ ID NO: 2410509 - RNA, 17 nt, Human
cacagacacacacacgc

SEQ ID NO: 2410510 - RNA, 14 nt, Human
cacagacacacaca

SEQ ID NO: 2410511 - RNA, 13 nt, Human
cacagacacacac

SEQ ID NO: 2410512 - RNA, 12 nt, Human
cacagacacaca

SEQ ID NO: 2410513 - RNA, 19 nt, Human
cacagaaucauaugauucu

SEQ ID NO: 2410514 - RNA, 21 nt, Human
cacagacccugcccugugggc

SEQ ID NO: 2410515 - RNA, 20 nt, Human
cacagacccugcccuguggg

SEQ ID NO: 2410516 - RNA, 19 nt, Human
cacagacccugcccugugg

SEQ ID NO: 2410517 - RNA, 16 nt, Human
cacagcuaacauggaa

SEQ ID NO: 2410518 - RNA, 15 nt, Human
cacagcuaacaugga

SEQ ID NO: 2410519 - RNA, 16 nt, Human
cacagcggccccugca

SEQ ID NO: 2410520 - RNA, 14 nt, Human
cacagcggccccug

SEQ ID NO: 2410521 - RNA, 21 nt, Human
cacagcggagguguggagccg

SEQ ID NO: 2410522 - RNA, 20 nt, Human
cacagcggggccccagggcu

SEQ ID NO: 2410523 - RNA, 14 nt, Human
cacagcucuguguu

SEQ ID NO: 2410524 - RNA, 10 nt, Human
cacagcucuu

SEQ ID NO: 2410525 - RNA, 23 nt, Human
cacagcucuguccugggagugag

SEQ ID NO: 2410526 - RNA, 20 nt, Human
cacagcucuguccugggagu

SEQ ID NO: 2410527 - RNA, 19 nt, Human
cacagcucccaccccaccc

SEQ ID NO: 2410528 - RNA, 22 nt, Human
cacagcucccaccccacccccu

SEQ ID NO: 2410529 - RNA, 14 nt, Human
cacagcucccaccc

SEQ ID NO: 2410530 - RNA, 15 nt, Human
cacagcucccacccc

SEQ ID NO: 2410531 - RNA, 16 nt, Human
cacagcucccacccca

SEQ ID NO: 2410532 - RNA, 17 nt, Human
cacagcucccaccccac

SEQ ID NO: 2410533 - RNA, 12 nt, Human
cacagcuaugaa

SEQ ID NO: 2410534 - RNA, 22 nt, Human
cacagcuaugaaggcuguacac

SEQ ID NO: 2410535 - RNA, 22 nt, Human
cacagcuaacauggaaguacua

SEQ ID NO: 2410536 - RNA, 21 nt, Human
cacagcuaacaauugugaagu

SEQ ID NO: 2410537 - RNA, 20 nt, Human
cacagcuaacaauugugaag

SEQ ID NO: 2410538 - RNA, 19 nt, Human
cacagcguccuguccacac

SEQ ID NO: 2410539 - RNA, 21 nt, Human
cacagcuaacacacagcuccc

SEQ ID NO: 2410540 - RNA, 20 nt, Human
cacagcuaacacacagcucc

SEQ ID NO: 2410541 - RNA, 15 nt, Human
cacagcuaccucuuc

SEQ ID NO: 2410542 - RNA, 21 nt, Human
cacagggccuuuggcaggugc

SEQ ID NO: 2410543 - RNA, 20 nt, Human
cacagggcaugccccggcca

SEQ ID NO: 2410544 - RNA, 23 nt, Human
cacagggcaugccccggccaccu

SEQ ID NO: 2410545 - RNA, 14 nt, Human
cacagggccccaga

SEQ ID NO: 2410546 - RNA, 19 nt, Human
cacagggccccagaaggca

SEQ ID NO: 2410547 - RNA, 22 nt, Human
cacagggccccagaaggcaggg

SEQ ID NO: 2410548 - RNA, 19 nt, Human
cacagggcagcugggccca

SEQ ID NO: 2410549 - RNA, 18 nt, Human
cacagggcagcugggccc

SEQ ID NO: 2410550 - RNA, 17 nt, Human
cacagggcagcugggcc

SEQ ID NO: 2410551 - RNA, 16 nt, Human
cacagggcagcugggc

SEQ ID NO: 2410552 - RNA, 22 nt, Human
cacagggcagcugggcccaacc

SEQ ID NO: 2410553 - RNA, 21 nt, Human
cacagggcagcugggcccaac

SEQ ID NO: 2410554 - RNA, 15 nt, Human
cacagggauccgacu

SEQ ID NO: 2410555 - RNA, 13 nt, Human
cacagggcagagc

SEQ ID NO: 2410556 - RNA, 14 nt, Human
cacagggcagagcc

SEQ ID NO: 2410557 - RNA, 17 nt, Human
cacagggcagagccggg

SEQ ID NO: 2410558 - RNA, 19 nt, Human
cacagggucugcucuuucu

SEQ ID NO: 2410559 - RNA, 17 nt, Human
cacagggucugcucuuu

SEQ ID NO: 2410560 - RNA, 16 nt, Human
cacagggucugcucuu

SEQ ID NO: 2410561 - RNA, 13 nt, Human
cacagggcgagac

SEQ ID NO: 2410562 - RNA, 23 nt, Human
cacagggucugcucuuucucugc

SEQ ID NO: 2410563 - RNA, 21 nt, Human
cacaggguucaaaaugucugu

SEQ ID NO: 2410564 - RNA, 14 nt, Human
cacaggguugggcc

SEQ ID NO: 2410565 - RNA, 16 nt, Human
cacaggguugggccca

SEQ ID NO: 2410566 - RNA, 18 nt, Human
cacaggguugggcccaga

SEQ ID NO: 2410567 - RNA, 22 nt, Human
cacaggguugggcccagaucug

SEQ ID NO: 2410568 - RNA, 23 nt, Human
cacaggguugggcccagaucugg

SEQ ID NO: 2410569 - RNA, 23 nt, Human
cacagguaugaccuucuaggaag

SEQ ID NO: 2410570 - RNA, 19 nt, Human
caccuuguuggagccugca

SEQ ID NO: 2410571 - RNA, 14 nt, Human
caccuuguuggagc

SEQ ID NO: 2410572 - RNA, 21 nt, Human
caccuugugucuguacacgug

SEQ ID NO: 2410573 - RNA, 17 nt, Human
caccuugugucuguaca

SEQ ID NO: 2410574 - RNA, 15 nt, Human
caccuugugucugua

SEQ ID NO: 2410575 - RNA, 14 nt, Human
caccuuguggcaag

SEQ ID NO: 2410576 - RNA, 20 nt, Human
caccuuggggcuugacuuuu

SEQ ID NO: 2410577 - RNA, 14 nt, Human
caccuuugaagaag

SEQ ID NO: 2410578 - RNA, 21 nt, Human
caccuuguuggagccugcagg

SEQ ID NO: 2410579 - RNA, 14 nt, Human
caccuuuaaagugu

SEQ ID NO: 2410580 - RNA, 12 nt, Human
caccuuuauuaa

SEQ ID NO: 2410581 - RNA, 14 nt, Human
caccuuuauuaaaa

SEQ ID NO: 2410582 - RNA, 15 nt, Human
caccuuuauuaaaau

SEQ ID NO: 2410583 - RNA, 15 nt, Human
caccuuuguccccac

SEQ ID NO: 2410584 - RNA, 14 nt, Human
caccuuugucccca

SEQ ID NO: 2410585 - RNA, 17 nt, Human
caccuuuguccccaccg

SEQ ID NO: 2410586 - RNA, 15 nt, Human
caccuuugcaggcau

SEQ ID NO: 2410587 - RNA, 17 nt, Human
caccuuuauuaaaaucu

SEQ ID NO: 2410588 - RNA, 18 nt, Human
caccuuuauuaaaaucuu

SEQ ID NO: 2410589 - RNA, 18 nt, Human
caccuuggggcuugacuu

SEQ ID NO: 2410590 - RNA, 22 nt, Human
caccuuggacauccuccuccca

SEQ ID NO: 2410591 - RNA, 17 nt, Human
caccuuggcaccagaca

SEQ ID NO: 2410592 - RNA, 13 nt, Human
caccuuggcucaa

SEQ ID NO: 2410593 - RNA, 21 nt, Human
caccuuggacauccuccuccc

SEQ ID NO: 2410594 - RNA, 18 nt, Human
caccuuggacauccuccu

SEQ ID NO: 2410595 - RNA, 17 nt, Human
caccuuggacauccucc

SEQ ID NO: 2410596 - RNA, 16 nt, Human
caccuuggacauccuc

SEQ ID NO: 2410597 - RNA, 14 nt, Human
caccuugcggggau

SEQ ID NO: 2410598 - RNA, 18 nt, Human
caccuugcaacacacaga

SEQ ID NO: 2410599 - RNA, 21 nt, Human
caccuugcaacacacagacac

SEQ ID NO: 2410600 - RNA, 17 nt, Human
caccugccagggacaga

SEQ ID NO: 2410601 - RNA, 19 nt, Human
caccuugacagggcacacc

SEQ ID NO: 2410602 - RNA, 17 nt, Human
caccugccauuugcacc

SEQ ID NO: 2410603 - RNA, 16 nt, Human
caccuugcaacacaca

SEQ ID NO: 2410604 - RNA, 17 nt, Human
caccuugcaacacacag

SEQ ID NO: 2410605 - RNA, 14 nt, Human
caccguucugugca

SEQ ID NO: 2410606 - RNA, 15 nt, Human
caccguucugugcac

SEQ ID NO: 2410607 - RNA, 18 nt, Human
caccguguaaaccaaagc

SEQ ID NO: 2410608 - RNA, 21 nt, Human
caccguuggggauuggggaag

SEQ ID NO: 2410609 - RNA, 13 nt, Human
caccguucugugc

SEQ ID NO: 2410610 - RNA, 16 nt, Human
caccguguaaaccaaa

SEQ ID NO: 2410611 - RNA, 21 nt, Human
caccuacaugagguacugaga

SEQ ID NO: 2410612 - RNA, 19 nt, Human
caccuaaucaggcugaggu

SEQ ID NO: 2410613 - RNA, 23 nt, Human
caccuacaguguacagucuugua

SEQ ID NO: 2410614 - RNA, 18 nt, Human
caccuaagggacauguuu

SEQ ID NO: 2410615 - RNA, 13 nt, Human
caccuaagggaca

SEQ ID NO: 2410616 - RNA, 19 nt, Human
caccuaagggacauguuuu

SEQ ID NO: 2410617 - RNA, 18 nt, Human
caccuaccaucagggaca

SEQ ID NO: 2410618 - RNA, 17 nt, Human
caccuaccaucagggac

SEQ ID NO: 2410619 - RNA, 22 nt, Human
caccuaccaucagggacaggau

SEQ ID NO: 2410620 - RNA, 20 nt, Human
caccuaccaccacgcccggc

SEQ ID NO: 2410621 - RNA, 21 nt, Human
caccuaucucgugggagagcc

SEQ ID NO: 2410622 - RNA, 19 nt, Human
caccuaugucauuucauuu

SEQ ID NO: 2410623 - RNA, 21 nt, Human
caccuacuacaucgcccucca

SEQ ID NO: 2410624 - RNA, 20 nt, Human
caccuacuacaucgcccucc

SEQ ID NO: 2410625 - RNA, 17 nt, Human
caccuaugugccaacug

SEQ ID NO: 2410626 - RNA, 14 nt, Human
caccuaugugccaa

SEQ ID NO: 2410627 - RNA, 12 nt, Human
caccuaugugcc

SEQ ID NO: 2410628 - RNA, 20 nt, Human
caccuaugucauuucauuuc

SEQ ID NO: 2410629 - RNA, 23 nt, Human
caccuaugucauuucauuuccua

SEQ ID NO: 2410630 - RNA, 21 nt, Human
caccuaugugccaacuguugu

SEQ ID NO: 2410631 - RNA, 13 nt, Human
caccuauuuccau

SEQ ID NO: 2410632 - RNA, 16 nt, Human
caccugccagggacag

SEQ ID NO: 2410633 - RNA, 14 nt, Human
caccugccagggac

SEQ ID NO: 2410634 - RNA, 23 nt, Human
caccucaaaauaccaugccauuu

SEQ ID NO: 2410635 - RNA, 13 nt, Human
caccugccaggga

SEQ ID NO: 2410636 - RNA, 21 nt, Human
caccucacagaaaugagauca

SEQ ID NO: 2410637 - RNA, 19 nt, Human
cacugaagaaaccuucaga

SEQ ID NO: 2410638 - RNA, 20 nt, Human
cacugaacuuugcugagccu

SEQ ID NO: 2410639 - RNA, 18 nt, Human
cacugaaaacaucuggaa

SEQ ID NO: 2410640 - RNA, 15 nt, Human
cacugaaaacaucug

SEQ ID NO: 2410641 - RNA, 16 nt, Human
cacugaaaacaucugg

SEQ ID NO: 2410642 - RNA, 16 nt, Human
cacugaaauauacaca

SEQ ID NO: 2410643 - RNA, 20 nt, Human
cacugaaauauacacacagc

SEQ ID NO: 2410644 - RNA, 17 nt, Human
cacucuuggagccugca

SEQ ID NO: 2410645 - RNA, 19 nt, Human
cacucuuggagccugcaga

SEQ ID NO: 2410646 - RNA, 23 nt, Human
cacugaaaaaucuaagugauaua

SEQ ID NO: 2410647 - RNA, 20 nt, Human
cacugaaaaaucuaagugau

SEQ ID NO: 2410648 - RNA, 22 nt, Human
cacuaggcccccacuugccucu

SEQ ID NO: 2410649 - RNA, 21 nt, Human
cacuaggcccccacuugccuc

SEQ ID NO: 2410650 - RNA, 13 nt, Human
cacucccacuucc

SEQ ID NO: 2410651 - RNA, 14 nt, Human
cacucccacuuccc

SEQ ID NO: 2410652 - RNA, 15 nt, Human
cacucccacuucccu

SEQ ID NO: 2410653 - RNA, 15 nt, Human
cacuccccaccuuca

SEQ ID NO: 2410654 - RNA, 13 nt, Human
cacucccagugcu

SEQ ID NO: 2410655 - RNA, 15 nt, Human
cacucccaggcagcc

SEQ ID NO: 2410656 - RNA, 14 nt, Human
cacucccaggcagc

SEQ ID NO: 2410657 - RNA, 13 nt, Human
cacucccaggcag

SEQ ID NO: 2410658 - RNA, 14 nt, Human
cacuccccaccuuc

SEQ ID NO: 2410659 - RNA, 15 nt, Human
cacuacugacaugug

SEQ ID NO: 2410660 - RNA, 13 nt, Human
cacuacucugugc

SEQ ID NO: 2410661 - RNA, 20 nt, Human
cacuacuccucugcagugcc

SEQ ID NO: 2410662 - RNA, 13 nt, Human
cacuacugacaug

SEQ ID NO: 2410663 - RNA, 14 nt, Human
cacuacucugugcc

SEQ ID NO: 2410664 - RNA, 23 nt, Human
cacuagcccaaugaaaugaauua

SEQ ID NO: 2410665 - RNA, 14 nt, Human
cacuagccucucca

SEQ ID NO: 2410666 - RNA, 16 nt, Human
cacuagccucuccagg

SEQ ID NO: 2410667 - RNA, 17 nt, Human
cacuagccucuccagga

SEQ ID NO: 2410668 - RNA, 22 nt, Human
cacuagccuuuggcucuggaga

SEQ ID NO: 2410669 - RNA, 21 nt, Human
cacuagccuuuggcucuggag

SEQ ID NO: 2410670 - RNA, 16 nt, Human
cacuaggacucugagg

SEQ ID NO: 2410671 - RNA, 20 nt, Human
cacuagccuuuggcucugga

SEQ ID NO: 2410672 - RNA, 18 nt, Human
cacuagccuuuggcucug

SEQ ID NO: 2410673 - RNA, 17 nt, Human
cacuagccuuuggcucu

SEQ ID NO: 2410674 - RNA, 21 nt, Human
cacuagccucuccaggaaugc

SEQ ID NO: 2410675 - RNA, 20 nt, Human
cacuaggcccccacuugccu

SEQ ID NO: 2410676 - RNA, 17 nt, Human
cacuaggcccccacuug

SEQ ID NO: 2410677 - RNA, 17 nt, Human
cacuaggacucugaggc

SEQ ID NO: 2410678 - RNA, 18 nt, Human
cacuaggacucugaggcu

SEQ ID NO: 2410679 - RNA, 19 nt, Human
cacucuuauugcccacgcu

SEQ ID NO: 2410680 - RNA, 18 nt, Human
cacucuuauugcccacgc

SEQ ID NO: 2410681 - RNA, 17 nt, Human
cacucuuauugcccacg

SEQ ID NO: 2410682 - RNA, 18 nt, Human
cacuccccgaagucuuuu

SEQ ID NO: 2410683 - RNA, 19 nt, Human
cacuccccgaagucuuuug

SEQ ID NO: 2410684 - RNA, 17 nt, Human
cacucuugaaaaaugca

SEQ ID NO: 2410685 - RNA, 11 nt, Human
cacucuuccag

SEQ ID NO: 2410686 - RNA, 11 nt, Human
cacucuuccaa

SEQ ID NO: 2410687 - RNA, 15 nt, Human
cacucuuggagccug

SEQ ID NO: 2410688 - RNA, 16 nt, Human
cacucuuggagccugc

SEQ ID NO: 2410689 - RNA, 14 nt, Human
cacucuuggagccu

SEQ ID NO: 2410690 - RNA, 14 nt, Human
cacucuuccugagu

SEQ ID NO: 2410691 - RNA, 21 nt, Human
cacucuuccagaaucccaaga

SEQ ID NO: 2410692 - RNA, 17 nt, Human
cacucuuccugcaagga

SEQ ID NO: 2410693 - RNA, 19 nt, Human
cacggagcccagcccuccc

SEQ ID NO: 2410694 - RNA, 20 nt, Human
cacggagggugacgggggug

SEQ ID NO: 2410695 - RNA, 23 nt, Human
cacggagucguggggugugcugg

SEQ ID NO: 2410696 - RNA, 21 nt, Human
cacggaggcaucugcacccuc

SEQ ID NO: 2410697 - RNA, 14 nt, Human
cacggaucugagaa

SEQ ID NO: 2410698 - RNA, 13 nt, Human
cacggaucugaga

SEQ ID NO: 2410699 - RNA, 20 nt, Human
cacggauccauguagcagga

SEQ ID NO: 2410700 - RNA, 23 nt, Human
cacggauccauguagcaggacug

SEQ ID NO: 2410701 - RNA, 16 nt, Human
cacggccaggccagag

SEQ ID NO: 2410702 - RNA, 15 nt, Human
cacggccaggccaga

SEQ ID NO: 2410703 - RNA, 18 nt, Human
cacggaucugagaaucuu

SEQ ID NO: 2410704 - RNA, 14 nt, Human
cacggccaggccag

SEQ ID NO: 2410705 - RNA, 17 nt, Human
cacuaccuccucaggga

SEQ ID NO: 2410706 - RNA, 16 nt, Human
cacuaccuccucaggg

SEQ ID NO: 2410707 - RNA, 15 nt, Human
cacuaccuccucagg

SEQ ID NO: 2410708 - RNA, 20 nt, Human
cacuaccuccucagggaugg

SEQ ID NO: 2410709 - RNA, 18 nt, Human
cacuaccuccucagggau

SEQ ID NO: 2410710 - RNA, 19 nt, Human
cacuacuccucugcagugc

SEQ ID NO: 2410711 - RNA, 18 nt, Human
cacuacuccucugcagug

SEQ ID NO: 2410712 - RNA, 15 nt, Human
cacuacuccucugca

SEQ ID NO: 2410713 - RNA, 14 nt, Human
cacuacuccucugc

SEQ ID NO: 2410714 - RNA, 17 nt, Human
cacuacucacagucucu

SEQ ID NO: 2410715 - RNA, 23 nt, Human
cacuacggaauaguuggcuagga

SEQ ID NO: 2410716 - RNA, 17 nt, Human
cacuaauuugauguuua

SEQ ID NO: 2410717 - RNA, 22 nt, Human
cacuaaguuauaguauaucugg

SEQ ID NO: 2410718 - RNA, 20 nt, Human
cacggcaggacaacgaggaa

SEQ ID NO: 2410719 - RNA, 15 nt, Human
cacuaauacaccagg

SEQ ID NO: 2410720 - RNA, 17 nt, Human
cagaaauguguuaucac

SEQ ID NO: 2410721 - RNA, 21 nt, Human
cagaaauuggaacagaauguu

SEQ ID NO: 2410722 - RNA, 20 nt, Human
cagaaauuggaacagaaugu

SEQ ID NO: 2410723 - RNA, 11 nt, Human
cagaaauugga

SEQ ID NO: 2410724 - RNA, 23 nt, Human
cagaaauuagaaaccuuaauaug

SEQ ID NO: 2410725 - RNA, 16 nt, Human
cagaaauuagccgggc

SEQ ID NO: 2410726 - RNA, 22 nt, Human
cagaagugugauugggaauaaa

SEQ ID NO: 2410727 - RNA, 13 nt, Human
cagaagugugauu

SEQ ID NO: 2410728 - RNA, 16 nt, Human
cagaaguggagcuggg

SEQ ID NO: 2410729 - RNA, 15 nt, Human
cagaaguggagcugg

SEQ ID NO: 2410730 - RNA, 11 nt, Human
cagaaguguga

SEQ ID NO: 2410731 - RNA, 14 nt, Human
cagaaguggagcug

SEQ ID NO: 2410732 - RNA, 13 nt, Human
cagaaguggagcu

SEQ ID NO: 2410733 - RNA, 21 nt, Human
cagaagugagcuuugcugcua

SEQ ID NO: 2410734 - RNA, 20 nt, Human
cagaagugagcuuugcugcu

SEQ ID NO: 2410735 - RNA, 22 nt, Human
cagaagugagcuuugcugcuac

SEQ ID NO: 2410736 - RNA, 18 nt, Human
cagaagugagcuuugcug

SEQ ID NO: 2410737 - RNA, 17 nt, Human
cagaagugagcuuugcu

SEQ ID NO: 2410738 - RNA, 14 nt, Human
cagaacagcagagg

SEQ ID NO: 2410739 - RNA, 19 nt, Human
cagaaauuuuuauuuuucu

SEQ ID NO: 2410740 - RNA, 18 nt, Human
cagaaauuuuuauuuuuc

SEQ ID NO: 2410741 - RNA, 21 nt, Human
cagaacaagguucccucugag

SEQ ID NO: 2410742 - RNA, 18 nt, Human
cagaacacacuccaucag

SEQ ID NO: 2410743 - RNA, 22 nt, Human
cagaaauuuaauucauguuucu

SEQ ID NO: 2410744 - RNA, 15 nt, Human
cagaaauuuuuauuu

SEQ ID NO: 2410745 - RNA, 14 nt, Human
cagaaauuuuuauu

SEQ ID NO: 2410746 - RNA, 23 nt, Human
cagaaauuuaauucauguuucuu

SEQ ID NO: 2410747 - RNA, 15 nt, Human
cagaacacauaauuc

SEQ ID NO: 2410748 - RNA, 15 nt, Human
cagaacacuaaccug

SEQ ID NO: 2410749 - RNA, 13 nt, Human
cagaacacuaacc

SEQ ID NO: 2410750 - RNA, 21 nt, Human
cagaacagcagagguucuuuu

SEQ ID NO: 2410751 - RNA, 18 nt, Human
cagaagucaugaagccca

SEQ ID NO: 2410752 - RNA, 19 nt, Human
cagaagucaugaagcccaa

SEQ ID NO: 2410753 - RNA, 21 nt, Human
cagaacacuaaccugaccgug

SEQ ID NO: 2410754 - RNA, 12 nt, Human
cagaacagcaga

SEQ ID NO: 2410755 - RNA, 11 nt, Human
cagaacacugu

SEQ ID NO: 2410756 - RNA, 21 nt, Human
cagaaguuucugccgcagccc

SEQ ID NO: 2410757 - RNA, 20 nt, Human
cagaaguuucugccgcagcc

SEQ ID NO: 2410758 - RNA, 22 nt, Human
cagaaguuucugccgcagcccu

SEQ ID NO: 2410759 - RNA, 19 nt, Human
cagaauaaagcaauuuucc

SEQ ID NO: 2410760 - RNA, 18 nt, Human
cagaauaaagcaauuuuc

SEQ ID NO: 2410761 - RNA, 17 nt, Human
cagaauaaagcaauuuu

SEQ ID NO: 2410762 - RNA, 16 nt, Human
cagaauaaagcaauuu

SEQ ID NO: 2410763 - RNA, 15 nt, Human
cagaauaaagcaauu

SEQ ID NO: 2410764 - RNA, 14 nt, Human
cagaauaaagcaau

SEQ ID NO: 2410765 - RNA, 13 nt, Human
cagaauaaagcaa

SEQ ID NO: 2410766 - RNA, 12 nt, Human
cagaauaaagca

SEQ ID NO: 2410767 - RNA, 21 nt, Human
cagaauaaacuggcagcucag

SEQ ID NO: 2410768 - RNA, 16 nt, Human
cagaaguuuggcaaua

SEQ ID NO: 2410769 - RNA, 11 nt, Human
cagaauaaagc

SEQ ID NO: 2410770 - RNA, 19 nt, Human
cagaaguuugucaagucaa

SEQ ID NO: 2410771 - RNA, 20 nt, Human
cagaauaaguuauugcaguu

SEQ ID NO: 2410772 - RNA, 19 nt, Human
cagaauaaguuauugcagu

SEQ ID NO: 2410773 - RNA, 18 nt, Human
cagaauaaguuauugcag

SEQ ID NO: 2410774 - RNA, 17 nt, Human
cagaauaaguuauugca

SEQ ID NO: 2410775 - RNA, 23 nt, Human
cagaauaaagcaauuuuccuuga

SEQ ID NO: 2410776 - RNA, 22 nt, Human
cagaauaaagcaauuuuccuug

SEQ ID NO: 2410777 - RNA, 21 nt, Human
cagaauaaagcaauuuuccuu

SEQ ID NO: 2410778 - RNA, 20 nt, Human
cagaauaaagcaauuuuccu

SEQ ID NO: 2410779 - RNA, 15 nt, Human
cagaauaaguuauug

SEQ ID NO: 2410780 - RNA, 22 nt, Human
cagaauaaaguucugaguguuu

SEQ ID NO: 2410781 - RNA, 13 nt, Human
cagaauauugcuu

SEQ ID NO: 2410782 - RNA, 22 nt, Human
cagaauauuagugaccucagcu

SEQ ID NO: 2410783 - RNA, 12 nt, Human
cagaauaucugg

SEQ ID NO: 2410784 - RNA, 16 nt, Human
cagaauacuuuucucu

SEQ ID NO: 2410785 - RNA, 21 nt, Human
cagaauagccacauuuggaau

SEQ ID NO: 2410786 - RNA, 22 nt, Human
cagaauagccacauuuggaaua

SEQ ID NO: 2410787 - RNA, 15 nt, Human
cagaauagccacauu

SEQ ID NO: 2410788 - RNA, 21 nt, Human
cagaauagcaaggugcucaca

SEQ ID NO: 2410789 - RNA, 23 nt, Human
cagaauaaguuauugcaguuuau

SEQ ID NO: 2410790 - RNA, 21 nt, Human
cagaauaaguuauugcaguuu

SEQ ID NO: 2410791 - RNA, 17 nt, Human
cagaauaaucuuugggu

SEQ ID NO: 2410792 - RNA, 22 nt, Human
cagaauacuguuaaaggaaaaa

SEQ ID NO: 2410793 - RNA, 14 nt, Human
cagaauaaugaaug

SEQ ID NO: 2410794 - RNA, 23 nt, Human
cagaauaaugaauggacucaaac

SEQ ID NO: 2410795 - RNA, 23 nt, Human
cagaauacaguaagcugcucuau

SEQ ID NO: 2410796 - RNA, 20 nt, Human
cacuuacuguuucugucagg

SEQ ID NO: 2410797 - RNA, 18 nt, Human
cacuuacuguuucuguca

SEQ ID NO: 2410798 - RNA, 16 nt, Human
cacuuacuguuucugu

SEQ ID NO: 2410799 - RNA, 15 nt, Human
cacuuacuguuucug

SEQ ID NO: 2410800 - RNA, 16 nt, Human
cacuuacuugcuuauu

SEQ ID NO: 2410801 - RNA, 17 nt, Human
cacuuacuuacccucac

SEQ ID NO: 2410802 - RNA, 19 nt, Human
cacuuagaaauugcauuuc

SEQ ID NO: 2410803 - RNA, 17 nt, Human
cacuuagaaauugcauu

SEQ ID NO: 2410804 - RNA, 15 nt, Human
cacuuacugguagga

SEQ ID NO: 2410805 - RNA, 21 nt, Human
cacuuacugguaggaccaagc

SEQ ID NO: 2410806 - RNA, 18 nt, Human
cacuuacuguuguccuau

SEQ ID NO: 2410807 - RNA, 22 nt, Human
cacuuaccuucaauaaaguauc

SEQ ID NO: 2410808 - RNA, 12 nt, Human
cacuguuucucu

SEQ ID NO: 2410809 - RNA, 14 nt, Human
cacuguuucucugc

SEQ ID NO: 2410810 - RNA, 18 nt, Human
cacuguuucucugcuguu

SEQ ID NO: 2410811 - RNA, 19 nt, Human
cacuguuucaaacuuuacu

SEQ ID NO: 2410812 - RNA, 11 nt, Human
cacuguuuaag

SEQ ID NO: 2410813 - RNA, 22 nt, Human
cacuggugacugcgaucuucag

SEQ ID NO: 2410814 - RNA, 17 nt, Human
cacuguuuacaagaaaa

SEQ ID NO: 2410815 - RNA, 18 nt, Human
cacuguuuacaagaaaaa

SEQ ID NO: 2410816 - RNA, 17 nt, Human
cacuguugcccaggcug

SEQ ID NO: 2410817 - RNA, 24 nt, Human
cacuugugccaacacucaagaagc

SEQ ID NO: 2410818 - RNA, 18 nt, Human
cacuugugccaacacuca

SEQ ID NO: 2410819 - RNA, 22 nt, Human
cacuugugcacccucuauccca

SEQ ID NO: 2410820 - RNA, 17 nt, Human
cacuugugauuauuuau

SEQ ID NO: 2410821 - RNA, 23 nt, Human
cacuuguccccaaauccgaaccu

SEQ ID NO: 2410822 - RNA, 12 nt, Human
cacuugucccca

SEQ ID NO: 2410823 - RNA, 20 nt, Human
cacuuguccccaaauccgaa

SEQ ID NO: 2410824 - RNA, 22 nt, Human
cacuugucccacuaucugggug

SEQ ID NO: 2410825 - RNA, 20 nt, Human
cacuugucccacuaucuggg

SEQ ID NO: 2410826 - RNA, 19 nt, Human
cacuugucccacuaucugg

SEQ ID NO: 2410827 - RNA, 17 nt, Human
cacuuggucugugagau

SEQ ID NO: 2410828 - RNA, 20 nt, Human
cacuuggucugugagaugcu

SEQ ID NO: 2410829 - RNA, 20 nt, Human
cacuuagaaauugcauuucc

SEQ ID NO: 2410830 - RNA, 20 nt, Human
cacuuggugauauguccuau

SEQ ID NO: 2410831 - RNA, 16 nt, Human
cacuugguuggguccu

SEQ ID NO: 2410832 - RNA, 19 nt, Human
cacuugguuggguccucac

SEQ ID NO: 2410833 - RNA, 23 nt, Human
cacuuguccagcugagcgccagg

SEQ ID NO: 2410834 - RNA, 12 nt, Human
cacuuguacaaa

SEQ ID NO: 2410835 - RNA, 20 nt, Human
cacuugguuggguccucaca

SEQ ID NO: 2410836 - RNA, 21 nt, Human
cacuugguuggguccucacau

SEQ ID NO: 2410837 - RNA, 23 nt, Human
cacuggggauugggccccugcca

SEQ ID NO: 2410838 - RNA, 14 nt, Human
cacuggggcacuug

SEQ ID NO: 2410839 - RNA, 22 nt, Human
cacuggggagcccgucucagug

SEQ ID NO: 2410840 - RNA, 17 nt, Human
cacuggugacaugucuu

SEQ ID NO: 2410841 - RNA, 16 nt, Human
cacuguugcccaggcu

SEQ ID NO: 2410842 - RNA, 15 nt, Human
cacuguugcccaggc

SEQ ID NO: 2410843 - RNA, 21 nt, Human
cacugguggcccgacagccug

SEQ ID NO: 2410844 - RNA, 13 nt, Human
cacugguggcccg

SEQ ID NO: 2410845 - RNA, 22 nt, Human
cacugguggcccgacagccugg

SEQ ID NO: 2410846 - RNA, 14 nt, Human
cacuguugcccagg

SEQ ID NO: 2410847 - RNA, 20 nt, Human
cacugggcuuggggaccaga

SEQ ID NO: 2410848 - RNA, 22 nt, Human
cacugggcuuggggaccagagc

SEQ ID NO: 2410849 - RNA, 15 nt, Human
cacuggggauugggc

SEQ ID NO: 2410850 - RNA, 16 nt, Human
cacuggggauugggcc

SEQ ID NO: 2410851 - RNA, 17 nt, Human
cacuggggauugggccc

SEQ ID NO: 2410852 - RNA, 18 nt, Human
cacuggggauugggcccc

SEQ ID NO: 2410853 - RNA, 23 nt, Human
cacugggcuuggggaccagagcu

SEQ ID NO: 2410854 - RNA, 21 nt, Human
cacuggggagcccgucucagu

SEQ ID NO: 2410855 - RNA, 21 nt, Human
cacuggggaaauaacagcugu

SEQ ID NO: 2410856 - RNA, 21 nt, Human
cacuuuaugccggaugugcuu

SEQ ID NO: 2410857 - RNA, 22 nt, Human
cacuugugccaacacucaagaa

SEQ ID NO: 2410858 - RNA, 22 nt, Human
cacuuuaugccggaugugcuuu

SEQ ID NO: 2410859 - RNA, 17 nt, Human
cacuuucacauagaugu

SEQ ID NO: 2410860 - RNA, 15 nt, Human
cacuuuccuccuggc

SEQ ID NO: 2410861 - RNA, 19 nt, Human
cacuuucagugaaagcauc

SEQ ID NO: 2410862 - RNA, 18 nt, Human
cacuuucagugaaagcau

SEQ ID NO: 2410863 - RNA, 17 nt, Human
cacuuucagugaaagca

SEQ ID NO: 2410864 - RNA, 21 nt, Human
cagcggggacagcuccuucug

SEQ ID NO: 2410865 - RNA, 12 nt, Human
cagcgccuuucc

SEQ ID NO: 2410866 - RNA, 18 nt, Human
cagcggggccccagggcu

SEQ ID NO: 2410867 - RNA, 19 nt, Human
cagcggggacagcuccuuc

SEQ ID NO: 2410868 - RNA, 18 nt, Human
cagcggggacagcuccuu

SEQ ID NO: 2410869 - RNA, 15 nt, Human
cagcgcccuuccucu

SEQ ID NO: 2410870 - RNA, 14 nt, Human
cagcgcccuuccuc

SEQ ID NO: 2410871 - RNA, 13 nt, Human
cagcgcccuuccu

SEQ ID NO: 2410872 - RNA, 12 nt, Human
cagcgcccuucc

SEQ ID NO: 2410873 - RNA, 19 nt, Human
cagcgcccgcugggcugag

SEQ ID NO: 2410874 - RNA, 17 nt, Human
cagcgcccgcugggcug

SEQ ID NO: 2410875 - RNA, 16 nt, Human
cagcgcccgcugggcu

SEQ ID NO: 2410876 - RNA, 18 nt, Human
cagcgcccuuccucucca

SEQ ID NO: 2410877 - RNA, 16 nt, Human
cagcgcccuuccucuc

SEQ ID NO: 2410878 - RNA, 20 nt, Human
cagcgcccuuccucuccacc

SEQ ID NO: 2410879 - RNA, 22 nt, Human
cagcgccuaguggggucucccu

SEQ ID NO: 2410880 - RNA, 23 nt, Human
cagcgccuaguggggucucccuc

SEQ ID NO: 2410881 - RNA, 20 nt, Human
cagcgccaggcugaccacag

SEQ ID NO: 2410882 - RNA, 21 nt, Human
cagcgccaggcugaccacagc

SEQ ID NO: 2410883 - RNA, 14 nt, Human
cagcgcccgcuggg

SEQ ID NO: 2410884 - RNA, 22 nt, Human
cagcgccaggcugaccacagca

SEQ ID NO: 2410885 - RNA, 18 nt, Human
cagcgccaggcugaccac

SEQ ID NO: 2410886 - RNA, 19 nt, Human
cagcgccaggcugaccaca

SEQ ID NO: 2410887 - RNA, 12 nt, Human
cagcgccaggcu

SEQ ID NO: 2410888 - RNA, 12 nt, Human
cagccugcucca

SEQ ID NO: 2410889 - RNA, 19 nt, Human
cagccugcuaauuccccag

SEQ ID NO: 2410890 - RNA, 21 nt, Human
cagccucugaccccuccucac

SEQ ID NO: 2410891 - RNA, 20 nt, Human
cagccucugaccccuccuca

SEQ ID NO: 2410892 - RNA, 19 nt, Human
cagccucugaccccuccuc

SEQ ID NO: 2410893 - RNA, 18 nt, Human
cagccucugaccccuccu

SEQ ID NO: 2410894 - RNA, 17 nt, Human
cagccucugaccccucc

SEQ ID NO: 2410895 - RNA, 16 nt, Human
cagccucugaccccuc

SEQ ID NO: 2410896 - RNA, 15 nt, Human
cagccucugaccccu

SEQ ID NO: 2410897 - RNA, 14 nt, Human
cagccucugacccc

SEQ ID NO: 2410898 - RNA, 13 nt, Human
cagccucuggcau

SEQ ID NO: 2410899 - RNA, 19 nt, Human
cagccucugagccccuggg

SEQ ID NO: 2410900 - RNA, 21 nt, Human
cagccucugagccccugggac

SEQ ID NO: 2410901 - RNA, 23 nt, Human
cagccucugaccccuccucacug

SEQ ID NO: 2410902 - RNA, 22 nt, Human
cagccucugaccccuccucacu

SEQ ID NO: 2410903 - RNA, 23 nt, Human
cagccucugacuuaagcugccuc

SEQ ID NO: 2410904 - RNA, 18 nt, Human
cagccucugagccccugg

SEQ ID NO: 2410905 - RNA, 17 nt, Human
cagccucugaaaaccaa

SEQ ID NO: 2410906 - RNA, 13 nt, Human
cagccgcugcccg

SEQ ID NO: 2410907 - RNA, 12 nt, Human
cagccgcugccc

SEQ ID NO: 2410908 - RNA, 20 nt, Human
cagccgcugagcgaggagau

SEQ ID NO: 2410909 - RNA, 15 nt, Human
cagccgcugcccggc

SEQ ID NO: 2410910 - RNA, 13 nt, Human
cagccucugaccc

SEQ ID NO: 2410911 - RNA, 21 nt, Human
cagccgcucggaggccccaaa

SEQ ID NO: 2410912 - RNA, 20 nt, Human
cagccgcucggaggccccaa

SEQ ID NO: 2410913 - RNA, 19 nt, Human
cagccgcucggaggcccca

SEQ ID NO: 2410914 - RNA, 23 nt, Human
cagccgcucggaggccccaaagg

SEQ ID NO: 2410915 - RNA, 19 nt, Human
cagccgcugagcgaggaga

SEQ ID NO: 2410916 - RNA, 20 nt, Human
cagccgcuccugucugccag

SEQ ID NO: 2410917 - RNA, 21 nt, Human
cagccgcuccugucugccagc

SEQ ID NO: 2410918 - RNA, 22 nt, Human
cagccgcuccugucugccagcc

SEQ ID NO: 2410919 - RNA, 23 nt, Human
cagccgcuccugucugccagcca

SEQ ID NO: 2410920 - RNA, 19 nt, Human
cagccgagauagccaaggc

SEQ ID NO: 2410921 - RNA, 20 nt, Human
cagcccuuugggaggcugag

SEQ ID NO: 2410922 - RNA, 23 nt, Human
cagcccuuugggaggcugaggcg

SEQ ID NO: 2410923 - RNA, 14 nt, Human
cagcccuuggccag

SEQ ID NO: 2410924 - RNA, 19 nt, Human
cagcccuuugggaggcuga

SEQ ID NO: 2410925 - RNA, 14 nt, Human
cagccgcuccuguc

SEQ ID NO: 2410926 - RNA, 16 nt, Human
cagccgcuccugucug

SEQ ID NO: 2410927 - RNA, 17 nt, Human
cagccgcuccugucugc

SEQ ID NO: 2410928 - RNA, 18 nt, Human
cagccgcuccugucugcc

SEQ ID NO: 2410929 - RNA, 19 nt, Human
cagccgcuccugucugcca

SEQ ID NO: 2410930 - RNA, 13 nt, Human
cagcccuuggcca

SEQ ID NO: 2410931 - RNA, 12 nt, Human
cagcccuuggcc

SEQ ID NO: 2410932 - RNA, 15 nt, Human
cagcccuugcuuguu

SEQ ID NO: 2410933 - RNA, 14 nt, Human
cagcccuugcuugu

SEQ ID NO: 2410934 - RNA, 13 nt, Human
cagcccuugcuug

SEQ ID NO: 2410935 - RNA, 12 nt, Human
cagcccuugcuu

SEQ ID NO: 2410936 - RNA, 11 nt, Human
cagcccuugcu

SEQ ID NO: 2410937 - RNA, 20 nt, Human
cagcccuugagcuccccaaa

SEQ ID NO: 2410938 - RNA, 16 nt, Human
caggaaaagcugcuga

SEQ ID NO: 2410939 - RNA, 15 nt, Human
caggaaaagcugcug

SEQ ID NO: 2410940 - RNA, 18 nt, Human
caggaaaagcugcugaca

SEQ ID NO: 2410941 - RNA, 19 nt, Human
caggaaaagccucuguguc

SEQ ID NO: 2410942 - RNA, 18 nt, Human
caggaaaagccucugugu

SEQ ID NO: 2410943 - RNA, 17 nt, Human
caggaaaagccucugug

SEQ ID NO: 2410944 - RNA, 23 nt, Human
caggaaaacugacagaggagggc

SEQ ID NO: 2410945 - RNA, 20 nt, Human
cagcucccaccccacccccu

SEQ ID NO: 2410946 - RNA, 17 nt, Human
cagcucccccugucccc

SEQ ID NO: 2410947 - RNA, 16 nt, Human
cagcucccccuguccc

SEQ ID NO: 2410948 - RNA, 15 nt, Human
cagcucccccugucc

SEQ ID NO: 2410949 - RNA, 14 nt, Human
cagcucccccuguc

SEQ ID NO: 2410950 - RNA, 13 nt, Human
cagcucccccugu

SEQ ID NO: 2410951 - RNA, 10 nt, Human
cagcuccccc

SEQ ID NO: 2410952 - RNA, 12 nt, Human
cagcucccccgg

SEQ ID NO: 2410953 - RNA, 22 nt, Human
cagcucccccgacggugggcau

SEQ ID NO: 2410954 - RNA, 24 nt, Human
cagcuccccagaguccucuaugaa

SEQ ID NO: 2410955 - RNA, 15 nt, Human
cagcuccccagaguc

SEQ ID NO: 2410956 - RNA, 13 nt, Human
cagcuccccagag

SEQ ID NO: 2410957 - RNA, 13 nt, Human
cagcuccccaaga

SEQ ID NO: 2410958 - RNA, 20 nt, Human
cagcucccauuucuacucuu

SEQ ID NO: 2410959 - RNA, 19 nt, Human
cagcucccauuucuacucu

SEQ ID NO: 2410960 - RNA, 17 nt, Human
cagcucccauuucuacu

SEQ ID NO: 2410961 - RNA, 14 nt, Human
cagcucccauuucu

SEQ ID NO: 2410962 - RNA, 23 nt, Human
cagcucccauaaccgcugauucu

SEQ ID NO: 2410963 - RNA, 22 nt, Human
cagcucccaccccacccccuuc

SEQ ID NO: 2410964 - RNA, 23 nt, Human
cagcucccaccccacccccuuca

SEQ ID NO: 2410965 - RNA, 21 nt, Human
cagcuccccucggagaagagc

SEQ ID NO: 2410966 - RNA, 22 nt, Human
cagcuccccucggagaagagcu

SEQ ID NO: 2410967 - RNA, 20 nt, Human
cagcucccuaggagaccaag

SEQ ID NO: 2410968 - RNA, 18 nt, Human
cagcucccuaggagacca

SEQ ID NO: 2410969 - RNA, 19 nt, Human
cagcucccuaggagaccaa

SEQ ID NO: 2410970 - RNA, 18 nt, Human
cagcucccccuguccccu

SEQ ID NO: 2410971 - RNA, 15 nt, Human
cagcucccuaggaga

SEQ ID NO: 2410972 - RNA, 19 nt, Human
cagcuccucauccagggcu

SEQ ID NO: 2410973 - RNA, 15 nt, Human
cagcuccucauccag

SEQ ID NO: 2410974 - RNA, 19 nt, Human
cagcuccuaacccuuauca

SEQ ID NO: 2410975 - RNA, 13 nt, Human
cagcuccuaaccc

SEQ ID NO: 2410976 - RNA, 21 nt, Human
cagcuccucccuuguucucua

SEQ ID NO: 2410977 - RNA, 20 nt, Human
cagcuccucauccagggcuc

SEQ ID NO: 2410978 - RNA, 14 nt, Human
cagcuccucccaca

SEQ ID NO: 2410979 - RNA, 16 nt, Human
cagcuccggccugucc

SEQ ID NO: 2410980 - RNA, 21 nt, Human
cagcuccggccuguccuccaa

SEQ ID NO: 2410981 - RNA, 15 nt, Human
cagcucccuucucug

SEQ ID NO: 2410982 - RNA, 14 nt, Human
cagcucccuucucu

SEQ ID NO: 2410983 - RNA, 14 nt, Human
cagcucccucugcc

SEQ ID NO: 2410984 - RNA, 15 nt, Human
cagcucccucugccu

SEQ ID NO: 2410985 - RNA, 16 nt, Human
cagcucccucugccug

SEQ ID NO: 2410986 - RNA, 20 nt, Human
cagcugugcucuggacaggc

SEQ ID NO: 2410987 - RNA, 19 nt, Human
cagcugugcucuggacagg

SEQ ID NO: 2410988 - RNA, 24 nt, Human
cagcugugcucuggacaggcaugu

SEQ ID NO: 2410989 - RNA, 19 nt, Human
cagcuguucagcugguuga

SEQ ID NO: 2410990 - RNA, 15 nt, Human
cagcuuaaaguaacc

SEQ ID NO: 2410991 - RNA, 21 nt, Human
cagcuguuuuaguuaaauuuc

SEQ ID NO: 2410992 - RNA, 21 nt, Human
cagcuguuuaaauguuuuucu

SEQ ID NO: 2410993 - RNA, 14 nt, Human
cagcuguuuaagau

SEQ ID NO: 2410994 - RNA, 14 nt, Human
cagcuguuugucau

SEQ ID NO: 2410995 - RNA, 20 nt, Human
cagcuguuuuaguuaaauuu

SEQ ID NO: 2410996 - RNA, 15 nt, Human
cagcuguuugucaua

SEQ ID NO: 2410997 - RNA, 20 nt, Human
cagcuguucugucccuugga

SEQ ID NO: 2410998 - RNA, 21 nt, Human
cagcuguuuaugcauagauaa

SEQ ID NO: 2410999 - RNA, 14 nt, Human
cagcugccugggau

SEQ ID NO: 2411000 - RNA, 13 nt, Human
cagcugccuggga

SEQ ID NO: 2411001 - RNA, 12 nt, Human
cagcugccuggg

SEQ ID NO: 2411002 - RNA, 12 nt, Human
cagcugccugca

SEQ ID NO: 2411003 - RNA, 15 nt, Human
cagcugauuuuaaca

SEQ ID NO: 2411004 - RNA, 17 nt, Human
cagcugauuuuaacaau

SEQ ID NO: 2411005 - RNA, 18 nt, Human
cagcugauguuggaagag

SEQ ID NO: 2411006 - RNA, 20 nt, Human
cagcugaugaguuacagccu

SEQ ID NO: 2411007 - RNA, 20 nt, Human
cagcugauguuggaagagaa

SEQ ID NO: 2411008 - RNA, 12 nt, Human
cagcugauuuua

SEQ ID NO: 2411009 - RNA, 14 nt, Human
cagcugaugaguua

SEQ ID NO: 2411010 - RNA, 23 nt, Human
cagcugauacaaauugcagacug

SEQ ID NO: 2411011 - RNA, 15 nt, Human
cagcugauacaaauu

SEQ ID NO: 2411012 - RNA, 19 nt, Human
cagcugagggugagugggu

SEQ ID NO: 2411013 - RNA, 19 nt, Human
cagcuccuccgugcuuccu

SEQ ID NO: 2411014 - RNA, 22 nt, Human
cagcuccucccuuguucucuaa

SEQ ID NO: 2411015 - RNA, 22 nt, Human
cagcuccuccgugcuuccucag

SEQ ID NO: 2411016 - RNA, 19 nt, Human
cagcugaggucucuugagg

SEQ ID NO: 2411017 - RNA, 20 nt, Human
cagcugaggucucuugaggg

SEQ ID NO: 2411018 - RNA, 19 nt, Human
cagauucuuuccugaggcu

SEQ ID NO: 2411019 - RNA, 18 nt, Human
cagauucuuuccugaggc

SEQ ID NO: 2411020 - RNA, 17 nt, Human
cagauucuuuccugagg

SEQ ID NO: 2411021 - RNA, 15 nt, Human
cagauucuuuccuga

SEQ ID NO: 2411022 - RNA, 19 nt, Human
cagauccccaagccuggca

SEQ ID NO: 2411023 - RNA, 15 nt, Human
cagauccccaagccu

SEQ ID NO: 2411024 - RNA, 13 nt, Human
cagauccucuugg

SEQ ID NO: 2411025 - RNA, 16 nt, Human
cagauccucacaacca

SEQ ID NO: 2411026 - RNA, 20 nt, Human
cagaucagcuccuaacccuu

SEQ ID NO: 2411027 - RNA, 16 nt, Human
cagaucaguguaccau

SEQ ID NO: 2411028 - RNA, 15 nt, Human
cagaucauccagaag

SEQ ID NO: 2411029 - RNA, 12 nt, Human
cagauccuggaa

SEQ ID NO: 2411030 - RNA, 14 nt, Human
cagauccucuuggu

SEQ ID NO: 2411031 - RNA, 23 nt, Human
cagaggggguggccucccaacuc

SEQ ID NO: 2411032 - RNA, 22 nt, Human
cagaggggguggccucccaacu

SEQ ID NO: 2411033 - RNA, 21 nt, Human
cagaaucaaagcaaugcauuu

SEQ ID NO: 2411034 - RNA, 20 nt, Human
cagaaucaaagcaaugcauu

SEQ ID NO: 2411035 - RNA, 15 nt, Human
cagaaucaaagcaau

SEQ ID NO: 2411036 - RNA, 13 nt, Human
cagaaucaaagca

SEQ ID NO: 2411037 - RNA, 15 nt, Human
cagaauaucugggau

SEQ ID NO: 2411038 - RNA, 19 nt, Human
cagaaucauaugauucugc

SEQ ID NO: 2411039 - RNA, 16 nt, Human
cagaaucauaugauuc

SEQ ID NO: 2411040 - RNA, 23 nt, Human
cagaaucaaagcaaugcauuuug

SEQ ID NO: 2411041 - RNA, 19 nt, Human
cagaauccaagugaacacu

SEQ ID NO: 2411042 - RNA, 19 nt, Human
cagagguaacagaacagcu

SEQ ID NO: 2411043 - RNA, 18 nt, Human
cagagguaacagaacagc

SEQ ID NO: 2411044 - RNA, 17 nt, Human
cagagguaacagaacag

SEQ ID NO: 2411045 - RNA, 16 nt, Human
cagagguaacagaaca

SEQ ID NO: 2411046 - RNA, 15 nt, Human
cagagguaacagaac

SEQ ID NO: 2411047 - RNA, 14 nt, Human
cagagguaacagaa

SEQ ID NO: 2411048 - RNA, 13 nt, Human
cagagguaacaga

SEQ ID NO: 2411049 - RNA, 21 nt, Human
cagagguaaaagugugagcag

SEQ ID NO: 2411050 - RNA, 20 nt, Human
cagagguaaaagugugagca

SEQ ID NO: 2411051 - RNA, 18 nt, Human
cagagguaaaagugugag

SEQ ID NO: 2411052 - RNA, 15 nt, Human
cagaauccuggcccu

SEQ ID NO: 2411053 - RNA, 21 nt, Human
cagaaucauaugauucugcuu

SEQ ID NO: 2411054 - RNA, 21 nt, Human
cagaauccuggcccucugugu

SEQ ID NO: 2411055 - RNA, 16 nt, Human
cagaauccuggcccuc

SEQ ID NO: 2411056 - RNA, 20 nt, Human
cagagggguaggcagagccu

SEQ ID NO: 2411057 - RNA, 15 nt, Human
cagagggguaggcag

SEQ ID NO: 2411058 - RNA, 21 nt, Human
cagagggguaggcagagccuu

SEQ ID NO: 2411059 - RNA, 23 nt, Human
cagagggguggguuccucuuccc

SEQ ID NO: 2411060 - RNA, 19 nt, Human
cagaucaagcugugagaca

SEQ ID NO: 2411061 - RNA, 17 nt, Human
cagaucaagcugugaga

SEQ ID NO: 2411062 - RNA, 18 nt, Human
cagaucaauggcgcagug

SEQ ID NO: 2411063 - RNA, 22 nt, Human
cagaucacagcuucagccagga

SEQ ID NO: 2411064 - RNA, 18 nt, Human
cagaucacagcuucagcc

SEQ ID NO: 2411065 - RNA, 16 nt, Human
cagaucacuacugcag

SEQ ID NO: 2411066 - RNA, 21 nt, Human
cagaucaccagcccggccugc

SEQ ID NO: 2411067 - RNA, 23 nt, Human
cagaucaauggcgcagugccucu

SEQ ID NO: 2411068 - RNA, 22 nt, Human
cagaucaccagcccggccugcu

SEQ ID NO: 2411069 - RNA, 13 nt, Human
cagaucacuacug

SEQ ID NO: 2411070 - RNA, 21 nt, Human
cagaguaauccaagcaaaugu

SEQ ID NO: 2411071 - RNA, 15 nt, Human
cagaucaagcuguga

SEQ ID NO: 2411072 - RNA, 20 nt, Human
cagauauuuuuucagaaaua

SEQ ID NO: 2411073 - RNA, 23 nt, Human
cagagguaacagaacagcuucag

SEQ ID NO: 2411074 - RNA, 17 nt, Human
cagagguugcagugugg

SEQ ID NO: 2411075 - RNA, 17 nt, Human
cagagguugcagugagc

SEQ ID NO: 2411076 - RNA, 16 nt, Human
cagagguugcagugag

SEQ ID NO: 2411077 - RNA, 15 nt, Human
cagagguccacaaca

SEQ ID NO: 2411078 - RNA, 20 nt, Human
cagagguccacaacacacag

SEQ ID NO: 2411079 - RNA, 22 nt, Human
cagagguaacagaacagcuuca

SEQ ID NO: 2411080 - RNA, 20 nt, Human
cagagguaacagaacagcuu

SEQ ID NO: 2411081 - RNA, 18 nt, Human
cagagguagggcugccac

SEQ ID NO: 2411082 - RNA, 21 nt, Human
cagcaguguuccccaucuggg

SEQ ID NO: 2411083 - RNA, 19 nt, Human
cagcaguguuccccaucug

SEQ ID NO: 2411084 - RNA, 17 nt, Human
cagcaguguuccccauc

SEQ ID NO: 2411085 - RNA, 14 nt, Human
cagcaguguucccc

SEQ ID NO: 2411086 - RNA, 23 nt, Human
cagcaguguuccccaucuggguc

SEQ ID NO: 2411087 - RNA, 22 nt, Human
cagcaguguuccccaucugggu

SEQ ID NO: 2411088 - RNA, 23 nt, Human
cagcaguugaaugacaacagaag

SEQ ID NO: 2411089 - RNA, 19 nt, Human
cagcagugugaggccaggg

SEQ ID NO: 2411090 - RNA, 20 nt, Human
cagcagugugaggccagggc

SEQ ID NO: 2411091 - RNA, 13 nt, Human
cagcaguguuccc

SEQ ID NO: 2411092 - RNA, 12 nt, Human
cagcaguguucc

SEQ ID NO: 2411093 - RNA, 22 nt, Human
cagcagugugaggccagggcag

SEQ ID NO: 2411094 - RNA, 16 nt, Human
cagcagugucaucaga

SEQ ID NO: 2411095 - RNA, 16 nt, Human
cagcagugcagccggg

SEQ ID NO: 2411096 - RNA, 17 nt, Human
cagcagugugaggccag

SEQ ID NO: 2411097 - RNA, 19 nt, Human
cagcagugagucucuucag

SEQ ID NO: 2411098 - RNA, 21 nt, Human
cagcagugagucucuucagaa

SEQ ID NO: 2411099 - RNA, 13 nt, Human
cagcauaauacuu

SEQ ID NO: 2411100 - RNA, 20 nt, Human
cagcaguuuucaagucaaau

SEQ ID NO: 2411101 - RNA, 17 nt, Human
cagcaguuugggagguc

SEQ ID NO: 2411102 - RNA, 18 nt, Human
cagcauaaaggccuuuuu

SEQ ID NO: 2411103 - RNA, 15 nt, Human
cagcauaaaggccuu

SEQ ID NO: 2411104 - RNA, 14 nt, Human
cagcauaaaggccu

SEQ ID NO: 2411105 - RNA, 19 nt, Human
cagcauaccuuuauuguga

SEQ ID NO: 2411106 - RNA, 16 nt, Human
cagcauaccugcuggu

SEQ ID NO: 2411107 - RNA, 22 nt, Human
cagcauaacaagguccaagaua

SEQ ID NO: 2411108 - RNA, 16 nt, Human
cagcacgauuucuguu

SEQ ID NO: 2411109 - RNA, 18 nt, Human
cagcacgauuucuguuua

SEQ ID NO: 2411110 - RNA, 19 nt, Human
cagcacgauuucuguuuag

SEQ ID NO: 2411111 - RNA, 20 nt, Human
cagcacgauuucuguuuaga

SEQ ID NO: 2411112 - RNA, 22 nt, Human
cagauucuuuccugaggcuggg

SEQ ID NO: 2411113 - RNA, 20 nt, Human
cagauucuuuccugaggcug

SEQ ID NO: 2411114 - RNA, 22 nt, Human
cagauugaguuuucuucuguga

SEQ ID NO: 2411115 - RNA, 12 nt, Human
cagauugaaaag

SEQ ID NO: 2411116 - RNA, 14 nt, Human
cagauugaaaagga

SEQ ID NO: 2411117 - RNA, 17 nt, Human
cagauugcaacaggcug

SEQ ID NO: 2411118 - RNA, 12 nt, Human
cagccagcucuc

SEQ ID NO: 2411119 - RNA, 15 nt, Human
cagccagcucucagc

SEQ ID NO: 2411120 - RNA, 16 nt, Human
cagccagcucucagcc

SEQ ID NO: 2411121 - RNA, 21 nt, Human
cagccagcucucagccaacga

SEQ ID NO: 2411122 - RNA, 17 nt, Human
cagccagcucucagcca

SEQ ID NO: 2411123 - RNA, 18 nt, Human
cagccagcucucagccaa

SEQ ID NO: 2411124 - RNA, 23 nt, Human
cagcaucauuuugcauucaaauu

SEQ ID NO: 2411125 - RNA, 22 nt, Human
cagcaucauuuugcauucaaau

SEQ ID NO: 2411126 - RNA, 18 nt, Human
cagcaucccuugaccagg

SEQ ID NO: 2411127 - RNA, 23 nt, Human
cagcaucccuugaccaggccugg

SEQ ID NO: 2411128 - RNA, 22 nt, Human
cagcaucccuugaccaggccug

SEQ ID NO: 2411129 - RNA, 19 nt, Human
cagcaucccuugaccaggc

SEQ ID NO: 2411130 - RNA, 20 nt, Human
cagcaucauuuugcauucaa

SEQ ID NO: 2411131 - RNA, 19 nt, Human
cagcaucauuuugcauuca

SEQ ID NO: 2411132 - RNA, 23 nt, Human
cagcaucaggguuaagaagacuu

SEQ ID NO: 2411133 - RNA, 13 nt, Human
cagcaucaggguu

SEQ ID NO: 2411134 - RNA, 20 nt, Human
cagcaucauggagguuugaa

SEQ ID NO: 2411135 - RNA, 16 nt, Human
cagccaggugccuugg

SEQ ID NO: 2411136 - RNA, 15 nt, Human
cagccaggugccuug

SEQ ID NO: 2411137 - RNA, 12 nt, Human
cagccagggcca

SEQ ID NO: 2411138 - RNA, 11 nt, Human
cagccagggcc

SEQ ID NO: 2411139 - RNA, 15 nt, Human
cagccagggccaggg

SEQ ID NO: 2411140 - RNA, 14 nt, Human
cagccaggugccuu

SEQ ID NO: 2411141 - RNA, 13 nt, Human
cagccaggugccu

SEQ ID NO: 2411142 - RNA, 16 nt, Human
cagccagggcugcuag

SEQ ID NO: 2411143 - RNA, 15 nt, Human
cagccagggcugcua

SEQ ID NO: 2411144 - RNA, 23 nt, Human
cagccagggcugcuagacggagg

SEQ ID NO: 2411145 - RNA, 12 nt, Human
cagccagggcug

SEQ ID NO: 2411146 - RNA, 13 nt, Human
cagccagggcugc

SEQ ID NO: 2411147 - RNA, 14 nt, Human
caggcacagcacag

SEQ ID NO: 2411148 - RNA, 16 nt, Human
caggcacagcacaggg

SEQ ID NO: 2411149 - RNA, 19 nt, Human
caggcacacgccaccucgc

SEQ ID NO: 2411150 - RNA, 15 nt, Human
caggcacacuucuuc

SEQ ID NO: 2411151 - RNA, 23 nt, Human
caggcacacacugugcuuucuau

SEQ ID NO: 2411152 - RNA, 15 nt, Human
caggcacacacugug

SEQ ID NO: 2411153 - RNA, 14 nt, Human
caggcacacacugu

SEQ ID NO: 2411154 - RNA, 14 nt, Human
caggcacaaaauga

SEQ ID NO: 2411155 - RNA, 19 nt, Human
caggcagacacggaucuga

SEQ ID NO: 2411156 - RNA, 16 nt, Human
caggcagacacggauc

SEQ ID NO: 2411157 - RNA, 14 nt, Human
caggcagacacgga

SEQ ID NO: 2411158 - RNA, 12 nt, Human
caggcagacacg

SEQ ID NO: 2411159 - RNA, 11 nt, Human
caggcagacac

SEQ ID NO: 2411160 - RNA, 10 nt, Human
caggcagaca

SEQ ID NO: 2411161 - RNA, 22 nt, Human
caggcagacacggaucugagaa

SEQ ID NO: 2411162 - RNA, 14 nt, Human
caggcagagaauca

SEQ ID NO: 2411163 - RNA, 15 nt, Human
caggcagagaaucau

SEQ ID NO: 2411164 - RNA, 23 nt, Human
caggcagagaaucauacuuagca

SEQ ID NO: 2411165 - RNA, 15 nt, Human
caggccagagggagu

SEQ ID NO: 2411166 - RNA, 13 nt, Human
caggccagaggga

SEQ ID NO: 2411167 - RNA, 18 nt, Human
caggcagauacaggaaaa

SEQ ID NO: 2411168 - RNA, 13 nt, Human
caggcagauccag

SEQ ID NO: 2411169 - RNA, 15 nt, Human
caggccacuugauga

SEQ ID NO: 2411170 - RNA, 23 nt, Human
caggccagcugcuugggcuucau

SEQ ID NO: 2411171 - RNA, 21 nt, Human
caggccagcugcuugggcuuc

SEQ ID NO: 2411172 - RNA, 19 nt, Human
caggccagcugcuugggcu

SEQ ID NO: 2411173 - RNA, 17 nt, Human
caggccagcugcuuggg

SEQ ID NO: 2411174 - RNA, 18 nt, Human
caggccaggcccucugcc

SEQ ID NO: 2411175 - RNA, 17 nt, Human
caggccaggcccucugc

SEQ ID NO: 2411176 - RNA, 19 nt, Human
caggccaggcccucugccc

SEQ ID NO: 2411177 - RNA, 20 nt, Human
caggccaggcccucugccca

SEQ ID NO: 2411178 - RNA, 16 nt, Human
caggccagagggagug

SEQ ID NO: 2411179 - RNA, 17 nt, Human
caggccacggcagccua

SEQ ID NO: 2411180 - RNA, 16 nt, Human
caggcuggcuccagau

SEQ ID NO: 2411181 - RNA, 20 nt, Human
caggcuggcuccagaugcag

SEQ ID NO: 2411182 - RNA, 17 nt, Human
caggcuggcuccagaug

SEQ ID NO: 2411183 - RNA, 18 nt, Human
caggcuggcuccagaugc

SEQ ID NO: 2411184 - RNA, 14 nt, Human
caggcugggagagc

SEQ ID NO: 2411185 - RNA, 12 nt, Human
caggcugggaga

SEQ ID NO: 2411186 - RNA, 15 nt, Human
caggcugggagagcc

SEQ ID NO: 2411187 - RNA, 20 nt, Human
caggcugggcuucaguggca

SEQ ID NO: 2411188 - RNA, 22 nt, Human
caggcugggcuucaguggcagc

SEQ ID NO: 2411189 - RNA, 21 nt, Human
caggcugggcuucaguggcag

SEQ ID NO: 2411190 - RNA, 16 nt, Human
cagggagccuccugcc

SEQ ID NO: 2411191 - RNA, 15 nt, Human
cagggagccuccugc

SEQ ID NO: 2411192 - RNA, 22 nt, Human
cagggagccuuugguucuggcc

SEQ ID NO: 2411193 - RNA, 18 nt, Human
cagggagccuccugccca

SEQ ID NO: 2411194 - RNA, 13 nt, Human
cagggagcggaaa

SEQ ID NO: 2411195 - RNA, 16 nt, Human
cagggagcggaaagca

SEQ ID NO: 2411196 - RNA, 17 nt, Human
cagggagcggaaagcag

SEQ ID NO: 2411197 - RNA, 14 nt, Human
cagggagccuccug

SEQ ID NO: 2411198 - RNA, 13 nt, Human
cagggagccuccu

SEQ ID NO: 2411199 - RNA, 12 nt, Human
cagggagccucc

SEQ ID NO: 2411200 - RNA, 20 nt, Human
cagggagcauuuuccuccau

SEQ ID NO: 2411201 - RNA, 13 nt, Human
cagggcucaggau

SEQ ID NO: 2411202 - RNA, 12 nt, Human
cagggcucagga

SEQ ID NO: 2411203 - RNA, 21 nt, Human
cagggcucugccccagaggcc

SEQ ID NO: 2411204 - RNA, 16 nt, Human
cagggcugaggccucu

SEQ ID NO: 2411205 - RNA, 18 nt, Human
cagggcugcuagacggag

SEQ ID NO: 2411206 - RNA, 14 nt, Human
cagggcugcuagac

SEQ ID NO: 2411207 - RNA, 15 nt, Human
cagggcuggacugag

SEQ ID NO: 2411208 - RNA, 14 nt, Human
cagggcuggacuga

SEQ ID NO: 2411209 - RNA, 18 nt, Human
cagggcugaggccucuca

SEQ ID NO: 2411210 - RNA, 21 nt, Human
cagggcugacacguccacccc

SEQ ID NO: 2411211 - RNA, 18 nt, Human
caggggaaagaugagcuu

SEQ ID NO: 2411212 - RNA, 16 nt, Human
caggggaaaaugaagg

SEQ ID NO: 2411213 - RNA, 23 nt, Human
caggggaaagaugagcuuuucua

SEQ ID NO: 2411214 - RNA, 14 nt, Human
caggggaaaaugaa

SEQ ID NO: 2411215 - RNA, 18 nt, Human
cagggcuggacugaggcc

SEQ ID NO: 2411216 - RNA, 20 nt, Human
caggggaaaaucagccugcu

SEQ ID NO: 2411217 - RNA, 17 nt, Human
cagggcuggacugaggc

SEQ ID NO: 2411218 - RNA, 16 nt, Human
cagggcuggacugagg

SEQ ID NO: 2411219 - RNA, 19 nt, Human
caggggaaaaucagccugc

SEQ ID NO: 2411220 - RNA, 23 nt, Human
cagggcucagcggggacagcucc

SEQ ID NO: 2411221 - RNA, 21 nt, Human
cagggcucagcggggacagcu

SEQ ID NO: 2411222 - RNA, 13 nt, Human
cagggaugcccug

SEQ ID NO: 2411223 - RNA, 14 nt, Human
cagggaugcccugg

SEQ ID NO: 2411224 - RNA, 16 nt, Human
cagggaugcccuggag

SEQ ID NO: 2411225 - RNA, 20 nt, Human
cagggaugcccuggaggugg

SEQ ID NO: 2411226 - RNA, 21 nt, Human
cagggaugcccuggagguggc

SEQ ID NO: 2411227 - RNA, 22 nt, Human
cagggaugcccuggagguggcu

SEQ ID NO: 2411228 - RNA, 19 nt, Human
cagggauggccguuggcca

SEQ ID NO: 2411229 - RNA, 23 nt, Human
cagggaugcccuggagguggcug

SEQ ID NO: 2411230 - RNA, 16 nt, Human
cagggaugguguucaa

SEQ ID NO: 2411231 - RNA, 20 nt, Human
cagggauggccguuggccac

SEQ ID NO: 2411232 - RNA, 17 nt, Human
cagggagcggccggcca

SEQ ID NO: 2411233 - RNA, 19 nt, Human
cagggagcggccggccagc

SEQ ID NO: 2411234 - RNA, 15 nt, Human
cagggagcggccggc

SEQ ID NO: 2411235 - RNA, 18 nt, Human
cagggagcggaaagcagc

SEQ ID NO: 2411236 - RNA, 19 nt, Human
cagggagcggaaagcagcu

SEQ ID NO: 2411237 - RNA, 21 nt, Human
cagggagcggccggccagccc

SEQ ID NO: 2411238 - RNA, 23 nt, Human
cagggagcggccggccagccccu

SEQ ID NO: 2411239 - RNA, 22 nt, Human
cagggagcggaaagcagcucaa

SEQ ID NO: 2411240 - RNA, 21 nt, Human
cagggaugagcauggagcugg

SEQ ID NO: 2411241 - RNA, 20 nt, Human
cagggaugagcauggagcug

SEQ ID NO: 2411242 - RNA, 19 nt, Human
cagggaugagcauggagcu

SEQ ID NO: 2411243 - RNA, 16 nt, Human
cagggaugagcaugga

SEQ ID NO: 2411244 - RNA, 23 nt, Human
cagggaugagcauggagcuggcc

SEQ ID NO: 2411245 - RNA, 22 nt, Human
cagggaugagcauggagcuggc

SEQ ID NO: 2411246 - RNA, 23 nt, Human
cagggaugccaucugugggcacg

SEQ ID NO: 2411247 - RNA, 12 nt, Human
cagggaugagca

SEQ ID NO: 2411248 - RNA, 19 nt, Human
cagggaucuugcauuccca

SEQ ID NO: 2411249 - RNA, 17 nt, Human
cagggaucuugcauucc

SEQ ID NO: 2411250 - RNA, 20 nt, Human
cagggcucugccccagaggc

SEQ ID NO: 2411251 - RNA, 12 nt, Human
cagugcaucuca

SEQ ID NO: 2411252 - RNA, 17 nt, Human
cagucuggaaugcagug

SEQ ID NO: 2411253 - RNA, 15 nt, Human
cagucuggaaugcag

SEQ ID NO: 2411254 - RNA, 18 nt, Human
cagucugcugcccuccau

SEQ ID NO: 2411255 - RNA, 21 nt, Human
cagucugcugcccuccauccc

SEQ ID NO: 2411256 - RNA, 22 nt, Human
cagucugcugcccuccaucccg

SEQ ID NO: 2411257 - RNA, 14 nt, Human
cagugcaugcuguc

SEQ ID NO: 2411258 - RNA, 13 nt, Human
cagugcaugcugu

SEQ ID NO: 2411259 - RNA, 18 nt, Human
cagugcaucucagcccac

SEQ ID NO: 2411260 - RNA, 17 nt, Human
cagugcaucucagccca

SEQ ID NO: 2411261 - RNA, 16 nt, Human
cagugcaucucagccc

SEQ ID NO: 2411262 - RNA, 15 nt, Human
cagugcaucucagcc

SEQ ID NO: 2411263 - RNA, 20 nt, Human
cagucucugagggcuuccuu

SEQ ID NO: 2411264 - RNA, 12 nt, Human
cagucucugagc

SEQ ID NO: 2411265 - RNA, 14 nt, Human
cagucucugagcag

SEQ ID NO: 2411266 - RNA, 16 nt, Human
cagucucugagggcuu

SEQ ID NO: 2411267 - RNA, 15 nt, Human
cagucucugagggcu

SEQ ID NO: 2411268 - RNA, 15 nt, Human
cagucucuuuaaucu

SEQ ID NO: 2411269 - RNA, 19 nt, Human
cagucucuuuaaucuucag

SEQ ID NO: 2411270 - RNA, 20 nt, Human
cagucucuuuaaucuucagu

SEQ ID NO: 2411271 - RNA, 22 nt, Human
cagucucuuuaaucuucaguuu

SEQ ID NO: 2411272 - RNA, 20 nt, Human
cagucugacuguuuccauca

SEQ ID NO: 2411273 - RNA, 13 nt, Human
cagucugcugccc

SEQ ID NO: 2411274 - RNA, 12 nt, Human
cagucugacccu

SEQ ID NO: 2411275 - RNA, 14 nt, Human
cagucugcugcccu

SEQ ID NO: 2411276 - RNA, 15 nt, Human
cagucugcugcccuc

SEQ ID NO: 2411277 - RNA, 18 nt, Human
cagugcauauuccuuucu

SEQ ID NO: 2411278 - RNA, 14 nt, Human
cagugcauauuccu

SEQ ID NO: 2411279 - RNA, 12 nt, Human
cagugggaggcg

SEQ ID NO: 2411280 - RNA, 23 nt, Human
cagugggagcugccuguucagcu

SEQ ID NO: 2411281 - RNA, 20 nt, Human
cagugggagcugccuguuca

SEQ ID NO: 2411282 - RNA, 17 nt, Human
cagugcccacaggauca

SEQ ID NO: 2411283 - RNA, 17 nt, Human
cagugcaugcugucccu

SEQ ID NO: 2411284 - RNA, 16 nt, Human
cagugcaugcuguccc

SEQ ID NO: 2411285 - RNA, 15 nt, Human
cagugcccacaggau

SEQ ID NO: 2411286 - RNA, 13 nt, Human
cagugcccacagg

SEQ ID NO: 2411287 - RNA, 18 nt, Human
cagugggaggggcaggcu

SEQ ID NO: 2411288 - RNA, 17 nt, Human
cagugggaggggcaggc

SEQ ID NO: 2411289 - RNA, 16 nt, Human
cagugggaggggcagg

SEQ ID NO: 2411290 - RNA, 15 nt, Human
cagugggaggggcag

SEQ ID NO: 2411291 - RNA, 14 nt, Human
cagugggaggggca

SEQ ID NO: 2411292 - RNA, 12 nt, Human
cagugggagggg

SEQ ID NO: 2411293 - RNA, 11 nt, Human
cagugggaggg

SEQ ID NO: 2411294 - RNA, 13 nt, Human
cagugggaggcgc

SEQ ID NO: 2411295 - RNA, 20 nt, Human
cagugggaggggcaggcuga

SEQ ID NO: 2411296 - RNA, 19 nt, Human
cagugggaggggcaggcug

SEQ ID NO: 2411297 - RNA, 21 nt, Human
cagugggaggggcaggcugac

SEQ ID NO: 2411298 - RNA, 14 nt, Human
cagugggccuggcc

SEQ ID NO: 2411299 - RNA, 15 nt, Human
cagugggccuggcca

SEQ ID NO: 2411300 - RNA, 21 nt, Human
cagugggccuggccagcaggu

SEQ ID NO: 2411301 - RNA, 18 nt, Human
caguggugguuuucuguu

SEQ ID NO: 2411302 - RNA, 21 nt, Human
caguggugcgaucuggguuca

SEQ ID NO: 2411303 - RNA, 20 nt, Human
caguggggaggggcuguggg

SEQ ID NO: 2411304 - RNA, 15 nt, Human
caguggggcagucau

SEQ ID NO: 2411305 - RNA, 20 nt, Human
caguggugcgaucuggguuc

SEQ ID NO: 2411306 - RNA, 23 nt, Human
cagucacguggaggagcagugca

SEQ ID NO: 2411307 - RNA, 18 nt, Human
cagucacguggaggagca

SEQ ID NO: 2411308 - RNA, 16 nt, Human
cagucaccucauggaa

SEQ ID NO: 2411309 - RNA, 15 nt, Human
cagucacauuccaag

SEQ ID NO: 2411310 - RNA, 19 nt, Human
cagucaccucauggaauug

SEQ ID NO: 2411311 - RNA, 12 nt, Human
cagucaccccag

SEQ ID NO: 2411312 - RNA, 17 nt, Human
cagucaccccaggacuc

SEQ ID NO: 2411313 - RNA, 17 nt, Human
cagucaccugcccagau

SEQ ID NO: 2411314 - RNA, 16 nt, Human
caguaaauaaauuguu

SEQ ID NO: 2411315 - RNA, 15 nt, Human
caguaaauaaauugu

SEQ ID NO: 2411316 - RNA, 14 nt, Human
caguaaauaaauug

SEQ ID NO: 2411317 - RNA, 14 nt, Human
caguaaacuuuuaa

SEQ ID NO: 2411318 - RNA, 15 nt, Human
caguaaagcacuugc

SEQ ID NO: 2411319 - RNA, 12 nt, Human
cagucacagcca

SEQ ID NO: 2411320 - RNA, 13 nt, Human
cagucacagccac

SEQ ID NO: 2411321 - RNA, 14 nt, Human
cagucacagccacc

SEQ ID NO: 2411322 - RNA, 16 nt, Human
cagucacagccacccc

SEQ ID NO: 2411323 - RNA, 15 nt, Human
cagucaauauuuuua

SEQ ID NO: 2411324 - RNA, 17 nt, Human
cagucaaggaguggcuu

SEQ ID NO: 2411325 - RNA, 17 nt, Human
caguaaauaaauuguuu

SEQ ID NO: 2411326 - RNA, 19 nt, Human
caggugccaguuauggcua

SEQ ID NO: 2411327 - RNA, 21 nt, Human
caggugcacaagcuccaagcu

SEQ ID NO: 2411328 - RNA, 22 nt, Human
caggugcccagcuauaccugug

SEQ ID NO: 2411329 - RNA, 15 nt, Human
caggugcaguggcuc

SEQ ID NO: 2411330 - RNA, 22 nt, Human
caggugcacaagcuccaagcuc

SEQ ID NO: 2411331 - RNA, 20 nt, Human
caggugcccaucccuggaag

SEQ ID NO: 2411332 - RNA, 17 nt, Human
caggugcccaucccugg

SEQ ID NO: 2411333 - RNA, 23 nt, Human
caggugcccagcuauaccugugc

SEQ ID NO: 2411334 - RNA, 11 nt, Human
caggugccucc

SEQ ID NO: 2411335 - RNA, 23 nt, Human
cagguugucugaagucacugcac

SEQ ID NO: 2411336 - RNA, 14 nt, Human
caggugccuuggag

SEQ ID NO: 2411337 - RNA, 18 nt, Human
cagguuguaguaaagaaa

SEQ ID NO: 2411338 - RNA, 13 nt, Human
caggugccuugga

SEQ ID NO: 2411339 - RNA, 15 nt, Human
caggugccuggacau

SEQ ID NO: 2411340 - RNA, 12 nt, Human
caggugccugga

SEQ ID NO: 2411341 - RNA, 21 nt, Human
caggugccuccaggugugcac

SEQ ID NO: 2411342 - RNA, 22 nt, Human
cagguugucugaagucacugca

SEQ ID NO: 2411343 - RNA, 19 nt, Human
caggugccuccaggugugc

SEQ ID NO: 2411344 - RNA, 18 nt, Human
caggugccuccaggugug

SEQ ID NO: 2411345 - RNA, 17 nt, Human
caggugccuccaggugu

SEQ ID NO: 2411346 - RNA, 16 nt, Human
caggugccuccaggug

SEQ ID NO: 2411347 - RNA, 15 nt, Human
caggugccuccaggu

SEQ ID NO: 2411348 - RNA, 14 nt, Human
caggugccuccagg

SEQ ID NO: 2411349 - RNA, 13 nt, Human
caggugccuccag

SEQ ID NO: 2411350 - RNA, 12 nt, Human
caggugccucca

SEQ ID NO: 2411351 - RNA, 21 nt, Human
cagguuggugggggccucggu

SEQ ID NO: 2411352 - RNA, 23 nt, Human
caguaaagaacaucccuccuggg

SEQ ID NO: 2411353 - RNA, 10 nt, Human
caguaaacau

SEQ ID NO: 2411354 - RNA, 16 nt, Human
caguaaacagaggagu

SEQ ID NO: 2411355 - RNA, 18 nt, Human
caguaaaauugccauauu

SEQ ID NO: 2411356 - RNA, 16 nt, Human
cagguuuuucaauuaa

SEQ ID NO: 2411357 - RNA, 15 nt, Human
cagguuuuucaauua

SEQ ID NO: 2411358 - RNA, 14 nt, Human
cagguuuuucaauu

SEQ ID NO: 2411359 - RNA, 21 nt, Human
caguaaaauugccauauugca

SEQ ID NO: 2411360 - RNA, 20 nt, Human
caguaaaauugccauauugc

SEQ ID NO: 2411361 - RNA, 12 nt, Human
cagguuuuucaa

SEQ ID NO: 2411362 - RNA, 13 nt, Human
cagguuuuucaau

SEQ ID NO: 2411363 - RNA, 15 nt, Human
cagguuuuguaaaga

SEQ ID NO: 2411364 - RNA, 12 nt, Human
cagguuuuccug

SEQ ID NO: 2411365 - RNA, 14 nt, Human
cagguuuaagcugu

SEQ ID NO: 2411366 - RNA, 16 nt, Human
cagguuuuccugaaga

SEQ ID NO: 2411367 - RNA, 19 nt, Human
cagguuuucugggugucca

SEQ ID NO: 2411368 - RNA, 14 nt, Human
cagguuuguuacau

SEQ ID NO: 2411369 - RNA, 13 nt, Human
cagguuuguuaca

SEQ ID NO: 2411370 - RNA, 19 nt, Human
cagguuguaguaaagaaau

SEQ ID NO: 2411371 - RNA, 21 nt, Human
caggugauccacccaccucag

SEQ ID NO: 2411372 - RNA, 20 nt, Human
caggugcacaagcuccaagc

SEQ ID NO: 2411373 - RNA, 19 nt, Human
caggugcacaagcuccaag

SEQ ID NO: 2411374 - RNA, 18 nt, Human
caggugcacaagcuccaa

SEQ ID NO: 2411375 - RNA, 17 nt, Human
caggugcacaagcucca

SEQ ID NO: 2411376 - RNA, 23 nt, Human
caggugauccacccaccucagcc

SEQ ID NO: 2411377 - RNA, 22 nt, Human
caggugauccacccaccucagc

SEQ ID NO: 2411378 - RNA, 15 nt, Human
caggugcacaagcuc

SEQ ID NO: 2411379 - RNA, 17 nt, Human
cauguuacugaccagca

SEQ ID NO: 2411380 - RNA, 14 nt, Human
cauguuaggaaaau

SEQ ID NO: 2411381 - RNA, 18 nt, Human
cauguuaggaaaauuuca

SEQ ID NO: 2411382 - RNA, 19 nt, Human
cauguuaggaaaauuucac

SEQ ID NO: 2411383 - RNA, 14 nt, Human
cauguccuguaaag

SEQ ID NO: 2411384 - RNA, 15 nt, Human
cauguccuguaaagg

SEQ ID NO: 2411385 - RNA, 23 nt, Human
caugucccuaccgagucucuucu

SEQ ID NO: 2411386 - RNA, 17 nt, Human
caugucccuacaccccu

SEQ ID NO: 2411387 - RNA, 18 nt, Human
cauguauuuguuugcaua

SEQ ID NO: 2411388 - RNA, 19 nt, Human
caugucaaacgugaaaaug

SEQ ID NO: 2411389 - RNA, 14 nt, Human
caugucaaacguga

SEQ ID NO: 2411390 - RNA, 21 nt, Human
cauguccccaaaccugcaagg

SEQ ID NO: 2411391 - RNA, 22 nt, Human
caugucccuaccgagucucuuc

SEQ ID NO: 2411392 - RNA, 16 nt, Human
caugucccuaccgagu

SEQ ID NO: 2411393 - RNA, 15 nt, Human
cauguuggccaggcu

SEQ ID NO: 2411394 - RNA, 14 nt, Human
cauguuggccaggc

SEQ ID NO: 2411395 - RNA, 22 nt, Human
cauguuauauauuuuuuguagg

SEQ ID NO: 2411396 - RNA, 14 nt, Human
cauguuauauauuu

SEQ ID NO: 2411397 - RNA, 13 nt, Human
cauguuauauauu

SEQ ID NO: 2411398 - RNA, 21 nt, Human
cauguugggaaacuuggcucg

SEQ ID NO: 2411399 - RNA, 20 nt, Human
cauguugggaaacuuggcuc

SEQ ID NO: 2411400 - RNA, 19 nt, Human
cauguugggaaacuuggcu

SEQ ID NO: 2411401 - RNA, 15 nt, Human
cauguugggaaacuu

SEQ ID NO: 2411402 - RNA, 22 nt, Human
cauguuggucaaaagcuggauu

SEQ ID NO: 2411403 - RNA, 20 nt, Human
cauguuauauauuuuuugua

SEQ ID NO: 2411404 - RNA, 16 nt, Human
cauguuggccaggcug

SEQ ID NO: 2411405 - RNA, 20 nt, Human
cauguauuuaucucuauuua

SEQ ID NO: 2411406 - RNA, 23 nt, Human
cauguauuuaucucuauuuaaua

SEQ ID NO: 2411407 - RNA, 15 nt, Human
cauguauuuaucucu

SEQ ID NO: 2411408 - RNA, 23 nt, Human
cauguauugugucuuuugcauga

SEQ ID NO: 2411409 - RNA, 21 nt, Human
cauguauugugucuuuugcau

SEQ ID NO: 2411410 - RNA, 20 nt, Human
cauguauugugucuuuugca

SEQ ID NO: 2411411 - RNA, 15 nt, Human
cauguauugugucuu

SEQ ID NO: 2411412 - RNA, 14 nt, Human
cauguauugugucu

SEQ ID NO: 2411413 - RNA, 15 nt, Human
cauguagcugaguuu

SEQ ID NO: 2411414 - RNA, 19 nt, Human
cauguauuggccuggaggu

SEQ ID NO: 2411415 - RNA, 14 nt, Human
cauguagcugaguu

SEQ ID NO: 2411416 - RNA, 15 nt, Human
cauguagaagcugca

SEQ ID NO: 2411417 - RNA, 18 nt, Human
cauguaggaaguaggaag

SEQ ID NO: 2411418 - RNA, 18 nt, Human
cauguagcccccuggccu

SEQ ID NO: 2411419 - RNA, 20 nt, Human
cauguagcccccuggccucu

SEQ ID NO: 2411420 - RNA, 21 nt, Human
cauguagcccccuggccucug

SEQ ID NO: 2411421 - RNA, 22 nt, Human
cauguagcccccuggccucugu

SEQ ID NO: 2411422 - RNA, 13 nt, Human
cauguagcccccu

SEQ ID NO: 2411423 - RNA, 17 nt, Human
cauguagcccccuggcc

SEQ ID NO: 2411424 - RNA, 14 nt, Human
cauguagcaggacu

SEQ ID NO: 2411425 - RNA, 20 nt, Human
cauguagcaggacugaauug

SEQ ID NO: 2411426 - RNA, 20 nt, Human
cauguagaaaauuuguuauu

SEQ ID NO: 2411427 - RNA, 19 nt, Human
cauguagaagcugcaucuu

SEQ ID NO: 2411428 - RNA, 13 nt, Human
cauguagaagcug

SEQ ID NO: 2411429 - RNA, 17 nt, Human
cauuauagaucccccag

SEQ ID NO: 2411430 - RNA, 20 nt, Human
cauuauaacugaaggagaag

SEQ ID NO: 2411431 - RNA, 18 nt, Human
cauuauaacugaaggaga

SEQ ID NO: 2411432 - RNA, 13 nt, Human
cauuauaaacgug

SEQ ID NO: 2411433 - RNA, 19 nt, Human
cauguuuacuuuucagggc

SEQ ID NO: 2411434 - RNA, 21 nt, Human
cauguuuacuuuucagggcau

SEQ ID NO: 2411435 - RNA, 16 nt, Human
cauucgguguggugca

SEQ ID NO: 2411436 - RNA, 14 nt, Human
cauucguucugugg

SEQ ID NO: 2411437 - RNA, 16 nt, Human
cauucuacacagagca

SEQ ID NO: 2411438 - RNA, 22 nt, Human
cauucuacacagagcaggacug

SEQ ID NO: 2411439 - RNA, 19 nt, Human
cauucuacacagagcagga

SEQ ID NO: 2411440 - RNA, 17 nt, Human
cauucuacacagagcag

SEQ ID NO: 2411441 - RNA, 15 nt, Human
cauucuacugaaaag

SEQ ID NO: 2411442 - RNA, 14 nt, Human
cauucuccacagca

SEQ ID NO: 2411443 - RNA, 18 nt, Human
cauucuccacagcaaccc

SEQ ID NO: 2411444 - RNA, 15 nt, Human
cauucuccacagcaa

SEQ ID NO: 2411445 - RNA, 17 nt, Human
cauucuccacagcaacc

SEQ ID NO: 2411446 - RNA, 16 nt, Human
cauucuccaccugcca

SEQ ID NO: 2411447 - RNA, 14 nt, Human
cauucuccaccugc

SEQ ID NO: 2411448 - RNA, 13 nt, Human
cauucuccaccug

SEQ ID NO: 2411449 - RNA, 23 nt, Human
cauucuagguaggggcccacuuc

SEQ ID NO: 2411450 - RNA, 17 nt, Human
caugggaaugaauguca

SEQ ID NO: 2411451 - RNA, 16 nt, Human
caugggaaugaauguc

SEQ ID NO: 2411452 - RNA, 15 nt, Human
caugggaaugaaugu

SEQ ID NO: 2411453 - RNA, 14 nt, Human
caugggaaugaaug

SEQ ID NO: 2411454 - RNA, 16 nt, Human
cauggcuaagcuuuau

SEQ ID NO: 2411455 - RNA, 17 nt, Human
caugcuggguucugcac

SEQ ID NO: 2411456 - RNA, 16 nt, Human
caugcuggguucugca

SEQ ID NO: 2411457 - RNA, 18 nt, Human
caugcuggguucugcaca

SEQ ID NO: 2411458 - RNA, 15 nt, Human
cauggcuaagcuuua

SEQ ID NO: 2411459 - RNA, 12 nt, Human
cauggcuaucug

SEQ ID NO: 2411460 - RNA, 22 nt, Human
cauggcuauaaacaauuacaug

SEQ ID NO: 2411461 - RNA, 11 nt, Human
cauggcugaac

SEQ ID NO: 2411462 - RNA, 20 nt, Human
cauggcuccagucugcugcc

SEQ ID NO: 2411463 - RNA, 22 nt, Human
cauggcuccagucugcugcccu

SEQ ID NO: 2411464 - RNA, 17 nt, Human
cauggcucccccuccac

SEQ ID NO: 2411465 - RNA, 17 nt, Human
cauggcuccagaaaugu

SEQ ID NO: 2411466 - RNA, 13 nt, Human
cauggcuccaguc

SEQ ID NO: 2411467 - RNA, 14 nt, Human
cauggcuccagucu

SEQ ID NO: 2411468 - RNA, 15 nt, Human
cauggcuccagucug

SEQ ID NO: 2411469 - RNA, 14 nt, Human
caugcuaauuauau

SEQ ID NO: 2411470 - RNA, 22 nt, Human
caugcuaauauaaguuucuuug

SEQ ID NO: 2411471 - RNA, 20 nt, Human
caugcuccuggcccacugca

SEQ ID NO: 2411472 - RNA, 13 nt, Human
caugcucucugca

SEQ ID NO: 2411473 - RNA, 16 nt, Human
caugcuaucucugugu

SEQ ID NO: 2411474 - RNA, 20 nt, Human
caugcugaagccaaagccaa

SEQ ID NO: 2411475 - RNA, 16 nt, Human
caugcugaagccaaag

SEQ ID NO: 2411476 - RNA, 13 nt, Human
caugcugaaggga

SEQ ID NO: 2411477 - RNA, 15 nt, Human
caugcugaagccaaa

SEQ ID NO: 2411478 - RNA, 17 nt, Human
caugcucuuagaaaauu

SEQ ID NO: 2411479 - RNA, 16 nt, Human
caugcucuuagaaaau

SEQ ID NO: 2411480 - RNA, 21 nt, Human
caugcucucugcagccagccc

SEQ ID NO: 2411481 - RNA, 14 nt, Human
caugcucucugcag

SEQ ID NO: 2411482 - RNA, 15 nt, Human
caugcucucugcagc

SEQ ID NO: 2411483 - RNA, 16 nt, Human
caugcucucugcagcc

SEQ ID NO: 2411484 - RNA, 19 nt, Human
caugcucucugcagccagc

SEQ ID NO: 2411485 - RNA, 20 nt, Human
caugcucucugcagccagcc

SEQ ID NO: 2411486 - RNA, 23 nt, Human
caugcucucugcagccagcccag

SEQ ID NO: 2411487 - RNA, 12 nt, Human
caugcuggagcc

SEQ ID NO: 2411488 - RNA, 19 nt, Human
caugcugaagggaccuuga

SEQ ID NO: 2411489 - RNA, 18 nt, Human
caugcugaagggaccuug

SEQ ID NO: 2411490 - RNA, 21 nt, Human
caugcugacuuucauuucuug

SEQ ID NO: 2411491 - RNA, 22 nt, Human
caugcuggaggugacaucucuu

SEQ ID NO: 2411492 - RNA, 19 nt, Human
caugcuggagccuguguaa

SEQ ID NO: 2411493 - RNA, 17 nt, Human
caugcuggagccugugu

SEQ ID NO: 2411494 - RNA, 16 nt, Human
caugcuggagccugug

SEQ ID NO: 2411495 - RNA, 15 nt, Human
caugcuggagccugu

SEQ ID NO: 2411496 - RNA, 14 nt, Human
caugcuggagccug

SEQ ID NO: 2411497 - RNA, 13 nt, Human
caugcuggagccu

SEQ ID NO: 2411498 - RNA, 20 nt, Human
caugcuggggcaagucccug

SEQ ID NO: 2411499 - RNA, 23 nt, Human
caugcugggaagacgccugagcu

SEQ ID NO: 2411500 - RNA, 22 nt, Human
caugcuggagccuguguaacag

SEQ ID NO: 2411501 - RNA, 20 nt, Human
caugcugggaagacgccuga

SEQ ID NO: 2411502 - RNA, 20 nt, Human
caugauggugcugaccucug

SEQ ID NO: 2411503 - RNA, 20 nt, Human
caugauggcaacagaucugg

SEQ ID NO: 2411504 - RNA, 14 nt, Human
caugauguuuagaa

SEQ ID NO: 2411505 - RNA, 12 nt, Human
caugauguggag

SEQ ID NO: 2411506 - RNA, 20 nt, Human
caugauguagugccucuuuc

SEQ ID NO: 2411507 - RNA, 23 nt, Human
caugaugguuauuuucuuuucuu

SEQ ID NO: 2411508 - RNA, 22 nt, Human
caugaugguuauuuucuuuucu

SEQ ID NO: 2411509 - RNA, 22 nt, Human
caugauguuaaccagaauaaag

SEQ ID NO: 2411510 - RNA, 20 nt, Human
caugauguggaguggggcag

SEQ ID NO: 2411511 - RNA, 19 nt, Human
caugauguuaaccagaaua

SEQ ID NO: 2411512 - RNA, 24 nt, Human
caugauuuugaaaucaugaagaua

SEQ ID NO: 2411513 - RNA, 18 nt, Human
caugauuuccuugaaugu

SEQ ID NO: 2411514 - RNA, 14 nt, Human
caugcuacacacug

SEQ ID NO: 2411515 - RNA, 20 nt, Human
caugcuacacacugcauguu

SEQ ID NO: 2411516 - RNA, 23 nt, Human
caugcuacacacugcauguuugu

SEQ ID NO: 2411517 - RNA, 12 nt, Human
caugauuuccuu

SEQ ID NO: 2411518 - RNA, 14 nt, Human
caugauuuccuuga

SEQ ID NO: 2411519 - RNA, 16 nt, Human
caugauuuccuugaau

SEQ ID NO: 2411520 - RNA, 17 nt, Human
caugauuuccuugaaug

SEQ ID NO: 2411521 - RNA, 13 nt, Human
caugauguuuucc

SEQ ID NO: 2411522 - RNA, 16 nt, Human
caucuggaaucuggag

SEQ ID NO: 2411523 - RNA, 21 nt, Human
caucuggaaucuggagaccag

SEQ ID NO: 2411524 - RNA, 19 nt, Human
caucuggaaccaucagaaa

SEQ ID NO: 2411525 - RNA, 12 nt, Human
caucuggaacca

SEQ ID NO: 2411526 - RNA, 17 nt, Human
caucuggaaccaucaga

SEQ ID NO: 2411527 - RNA, 22 nt, Human
caucugcuuacaauucccugcu

SEQ ID NO: 2411528 - RNA, 20 nt, Human
caucugcuuacaauucccug

SEQ ID NO: 2411529 - RNA, 14 nt, Human
caucugugaauaag

SEQ ID NO: 2411530 - RNA, 13 nt, Human
caucugugaauaa

SEQ ID NO: 2411531 - RNA, 21 nt, Human
caucuggaaggggaucccacc

SEQ ID NO: 2411532 - RNA, 15 nt, Human
caucugugauucccu

SEQ ID NO: 2411533 - RNA, 17 nt, Human
caucugugcacugccca

SEQ ID NO: 2411534 - RNA, 18 nt, Human
caucugugcacugcccau

SEQ ID NO: 2411535 - RNA, 21 nt, Human
caucugugcacugcccaugga

SEQ ID NO: 2411536 - RNA, 15 nt, Human
caucugugcacgcag

SEQ ID NO: 2411537 - RNA, 17 nt, Human
caucugugggcacgcug

SEQ ID NO: 2411538 - RNA, 11 nt, Human
caucuguuuuu

SEQ ID NO: 2411539 - RNA, 20 nt, Human
caucuguuguuuuguuuuaa

SEQ ID NO: 2411540 - RNA, 19 nt, Human
caucuguguuucaaguggg

SEQ ID NO: 2411541 - RNA, 12 nt, Human
caucuguuguuu

SEQ ID NO: 2411542 - RNA, 17 nt, Human
caucuguguuucaagug

SEQ ID NO: 2411543 - RNA, 12 nt, Human
caucuguucugg

SEQ ID NO: 2411544 - RNA, 11 nt, Human
caucugugucu

SEQ ID NO: 2411545 - RNA, 13 nt, Human
caucugugucuug

SEQ ID NO: 2411546 - RNA, 14 nt, Human
caucugugucuugu

SEQ ID NO: 2411547 - RNA, 15 nt, Human
caucugugugaaaau

SEQ ID NO: 2411548 - RNA, 20 nt, Human
caucugcucuccuuccugga

SEQ ID NO: 2411549 - RNA, 18 nt, Human
caucugcucuccuuccug

SEQ ID NO: 2411550 - RNA, 20 nt, Human
caucgugaaacccugucucu

SEQ ID NO: 2411551 - RNA, 16 nt, Human
caucugcucuccuucc

SEQ ID NO: 2411552 - RNA, 19 nt, Human
caucugcugguccguggga

SEQ ID NO: 2411553 - RNA, 14 nt, Human
caucugcugguccg

SEQ ID NO: 2411554 - RNA, 22 nt, Human
caucggugaaacuaacagauaa

SEQ ID NO: 2411555 - RNA, 13 nt, Human
caucgggcugagg

SEQ ID NO: 2411556 - RNA, 21 nt, Human
caucggugaaacuaacagaua

SEQ ID NO: 2411557 - RNA, 21 nt, Human
caucguauaacacaauaugaa

SEQ ID NO: 2411558 - RNA, 22 nt, Human
cauccuggcacccggccccugc

SEQ ID NO: 2411559 - RNA, 19 nt, Human
caucgcaccauucugacuc

SEQ ID NO: 2411560 - RNA, 18 nt, Human
caucgcaccauucugacu

SEQ ID NO: 2411561 - RNA, 23 nt, Human
cauccugccuuagagccaggcac

SEQ ID NO: 2411562 - RNA, 16 nt, Human
caucgcaccauucuga

SEQ ID NO: 2411563 - RNA, 16 nt, Human
caucgccgggacucca

SEQ ID NO: 2411564 - RNA, 22 nt, Human
cauccugccuuagagccaggca

SEQ ID NO: 2411565 - RNA, 15 nt, Human
cauccuggcacccgg

SEQ ID NO: 2411566 - RNA, 21 nt, Human
caucccguguucuccuuuucc

SEQ ID NO: 2411567 - RNA, 17 nt, Human
caucccguguucuccuu

SEQ ID NO: 2411568 - RNA, 12 nt, Human
caucccuacccc

SEQ ID NO: 2411569 - RNA, 18 nt, Human
caucccuaaugcugcaga

SEQ ID NO: 2411570 - RNA, 21 nt, Human
cauccugccuuagagccaggc

SEQ ID NO: 2411571 - RNA, 17 nt, Human
caucccgagcaccucca

SEQ ID NO: 2411572 - RNA, 21 nt, Human
caucccgggacgcagcaggag

SEQ ID NO: 2411573 - RNA, 16 nt, Human
caucccguguucuccu

SEQ ID NO: 2411574 - RNA, 14 nt, Human
caucccguguucuc

SEQ ID NO: 2411575 - RNA, 12 nt, Human
caucacuucccu

SEQ ID NO: 2411576 - RNA, 14 nt, Human
caucacuucccuac

SEQ ID NO: 2411577 - RNA, 14 nt, Human
caucacuuguacaa

SEQ ID NO: 2411578 - RNA, 15 nt, Human
caucacuuguacaaa

SEQ ID NO: 2411579 - RNA, 23 nt, Human
caucacuugaauccuagggccug

SEQ ID NO: 2411580 - RNA, 20 nt, Human
caucacuugaauccuagggc

SEQ ID NO: 2411581 - RNA, 21 nt, Human
cauccccuguagagugggagc

SEQ ID NO: 2411582 - RNA, 23 nt, Human
caucccgacauggacccggagcu

SEQ ID NO: 2411583 - RNA, 19 nt, Human
caucacuggagcaccaggc

SEQ ID NO: 2411584 - RNA, 13 nt, Human
cauauucugucug

SEQ ID NO: 2411585 - RNA, 22 nt, Human
cauauuccugcagccuggaggc

SEQ ID NO: 2411586 - RNA, 19 nt, Human
caguggugguuuucuguuc

SEQ ID NO: 2411587 - RNA, 20 nt, Human
caguggugguuuucuguucu

SEQ ID NO: 2411588 - RNA, 21 nt, Human
caguggugguuuucuguucuu

SEQ ID NO: 2411589 - RNA, 22 nt, Human
caguggugguuuucuguucuuu

SEQ ID NO: 2411590 - RNA, 20 nt, Human
cauauggacucugcacauga

SEQ ID NO: 2411591 - RNA, 17 nt, Human
cauauggacucugcaca

SEQ ID NO: 2411592 - RNA, 15 nt, Human
cauauggacucugca

SEQ ID NO: 2411593 - RNA, 23 nt, Human
cauauggauuuucuauuguuacu

SEQ ID NO: 2411594 - RNA, 20 nt, Human
cauauggauuuucuauuguu

SEQ ID NO: 2411595 - RNA, 18 nt, Human
cauauggauuuucuauug

SEQ ID NO: 2411596 - RNA, 18 nt, Human
cauauggacucugcacau

SEQ ID NO: 2411597 - RNA, 23 nt, Human
cauaugcuguauauccuuucuaa

SEQ ID NO: 2411598 - RNA, 16 nt, Human
cagugguggcagggcc

SEQ ID NO: 2411599 - RNA, 14 nt, Human
cagugguggcaggg

SEQ ID NO: 2411600 - RNA, 12 nt, Human
cagugguggcag

SEQ ID NO: 2411601 - RNA, 19 nt, Human
cagugguggcagggccuag

SEQ ID NO: 2411602 - RNA, 18 nt, Human
cauauucuguuggccagu

SEQ ID NO: 2411603 - RNA, 17 nt, Human
cauauucuguuggccag

SEQ ID NO: 2411604 - RNA, 16 nt, Human
cauauuaccacagaca

SEQ ID NO: 2411605 - RNA, 16 nt, Human
cauauuccauauuuau

SEQ ID NO: 2411606 - RNA, 23 nt, Human
cauauucauguaaacaaaauuua

SEQ ID NO: 2411607 - RNA, 17 nt, Human
cauauuccauauuuauu

SEQ ID NO: 2411608 - RNA, 17 nt, Human
cauauuccugcagccug

SEQ ID NO: 2411609 - RNA, 18 nt, Human
cauauuccugcagccugg

SEQ ID NO: 2411610 - RNA, 21 nt, Human
cauauuccugcagccuggagg

SEQ ID NO: 2411611 - RNA, 20 nt, Human
cauauggcccagugucaagu

SEQ ID NO: 2411612 - RNA, 16 nt, Human
cauauggcccaguguc

SEQ ID NO: 2411613 - RNA, 15 nt, Human
cauauggcccagugu

SEQ ID NO: 2411614 - RNA, 16 nt, Human
cauauguugcucaguc

SEQ ID NO: 2411615 - RNA, 15 nt, Human
cauauguugcucagu

SEQ ID NO: 2411616 - RNA, 19 nt, Human
cauauguugaauacuuuuu

SEQ ID NO: 2411617 - RNA, 22 nt, Human
cauauguuucgcugauauaugu

SEQ ID NO: 2411618 - RNA, 19 nt, Human
ccacgcccccacuggugac

SEQ ID NO: 2411619 - RNA, 18 nt, Human
ccacgcccccacugguga

SEQ ID NO: 2411620 - RNA, 18 nt, Human
ccacgcccguccugccug

SEQ ID NO: 2411621 - RNA, 17 nt, Human
ccacgcccguccugccu

SEQ ID NO: 2411622 - RNA, 15 nt, Human
ccacgcccguccugc

SEQ ID NO: 2411623 - RNA, 15 nt, Human
ccacgacugucucca

SEQ ID NO: 2411624 - RNA, 13 nt, Human
ccacgcccggcua

SEQ ID NO: 2411625 - RNA, 13 nt, Human
ccacgcccccacu

SEQ ID NO: 2411626 - RNA, 14 nt, Human
ccaccuuuucagcg

SEQ ID NO: 2411627 - RNA, 19 nt, Human
ccacgaauuugcuggggaa

SEQ ID NO: 2411628 - RNA, 15 nt, Human
ccacgaauuugcugg

SEQ ID NO: 2411629 - RNA, 23 nt, Human
ccacgaauuugcuggggaaucuc

SEQ ID NO: 2411630 - RNA, 14 nt, Human
ccacgacugucucc

SEQ ID NO: 2411631 - RNA, 17 nt, Human
ccacgcccccacuggug

SEQ ID NO: 2411632 - RNA, 16 nt, Human
ccacgcccccacuggu

SEQ ID NO: 2411633 - RNA, 13 nt, Human
ccaccgccuccua

SEQ ID NO: 2411634 - RNA, 17 nt, Human
ccaccgcccagagaccc

SEQ ID NO: 2411635 - RNA, 17 nt, Human
ccaccgccauggcuucc

SEQ ID NO: 2411636 - RNA, 14 nt, Human
ccaccgccauggcu

SEQ ID NO: 2411637 - RNA, 13 nt, Human
ccaccgccauggc

SEQ ID NO: 2411638 - RNA, 18 nt, Human
ccaccgcaugcccccucg

SEQ ID NO: 2411639 - RNA, 13 nt, Human
ccaccgcccagag

SEQ ID NO: 2411640 - RNA, 23 nt, Human
ccaccuuucagauaacuguuauu

SEQ ID NO: 2411641 - RNA, 18 nt, Human
ccaccgccauggcuucca

SEQ ID NO: 2411642 - RNA, 20 nt, Human
ccaccuuuauuaaaaucuua

SEQ ID NO: 2411643 - RNA, 21 nt, Human
ccaccuuugaagaaguaagga

SEQ ID NO: 2411644 - RNA, 17 nt, Human
ccaccgcaugcccccuc

SEQ ID NO: 2411645 - RNA, 16 nt, Human
ccaccgcaugcccccu

SEQ ID NO: 2411646 - RNA, 13 nt, Human
ccaccgcaugccc

SEQ ID NO: 2411647 - RNA, 23 nt, Human
ccaccgaaguggacuggccccug

SEQ ID NO: 2411648 - RNA, 19 nt, Human
ccaccgcagacaggaccag

SEQ ID NO: 2411649 - RNA, 22 nt, Human
ccaccgcagacaggaccaggga

SEQ ID NO: 2411650 - RNA, 13 nt, Human
ccaccgcagacag

SEQ ID NO: 2411651 - RNA, 18 nt, Human
ccaccgaagccgccugug

SEQ ID NO: 2411652 - RNA, 15 nt, Human
ccacccuuugggggg

SEQ ID NO: 2411653 - RNA, 22 nt, Human
ccaccgaaguggacuggccccu

SEQ ID NO: 2411654 - RNA, 23 nt, Human
ccacccuuuggggggggcccgcc

SEQ ID NO: 2411655 - RNA, 22 nt, Human
ccacgcccguccugccuguggc

SEQ ID NO: 2411656 - RNA, 21 nt, Human
ccacgcccguccugccugugg

SEQ ID NO: 2411657 - RNA, 20 nt, Human
ccacgcccguccugccugug

SEQ ID NO: 2411658 - RNA, 19 nt, Human
ccacgcccguccugccugu

SEQ ID NO: 2411659 - RNA, 17 nt, Human
ccacgcccuccccuccc

SEQ ID NO: 2411660 - RNA, 15 nt, Human
ccacgcccuccccuc

SEQ ID NO: 2411661 - RNA, 23 nt, Human
ccacgcccguccugccuguggcg

SEQ ID NO: 2411662 - RNA, 14 nt, Human
ccacgcccuccccu

SEQ ID NO: 2411663 - RNA, 12 nt, Human
ccacagcaguug

SEQ ID NO: 2411664 - RNA, 14 nt, Human
ccacagcacagcca

SEQ ID NO: 2411665 - RNA, 19 nt, Human
ccacagcaaggcaccugca

SEQ ID NO: 2411666 - RNA, 17 nt, Human
ccacagcaaggcaccug

SEQ ID NO: 2411667 - RNA, 19 nt, Human
ccacagcaaccccaggcug

SEQ ID NO: 2411668 - RNA, 20 nt, Human
ccacagcaaccccaggcuga

SEQ ID NO: 2411669 - RNA, 18 nt, Human
ccacagaugccuccaccc

SEQ ID NO: 2411670 - RNA, 23 nt, Human
ccacagcgcuggccgggaccccg

SEQ ID NO: 2411671 - RNA, 13 nt, Human
ccacagcucccac

SEQ ID NO: 2411672 - RNA, 15 nt, Human
ccacagcucccaccc

SEQ ID NO: 2411673 - RNA, 16 nt, Human
ccacagcucccacccc

SEQ ID NO: 2411674 - RNA, 17 nt, Human
ccacagcucccacccca

SEQ ID NO: 2411675 - RNA, 22 nt, Human
ccacagccagcaccuggcaucg

SEQ ID NO: 2411676 - RNA, 19 nt, Human
ccacagccagcaccuggca

SEQ ID NO: 2411677 - RNA, 18 nt, Human
ccacagccagcaccuggc

SEQ ID NO: 2411678 - RNA, 17 nt, Human
ccacagccagcaccugg

SEQ ID NO: 2411679 - RNA, 16 nt, Human
ccacagccuccccugc

SEQ ID NO: 2411680 - RNA, 19 nt, Human
ccacagccuccccugccag

SEQ ID NO: 2411681 - RNA, 20 nt, Human
ccacagccuccccugccagg

SEQ ID NO: 2411682 - RNA, 17 nt, Human
ccacagcaguugaaaag

SEQ ID NO: 2411683 - RNA, 18 nt, Human
ccacagcaguugaaaaga

SEQ ID NO: 2411684 - RNA, 23 nt, Human
ccacagcaguugaaaagacucca

SEQ ID NO: 2411685 - RNA, 20 nt, Human
ccacagcaaggcaccugcag

SEQ ID NO: 2411686 - RNA, 14 nt, Human
ccacagcagcugaa

SEQ ID NO: 2411687 - RNA, 15 nt, Human
ccacagccagcaccu

SEQ ID NO: 2411688 - RNA, 20 nt, Human
ccacagcaucauuuugcauu

SEQ ID NO: 2411689 - RNA, 12 nt, Human
ccacagcaggug

SEQ ID NO: 2411690 - RNA, 20 nt, Human
ccacccuuggaggcugucuu

SEQ ID NO: 2411691 - RNA, 19 nt, Human
ccacccuuggccugucuca

SEQ ID NO: 2411692 - RNA, 16 nt, Human
ccacccuuggccuguc

SEQ ID NO: 2411693 - RNA, 17 nt, Human
ccacccuuggccugucu

SEQ ID NO: 2411694 - RNA, 12 nt, Human
ccacccuuggcc

SEQ ID NO: 2411695 - RNA, 13 nt, Human
ccacccuuggccu

SEQ ID NO: 2411696 - RNA, 14 nt, Human
ccacccuuggccug

SEQ ID NO: 2411697 - RNA, 15 nt, Human
ccacccuuggccugu

SEQ ID NO: 2411698 - RNA, 19 nt, Human
ccacccugucccccagcuc

SEQ ID NO: 2411699 - RNA, 18 nt, Human
ccacccugucccccagcu

SEQ ID NO: 2411700 - RNA, 16 nt, Human
ccacccugucccccag

SEQ ID NO: 2411701 - RNA, 14 nt, Human
ccacccuguccccc

SEQ ID NO: 2411702 - RNA, 22 nt, Human
ccacccugucccccagcucugg

SEQ ID NO: 2411703 - RNA, 21 nt, Human
ccacccugucccccagcucug

SEQ ID NO: 2411704 - RNA, 12 nt, Human
ccacccuguguu

SEQ ID NO: 2411705 - RNA, 13 nt, Human
ccacccuugccca

SEQ ID NO: 2411706 - RNA, 12 nt, Human
ccacccuugccc

SEQ ID NO: 2411707 - RNA, 14 nt, Human
ccacccuuccccuc

SEQ ID NO: 2411708 - RNA, 23 nt, Human
ccacccugggcucugugggcugc

SEQ ID NO: 2411709 - RNA, 20 nt, Human
ccacccugggcucugugggc

SEQ ID NO: 2411710 - RNA, 18 nt, Human
ccacccugggcucugugg

SEQ ID NO: 2411711 - RNA, 17 nt, Human
ccacccugggcucugug

SEQ ID NO: 2411712 - RNA, 16 nt, Human
ccacccugggcucugg

SEQ ID NO: 2411713 - RNA, 15 nt, Human
ccacccugggcucug

SEQ ID NO: 2411714 - RNA, 13 nt, Human
ccacccugggcuc

SEQ ID NO: 2411715 - RNA, 12 nt, Human
ccacccugggcu

SEQ ID NO: 2411716 - RNA, 22 nt, Human
ccacccugggcccugggcugga

SEQ ID NO: 2411717 - RNA, 20 nt, Human
ccacccugggcccugggcug

SEQ ID NO: 2411718 - RNA, 17 nt, Human
ccacccugggcccuggg

SEQ ID NO: 2411719 - RNA, 16 nt, Human
ccacccugggcccugg

SEQ ID NO: 2411720 - RNA, 15 nt, Human
ccaccaucaagccac

SEQ ID NO: 2411721 - RNA, 18 nt, Human
ccaccauauucagugcug

SEQ ID NO: 2411722 - RNA, 22 nt, Human
ccaccauauucagugcuguggc

SEQ ID NO: 2411723 - RNA, 15 nt, Human
ccacccugggcccug

SEQ ID NO: 2411724 - RNA, 23 nt, Human
ccaccauauucagugcuguggcc

SEQ ID NO: 2411725 - RNA, 19 nt, Human
ccacagcucccaccccacc

SEQ ID NO: 2411726 - RNA, 17 nt, Human
ccaccacacccagccca

SEQ ID NO: 2411727 - RNA, 20 nt, Human
ccaccacagccagcaccugg

SEQ ID NO: 2411728 - RNA, 18 nt, Human
ccaccacagccagcaccu

SEQ ID NO: 2411729 - RNA, 15 nt, Human
ccaccacagccagca

SEQ ID NO: 2411730 - RNA, 14 nt, Human
ccaccacagccagc

SEQ ID NO: 2411731 - RNA, 21 nt, Human
ccaccacacugauccagcccu

SEQ ID NO: 2411732 - RNA, 17 nt, Human
ccaccacaccgcagaag

SEQ ID NO: 2411733 - RNA, 14 nt, Human
ccaccaucaagcca

SEQ ID NO: 2411734 - RNA, 13 nt, Human
ccaccaucaagcc

SEQ ID NO: 2411735 - RNA, 15 nt, Human
ccaccaccacuggcc

SEQ ID NO: 2411736 - RNA, 14 nt, Human
ccaccaccacuggc

SEQ ID NO: 2411737 - RNA, 17 nt, Human
ccaccaccaauugccaa

SEQ ID NO: 2411738 - RNA, 21 nt, Human
ccaccacagccagcaccuggc

SEQ ID NO: 2411739 - RNA, 11 nt, Human
ccaccacccaa

SEQ ID NO: 2411740 - RNA, 15 nt, Human
ccaccaccagaaagc

SEQ ID NO: 2411741 - RNA, 16 nt, Human
ccaccaccacuggcca

SEQ ID NO: 2411742 - RNA, 17 nt, Human
ccacucccugcaaccug

SEQ ID NO: 2411743 - RNA, 14 nt, Human
ccacucucauuccc

SEQ ID NO: 2411744 - RNA, 16 nt, Human
ccacucucauucccca

SEQ ID NO: 2411745 - RNA, 17 nt, Human
ccacucucauuccccag

SEQ ID NO: 2411746 - RNA, 18 nt, Human
ccacucucauuccccagg

SEQ ID NO: 2411747 - RNA, 19 nt, Human
ccacucucauuccccaggu

SEQ ID NO: 2411748 - RNA, 12 nt, Human
ccacucucccca

SEQ ID NO: 2411749 - RNA, 13 nt, Human
ccacucuccccac

SEQ ID NO: 2411750 - RNA, 14 nt, Human
ccacucuccccaca

SEQ ID NO: 2411751 - RNA, 15 nt, Human
ccacucuccccacac

SEQ ID NO: 2411752 - RNA, 16 nt, Human
ccacucuccccacacu

SEQ ID NO: 2411753 - RNA, 22 nt, Human
ccacucuaggggucaggcucca

SEQ ID NO: 2411754 - RNA, 21 nt, Human
ccacucuaggggucaggcucc

SEQ ID NO: 2411755 - RNA, 23 nt, Human
ccacucuaggggucaggcuccau

SEQ ID NO: 2411756 - RNA, 19 nt, Human
ccacucuagggcaguggag

SEQ ID NO: 2411757 - RNA, 21 nt, Human
ccacucuacccucccaccccc

SEQ ID NO: 2411758 - RNA, 19 nt, Human
ccacucuacccucccaccc

SEQ ID NO: 2411759 - RNA, 20 nt, Human
ccacucuacccucccacccc

SEQ ID NO: 2411760 - RNA, 23 nt, Human
ccacuccgagaggugggccaguc

SEQ ID NO: 2411761 - RNA, 19 nt, Human
ccacuccgagaggugggcc

SEQ ID NO: 2411762 - RNA, 17 nt, Human
ccacuccgagagguggg

SEQ ID NO: 2411763 - RNA, 16 nt, Human
ccacuccgagaggugg

SEQ ID NO: 2411764 - RNA, 14 nt, Human
ccacuccuccuagc

SEQ ID NO: 2411765 - RNA, 12 nt, Human
ccacuccucuga

SEQ ID NO: 2411766 - RNA, 18 nt, Human
ccacucuacccucccacc

SEQ ID NO: 2411767 - RNA, 20 nt, Human
ccacuccgagaggugggcca

SEQ ID NO: 2411768 - RNA, 12 nt, Human
ccacuccuccaa

SEQ ID NO: 2411769 - RNA, 16 nt, Human
ccacuccuccaaagga

SEQ ID NO: 2411770 - RNA, 19 nt, Human
ccaaaagauugcugaaauu

SEQ ID NO: 2411771 - RNA, 22 nt, Human
ccaaaagauugcugaaauuuua

SEQ ID NO: 2411772 - RNA, 16 nt, Human
ccaaaagauugcugaa

SEQ ID NO: 2411773 - RNA, 22 nt, Human
ccaaaagaagcccccagcuaag

SEQ ID NO: 2411774 - RNA, 21 nt, Human
ccaaaacucuccucugcugcu

SEQ ID NO: 2411775 - RNA, 11 nt, Human
ccaaaacugug

SEQ ID NO: 2411776 - RNA, 16 nt, Human
ccaaaacugugcagag

SEQ ID NO: 2411777 - RNA, 20 nt, Human
ccaaaacucuccucugcugc

SEQ ID NO: 2411778 - RNA, 22 nt, Human
cauuuuuuuuaagaaaaaggau

SEQ ID NO: 2411779 - RNA, 17 nt, Human
cauuuguauaaaauaau

SEQ ID NO: 2411780 - RNA, 20 nt, Human
cauuuguauaaaauaauuuu

SEQ ID NO: 2411781 - RNA, 19 nt, Human
cauuuguauaaaauaauuu

SEQ ID NO: 2411782 - RNA, 20 nt, Human
cauuuuuuuaauuuauuauu

SEQ ID NO: 2411783 - RNA, 17 nt, Human
cauuuuuuuaauuuauu

SEQ ID NO: 2411784 - RNA, 17 nt, Human
cauuuuuuuccaggcug

SEQ ID NO: 2411785 - RNA, 15 nt, Human
cauuuuuuuccaggc

SEQ ID NO: 2411786 - RNA, 18 nt, Human
cauuuuuuuccaggcugg

SEQ ID NO: 2411787 - RNA, 13 nt, Human
cauuuuuucaguc

SEQ ID NO: 2411788 - RNA, 22 nt, Human
cauuugugugugugcaagugug

SEQ ID NO: 2411789 - RNA, 18 nt, Human
cauuuuuuaaggaaacaa

SEQ ID NO: 2411790 - RNA, 14 nt, Human
cauuugugucaaug

SEQ ID NO: 2411791 - RNA, 15 nt, Human
cauuugugucaaugg

SEQ ID NO: 2411792 - RNA, 13 nt, Human
cauuugugugugu

SEQ ID NO: 2411793 - RNA, 19 nt, Human
cauuugugugugugcaagu

SEQ ID NO: 2411794 - RNA, 15 nt, Human
cauuugugaggccca

SEQ ID NO: 2411795 - RNA, 12 nt, Human
cauuugugaggc

SEQ ID NO: 2411796 - RNA, 11 nt, Human
cauuugugagg

SEQ ID NO: 2411797 - RNA, 18 nt, Human
ccaaugucugccacacaa

SEQ ID NO: 2411798 - RNA, 11 nt, Human
ccaaugucugc

SEQ ID NO: 2411799 - RNA, 21 nt, Human
ccaauguauugauaagagggc

SEQ ID NO: 2411800 - RNA, 17 nt, Human
ccaauguaggagcugcc

SEQ ID NO: 2411801 - RNA, 20 nt, Human
ccaauguaggagcugccuug

SEQ ID NO: 2411802 - RNA, 12 nt, Human
ccaaugucuuga

SEQ ID NO: 2411803 - RNA, 19 nt, Human
ccaaugugaacagcggcug

SEQ ID NO: 2411804 - RNA, 20 nt, Human
ccaauggguuuuucccugua

SEQ ID NO: 2411805 - RNA, 15 nt, Human
ccaauguaggagcug

SEQ ID NO: 2411806 - RNA, 17 nt, Human
ccaaugggagcucaugg

SEQ ID NO: 2411807 - RNA, 23 nt, Human
ccaaugaaauacacaaguaaaca

SEQ ID NO: 2411808 - RNA, 18 nt, Human
ccaacucaccccagcccc

SEQ ID NO: 2411809 - RNA, 17 nt, Human
ccaacucaccccagccc

SEQ ID NO: 2411810 - RNA, 16 nt, Human
ccaacucaccccagcc

SEQ ID NO: 2411811 - RNA, 12 nt, Human
ccaacucuccug

SEQ ID NO: 2411812 - RNA, 14 nt, Human
ccaacucuagcugg

SEQ ID NO: 2411813 - RNA, 21 nt, Human
ccaacucuagcuggggguggg

SEQ ID NO: 2411814 - RNA, 15 nt, Human
ccaacuccuggaagc

SEQ ID NO: 2411815 - RNA, 19 nt, Human
ccaacuccuggaagcugug

SEQ ID NO: 2411816 - RNA, 22 nt, Human
ccaacuccuggaagcugugucc

SEQ ID NO: 2411817 - RNA, 14 nt, Human
ccaacugcugcuuu

SEQ ID NO: 2411818 - RNA, 13 nt, Human
ccaacugcugcuu

SEQ ID NO: 2411819 - RNA, 12 nt, Human
ccaacugcugcu

SEQ ID NO: 2411820 - RNA, 16 nt, Human
ccaacugggcccaaga

SEQ ID NO: 2411821 - RNA, 13 nt, Human
ccaacuguauaua

SEQ ID NO: 2411822 - RNA, 18 nt, Human
ccaacuguguucauuaga

SEQ ID NO: 2411823 - RNA, 17 nt, Human
ccaacugggcccaagac

SEQ ID NO: 2411824 - RNA, 17 nt, Human
ccaaauguucaucaaug

SEQ ID NO: 2411825 - RNA, 14 nt, Human
ccaacucaccccag

SEQ ID NO: 2411826 - RNA, 23 nt, Human
ccaaauggaaaugggcagagcag

SEQ ID NO: 2411827 - RNA, 18 nt, Human
ccaaauguaauugaauaa

SEQ ID NO: 2411828 - RNA, 22 nt, Human
ccaaauguaauugaauaaaguu

SEQ ID NO: 2411829 - RNA, 13 nt, Human
ccaagcucugcuc

SEQ ID NO: 2411830 - RNA, 17 nt, Human
ccaagcucugcuccucu

SEQ ID NO: 2411831 - RNA, 12 nt, Human
ccaagcucugcu

SEQ ID NO: 2411832 - RNA, 14 nt, Human
ccaagcuccuuggg

SEQ ID NO: 2411833 - RNA, 15 nt, Human
ccaagcuccuuggga

SEQ ID NO: 2411834 - RNA, 17 nt, Human
ccaagcuccuugggagg

SEQ ID NO: 2411835 - RNA, 19 nt, Human
ccaagcuccuugggaggcc

SEQ ID NO: 2411836 - RNA, 23 nt, Human
ccaagcugccuccccucuccuuc

SEQ ID NO: 2411837 - RNA, 18 nt, Human
ccaagcucugcuccucuc

SEQ ID NO: 2411838 - RNA, 15 nt, Human
ccaagcucucugcau

SEQ ID NO: 2411839 - RNA, 14 nt, Human
ccaagcucucugca

SEQ ID NO: 2411840 - RNA, 18 nt, Human
ccaagcucuagugggaag

SEQ ID NO: 2411841 - RNA, 22 nt, Human
ccaagcuccuugggaggcccca

SEQ ID NO: 2411842 - RNA, 12 nt, Human
ccaaugaaauga

SEQ ID NO: 2411843 - RNA, 14 nt, Human
ccaaucauuuuaau

SEQ ID NO: 2411844 - RNA, 12 nt, Human
ccaaucauuuua

SEQ ID NO: 2411845 - RNA, 22 nt, Human
ccaauauuuucuuuaaugcuuu

SEQ ID NO: 2411846 - RNA, 17 nt, Human
ccaauauuuaccagacc

SEQ ID NO: 2411847 - RNA, 20 nt, Human
ccaauauuuucuuuaaugcu

SEQ ID NO: 2411848 - RNA, 14 nt, Human
ccaauauuuguaga

SEQ ID NO: 2411849 - RNA, 18 nt, Human
ccaauauuucucagacau

SEQ ID NO: 2411850 - RNA, 14 nt, Human
ccaaugcacuuugu

SEQ ID NO: 2411851 - RNA, 19 nt, Human
ccaaugaggucugaaaugg

SEQ ID NO: 2411852 - RNA, 15 nt, Human
ccaaugauggucacc

SEQ ID NO: 2411853 - RNA, 22 nt, Human
ccaaucauuuuaauuauuauuc

SEQ ID NO: 2411854 - RNA, 17 nt, Human
ccucccaccucagccuc

SEQ ID NO: 2411855 - RNA, 15 nt, Human
ccucccaccucagcc

SEQ ID NO: 2411856 - RNA, 19 nt, Human
ccuccaaccuggggggcag

SEQ ID NO: 2411857 - RNA, 12 nt, Human
ccucccaccccc

SEQ ID NO: 2411858 - RNA, 16 nt, Human
ccucccacccaccgcc

SEQ ID NO: 2411859 - RNA, 13 nt, Human
ccucccaccccca

SEQ ID NO: 2411860 - RNA, 17 nt, Human
ccucccacccccaucuc

SEQ ID NO: 2411861 - RNA, 13 nt, Human
ccucccacccccu

SEQ ID NO: 2411862 - RNA, 15 nt, Human
ccuccaaaagcacuu

SEQ ID NO: 2411863 - RNA, 19 nt, Human
ccuccaaaacuccugcccc

SEQ ID NO: 2411864 - RNA, 17 nt, Human
ccuccaaaggcccccua

SEQ ID NO: 2411865 - RNA, 16 nt, Human
ccuccaaaggcccccu

SEQ ID NO: 2411866 - RNA, 19 nt, Human
ccuccaacaccaagcacag

SEQ ID NO: 2411867 - RNA, 23 nt, Human
ccucauuuuugaauacaggcaua

SEQ ID NO: 2411868 - RNA, 22 nt, Human
ccucauggccccucugaccugc

SEQ ID NO: 2411869 - RNA, 18 nt, Human
ccucauggccccucugac

SEQ ID NO: 2411870 - RNA, 21 nt, Human
ccucauguacauacccuggcc

SEQ ID NO: 2411871 - RNA, 19 nt, Human
ccucaugguggguucaggg

SEQ ID NO: 2411872 - RNA, 15 nt, Human
ccucccauggcaccu

SEQ ID NO: 2411873 - RNA, 16 nt, Human
ccuccccaacccugcc

SEQ ID NO: 2411874 - RNA, 21 nt, Human
ccuccccaacccugccccugc

SEQ ID NO: 2411875 - RNA, 21 nt, Human
ccucccaucugggaguccccu

SEQ ID NO: 2411876 - RNA, 16 nt, Human
ccucccaucugggagu

SEQ ID NO: 2411877 - RNA, 13 nt, Human
ccucccaucuggg

SEQ ID NO: 2411878 - RNA, 17 nt, Human
ccucccauccccuggac

SEQ ID NO: 2411879 - RNA, 20 nt, Human
ccuccccaaaucaauacacu

SEQ ID NO: 2411880 - RNA, 16 nt, Human
ccucccaucucacaca

SEQ ID NO: 2411881 - RNA, 13 nt, Human
ccucccaucucac

SEQ ID NO: 2411882 - RNA, 14 nt, Human
ccucccauccccug

SEQ ID NO: 2411883 - RNA, 21 nt, Human
ccucccacccgaugcugcuuu

SEQ ID NO: 2411884 - RNA, 19 nt, Human
ccucccacccgaugcugcu

SEQ ID NO: 2411885 - RNA, 12 nt, Human
ccucccacccga

SEQ ID NO: 2411886 - RNA, 20 nt, Human
ccucccacccccuucucugc

SEQ ID NO: 2411887 - RNA, 21 nt, Human
ccucccacccccuucucugcu

SEQ ID NO: 2411888 - RNA, 20 nt, Human
ccucaaaaagauuuccccau

SEQ ID NO: 2411889 - RNA, 20 nt, Human
ccuauuuuuuuucuguuaua

SEQ ID NO: 2411890 - RNA, 18 nt, Human
ccucaaaccuccucuucu

SEQ ID NO: 2411891 - RNA, 16 nt, Human
ccucaaaccuccucuu

SEQ ID NO: 2411892 - RNA, 15 nt, Human
ccucaaaccuccucu

SEQ ID NO: 2411893 - RNA, 13 nt, Human
ccucaaaccuccu

SEQ ID NO: 2411894 - RNA, 22 nt, Human
ccucaaacaguagguuggcagu

SEQ ID NO: 2411895 - RNA, 21 nt, Human
ccucaaacacugcaggcauca

SEQ ID NO: 2411896 - RNA, 18 nt, Human
ccucaaacacugcaggca

SEQ ID NO: 2411897 - RNA, 17 nt, Human
ccucaaacacugcaggc

SEQ ID NO: 2411898 - RNA, 15 nt, Human
ccucaaacacugcag

SEQ ID NO: 2411899 - RNA, 13 nt, Human
ccucaaacacugc

SEQ ID NO: 2411900 - RNA, 16 nt, Human
ccucaaaagcacccuu

SEQ ID NO: 2411901 - RNA, 20 nt, Human
ccucagccuggccagacaca

SEQ ID NO: 2411902 - RNA, 21 nt, Human
ccucagccuggccagacacag

SEQ ID NO: 2411903 - RNA, 16 nt, Human
ccucaaaggcccgcuc

SEQ ID NO: 2411904 - RNA, 19 nt, Human
ccucagccuggccagacac

SEQ ID NO: 2411905 - RNA, 22 nt, Human
ccucagccuggccagacacagg

SEQ ID NO: 2411906 - RNA, 11 nt, Human
ccucagccugu

SEQ ID NO: 2411907 - RNA, 12 nt, Human
ccucagccugug

SEQ ID NO: 2411908 - RNA, 22 nt, Human
ccucagccuuccccuugcccag

SEQ ID NO: 2411909 - RNA, 16 nt, Human
ccucagccugugcugc

SEQ ID NO: 2411910 - RNA, 16 nt, Human
ccucauggccccucug

SEQ ID NO: 2411911 - RNA, 15 nt, Human
ccucauggccccucu

SEQ ID NO: 2411912 - RNA, 23 nt, Human
ccucauggaauuggagcucgugg

SEQ ID NO: 2411913 - RNA, 18 nt, Human
ccucaggacaaugucuga

SEQ ID NO: 2411914 - RNA, 17 nt, Human
ccucaggaaugggcugu

SEQ ID NO: 2411915 - RNA, 16 nt, Human
ccucaggaaugggcug

SEQ ID NO: 2411916 - RNA, 18 nt, Human
ccucaggacugcaacagg

SEQ ID NO: 2411917 - RNA, 13 nt, Human
ccucaggacugca

SEQ ID NO: 2411918 - RNA, 17 nt, Human
ccucagccuugccagag

SEQ ID NO: 2411919 - RNA, 18 nt, Human
ccucagccuugccagaga

SEQ ID NO: 2411920 - RNA, 19 nt, Human
ccucagccuugccagagau

SEQ ID NO: 2411921 - RNA, 20 nt, Human
ccucagccuugccagagauc

SEQ ID NO: 2411922 - RNA, 14 nt, Human
ccucagcugcuucu

SEQ ID NO: 2411923 - RNA, 20 nt, Human
ccucagcugccucacuuccu

SEQ ID NO: 2411924 - RNA, 21 nt, Human
ccucagccuugccagagaucc

SEQ ID NO: 2411925 - RNA, 19 nt, Human
ccucagcugccucacuucc

SEQ ID NO: 2411926 - RNA, 17 nt, Human
ccggcgucagccuccag

SEQ ID NO: 2411927 - RNA, 16 nt, Human
ccggcgucagccucca

SEQ ID NO: 2411928 - RNA, 15 nt, Human
ccggcgucagccucc

SEQ ID NO: 2411929 - RNA, 14 nt, Human
ccggcgucagccuc

SEQ ID NO: 2411930 - RNA, 13 nt, Human
ccggcgucagccu

SEQ ID NO: 2411931 - RNA, 16 nt, Human
ccggcgggcgggccgg

SEQ ID NO: 2411932 - RNA, 19 nt, Human
ccggcggcccaagcccgac

SEQ ID NO: 2411933 - RNA, 21 nt, Human
ccggcgcuugccacuagggcu

SEQ ID NO: 2411934 - RNA, 22 nt, Human
ccggcgucagccuccagccucu

SEQ ID NO: 2411935 - RNA, 21 nt, Human
ccggcgucagccuccagccuc

SEQ ID NO: 2411936 - RNA, 20 nt, Human
ccggcgucagccuccagccu

SEQ ID NO: 2411937 - RNA, 19 nt, Human
ccggcgucagccuccagcc

SEQ ID NO: 2411938 - RNA, 23 nt, Human
ccggcgucagccuccagccucug

SEQ ID NO: 2411939 - RNA, 16 nt, Human
ccggccugcucccagc

SEQ ID NO: 2411940 - RNA, 20 nt, Human
ccggccugcucccagcagcc

SEQ ID NO: 2411941 - RNA, 15 nt, Human
ccggcgagcccugug

SEQ ID NO: 2411942 - RNA, 21 nt, Human
ccggcgcccucuguccugacu

SEQ ID NO: 2411943 - RNA, 19 nt, Human
ccggcgcccucuguccuga

SEQ ID NO: 2411944 - RNA, 18 nt, Human
ccggcgcccucuguccug

SEQ ID NO: 2411945 - RNA, 17 nt, Human
ccggcgcccucuguccu

SEQ ID NO: 2411946 - RNA, 15 nt, Human
ccggcgcccucuguc

SEQ ID NO: 2411947 - RNA, 14 nt, Human
ccggcgcccucugu

SEQ ID NO: 2411948 - RNA, 17 nt, Human
ccggcgagcccugugga

SEQ ID NO: 2411949 - RNA, 21 nt, Human
ccggccugaugacagagcgag

SEQ ID NO: 2411950 - RNA, 22 nt, Human
ccggccucucuggccucccacc

SEQ ID NO: 2411951 - RNA, 21 nt, Human
ccggccucucuggccucccac

SEQ ID NO: 2411952 - RNA, 20 nt, Human
ccggccucucuggccuccca

SEQ ID NO: 2411953 - RNA, 19 nt, Human
ccggccccggccccagcca

SEQ ID NO: 2411954 - RNA, 18 nt, Human
ccggccucucuggccucc

SEQ ID NO: 2411955 - RNA, 14 nt, Human
ccggccccugcugg

SEQ ID NO: 2411956 - RNA, 17 nt, Human
ccggccccagccagagu

SEQ ID NO: 2411957 - RNA, 16 nt, Human
ccggccccggccccag

SEQ ID NO: 2411958 - RNA, 20 nt, Human
ccggcccccuggucucuggu

SEQ ID NO: 2411959 - RNA, 19 nt, Human
ccggcccccuggucucugg

SEQ ID NO: 2411960 - RNA, 15 nt, Human
ccggcccccuggucu

SEQ ID NO: 2411961 - RNA, 13 nt, Human
ccggcccccuggu

SEQ ID NO: 2411962 - RNA, 18 nt, Human
ccggccccagccagaguu

SEQ ID NO: 2411963 - RNA, 17 nt, Human
ccggcccccagagcgcc

SEQ ID NO: 2411964 - RNA, 13 nt, Human
ccggccccugcug

SEQ ID NO: 2411965 - RNA, 15 nt, Human
cccuucgcuccugug

SEQ ID NO: 2411966 - RNA, 14 nt, Human
cccuucgcuccugu

SEQ ID NO: 2411967 - RNA, 21 nt, Human
cccuucucuccagccccugga

SEQ ID NO: 2411968 - RNA, 19 nt, Human
cccuuccuuuucccugcuu

SEQ ID NO: 2411969 - RNA, 21 nt, Human
cccugugacauggugccugag

SEQ ID NO: 2411970 - RNA, 20 nt, Human
cccugugacauggugccuga

SEQ ID NO: 2411971 - RNA, 19 nt, Human
cccugugacauggugccug

SEQ ID NO: 2411972 - RNA, 22 nt, Human
cccuuccuuuucccugcuucca

SEQ ID NO: 2411973 - RNA, 21 nt, Human
cccuuccuuuucccugcuucc

SEQ ID NO: 2411974 - RNA, 22 nt, Human
cccuucucuccagccccuggau

SEQ ID NO: 2411975 - RNA, 13 nt, Human
cccuucucugcuc

SEQ ID NO: 2411976 - RNA, 14 nt, Human
cccuucucugcucc

SEQ ID NO: 2411977 - RNA, 15 nt, Human
cccuucucugcucca

SEQ ID NO: 2411978 - RNA, 16 nt, Human
cccuucucugcuccac

SEQ ID NO: 2411979 - RNA, 17 nt, Human
cccuucucugcuccacc

SEQ ID NO: 2411980 - RNA, 20 nt, Human
cccuucucugcuccaccaca

SEQ ID NO: 2411981 - RNA, 23 nt, Human
cccuucucugcuccaccacaucc

SEQ ID NO: 2411982 - RNA, 22 nt, Human
ccgcagcucuugcccuucccug

SEQ ID NO: 2411983 - RNA, 20 nt, Human
ccgcagcucuugcccuuccc

SEQ ID NO: 2411984 - RNA, 18 nt, Human
ccgcagcucuugcccuuc

SEQ ID NO: 2411985 - RNA, 17 nt, Human
ccgcagcucuugcccuu

SEQ ID NO: 2411986 - RNA, 14 nt, Human
ccgcagcucuugcc

SEQ ID NO: 2411987 - RNA, 14 nt, Human
ccgcagccucccuc

SEQ ID NO: 2411988 - RNA, 21 nt, Human
ccgcauccuagucucuaucau

SEQ ID NO: 2411989 - RNA, 12 nt, Human
ccgcaucuucuc

SEQ ID NO: 2411990 - RNA, 15 nt, Human
ccgcaucuucuccau

SEQ ID NO: 2411991 - RNA, 16 nt, Human
ccgcaucuucuccauc

SEQ ID NO: 2411992 - RNA, 19 nt, Human
ccgcaucuucuccaucugg

SEQ ID NO: 2411993 - RNA, 20 nt, Human
ccgcaucuucuccaucuggc

SEQ ID NO: 2411994 - RNA, 22 nt, Human
ccgcaucuucuccaucuggcag

SEQ ID NO: 2411995 - RNA, 23 nt, Human
ccgcaugcccccucgugccaguc

SEQ ID NO: 2411996 - RNA, 22 nt, Human
ccgcaugcccccucgugccagu

SEQ ID NO: 2411997 - RNA, 21 nt, Human
ccgcaugcccccucgugccag

SEQ ID NO: 2411998 - RNA, 19 nt, Human
ccgcaugcccccucgugcc

SEQ ID NO: 2411999 - RNA, 18 nt, Human
ccgcaugcccccucgugc

SEQ ID NO: 2412000 - RNA, 13 nt, Human
ccgcaugcccccu

SEQ ID NO: 2412001 - RNA, 12 nt, Human
ccgcaugccccc

SEQ ID NO: 2412002 - RNA, 17 nt, Human
ccgcaugcggcccagga

SEQ ID NO: 2412003 - RNA, 16 nt, Human
ccgcaugcggcccagg

SEQ ID NO: 2412004 - RNA, 14 nt, Human
ccgcauucccugag

SEQ ID NO: 2412005 - RNA, 13 nt, Human
ccgcauucccuga

SEQ ID NO: 2412006 - RNA, 22 nt, Human
ccgcagucgucgcacagucucu

SEQ ID NO: 2412007 - RNA, 15 nt, Human
ccgcagugugcacua

SEQ ID NO: 2412008 - RNA, 21 nt, Human
ccgcagucgucgcacagucuc

SEQ ID NO: 2412009 - RNA, 19 nt, Human
ccgcagucgucgcacaguc

SEQ ID NO: 2412010 - RNA, 19 nt, Human
ccgcaggaagcugcuccgu

SEQ ID NO: 2412011 - RNA, 12 nt, Human
ccgcaggaagcu

SEQ ID NO: 2412012 - RNA, 13 nt, Human
ccgcaggaagcug

SEQ ID NO: 2412013 - RNA, 14 nt, Human
ccgcaggaagcugc

SEQ ID NO: 2412014 - RNA, 15 nt, Human
ccgcaggaagcugcu

SEQ ID NO: 2412015 - RNA, 23 nt, Human
ccgcaggauuugggcucuuggaa

SEQ ID NO: 2412016 - RNA, 23 nt, Human
ccgcagugugcacuaaggggccc

SEQ ID NO: 2412017 - RNA, 22 nt, Human
ccgcagugugcacuaaggggcc

SEQ ID NO: 2412018 - RNA, 17 nt, Human
ccgcaguuccugucccu

SEQ ID NO: 2412019 - RNA, 16 nt, Human
ccgcauccuagucucu

SEQ ID NO: 2412020 - RNA, 12 nt, Human
cccugucuagag

SEQ ID NO: 2412021 - RNA, 13 nt, Human
cccugucuaauga

SEQ ID NO: 2412022 - RNA, 16 nt, Human
cccugucuaaugaaac

SEQ ID NO: 2412023 - RNA, 20 nt, Human
cccugucucaaaaaaagaaa

SEQ ID NO: 2412024 - RNA, 23 nt, Human
cccugucucaaaaaaagaaaaag

SEQ ID NO: 2412025 - RNA, 19 nt, Human
cccugugauggggcccugc

SEQ ID NO: 2412026 - RNA, 18 nt, Human
cccugugauggggcccug

SEQ ID NO: 2412027 - RNA, 20 nt, Human
cccugugauggggcccugcc

SEQ ID NO: 2412028 - RNA, 13 nt, Human
cccuucgcuccug

SEQ ID NO: 2412029 - RNA, 18 nt, Human
cccugugacauggugccu

SEQ ID NO: 2412030 - RNA, 17 nt, Human
cccugugacauggugcc

SEQ ID NO: 2412031 - RNA, 23 nt, Human
cccugucuguagagggcccuggu

SEQ ID NO: 2412032 - RNA, 22 nt, Human
cccugucuguagagggcccugg

SEQ ID NO: 2412033 - RNA, 13 nt, Human
cccugucuugucc

SEQ ID NO: 2412034 - RNA, 17 nt, Human
cccugugauggggcccu

SEQ ID NO: 2412035 - RNA, 16 nt, Human
cccugucuagagaggg

SEQ ID NO: 2412036 - RNA, 17 nt, Human
cccugucuagagaggga

SEQ ID NO: 2412037 - RNA, 14 nt, Human
cccugucucuacua

SEQ ID NO: 2412038 - RNA, 20 nt, Human
cccugucuagagagggaggc

SEQ ID NO: 2412039 - RNA, 23 nt, Human
cccugucugaaggacacuuccug

SEQ ID NO: 2412040 - RNA, 23 nt, Human
cccugucucuacuaaaaaugcaa

SEQ ID NO: 2412041 - RNA, 21 nt, Human
cccugucuguagagggcccug

SEQ ID NO: 2412042 - RNA, 20 nt, Human
cccugucuguagagggcccu

SEQ ID NO: 2412043 - RNA, 16 nt, Human
cccugucugccagggc

SEQ ID NO: 2412044 - RNA, 22 nt, Human
ccuggccgcccccugcccccca

SEQ ID NO: 2412045 - RNA, 21 nt, Human
ccuggccgcccccugcccccc

SEQ ID NO: 2412046 - RNA, 23 nt, Human
ccuggccggcaaccccaguucug

SEQ ID NO: 2412047 - RNA, 21 nt, Human
ccuggccggcaaccccaguuc

SEQ ID NO: 2412048 - RNA, 19 nt, Human
ccuggccggcaaccccagu

SEQ ID NO: 2412049 - RNA, 22 nt, Human
ccuggccggcaaccccaguucu

SEQ ID NO: 2412050 - RNA, 21 nt, Human
ccuggccucugcacuccccug

SEQ ID NO: 2412051 - RNA, 20 nt, Human
ccuggccucugcacuccccu

SEQ ID NO: 2412052 - RNA, 22 nt, Human
ccuggccuagcauacguacaca

SEQ ID NO: 2412053 - RNA, 13 nt, Human
ccuggccucugug

SEQ ID NO: 2412054 - RNA, 22 nt, Human
ccuggccucugcacuccccugc

SEQ ID NO: 2412055 - RNA, 20 nt, Human
ccugggccccaguuguauuu

SEQ ID NO: 2412056 - RNA, 23 nt, Human
ccugggccccaccaccuaggcca

SEQ ID NO: 2412057 - RNA, 11 nt, Human
ccugggcccuc

SEQ ID NO: 2412058 - RNA, 14 nt, Human
ccugggcccucucu

SEQ ID NO: 2412059 - RNA, 22 nt, Human
ccugggccccucaucugcucag

SEQ ID NO: 2412060 - RNA, 21 nt, Human
ccugggccccaccaccuaggc

SEQ ID NO: 2412061 - RNA, 12 nt, Human
ccugggggcucu

SEQ ID NO: 2412062 - RNA, 13 nt, Human
ccugggggcucuc

SEQ ID NO: 2412063 - RNA, 14 nt, Human
ccugggggcucuca

SEQ ID NO: 2412064 - RNA, 21 nt, Human
ccugguggcagugggagcugc

SEQ ID NO: 2412065 - RNA, 16 nt, Human
ccugggggaagcccug

SEQ ID NO: 2412066 - RNA, 17 nt, Human
ccugggggaagcccugg

SEQ ID NO: 2412067 - RNA, 19 nt, Human
ccugggggaagcccuggau

SEQ ID NO: 2412068 - RNA, 19 nt, Human
ccugggggcagggagagga

SEQ ID NO: 2412069 - RNA, 18 nt, Human
ccugggggaagcccugga

SEQ ID NO: 2412070 - RNA, 21 nt, Human
ccuggggcuucuccugaccca

SEQ ID NO: 2412071 - RNA, 18 nt, Human
ccuggggcuucuccugac

SEQ ID NO: 2412072 - RNA, 17 nt, Human
ccuggggcuucuccuga

SEQ ID NO: 2412073 - RNA, 19 nt, Human
ccuggggcuggccucccaa

SEQ ID NO: 2412074 - RNA, 12 nt, Human
ccuggggccucg

SEQ ID NO: 2412075 - RNA, 22 nt, Human
ccuggggccucggagccucauc

SEQ ID NO: 2412076 - RNA, 21 nt, Human
ccuggggccuggaccugccuc

SEQ ID NO: 2412077 - RNA, 19 nt, Human
ccuggggccuggaccugcc

SEQ ID NO: 2412078 - RNA, 18 nt, Human
ccuggggccuggaccugc

SEQ ID NO: 2412079 - RNA, 17 nt, Human
ccuggggccuggaccug

SEQ ID NO: 2412080 - RNA, 16 nt, Human
ccuggggccuggaccu

SEQ ID NO: 2412081 - RNA, 13 nt, Human
ccuggggccucuu

SEQ ID NO: 2412082 - RNA, 19 nt, Human
ccugggcccugggcuggaa

SEQ ID NO: 2412083 - RNA, 18 nt, Human
ccugggcccugggcugga

SEQ ID NO: 2412084 - RNA, 16 nt, Human
ccugggcccugggcug

SEQ ID NO: 2412085 - RNA, 15 nt, Human
ccugggcccugggcu

SEQ ID NO: 2412086 - RNA, 14 nt, Human
ccugggcccugggc

SEQ ID NO: 2412087 - RNA, 15 nt, Human
ccugggcccucucug

SEQ ID NO: 2412088 - RNA, 18 nt, Human
ccugggcccucucugcuc

SEQ ID NO: 2412089 - RNA, 13 nt, Human
ccugggccgcugc

SEQ ID NO: 2412090 - RNA, 17 nt, Human
ccugggccgcugccacg

SEQ ID NO: 2412091 - RNA, 16 nt, Human
ccugggccgcugccac

SEQ ID NO: 2412092 - RNA, 12 nt, Human
ccugggccugca

SEQ ID NO: 2412093 - RNA, 23 nt, Human
ccuggggcagucaccugcccaga

SEQ ID NO: 2412094 - RNA, 20 nt, Human
ccugucgagacacuugccuu

SEQ ID NO: 2412095 - RNA, 18 nt, Human
ccugucgagacacuugcc

SEQ ID NO: 2412096 - RNA, 18 nt, Human
ccuguccugggcuggugg

SEQ ID NO: 2412097 - RNA, 16 nt, Human
ccuguccugggcuggu

SEQ ID NO: 2412098 - RNA, 15 nt, Human
ccuguccugggcugg

SEQ ID NO: 2412099 - RNA, 19 nt, Human
ccuguccugccuaaggcug

SEQ ID NO: 2412100 - RNA, 17 nt, Human
ccugucgagacacuugc

SEQ ID NO: 2412101 - RNA, 15 nt, Human
ccugucgagacacuu

SEQ ID NO: 2412102 - RNA, 14 nt, Human
ccugucgagacacu

SEQ ID NO: 2412103 - RNA, 12 nt, Human
ccuguccuugca

SEQ ID NO: 2412104 - RNA, 21 nt, Human
ccuguccuucucucaccuccu

SEQ ID NO: 2412105 - RNA, 15 nt, Human
ccuguaaucacagcu

SEQ ID NO: 2412106 - RNA, 16 nt, Human
ccuguaauaaauauga

SEQ ID NO: 2412107 - RNA, 15 nt, Human
ccuguaauaaauaug

SEQ ID NO: 2412108 - RNA, 20 nt, Human
ccuguaaucauauaauaaau

SEQ ID NO: 2412109 - RNA, 22 nt, Human
ccuguaauaaauaugagugcca

SEQ ID NO: 2412110 - RNA, 13 nt, Human
ccuguaaucccag

SEQ ID NO: 2412111 - RNA, 15 nt, Human
ccuguaaucccagca

SEQ ID NO: 2412112 - RNA, 22 nt, Human
ccuguccugauggucagcuccc

SEQ ID NO: 2412113 - RNA, 13 nt, Human
ccuguccugaugg

SEQ ID NO: 2412114 - RNA, 23 nt, Human
ccuguccugauggucagcucccu

SEQ ID NO: 2412115 - RNA, 17 nt, Human
ccuguccugccuaaggc

SEQ ID NO: 2412116 - RNA, 16 nt, Human
ccuguaaucccagcac

SEQ ID NO: 2412117 - RNA, 17 nt, Human
ccuguaaucccagcacu

SEQ ID NO: 2412118 - RNA, 14 nt, Human
ccuguaaucccagc

SEQ ID NO: 2412119 - RNA, 19 nt, Human
ccuguccugaccugucuca

SEQ ID NO: 2412120 - RNA, 16 nt, Human
ccugggggcucucaug

SEQ ID NO: 2412121 - RNA, 14 nt, Human
ccuggugggccaac

SEQ ID NO: 2412122 - RNA, 17 nt, Human
ccugguggccucugccc

SEQ ID NO: 2412123 - RNA, 16 nt, Human
ccugguucucaucuuu

SEQ ID NO: 2412124 - RNA, 15 nt, Human
ccugguucucaucuu

SEQ ID NO: 2412125 - RNA, 13 nt, Human
ccugguucucauc

SEQ ID NO: 2412126 - RNA, 14 nt, Human
ccugguucucaucu

SEQ ID NO: 2412127 - RNA, 23 nt, Human
ccuggugggccaacaaagaacac

SEQ ID NO: 2412128 - RNA, 14 nt, Human
ccuggugggccucc

SEQ ID NO: 2412129 - RNA, 18 nt, Human
ccuggugggccuccucug

SEQ ID NO: 2412130 - RNA, 20 nt, Human
ccuggugggccuccucuguc

SEQ ID NO: 2412131 - RNA, 13 nt, Human
ccugguuuccugc

SEQ ID NO: 2412132 - RNA, 14 nt, Human
ccugguuuccugcc

SEQ ID NO: 2412133 - RNA, 21 nt, Human
ccugguucugaugaugugccu

SEQ ID NO: 2412134 - RNA, 15 nt, Human
ccugguucugaugau

SEQ ID NO: 2412135 - RNA, 17 nt, Human
ccugguuucacuggccc

SEQ ID NO: 2412136 - RNA, 18 nt, Human
ccugguuucacuggccca

SEQ ID NO: 2412137 - RNA, 15 nt, Human
ccugguuuccugccc

SEQ ID NO: 2412138 - RNA, 14 nt, Human
ccuguaauaaauau

SEQ ID NO: 2412139 - RNA, 13 nt, Human
ccuguaauaaaua

SEQ ID NO: 2412140 - RNA, 12 nt, Human
ccuguaauaaau

SEQ ID NO: 2412141 - RNA, 18 nt, Human
ccuguaacuugagaguag

SEQ ID NO: 2412142 - RNA, 21 nt, Human
ccugugacauggugccugaga

SEQ ID NO: 2412143 - RNA, 19 nt, Human
ccugugacauggugccuga

SEQ ID NO: 2412144 - RNA, 18 nt, Human
ccugugacauggugccug

SEQ ID NO: 2412145 - RNA, 17 nt, Human
ccugugacauggugccu

SEQ ID NO: 2412146 - RNA, 22 nt, Human
ccugugaaugccacugccuucg

SEQ ID NO: 2412147 - RNA, 21 nt, Human
ccugugaaugccacugccuuc

SEQ ID NO: 2412148 - RNA, 19 nt, Human
ccugugaaugccacugccu

SEQ ID NO: 2412149 - RNA, 17 nt, Human
ccugugaaugccacugc

SEQ ID NO: 2412150 - RNA, 16 nt, Human
ccugugaaugccacug

SEQ ID NO: 2412151 - RNA, 18 nt, Human
ccugugaaguaaggaugu

SEQ ID NO: 2412152 - RNA, 16 nt, Human
ccugugaacugaacuc

SEQ ID NO: 2412153 - RNA, 17 nt, Human
ccugugaacugaacucu

SEQ ID NO: 2412154 - RNA, 22 nt, Human
ccugugaaagacucaaugagcu

SEQ ID NO: 2412155 - RNA, 19 nt, Human
ccugugaaauaguucaaag

SEQ ID NO: 2412156 - RNA, 17 nt, Human
ccugugaccagcacugu

SEQ ID NO: 2412157 - RNA, 23 nt, Human
ccugugacauggugccugagagg

SEQ ID NO: 2412158 - RNA, 22 nt, Human
ccugugacauggugccugagag

SEQ ID NO: 2412159 - RNA, 19 nt, Human
ccugugaccagucugaccc

SEQ ID NO: 2412160 - RNA, 16 nt, Human
ccugugaccagcacug

SEQ ID NO: 2412161 - RNA, 15 nt, Human
ccugucuaaugaaac

SEQ ID NO: 2412162 - RNA, 17 nt, Human
ccugucggccugguguu

SEQ ID NO: 2412163 - RNA, 13 nt, Human
ccugucggccugg

SEQ ID NO: 2412164 - RNA, 22 nt, Human
ccugucuaaugaaaccuguguc

SEQ ID NO: 2412165 - RNA, 14 nt, Human
ccugucuagagagg

SEQ ID NO: 2412166 - RNA, 16 nt, Human
ccugucuagagaggga

SEQ ID NO: 2412167 - RNA, 20 nt, Human
ccugucugaaggacacuucc

SEQ ID NO: 2412168 - RNA, 22 nt, Human
ccugucucuuccauaugaccuc

SEQ ID NO: 2412169 - RNA, 21 nt, Human
ccugucugaaggacacuuccu

SEQ ID NO: 2412170 - RNA, 14 nt, Human
ccugucugccagcc

SEQ ID NO: 2412171 - RNA, 15 nt, Human
ccugucugccagcca

SEQ ID NO: 2412172 - RNA, 16 nt, Human
ccugucugccagccag

SEQ ID NO: 2412173 - RNA, 17 nt, Human
ccugucugccagccagc

SEQ ID NO: 2412174 - RNA, 19 nt, Human
ccugucugccagccagcag

SEQ ID NO: 2412175 - RNA, 20 nt, Human
ccugucugccagccagcagc

SEQ ID NO: 2412176 - RNA, 14 nt, Human
ccugucucuuccau

SEQ ID NO: 2412177 - RNA, 13 nt, Human
ccugucucuucca

SEQ ID NO: 2412178 - RNA, 13 nt, Human
ccugucucugccc

SEQ ID NO: 2412179 - RNA, 17 nt, Human
ccugucuagagagggag

SEQ ID NO: 2412180 - RNA, 17 nt, Human
ccugucucauccccagg

SEQ ID NO: 2412181 - RNA, 13 nt, Human
ccugucucagccu

SEQ ID NO: 2412182 - RNA, 14 nt, Human
ccugucucagccuc

SEQ ID NO: 2412183 - RNA, 15 nt, Human
ccugucucagccucc

SEQ ID NO: 2412184 - RNA, 16 nt, Human
ccugucucagccuccc

SEQ ID NO: 2412185 - RNA, 22 nt, Human
ccugucuuugggagaaaacguc

SEQ ID NO: 2412186 - RNA, 14 nt, Human
ccugucuuuaagga

SEQ ID NO: 2412187 - RNA, 17 nt, Human
ccugucuuuaaggaaaa

SEQ ID NO: 2412188 - RNA, 18 nt, Human
ccugucuucccaggguag

SEQ ID NO: 2412189 - RNA, 16 nt, Human
ccugucuucccagggu

SEQ ID NO: 2412190 - RNA, 15 nt, Human
ccugucuucccaggg

SEQ ID NO: 2412191 - RNA, 22 nt, Human
ccugucuuccugcauucaccca

SEQ ID NO: 2412192 - RNA, 15 nt, Human
ccugucuuccugcau

SEQ ID NO: 2412193 - RNA, 19 nt, Human
ccugucuuccugcauucac

SEQ ID NO: 2412194 - RNA, 21 nt, Human
ccugucugucucuccaucugu

SEQ ID NO: 2412195 - RNA, 19 nt, Human
ccugucugucucuccaucu

SEQ ID NO: 2412196 - RNA, 18 nt, Human
ccugucugucucuccauc

SEQ ID NO: 2412197 - RNA, 17 nt, Human
ccugucugucucuccau

SEQ ID NO: 2412198 - RNA, 14 nt, Human
ccugucuucccagg

SEQ ID NO: 2412199 - RNA, 17 nt, Human
ccugucuguuacacugg

SEQ ID NO: 2412200 - RNA, 23 nt, Human
ccugucuguagagggcccuggug

SEQ ID NO: 2412201 - RNA, 22 nt, Human
ccugucuguagagggcccuggu

SEQ ID NO: 2412202 - RNA, 21 nt, Human
ccugucuguagagggcccugg

SEQ ID NO: 2412203 - RNA, 20 nt, Human
ccugucuguagagggcccug

SEQ ID NO: 2412204 - RNA, 21 nt, Human
ccugucugccagccagcagcc

SEQ ID NO: 2412205 - RNA, 23 nt, Human
ccugucugccagccagcagccag

SEQ ID NO: 2412206 - RNA, 15 nt, Human
ccugucugccagggc

SEQ ID NO: 2412207 - RNA, 11 nt, Human
ccucuuucccu

SEQ ID NO: 2412208 - RNA, 23 nt, Human
ccucuuucaagcagucgugccug

SEQ ID NO: 2412209 - RNA, 19 nt, Human
ccucuuuagaguuagacug

SEQ ID NO: 2412210 - RNA, 18 nt, Human
ccugcacuugcagacucu

SEQ ID NO: 2412211 - RNA, 22 nt, Human
ccugcagaggucugugcugagg

SEQ ID NO: 2412212 - RNA, 21 nt, Human
ccugcagaggucugugcugag

SEQ ID NO: 2412213 - RNA, 20 nt, Human
ccugcagaggucugugcuga

SEQ ID NO: 2412214 - RNA, 19 nt, Human
ccugcagaggucugugcug

SEQ ID NO: 2412215 - RNA, 14 nt, Human
ccugagucuccugu

SEQ ID NO: 2412216 - RNA, 18 nt, Human
ccugcagaggucugugcu

SEQ ID NO: 2412217 - RNA, 15 nt, Human
ccugagucuccugug

SEQ ID NO: 2412218 - RNA, 19 nt, Human
ccugcagaggggaaaccag

SEQ ID NO: 2412219 - RNA, 17 nt, Human
ccugcacuugcagacuc

SEQ ID NO: 2412220 - RNA, 16 nt, Human
ccugcacuugcagacu

SEQ ID NO: 2412221 - RNA, 21 nt, Human
ccugagucguacagaaagcug

SEQ ID NO: 2412222 - RNA, 22 nt, Human
ccugagucguacagaaagcugc

SEQ ID NO: 2412223 - RNA, 19 nt, Human
ccugagucguacagaaagc

SEQ ID NO: 2412224 - RNA, 23 nt, Human
ccugagucacccuaccugugccu

SEQ ID NO: 2412225 - RNA, 23 nt, Human
ccugaguccaagaggguccuuua

SEQ ID NO: 2412226 - RNA, 15 nt, Human
ccugagucaccagga

SEQ ID NO: 2412227 - RNA, 13 nt, Human
ccugacccaggcc

SEQ ID NO: 2412228 - RNA, 16 nt, Human
ccugacccaggccgca

SEQ ID NO: 2412229 - RNA, 15 nt, Human
ccugacccaggccgc

SEQ ID NO: 2412230 - RNA, 14 nt, Human
ccugacccaggccg

SEQ ID NO: 2412231 - RNA, 21 nt, Human
ccugaguagcugggauuacag

SEQ ID NO: 2412232 - RNA, 18 nt, Human
ccugacccaggccgcagc

SEQ ID NO: 2412233 - RNA, 13 nt, Human
ccugagucaccag

SEQ ID NO: 2412234 - RNA, 14 nt, Human
ccugagucaccagg

SEQ ID NO: 2412235 - RNA, 15 nt, Human
ccugagucacccaug

SEQ ID NO: 2412236 - RNA, 18 nt, Human
ccugagucacccaugaag

SEQ ID NO: 2412237 - RNA, 20 nt, Human
ccugaccaacaguuccuuca

SEQ ID NO: 2412238 - RNA, 13 nt, Human
ccucuuucccucc

SEQ ID NO: 2412239 - RNA, 21 nt, Human
ccugaccacccuccccucucu

SEQ ID NO: 2412240 - RNA, 20 nt, Human
ccugaccacccuccccucuc

SEQ ID NO: 2412241 - RNA, 18 nt, Human
ccugaccacccuccccuc

SEQ ID NO: 2412242 - RNA, 17 nt, Human
ccugaccacccuccccu

SEQ ID NO: 2412243 - RNA, 23 nt, Human
ccugaccacccuccccucucuug

SEQ ID NO: 2412244 - RNA, 20 nt, Human
ccugaccacgcuuucuagcu

SEQ ID NO: 2412245 - RNA, 15 nt, Human
ccugaccacccuccc

SEQ ID NO: 2412246 - RNA, 14 nt, Human
ccugaccacccucc

SEQ ID NO: 2412247 - RNA, 13 nt, Human
ccugaccacccuc

SEQ ID NO: 2412248 - RNA, 12 nt, Human
ccugaccacccu

SEQ ID NO: 2412249 - RNA, 13 nt, Human
ccucuuucaucca

SEQ ID NO: 2412250 - RNA, 15 nt, Human
ccucuuucauccacu

SEQ ID NO: 2412251 - RNA, 19 nt, Human
ccugaccaacauggagaaa

SEQ ID NO: 2412252 - RNA, 19 nt, Human
ccugcagccuccuccugac

SEQ ID NO: 2412253 - RNA, 22 nt, Human
ccugcagccccgcgccuccuuc

SEQ ID NO: 2412254 - RNA, 18 nt, Human
ccugcagccuccuccuga

SEQ ID NO: 2412255 - RNA, 15 nt, Human
ccugcagccuccucc

SEQ ID NO: 2412256 - RNA, 19 nt, Human
ccugccccagcccaagucc

SEQ ID NO: 2412257 - RNA, 18 nt, Human
ccugccccagcccaaguc

SEQ ID NO: 2412258 - RNA, 17 nt, Human
ccugccccagcccaagu

SEQ ID NO: 2412259 - RNA, 15 nt, Human
ccugccccagcccaa

SEQ ID NO: 2412260 - RNA, 14 nt, Human
ccugccccaggccu

SEQ ID NO: 2412261 - RNA, 18 nt, Human
ccugccccaggccugaaa

SEQ ID NO: 2412262 - RNA, 16 nt, Human
ccugccccaggccuga

SEQ ID NO: 2412263 - RNA, 17 nt, Human
ccugccccagggcuccc

SEQ ID NO: 2412264 - RNA, 19 nt, Human
ccugccuccacccucugag

SEQ ID NO: 2412265 - RNA, 18 nt, Human
ccugccuccacccucuga

SEQ ID NO: 2412266 - RNA, 16 nt, Human
ccugcccccaauccau

SEQ ID NO: 2412267 - RNA, 12 nt, Human
ccugccuccagg

SEQ ID NO: 2412268 - RNA, 20 nt, Human
ccugccuccacccucugagc

SEQ ID NO: 2412269 - RNA, 14 nt, Human
ccugccuccaggaa

SEQ ID NO: 2412270 - RNA, 15 nt, Human
ccugcccccaaucca

SEQ ID NO: 2412271 - RNA, 15 nt, Human
ccugcccccaaauaa

SEQ ID NO: 2412272 - RNA, 16 nt, Human
ccugccuccacccucu

SEQ ID NO: 2412273 - RNA, 18 nt, Human
ccugcccagaucccagaa

SEQ ID NO: 2412274 - RNA, 12 nt, Human
ccugcccaggag

SEQ ID NO: 2412275 - RNA, 20 nt, Human
ccugcccaggagagccagcc

SEQ ID NO: 2412276 - RNA, 22 nt, Human
ccugcccaggagagccagcccu

SEQ ID NO: 2412277 - RNA, 23 nt, Human
ccugcccaggagagccagcccuc

SEQ ID NO: 2412278 - RNA, 14 nt, Human
ccugcccaccuguc

SEQ ID NO: 2412279 - RNA, 22 nt, Human
ccugcccacccguggagauggg

SEQ ID NO: 2412280 - RNA, 13 nt, Human
ccugcccaccugu

SEQ ID NO: 2412281 - RNA, 14 nt, Human
ccugccccagccca

SEQ ID NO: 2412282 - RNA, 13 nt, Human
ccugccccagccc

SEQ ID NO: 2412283 - RNA, 12 nt, Human
ccugccccagcc

SEQ ID NO: 2412284 - RNA, 21 nt, Human
ccugccccaacucuccccuga

SEQ ID NO: 2412285 - RNA, 24 nt, Human
ccugccccaacucuccccugaccu

SEQ ID NO: 2412286 - RNA, 20 nt, Human
ccugccccaaucccuuuauu

SEQ ID NO: 2412287 - RNA, 13 nt, Human
ccugcccaggccc

SEQ ID NO: 2412288 - RNA, 12 nt, Human
ccugcccaccug

SEQ ID NO: 2412289 - RNA, 20 nt, Human
ccugcccaccuggccucugc

SEQ ID NO: 2412290 - RNA, 14 nt, Human
ccugcccaccuggc

SEQ ID NO: 2412291 - RNA, 13 nt, Human
ccugcccaccugg

SEQ ID NO: 2412292 - RNA, 12 nt, Human
ccugcccacccg

SEQ ID NO: 2412293 - RNA, 13 nt, Human
ccugcccacccgu

SEQ ID NO: 2412294 - RNA, 20 nt, Human
ccugcugcugacccagccug

SEQ ID NO: 2412295 - RNA, 18 nt, Human
ccugcugcugacccagcc

SEQ ID NO: 2412296 - RNA, 20 nt, Human
ccugcugcaguugccaguca

SEQ ID NO: 2412297 - RNA, 21 nt, Human
ccugcugcaguugccagucac

SEQ ID NO: 2412298 - RNA, 23 nt, Human
ccugcugccgccucccagccugg

SEQ ID NO: 2412299 - RNA, 22 nt, Human
ccugcugccgccucccagccug

SEQ ID NO: 2412300 - RNA, 13 nt, Human
ccugcugccuccc

SEQ ID NO: 2412301 - RNA, 15 nt, Human
ccugcugccucccca

SEQ ID NO: 2412302 - RNA, 16 nt, Human
ccugcugccuccccaa

SEQ ID NO: 2412303 - RNA, 17 nt, Human
ccugcugccuccccaac

SEQ ID NO: 2412304 - RNA, 21 nt, Human
ccugcugccuccccaacccug

SEQ ID NO: 2412305 - RNA, 19 nt, Human
ccugcugccuccccaaccc

SEQ ID NO: 2412306 - RNA, 20 nt, Human
ccugcugccuccccaacccu

SEQ ID NO: 2412307 - RNA, 23 nt, Human
ccugcugccuccccaacccugcc

SEQ ID NO: 2412308 - RNA, 19 nt, Human
ccugcugcaguugccaguc

SEQ ID NO: 2412309 - RNA, 17 nt, Human
ccugcugcaguugccag

SEQ ID NO: 2412310 - RNA, 23 nt, Human
ccugccucgaacuggcugcaaag

SEQ ID NO: 2412311 - RNA, 21 nt, Human
ccugccucgaacuggcugcaa

SEQ ID NO: 2412312 - RNA, 12 nt, Human
ccugccuccugc

SEQ ID NO: 2412313 - RNA, 16 nt, Human
ccugccucccuucaug

SEQ ID NO: 2412314 - RNA, 15 nt, Human
ccugccuccccugug

SEQ ID NO: 2412315 - RNA, 17 nt, Human
ccugccuccccugugca

SEQ ID NO: 2412316 - RNA, 19 nt, Human
ccugccucgaacuggcugc

SEQ ID NO: 2412317 - RNA, 17 nt, Human
ccugccuccagggcugg

SEQ ID NO: 2412318 - RNA, 16 nt, Human
ccugccuccagggcug

SEQ ID NO: 2412319 - RNA, 15 nt, Human
ccugccuccagggcu

SEQ ID NO: 2412320 - RNA, 15 nt, Human
ccugccuccaggaac

SEQ ID NO: 2412321 - RNA, 20 nt, Human
ccugccuccaggaaccacac

SEQ ID NO: 2412322 - RNA, 21 nt, Human
ccugccuccagggcuggacug

SEQ ID NO: 2412323 - RNA, 20 nt, Human
ccugccuccagggcuggacu

SEQ ID NO: 2412324 - RNA, 23 nt, Human
ccugccuccagggcuggacugag

SEQ ID NO: 2412325 - RNA, 15 nt, Human
cccagcacugaggaa

SEQ ID NO: 2412326 - RNA, 14 nt, Human
cccagcacugagga

SEQ ID NO: 2412327 - RNA, 12 nt, Human
cccagcccaccc

SEQ ID NO: 2412328 - RNA, 13 nt, Human
cccagcccaaguc

SEQ ID NO: 2412329 - RNA, 14 nt, Human
cccagcccaagucc

SEQ ID NO: 2412330 - RNA, 12 nt, Human
cccagcccaagu

SEQ ID NO: 2412331 - RNA, 15 nt, Human
cccagcaggugggga

SEQ ID NO: 2412332 - RNA, 19 nt, Human
cccagccauuaccauggag

SEQ ID NO: 2412333 - RNA, 20 nt, Human
cccagccauuaccauggaga

SEQ ID NO: 2412334 - RNA, 22 nt, Human
cccagccauuaccauggagaca

SEQ ID NO: 2412335 - RNA, 16 nt, Human
cccagcccaaagcugu

SEQ ID NO: 2412336 - RNA, 15 nt, Human
cccagcccacccucc

SEQ ID NO: 2412337 - RNA, 14 nt, Human
cccagcccacccuc

SEQ ID NO: 2412338 - RNA, 13 nt, Human
cccagcccacccu

SEQ ID NO: 2412339 - RNA, 18 nt, Human
cccagcugugagccuugg

SEQ ID NO: 2412340 - RNA, 14 nt, Human
cccagcccacuucu

SEQ ID NO: 2412341 - RNA, 22 nt, Human
cccagcagcccuaaggaucucu

SEQ ID NO: 2412342 - RNA, 17 nt, Human
cccagcagcccuaagga

SEQ ID NO: 2412343 - RNA, 21 nt, Human
cccagcacuuugggaggccua

SEQ ID NO: 2412344 - RNA, 18 nt, Human
cccagcagggccacuccc

SEQ ID NO: 2412345 - RNA, 13 nt, Human
cccagcagggccu

SEQ ID NO: 2412346 - RNA, 22 nt, Human
cccagcagggucuuuucaucug

SEQ ID NO: 2412347 - RNA, 19 nt, Human
cccagcagggccucaaagu

SEQ ID NO: 2412348 - RNA, 16 nt, Human
cccagcagguggggag

SEQ ID NO: 2412349 - RNA, 16 nt, Human
cccagcacuuggagag

SEQ ID NO: 2412350 - RNA, 18 nt, Human
cccagcacuuguguuguc

SEQ ID NO: 2412351 - RNA, 21 nt, Human
cccagcacugcuugaggaaaa

SEQ ID NO: 2412352 - RNA, 24 nt, Human
cccagcacugaggaagaacggggc

SEQ ID NO: 2412353 - RNA, 20 nt, Human
cccagcacuuugggaggccu

SEQ ID NO: 2412354 - RNA, 22 nt, Human
cccagcacuuugggaggccaag

SEQ ID NO: 2412355 - RNA, 20 nt, Human
cccagcacuuugggaggcca

SEQ ID NO: 2412356 - RNA, 12 nt, Human
cccagcacuuug

SEQ ID NO: 2412357 - RNA, 17 nt, Human
cccagcacuuugggagg

SEQ ID NO: 2412358 - RNA, 15 nt, Human
cccagcacuuuggga

SEQ ID NO: 2412359 - RNA, 15 nt, Human
cccaggcuuagucac

SEQ ID NO: 2412360 - RNA, 12 nt, Human
cccaggcugggc

SEQ ID NO: 2412361 - RNA, 16 nt, Human
cccaggcuggucucaa

SEQ ID NO: 2412362 - RNA, 15 nt, Human
cccagggcuacccuc

SEQ ID NO: 2412363 - RNA, 19 nt, Human
cccaggcugggcaaggagg

SEQ ID NO: 2412364 - RNA, 13 nt, Human
cccaggcugggca

SEQ ID NO: 2412365 - RNA, 20 nt, Human
cccaggcuuagucacugaga

SEQ ID NO: 2412366 - RNA, 21 nt, Human
cccagggcuacccucccccag

SEQ ID NO: 2412367 - RNA, 14 nt, Human
cccagggcucagcc

SEQ ID NO: 2412368 - RNA, 15 nt, Human
cccagggcucagccu

SEQ ID NO: 2412369 - RNA, 16 nt, Human
cccagggcucagccug

SEQ ID NO: 2412370 - RNA, 21 nt, Human
cccaggcuggcgugcaguggu

SEQ ID NO: 2412371 - RNA, 20 nt, Human
cccaggacaccacacccagc

SEQ ID NO: 2412372 - RNA, 19 nt, Human
cccaggacaccacacccag

SEQ ID NO: 2412373 - RNA, 22 nt, Human
cccaggaaugccaaggagacau

SEQ ID NO: 2412374 - RNA, 22 nt, Human
cccaggaaaggcuccaggagca

SEQ ID NO: 2412375 - RNA, 21 nt, Human
cccaggaaaggcuccaggagc

SEQ ID NO: 2412376 - RNA, 23 nt, Human
cccaggaaaggcuccaggagcag

SEQ ID NO: 2412377 - RNA, 11 nt, Human
cccaggaacaa

SEQ ID NO: 2412378 - RNA, 19 nt, Human
cccagcugugagccuuggc

SEQ ID NO: 2412379 - RNA, 18 nt, Human
cccagcccacccuccugu

SEQ ID NO: 2412380 - RNA, 16 nt, Human
cccagcccacccuccu

SEQ ID NO: 2412381 - RNA, 15 nt, Human
cccaggaacugggcc

SEQ ID NO: 2412382 - RNA, 12 nt, Human
cccaggaagccg

SEQ ID NO: 2412383 - RNA, 23 nt, Human
cccagcugugcucuggacaggca

SEQ ID NO: 2412384 - RNA, 21 nt, Human
cccagcugugcucuggacagg

SEQ ID NO: 2412385 - RNA, 19 nt, Human
cccaggaaaggcuccagga

SEQ ID NO: 2412386 - RNA, 11 nt, Human
cccagcuguuu

SEQ ID NO: 2412387 - RNA, 14 nt, Human
ccauuucuauuuau

SEQ ID NO: 2412388 - RNA, 13 nt, Human
ccauuucuauuua

SEQ ID NO: 2412389 - RNA, 12 nt, Human
ccauuucuauuu

SEQ ID NO: 2412390 - RNA, 22 nt, Human
ccauuucuacucuuaaguuucu

SEQ ID NO: 2412391 - RNA, 23 nt, Human
ccauuucuagaacaucccugcca

SEQ ID NO: 2412392 - RNA, 14 nt, Human
ccauuucucacuga

SEQ ID NO: 2412393 - RNA, 13 nt, Human
ccauuucucacug

SEQ ID NO: 2412394 - RNA, 17 nt, Human
ccauuucuauuuauuua

SEQ ID NO: 2412395 - RNA, 12 nt, Human
ccauuucucaug

SEQ ID NO: 2412396 - RNA, 16 nt, Human
ccauuucucacugaga

SEQ ID NO: 2412397 - RNA, 22 nt, Human
cccauucugccugcccaggccc

SEQ ID NO: 2412398 - RNA, 21 nt, Human
cccauucugccugcccaggcc

SEQ ID NO: 2412399 - RNA, 20 nt, Human
cccauucugccugcccaggc

SEQ ID NO: 2412400 - RNA, 21 nt, Human
ccccauccucuguacagagcc

SEQ ID NO: 2412401 - RNA, 19 nt, Human
ccccauccucuguacagag

SEQ ID NO: 2412402 - RNA, 22 nt, Human
ccccauccucuguacagagccc

SEQ ID NO: 2412403 - RNA, 19 nt, Human
ccccaucuggguccuugca

SEQ ID NO: 2412404 - RNA, 14 nt, Human
ccccaucugggucc

SEQ ID NO: 2412405 - RNA, 12 nt, Human
ccccaucuguga

SEQ ID NO: 2412406 - RNA, 17 nt, Human
ccccauccucuguacag

SEQ ID NO: 2412407 - RNA, 20 nt, Human
cccauuucuagaacaucccu

SEQ ID NO: 2412408 - RNA, 19 nt, Human
cccauuucuauuuauuuac

SEQ ID NO: 2412409 - RNA, 20 nt, Human
ccccagcaagugagagcugg

SEQ ID NO: 2412410 - RNA, 19 nt, Human
ccccagcaagugagagcug

SEQ ID NO: 2412411 - RNA, 17 nt, Human
ccccagcaagugagagc

SEQ ID NO: 2412412 - RNA, 23 nt, Human
ccccagauugcaacaggcugggc

SEQ ID NO: 2412413 - RNA, 22 nt, Human
ccccagauugcaacaggcuggg

SEQ ID NO: 2412414 - RNA, 21 nt, Human
ccccagauugcaacaggcugg

SEQ ID NO: 2412415 - RNA, 20 nt, Human
cccauuuaaauuuuuuuccu

SEQ ID NO: 2412416 - RNA, 15 nt, Human
cccauuuauccaccu

SEQ ID NO: 2412417 - RNA, 12 nt, Human
cccauuucagcu

SEQ ID NO: 2412418 - RNA, 13 nt, Human
cccauuucagcug

SEQ ID NO: 2412419 - RNA, 18 nt, Human
cccauuuauccaccucca

SEQ ID NO: 2412420 - RNA, 19 nt, Human
cccauuuauccaccuccau

SEQ ID NO: 2412421 - RNA, 17 nt, Human
cccauuucuauuuauuu

SEQ ID NO: 2412422 - RNA, 16 nt, Human
cccauuucuauuuauu

SEQ ID NO: 2412423 - RNA, 22 nt, Human
cccauuucuacucuuaaguuuc

SEQ ID NO: 2412424 - RNA, 12 nt, Human
cccauuucuacu

SEQ ID NO: 2412425 - RNA, 15 nt, Human
cccauuucuauuuau

SEQ ID NO: 2412426 - RNA, 17 nt, Human
cccauuucccaucugca

SEQ ID NO: 2412427 - RNA, 16 nt, Human
cccauuucccaucugc

SEQ ID NO: 2412428 - RNA, 15 nt, Human
cccauuucccaucug

SEQ ID NO: 2412429 - RNA, 14 nt, Human
cccauuucccaucu

SEQ ID NO: 2412430 - RNA, 19 nt, Human
cccauuucccaucugcacc

SEQ ID NO: 2412431 - RNA, 18 nt, Human
cccauuucuaaaggccuc

SEQ ID NO: 2412432 - RNA, 21 nt, Human
cccauuucuaaaggccucuuc

SEQ ID NO: 2412433 - RNA, 23 nt, Human
cccaguuugcagaaaagcaccug

SEQ ID NO: 2412434 - RNA, 23 nt, Human
cccauaauuuuuuuuuuccuuuu

SEQ ID NO: 2412435 - RNA, 22 nt, Human
cccauaauuuuuuuuuuccuuu

SEQ ID NO: 2412436 - RNA, 19 nt, Human
cccauaauuuucuucaugc

SEQ ID NO: 2412437 - RNA, 17 nt, Human
cccaguuucugccucug

SEQ ID NO: 2412438 - RNA, 16 nt, Human
cccaguuucugccucu

SEQ ID NO: 2412439 - RNA, 14 nt, Human
cccaguuucugccu

SEQ ID NO: 2412440 - RNA, 20 nt, Human
cccaguuucugccucugagg

SEQ ID NO: 2412441 - RNA, 15 nt, Human
cccaguuugcagaaa

SEQ ID NO: 2412442 - RNA, 16 nt, Human
cccaguuugcagaaaa

SEQ ID NO: 2412443 - RNA, 22 nt, Human
cccaguuugcagaaaagcaccu

SEQ ID NO: 2412444 - RNA, 15 nt, Human
cccagggcuccugca

SEQ ID NO: 2412445 - RNA, 14 nt, Human
cccagggcuccugc

SEQ ID NO: 2412446 - RNA, 20 nt, Human
cccagggcucagccuggugg

SEQ ID NO: 2412447 - RNA, 17 nt, Human
cccagggcucagccugg

SEQ ID NO: 2412448 - RNA, 18 nt, Human
cccagggcucagccuggu

SEQ ID NO: 2412449 - RNA, 13 nt, Human
cccaguuguauuu

SEQ ID NO: 2412450 - RNA, 17 nt, Human
cccaggggaaaaugaag

SEQ ID NO: 2412451 - RNA, 17 nt, Human
ccccuucgcuccugugu

SEQ ID NO: 2412452 - RNA, 15 nt, Human
ccccuucgcuccugu

SEQ ID NO: 2412453 - RNA, 14 nt, Human
ccccuucgcuccug

SEQ ID NO: 2412454 - RNA, 22 nt, Human
ccccuuccugucccaccucuuc

SEQ ID NO: 2412455 - RNA, 12 nt, Human
ccccuuccuguc

SEQ ID NO: 2412456 - RNA, 21 nt, Human
ccccuucuacauuucuuagac

SEQ ID NO: 2412457 - RNA, 19 nt, Human
ccccuucgcuccugugucu

SEQ ID NO: 2412458 - RNA, 15 nt, Human
ccccuucucaucacu

SEQ ID NO: 2412459 - RNA, 16 nt, Human
ccccuucucagaaucu

SEQ ID NO: 2412460 - RNA, 14 nt, Human
ccccuucucagaau

SEQ ID NO: 2412461 - RNA, 22 nt, Human
ccccuucuagguggcaaggcug

SEQ ID NO: 2412462 - RNA, 20 nt, Human
ccccuuccuugcucugcacc

SEQ ID NO: 2412463 - RNA, 19 nt, Human
ccccuuccuugcucugcac

SEQ ID NO: 2412464 - RNA, 16 nt, Human
ccccuucucucaucuc

SEQ ID NO: 2412465 - RNA, 13 nt, Human
ccccuucucucau

SEQ ID NO: 2412466 - RNA, 16 nt, Human
ccccuucucccacacu

SEQ ID NO: 2412467 - RNA, 12 nt, Human
ccccuucuccca

SEQ ID NO: 2412468 - RNA, 13 nt, Human
ccccuucucccac

SEQ ID NO: 2412469 - RNA, 15 nt, Human
ccccugcaaagccca

SEQ ID NO: 2412470 - RNA, 21 nt, Human
ccccugagcaaugucugugcu

SEQ ID NO: 2412471 - RNA, 19 nt, Human
ccccugagcaaugucugug

SEQ ID NO: 2412472 - RNA, 18 nt, Human
ccccugagcaaugucugu

SEQ ID NO: 2412473 - RNA, 20 nt, Human
ccccugaccugugagcccag

SEQ ID NO: 2412474 - RNA, 21 nt, Human
ccccugagacaaauggaggcc

SEQ ID NO: 2412475 - RNA, 15 nt, Human
ccccugaccugugag

SEQ ID NO: 2412476 - RNA, 18 nt, Human
ccccugcacuccagccug

SEQ ID NO: 2412477 - RNA, 16 nt, Human
ccccugcaaagcccag

SEQ ID NO: 2412478 - RNA, 12 nt, Human
ccccugauuaca

SEQ ID NO: 2412479 - RNA, 22 nt, Human
ccccugcacuggaguccagucu

SEQ ID NO: 2412480 - RNA, 14 nt, Human
ccccauucugccug

SEQ ID NO: 2412481 - RNA, 13 nt, Human
ccccauucugccu

SEQ ID NO: 2412482 - RNA, 15 nt, Human
ccccauucugccugc

SEQ ID NO: 2412483 - RNA, 15 nt, Human
ccccaugauguaagu

SEQ ID NO: 2412484 - RNA, 13 nt, Human
ccccaucugugaa

SEQ ID NO: 2412485 - RNA, 14 nt, Human
ccccaucugugaau

SEQ ID NO: 2412486 - RNA, 14 nt, Human
ccccaucuugcuuc

SEQ ID NO: 2412487 - RNA, 12 nt, Human
ccccaucuugcu

SEQ ID NO: 2412488 - RNA, 19 nt, Human
ccccaugcacugugaagga

SEQ ID NO: 2412489 - RNA, 23 nt, Human
ccccaugcacugugaaggacccu

SEQ ID NO: 2412490 - RNA, 13 nt, Human
ccccaugcacugu

SEQ ID NO: 2412491 - RNA, 23 nt, Human
ccccauuccugggaaauauuccc

SEQ ID NO: 2412492 - RNA, 13 nt, Human
ccccaugccaaag

SEQ ID NO: 2412493 - RNA, 22 nt, Human
ccccaugccaaagcuagggugg

SEQ ID NO: 2412494 - RNA, 21 nt, Human
cccucagaacccuuggcuugc

SEQ ID NO: 2412495 - RNA, 22 nt, Human
cccucagaacccuuggcuugcc

SEQ ID NO: 2412496 - RNA, 23 nt, Human
cccucagaacccuuggcuugccc

SEQ ID NO: 2412497 - RNA, 20 nt, Human
cccucagaaacacuggggcu

SEQ ID NO: 2412498 - RNA, 17 nt, Human
cccucagaacccuuggc

SEQ ID NO: 2412499 - RNA, 18 nt, Human
cccucagaacccuuggcu

SEQ ID NO: 2412500 - RNA, 17 nt, Human
cccucagaaacacuggg

SEQ ID NO: 2412501 - RNA, 15 nt, Human
cccucagcaccccuu

SEQ ID NO: 2412502 - RNA, 14 nt, Human
cccucagcaccccu

SEQ ID NO: 2412503 - RNA, 13 nt, Human
cccucagagccac

SEQ ID NO: 2412504 - RNA, 15 nt, Human
cccucagagugcaag

SEQ ID NO: 2412505 - RNA, 19 nt, Human
ccccuucugcucagcucug

SEQ ID NO: 2412506 - RNA, 20 nt, Human
ccccuucugcucagcucugg

SEQ ID NO: 2412507 - RNA, 22 nt, Human
ccccuucugggcaucuguucug

SEQ ID NO: 2412508 - RNA, 14 nt, Human
ccccuucugggcau

SEQ ID NO: 2412509 - RNA, 21 nt, Human
ccccuucugcucagcucuggg

SEQ ID NO: 2412510 - RNA, 23 nt, Human
ccccuucugggcaucuguucugg

SEQ ID NO: 2412511 - RNA, 14 nt, Human
ccccuugccacccc

SEQ ID NO: 2412512 - RNA, 20 nt, Human
ccccuugccaccccacccuc

SEQ ID NO: 2412513 - RNA, 16 nt, Human
ccccuucugacccaug

SEQ ID NO: 2412514 - RNA, 14 nt, Human
ccccuucucuccuc

SEQ ID NO: 2412515 - RNA, 14 nt, Human
ccccuucugcucag

SEQ ID NO: 2412516 - RNA, 17 nt, Human
ccccuucugacccaugc

SEQ ID NO: 2412517 - RNA, 12 nt, Human
cccgggaagggg

SEQ ID NO: 2412518 - RNA, 22 nt, Human
cccuauccuacuuccccuuccu

SEQ ID NO: 2412519 - RNA, 17 nt, Human
cccggcugguuuuguaa

SEQ ID NO: 2412520 - RNA, 23 nt, Human
cccggcugguuuuguaagaugcu

SEQ ID NO: 2412521 - RNA, 12 nt, Human
cccggcugcccu

SEQ ID NO: 2412522 - RNA, 13 nt, Human
cccggcugcccuu

SEQ ID NO: 2412523 - RNA, 12 nt, Human
cccggcugcgga

SEQ ID NO: 2412524 - RNA, 23 nt, Human
cccuaucuaacccucccauggca

SEQ ID NO: 2412525 - RNA, 17 nt, Human
cccuaucuaacccuccc

SEQ ID NO: 2412526 - RNA, 14 nt, Human
cccuaucuuugcca

SEQ ID NO: 2412527 - RNA, 16 nt, Human
cccuaucuuugccacc

SEQ ID NO: 2412528 - RNA, 19 nt, Human
cccuaucuuugccacccuc

SEQ ID NO: 2412529 - RNA, 20 nt, Human
cccucaacucuccuccagag

SEQ ID NO: 2412530 - RNA, 16 nt, Human
cccuauggggaugguc

SEQ ID NO: 2412531 - RNA, 18 nt, Human
cccuauggggauggucca

SEQ ID NO: 2412532 - RNA, 21 nt, Human
cccuaucuuugccacccucau

SEQ ID NO: 2412533 - RNA, 13 nt, Human
cccuaugcugccu

SEQ ID NO: 2412534 - RNA, 16 nt, Human
cccuauggaugugggg

SEQ ID NO: 2412535 - RNA, 17 nt, Human
cccuauggaagcauauu

SEQ ID NO: 2412536 - RNA, 14 nt, Human
cccucacuggauga

SEQ ID NO: 2412537 - RNA, 18 nt, Human
cccucacugaaugccuca

SEQ ID NO: 2412538 - RNA, 16 nt, Human
cccucacucuggccuc

SEQ ID NO: 2412539 - RNA, 14 nt, Human
cccucacucuggcc

SEQ ID NO: 2412540 - RNA, 13 nt, Human
cccucacagccuc

SEQ ID NO: 2412541 - RNA, 12 nt, Human
cccucacagccu

SEQ ID NO: 2412542 - RNA, 10 nt, Human
cccucacacu

SEQ ID NO: 2412543 - RNA, 12 nt, Human
cccucacacugg

SEQ ID NO: 2412544 - RNA, 13 nt, Human
cccucacacuggg

SEQ ID NO: 2412545 - RNA, 14 nt, Human
cccucacacuggga

SEQ ID NO: 2412546 - RNA, 21 nt, Human
cccucaaggccucccacagug

SEQ ID NO: 2412547 - RNA, 20 nt, Human
cccucaaggccucccacagu

SEQ ID NO: 2412548 - RNA, 19 nt, Human
cccucaaggccucccacag

SEQ ID NO: 2412549 - RNA, 18 nt, Human
cccucaaggccucccaca

SEQ ID NO: 2412550 - RNA, 22 nt, Human
cccucaaggccucccacaguga

SEQ ID NO: 2412551 - RNA, 19 nt, Human
cccucaauucccccuggcc

SEQ ID NO: 2412552 - RNA, 17 nt, Human
cccucaaggccucccac

SEQ ID NO: 2412553 - RNA, 21 nt, Human
cccucaagccaauccccuccu

SEQ ID NO: 2412554 - RNA, 16 nt, Human
cccucaaggccuccca

SEQ ID NO: 2412555 - RNA, 20 nt, Human
cccucaagccaauccccucc

SEQ ID NO: 2412556 - RNA, 17 nt, Human
cccucaagaggaaguga

SEQ ID NO: 2412557 - RNA, 14 nt, Human
ccauacauuugugu

SEQ ID NO: 2412558 - RNA, 13 nt, Human
ccauacauuugug

SEQ ID NO: 2412559 - RNA, 22 nt, Human
ccauaaccgcugauucucaggg

SEQ ID NO: 2412560 - RNA, 23 nt, Human
ccauaauuuucuucaugcaauga

SEQ ID NO: 2412561 - RNA, 17 nt, Human
ccauaaccgcugauucu

SEQ ID NO: 2412562 - RNA, 16 nt, Human
ccauaaccgcugauuc

SEQ ID NO: 2412563 - RNA, 20 nt, Human
ccauaauuuuuuuuuuccuu

SEQ ID NO: 2412564 - RNA, 23 nt, Human
ccaucccaaacccuucagugcca

SEQ ID NO: 2412565 - RNA, 13 nt, Human
ccauacagcucua

SEQ ID NO: 2412566 - RNA, 12 nt, Human
ccaucccacacc

SEQ ID NO: 2412567 - RNA, 14 nt, Human
ccaucccacacccu

SEQ ID NO: 2412568 - RNA, 12 nt, Human
ccaucccagccc

SEQ ID NO: 2412569 - RNA, 18 nt, Human
ccauccccauccuccagc

SEQ ID NO: 2412570 - RNA, 21 nt, Human
ccaucccagagggugggcuuc

SEQ ID NO: 2412571 - RNA, 17 nt, Human
ccauccccauccuccag

SEQ ID NO: 2412572 - RNA, 16 nt, Human
ccaucccacacccugg

SEQ ID NO: 2412573 - RNA, 20 nt, Human
ccaucccacugcucccccaa

SEQ ID NO: 2412574 - RNA, 17 nt, Human
ccaucccacugcucccc

SEQ ID NO: 2412575 - RNA, 15 nt, Human
ccauaacagccaaca

SEQ ID NO: 2412576 - RNA, 13 nt, Human
ccauaacagccaa

SEQ ID NO: 2412577 - RNA, 13 nt, Human
ccauaaagaagca

SEQ ID NO: 2412578 - RNA, 20 nt, Human
ccauaaagaagauguuuaac

SEQ ID NO: 2412579 - RNA, 19 nt, Human
ccauaaagaagauguuuaa

SEQ ID NO: 2412580 - RNA, 16 nt, Human
ccauaaacuucauggu

SEQ ID NO: 2412581 - RNA, 14 nt, Human
ccauaaacuucaug

SEQ ID NO: 2412582 - RNA, 22 nt, Human
ccauaaacacccaugaaucaaa

SEQ ID NO: 2412583 - RNA, 20 nt, Human
ccauaaaacauuaagaaaau

SEQ ID NO: 2412584 - RNA, 19 nt, Human
ccauaaaacauuaagaaaa

SEQ ID NO: 2412585 - RNA, 12 nt, Human
ccauaaaacauu

SEQ ID NO: 2412586 - RNA, 14 nt, Human
ccauaaaaagcuga

SEQ ID NO: 2412587 - RNA, 13 nt, Human
ccauaaaaagcug

SEQ ID NO: 2412588 - RNA, 23 nt, Human
ccaguuugcagaaaagcaccugc

SEQ ID NO: 2412589 - RNA, 14 nt, Human
ccaguuugcagaaa

SEQ ID NO: 2412590 - RNA, 15 nt, Human
ccaugaguccccugu

SEQ ID NO: 2412591 - RNA, 14 nt, Human
ccaugaguccccug

SEQ ID NO: 2412592 - RNA, 16 nt, Human
ccaugaguccccuguu

SEQ ID NO: 2412593 - RNA, 13 nt, Human
ccaugggccuccu

SEQ ID NO: 2412594 - RNA, 13 nt, Human
ccaugaguccccu

SEQ ID NO: 2412595 - RNA, 19 nt, Human
ccaugagccucagcauccu

SEQ ID NO: 2412596 - RNA, 18 nt, Human
ccaugagccucagcaucc

SEQ ID NO: 2412597 - RNA, 14 nt, Human
ccaugagccucagc

SEQ ID NO: 2412598 - RNA, 16 nt, Human
ccauccccuguagagu

SEQ ID NO: 2412599 - RNA, 22 nt, Human
ccauccccuguagagugggagc

SEQ ID NO: 2412600 - RNA, 13 nt, Human
ccaucccccugcc

SEQ ID NO: 2412601 - RNA, 12 nt, Human
ccaucccccugc

SEQ ID NO: 2412602 - RNA, 22 nt, Human
ccauccccccucaccaggggca

SEQ ID NO: 2412603 - RNA, 21 nt, Human
ccauccccccucaccaggggc

SEQ ID NO: 2412604 - RNA, 20 nt, Human
ccauccccccucaccagggg

SEQ ID NO: 2412605 - RNA, 19 nt, Human
ccauccccccucaccaggg

SEQ ID NO: 2412606 - RNA, 14 nt, Human
ccauccccccucac

SEQ ID NO: 2412607 - RNA, 22 nt, Human
ccauccccauccuccagcuucu

SEQ ID NO: 2412608 - RNA, 15 nt, Human
ccaucccccugcccu

SEQ ID NO: 2412609 - RNA, 14 nt, Human
ccaucccccugccc

SEQ ID NO: 2412610 - RNA, 19 nt, Human
ccaucccccugcccucgug

SEQ ID NO: 2412611 - RNA, 14 nt, Human
ccauccccgcagug

SEQ ID NO: 2412612 - RNA, 13 nt, Human
ccauccccuggac

SEQ ID NO: 2412613 - RNA, 17 nt, Human
ccauccccgcagugugc

SEQ ID NO: 2412614 - RNA, 17 nt, Human
ccaucccugccugguca

SEQ ID NO: 2412615 - RNA, 19 nt, Human
ccaucccuuuuugaagugu

SEQ ID NO: 2412616 - RNA, 14 nt, Human
ccaucccugccugg

SEQ ID NO: 2412617 - RNA, 13 nt, Human
ccaucccugccug

SEQ ID NO: 2412618 - RNA, 12 nt, Human
ccaucccugccu

SEQ ID NO: 2412619 - RNA, 15 nt, Human
ccauccccuggacug

SEQ ID NO: 2412620 - RNA, 16 nt, Human
ccaucccugccugguc

SEQ ID NO: 2412621 - RNA, 15 nt, Human
ccaucccugccuggu

SEQ ID NO: 2412622 - RNA, 19 nt, Human
ccauccggcccccagagcg

SEQ ID NO: 2412623 - RNA, 16 nt, Human
ccauccgccagggccc

SEQ ID NO: 2412624 - RNA, 15 nt, Human
ccauccgccagggcc

SEQ ID NO: 2412625 - RNA, 21 nt, Human
ccauccuaaucauccaaugcu

SEQ ID NO: 2412626 - RNA, 22 nt, Human
ccauccuaaucauccaaugcuc

SEQ ID NO: 2412627 - RNA, 15 nt, Human
ccauccuaccaaugc

SEQ ID NO: 2412628 - RNA, 23 nt, Human
ccauccuaaucauccaaugcuca

SEQ ID NO: 2412629 - RNA, 20 nt, Human
ccauccuaccaaugcaugca

SEQ ID NO: 2412630 - RNA, 19 nt, Human
ccauccuaccaaugcaugc

SEQ ID NO: 2412631 - RNA, 15 nt, Human
ccaugggccuccugu

SEQ ID NO: 2412632 - RNA, 14 nt, Human
ccaugggccuccug

SEQ ID NO: 2412633 - RNA, 12 nt, Human
ccauucuuucug

SEQ ID NO: 2412634 - RNA, 13 nt, Human
ccauucuuucuga

SEQ ID NO: 2412635 - RNA, 17 nt, Human
ccauucuuucugauaac

SEQ ID NO: 2412636 - RNA, 22 nt, Human
ccauucuuuuguaauuuaaaug

SEQ ID NO: 2412637 - RNA, 18 nt, Human
ccauucuuuuguaauuua

SEQ ID NO: 2412638 - RNA, 16 nt, Human
ccauucuuuuguaauu

SEQ ID NO: 2412639 - RNA, 15 nt, Human
ccauucuuuuguaau

SEQ ID NO: 2412640 - RNA, 18 nt, Human
ccauuucuacucucccau

SEQ ID NO: 2412641 - RNA, 13 nt, Human
ccauuucuacucu

SEQ ID NO: 2412642 - RNA, 13 nt, Human
ccauuuccugaga

SEQ ID NO: 2412643 - RNA, 19 nt, Human
ccauuucuaaaggccucuu

SEQ ID NO: 2412644 - RNA, 21 nt, Human
ccauuucuaaaggccucuucc

SEQ ID NO: 2412645 - RNA, 16 nt, Human
ccauuuagguuucuga

SEQ ID NO: 2412646 - RNA, 21 nt, Human
ccauuuagguuucugaguucc

SEQ ID NO: 2412647 - RNA, 18 nt, Human
ccauuucccaucugcacc

SEQ ID NO: 2412648 - RNA, 14 nt, Human
ccauuuauccaccu

SEQ ID NO: 2412649 - RNA, 18 nt, Human
ccauuuauacaaauuaga

SEQ ID NO: 2412650 - RNA, 14 nt, Human
ccauuuagccacca

SEQ ID NO: 2412651 - RNA, 19 nt, Human
ccauuuaguucuuuguuau

SEQ ID NO: 2412652 - RNA, 19 nt, Human
ccauuuaaauuuuuuuccu

SEQ ID NO: 2412653 - RNA, 16 nt, Human
ccauugacauguacag

SEQ ID NO: 2412654 - RNA, 15 nt, Human
ccauugacauguaca

SEQ ID NO: 2412655 - RNA, 17 nt, Human
ccauugacauguacaga

SEQ ID NO: 2412656 - RNA, 22 nt, Human
ccauuuaaagcuuauuaaaacu

SEQ ID NO: 2412657 - RNA, 13 nt, Human
ccauugaauucuu

SEQ ID NO: 2412658 - RNA, 22 nt, Human
ccauugaauucuugguugagga

SEQ ID NO: 2412659 - RNA, 15 nt, Human
ccaggagggcacugg

SEQ ID NO: 2412660 - RNA, 14 nt, Human
ccagucaaccuggg

SEQ ID NO: 2412661 - RNA, 19 nt, Human
ccagggggacuagccccug

SEQ ID NO: 2412662 - RNA, 18 nt, Human
ccagggggacuagccccu

SEQ ID NO: 2412663 - RNA, 17 nt, Human
ccagggggacuagcccc

SEQ ID NO: 2412664 - RNA, 19 nt, Human
ccaggggcuggcuucagga

SEQ ID NO: 2412665 - RNA, 21 nt, Human
ccaggggcuggcuucaggagg

SEQ ID NO: 2412666 - RNA, 14 nt, Human
ccaggggcuggcuu

SEQ ID NO: 2412667 - RNA, 23 nt, Human
ccagggggacuagccccugugga

SEQ ID NO: 2412668 - RNA, 20 nt, Human
ccagggggacuagccccugu

SEQ ID NO: 2412669 - RNA, 22 nt, Human
ccagggggccagucccugaggc

SEQ ID NO: 2412670 - RNA, 21 nt, Human
ccagucaccccggccaccugc

SEQ ID NO: 2412671 - RNA, 20 nt, Human
ccagucaccccggccaccug

SEQ ID NO: 2412672 - RNA, 13 nt, Human
ccagucaccccgg

SEQ ID NO: 2412673 - RNA, 12 nt, Human
ccagucaccccg

SEQ ID NO: 2412674 - RNA, 15 nt, Human
ccaguccccccaccc

SEQ ID NO: 2412675 - RNA, 23 nt, Human
ccagucccccaaccccagccgcu

SEQ ID NO: 2412676 - RNA, 21 nt, Human
ccagucccccaaccccagccg

SEQ ID NO: 2412677 - RNA, 20 nt, Human
ccagucccccaaccccagcc

SEQ ID NO: 2412678 - RNA, 16 nt, Human
ccagucccccaacccc

SEQ ID NO: 2412679 - RNA, 15 nt, Human
ccagucccccaaccc

SEQ ID NO: 2412680 - RNA, 17 nt, Human
ccaguccccccacccuc

SEQ ID NO: 2412681 - RNA, 14 nt, Human
ccagucccccugcc

SEQ ID NO: 2412682 - RNA, 22 nt, Human
ccaguccccaccccugccccca

SEQ ID NO: 2412683 - RNA, 21 nt, Human
ccaguccccaccccugccccc

SEQ ID NO: 2412684 - RNA, 19 nt, Human
ccaguccccaccccugccc

SEQ ID NO: 2412685 - RNA, 18 nt, Human
ccaguccccaccccugcc

SEQ ID NO: 2412686 - RNA, 17 nt, Human
ccaguccccaccccugc

SEQ ID NO: 2412687 - RNA, 16 nt, Human
ccaguccccaccccug

SEQ ID NO: 2412688 - RNA, 15 nt, Human
ccaguccccaccccu

SEQ ID NO: 2412689 - RNA, 14 nt, Human
ccagucccaggggc

SEQ ID NO: 2412690 - RNA, 23 nt, Human
ccagucagccucucucccagucu

SEQ ID NO: 2412691 - RNA, 22 nt, Human
ccagucagccucucucccaguc

SEQ ID NO: 2412692 - RNA, 20 nt, Human
ccagucagccucucucccag

SEQ ID NO: 2412693 - RNA, 19 nt, Human
ccagucagccucucuccca

SEQ ID NO: 2412694 - RNA, 18 nt, Human
ccagucagccucucuccc

SEQ ID NO: 2412695 - RNA, 17 nt, Human
ccagucagccucucucc

SEQ ID NO: 2412696 - RNA, 15 nt, Human
ccagucagccucucu

SEQ ID NO: 2412697 - RNA, 14 nt, Human
ccagucagccucuc

SEQ ID NO: 2412698 - RNA, 13 nt, Human
ccagucagccucu

SEQ ID NO: 2412699 - RNA, 12 nt, Human
ccagucagccuc

SEQ ID NO: 2412700 - RNA, 21 nt, Human
ccaggcugggagagccuucca

SEQ ID NO: 2412701 - RNA, 18 nt, Human
ccaggcugggagagccuu

SEQ ID NO: 2412702 - RNA, 17 nt, Human
ccaggcugggagagccu

SEQ ID NO: 2412703 - RNA, 15 nt, Human
ccaggcugggagagc

SEQ ID NO: 2412704 - RNA, 23 nt, Human
ccaggggcugcuuccuccuggaa

SEQ ID NO: 2412705 - RNA, 22 nt, Human
ccaggggcugcuuccuccugga

SEQ ID NO: 2412706 - RNA, 21 nt, Human
ccaggggcugcuuccuccugg

SEQ ID NO: 2412707 - RNA, 20 nt, Human
ccaggggcugcuuccuccug

SEQ ID NO: 2412708 - RNA, 22 nt, Human
ccaggcugggagagccuuccag

SEQ ID NO: 2412709 - RNA, 22 nt, Human
ccaggggccccuccagcuugug

SEQ ID NO: 2412710 - RNA, 15 nt, Human
ccaggcacacacugu

SEQ ID NO: 2412711 - RNA, 20 nt, Human
ccaggagggcacuggagcug

SEQ ID NO: 2412712 - RNA, 17 nt, Human
ccaggagggcacuggag

SEQ ID NO: 2412713 - RNA, 16 nt, Human
ccaggagggcacugga

SEQ ID NO: 2412714 - RNA, 22 nt, Human
ccaggagguggcuauggccacc

SEQ ID NO: 2412715 - RNA, 19 nt, Human
ccaggagggcacuggagcu

SEQ ID NO: 2412716 - RNA, 18 nt, Human
ccaggaggucgaccccaa

SEQ ID NO: 2412717 - RNA, 22 nt, Human
ccaggauguacaaggacagccc

SEQ ID NO: 2412718 - RNA, 23 nt, Human
ccaggauggcccuucccacugga

SEQ ID NO: 2412719 - RNA, 20 nt, Human
ccaggaguucgaggcugcag

SEQ ID NO: 2412720 - RNA, 21 nt, Human
ccaggaguguggccacguggg

SEQ ID NO: 2412721 - RNA, 14 nt, Human
ccaggcugggagag

SEQ ID NO: 2412722 - RNA, 13 nt, Human
ccaggcugggaga

SEQ ID NO: 2412723 - RNA, 12 nt, Human
ccaggcaaauca

SEQ ID NO: 2412724 - RNA, 20 nt, Human
ccaggauuuuaacaaaagca

SEQ ID NO: 2412725 - RNA, 19 nt, Human
ccaggcaaaucaguuacua

SEQ ID NO: 2412726 - RNA, 17 nt, Human
ccaggcaacuugggaac

SEQ ID NO: 2412727 - RNA, 23 nt, Human
ccaggauuuuaacaaaagcaaga

SEQ ID NO: 2412728 - RNA, 18 nt, Human
ccaggauugaagagcauu

SEQ ID NO: 2412729 - RNA, 17 nt, Human
ccaggauugaagagcau

SEQ ID NO: 2412730 - RNA, 16 nt, Human
ccaggauugaagagca

SEQ ID NO: 2412731 - RNA, 19 nt, Human
ccagcagagcaccuuagac

SEQ ID NO: 2412732 - RNA, 23 nt, Human
ccagcagagcaccuuagacaguc

SEQ ID NO: 2412733 - RNA, 15 nt, Human
ccagcagaucccagc

SEQ ID NO: 2412734 - RNA, 16 nt, Human
ccagcagaucccagcu

SEQ ID NO: 2412735 - RNA, 17 nt, Human
ccagcagaucccagcuc

SEQ ID NO: 2412736 - RNA, 18 nt, Human
ccagcagaucccagcuca

SEQ ID NO: 2412737 - RNA, 21 nt, Human
ccacucugcuuugacugagca

SEQ ID NO: 2412738 - RNA, 20 nt, Human
ccacucugcuucucugacuu

SEQ ID NO: 2412739 - RNA, 19 nt, Human
ccacucugcuucucugacu

SEQ ID NO: 2412740 - RNA, 17 nt, Human
ccacucugcuucucuga

SEQ ID NO: 2412741 - RNA, 14 nt, Human
ccacucugcuucuc

SEQ ID NO: 2412742 - RNA, 13 nt, Human
ccacucugcuucu

SEQ ID NO: 2412743 - RNA, 21 nt, Human
ccacucugcucgccuuagcac

SEQ ID NO: 2412744 - RNA, 23 nt, Human
ccacucuccuugcuacccagaaa

SEQ ID NO: 2412745 - RNA, 14 nt, Human
ccacucugccucug

SEQ ID NO: 2412746 - RNA, 16 nt, Human
ccacucugccucugcc

SEQ ID NO: 2412747 - RNA, 21 nt, Human
ccacucuccuugcuacccaga

SEQ ID NO: 2412748 - RNA, 12 nt, Human
ccacucuccuug

SEQ ID NO: 2412749 - RNA, 20 nt, Human
ccacucucccccacccccuc

SEQ ID NO: 2412750 - RNA, 17 nt, Human
ccacucuccccacacua

SEQ ID NO: 2412751 - RNA, 23 nt, Human
ccaggaaaggcuccaggagcagc

SEQ ID NO: 2412752 - RNA, 22 nt, Human
ccaggaaaggcuccaggagcag

SEQ ID NO: 2412753 - RNA, 21 nt, Human
ccaggaaaggcuccaggagca

SEQ ID NO: 2412754 - RNA, 18 nt, Human
ccagcuugaaaccuucac

SEQ ID NO: 2412755 - RNA, 23 nt, Human
ccagcuucugguacucuccuaga

SEQ ID NO: 2412756 - RNA, 22 nt, Human
ccagcuucugguacucuccuag

SEQ ID NO: 2412757 - RNA, 21 nt, Human
ccagcuucugguacucuccua

SEQ ID NO: 2412758 - RNA, 18 nt, Human
ccagcuucuccaggcucu

SEQ ID NO: 2412759 - RNA, 17 nt, Human
ccagcuucuccaggcuc

SEQ ID NO: 2412760 - RNA, 16 nt, Human
ccagcuucuccaggcu

SEQ ID NO: 2412761 - RNA, 15 nt, Human
ccagcuucuccaggc

SEQ ID NO: 2412762 - RNA, 14 nt, Human
ccagcuucuccagg

SEQ ID NO: 2412763 - RNA, 16 nt, Human
ccagcuuaucucaggg

SEQ ID NO: 2412764 - RNA, 22 nt, Human
ccagcucagucccaucagagag

SEQ ID NO: 2412765 - RNA, 21 nt, Human
ccaggaacaaucgauggccuu

SEQ ID NO: 2412766 - RNA, 16 nt, Human
ccaggaaaugugcaca

SEQ ID NO: 2412767 - RNA, 22 nt, Human
ccaggaacacccgacuccucaa

SEQ ID NO: 2412768 - RNA, 19 nt, Human
ccagcagccuggacccugu

SEQ ID NO: 2412769 - RNA, 20 nt, Human
ccagcagccuggacccugug

SEQ ID NO: 2412770 - RNA, 15 nt, Human
ccagcagccuggacc

SEQ ID NO: 2412771 - RNA, 14 nt, Human
ccagcagccuggac

SEQ ID NO: 2412772 - RNA, 12 nt, Human
ccagccccugua

SEQ ID NO: 2412773 - RNA, 19 nt, Human
ccagccccuguauggcacu

SEQ ID NO: 2412774 - RNA, 21 nt, Human
ccagccccuggccccaggacc

SEQ ID NO: 2412775 - RNA, 23 nt, Human
ccagccccuggccccaggaccug

SEQ ID NO: 2412776 - RNA, 10 nt, Human
ccagccccuu

SEQ ID NO: 2412777 - RNA, 21 nt, Human
ccagccccuggaugcagccuc

SEQ ID NO: 2412778 - RNA, 13 nt, Human
ccagccccuggcc

SEQ ID NO: 2412779 - RNA, 19 nt, Human
ccagcagaucccagcucac

SEQ ID NO: 2412780 - RNA, 21 nt, Human
ccagcagaucccagcucacgu

SEQ ID NO: 2412781 - RNA, 19 nt, Human
ccagcguccuccucuguga

SEQ ID NO: 2412782 - RNA, 21 nt, Human
ccagccccuucucagaaucua

SEQ ID NO: 2412783 - RNA, 16 nt, Human
ccagccccuucucaga

SEQ ID NO: 2412784 - RNA, 17 nt, Human
ccagcguuugaggggcu

SEQ ID NO: 2412785 - RNA, 22 nt, Human
ccagcguuugaggggcuggccu

SEQ ID NO: 2412786 - RNA, 13 nt, Human
ccagcuaagaacc

SEQ ID NO: 2412787 - RNA, 14 nt, Human
ccagcuaagaaccu

SEQ ID NO: 2412788 - RNA, 15 nt, Human
ccagcuaagaaccug

SEQ ID NO: 2412789 - RNA, 23 nt, Human
ccagcuaaucuguagggcuggac

SEQ ID NO: 2412790 - RNA, 22 nt, Human
ccagcuaaucuguagggcugga

SEQ ID NO: 2412791 - RNA, 21 nt, Human
ccagcuaaucuguagggcugg

SEQ ID NO: 2412792 - RNA, 20 nt, Human
ccagcuaaucuguagggcug

SEQ ID NO: 2412793 - RNA, 17 nt, Human
ccagcuaaucuguaggg

SEQ ID NO: 2412794 - RNA, 17 nt, Human
ccagcuaagaaccugga

SEQ ID NO: 2412795 - RNA, 18 nt, Human
ccagcuaagaaccuggaa

SEQ ID NO: 2412796 - RNA, 19 nt, Human
ccagcuaagaaccuggaac

SEQ ID NO: 2412797 - RNA, 21 nt, Human
ccagcuaaggacauuucccag

SEQ ID NO: 2412798 - RNA, 23 nt, Human
ccagcuaaggacauuucccaggg

SEQ ID NO: 2412799 - RNA, 23 nt, Human
ccagcucaggacagaugccacac

SEQ ID NO: 2412800 - RNA, 20 nt, Human
ccagcucaggacagaugcca

SEQ ID NO: 2412801 - RNA, 15 nt, Human
ccagcucagucccau

SEQ ID NO: 2412802 - RNA, 13 nt, Human
ccagcucaggaca

SEQ ID NO: 2412803 - RNA, 19 nt, Human
ccagcucaggacagaugcc

SEQ ID NO: 2412804 - RNA, 15 nt, Human
ccagcucacgucaca

SEQ ID NO: 2412805 - RNA, 19 nt, Human
ccagcucaccccuggagga

SEQ ID NO: 2412806 - RNA, 14 nt, Human
ccagcucaccccug

SEQ ID NO: 2412807 - RNA, 14 nt, Human
ccagcucacgucac

SEQ ID NO: 2412808 - RNA, 13 nt, Human
ccagcucagaggg

SEQ ID NO: 2412809 - RNA, 23 nt, Human
ccagcucaccccccacacucacu

SEQ ID NO: 2412810 - RNA, 19 nt, Human
ccagcucaccccccacacu

SEQ ID NO: 2412811 - RNA, 17 nt, Human
ccagcucaccccccaca

SEQ ID NO: 2412812 - RNA, 13 nt, Human
ccagcucaccccc

SEQ ID NO: 2412813 - RNA, 12 nt, Human
ccagcucacccc

SEQ ID NO: 2412814 - RNA, 14 nt, Human
cguaaaauuaagaa

SEQ ID NO: 2412815 - RNA, 18 nt, Human
cgguguggugcaguguga

SEQ ID NO: 2412816 - RNA, 23 nt, Human
cgguguuuaagacauuuuuggaa

SEQ ID NO: 2412817 - RNA, 11 nt, Human
cgguuucucca

SEQ ID NO: 2412818 - RNA, 15 nt, Human
cgguuugaagccugg

SEQ ID NO: 2412819 - RNA, 21 nt, Human
cgguuuggggagcagagacac

SEQ ID NO: 2412820 - RNA, 16 nt, Human
cgguuuuacugcagcu

SEQ ID NO: 2412821 - RNA, 16 nt, Human
cgugaguccuggcaug

SEQ ID NO: 2412822 - RNA, 17 nt, Human
cgugaggccagagacac

SEQ ID NO: 2412823 - RNA, 17 nt, Human
cgugaguccuggcaugg

SEQ ID NO: 2412824 - RNA, 16 nt, Human
cgugaggccagagaca

SEQ ID NO: 2412825 - RNA, 21 nt, Human
cgugguggaagaggggacagg

SEQ ID NO: 2412826 - RNA, 18 nt, Human
cgugguguuauuuaaaga

SEQ ID NO: 2412827 - RNA, 19 nt, Human
cgugguguuauuuaaagaa

SEQ ID NO: 2412828 - RNA, 15 nt, Human
cguguaaaccaaagc

SEQ ID NO: 2412829 - RNA, 12 nt, Human
cguguaaaccaa

SEQ ID NO: 2412830 - RNA, 16 nt, Human
cgugugcgugcaugug

SEQ ID NO: 2412831 - RNA, 21 nt, Human
cguguggcaauagugggcccu

SEQ ID NO: 2412832 - RNA, 20 nt, Human
cguguaaccauggacccaau

SEQ ID NO: 2412833 - RNA, 14 nt, Human
cgugcacacaccag

SEQ ID NO: 2412834 - RNA, 17 nt, Human
cgugaugccucccuguu

SEQ ID NO: 2412835 - RNA, 23 nt, Human
cgugauguaggguaaggugccuu

SEQ ID NO: 2412836 - RNA, 20 nt, Human
cgugcaauuuguuugugcuu

SEQ ID NO: 2412837 - RNA, 18 nt, Human
cgugauuuugcuguagaa

SEQ ID NO: 2412838 - RNA, 22 nt, Human
cgugaucucggcucacugcaac

SEQ ID NO: 2412839 - RNA, 13 nt, Human
cgugaucuuggcu

SEQ ID NO: 2412840 - RNA, 18 nt, Human
cgugauccacccaccucg

SEQ ID NO: 2412841 - RNA, 22 nt, Human
cgugaucaaagccacacucugg

SEQ ID NO: 2412842 - RNA, 15 nt, Human
cgcugccagcucugu

SEQ ID NO: 2412843 - RNA, 19 nt, Human
cgcugccagcucuguauca

SEQ ID NO: 2412844 - RNA, 16 nt, Human
cgcugccacccaccuc

SEQ ID NO: 2412845 - RNA, 17 nt, Human
cgcugccacccaccucc

SEQ ID NO: 2412846 - RNA, 20 nt, Human
cgcugccacccaccucccug

SEQ ID NO: 2412847 - RNA, 18 nt, Human
cgcugcccaggggagccc

SEQ ID NO: 2412848 - RNA, 21 nt, Human
cgcugaugcugggcugggugc

SEQ ID NO: 2412849 - RNA, 19 nt, Human
cgcugaugcugggcugggu

SEQ ID NO: 2412850 - RNA, 14 nt, Human
cgcugauucucagg

SEQ ID NO: 2412851 - RNA, 23 nt, Human
cgcugauucucagggucucugcu

SEQ ID NO: 2412852 - RNA, 16 nt, Human
cgcugauucucagggu

SEQ ID NO: 2412853 - RNA, 19 nt, Human
cgcugcaaccuguugauag

SEQ ID NO: 2412854 - RNA, 17 nt, Human
cgcugaugcugggcugg

SEQ ID NO: 2412855 - RNA, 16 nt, Human
cgcugaugcugggcug

SEQ ID NO: 2412856 - RNA, 14 nt, Human
cgcugaugcugggc

SEQ ID NO: 2412857 - RNA, 13 nt, Human
cgcugaugcuggg

SEQ ID NO: 2412858 - RNA, 12 nt, Human
cgcugaugcugg

SEQ ID NO: 2412859 - RNA, 13 nt, Human
cgcugauauaugu

SEQ ID NO: 2412860 - RNA, 15 nt, Human
cgccuguagucccag

SEQ ID NO: 2412861 - RNA, 17 nt, Human
cgccuguaaucccagcu

SEQ ID NO: 2412862 - RNA, 18 nt, Human
cgccuguaaucccagcac

SEQ ID NO: 2412863 - RNA, 18 nt, Human
cgccuguaaucccagcag

SEQ ID NO: 2412864 - RNA, 20 nt, Human
cgccuguaaucccagcuacu

SEQ ID NO: 2412865 - RNA, 16 nt, Human
cgccuguaaucccagc

SEQ ID NO: 2412866 - RNA, 17 nt, Human
cgccuguaaucccagca

SEQ ID NO: 2412867 - RNA, 20 nt, Human
cgccuguaaucccagcacuu

SEQ ID NO: 2412868 - RNA, 19 nt, Human
cggagcuaacacuggcccc

SEQ ID NO: 2412869 - RNA, 21 nt, Human
cggagcuaacacuggccccua

SEQ ID NO: 2412870 - RNA, 20 nt, Human
cggagcuaacacuggccccu

SEQ ID NO: 2412871 - RNA, 16 nt, Human
cggagucccaccuugg

SEQ ID NO: 2412872 - RNA, 21 nt, Human
cggagcuggccccgccgccug

SEQ ID NO: 2412873 - RNA, 16 nt, Human
cggagcuggccccgcc

SEQ ID NO: 2412874 - RNA, 13 nt, Human
cggagcuggcccc

SEQ ID NO: 2412875 - RNA, 17 nt, Human
cggcuccccaugugucc

SEQ ID NO: 2412876 - RNA, 15 nt, Human
cggcuccccaugugu

SEQ ID NO: 2412877 - RNA, 20 nt, Human
cggcuccccauguguccugg

SEQ ID NO: 2412878 - RNA, 14 nt, Human
cggcucccuggagc

SEQ ID NO: 2412879 - RNA, 17 nt, Human
cgggcaugggcacuccc

SEQ ID NO: 2412880 - RNA, 14 nt, Human
cgggccacagagaa

SEQ ID NO: 2412881 - RNA, 12 nt, Human
cgggccacagag

SEQ ID NO: 2412882 - RNA, 16 nt, Human
cggcuccaggcuccuu

SEQ ID NO: 2412883 - RNA, 15 nt, Human
cggcuccaggcuccu

SEQ ID NO: 2412884 - RNA, 14 nt, Human
cggcuccaggcucc

SEQ ID NO: 2412885 - RNA, 13 nt, Human
cggcuccaggcuc

SEQ ID NO: 2412886 - RNA, 14 nt, Human
cggcucacugcagc

SEQ ID NO: 2412887 - RNA, 15 nt, Human
cggcucacugcagcc

SEQ ID NO: 2412888 - RNA, 20 nt, Human
cggagucccaccuuggcugc

SEQ ID NO: 2412889 - RNA, 18 nt, Human
cggagucccaccuuggcu

SEQ ID NO: 2412890 - RNA, 17 nt, Human
cggcucacugcagccuc

SEQ ID NO: 2412891 - RNA, 16 nt, Human
cggcucacugcagccu

SEQ ID NO: 2412892 - RNA, 12 nt, Human
cggcuccaggcu

SEQ ID NO: 2412893 - RNA, 14 nt, Human
cggaggccccaaag

SEQ ID NO: 2412894 - RNA, 21 nt, Human
cggaggccacaugagucccag

SEQ ID NO: 2412895 - RNA, 19 nt, Human
cggaggccacaugaguccc

SEQ ID NO: 2412896 - RNA, 16 nt, Human
cggaggccacaugagu

SEQ ID NO: 2412897 - RNA, 13 nt, Human
cgguguggagaag

SEQ ID NO: 2412898 - RNA, 15 nt, Human
cggggacagcuccuu

SEQ ID NO: 2412899 - RNA, 18 nt, Human
cgguguggagaagcggcu

SEQ ID NO: 2412900 - RNA, 20 nt, Human
cgguguggugcagugugaaa

SEQ ID NO: 2412901 - RNA, 21 nt, Human
cggggacagaggccugcccgg

SEQ ID NO: 2412902 - RNA, 16 nt, Human
cggugugggcuguguc

SEQ ID NO: 2412903 - RNA, 17 nt, Human
cgggcucugccucccau

SEQ ID NO: 2412904 - RNA, 16 nt, Human
cggggaacuccuggaa

SEQ ID NO: 2412905 - RNA, 17 nt, Human
cgggcgugguggcgggc

SEQ ID NO: 2412906 - RNA, 14 nt, Human
cgggcugcccugcc

SEQ ID NO: 2412907 - RNA, 18 nt, Human
cggggacagaggccugcc

SEQ ID NO: 2412908 - RNA, 17 nt, Human
cggggacagaggccugc

SEQ ID NO: 2412909 - RNA, 16 nt, Human
cggggacagaggccug

SEQ ID NO: 2412910 - RNA, 14 nt, Human
cggggacagaggcc

SEQ ID NO: 2412911 - RNA, 14 nt, Human
cggggacagcuccu

SEQ ID NO: 2412912 - RNA, 16 nt, Human
cgggcucugccuccca

SEQ ID NO: 2412913 - RNA, 14 nt, Human
cgggcucugccucc

SEQ ID NO: 2412914 - RNA, 15 nt, Human
cgggcucagcaaaag

SEQ ID NO: 2412915 - RNA, 21 nt, Human
cgggcggucagggguucgaga

SEQ ID NO: 2412916 - RNA, 16 nt, Human
cgggcgcggccagccc

SEQ ID NO: 2412917 - RNA, 13 nt, Human
cgggcucugccuc

SEQ ID NO: 2412918 - RNA, 17 nt, Human
cgggccacagagaaagu

SEQ ID NO: 2412919 - RNA, 21 nt, Human
cgggcaugguggcgcaagccu

SEQ ID NO: 2412920 - RNA, 12 nt, Human
cgggccaaggac

SEQ ID NO: 2412921 - RNA, 14 nt, Human
cgggccaaggacug

SEQ ID NO: 2412922 - RNA, 20 nt, Human
cgggccaaggacugccgacc

SEQ ID NO: 2412923 - RNA, 11 nt, Human
cgggcucagca

SEQ ID NO: 2412924 - RNA, 17 nt, Human
cgggcgagucacugccu

SEQ ID NO: 2412925 - RNA, 19 nt, Human
cgggcgagucacugccucu

SEQ ID NO: 2412926 - RNA, 23 nt, Human
cgggcgccuguagucccagccac

SEQ ID NO: 2412927 - RNA, 20 nt, Human
cgacccuugccgucuaccug

SEQ ID NO: 2412928 - RNA, 19 nt, Human
cgacccuugccgucuaccu

SEQ ID NO: 2412929 - RNA, 15 nt, Human
cgacgcgucuccugu

SEQ ID NO: 2412930 - RNA, 22 nt, Human
cgacggugggcauuugugaggc

SEQ ID NO: 2412931 - RNA, 12 nt, Human
cgaccuuuaccu

SEQ ID NO: 2412932 - RNA, 19 nt, Human
cgaccgaggcuggagcugg

SEQ ID NO: 2412933 - RNA, 15 nt, Human
cgaccgaggcuggag

SEQ ID NO: 2412934 - RNA, 14 nt, Human
cgacuaauuucaaa

SEQ ID NO: 2412935 - RNA, 11 nt, Human
cgacucaggau

SEQ ID NO: 2412936 - RNA, 13 nt, Human
cgacucagccuca

SEQ ID NO: 2412937 - RNA, 13 nt, Human
cgacucugaccuc

SEQ ID NO: 2412938 - RNA, 19 nt, Human
cgacuccguuggccacucc

SEQ ID NO: 2412939 - RNA, 16 nt, Human
cgacuccguuggccac

SEQ ID NO: 2412940 - RNA, 20 nt, Human
cgacucuauagacucuagga

SEQ ID NO: 2412941 - RNA, 18 nt, Human
cgacucuauagacucuag

SEQ ID NO: 2412942 - RNA, 20 nt, Human
cgacugcacagcggccccug

SEQ ID NO: 2412943 - RNA, 15 nt, Human
cgacuggguuuaugu

SEQ ID NO: 2412944 - RNA, 17 nt, Human
cgacugcccggcagggu

SEQ ID NO: 2412945 - RNA, 16 nt, Human
cgacugcacagcggcc

SEQ ID NO: 2412946 - RNA, 17 nt, Human
cgacugccaucuuggac

SEQ ID NO: 2412947 - RNA, 18 nt, Human
ccuuuuuauuugcaugug

SEQ ID NO: 2412948 - RNA, 17 nt, Human
ccuuuuuauuugcaugu

SEQ ID NO: 2412949 - RNA, 22 nt, Human
ccuuuuugaaguguaggcagac

SEQ ID NO: 2412950 - RNA, 13 nt, Human
ccuuuuugaagug

SEQ ID NO: 2412951 - RNA, 23 nt, Human
ccuuuuugguacuuauuacugcu

SEQ ID NO: 2412952 - RNA, 21 nt, Human
ccuuuuugguacuuauuacug

SEQ ID NO: 2412953 - RNA, 22 nt, Human
ccuuuuucauauguugcucagu

SEQ ID NO: 2412954 - RNA, 15 nt, Human
ccuuuuuacuccccu

SEQ ID NO: 2412955 - RNA, 23 nt, Human
ccuuuuuacuccccuugagcuga

SEQ ID NO: 2412956 - RNA, 21 nt, Human
ccuuuuuuaagauuuuucuca

SEQ ID NO: 2412957 - RNA, 22 nt, Human
cgaauuaauagcuuuuauugua

SEQ ID NO: 2412958 - RNA, 16 nt, Human
cgaauuuuaaaagaug

SEQ ID NO: 2412959 - RNA, 21 nt, Human
ccuuuuuuagaguugauacua

SEQ ID NO: 2412960 - RNA, 13 nt, Human
ccuuuuuuaaaaa

SEQ ID NO: 2412961 - RNA, 16 nt, Human
ccuuuuuuaaaaaugc

SEQ ID NO: 2412962 - RNA, 20 nt, Human
ccuuuuuuaagauuuuucuc

SEQ ID NO: 2412963 - RNA, 19 nt, Human
ccuuuuuuaagauuuuucu

SEQ ID NO: 2412964 - RNA, 18 nt, Human
ccuuuuuuaagauuuuuc

SEQ ID NO: 2412965 - RNA, 14 nt, Human
ccuuuuuuaagauu

SEQ ID NO: 2412966 - RNA, 13 nt, Human
ccuuuuuuaagau

SEQ ID NO: 2412967 - RNA, 17 nt, Human
ccuuuuuuaaaaaugca

SEQ ID NO: 2412968 - RNA, 13 nt, Human
cgacaaugcaaac

SEQ ID NO: 2412969 - RNA, 12 nt, Human
cgacaagugcug

SEQ ID NO: 2412970 - RNA, 18 nt, Human
cgacaaccgaugcuccag

SEQ ID NO: 2412971 - RNA, 21 nt, Human
cgacaaccgaugcuccagcca

SEQ ID NO: 2412972 - RNA, 12 nt, Human
cgacaaugcaaa

SEQ ID NO: 2412973 - RNA, 15 nt, Human
cgacaaccgaugcuc

SEQ ID NO: 2412974 - RNA, 17 nt, Human
cgaauuuuucagaugau

SEQ ID NO: 2412975 - RNA, 18 nt, Human
cgaccccaucugcccagg

SEQ ID NO: 2412976 - RNA, 19 nt, Human
cgaccccaucugcccagga

SEQ ID NO: 2412977 - RNA, 19 nt, Human
cgaccccgucacagccuca

SEQ ID NO: 2412978 - RNA, 14 nt, Human
cgacagccuggcac

SEQ ID NO: 2412979 - RNA, 22 nt, Human
cgacagagggaagaaaagagcu

SEQ ID NO: 2412980 - RNA, 17 nt, Human
cgaccccaucugcccag

SEQ ID NO: 2412981 - RNA, 13 nt, Human
cgacagccuggca

SEQ ID NO: 2412982 - RNA, 12 nt, Human
cgacagccuggc

SEQ ID NO: 2412983 - RNA, 16 nt, Human
cgacagagcgagacuu

SEQ ID NO: 2412984 - RNA, 15 nt, Human
cgacagcccccucug

SEQ ID NO: 2412985 - RNA, 22 nt, Human
ccuugcuggacggggacugggg

SEQ ID NO: 2412986 - RNA, 18 nt, Human
ccuugcuuaugacaucac

SEQ ID NO: 2412987 - RNA, 14 nt, Human
ccuuuaagagaaau

SEQ ID NO: 2412988 - RNA, 22 nt, Human
ccuugcuugcugccuucuggau

SEQ ID NO: 2412989 - RNA, 13 nt, Human
ccuugcucugcac

SEQ ID NO: 2412990 - RNA, 19 nt, Human
ccuugcucucccucuucuc

SEQ ID NO: 2412991 - RNA, 21 nt, Human
ccuugcugguuuucuggaugg

SEQ ID NO: 2412992 - RNA, 17 nt, Human
ccuugcuggaaaaccca

SEQ ID NO: 2412993 - RNA, 17 nt, Human
ccuugcucugcaggcac

SEQ ID NO: 2412994 - RNA, 16 nt, Human
ccuugcuguccuaggc

SEQ ID NO: 2412995 - RNA, 22 nt, Human
ccuugcccugaccucccagccc

SEQ ID NO: 2412996 - RNA, 19 nt, Human
ccuugcccugaccucccag

SEQ ID NO: 2412997 - RNA, 16 nt, Human
ccuugcccugaccucc

SEQ ID NO: 2412998 - RNA, 15 nt, Human
ccuugcccugaccuc

SEQ ID NO: 2412999 - RNA, 14 nt, Human
ccuugcccugaccu

SEQ ID NO: 2413000 - RNA, 13 nt, Human
ccuugcccugacc

SEQ ID NO: 2413001 - RNA, 12 nt, Human
ccuugcccugac

SEQ ID NO: 2413002 - RNA, 16 nt, Human
ccuugccgucuaccug

SEQ ID NO: 2413003 - RNA, 17 nt, Human
ccuugcccuugcccuga

SEQ ID NO: 2413004 - RNA, 16 nt, Human
ccuugcccuugcccug

SEQ ID NO: 2413005 - RNA, 15 nt, Human
ccuugcccuugcccu

SEQ ID NO: 2413006 - RNA, 23 nt, Human
ccuugcccugaccucccagcccu

SEQ ID NO: 2413007 - RNA, 20 nt, Human
ccuugcucuccccugcccug

SEQ ID NO: 2413008 - RNA, 18 nt, Human
ccuugcucucccucuucu

SEQ ID NO: 2413009 - RNA, 17 nt, Human
ccuugcucucccucuuc

SEQ ID NO: 2413010 - RNA, 15 nt, Human
ccuugcucucccucu

SEQ ID NO: 2413011 - RNA, 14 nt, Human
ccuugcucucccuc

SEQ ID NO: 2413012 - RNA, 13 nt, Human
ccuugcucucccu

SEQ ID NO: 2413013 - RNA, 18 nt, Human
ccuugcccuugcccugac

SEQ ID NO: 2413014 - RNA, 22 nt, Human
ccuugcucuccccugcccugcu

SEQ ID NO: 2413015 - RNA, 22 nt, Human
ccuugcccagggcucagccugg

SEQ ID NO: 2413016 - RNA, 18 nt, Human
ccuugcccggauucuggg

SEQ ID NO: 2413017 - RNA, 19 nt, Human
ccuugcccggauucuggga

SEQ ID NO: 2413018 - RNA, 21 nt, Human
ccuugcccagggcucagccug

SEQ ID NO: 2413019 - RNA, 19 nt, Human
ccuuucauuuacuguggcu

SEQ ID NO: 2413020 - RNA, 18 nt, Human
ccuuucauuuacuguggc

SEQ ID NO: 2413021 - RNA, 22 nt, Human
ccuuucauuuacuguggcuucu

SEQ ID NO: 2413022 - RNA, 16 nt, Human
ccuuuccaaggcuucu

SEQ ID NO: 2413023 - RNA, 12 nt, Human
ccuuucagcugu

SEQ ID NO: 2413024 - RNA, 15 nt, Human
ccuuucagcugugaa

SEQ ID NO: 2413025 - RNA, 12 nt, Human
ccuuucagggaa

SEQ ID NO: 2413026 - RNA, 16 nt, Human
ccuuucauuuacugug

SEQ ID NO: 2413027 - RNA, 14 nt, Human
ccuuucauuuacug

SEQ ID NO: 2413028 - RNA, 12 nt, Human
ccuuucauauuu

SEQ ID NO: 2413029 - RNA, 20 nt, Human
ccuuucagggaauuucagga

SEQ ID NO: 2413030 - RNA, 23 nt, Human
ccuuuugaggagccccagcuacc

SEQ ID NO: 2413031 - RNA, 21 nt, Human
ccuuuugaggagccccagcua

SEQ ID NO: 2413032 - RNA, 16 nt, Human
ccuuuugaggagcccc

SEQ ID NO: 2413033 - RNA, 15 nt, Human
ccuuuugagugccuu

SEQ ID NO: 2413034 - RNA, 17 nt, Human
ccuuuugagugccuuac

SEQ ID NO: 2413035 - RNA, 15 nt, Human
ccuuuugcaccccuc

SEQ ID NO: 2413036 - RNA, 14 nt, Human
ccuuuugcaccccu

SEQ ID NO: 2413037 - RNA, 12 nt, Human
ccuuuugcaccc

SEQ ID NO: 2413038 - RNA, 14 nt, Human
ccuuuuuacucccc

SEQ ID NO: 2413039 - RNA, 16 nt, Human
ccuuuugcaccccucc

SEQ ID NO: 2413040 - RNA, 19 nt, Human
ccuuucaccccagggccug

SEQ ID NO: 2413041 - RNA, 21 nt, Human
ccuuucaccccagggccugag

SEQ ID NO: 2413042 - RNA, 19 nt, Human
ccuuucagaugucuucugc

SEQ ID NO: 2413043 - RNA, 17 nt, Human
ccuuucagaugucuucu

SEQ ID NO: 2413044 - RNA, 14 nt, Human
ccuuucagaugucu

SEQ ID NO: 2413045 - RNA, 13 nt, Human
ccuuucagauguc

SEQ ID NO: 2413046 - RNA, 21 nt, Human
ccuuucagaugucuucugccu

SEQ ID NO: 2413047 - RNA, 20 nt, Human
ccuuucagaugucuucugcc

SEQ ID NO: 2413048 - RNA, 22 nt, Human
ccuuucagaugucuucugccug

SEQ ID NO: 2413049 - RNA, 15 nt, Human
ccuuucacaaccuuc

SEQ ID NO: 2413050 - RNA, 17 nt, Human
ccuuucaccccagggcc

SEQ ID NO: 2413051 - RNA, 21 nt, Human
ccuuucacaaaauuuuauucc

SEQ ID NO: 2413052 - RNA, 22 nt, Human
ccuuucacaaaauuuuauuccu

SEQ ID NO: 2413053 - RNA, 21 nt, Human
ccuuucaauaggaaaaacuga

SEQ ID NO: 2413054 - RNA, 18 nt, Human
ccuuuacucauagcacuu

SEQ ID NO: 2413055 - RNA, 15 nt, Human
ccuuuacuugaccuc

SEQ ID NO: 2413056 - RNA, 23 nt, Human
ccuuuacacauucggcucccugg

SEQ ID NO: 2413057 - RNA, 21 nt, Human
ccuuuacacauucggcucccu

SEQ ID NO: 2413058 - RNA, 19 nt, Human
ccuuuacacucaggcuuuc

SEQ ID NO: 2413059 - RNA, 13 nt, Human
ccuuuaaugcauc

SEQ ID NO: 2413060 - RNA, 19 nt, Human
ccuuuacggacacccccuc

SEQ ID NO: 2413061 - RNA, 14 nt, Human
ccuuuacggacacc

SEQ ID NO: 2413062 - RNA, 13 nt, Human
cgccuccaggcca

SEQ ID NO: 2413063 - RNA, 15 nt, Human
cgccucaguaagacg

SEQ ID NO: 2413064 - RNA, 19 nt, Human
cgccucaggaaugggcugu

SEQ ID NO: 2413065 - RNA, 17 nt, Human
cgccucaggaaugggcu

SEQ ID NO: 2413066 - RNA, 16 nt, Human
cgccuaugaucccagc

SEQ ID NO: 2413067 - RNA, 17 nt, Human
cgccucaaugugguugc

SEQ ID NO: 2413068 - RNA, 22 nt, Human
cgccucaaugugguugcaaggc

SEQ ID NO: 2413069 - RNA, 15 nt, Human
cgccagauggggccu

SEQ ID NO: 2413070 - RNA, 18 nt, Human
cgccagauggggccucug

SEQ ID NO: 2413071 - RNA, 20 nt, Human
cgccuaguggggucucccuc

SEQ ID NO: 2413072 - RNA, 21 nt, Human
cgccuaguggggucucccucu

SEQ ID NO: 2413073 - RNA, 21 nt, Human
cgccacuacacuccagccuga

SEQ ID NO: 2413074 - RNA, 19 nt, Human
cgccaaauaaugucucugu

SEQ ID NO: 2413075 - RNA, 20 nt, Human
cgcauucucauggagaaguu

SEQ ID NO: 2413076 - RNA, 14 nt, Human
cgcauucucaugga

SEQ ID NO: 2413077 - RNA, 17 nt, Human
cgccaaauaaugucucu

SEQ ID NO: 2413078 - RNA, 22 nt, Human
cgccacuacacuccagccugag

SEQ ID NO: 2413079 - RNA, 15 nt, Human
cgccacuccugaacc

SEQ ID NO: 2413080 - RNA, 21 nt, Human
cgccaacaacuucuccauccu

SEQ ID NO: 2413081 - RNA, 15 nt, Human
cgccacucgcuuccc

SEQ ID NO: 2413082 - RNA, 20 nt, Human
cgccacugcacuccggccug

SEQ ID NO: 2413083 - RNA, 23 nt, Human
cgccacucgcuucccccauagcc

SEQ ID NO: 2413084 - RNA, 21 nt, Human
cgccacugcacuccagccugg

SEQ ID NO: 2413085 - RNA, 22 nt, Human
cgccacugcacuccagccuggg

SEQ ID NO: 2413086 - RNA, 23 nt, Human
cgccacugcacuccagccugggc

SEQ ID NO: 2413087 - RNA, 19 nt, Human
cgccuggcugcagccugcg

SEQ ID NO: 2413088 - RNA, 11 nt, Human
cgccuggcaga

SEQ ID NO: 2413089 - RNA, 12 nt, Human
cgccuggccuga

SEQ ID NO: 2413090 - RNA, 20 nt, Human
cgccuggcagaacugagcuc

SEQ ID NO: 2413091 - RNA, 16 nt, Human
cgccugagcucacucg

SEQ ID NO: 2413092 - RNA, 20 nt, Human
cgccugaggaacccuuacag

SEQ ID NO: 2413093 - RNA, 18 nt, Human
cgccugcaaacgcugccu

SEQ ID NO: 2413094 - RNA, 23 nt, Human
cgccugacaaccacuggucugua

SEQ ID NO: 2413095 - RNA, 21 nt, Human
cgccugacaaccacuggucug

SEQ ID NO: 2413096 - RNA, 20 nt, Human
cgccugacaaccacuggucu

SEQ ID NO: 2413097 - RNA, 15 nt, Human
cgccucuuucaagca

SEQ ID NO: 2413098 - RNA, 13 nt, Human
cgccucugcauuc

SEQ ID NO: 2413099 - RNA, 13 nt, Human
cgccucugcuggc

SEQ ID NO: 2413100 - RNA, 19 nt, Human
cgccucuucuucuucagaa

SEQ ID NO: 2413101 - RNA, 14 nt, Human
cgccucccacuggg

SEQ ID NO: 2413102 - RNA, 18 nt, Human
cgccuccauccaaggcca

SEQ ID NO: 2413103 - RNA, 16 nt, Human
cgccuccauccaaggc

SEQ ID NO: 2413104 - RNA, 21 nt, Human
cgccuccauuuuuguuguuau

SEQ ID NO: 2413105 - RNA, 13 nt, Human
cgccucccacugg

SEQ ID NO: 2413106 - RNA, 15 nt, Human
cgauauacucuagau

SEQ ID NO: 2413107 - RNA, 18 nt, Human
cgaucacaacgugcauug

SEQ ID NO: 2413108 - RNA, 20 nt, Human
cgagucauucguucugugga

SEQ ID NO: 2413109 - RNA, 13 nt, Human
cgaguccaagcug

SEQ ID NO: 2413110 - RNA, 14 nt, Human
cgaguccaagcugg

SEQ ID NO: 2413111 - RNA, 15 nt, Human
cgaguccaagcuggg

SEQ ID NO: 2413112 - RNA, 14 nt, Human
cgauagugguggug

SEQ ID NO: 2413113 - RNA, 18 nt, Human
cgagucauucguucugug

SEQ ID NO: 2413114 - RNA, 19 nt, Human
cgagucauucguucugugg

SEQ ID NO: 2413115 - RNA, 22 nt, Human
cgagucacugccucucccuggc

SEQ ID NO: 2413116 - RNA, 15 nt, Human
cgagucacugccucu

SEQ ID NO: 2413117 - RNA, 18 nt, Human
cgagucacugccucuccc

SEQ ID NO: 2413118 - RNA, 21 nt, Human
cgaguauguguuugugugugu

SEQ ID NO: 2413119 - RNA, 13 nt, Human
cgaguauguguuu

SEQ ID NO: 2413120 - RNA, 20 nt, Human
cgagucaaaacucaaaugcu

SEQ ID NO: 2413121 - RNA, 16 nt, Human
cgagucaauccccuca

SEQ ID NO: 2413122 - RNA, 20 nt, Human
cgagucaauccccucauuca

SEQ ID NO: 2413123 - RNA, 12 nt, Human
cgagucacugcc

SEQ ID NO: 2413124 - RNA, 14 nt, Human
cgagucacugccuc

SEQ ID NO: 2413125 - RNA, 13 nt, Human
cgcaggcuggccc

SEQ ID NO: 2413126 - RNA, 18 nt, Human
cgcaggcgggaaaagcag

SEQ ID NO: 2413127 - RNA, 18 nt, Human
cgcaugcccccucgugcc

SEQ ID NO: 2413128 - RNA, 16 nt, Human
cgcaugcccccucgug

SEQ ID NO: 2413129 - RNA, 14 nt, Human
cgcaugcccccucg

SEQ ID NO: 2413130 - RNA, 13 nt, Human
cgcaugcccccuc

SEQ ID NO: 2413131 - RNA, 21 nt, Human
cgcaugcccccucgugccagu

SEQ ID NO: 2413132 - RNA, 20 nt, Human
cgcaugcccccucgugccag

SEQ ID NO: 2413133 - RNA, 22 nt, Human
cgcaugcccccucgugccaguc

SEQ ID NO: 2413134 - RNA, 15 nt, Human
cgcaugcccucaauc

SEQ ID NO: 2413135 - RNA, 16 nt, Human
cgcauggucacacacu

SEQ ID NO: 2413136 - RNA, 18 nt, Human
cgcauggaguguguauug

SEQ ID NO: 2413137 - RNA, 22 nt, Human
cgcauggaguguguauuguucc

SEQ ID NO: 2413138 - RNA, 16 nt, Human
cgcaugcggcccagga

SEQ ID NO: 2413139 - RNA, 14 nt, Human
cgcaugcggcccag

SEQ ID NO: 2413140 - RNA, 19 nt, Human
cgcauggucacacacugau

SEQ ID NO: 2413141 - RNA, 12 nt, Human
cgcauucccuga

SEQ ID NO: 2413142 - RNA, 13 nt, Human
cgcauucucaugg

SEQ ID NO: 2413143 - RNA, 23 nt, Human
cgcauggaguguguauuguuccc

SEQ ID NO: 2413144 - RNA, 13 nt, Human
cgcauucccugag

SEQ ID NO: 2413145 - RNA, 18 nt, Human
cgcaggcccccaggugcc

SEQ ID NO: 2413146 - RNA, 22 nt, Human
cgcaggauucuuccucccuccc

SEQ ID NO: 2413147 - RNA, 23 nt, Human
cgaucacaacgugcauugugcuu

SEQ ID NO: 2413148 - RNA, 22 nt, Human
cgaucacaacgugcauugugcu

SEQ ID NO: 2413149 - RNA, 15 nt, Human
cgauccaccugucuc

SEQ ID NO: 2413150 - RNA, 24 nt, Human
cgaucacaacgugcauugugcuuc

SEQ ID NO: 2413151 - RNA, 13 nt, Human
cgcaggaagcugc

SEQ ID NO: 2413152 - RNA, 15 nt, Human
cgcaggaagcugcuc

SEQ ID NO: 2413153 - RNA, 13 nt, Human
cuacucagaagcc

SEQ ID NO: 2413154 - RNA, 16 nt, Human
cuacucagaagccuga

SEQ ID NO: 2413155 - RNA, 17 nt, Human
cuacucagaagccugag

SEQ ID NO: 2413156 - RNA, 19 nt, Human
cuacucagaagccugaggc

SEQ ID NO: 2413157 - RNA, 21 nt, Human
cuacucagaagccugaggcug

SEQ ID NO: 2413158 - RNA, 19 nt, Human
cuacguuccuauugucauu

SEQ ID NO: 2413159 - RNA, 16 nt, Human
cuacguuaagggaagg

SEQ ID NO: 2413160 - RNA, 18 nt, Human
cuacgugugauuuuucug

SEQ ID NO: 2413161 - RNA, 14 nt, Human
cuacgugugauuuu

SEQ ID NO: 2413162 - RNA, 17 nt, Human
cuacguuaccaggcagg

SEQ ID NO: 2413163 - RNA, 17 nt, Human
cuacguacaugugaggc

SEQ ID NO: 2413164 - RNA, 13 nt, Human
cuacgugugauuu

SEQ ID NO: 2413165 - RNA, 22 nt, Human
cuacgcugaagauggcauccug

SEQ ID NO: 2413166 - RNA, 13 nt, Human
cuacgccugccuc

SEQ ID NO: 2413167 - RNA, 21 nt, Human
cuacgcucuccuuucuuucua

SEQ ID NO: 2413168 - RNA, 17 nt, Human
cuaccuuuguauucucu

SEQ ID NO: 2413169 - RNA, 15 nt, Human
cuacgccaaucaagg

SEQ ID NO: 2413170 - RNA, 14 nt, Human
cuacgccugcaugu

SEQ ID NO: 2413171 - RNA, 14 nt, Human
cuacgcucuccuuu

SEQ ID NO: 2413172 - RNA, 20 nt, Human
cuaccuguucagugucccgg

SEQ ID NO: 2413173 - RNA, 16 nt, Human
cuaccuguucaguguc

SEQ ID NO: 2413174 - RNA, 22 nt, Human
cuaccuguucagugucccgggc

SEQ ID NO: 2413175 - RNA, 21 nt, Human
cuaccuguucagugucccggg

SEQ ID NO: 2413176 - RNA, 19 nt, Human
cuaccuuaaaauguaaaac

SEQ ID NO: 2413177 - RNA, 15 nt, Human
cuaccugcucuccaa

SEQ ID NO: 2413178 - RNA, 13 nt, Human
cuaccugugccug

SEQ ID NO: 2413179 - RNA, 12 nt, Human
cuaccugugccu

SEQ ID NO: 2413180 - RNA, 20 nt, Human
cuacaugagguacugagagu

SEQ ID NO: 2413181 - RNA, 18 nt, Human
cuacaugagguacugaga

SEQ ID NO: 2413182 - RNA, 15 nt, Human
cuacaucuucugccu

SEQ ID NO: 2413183 - RNA, 14 nt, Human
cuacaucuucugcc

SEQ ID NO: 2413184 - RNA, 16 nt, Human
cuacaucuucugccuu

SEQ ID NO: 2413185 - RNA, 10 nt, Human
cuacaugaaa

SEQ ID NO: 2413186 - RNA, 23 nt, Human
cuacauacuuucauccugacucu

SEQ ID NO: 2413187 - RNA, 15 nt, Human
cuacaucgcccucca

SEQ ID NO: 2413188 - RNA, 17 nt, Human
cuacaucgcccuccaca

SEQ ID NO: 2413189 - RNA, 16 nt, Human
cuaccugccacucaca

SEQ ID NO: 2413190 - RNA, 15 nt, Human
cuaccugccacucac

SEQ ID NO: 2413191 - RNA, 14 nt, Human
cuaccugccacuca

SEQ ID NO: 2413192 - RNA, 22 nt, Human
cuaccugccacucacacagcca

SEQ ID NO: 2413193 - RNA, 19 nt, Human
cuaccugccacucacacag

SEQ ID NO: 2413194 - RNA, 12 nt, Human
cuaccugcucuc

SEQ ID NO: 2413195 - RNA, 19 nt, Human
cuaccugcucuccaagucu

SEQ ID NO: 2413196 - RNA, 16 nt, Human
cuaccuggucucuccu

SEQ ID NO: 2413197 - RNA, 13 nt, Human
cuacaugaaacag

SEQ ID NO: 2413198 - RNA, 22 nt, Human
cuacaugaucuagagccaguua

SEQ ID NO: 2413199 - RNA, 18 nt, Human
cuacaucuuuuuucacaa

SEQ ID NO: 2413200 - RNA, 14 nt, Human
cuacaugcagccca

SEQ ID NO: 2413201 - RNA, 15 nt, Human
cuacaugcagcccau

SEQ ID NO: 2413202 - RNA, 17 nt, Human
cuacaugcagcccaugc

SEQ ID NO: 2413203 - RNA, 21 nt, Human
cuacaugcagcccaugcccac

SEQ ID NO: 2413204 - RNA, 23 nt, Human
cuacaugcagcccaugcccaccu

SEQ ID NO: 2413205 - RNA, 16 nt, Human
cuacagugguuuuaua

SEQ ID NO: 2413206 - RNA, 14 nt, Human
cuacagugguuuua

SEQ ID NO: 2413207 - RNA, 15 nt, Human
cuaauuucuccuccc

SEQ ID NO: 2413208 - RNA, 14 nt, Human
cuaauuucuccucc

SEQ ID NO: 2413209 - RNA, 20 nt, Human
cuacaguccucccaucucac

SEQ ID NO: 2413210 - RNA, 19 nt, Human
cuacaguugaaaaacagcu

SEQ ID NO: 2413211 - RNA, 21 nt, Human
cuacaguugaaaaacagcuga

SEQ ID NO: 2413212 - RNA, 18 nt, Human
cuacauacuauggaauuu

SEQ ID NO: 2413213 - RNA, 22 nt, Human
cuacaguuggaaauccauccag

SEQ ID NO: 2413214 - RNA, 21 nt, Human
cuacaguuggaaauccaucca

SEQ ID NO: 2413215 - RNA, 20 nt, Human
cuacaguuguuuuuugaaaa

SEQ ID NO: 2413216 - RNA, 22 nt, Human
cuacaguuguuuuuugaaaaca

SEQ ID NO: 2413217 - RNA, 22 nt, Human
cuacaguugaaaaacagcugag

SEQ ID NO: 2413218 - RNA, 20 nt, Human
cuacaguuggaaauccaucc

SEQ ID NO: 2413219 - RNA, 21 nt, Human
cuacagugguuuuauacugaa

SEQ ID NO: 2413220 - RNA, 13 nt, Human
cuacaguguacag

SEQ ID NO: 2413221 - RNA, 16 nt, Human
cuacaaaaacacagca

SEQ ID NO: 2413222 - RNA, 17 nt, Human
cuacaaaaacacagcaa

SEQ ID NO: 2413223 - RNA, 18 nt, Human
cuacaaaaacacagcaag

SEQ ID NO: 2413224 - RNA, 19 nt, Human
cuacaguccucccaucuca

SEQ ID NO: 2413225 - RNA, 15 nt, Human
cuacaaaaacacagc

SEQ ID NO: 2413226 - RNA, 18 nt, Human
cuaauuucaaaaugcuuu

SEQ ID NO: 2413227 - RNA, 19 nt, Human
cuaauuucaaaaugcuuuu

SEQ ID NO: 2413228 - RNA, 22 nt, Human
cuaauuucaaaaugcuuuuuau

SEQ ID NO: 2413229 - RNA, 14 nt, Human
cuaauuuauuuugu

SEQ ID NO: 2413230 - RNA, 21 nt, Human
cuaauuucaaaaauauaacuu

SEQ ID NO: 2413231 - RNA, 19 nt, Human
cuaauuucaaaaauauaac

SEQ ID NO: 2413232 - RNA, 17 nt, Human
cuaauuucaaaaugcuu

SEQ ID NO: 2413233 - RNA, 23 nt, Human
cuaauuuauccugaaauuucaga

SEQ ID NO: 2413234 - RNA, 21 nt, Human
cuaauuuaucuugucucuggg

SEQ ID NO: 2413235 - RNA, 21 nt, Human
cuaauuuauccugaaauuuca

SEQ ID NO: 2413236 - RNA, 20 nt, Human
cuaaguaaaaccacagcagu

SEQ ID NO: 2413237 - RNA, 11 nt, Human
cgugugugugu

SEQ ID NO: 2413238 - RNA, 23 nt, Human
cguguguggguggauauaaauau

SEQ ID NO: 2413239 - RNA, 22 nt, Human
cguguguggguggauauaaaua

SEQ ID NO: 2413240 - RNA, 12 nt, Human
cgugugugugcg

SEQ ID NO: 2413241 - RNA, 22 nt, Human
cguguguagaguuaagaagcug

SEQ ID NO: 2413242 - RNA, 15 nt, Human
cguguguagaguuaa

SEQ ID NO: 2413243 - RNA, 12 nt, Human
cguguguagagu

SEQ ID NO: 2413244 - RNA, 19 nt, Human
cguguguacacgggacuga

SEQ ID NO: 2413245 - RNA, 22 nt, Human
cguguggcaauagugggcccuc

SEQ ID NO: 2413246 - RNA, 20 nt, Human
cguguggcucacguguguga

SEQ ID NO: 2413247 - RNA, 18 nt, Human
cguguguagaguuaagaa

SEQ ID NO: 2413248 - RNA, 17 nt, Human
cguguguccaugugugu

SEQ ID NO: 2413249 - RNA, 21 nt, Human
cguguguggguggauauaaau

SEQ ID NO: 2413250 - RNA, 22 nt, Human
cgugugugcaagugucugugug

SEQ ID NO: 2413251 - RNA, 22 nt, Human
cuaaguaaaaccacagcaguug

SEQ ID NO: 2413252 - RNA, 23 nt, Human
cuaaguaaaaccacagcaguuga

SEQ ID NO: 2413253 - RNA, 23 nt, Human
cuaagugauccucccaccucagc

SEQ ID NO: 2413254 - RNA, 20 nt, Human
cuaaguuuuuauggcuuuug

SEQ ID NO: 2413255 - RNA, 14 nt, Human
cuaagugugaacug

SEQ ID NO: 2413256 - RNA, 21 nt, Human
cuaagugguacuaacuuuccu

SEQ ID NO: 2413257 - RNA, 16 nt, Human
cuaaguuauaguauau

SEQ ID NO: 2413258 - RNA, 20 nt, Human
cuaaguuauaguauaucugg

SEQ ID NO: 2413259 - RNA, 23 nt, Human
cuaaguuuuuauggcuuuugugc

SEQ ID NO: 2413260 - RNA, 21 nt, Human
cuaauucuuugaccuguuggg

SEQ ID NO: 2413261 - RNA, 22 nt, Human
cuaauucuuugaccuguuggga

SEQ ID NO: 2413262 - RNA, 21 nt, Human
cuagcauacguacacauuuua

SEQ ID NO: 2413263 - RNA, 23 nt, Human
cuagcauacguacacauuuuauu

SEQ ID NO: 2413264 - RNA, 13 nt, Human
cuagcaucccuga

SEQ ID NO: 2413265 - RNA, 21 nt, Human
cuagcauaugaguuucauagc

SEQ ID NO: 2413266 - RNA, 18 nt, Human
cuagcauaucugccuuua

SEQ ID NO: 2413267 - RNA, 17 nt, Human
cuagcauaucugccuuu

SEQ ID NO: 2413268 - RNA, 15 nt, Human
cuagcauaucugccu

SEQ ID NO: 2413269 - RNA, 14 nt, Human
cuagcauaucugcc

SEQ ID NO: 2413270 - RNA, 21 nt, Human
cuagaauuugauuauuaacau

SEQ ID NO: 2413271 - RNA, 19 nt, Human
cuagaauuuuaagugcuuu

SEQ ID NO: 2413272 - RNA, 13 nt, Human
cuagacaacccug

SEQ ID NO: 2413273 - RNA, 15 nt, Human
cuagacaacccugca

SEQ ID NO: 2413274 - RNA, 16 nt, Human
cuagacaacccugcaa

SEQ ID NO: 2413275 - RNA, 14 nt, Human
cuagaauuucuuua

SEQ ID NO: 2413276 - RNA, 15 nt, Human
cuagaauuuauucaa

SEQ ID NO: 2413277 - RNA, 23 nt, Human
cuagaauuuauucaauuccucug

SEQ ID NO: 2413278 - RNA, 22 nt, Human
cuagaauuuauucaauuccucu

SEQ ID NO: 2413279 - RNA, 19 nt, Human
cuagaagugggccaggaca

SEQ ID NO: 2413280 - RNA, 20 nt, Human
cuagaagugggccaggacag

SEQ ID NO: 2413281 - RNA, 15 nt, Human
cuagaaguuacugaa

SEQ ID NO: 2413282 - RNA, 21 nt, Human
cuagaagugggccaggacagg

SEQ ID NO: 2413283 - RNA, 19 nt, Human
cuagaaggccacaugucac

SEQ ID NO: 2413284 - RNA, 14 nt, Human
cuagaaggccacau

SEQ ID NO: 2413285 - RNA, 13 nt, Human
cuagaaggccaca

SEQ ID NO: 2413286 - RNA, 21 nt, Human
cuagaagccaagggaaagggg

SEQ ID NO: 2413287 - RNA, 20 nt, Human
cuagaagccaagggaaaggg

SEQ ID NO: 2413288 - RNA, 16 nt, Human
cuagaagccaagggaa

SEQ ID NO: 2413289 - RNA, 13 nt, Human
cuagaagccaagg

SEQ ID NO: 2413290 - RNA, 12 nt, Human
cuagaagccaag

SEQ ID NO: 2413291 - RNA, 22 nt, Human
cuagaagggcuagaaccuggag

SEQ ID NO: 2413292 - RNA, 21 nt, Human
cuagaagggcuagaaccugga

SEQ ID NO: 2413293 - RNA, 17 nt, Human
cuagaagugggccagga

SEQ ID NO: 2413294 - RNA, 20 nt, Human
cuagaagggccaguccugcc

SEQ ID NO: 2413295 - RNA, 23 nt, Human
cuagaagggccaguccugccugg

SEQ ID NO: 2413296 - RNA, 21 nt, Human
cuagaagaugaauacaaacaa

SEQ ID NO: 2413297 - RNA, 18 nt, Human
cuagaaccuggagggcug

SEQ ID NO: 2413298 - RNA, 16 nt, Human
cuagaaccuggagggc

SEQ ID NO: 2413299 - RNA, 14 nt, Human
cuagaaccuggagg

SEQ ID NO: 2413300 - RNA, 15 nt, Human
cuagaaccuggagag

SEQ ID NO: 2413301 - RNA, 14 nt, Human
cuagaaccuggaga

SEQ ID NO: 2413302 - RNA, 18 nt, Human
cuagaaccuggaagggcu

SEQ ID NO: 2413303 - RNA, 18 nt, Human
cuagaaccuagaagggcu

SEQ ID NO: 2413304 - RNA, 22 nt, Human
cuagaagauuuugaaauuuuua

SEQ ID NO: 2413305 - RNA, 12 nt, Human
cuagaacucccu

SEQ ID NO: 2413306 - RNA, 13 nt, Human
cuagaacucccuu

SEQ ID NO: 2413307 - RNA, 17 nt, Human
cuagaaccuagaagggc

SEQ ID NO: 2413308 - RNA, 18 nt, Human
cuagaacaucccugccag

SEQ ID NO: 2413309 - RNA, 15 nt, Human
cuacucagcagcccu

SEQ ID NO: 2413310 - RNA, 16 nt, Human
cuacucagcagcccuc

SEQ ID NO: 2413311 - RNA, 17 nt, Human
cuacucagcagcccucc

SEQ ID NO: 2413312 - RNA, 18 nt, Human
cuacucagcagcccuccu

SEQ ID NO: 2413313 - RNA, 19 nt, Human
cuacucagcagcccuccuc

SEQ ID NO: 2413314 - RNA, 20 nt, Human
cuacucagcagcccuccuca

SEQ ID NO: 2413315 - RNA, 21 nt, Human
cuacucagcagcccuccucac

SEQ ID NO: 2413316 - RNA, 22 nt, Human
cuacucagcagcccuccucacc

SEQ ID NO: 2413317 - RNA, 13 nt, Human
cuacucaggaggc

SEQ ID NO: 2413318 - RNA, 15 nt, Human
cuacucaggaggcug

SEQ ID NO: 2413319 - RNA, 16 nt, Human
cuacucaggaggcuga

SEQ ID NO: 2413320 - RNA, 23 nt, Human
cuacucaggaggcugaggcagaa

SEQ ID NO: 2413321 - RNA, 14 nt, Human
cuaucauuaaaguu

SEQ ID NO: 2413322 - RNA, 13 nt, Human
cuaucauuaaagu

SEQ ID NO: 2413323 - RNA, 16 nt, Human
cuaucauuaaaguucu

SEQ ID NO: 2413324 - RNA, 15 nt, Human
cuaucauuaaaguuc

SEQ ID NO: 2413325 - RNA, 17 nt, Human
cuaucauuaaaguucua

SEQ ID NO: 2413326 - RNA, 18 nt, Human
cuaucaugucaaacguga

SEQ ID NO: 2413327 - RNA, 23 nt, Human
cuaucauuuuuguacaguuugcu

SEQ ID NO: 2413328 - RNA, 18 nt, Human
cuaucauuuuuguacagu

SEQ ID NO: 2413329 - RNA, 17 nt, Human
cuaucauuuuuguacag

SEQ ID NO: 2413330 - RNA, 16 nt, Human
cuaucauuuuuguaca

SEQ ID NO: 2413331 - RNA, 15 nt, Human
cuaucauuuuuguac

SEQ ID NO: 2413332 - RNA, 21 nt, Human
cuaucauuuaauaauauacuu

SEQ ID NO: 2413333 - RNA, 17 nt, Human
cuaucauuuaauaauau

SEQ ID NO: 2413334 - RNA, 15 nt, Human
cuaucauuuaauaau

SEQ ID NO: 2413335 - RNA, 13 nt, Human
cuaucauuuaaua

SEQ ID NO: 2413336 - RNA, 23 nt, Human
cuauccacagagagucccacugc

SEQ ID NO: 2413337 - RNA, 19 nt, Human
cuauccacagagaguccca

SEQ ID NO: 2413338 - RNA, 17 nt, Human
cuauccacagagagucc

SEQ ID NO: 2413339 - RNA, 15 nt, Human
cuauccacagagagu

SEQ ID NO: 2413340 - RNA, 13 nt, Human
cuauccacagaga

SEQ ID NO: 2413341 - RNA, 22 nt, Human
cuaucauuuuuguacaguuugc

SEQ ID NO: 2413342 - RNA, 18 nt, Human
cuaucguaaaauuaagaa

SEQ ID NO: 2413343 - RNA, 17 nt, Human
cuaucuaacccucccau

SEQ ID NO: 2413344 - RNA, 17 nt, Human
cuaucguaaaauuaaga

SEQ ID NO: 2413345 - RNA, 14 nt, Human
cuaucuaaauguug

SEQ ID NO: 2413346 - RNA, 15 nt, Human
cuaucucccccagcc

SEQ ID NO: 2413347 - RNA, 16 nt, Human
cuaucuaacccuccca

SEQ ID NO: 2413348 - RNA, 15 nt, Human
cuaucuacucuccuc

SEQ ID NO: 2413349 - RNA, 16 nt, Human
cuaucuacucuccuca

SEQ ID NO: 2413350 - RNA, 17 nt, Human
cuaucuacucuccucau

SEQ ID NO: 2413351 - RNA, 22 nt, Human
cuaguuuucaguuuguauauac

SEQ ID NO: 2413352 - RNA, 18 nt, Human
cuaguuuucuccucccag

SEQ ID NO: 2413353 - RNA, 19 nt, Human
cuaguuuucuccucccagg

SEQ ID NO: 2413354 - RNA, 20 nt, Human
cuaguuuucaguuuguauau

SEQ ID NO: 2413355 - RNA, 19 nt, Human
cuaguuuucaguuuguaua

SEQ ID NO: 2413356 - RNA, 23 nt, Human
cuaguuuuaaaaaaauaaaacau

SEQ ID NO: 2413357 - RNA, 16 nt, Human
cuaguuuucuccuccc

SEQ ID NO: 2413358 - RNA, 17 nt, Human
cuaguuuucuccuccca

SEQ ID NO: 2413359 - RNA, 22 nt, Human
cuaguuugauuaaauucuugca

SEQ ID NO: 2413360 - RNA, 13 nt, Human
cuaguuugcauuc

SEQ ID NO: 2413361 - RNA, 21 nt, Human
cuaguuugauuaaauucuugc

SEQ ID NO: 2413362 - RNA, 23 nt, Human
cuaguuguuugauucagacagcu

SEQ ID NO: 2413363 - RNA, 22 nt, Human
cuaguuguuugauucagacagc

SEQ ID NO: 2413364 - RNA, 13 nt, Human
cuaguuugauuaa

SEQ ID NO: 2413365 - RNA, 23 nt, Human
cuagccagacacucugcucugcc

SEQ ID NO: 2413366 - RNA, 22 nt, Human
cuagccagacacucugcucugc

SEQ ID NO: 2413367 - RNA, 19 nt, Human
cuagccagacacucugcuc

SEQ ID NO: 2413368 - RNA, 15 nt, Human
cuagccagacacucu

SEQ ID NO: 2413369 - RNA, 15 nt, Human
cuagccagaggagag

SEQ ID NO: 2413370 - RNA, 13 nt, Human
cuagccagaggag

SEQ ID NO: 2413371 - RNA, 12 nt, Human
cuagccagagga

SEQ ID NO: 2413372 - RNA, 19 nt, Human
cuagccaccgccuccuaca

SEQ ID NO: 2413373 - RNA, 16 nt, Human
cuagcaucucaugagu

SEQ ID NO: 2413374 - RNA, 17 nt, Human
cuaucucccccagcccc

SEQ ID NO: 2413375 - RNA, 16 nt, Human
cuaucucccccagccc

SEQ ID NO: 2413376 - RNA, 15 nt, Human
cuauuaaaggaauaa

SEQ ID NO: 2413377 - RNA, 18 nt, Human
cuaucucccccagcccca

SEQ ID NO: 2413378 - RNA, 23 nt, Human
cuauuaagauuuccaagugccaa

SEQ ID NO: 2413379 - RNA, 19 nt, Human
cuauuaaggugauauauuu

SEQ ID NO: 2413380 - RNA, 23 nt, Human
cuauuaaggugauauauuuaaaa

SEQ ID NO: 2413381 - RNA, 21 nt, Human
cuauuaaggugauauauuuaa

SEQ ID NO: 2413382 - RNA, 23 nt, Human
cuauuaagaggcagaaaauugca

SEQ ID NO: 2413383 - RNA, 17 nt, Human
cuauuaagauuuccaag

SEQ ID NO: 2413384 - RNA, 16 nt, Human
cuauuaagauuuccaa

SEQ ID NO: 2413385 - RNA, 12 nt, Human
cuauuuuuguag

SEQ ID NO: 2413386 - RNA, 13 nt, Human
cuauuuuuguaga

SEQ ID NO: 2413387 - RNA, 14 nt, Human
cuauuuuuguagaa

SEQ ID NO: 2413388 - RNA, 22 nt, Human
cuauuuuugucuuauauauauu

SEQ ID NO: 2413389 - RNA, 18 nt, Human
cuauuuuuuauuuuacuu

SEQ ID NO: 2413390 - RNA, 15 nt, Human
cuauuuuuguagaag

SEQ ID NO: 2413391 - RNA, 23 nt, Human
cucaaaauaccaugccauuuaaa

SEQ ID NO: 2413392 - RNA, 18 nt, Human
cucaaaagcugggcaggu

SEQ ID NO: 2413393 - RNA, 17 nt, Human
cucaaaaaaagaaaaag

SEQ ID NO: 2413394 - RNA, 21 nt, Human
cucaaaaaaaaaaaaaugcac

SEQ ID NO: 2413395 - RNA, 21 nt, Human
cuauuuuuuuucuguuauaua

SEQ ID NO: 2413396 - RNA, 20 nt, Human
cuauuuuuuuucuguuauau

SEQ ID NO: 2413397 - RNA, 16 nt, Human
cucaaacacugcaggc

SEQ ID NO: 2413398 - RNA, 14 nt, Human
cucaaacacugcag

SEQ ID NO: 2413399 - RNA, 18 nt, Human
cucaaaccaaaucacuga

SEQ ID NO: 2413400 - RNA, 19 nt, Human
cucaaaccaaaucacugaa

SEQ ID NO: 2413401 - RNA, 22 nt, Human
cucaaaccaaaucacugaacuu

SEQ ID NO: 2413402 - RNA, 13 nt, Human
cucaaacacugca

SEQ ID NO: 2413403 - RNA, 12 nt, Human
cucaaacacugc

SEQ ID NO: 2413404 - RNA, 21 nt, Human
cucaaacacaguuacacuugu

SEQ ID NO: 2413405 - RNA, 15 nt, Human
cucaaacacaguuac

SEQ ID NO: 2413406 - RNA, 16 nt, Human
cucaaacaacacuggu

SEQ ID NO: 2413407 - RNA, 17 nt, Human
cucaaacaacacuggug

SEQ ID NO: 2413408 - RNA, 18 nt, Human
cucaaaauauuuguacau

SEQ ID NO: 2413409 - RNA, 16 nt, Human
cucaaaaugacagcca

SEQ ID NO: 2413410 - RNA, 20 nt, Human
cucaaaacuuaacauauuua

SEQ ID NO: 2413411 - RNA, 16 nt, Human
cucaaaacuuaacaua

SEQ ID NO: 2413412 - RNA, 20 nt, Human
cuauuuuuuauuuuacuuuu

SEQ ID NO: 2413413 - RNA, 13 nt, Human
cucaaaauauuug

SEQ ID NO: 2413414 - RNA, 20 nt, Human
cucaaaagcacccuugacgu

SEQ ID NO: 2413415 - RNA, 22 nt, Human
cucacaaaccaugcaaaugcua

SEQ ID NO: 2413416 - RNA, 11 nt, Human
cucacaaaaga

SEQ ID NO: 2413417 - RNA, 23 nt, Human
cucaauuuuaucccucaccugua

SEQ ID NO: 2413418 - RNA, 12 nt, Human
cucaauuuuugg

SEQ ID NO: 2413419 - RNA, 21 nt, Human
cucaauuuuugguugaauaaa

SEQ ID NO: 2413420 - RNA, 14 nt, Human
cucaauucuucccu

SEQ ID NO: 2413421 - RNA, 19 nt, Human
cucaauucuucccuaucuu

SEQ ID NO: 2413422 - RNA, 16 nt, Human
cucaauuucuccccag

SEQ ID NO: 2413423 - RNA, 15 nt, Human
cucaauuucucccca

SEQ ID NO: 2413424 - RNA, 13 nt, Human
cucaauuucuccc

SEQ ID NO: 2413425 - RNA, 15 nt, Human
cucaaugcacugaca

SEQ ID NO: 2413426 - RNA, 13 nt, Human
cucaaugcacuga

SEQ ID NO: 2413427 - RNA, 13 nt, Human
cucaauggacugg

SEQ ID NO: 2413428 - RNA, 15 nt, Human
cucaaugcucauaac

SEQ ID NO: 2413429 - RNA, 16 nt, Human
cucaaugcagccagac

SEQ ID NO: 2413430 - RNA, 13 nt, Human
cucaaugcucaua

SEQ ID NO: 2413431 - RNA, 12 nt, Human
cucaaugcucau

SEQ ID NO: 2413432 - RNA, 12 nt, Human
cucaaugagcuc

SEQ ID NO: 2413433 - RNA, 16 nt, Human
cucaaugagcucuucc

SEQ ID NO: 2413434 - RNA, 13 nt, Human
cucaaacguggcu

SEQ ID NO: 2413435 - RNA, 21 nt, Human
cucaaaccuguuuaaauauuu

SEQ ID NO: 2413436 - RNA, 18 nt, Human
cucaaaccuguuuaaaua

SEQ ID NO: 2413437 - RNA, 15 nt, Human
cucaaacguggcuuu

SEQ ID NO: 2413438 - RNA, 15 nt, Human
cucaaaccuguuuaa

SEQ ID NO: 2413439 - RNA, 15 nt, Human
cucaaaccuccucuu

SEQ ID NO: 2413440 - RNA, 14 nt, Human
cucaaaccuccucu

SEQ ID NO: 2413441 - RNA, 18 nt, Human
cucaaacacugcaggcau

SEQ ID NO: 2413442 - RNA, 13 nt, Human
cucaaaccuccuc

SEQ ID NO: 2413443 - RNA, 20 nt, Human
cucaaacucuugaccucagg

SEQ ID NO: 2413444 - RNA, 13 nt, Human
cucaaacuccuga

SEQ ID NO: 2413445 - RNA, 14 nt, Human
cucaaacuccugac

SEQ ID NO: 2413446 - RNA, 14 nt, Human
cucaauaagccuug

SEQ ID NO: 2413447 - RNA, 16 nt, Human
cucaauaaaugauucu

SEQ ID NO: 2413448 - RNA, 14 nt, Human
cucaauaaaguaca

SEQ ID NO: 2413449 - RNA, 15 nt, Human
cucaauaagccuugu

SEQ ID NO: 2413450 - RNA, 16 nt, Human
cucaauauuccugaau

SEQ ID NO: 2413451 - RNA, 15 nt, Human
cucaauaugcuuaca

SEQ ID NO: 2413452 - RNA, 18 nt, Human
cucaauauuccugaauga

SEQ ID NO: 2413453 - RNA, 11 nt, Human
cucaauauuuu

SEQ ID NO: 2413454 - RNA, 13 nt, Human
cucccccaucucu

SEQ ID NO: 2413455 - RNA, 17 nt, Human
cucccccauccuccccu

SEQ ID NO: 2413456 - RNA, 13 nt, Human
cuccccccacugc

SEQ ID NO: 2413457 - RNA, 14 nt, Human
cuccccccacugca

SEQ ID NO: 2413458 - RNA, 13 nt, Human
cucccccccaugc

SEQ ID NO: 2413459 - RNA, 15 nt, Human
cuccccccacugcag

SEQ ID NO: 2413460 - RNA, 16 nt, Human
cuccccccacugcagg

SEQ ID NO: 2413461 - RNA, 22 nt, Human
cucccccagccccauccucugu

SEQ ID NO: 2413462 - RNA, 15 nt, Human
cucccccauccuccc

SEQ ID NO: 2413463 - RNA, 12 nt, Human
cucccccauccu

SEQ ID NO: 2413464 - RNA, 11 nt, Human
cucccccaucc

SEQ ID NO: 2413465 - RNA, 20 nt, Human
cucccccagccccauccucu

SEQ ID NO: 2413466 - RNA, 15 nt, Human
cucccccagccccau

SEQ ID NO: 2413467 - RNA, 21 nt, Human
cucccccaacccccaccccac

SEQ ID NO: 2413468 - RNA, 23 nt, Human
cucccccaacccccaccccacac

SEQ ID NO: 2413469 - RNA, 14 nt, Human
cucccccacccccu

SEQ ID NO: 2413470 - RNA, 19 nt, Human
cucccccacccccucccca

SEQ ID NO: 2413471 - RNA, 23 nt, Human
cuccucuucaacugaccagccuc

SEQ ID NO: 2413472 - RNA, 18 nt, Human
cuccucuucaacugacca

SEQ ID NO: 2413473 - RNA, 23 nt, Human
cuccucugugaccaaugucuuga

SEQ ID NO: 2413474 - RNA, 22 nt, Human
cuccucugugaccaaugucuug

SEQ ID NO: 2413475 - RNA, 19 nt, Human
cuccucuuaaaaaauaaaa

SEQ ID NO: 2413476 - RNA, 20 nt, Human
cuccucuuaaaaaauaaaaa

SEQ ID NO: 2413477 - RNA, 10 nt, Human
cuccuggagg

SEQ ID NO: 2413478 - RNA, 12 nt, Human
cuccuggagccu

SEQ ID NO: 2413479 - RNA, 22 nt, Human
cuccuggacugccuugaauauc

SEQ ID NO: 2413480 - RNA, 14 nt, Human
cuccuggacugccu

SEQ ID NO: 2413481 - RNA, 12 nt, Human
cuccuggacucc

SEQ ID NO: 2413482 - RNA, 15 nt, Human
cuccuggacuccugc

SEQ ID NO: 2413483 - RNA, 21 nt, Human
cuccucuuaaaaaauaaaaac

SEQ ID NO: 2413484 - RNA, 23 nt, Human
cuccucuuaaaaaauaaaaacug

SEQ ID NO: 2413485 - RNA, 13 nt, Human
cuccucugugacc

SEQ ID NO: 2413486 - RNA, 12 nt, Human
cuccucugugaa

SEQ ID NO: 2413487 - RNA, 18 nt, Human
cuccucugugaagcauuc

SEQ ID NO: 2413488 - RNA, 16 nt, Human
cuccucugucugcccu

SEQ ID NO: 2413489 - RNA, 20 nt, Human
cuccucuccuggaggauugc

SEQ ID NO: 2413490 - RNA, 12 nt, Human
cuccucucugcc

SEQ ID NO: 2413491 - RNA, 16 nt, Human
cuccuggcccacugca

SEQ ID NO: 2413492 - RNA, 18 nt, Human
cuccuggcccacugcauc

SEQ ID NO: 2413493 - RNA, 19 nt, Human
cuccuggagccuuugaaua

SEQ ID NO: 2413494 - RNA, 16 nt, Human
cuccugggaucugcuc

SEQ ID NO: 2413495 - RNA, 15 nt, Human
cuccugggaucugcu

SEQ ID NO: 2413496 - RNA, 17 nt, Human
cuccugggaucugcucg

SEQ ID NO: 2413497 - RNA, 22 nt, Human
cuccugggccccucaucugcuc

SEQ ID NO: 2413498 - RNA, 12 nt, Human
cuccuacagccc

SEQ ID NO: 2413499 - RNA, 16 nt, Human
cuccuacaccuaacuc

SEQ ID NO: 2413500 - RNA, 20 nt, Human
cuccuacccaccgcccuugc

SEQ ID NO: 2413501 - RNA, 12 nt, Human
cuccuaagagag

SEQ ID NO: 2413502 - RNA, 16 nt, Human
cuccucuccuggagga

SEQ ID NO: 2413503 - RNA, 15 nt, Human
cuccucuccuggagg

SEQ ID NO: 2413504 - RNA, 14 nt, Human
cuccucuccuggag

SEQ ID NO: 2413505 - RNA, 13 nt, Human
cuccucuccugga

SEQ ID NO: 2413506 - RNA, 13 nt, Human
cuccucucugccc

SEQ ID NO: 2413507 - RNA, 14 nt, Human
cuccucucugcccu

SEQ ID NO: 2413508 - RNA, 15 nt, Human
cuccucucugcccua

SEQ ID NO: 2413509 - RNA, 18 nt, Human
cuccucugcugcuggcug

SEQ ID NO: 2413510 - RNA, 16 nt, Human
cuccucugcugcuggc

SEQ ID NO: 2413511 - RNA, 19 nt, Human
cuccucucugcccuaaugc

SEQ ID NO: 2413512 - RNA, 21 nt, Human
cuccguuagcuccuguggccc

SEQ ID NO: 2413513 - RNA, 18 nt, Human
cuccguuagcuccugugg

SEQ ID NO: 2413514 - RNA, 17 nt, Human
cuccguuagcuccugug

SEQ ID NO: 2413515 - RNA, 20 nt, Human
cuccguuggccacuccgaga

SEQ ID NO: 2413516 - RNA, 12 nt, Human
cuccguuggcca

SEQ ID NO: 2413517 - RNA, 22 nt, Human
cuccguuagcuccuguggcccc

SEQ ID NO: 2413518 - RNA, 17 nt, Human
cuccuaaaguagacuuc

SEQ ID NO: 2413519 - RNA, 22 nt, Human
cuccuggggguucuuucuuccu

SEQ ID NO: 2413520 - RNA, 20 nt, Human
cuccuggggguucuuucuuc

SEQ ID NO: 2413521 - RNA, 12 nt, Human
cuccugggcccu

SEQ ID NO: 2413522 - RNA, 14 nt, Human
cuccugggcccucu

SEQ ID NO: 2413523 - RNA, 18 nt, Human
cuccuggggguucuuucu

SEQ ID NO: 2413524 - RNA, 14 nt, Human
cuccuggggguucu

SEQ ID NO: 2413525 - RNA, 23 nt, Human
cuccuggggguucuuucuuccuc

SEQ ID NO: 2413526 - RNA, 21 nt, Human
cuccuggguuuuguauucucu

SEQ ID NO: 2413527 - RNA, 22 nt, Human
cuccuggguugagcuguugccu

SEQ ID NO: 2413528 - RNA, 16 nt, Human
cuccuggguugagcug

SEQ ID NO: 2413529 - RNA, 15 nt, Human
cuccuggguugagcu

SEQ ID NO: 2413530 - RNA, 14 nt, Human
cucgaacuggcugc

SEQ ID NO: 2413531 - RNA, 13 nt, Human
cucgaacuggcug

SEQ ID NO: 2413532 - RNA, 15 nt, Human
cucgaacuggcugca

SEQ ID NO: 2413533 - RNA, 16 nt, Human
cucucagcucagcgcc

SEQ ID NO: 2413534 - RNA, 21 nt, Human
cucucacuaaacuuuacccaa

SEQ ID NO: 2413535 - RNA, 12 nt, Human
cucucagcucca

SEQ ID NO: 2413536 - RNA, 15 nt, Human
cucucacuaaacuuu

SEQ ID NO: 2413537 - RNA, 15 nt, Human
cucucagcuccaggu

SEQ ID NO: 2413538 - RNA, 13 nt, Human
cucucagcuccag

SEQ ID NO: 2413539 - RNA, 17 nt, Human
cucucagcucagcgcca

SEQ ID NO: 2413540 - RNA, 19 nt, Human
cucucaggagcacaggcag

SEQ ID NO: 2413541 - RNA, 18 nt, Human
cucucaggagcacaggca

SEQ ID NO: 2413542 - RNA, 17 nt, Human
cucucaggagcacaggc

SEQ ID NO: 2413543 - RNA, 16 nt, Human
cucucaggagcacagg

SEQ ID NO: 2413544 - RNA, 15 nt, Human
cucucaggagcacag

SEQ ID NO: 2413545 - RNA, 13 nt, Human
cucucaggagcac

SEQ ID NO: 2413546 - RNA, 17 nt, Human
cucucaggaccaaagcu

SEQ ID NO: 2413547 - RNA, 16 nt, Human
cucucaggcaugccug

SEQ ID NO: 2413548 - RNA, 21 nt, Human
cucucaggagcacaggcagcu

SEQ ID NO: 2413549 - RNA, 20 nt, Human
cucucaggagcacaggcagc

SEQ ID NO: 2413550 - RNA, 14 nt, Human
cucucaggaucaag

SEQ ID NO: 2413551 - RNA, 13 nt, Human
cucucaauuuuug

SEQ ID NO: 2413552 - RNA, 14 nt, Human
cucucaauuuuugg

SEQ ID NO: 2413553 - RNA, 19 nt, Human
cucucaauuuuugguugaa

SEQ ID NO: 2413554 - RNA, 22 nt, Human
cucucaauuuuugguugaauaa

SEQ ID NO: 2413555 - RNA, 16 nt, Human
cucucaccuguacucu

SEQ ID NO: 2413556 - RNA, 12 nt, Human
cucucaccuccu

SEQ ID NO: 2413557 - RNA, 14 nt, Human
cucucacauuacug

SEQ ID NO: 2413558 - RNA, 13 nt, Human
cucucacauuacu

SEQ ID NO: 2413559 - RNA, 22 nt, Human
cucucacauguuuagaguugca

SEQ ID NO: 2413560 - RNA, 23 nt, Human
cucuaucauuuaauaauauacuu

SEQ ID NO: 2413561 - RNA, 21 nt, Human
cucuaucauuuaauaauauac

SEQ ID NO: 2413562 - RNA, 15 nt, Human
cucuaucauuuaaua

SEQ ID NO: 2413563 - RNA, 14 nt, Human
cucuaucauuuaau

SEQ ID NO: 2413564 - RNA, 18 nt, Human
cucuaucauuaaaguucu

SEQ ID NO: 2413565 - RNA, 16 nt, Human
cucuaucauuaaaguu

SEQ ID NO: 2413566 - RNA, 15 nt, Human
cucuaucauuaaagu

SEQ ID NO: 2413567 - RNA, 13 nt, Human
cucuaucauuaaa

SEQ ID NO: 2413568 - RNA, 15 nt, Human
cucuaucaccaagga

SEQ ID NO: 2413569 - RNA, 15 nt, Human
cucuauagcaccagg

SEQ ID NO: 2413570 - RNA, 11 nt, Human
cucuauauuua

SEQ ID NO: 2413571 - RNA, 22 nt, Human
cucuauauuuagauuguuaaaa

SEQ ID NO: 2413572 - RNA, 20 nt, Human
cucuaaaagauccuuuuuaa

SEQ ID NO: 2413573 - RNA, 13 nt, Human
cucuaaaagaucc

SEQ ID NO: 2413574 - RNA, 17 nt, Human
cucuaaaagguucaggg

SEQ ID NO: 2413575 - RNA, 16 nt, Human
cucuaaaagguucagg

SEQ ID NO: 2413576 - RNA, 18 nt, Human
cucuaaaagguucaggga

SEQ ID NO: 2413577 - RNA, 17 nt, Human
cucuaaaauagccacuu

SEQ ID NO: 2413578 - RNA, 19 nt, Human
cucguuucaaaaacacagu

SEQ ID NO: 2413579 - RNA, 21 nt, Human
cucguuuuucuucuuaagacu

SEQ ID NO: 2413580 - RNA, 23 nt, Human
cucguugacuggcuguguguugg

SEQ ID NO: 2413581 - RNA, 18 nt, Human
cucuaaagcaauaauggu

SEQ ID NO: 2413582 - RNA, 21 nt, Human
cucuaaagaguuuauuuuaag

SEQ ID NO: 2413583 - RNA, 17 nt, Human
cucgugguaggacugua

SEQ ID NO: 2413584 - RNA, 20 nt, Human
cucguguauccuggggcucc

SEQ ID NO: 2413585 - RNA, 19 nt, Human
cucguguauccuggggcuc

SEQ ID NO: 2413586 - RNA, 18 nt, Human
cucguguauccuggggcu

SEQ ID NO: 2413587 - RNA, 17 nt, Human
cucguguauccuggggc

SEQ ID NO: 2413588 - RNA, 16 nt, Human
cucguguauccugggg

SEQ ID NO: 2413589 - RNA, 15 nt, Human
cucguguauccuggg

SEQ ID NO: 2413590 - RNA, 14 nt, Human
cucguguauccugg

SEQ ID NO: 2413591 - RNA, 16 nt, Human
cucgugguccccaaca

SEQ ID NO: 2413592 - RNA, 21 nt, Human
cucgugguaggacuguagaaa

SEQ ID NO: 2413593 - RNA, 14 nt, Human
cucguuaauuugua

SEQ ID NO: 2413594 - RNA, 20 nt, Human
cucguugacuggcugugugu

SEQ ID NO: 2413595 - RNA, 20 nt, Human
cuccacuuucuagccagagg

SEQ ID NO: 2413596 - RNA, 19 nt, Human
cuccacuuucuagccagag

SEQ ID NO: 2413597 - RNA, 16 nt, Human
cuccacuuucuagcca

SEQ ID NO: 2413598 - RNA, 23 nt, Human
cuccacuuggucugugagaugcu

SEQ ID NO: 2413599 - RNA, 18 nt, Human
cuccacugucacccucca

SEQ ID NO: 2413600 - RNA, 13 nt, Human
cuccacugucacc

SEQ ID NO: 2413601 - RNA, 21 nt, Human
cuccacuucuuguuccccacu

SEQ ID NO: 2413602 - RNA, 16 nt, Human
cuccagggccacgugc

SEQ ID NO: 2413603 - RNA, 21 nt, Human
cucccaccucugugaccucag

SEQ ID NO: 2413604 - RNA, 20 nt, Human
cucccaccucugugaccuca

SEQ ID NO: 2413605 - RNA, 19 nt, Human
cucccaccucugugaccuc

SEQ ID NO: 2413606 - RNA, 18 nt, Human
cucccaccucugugaccu

SEQ ID NO: 2413607 - RNA, 17 nt, Human
cucccaccucugugacc

SEQ ID NO: 2413608 - RNA, 15 nt, Human
cucccaccucuguga

SEQ ID NO: 2413609 - RNA, 14 nt, Human
cucccaccucugug

SEQ ID NO: 2413610 - RNA, 13 nt, Human
cucccaccucugu

SEQ ID NO: 2413611 - RNA, 12 nt, Human
cucccaccucug

SEQ ID NO: 2413612 - RNA, 23 nt, Human
cucccaccucccccucccccuuc

SEQ ID NO: 2413613 - RNA, 23 nt, Human
cucccacccccuucucugcucca

SEQ ID NO: 2413614 - RNA, 15 nt, Human
cucccacgugggaga

SEQ ID NO: 2413615 - RNA, 14 nt, Human
cucccacgugggag

SEQ ID NO: 2413616 - RNA, 22 nt, Human
cucccacagugacucgggcucc

SEQ ID NO: 2413617 - RNA, 19 nt, Human
cuccccaugauguuuagaa

SEQ ID NO: 2413618 - RNA, 12 nt, Human
cuccccauggag

SEQ ID NO: 2413619 - RNA, 17 nt, Human
cuccccauggagccagc

SEQ ID NO: 2413620 - RNA, 14 nt, Human
cuccccaugugucc

SEQ ID NO: 2413621 - RNA, 21 nt, Human
cuccccauuucccaucugcac

SEQ ID NO: 2413622 - RNA, 20 nt, Human
cuccccauuucccaucugca

SEQ ID NO: 2413623 - RNA, 22 nt, Human
cuccccauuucccaucugcacc

SEQ ID NO: 2413624 - RNA, 19 nt, Human
cuccccauuucccaucugc

SEQ ID NO: 2413625 - RNA, 18 nt, Human
cuccccauuucccaucug

SEQ ID NO: 2413626 - RNA, 17 nt, Human
cuccccauuucccaucu

SEQ ID NO: 2413627 - RNA, 16 nt, Human
cuccccauuagcuuuc

SEQ ID NO: 2413628 - RNA, 20 nt, Human
cuccccauguguccugguuc

SEQ ID NO: 2413629 - RNA, 18 nt, Human
cuccccauguguccuggu

SEQ ID NO: 2413630 - RNA, 21 nt, Human
cuccccauguguccugguucc

SEQ ID NO: 2413631 - RNA, 21 nt, Human
cuccccauuagagucagccuu

SEQ ID NO: 2413632 - RNA, 20 nt, Human
cuccagggcuggacugaggc

SEQ ID NO: 2413633 - RNA, 19 nt, Human
cuccagggcuggacugagg

SEQ ID NO: 2413634 - RNA, 18 nt, Human
cuccagggcuggacugag

SEQ ID NO: 2413635 - RNA, 17 nt, Human
cuccagggcuggacuga

SEQ ID NO: 2413636 - RNA, 18 nt, Human
cuccaggggcugcuuccu

SEQ ID NO: 2413637 - RNA, 15 nt, Human
cuccaggggcugcuu

SEQ ID NO: 2413638 - RNA, 14 nt, Human
cuccaggggcugcu

SEQ ID NO: 2413639 - RNA, 21 nt, Human
cuccagggcuggacugaggcc

SEQ ID NO: 2413640 - RNA, 16 nt, Human
cuccagggcuggacug

SEQ ID NO: 2413641 - RNA, 15 nt, Human
cuccagggcuggacu

SEQ ID NO: 2413642 - RNA, 14 nt, Human
cuccagggcuggac

SEQ ID NO: 2413643 - RNA, 13 nt, Human
cuccagggcugga

SEQ ID NO: 2413644 - RNA, 12 nt, Human
cuccagggcugg

SEQ ID NO: 2413645 - RNA, 18 nt, Human
cuccagggccacgugcca

SEQ ID NO: 2413646 - RNA, 19 nt, Human
cuccagggccacgugccag

SEQ ID NO: 2413647 - RNA, 23 nt, Human
cuccagggccacgugccaggccc

SEQ ID NO: 2413648 - RNA, 21 nt, Human
cuccaggggcugcuuccuccu

SEQ ID NO: 2413649 - RNA, 13 nt, Human
cucccaccacagc

SEQ ID NO: 2413650 - RNA, 14 nt, Human
cucccaccacagca

SEQ ID NO: 2413651 - RNA, 14 nt, Human
cucccaccaggcua

SEQ ID NO: 2413652 - RNA, 19 nt, Human
cucccaccacagcaggugu

SEQ ID NO: 2413653 - RNA, 17 nt, Human
cucccacccaccgccac

SEQ ID NO: 2413654 - RNA, 14 nt, Human
cucccacccaccgc

SEQ ID NO: 2413655 - RNA, 13 nt, Human
cucccacccaccg

SEQ ID NO: 2413656 - RNA, 12 nt, Human
cucccaccccac

SEQ ID NO: 2413657 - RNA, 13 nt, Human
cucccaccccacc

SEQ ID NO: 2413658 - RNA, 19 nt, Human
cucccaccccacccccuuc

SEQ ID NO: 2413659 - RNA, 22 nt, Human
cucccaccccacccccuucagu

SEQ ID NO: 2413660 - RNA, 23 nt, Human
cucccaccccacccccuucagug

SEQ ID NO: 2413661 - RNA, 15 nt, Human
cucccacccccaucu

SEQ ID NO: 2413662 - RNA, 19 nt, Human
cucccacccccaucucucc

SEQ ID NO: 2413663 - RNA, 20 nt, Human
cucccacccccaucucuccc

SEQ ID NO: 2413664 - RNA, 22 nt, Human
cucccacccccaucucucccuc

SEQ ID NO: 2413665 - RNA, 18 nt, Human
cucccacccccuucucug

SEQ ID NO: 2413666 - RNA, 22 nt, Human
cucccacccccuucucugcucc

SEQ ID NO: 2413667 - RNA, 20 nt, Human
cucaucugcugguccguggg

SEQ ID NO: 2413668 - RNA, 16 nt, Human
cucaucugcugguccg

SEQ ID NO: 2413669 - RNA, 15 nt, Human
cucaucugcuggucc

SEQ ID NO: 2413670 - RNA, 14 nt, Human
cucaucugcugguc

SEQ ID NO: 2413671 - RNA, 18 nt, Human
cucaucugggggagugga

SEQ ID NO: 2413672 - RNA, 13 nt, Human
cucaucugcuggu

SEQ ID NO: 2413673 - RNA, 15 nt, Human
cucagucucccuccc

SEQ ID NO: 2413674 - RNA, 16 nt, Human
cucagucucccucccu

SEQ ID NO: 2413675 - RNA, 17 nt, Human
cucagucucccucccuu

SEQ ID NO: 2413676 - RNA, 13 nt, Human
cucagucucccuu

SEQ ID NO: 2413677 - RNA, 16 nt, Human
cucagucucaggagca

SEQ ID NO: 2413678 - RNA, 23 nt, Human
cucaugcccacccccugcccugc

SEQ ID NO: 2413679 - RNA, 22 nt, Human
cucaugcccacccccugcccug

SEQ ID NO: 2413680 - RNA, 21 nt, Human
cucaugcccacccccugcccu

SEQ ID NO: 2413681 - RNA, 20 nt, Human
cucaugcccacccccugccc

SEQ ID NO: 2413682 - RNA, 22 nt, Human
cucaugcccccuuucagauguc

SEQ ID NO: 2413683 - RNA, 17 nt, Human
cucaugcccccuuucag

SEQ ID NO: 2413684 - RNA, 14 nt, Human
cucaugccccuggc

SEQ ID NO: 2413685 - RNA, 19 nt, Human
cucaugcccacccccugcc

SEQ ID NO: 2413686 - RNA, 17 nt, Human
cucaugcccacccccug

SEQ ID NO: 2413687 - RNA, 16 nt, Human
cucaugcccacccccu

SEQ ID NO: 2413688 - RNA, 13 nt, Human
cucaugcccaccc

SEQ ID NO: 2413689 - RNA, 22 nt, Human
cucaugcaucuccaccugcucc

SEQ ID NO: 2413690 - RNA, 12 nt, Human
cucaucugucac

SEQ ID NO: 2413691 - RNA, 14 nt, Human
cucaucugucacca

SEQ ID NO: 2413692 - RNA, 13 nt, Human
cucaucugucccu

SEQ ID NO: 2413693 - RNA, 15 nt, Human
cucaucugucccucc

SEQ ID NO: 2413694 - RNA, 17 nt, Human
cucaucugucccuccgg

SEQ ID NO: 2413695 - RNA, 18 nt, Human
cucaucugucccuccggg

SEQ ID NO: 2413696 - RNA, 13 nt, Human
cucaucuuacugu

SEQ ID NO: 2413697 - RNA, 19 nt, Human
cucaucugggggaguggaa

SEQ ID NO: 2413698 - RNA, 12 nt, Human
cucaucugugau

SEQ ID NO: 2413699 - RNA, 20 nt, Human
cucaguaaguaucuggagga

SEQ ID NO: 2413700 - RNA, 21 nt, Human
cucaguaagacgacaaggaaa

SEQ ID NO: 2413701 - RNA, 21 nt, Human
cucaguaaguaucuggaggaa

SEQ ID NO: 2413702 - RNA, 12 nt, Human
cucaguacuuug

SEQ ID NO: 2413703 - RNA, 17 nt, Human
cucaguacuuuggaggc

SEQ ID NO: 2413704 - RNA, 18 nt, Human
cucaguacuuuggaggcc

SEQ ID NO: 2413705 - RNA, 19 nt, Human
cucaguacuuuggaggccc

SEQ ID NO: 2413706 - RNA, 20 nt, Human
cucaguacuuuggaggcccc

SEQ ID NO: 2413707 - RNA, 21 nt, Human
cucaguacuuuggaggccccu

SEQ ID NO: 2413708 - RNA, 13 nt, Human
cucagucucccuc

SEQ ID NO: 2413709 - RNA, 14 nt, Human
cucagucucaggag

SEQ ID NO: 2413710 - RNA, 15 nt, Human
cucagucucaggagc

SEQ ID NO: 2413711 - RNA, 23 nt, Human
cucaguacuuuggaggccccuau

SEQ ID NO: 2413712 - RNA, 21 nt, Human
cucaguccuccccucacagcc

SEQ ID NO: 2413713 - RNA, 23 nt, Human
cucaguccuccccucacagccuc

SEQ ID NO: 2413714 - RNA, 22 nt, Human
cucaguccuccccucacagccu

SEQ ID NO: 2413715 - RNA, 13 nt, Human
cucagucucagga

SEQ ID NO: 2413716 - RNA, 19 nt, Human
cucaguaagacgacaagga

SEQ ID NO: 2413717 - RNA, 16 nt, Human
cucaguaaagcacuug

SEQ ID NO: 2413718 - RNA, 20 nt, Human
cucagguuugccugagggcg

SEQ ID NO: 2413719 - RNA, 14 nt, Human
cucaguaaaaugaa

SEQ ID NO: 2413720 - RNA, 22 nt, Human
cucagguugucugaagucacug

SEQ ID NO: 2413721 - RNA, 16 nt, Human
cuccacuuggucugug

SEQ ID NO: 2413722 - RNA, 17 nt, Human
cuccacuuggucuguga

SEQ ID NO: 2413723 - RNA, 21 nt, Human
cuccacuuggucugugagaug

SEQ ID NO: 2413724 - RNA, 22 nt, Human
cuccacuuggucugugagaugc

SEQ ID NO: 2413725 - RNA, 13 nt, Human
cuccacuuggucu

SEQ ID NO: 2413726 - RNA, 15 nt, Human
cuccacuuggucugu

SEQ ID NO: 2413727 - RNA, 16 nt, Human
cuccacugucacauug

SEQ ID NO: 2413728 - RNA, 13 nt, Human
cuccacugucaca

SEQ ID NO: 2413729 - RNA, 12 nt, Human
cuccacugucac

SEQ ID NO: 2413730 - RNA, 11 nt, Human
cuccacuguca

SEQ ID NO: 2413731 - RNA, 9 nt, Human
cuccacugu

SEQ ID NO: 2413732 - RNA, 23 nt, Human
cuccacuggccggagucagugcc

SEQ ID NO: 2413733 - RNA, 16 nt, Human
cuccacuggauggagg

SEQ ID NO: 2413734 - RNA, 16 nt, Human
cuccaagcucccaggc

SEQ ID NO: 2413735 - RNA, 15 nt, Human
cuccaagcucccagg

SEQ ID NO: 2413736 - RNA, 14 nt, Human
cuccaagcucccag

SEQ ID NO: 2413737 - RNA, 13 nt, Human
cuccaagcuccca

SEQ ID NO: 2413738 - RNA, 18 nt, Human
cuccaagccccaucuucu

SEQ ID NO: 2413739 - RNA, 17 nt, Human
cuccaagccccaucuuc

SEQ ID NO: 2413740 - RNA, 14 nt, Human
cuccaagcuccauc

SEQ ID NO: 2413741 - RNA, 19 nt, Human
cuccaagcuccaucuccac

SEQ ID NO: 2413742 - RNA, 18 nt, Human
cuccaagcuccaucucca

SEQ ID NO: 2413743 - RNA, 23 nt, Human
cuccaagcccaguucagcuuggg

SEQ ID NO: 2413744 - RNA, 15 nt, Human
cuccaagccccaucu

SEQ ID NO: 2413745 - RNA, 13 nt, Human
cuccaagccagcg

SEQ ID NO: 2413746 - RNA, 24 nt, Human
cuccaagcaggacauggacaagga

SEQ ID NO: 2413747 - RNA, 22 nt, Human
cuccaagcaggacauggacaag

SEQ ID NO: 2413748 - RNA, 14 nt, Human
cuccaagcaggaca

SEQ ID NO: 2413749 - RNA, 13 nt, Human
cuccaagcaggac

SEQ ID NO: 2413750 - RNA, 22 nt, Human
cuccaagaccuucuccuucacc

SEQ ID NO: 2413751 - RNA, 21 nt, Human
cuccaagaccuguugguucca

SEQ ID NO: 2413752 - RNA, 20 nt, Human
cuccaagaaugcugaaacca

SEQ ID NO: 2413753 - RNA, 17 nt, Human
cuccaagaaugcugaaa

SEQ ID NO: 2413754 - RNA, 15 nt, Human
cuccaagaccuucuc

SEQ ID NO: 2413755 - RNA, 21 nt, Human
cuccaagaccuucuccuucac

SEQ ID NO: 2413756 - RNA, 15 nt, Human
cucauguggcuggaa

SEQ ID NO: 2413757 - RNA, 14 nt, Human
cucauguggcugga

SEQ ID NO: 2413758 - RNA, 13 nt, Human
cucauguggcugg

SEQ ID NO: 2413759 - RNA, 12 nt, Human
cucauguggcug

SEQ ID NO: 2413760 - RNA, 16 nt, Human
cucaugugauccuuuu

SEQ ID NO: 2413761 - RNA, 14 nt, Human
cucaugugauccuu

SEQ ID NO: 2413762 - RNA, 12 nt, Human
cucaugugaucc

SEQ ID NO: 2413763 - RNA, 23 nt, Human
cucaugcccccuuucagaugucu

SEQ ID NO: 2413764 - RNA, 16 nt, Human
cucaugccccuggcug

SEQ ID NO: 2413765 - RNA, 17 nt, Human
cucaugccccuggcugg

SEQ ID NO: 2413766 - RNA, 12 nt, Human
cucaugccucag

SEQ ID NO: 2413767 - RNA, 16 nt, Human
cucaugccucagccuc

SEQ ID NO: 2413768 - RNA, 16 nt, Human
cuccaagaaugcugaa

SEQ ID NO: 2413769 - RNA, 15 nt, Human
cuccaagaaugcuga

SEQ ID NO: 2413770 - RNA, 14 nt, Human
cuccaagaaugcug

SEQ ID NO: 2413771 - RNA, 18 nt, Human
cuccaacuggauuauaaa

SEQ ID NO: 2413772 - RNA, 18 nt, Human
cuccaaccuggggggcag

SEQ ID NO: 2413773 - RNA, 19 nt, Human
cucaugugugcucuucuuc

SEQ ID NO: 2413774 - RNA, 14 nt, Human
cuccaaccuggaca

SEQ ID NO: 2413775 - RNA, 21 nt, Human
cuccaaccugcaaagaucugu

SEQ ID NO: 2413776 - RNA, 13 nt, Human
cuccaaccugcaa

SEQ ID NO: 2413777 - RNA, 18 nt, Human
cucaugugugcucuucuu

SEQ ID NO: 2413778 - RNA, 12 nt, Human
cucauguguaug

SEQ ID NO: 2413779 - RNA, 16 nt, Human
cucauguucugcuuuc

SEQ ID NO: 2413780 - RNA, 16 nt, Human
cucaugugugcaacag

SEQ ID NO: 2413781 - RNA, 9 nt, Human
cucaugugu

SEQ ID NO: 2413782 - RNA, 15 nt, Human
cucauguucugcuuu

SEQ ID NO: 2413783 - RNA, 17 nt, Human
cugagucaccaggaaug

SEQ ID NO: 2413784 - RNA, 21 nt, Human
cugaguaucuccucgcaagcu

SEQ ID NO: 2413785 - RNA, 22 nt, Human
cugaguaucuccucgcaagcug

SEQ ID NO: 2413786 - RNA, 20 nt, Human
cugaguauguuaagcucuuu

SEQ ID NO: 2413787 - RNA, 14 nt, Human
cugagucaccagga

SEQ ID NO: 2413788 - RNA, 15 nt, Human
cugagucaccaggaa

SEQ ID NO: 2413789 - RNA, 15 nt, Human
cugaguagcugggau

SEQ ID NO: 2413790 - RNA, 20 nt, Human
cugaguagcugggauuacag

SEQ ID NO: 2413791 - RNA, 14 nt, Human
cugaguagcuggga

SEQ ID NO: 2413792 - RNA, 20 nt, Human
cugaguagcuggauuacagg

SEQ ID NO: 2413793 - RNA, 14 nt, Human
cugaggaauccaga

SEQ ID NO: 2413794 - RNA, 15 nt, Human
cugagcuuugcaugu

SEQ ID NO: 2413795 - RNA, 12 nt, Human
cugagcuuugca

SEQ ID NO: 2413796 - RNA, 16 nt, Human
cugaggaaaggccagc

SEQ ID NO: 2413797 - RNA, 17 nt, Human
cugaggaaaggccagcu

SEQ ID NO: 2413798 - RNA, 18 nt, Human
cugaggaaaggccagcug

SEQ ID NO: 2413799 - RNA, 19 nt, Human
cugaggaaaggccagcugg

SEQ ID NO: 2413800 - RNA, 20 nt, Human
cugaggaaaggccagcuggc

SEQ ID NO: 2413801 - RNA, 22 nt, Human
cugaggaaaggccagcuggcag

SEQ ID NO: 2413802 - RNA, 20 nt, Human
cugaggaauccagacccggc

SEQ ID NO: 2413803 - RNA, 17 nt, Human
cugaggaauccagaccc

SEQ ID NO: 2413804 - RNA, 20 nt, Human
cugaggacacuaaccacgcu

SEQ ID NO: 2413805 - RNA, 21 nt, Human
cugaggaauccagacccggcu

SEQ ID NO: 2413806 - RNA, 13 nt, Human
cugaggacagcug

SEQ ID NO: 2413807 - RNA, 16 nt, Human
cugaggaauuuucuuu

SEQ ID NO: 2413808 - RNA, 23 nt, Human
cugaggacacuaaccacgcugga

SEQ ID NO: 2413809 - RNA, 21 nt, Human
cugagauaugaacauauuguu

SEQ ID NO: 2413810 - RNA, 23 nt, Human
cugagauaugaacauauuguuga

SEQ ID NO: 2413811 - RNA, 21 nt, Human
cugagaucaaaacgguuuuac

SEQ ID NO: 2413812 - RNA, 17 nt, Human
cugagaucucugcagga

SEQ ID NO: 2413813 - RNA, 18 nt, Human
cugagaucucugcaggaa

SEQ ID NO: 2413814 - RNA, 16 nt, Human
cugagaucucugcagg

SEQ ID NO: 2413815 - RNA, 14 nt, Human
cugagaucgugccg

SEQ ID NO: 2413816 - RNA, 23 nt, Human
cugagauggaacccuuuuggccc

SEQ ID NO: 2413817 - RNA, 14 nt, Human
cugagcuuucugcu

SEQ ID NO: 2413818 - RNA, 15 nt, Human
cugagcuuucugcua

SEQ ID NO: 2413819 - RNA, 15 nt, Human
cugaggaaaggccag

SEQ ID NO: 2413820 - RNA, 22 nt, Human
cugaggugccugucccaccccc

SEQ ID NO: 2413821 - RNA, 19 nt, Human
cugaggugccugucccacc

SEQ ID NO: 2413822 - RNA, 17 nt, Human
cugaggugccuguccca

SEQ ID NO: 2413823 - RNA, 16 nt, Human
cugaggucuggcugcu

SEQ ID NO: 2413824 - RNA, 19 nt, Human
cugaggugaaagggagcua

SEQ ID NO: 2413825 - RNA, 14 nt, Human
cugaggucuggcug

SEQ ID NO: 2413826 - RNA, 13 nt, Human
cugaggucuggcu

SEQ ID NO: 2413827 - RNA, 17 nt, Human
cugaggugaaagggagc

SEQ ID NO: 2413828 - RNA, 17 nt, Human
cugaggucuagaaauag

SEQ ID NO: 2413829 - RNA, 19 nt, Human
cugaggucucgcugaugcu

SEQ ID NO: 2413830 - RNA, 16 nt, Human
cugaggucucuugagg

SEQ ID NO: 2413831 - RNA, 19 nt, Human
cugaggucucuugagggag

SEQ ID NO: 2413832 - RNA, 21 nt, Human
cugaggucucuugagggagcu

SEQ ID NO: 2413833 - RNA, 19 nt, Human
cugaggaggccuccaucuc

SEQ ID NO: 2413834 - RNA, 16 nt, Human
cugaggaggccuccau

SEQ ID NO: 2413835 - RNA, 15 nt, Human
cugaggaggccucca

SEQ ID NO: 2413836 - RNA, 14 nt, Human
cugaggaggccucc

SEQ ID NO: 2413837 - RNA, 11 nt, Human
cugaggagaaa

SEQ ID NO: 2413838 - RNA, 13 nt, Human
cugaggaggccuc

SEQ ID NO: 2413839 - RNA, 16 nt, Human
cugaggacagcugucc

SEQ ID NO: 2413840 - RNA, 15 nt, Human
cugaggacagcuguc

SEQ ID NO: 2413841 - RNA, 14 nt, Human
cugaggacagcugu

SEQ ID NO: 2413842 - RNA, 14 nt, Human
cugaggaccagcca

SEQ ID NO: 2413843 - RNA, 17 nt, Human
cugaggacauuccaaga

SEQ ID NO: 2413844 - RNA, 17 nt, Human
cugaggacagcuguccu

SEQ ID NO: 2413845 - RNA, 22 nt, Human
cugaggacuuaaaauauuccug

SEQ ID NO: 2413846 - RNA, 18 nt, Human
cugaguacguugugcauu

SEQ ID NO: 2413847 - RNA, 17 nt, Human
cugaguacguugugcau

SEQ ID NO: 2413848 - RNA, 19 nt, Human
cugaguacguugugcauuu

SEQ ID NO: 2413849 - RNA, 20 nt, Human
cugaguacguugugcauuug

SEQ ID NO: 2413850 - RNA, 21 nt, Human
cugaguacguugugcauuugg

SEQ ID NO: 2413851 - RNA, 12 nt, Human
cugaggugggag

SEQ ID NO: 2413852 - RNA, 19 nt, Human
cugaguagaaaggccuuua

SEQ ID NO: 2413853 - RNA, 14 nt, Human
cugaguagaaaggc

SEQ ID NO: 2413854 - RNA, 12 nt, Human
cugaguagaaag

SEQ ID NO: 2413855 - RNA, 20 nt, Human
cugaguagaaaggccuuuaa

SEQ ID NO: 2413856 - RNA, 19 nt, Human
cugaguagcuggauuacag

SEQ ID NO: 2413857 - RNA, 22 nt, Human
cugacaaccaccgcuccccagc

SEQ ID NO: 2413858 - RNA, 20 nt, Human
cugacaaccacuggucugua

SEQ ID NO: 2413859 - RNA, 18 nt, Human
cugacaaccacuggucug

SEQ ID NO: 2413860 - RNA, 13 nt, Human
cugacaacuugaa

SEQ ID NO: 2413861 - RNA, 15 nt, Human
cugacaacagacuuc

SEQ ID NO: 2413862 - RNA, 18 nt, Human
cugacaacagacuucuga

SEQ ID NO: 2413863 - RNA, 19 nt, Human
cugacaacagacuucugaa

SEQ ID NO: 2413864 - RNA, 21 nt, Human
cugacaaccaccgcuccccag

SEQ ID NO: 2413865 - RNA, 20 nt, Human
cugacaaccaccgcucccca

SEQ ID NO: 2413866 - RNA, 13 nt, Human
cugagaggcaggc

SEQ ID NO: 2413867 - RNA, 12 nt, Human
cugagaggcagg

SEQ ID NO: 2413868 - RNA, 12 nt, Human
cugagaggccac

SEQ ID NO: 2413869 - RNA, 15 nt, Human
cugagaggcaggcau

SEQ ID NO: 2413870 - RNA, 14 nt, Human
cugagaggcaggca

SEQ ID NO: 2413871 - RNA, 17 nt, Human
cugagaggcaggcauag

SEQ ID NO: 2413872 - RNA, 22 nt, Human
cugagaggacuuuucuuugugg

SEQ ID NO: 2413873 - RNA, 21 nt, Human
cugagaggacuuuucuuugug

SEQ ID NO: 2413874 - RNA, 13 nt, Human
cugagagucugca

SEQ ID NO: 2413875 - RNA, 15 nt, Human
cugagaguuuaguug

SEQ ID NO: 2413876 - RNA, 14 nt, Human
cugagaguuuaguu

SEQ ID NO: 2413877 - RNA, 15 nt, Human
cugagauaugaacau

SEQ ID NO: 2413878 - RNA, 16 nt, Human
cugagauaugaacaua

SEQ ID NO: 2413879 - RNA, 12 nt, Human
cugagauaugaa

SEQ ID NO: 2413880 - RNA, 18 nt, Human
cugagauaccagcgagga

SEQ ID NO: 2413881 - RNA, 17 nt, Human
cugagaguagagucacu

SEQ ID NO: 2413882 - RNA, 19 nt, Human
cugagaguauuuaggcaga

SEQ ID NO: 2413883 - RNA, 20 nt, Human
cugagaguauuuaggcagau

SEQ ID NO: 2413884 - RNA, 16 nt, Human
cugagagccccagcug

SEQ ID NO: 2413885 - RNA, 15 nt, Human
cugagagccccagcu

SEQ ID NO: 2413886 - RNA, 17 nt, Human
cugagagccccagcuga

SEQ ID NO: 2413887 - RNA, 14 nt, Human
cugagagccccagc

SEQ ID NO: 2413888 - RNA, 13 nt, Human
cugagagccccag

SEQ ID NO: 2413889 - RNA, 14 nt, Human
cugagagaguggca

SEQ ID NO: 2413890 - RNA, 24 nt, Human
cugagagaguggcauuggcagcag

SEQ ID NO: 2413891 - RNA, 22 nt, Human
cugagacucgcgacaaugcaaa

SEQ ID NO: 2413892 - RNA, 21 nt, Human
cugagacucucuuaggagcag

SEQ ID NO: 2413893 - RNA, 17 nt, Human
cugagacucucuuagga

SEQ ID NO: 2413894 - RNA, 21 nt, Human
cugagacuuucagugcacugu

SEQ ID NO: 2413895 - RNA, 14 nt, Human
cugagacugcggga

SEQ ID NO: 2413896 - RNA, 14 nt, Human
cugagagaaaauaa

SEQ ID NO: 2413897 - RNA, 12 nt, Human
cugagagaaaua

SEQ ID NO: 2413898 - RNA, 15 nt, Human
cugagagacccaagg

SEQ ID NO: 2413899 - RNA, 17 nt, Human
cugagagacccaaggag

SEQ ID NO: 2413900 - RNA, 19 nt, Human
cugagagacccaaggagga

SEQ ID NO: 2413901 - RNA, 18 nt, Human
cugagagacuuuuaauca

SEQ ID NO: 2413902 - RNA, 16 nt, Human
cugagagacuuuuaau

SEQ ID NO: 2413903 - RNA, 13 nt, Human
cugagagacuuuu

SEQ ID NO: 2413904 - RNA, 20 nt, Human
cugagagacccaaggaggaa

SEQ ID NO: 2413905 - RNA, 22 nt, Human
cugacccaugcugcccugugag

SEQ ID NO: 2413906 - RNA, 21 nt, Human
cugacccaugcugcccuguga

SEQ ID NO: 2413907 - RNA, 22 nt, Human
cugaccccaaacaccuuccagc

SEQ ID NO: 2413908 - RNA, 21 nt, Human
cugaccccaaacaccuuccag

SEQ ID NO: 2413909 - RNA, 20 nt, Human
cugaccccaaacaccuucca

SEQ ID NO: 2413910 - RNA, 21 nt, Human
cugaccugaggcuccugugcu

SEQ ID NO: 2413911 - RNA, 13 nt, Human
cugaccugaggcu

SEQ ID NO: 2413912 - RNA, 21 nt, Human
cugaccccagugguauccugu

SEQ ID NO: 2413913 - RNA, 23 nt, Human
cugaccccaaagagccuggagaa

SEQ ID NO: 2413914 - RNA, 20 nt, Human
cugaccccaaagagccugga

SEQ ID NO: 2413915 - RNA, 14 nt, Human
cugaccugcacugg

SEQ ID NO: 2413916 - RNA, 12 nt, Human
cugaccugcagg

SEQ ID NO: 2413917 - RNA, 13 nt, Human
cugaccugcaggc

SEQ ID NO: 2413918 - RNA, 23 nt, Human
cugagaccaguugggagcacugg

SEQ ID NO: 2413919 - RNA, 15 nt, Human
cugagacaggagaau

SEQ ID NO: 2413920 - RNA, 13 nt, Human
cugagacaggaga

SEQ ID NO: 2413921 - RNA, 14 nt, Human
cugagaccaguugg

SEQ ID NO: 2413922 - RNA, 19 nt, Human
cugagaccccuggccuccg

SEQ ID NO: 2413923 - RNA, 17 nt, Human
cugagaccccuggccuc

SEQ ID NO: 2413924 - RNA, 16 nt, Human
cugagaccccuggccu

SEQ ID NO: 2413925 - RNA, 15 nt, Human
cugagaccccuggcc

SEQ ID NO: 2413926 - RNA, 13 nt, Human
cugagaccccugg

SEQ ID NO: 2413927 - RNA, 22 nt, Human
cugagaccaguugggagcacug

SEQ ID NO: 2413928 - RNA, 19 nt, Human
cugagaccaguugggagca

SEQ ID NO: 2413929 - RNA, 21 nt, Human
cugagaccccuggccuccggc

SEQ ID NO: 2413930 - RNA, 20 nt, Human
cugagaccccuggccuccgg

SEQ ID NO: 2413931 - RNA, 20 nt, Human
cugagaccugacaagcacug

SEQ ID NO: 2413932 - RNA, 21 nt, Human
cugagacucgcgacaaugcaa

SEQ ID NO: 2413933 - RNA, 23 nt, Human
cugagacagcccgggcucugccu

SEQ ID NO: 2413934 - RNA, 20 nt, Human
cugaccugucaugccccccu

SEQ ID NO: 2413935 - RNA, 19 nt, Human
cugaccugucaugcccccc

SEQ ID NO: 2413936 - RNA, 18 nt, Human
cugaccugucaugccccc

SEQ ID NO: 2413937 - RNA, 17 nt, Human
cugaccugucaugcccc

SEQ ID NO: 2413938 - RNA, 15 nt, Human
cugaccugucaugcc

SEQ ID NO: 2413939 - RNA, 23 nt, Human
cucuucaggaagaaaggagucug

SEQ ID NO: 2413940 - RNA, 17 nt, Human
cucuucaggccucccuc

SEQ ID NO: 2413941 - RNA, 13 nt, Human
cucuucagaggcc

SEQ ID NO: 2413942 - RNA, 21 nt, Human
cucuucagaaagugugcuuua

SEQ ID NO: 2413943 - RNA, 17 nt, Human
cucuucagaggcccucg

SEQ ID NO: 2413944 - RNA, 13 nt, Human
cucuucaggccuc

SEQ ID NO: 2413945 - RNA, 14 nt, Human
cucuucaggccucc

SEQ ID NO: 2413946 - RNA, 15 nt, Human
cucuucaggccuccc

SEQ ID NO: 2413947 - RNA, 16 nt, Human
cucuucaggccucccu

SEQ ID NO: 2413948 - RNA, 17 nt, Human
cucuucaacugaccagc

SEQ ID NO: 2413949 - RNA, 16 nt, Human
cucuucaacugaccag

SEQ ID NO: 2413950 - RNA, 17 nt, Human
cucuucaaauuagaaga

SEQ ID NO: 2413951 - RNA, 18 nt, Human
cucuucaaggacuuucug

SEQ ID NO: 2413952 - RNA, 20 nt, Human
cucuucaacugaccagccuc

SEQ ID NO: 2413953 - RNA, 17 nt, Human
cucuuagcuccccucca

SEQ ID NO: 2413954 - RNA, 15 nt, Human
cucuuagcuccccuc

SEQ ID NO: 2413955 - RNA, 18 nt, Human
cucuuagcuccccuccaa

SEQ ID NO: 2413956 - RNA, 12 nt, Human
cucuuauuugcu

SEQ ID NO: 2413957 - RNA, 15 nt, Human
cucuuauuuuacaau

SEQ ID NO: 2413958 - RNA, 18 nt, Human
cucuucagaucucuaacu

SEQ ID NO: 2413959 - RNA, 19 nt, Human
cucuucagaucucuaacuu

SEQ ID NO: 2413960 - RNA, 14 nt, Human
cucuucaaucucuu

SEQ ID NO: 2413961 - RNA, 18 nt, Human
cucuucaccccccacuca

SEQ ID NO: 2413962 - RNA, 17 nt, Human
cucuucaccccccacuc

SEQ ID NO: 2413963 - RNA, 16 nt, Human
cucuucaccccccacu

SEQ ID NO: 2413964 - RNA, 11 nt, Human
cucuucagaaa

SEQ ID NO: 2413965 - RNA, 18 nt, Human
cucuuagcagcuuccaga

SEQ ID NO: 2413966 - RNA, 17 nt, Human
cucuuagcagcuuccag

SEQ ID NO: 2413967 - RNA, 19 nt, Human
cucuuagcagcuuccagau

SEQ ID NO: 2413968 - RNA, 21 nt, Human
cucuuagcauuuuaauuagau

SEQ ID NO: 2413969 - RNA, 13 nt, Human
cucuuauugccca

SEQ ID NO: 2413970 - RNA, 22 nt, Human
cucuuagaugcaguucugaaga

SEQ ID NO: 2413971 - RNA, 14 nt, Human
cucuuagauggauu

SEQ ID NO: 2413972 - RNA, 21 nt, Human
cucuguccagggcccugagcu

SEQ ID NO: 2413973 - RNA, 20 nt, Human
cucuuauugcccacgcugga

SEQ ID NO: 2413974 - RNA, 19 nt, Human
cucuuauugcccacgcugg

SEQ ID NO: 2413975 - RNA, 15 nt, Human
cucuuauugcccacg

SEQ ID NO: 2413976 - RNA, 14 nt, Human
cucuuauugcccac

SEQ ID NO: 2413977 - RNA, 23 nt, Human
cucuggugagucuuggcggcagc

SEQ ID NO: 2413978 - RNA, 22 nt, Human
cucuggugagucuuggcggcag

SEQ ID NO: 2413979 - RNA, 21 nt, Human
cucuggugagucuuggcggca

SEQ ID NO: 2413980 - RNA, 20 nt, Human
cucuggugacaccagccuuu

SEQ ID NO: 2413981 - RNA, 20 nt, Human
cucuggucuucuuuggguaa

SEQ ID NO: 2413982 - RNA, 16 nt, Human
cucuggugacaccagc

SEQ ID NO: 2413983 - RNA, 18 nt, Human
cucuggugacaccagccu

SEQ ID NO: 2413984 - RNA, 19 nt, Human
cucuggugacaccagccuu

SEQ ID NO: 2413985 - RNA, 16 nt, Human
cucuggucgcuccugc

SEQ ID NO: 2413986 - RNA, 18 nt, Human
cucuggucgcuccugccc

SEQ ID NO: 2413987 - RNA, 17 nt, Human
cucuggucgcuccugcc

SEQ ID NO: 2413988 - RNA, 20 nt, Human
cucuggucgcuccugcccac

SEQ ID NO: 2413989 - RNA, 22 nt, Human
cucuggucugggugccccgucc

SEQ ID NO: 2413990 - RNA, 12 nt, Human
cucuguccaggc

SEQ ID NO: 2413991 - RNA, 20 nt, Human
cucugucagucacagccacc

SEQ ID NO: 2413992 - RNA, 13 nt, Human
cucugucagaugg

SEQ ID NO: 2413993 - RNA, 14 nt, Human
cucuguccaggcac

SEQ ID NO: 2413994 - RNA, 19 nt, Human
cucuguccaggcacugaga

SEQ ID NO: 2413995 - RNA, 14 nt, Human
cucuguccagggcc

SEQ ID NO: 2413996 - RNA, 20 nt, Human
cucuguccagggcccugagc

SEQ ID NO: 2413997 - RNA, 14 nt, Human
cucugucagucaca

SEQ ID NO: 2413998 - RNA, 16 nt, Human
cucugucagucacagc

SEQ ID NO: 2413999 - RNA, 17 nt, Human
cucugucagucacagcc

SEQ ID NO: 2414000 - RNA, 19 nt, Human
cucugucagucacagccac

SEQ ID NO: 2414001 - RNA, 18 nt, Human
cucugucacugcaggcac

SEQ ID NO: 2414002 - RNA, 23 nt, Human
cucugucagaugggaagacauga

SEQ ID NO: 2414003 - RNA, 16 nt, Human
cucugcugacagacac

SEQ ID NO: 2414004 - RNA, 14 nt, Human
cucugcugacagac

SEQ ID NO: 2414005 - RNA, 13 nt, Human
cucugcuccccag

SEQ ID NO: 2414006 - RNA, 13 nt, Human
cucugcucugcgu

SEQ ID NO: 2414007 - RNA, 13 nt, Human
cucugcugacaga

SEQ ID NO: 2414008 - RNA, 20 nt, Human
cucugggucagugguccaca

SEQ ID NO: 2414009 - RNA, 17 nt, Human
cucugggucaguggucc

SEQ ID NO: 2414010 - RNA, 20 nt, Human
cucuggggucccccaucccc

SEQ ID NO: 2414011 - RNA, 14 nt, Human
cucugcugaagguu

SEQ ID NO: 2414012 - RNA, 14 nt, Human
cucugguccauaga

SEQ ID NO: 2414013 - RNA, 17 nt, Human
cucugguaauauugacu

SEQ ID NO: 2414014 - RNA, 17 nt, Human
cucugcaggucccuaau

SEQ ID NO: 2414015 - RNA, 16 nt, Human
cucugcaggucccuaa

SEQ ID NO: 2414016 - RNA, 15 nt, Human
cucugcaggucccua

SEQ ID NO: 2414017 - RNA, 14 nt, Human
cucugcaggucccu

SEQ ID NO: 2414018 - RNA, 20 nt, Human
cucugcuccucuccccagca

SEQ ID NO: 2414019 - RNA, 18 nt, Human
cucugcuccucuccccag

SEQ ID NO: 2414020 - RNA, 13 nt, Human
cucugcuccucuc

SEQ ID NO: 2414021 - RNA, 19 nt, Human
cucugcuccaccacauccu

SEQ ID NO: 2414022 - RNA, 20 nt, Human
cucugcacuccccugcuggg

SEQ ID NO: 2414023 - RNA, 17 nt, Human
cucucccgguucuucca

SEQ ID NO: 2414024 - RNA, 23 nt, Human
cucucccggagguugggugggcc

SEQ ID NO: 2414025 - RNA, 18 nt, Human
cucugcacuccccugcug

SEQ ID NO: 2414026 - RNA, 21 nt, Human
cucugcacuccccugcugggu

SEQ ID NO: 2414027 - RNA, 13 nt, Human
cucugcagguccc

SEQ ID NO: 2414028 - RNA, 15 nt, Human
cucuccccugaccug

SEQ ID NO: 2414029 - RNA, 17 nt, Human
cucuccccugaccugug

SEQ ID NO: 2414030 - RNA, 21 nt, Human
cucuccccucagagugcaagc

SEQ ID NO: 2414031 - RNA, 18 nt, Human
cucucaggcaugccugug

SEQ ID NO: 2414032 - RNA, 19 nt, Human
cucucaggcaugccugugu

SEQ ID NO: 2414033 - RNA, 20 nt, Human
cucucaggcaugccugugug

SEQ ID NO: 2414034 - RNA, 21 nt, Human
cucuccccuggaacugucucu

SEQ ID NO: 2414035 - RNA, 15 nt, Human
cucuccccugcccug

SEQ ID NO: 2414036 - RNA, 16 nt, Human
cucuccccugcccugc

SEQ ID NO: 2414037 - RNA, 17 nt, Human
cucuccccugcccugcu

SEQ ID NO: 2414038 - RNA, 18 nt, Human
cucuccccugcccugcug

SEQ ID NO: 2414039 - RNA, 23 nt, Human
cucuugagccuugaacuuugacc

SEQ ID NO: 2414040 - RNA, 18 nt, Human
cucuugagccuugaacuu

SEQ ID NO: 2414041 - RNA, 16 nt, Human
cucuugagccuugaac

SEQ ID NO: 2414042 - RNA, 17 nt, Human
cucuugagccuugaacu

SEQ ID NO: 2414043 - RNA, 15 nt, Human
cugaaacaacaaaua

SEQ ID NO: 2414044 - RNA, 19 nt, Human
cucuuuuuguaccugguga

SEQ ID NO: 2414045 - RNA, 21 nt, Human
cucuuuuugggcuccuuuuuc

SEQ ID NO: 2414046 - RNA, 17 nt, Human
cucuuuuugggcuccuu

SEQ ID NO: 2414047 - RNA, 22 nt, Human
cugaaaauugaugggauuuggu

SEQ ID NO: 2414048 - RNA, 15 nt, Human
cugaaacaacuugga

SEQ ID NO: 2414049 - RNA, 16 nt, Human
cugaaacaacuuggaa

SEQ ID NO: 2414050 - RNA, 13 nt, Human
cugaaacaggaga

SEQ ID NO: 2414051 - RNA, 16 nt, Human
cugaaacccuggacca

SEQ ID NO: 2414052 - RNA, 20 nt, Human
cugaaacaacuuggaaagau

SEQ ID NO: 2414053 - RNA, 14 nt, Human
cugaaaccaguguu

SEQ ID NO: 2414054 - RNA, 14 nt, Human
cugaaacaggagag

SEQ ID NO: 2414055 - RNA, 13 nt, Human
cugaaacuucccu

SEQ ID NO: 2414056 - RNA, 22 nt, Human
cugaaacuuauuuuuuucugau

SEQ ID NO: 2414057 - RNA, 17 nt, Human
cugaaacuuacacacaa

SEQ ID NO: 2414058 - RNA, 23 nt, Human
cugaaacuuauuuuuuucugauu

SEQ ID NO: 2414059 - RNA, 14 nt, Human
cugaaagaaacagu

SEQ ID NO: 2414060 - RNA, 15 nt, Human
cugaaagaaacaguu

SEQ ID NO: 2414061 - RNA, 16 nt, Human
cugaaagaaacaguua

SEQ ID NO: 2414062 - RNA, 19 nt, Human
cugaaagaaacaguuaacu

SEQ ID NO: 2414063 - RNA, 20 nt, Human
cugaaagaaacaguuaacuu

SEQ ID NO: 2414064 - RNA, 21 nt, Human
cugaaagaaacaguuaacuuu

SEQ ID NO: 2414065 - RNA, 21 nt, Human
cucuugaugccuggcggggug

SEQ ID NO: 2414066 - RNA, 16 nt, Human
cucuugaugccuggcg

SEQ ID NO: 2414067 - RNA, 15 nt, Human
cucuugaugccuggc

SEQ ID NO: 2414068 - RNA, 13 nt, Human
cucuugaugccug

SEQ ID NO: 2414069 - RNA, 21 nt, Human
cucuuuugcuuuauuccagaa

SEQ ID NO: 2414070 - RNA, 13 nt, Human
cucuuuucucuuu

SEQ ID NO: 2414071 - RNA, 20 nt, Human
cucuuuugaauccaugcuug

SEQ ID NO: 2414072 - RNA, 18 nt, Human
cucuuuuuagggccaggc

SEQ ID NO: 2414073 - RNA, 18 nt, Human
cucuuuucuuuagagcau

SEQ ID NO: 2414074 - RNA, 11 nt, Human
cucuuuuuaag

SEQ ID NO: 2414075 - RNA, 22 nt, Human
cucuuuuuagggccaggcaggu

SEQ ID NO: 2414076 - RNA, 20 nt, Human
cucuuuuuagggccaggcag

SEQ ID NO: 2414077 - RNA, 16 nt, Human
cucuuuuuggaggugc

SEQ ID NO: 2414078 - RNA, 23 nt, Human
cucuugauaccccccucugucuu

SEQ ID NO: 2414079 - RNA, 21 nt, Human
cucuugauuauccauauugag

SEQ ID NO: 2414080 - RNA, 14 nt, Human
cucuuuucucugug

SEQ ID NO: 2414081 - RNA, 21 nt, Human
cugaaggccccgcccaggcuu

SEQ ID NO: 2414082 - RNA, 13 nt, Human
cugaaggccuggc

SEQ ID NO: 2414083 - RNA, 17 nt, Human
cugaaggcuggguucug

SEQ ID NO: 2414084 - RNA, 19 nt, Human
cugaaggccccgcccaggc

SEQ ID NO: 2414085 - RNA, 21 nt, Human
cugaaggagccccauuccugg

SEQ ID NO: 2414086 - RNA, 21 nt, Human
cugaaggagauuuuccuuccu

SEQ ID NO: 2414087 - RNA, 18 nt, Human
cugaaggccccgcccagg

SEQ ID NO: 2414088 - RNA, 23 nt, Human
cugacaacacucauugaccugag

SEQ ID NO: 2414089 - RNA, 22 nt, Human
cugacaacacucauugaccuga

SEQ ID NO: 2414090 - RNA, 21 nt, Human
cugaaggccuggcccacagca

SEQ ID NO: 2414091 - RNA, 18 nt, Human
cugacaaaaaguuuccau

SEQ ID NO: 2414092 - RNA, 12 nt, Human
cugaagcugagg

SEQ ID NO: 2414093 - RNA, 20 nt, Human
cugaagcugacgaacuucca

SEQ ID NO: 2414094 - RNA, 23 nt, Human
cugaagccuuugcauuuuggaga

SEQ ID NO: 2414095 - RNA, 23 nt, Human
cugaaggacauugcggacagcca

SEQ ID NO: 2414096 - RNA, 20 nt, Human
cugaaggagauuuuccuucc

SEQ ID NO: 2414097 - RNA, 18 nt, Human
cugaaggagauuuuccuu

SEQ ID NO: 2414098 - RNA, 16 nt, Human
cugaaggagauuuucc

SEQ ID NO: 2414099 - RNA, 12 nt, Human
cugaaggagauu

SEQ ID NO: 2414100 - RNA, 12 nt, Human
cugaaggagccc

SEQ ID NO: 2414101 - RNA, 13 nt, Human
cugaaggagcccc

SEQ ID NO: 2414102 - RNA, 15 nt, Human
cugaaggacugugac

SEQ ID NO: 2414103 - RNA, 14 nt, Human
cugaaggacuguga

SEQ ID NO: 2414104 - RNA, 13 nt, Human
cugaaggacugug

SEQ ID NO: 2414105 - RNA, 12 nt, Human
cugaaggacugu

SEQ ID NO: 2414106 - RNA, 22 nt, Human
cugaaggacugugacaggcagc

SEQ ID NO: 2414107 - RNA, 21 nt, Human
cugaaggacugugacaggcag

SEQ ID NO: 2414108 - RNA, 23 nt, Human
cugaaggacugugacaggcagca

SEQ ID NO: 2414109 - RNA, 12 nt, Human
cugaaggagaag

SEQ ID NO: 2414110 - RNA, 22 nt, Human
cugaagcuaucguaaaauuaag

SEQ ID NO: 2414111 - RNA, 21 nt, Human
cugaagcuaucguaaaauuaa

SEQ ID NO: 2414112 - RNA, 15 nt, Human
cugaaagacaauaua

SEQ ID NO: 2414113 - RNA, 12 nt, Human
cugaagccucug

SEQ ID NO: 2414114 - RNA, 15 nt, Human
cugaagccucuggga

SEQ ID NO: 2414115 - RNA, 14 nt, Human
cugaagccucuggg

SEQ ID NO: 2414116 - RNA, 13 nt, Human
cugaagccucugg

SEQ ID NO: 2414117 - RNA, 19 nt, Human
cugaaagaacauggacuug

SEQ ID NO: 2414118 - RNA, 13 nt, Human
cugaagccugcag

SEQ ID NO: 2414119 - RNA, 15 nt, Human
cugaagccugcagga

SEQ ID NO: 2414120 - RNA, 19 nt, Human
cugaagccuuucuuuugga

SEQ ID NO: 2414121 - RNA, 22 nt, Human
aagaucaaaagcuuauucaucu

SEQ ID NO: 2414122 - RNA, 13 nt, Human
aagauauuuuucc

SEQ ID NO: 2414123 - RNA, 23 nt, Human
aagaucaaaagguuaauaaagua

SEQ ID NO: 2414124 - RNA, 17 nt, Human
aagauauuuuuaucuuu

SEQ ID NO: 2414125 - RNA, 19 nt, Human
aagauauuuuuaucuuuau

SEQ ID NO: 2414126 - RNA, 17 nt, Human
aagauauuuuucaugau

SEQ ID NO: 2414127 - RNA, 15 nt, Human
aagauauuuuucaug

SEQ ID NO: 2414128 - RNA, 20 nt, Human
aagaucaaaagguuaauaaa

SEQ ID NO: 2414129 - RNA, 21 nt, Human
aagauuuuucucaaaguuuug

SEQ ID NO: 2414130 - RNA, 20 nt, Human
aagauuuuucucaaaguuuu

SEQ ID NO: 2414131 - RNA, 19 nt, Human
aagauuuuucucaaaguuu

SEQ ID NO: 2414132 - RNA, 22 nt, Human
aagauggcccagcuccccaaga

SEQ ID NO: 2414133 - RNA, 15 nt, Human
aagauuuuucucaaa

SEQ ID NO: 2414134 - RNA, 16 nt, Human
aagauggcugugccuc

SEQ ID NO: 2414135 - RNA, 17 nt, Human
aagauggcugacuuugc

SEQ ID NO: 2414136 - RNA, 15 nt, Human
aagauggaugugcuu

SEQ ID NO: 2414137 - RNA, 14 nt, Human
aagauggauucuca

SEQ ID NO: 2414138 - RNA, 16 nt, Human
aagauggauucucaga

SEQ ID NO: 2414139 - RNA, 17 nt, Human
aagauggauucucagau

SEQ ID NO: 2414140 - RNA, 21 nt, Human
aagauggauucucagauauuu

SEQ ID NO: 2414141 - RNA, 21 nt, Human
aagauggauugguguaaaagg

SEQ ID NO: 2414142 - RNA, 21 nt, Human
aagauggcccagcuccccaag

SEQ ID NO: 2414143 - RNA, 18 nt, Human
aagauggcauccugugaa

SEQ ID NO: 2414144 - RNA, 23 nt, Human
aagauggcacuuauaaccaaagc

SEQ ID NO: 2414145 - RNA, 13 nt, Human
guguauguggggg

SEQ ID NO: 2414146 - RNA, 21 nt, Human
guguaugugggggucugugug

SEQ ID NO: 2414147 - RNA, 17 nt, Human
aagcaacccaaauguuc

SEQ ID NO: 2414148 - RNA, 14 nt, Human
aagcaacagguuuu

SEQ ID NO: 2414149 - RNA, 14 nt, Human
aagcaaauugauga

SEQ ID NO: 2414150 - RNA, 20 nt, Human
aagcaaaugugaaucauuuu

SEQ ID NO: 2414151 - RNA, 14 nt, Human
aagcaaaauauuau

SEQ ID NO: 2414152 - RNA, 13 nt, Human
aagcaaaauauua

SEQ ID NO: 2414153 - RNA, 23 nt, Human
aagcaaaaucauuuuauauguca

SEQ ID NO: 2414154 - RNA, 17 nt, Human
aagcaaaaucauggaau

SEQ ID NO: 2414155 - RNA, 18 nt, Human
aagcaaaugugaccugug

SEQ ID NO: 2414156 - RNA, 22 nt, Human
gugucuuaauuaaaagaauauu

SEQ ID NO: 2414157 - RNA, 22 nt, Human
gugucuguacacguguccugua

SEQ ID NO: 2414158 - RNA, 21 nt, Human
gugucuguacacguguccugu

SEQ ID NO: 2414159 - RNA, 16 nt, Human
gugucuguacacgugu

SEQ ID NO: 2414160 - RNA, 13 nt, Human
gugucuguacacg

SEQ ID NO: 2414161 - RNA, 19 nt, Human
gugucagguggggcagcuu

SEQ ID NO: 2414162 - RNA, 12 nt, Human
gugucugggcug

SEQ ID NO: 2414163 - RNA, 12 nt, Human
gugucuguacac

SEQ ID NO: 2414164 - RNA, 23 nt, Human
gugucacuacucacagucucuuu

SEQ ID NO: 2414165 - RNA, 22 nt, Human
gugugaacuggacccuguugcu

SEQ ID NO: 2414166 - RNA, 17 nt, Human
gugugaacuggacccug

SEQ ID NO: 2414167 - RNA, 13 nt, Human
gugugaagguccu

SEQ ID NO: 2414168 - RNA, 21 nt, Human
gugugaaaggaagcuccacug

SEQ ID NO: 2414169 - RNA, 19 nt, Human
gugucuuaauuauuauuug

SEQ ID NO: 2414170 - RNA, 15 nt, Human
gugucuuaauuauua

SEQ ID NO: 2414171 - RNA, 14 nt, Human
gugugaacuggacc

SEQ ID NO: 2414172 - RNA, 18 nt, Human
gugugaaagucagaugcc

SEQ ID NO: 2414173 - RNA, 23 nt, Human
gugugaaccaccacacccagccc

SEQ ID NO: 2414174 - RNA, 14 nt, Human
gugucuuaauuauu

SEQ ID NO: 2414175 - RNA, 13 nt, Human
gugucugggcuga

SEQ ID NO: 2414176 - RNA, 13 nt, Human
gugucuguauuua

SEQ ID NO: 2414177 - RNA, 14 nt, Human
gugucuguauuuau

SEQ ID NO: 2414178 - RNA, 18 nt, Human
gugucagguggggcagcu

SEQ ID NO: 2414179 - RNA, 14 nt, Human
gugucagguggggc

SEQ ID NO: 2414180 - RNA, 23 nt, Human
gugucaaguugugcuuguuuaca

SEQ ID NO: 2414181 - RNA, 18 nt, Human
gugucaaguugugcuugu

SEQ ID NO: 2414182 - RNA, 14 nt, Human
gugucaccugugcu

SEQ ID NO: 2414183 - RNA, 22 nt, Human
gugucaccugaagacucauucu

SEQ ID NO: 2414184 - RNA, 13 nt, Human
guguauuccaaga

SEQ ID NO: 2414185 - RNA, 20 nt, Human
guguauuccaagacaugucu

SEQ ID NO: 2414186 - RNA, 16 nt, Human
guguauuaaaaaaaac

SEQ ID NO: 2414187 - RNA, 18 nt, Human
guguaugugcgugugugc

SEQ ID NO: 2414188 - RNA, 22 nt, Human
guguauguuugcacacuugugu

SEQ ID NO: 2414189 - RNA, 18 nt, Human
guguauguuugcacacuu

SEQ ID NO: 2414190 - RNA, 14 nt, Human
gugucaccugaaga

SEQ ID NO: 2414191 - RNA, 19 nt, Human
guguauucuaguuuuguca

SEQ ID NO: 2414192 - RNA, 17 nt, Human
guguauuuaacagggag

SEQ ID NO: 2414193 - RNA, 16 nt, Human
gugucaaguugugcuu

SEQ ID NO: 2414194 - RNA, 12 nt, Human
guguauuguucc

SEQ ID NO: 2414195 - RNA, 18 nt, Human
guguauuuaacagggagg

SEQ ID NO: 2414196 - RNA, 22 nt, Human
aagagggagggagggcuccaga

SEQ ID NO: 2414197 - RNA, 21 nt, Human
aagagggagggagggcuccag

SEQ ID NO: 2414198 - RNA, 22 nt, Human
aagagggaauccccgaaggugc

SEQ ID NO: 2414199 - RNA, 23 nt, Human
aagagggaagaaagagaaggagc

SEQ ID NO: 2414200 - RNA, 13 nt, Human
aagaggcugguuc

SEQ ID NO: 2414201 - RNA, 17 nt, Human
aagaggcuggugcugug

SEQ ID NO: 2414202 - RNA, 23 nt, Human
aagaggcccugucuguaccuaac

SEQ ID NO: 2414203 - RNA, 16 nt, Human
aagagggacgccuggg

SEQ ID NO: 2414204 - RNA, 17 nt, Human
aagagggacgccugggg

SEQ ID NO: 2414205 - RNA, 18 nt, Human
aagagggagauggagacu

SEQ ID NO: 2414206 - RNA, 19 nt, Human
aagagggagagguggagca

SEQ ID NO: 2414207 - RNA, 17 nt, Human
aagagggagaagcauga

SEQ ID NO: 2414208 - RNA, 18 nt, Human
aagagggagaagcaugaa

SEQ ID NO: 2414209 - RNA, 16 nt, Human
aagaggcagaaaauug

SEQ ID NO: 2414210 - RNA, 19 nt, Human
aagaggcagaaaauugcac

SEQ ID NO: 2414211 - RNA, 14 nt, Human
aagaggcgggccag

SEQ ID NO: 2414212 - RNA, 15 nt, Human
aagaggccaaugccc

SEQ ID NO: 2414213 - RNA, 14 nt, Human
aagaggcagggucu

SEQ ID NO: 2414214 - RNA, 15 nt, Human
aagaggcaccugucc

SEQ ID NO: 2414215 - RNA, 18 nt, Human
aagaggcaccugucccag

SEQ ID NO: 2414216 - RNA, 11 nt, Human
aagaggcaggg

SEQ ID NO: 2414217 - RNA, 16 nt, Human
aagaggugacugggcc

SEQ ID NO: 2414218 - RNA, 16 nt, Human
aagaggugugcaagag

SEQ ID NO: 2414219 - RNA, 18 nt, Human
aagaggugugcaagagag

SEQ ID NO: 2414220 - RNA, 19 nt, Human
aagagguagaaaagauugg

SEQ ID NO: 2414221 - RNA, 21 nt, Human
aagagguauuuaucuuuacuu

SEQ ID NO: 2414222 - RNA, 22 nt, Human
aagagggucugaggaauccaga

SEQ ID NO: 2414223 - RNA, 17 nt, Human
aagauauaagugcugua

SEQ ID NO: 2414224 - RNA, 16 nt, Human
aagauauaagugcugu

SEQ ID NO: 2414225 - RNA, 20 nt, Human
aagauauaacuauugcccag

SEQ ID NO: 2414226 - RNA, 15 nt, Human
aagauauaagugcug

SEQ ID NO: 2414227 - RNA, 13 nt, Human
aagauaggcucug

SEQ ID NO: 2414228 - RNA, 14 nt, Human
aagauaggcucugc

SEQ ID NO: 2414229 - RNA, 15 nt, Human
aagauaggcucugca

SEQ ID NO: 2414230 - RNA, 16 nt, Human
aagauaggcucugcac

SEQ ID NO: 2414231 - RNA, 17 nt, Human
aagauaggcucugcaca

SEQ ID NO: 2414232 - RNA, 18 nt, Human
aagauaggcucugcacag

SEQ ID NO: 2414233 - RNA, 15 nt, Human
aagauagcagggcau

SEQ ID NO: 2414234 - RNA, 17 nt, Human
aagauagcuucacccca

SEQ ID NO: 2414235 - RNA, 19 nt, Human
guguaaauaguuacuccag

SEQ ID NO: 2414236 - RNA, 15 nt, Human
guguaacagcuccuu

SEQ ID NO: 2414237 - RNA, 14 nt, Human
guguaacagcuccu

SEQ ID NO: 2414238 - RNA, 13 nt, Human
guguaacagcucc

SEQ ID NO: 2414239 - RNA, 23 nt, Human
guguaacagcuccuugggaggaa

SEQ ID NO: 2414240 - RNA, 12 nt, Human
guguaacagcug

SEQ ID NO: 2414241 - RNA, 15 nt, Human
guguaacagcugagg

SEQ ID NO: 2414242 - RNA, 21 nt, Human
guguaacagcugaggucucuu

SEQ ID NO: 2414243 - RNA, 23 nt, Human
guguaacugucagccgggcccug

SEQ ID NO: 2414244 - RNA, 18 nt, Human
guguaacuggcaguuuuc

SEQ ID NO: 2414245 - RNA, 17 nt, Human
guguaacaggucuccuc

SEQ ID NO: 2414246 - RNA, 19 nt, Human
guguaacaggucuccucuu

SEQ ID NO: 2414247 - RNA, 19 nt, Human
guguaaaguuagucuacuc

SEQ ID NO: 2414248 - RNA, 16 nt, Human
guguaaaguuagucua

SEQ ID NO: 2414249 - RNA, 13 nt, Human
guguaaaguuagu

SEQ ID NO: 2414250 - RNA, 21 nt, Human
guguaaagcauuccaacaaag

SEQ ID NO: 2414251 - RNA, 12 nt, Human
guguaaagcauu

SEQ ID NO: 2414252 - RNA, 22 nt, Human
guguaaaccaaagcccuaaaau

SEQ ID NO: 2414253 - RNA, 15 nt, Human
guguaaaccaaagcc

SEQ ID NO: 2414254 - RNA, 15 nt, Human
guguaaaaugugaag

SEQ ID NO: 2414255 - RNA, 19 nt, Human
guguaaaauauuuugaauc

SEQ ID NO: 2414256 - RNA, 18 nt, Human
guguaaaauauuuugaau

SEQ ID NO: 2414257 - RNA, 17 nt, Human
guguaaaauauuuugaa

SEQ ID NO: 2414258 - RNA, 23 nt, Human
guguaaaacgagaauccacccau

SEQ ID NO: 2414259 - RNA, 20 nt, Human
gugguugcuguuuuccuccc

SEQ ID NO: 2414260 - RNA, 19 nt, Human
gugguugcuguuuuccucc

SEQ ID NO: 2414261 - RNA, 22 nt, Human
gugguucacucuuggagccugc

SEQ ID NO: 2414262 - RNA, 23 nt, Human
gugguucacucuuggagccugca

SEQ ID NO: 2414263 - RNA, 23 nt, Human
gugcugcuacccucccugcuguc

SEQ ID NO: 2414264 - RNA, 22 nt, Human
gugcugcuacccucccugcugu

SEQ ID NO: 2414265 - RNA, 14 nt, Human
gugcugcugcugcu

SEQ ID NO: 2414266 - RNA, 15 nt, Human
gugguuucagaaaug

SEQ ID NO: 2414267 - RNA, 18 nt, Human
gugguugcuguuuuccuc

SEQ ID NO: 2414268 - RNA, 18 nt, Human
gugguuccccaccgaagu

SEQ ID NO: 2414269 - RNA, 13 nt, Human
gugcugcugaaga

SEQ ID NO: 2414270 - RNA, 20 nt, Human
gugcucucugccacuggaag

SEQ ID NO: 2414271 - RNA, 13 nt, Human
gugcucucugcca

SEQ ID NO: 2414272 - RNA, 23 nt, Human
gugcugcccugcccaccuggccu

SEQ ID NO: 2414273 - RNA, 21 nt, Human
gugcugcuacccucccugcug

SEQ ID NO: 2414274 - RNA, 19 nt, Human
gugcugcuacccucccugc

SEQ ID NO: 2414275 - RNA, 18 nt, Human
gugcugcuacccucccug

SEQ ID NO: 2414276 - RNA, 17 nt, Human
gugcugcuacccucccu

SEQ ID NO: 2414277 - RNA, 15 nt, Human
gugcugcuacccucc

SEQ ID NO: 2414278 - RNA, 11 nt, Human
gugcugccucu

SEQ ID NO: 2414279 - RNA, 12 nt, Human
gugcugccucua

SEQ ID NO: 2414280 - RNA, 19 nt, Human
gugcugccucuaccugaca

SEQ ID NO: 2414281 - RNA, 16 nt, Human
aagcacuaaacaaaga

SEQ ID NO: 2414282 - RNA, 17 nt, Human
aagcaccuccugccucg

SEQ ID NO: 2414283 - RNA, 14 nt, Human
aagcaccccaugcc

SEQ ID NO: 2414284 - RNA, 19 nt, Human
aagcaccgccuccaaaugc

SEQ ID NO: 2414285 - RNA, 12 nt, Human
aagcacccuuga

SEQ ID NO: 2414286 - RNA, 12 nt, Human
aagcaccugccg

SEQ ID NO: 2414287 - RNA, 13 nt, Human
aagcaccugccga

SEQ ID NO: 2414288 - RNA, 17 nt, Human
aagcaccugccgaccuc

SEQ ID NO: 2414289 - RNA, 16 nt, Human
aagcacugacuucuaa

SEQ ID NO: 2414290 - RNA, 17 nt, Human
aagcacugacuucuaag

SEQ ID NO: 2414291 - RNA, 19 nt, Human
aagcaccuuagcuggcauu

SEQ ID NO: 2414292 - RNA, 15 nt, Human
aagcacgaaauguua

SEQ ID NO: 2414293 - RNA, 16 nt, Human
aagcaccuuagcuggc

SEQ ID NO: 2414294 - RNA, 20 nt, Human
aagcaccugccgaccucguc

SEQ ID NO: 2414295 - RNA, 17 nt, Human
aagcacuacauaaacug

SEQ ID NO: 2414296 - RNA, 23 nt, Human
aagcacuacauaaacugacuuua

SEQ ID NO: 2414297 - RNA, 16 nt, Human
aagcaccuccugccuc

SEQ ID NO: 2414298 - RNA, 15 nt, Human
aagcaccuccugccu

SEQ ID NO: 2414299 - RNA, 14 nt, Human
aagcaccuccugcc

SEQ ID NO: 2414300 - RNA, 13 nt, Human
aagcaccuccugc

SEQ ID NO: 2414301 - RNA, 16 nt, Human
aagcaccaaaauaaga

SEQ ID NO: 2414302 - RNA, 17 nt, Human
aagcaccaaaauaagaa

SEQ ID NO: 2414303 - RNA, 19 nt, Human
aagcaccaaaauaagaaaa

SEQ ID NO: 2414304 - RNA, 21 nt, Human
aagcaccaaaauaagaaaaga

SEQ ID NO: 2414305 - RNA, 19 nt, Human
aagcaccagcuucuccagg

SEQ ID NO: 2414306 - RNA, 14 nt, Human
aagcaccaagcuca

SEQ ID NO: 2414307 - RNA, 22 nt, Human
aagcaccaaaauaagaaaagau

SEQ ID NO: 2414308 - RNA, 21 nt, Human
aagcaccagcuucuccaggcu

SEQ ID NO: 2414309 - RNA, 20 nt, Human
aagcaccagcuucuccaggc

SEQ ID NO: 2414310 - RNA, 21 nt, Human
aagcacaugccucucucaggc

SEQ ID NO: 2414311 - RNA, 17 nt, Human
aagcacaguuugaacaa

SEQ ID NO: 2414312 - RNA, 16 nt, Human
aagcacaguuugaaca

SEQ ID NO: 2414313 - RNA, 16 nt, Human
aagcacauauugagca

SEQ ID NO: 2414314 - RNA, 16 nt, Human
aagcacauguuuauuu

SEQ ID NO: 2414315 - RNA, 18 nt, Human
aagcacaguuugaacaaa

SEQ ID NO: 2414316 - RNA, 16 nt, Human
aagcacaucugcauuu

SEQ ID NO: 2414317 - RNA, 20 nt, Human
aagcacaugccucucucagg

SEQ ID NO: 2414318 - RNA, 19 nt, Human
aagcacaugccucucucag

SEQ ID NO: 2414319 - RNA, 16 nt, Human
aagcacaugccucucu

SEQ ID NO: 2414320 - RNA, 15 nt, Human
aagcacaugccucuc

SEQ ID NO: 2414321 - RNA, 15 nt, Human
aagcacaguuugaac

SEQ ID NO: 2414322 - RNA, 14 nt, Human
aagcacaguuugaa

SEQ ID NO: 2414323 - RNA, 20 nt, Human
aagcacaguguuaaaugaaa

SEQ ID NO: 2414324 - RNA, 18 nt, Human
aagcacaguguuaaauga

SEQ ID NO: 2414325 - RNA, 13 nt, Human
aagcacaguguua

SEQ ID NO: 2414326 - RNA, 24 nt, Human
aagcacagugguggcagggccuag

SEQ ID NO: 2414327 - RNA, 23 nt, Human
aagcacagugguggcagggccua

SEQ ID NO: 2414328 - RNA, 20 nt, Human
aagcacagugguggcagggc

SEQ ID NO: 2414329 - RNA, 14 nt, Human
aagcacaugccucu

SEQ ID NO: 2414330 - RNA, 11 nt, Human
aagcacagcag

SEQ ID NO: 2414331 - RNA, 16 nt, Human
aagcacagcagccugg

SEQ ID NO: 2414332 - RNA, 19 nt, Human
aagcacagugguggcaggg

SEQ ID NO: 2414333 - RNA, 18 nt, Human
aagcacagugguggcagg

SEQ ID NO: 2414334 - RNA, 14 nt, Human
aagcacaguggugg

SEQ ID NO: 2414335 - RNA, 13 nt, Human
aagcacaguggug

SEQ ID NO: 2414336 - RNA, 20 nt, Human
aagcacagucugaugacaca

SEQ ID NO: 2414337 - RNA, 12 nt, Human
aagcacaguggu

SEQ ID NO: 2414338 - RNA, 15 nt, Human
aagcacagugccugc

SEQ ID NO: 2414339 - RNA, 12 nt, Human
guguuucuguau

SEQ ID NO: 2414340 - RNA, 15 nt, Human
guguuucuguuauua

SEQ ID NO: 2414341 - RNA, 13 nt, Human
guguuucugugca

SEQ ID NO: 2414342 - RNA, 22 nt, Human
guguuucucccucucacugucu

SEQ ID NO: 2414343 - RNA, 16 nt, Human
guguuucuuuaguuuu

SEQ ID NO: 2414344 - RNA, 13 nt, Human
guguuucuuuagu

SEQ ID NO: 2414345 - RNA, 21 nt, Human
guguuucucccucucacuguc

SEQ ID NO: 2414346 - RNA, 13 nt, Human
guguuucucccuc

SEQ ID NO: 2414347 - RNA, 13 nt, Human
guguuucugacuc

SEQ ID NO: 2414348 - RNA, 17 nt, Human
guguuucuauugacuuc

SEQ ID NO: 2414349 - RNA, 15 nt, Human
guguuucuagggaaa

SEQ ID NO: 2414350 - RNA, 13 nt, Human
gugugaaguuaga

SEQ ID NO: 2414351 - RNA, 12 nt, Human
gugugaaguuag

SEQ ID NO: 2414352 - RNA, 11 nt, Human
gugugaaguua

SEQ ID NO: 2414353 - RNA, 18 nt, Human
gugugaagguccugcuau

SEQ ID NO: 2414354 - RNA, 21 nt, Human
gugugaaguuagaauuccuuc

SEQ ID NO: 2414355 - RNA, 17 nt, Human
gugugaaguuagaauuc

SEQ ID NO: 2414356 - RNA, 22 nt, Human
guguuugcacguuaugguguuu

SEQ ID NO: 2414357 - RNA, 20 nt, Human
aagcaauuuuccuugaagcc

SEQ ID NO: 2414358 - RNA, 19 nt, Human
aagcaauuuuccuugaagc

SEQ ID NO: 2414359 - RNA, 18 nt, Human
aagcaauuuuccuugaag

SEQ ID NO: 2414360 - RNA, 22 nt, Human
aagcaauuuuccuugaagccga

SEQ ID NO: 2414361 - RNA, 21 nt, Human
aagcaauuuuccuugaagccg

SEQ ID NO: 2414362 - RNA, 13 nt, Human
aagcacaagaagc

SEQ ID NO: 2414363 - RNA, 16 nt, Human
aagcacacuugacauc

SEQ ID NO: 2414364 - RNA, 19 nt, Human
aagcacagaaggaggagga

SEQ ID NO: 2414365 - RNA, 19 nt, Human
aagcacacucauccccuca

SEQ ID NO: 2414366 - RNA, 20 nt, Human
aagccaaagcuaggccuggc

SEQ ID NO: 2414367 - RNA, 13 nt, Human
aagccaagcagcc

SEQ ID NO: 2414368 - RNA, 13 nt, Human
aagccaaagccaa

SEQ ID NO: 2414369 - RNA, 14 nt, Human
aagccaagcagcca

SEQ ID NO: 2414370 - RNA, 16 nt, Human
aagccaagcagccaag

SEQ ID NO: 2414371 - RNA, 16 nt, Human
aagccaagggaaaggg

SEQ ID NO: 2414372 - RNA, 14 nt, Human
aagccaagggaaag

SEQ ID NO: 2414373 - RNA, 13 nt, Human
aagccaagggaaa

SEQ ID NO: 2414374 - RNA, 17 nt, Human
aagccaagcagccaagc

SEQ ID NO: 2414375 - RNA, 18 nt, Human
aagccaaagcuaggccug

SEQ ID NO: 2414376 - RNA, 17 nt, Human
aagccaaagcuaggccu

SEQ ID NO: 2414377 - RNA, 19 nt, Human
aagccaauccccuccuugg

SEQ ID NO: 2414378 - RNA, 16 nt, Human
aagccaauccccuccu

SEQ ID NO: 2414379 - RNA, 15 nt, Human
aagccaauccccucc

SEQ ID NO: 2414380 - RNA, 14 nt, Human
aagccaauccccuc

SEQ ID NO: 2414381 - RNA, 19 nt, Human
aagccaagggaaccugugu

SEQ ID NO: 2414382 - RNA, 18 nt, Human
aagccaagggaaccugug

SEQ ID NO: 2414383 - RNA, 20 nt, Human
aagccaagggaaccuguguc

SEQ ID NO: 2414384 - RNA, 23 nt, Human
aagccaagggaaaggggugcuuu

SEQ ID NO: 2414385 - RNA, 13 nt, Human
aagccaagggccu

SEQ ID NO: 2414386 - RNA, 20 nt, Human
aagccaauaacacacagcua

SEQ ID NO: 2414387 - RNA, 18 nt, Human
aagccaauaacacacagc

SEQ ID NO: 2414388 - RNA, 17 nt, Human
aagccaauaacacacag

SEQ ID NO: 2414389 - RNA, 19 nt, Human
aagccaaguggggugcugg

SEQ ID NO: 2414390 - RNA, 16 nt, Human
aagccaagggccucuu

SEQ ID NO: 2414391 - RNA, 13 nt, Human
aagccaagugggg

SEQ ID NO: 2414392 - RNA, 22 nt, Human
aagccaagucagcuuugccuuc

SEQ ID NO: 2414393 - RNA, 19 nt, Human
aagcauuguaaaugugcuu

SEQ ID NO: 2414394 - RNA, 20 nt, Human
aagcauguuucauguuuugu

SEQ ID NO: 2414395 - RNA, 16 nt, Human
aagcauguuucauguu

SEQ ID NO: 2414396 - RNA, 17 nt, Human
aagcauuaacuucucug

SEQ ID NO: 2414397 - RNA, 22 nt, Human
aagcauuguuugcuuauuguuc

SEQ ID NO: 2414398 - RNA, 23 nt, Human
aagcauuguuugcuuauuguucc

SEQ ID NO: 2414399 - RNA, 11 nt, Human
aagcauuguuu

SEQ ID NO: 2414400 - RNA, 14 nt, Human
aagcauuguuugcu

SEQ ID NO: 2414401 - RNA, 20 nt, Human
aagcauuguuugcuuauugu

SEQ ID NO: 2414402 - RNA, 21 nt, Human
aagcauuguuugcuuauuguu

SEQ ID NO: 2414403 - RNA, 20 nt, Human
aagcauuuaauguagccaug

SEQ ID NO: 2414404 - RNA, 19 nt, Human
aagcauuuaauguagccau

SEQ ID NO: 2414405 - RNA, 23 nt, Human
aagcauuuaauguagccauggga

SEQ ID NO: 2414406 - RNA, 16 nt, Human
aagcauuuacuuugaa

SEQ ID NO: 2414407 - RNA, 17 nt, Human
aagcauuugaaugcauu

SEQ ID NO: 2414408 - RNA, 12 nt, Human
aagcauuuuaua

SEQ ID NO: 2414409 - RNA, 14 nt, Human
aagcauuuuauaaa

SEQ ID NO: 2414410 - RNA, 15 nt, Human
aagcauuuuauaaau

SEQ ID NO: 2414411 - RNA, 21 nt, Human
aagcauuugaaugcauuuugu

SEQ ID NO: 2414412 - RNA, 18 nt, Human
aagcauuugaaugcauuu

SEQ ID NO: 2414413 - RNA, 17 nt, Human
aagcauuuuauaaaucg

SEQ ID NO: 2414414 - RNA, 19 nt, Human
aagcauuuuauaaaucgcu

SEQ ID NO: 2414415 - RNA, 21 nt, Human
aagcauuuuauaaaucgcuuu

SEQ ID NO: 2414416 - RNA, 12 nt, Human
aagccaaagagu

SEQ ID NO: 2414417 - RNA, 16 nt, Human
aagccaaagacuuagu

SEQ ID NO: 2414418 - RNA, 19 nt, Human
aagcacugacuucuaagua

SEQ ID NO: 2414419 - RNA, 20 nt, Human
aagcacugacuucuaaguaa

SEQ ID NO: 2414420 - RNA, 12 nt, Human
aagcacugugcu

SEQ ID NO: 2414421 - RNA, 23 nt, Human
aagcacugcuaggcgagugccag

SEQ ID NO: 2414422 - RNA, 19 nt, Human
aagcacugcuaggcgagug

SEQ ID NO: 2414423 - RNA, 16 nt, Human
aagcacugaccuguca

SEQ ID NO: 2414424 - RNA, 21 nt, Human
aagcacugaccugucaugccc

SEQ ID NO: 2414425 - RNA, 19 nt, Human
aagcauauguguuggcuug

SEQ ID NO: 2414426 - RNA, 17 nt, Human
aagcauauuguuauuau

SEQ ID NO: 2414427 - RNA, 23 nt, Human
aagcauauuguuauuauauaauu

SEQ ID NO: 2414428 - RNA, 14 nt, Human
aagcaucaaacucu

SEQ ID NO: 2414429 - RNA, 15 nt, Human
aagcaucaccucagg

SEQ ID NO: 2414430 - RNA, 16 nt, Human
aagcaucaccucaggc

SEQ ID NO: 2414431 - RNA, 18 nt, Human
aagcaucaccucaggcca

SEQ ID NO: 2414432 - RNA, 19 nt, Human
aagcaucaccucaggccag

SEQ ID NO: 2414433 - RNA, 21 nt, Human
aagcaucuuccagaaguguga

SEQ ID NO: 2414434 - RNA, 23 nt, Human
aagcaucaccucaggccaggugc

SEQ ID NO: 2414435 - RNA, 15 nt, Human
aagcaucaaacucuu

SEQ ID NO: 2414436 - RNA, 15 nt, Human
aagcauguacagugu

SEQ ID NO: 2414437 - RNA, 13 nt, Human
aagcauguacagu

SEQ ID NO: 2414438 - RNA, 12 nt, Human
aagcauguacag

SEQ ID NO: 2414439 - RNA, 23 nt, Human
aagcaugcacaaauucugucucu

SEQ ID NO: 2414440 - RNA, 20 nt, Human
aagcaucuuggggggguggc

SEQ ID NO: 2414441 - RNA, 13 nt, Human
aagcaugaaaaag

SEQ ID NO: 2414442 - RNA, 12 nt, Human
aagcaugugaga

SEQ ID NO: 2414443 - RNA, 21 nt, Human
aagcauguacaguguucuguu

SEQ ID NO: 2414444 - RNA, 18 nt, Human
aagcauguacaguguucu

SEQ ID NO: 2414445 - RNA, 17 nt, Human
aagcauguacaguguuc

SEQ ID NO: 2414446 - RNA, 16 nt, Human
aagcauguacaguguu

SEQ ID NO: 2414447 - RNA, 18 nt, Human
aagcauguauucagcuuu

SEQ ID NO: 2414448 - RNA, 22 nt, Human
aagcauguacaguguucuguuu

SEQ ID NO: 2414449 - RNA, 16 nt, Human
aagcauguaggagaau

SEQ ID NO: 2414450 - RNA, 18 nt, Human
aagcauuguaaaugugcu

SEQ ID NO: 2414451 - RNA, 17 nt, Human
aagcaugucucaauagu

SEQ ID NO: 2414452 - RNA, 13 nt, Human
aagcauguggcau

SEQ ID NO: 2414453 - RNA, 19 nt, Human
aagcauguggcauguucau

SEQ ID NO: 2414454 - RNA, 15 nt, Human
aagcauguuucaugu

SEQ ID NO: 2414455 - RNA, 14 nt, Human
aagcauguuucaug

SEQ ID NO: 2414456 - RNA, 12 nt, Human
aagcauguuuca

SEQ ID NO: 2414457 - RNA, 14 nt, Human
guuaauuuuuccua

SEQ ID NO: 2414458 - RNA, 23 nt, Human
guuacucuucaguuaagccuuug

SEQ ID NO: 2414459 - RNA, 18 nt, Human
guuaauucagcacugauu

SEQ ID NO: 2414460 - RNA, 14 nt, Human
guuacucugguucu

SEQ ID NO: 2414461 - RNA, 17 nt, Human
guuacugaucaugcauu

SEQ ID NO: 2414462 - RNA, 18 nt, Human
guuacugaucaugcauug

SEQ ID NO: 2414463 - RNA, 19 nt, Human
guuacugaucaugcauugu

SEQ ID NO: 2414464 - RNA, 21 nt, Human
guuaauucagcacugauuuca

SEQ ID NO: 2414465 - RNA, 22 nt, Human
guuaaucaauuuaaacccauuu

SEQ ID NO: 2414466 - RNA, 21 nt, Human
guuaaucaauuuaaacccauu

SEQ ID NO: 2414467 - RNA, 17 nt, Human
guuaaucaauuuaaacc

SEQ ID NO: 2414468 - RNA, 19 nt, Human
guuaauuccaauuauauga

SEQ ID NO: 2414469 - RNA, 18 nt, Human
guuaaucauuagguguga

SEQ ID NO: 2414470 - RNA, 19 nt, Human
guuaauauuuauaggucac

SEQ ID NO: 2414471 - RNA, 14 nt, Human
guuaaucaauuuaa

SEQ ID NO: 2414472 - RNA, 13 nt, Human
guuaaucaauuua

SEQ ID NO: 2414473 - RNA, 12 nt, Human
guuaaucaauuu

SEQ ID NO: 2414474 - RNA, 14 nt, Human
aagccauugucuuc

SEQ ID NO: 2414475 - RNA, 13 nt, Human
aagccauugucuu

SEQ ID NO: 2414476 - RNA, 16 nt, Human
aagcccaaccuccuga

SEQ ID NO: 2414477 - RNA, 18 nt, Human
aagcccaauauuauaauu

SEQ ID NO: 2414478 - RNA, 17 nt, Human
aagcccaaccuccugac

SEQ ID NO: 2414479 - RNA, 22 nt, Human
aagcccaaccuccugaccuguc

SEQ ID NO: 2414480 - RNA, 12 nt, Human
aagccauugucu

SEQ ID NO: 2414481 - RNA, 20 nt, Human
aagccaauccccuccuuggg

SEQ ID NO: 2414482 - RNA, 20 nt, Human
aagccauucuaaggaaauua

SEQ ID NO: 2414483 - RNA, 18 nt, Human
aagcccagaaaaggacag

SEQ ID NO: 2414484 - RNA, 20 nt, Human
aagcccagcacugcuugagg

SEQ ID NO: 2414485 - RNA, 23 nt, Human
aagcccagcacugcuugaggaaa

SEQ ID NO: 2414486 - RNA, 13 nt, Human
aagcccagcuuga

SEQ ID NO: 2414487 - RNA, 21 nt, Human
guuaauauaucccagaaauua

SEQ ID NO: 2414488 - RNA, 12 nt, Human
guuaauacuagu

SEQ ID NO: 2414489 - RNA, 15 nt, Human
guuaauauuuaagac

SEQ ID NO: 2414490 - RNA, 15 nt, Human
guuaauaaauuaaaa

SEQ ID NO: 2414491 - RNA, 12 nt, Human
guuaauaaaagu

SEQ ID NO: 2414492 - RNA, 19 nt, Human
guuauuauauuuacaaaug

SEQ ID NO: 2414493 - RNA, 19 nt, Human
guuagagguucccuuugac

SEQ ID NO: 2414494 - RNA, 13 nt, Human
guuagaauuccuu

SEQ ID NO: 2414495 - RNA, 14 nt, Human
guuacuguugugac

SEQ ID NO: 2414496 - RNA, 16 nt, Human
guuacuguugugaccu

SEQ ID NO: 2414497 - RNA, 12 nt, Human
guuagaauuccu

SEQ ID NO: 2414498 - RNA, 18 nt, Human
guuagacucuuacuuuuu

SEQ ID NO: 2414499 - RNA, 20 nt, Human
guuagaauuccuucagggug

SEQ ID NO: 2414500 - RNA, 13 nt, Human
guuacuguaauuc

SEQ ID NO: 2414501 - RNA, 16 nt, Human
guuacuguuauagagg

SEQ ID NO: 2414502 - RNA, 14 nt, Human
guuauugcaguuua

SEQ ID NO: 2414503 - RNA, 13 nt, Human
guuauugcaguuu

SEQ ID NO: 2414504 - RNA, 22 nt, Human
guuagagguuuuaaagugauua

SEQ ID NO: 2414505 - RNA, 20 nt, Human
guuauuauauuuacaaaugg

SEQ ID NO: 2414506 - RNA, 17 nt, Human
guuauuauauuuacaaa

SEQ ID NO: 2414507 - RNA, 15 nt, Human
guuauuuucaguauu

SEQ ID NO: 2414508 - RNA, 14 nt, Human
guuauuuucaguau

SEQ ID NO: 2414509 - RNA, 12 nt, Human
guuauuuucagu

SEQ ID NO: 2414510 - RNA, 19 nt, Human
guuauuuuaguuucuguuc

SEQ ID NO: 2414511 - RNA, 21 nt, Human
guuauuuuauugauuauuacu

SEQ ID NO: 2414512 - RNA, 15 nt, Human
guuauuuuaguuucu

SEQ ID NO: 2414513 - RNA, 13 nt, Human
guuauuuuaguuu

SEQ ID NO: 2414514 - RNA, 19 nt, Human
guuauuuguuauuuucagu

SEQ ID NO: 2414515 - RNA, 18 nt, Human
guuauuuguuauuuucag

SEQ ID NO: 2414516 - RNA, 17 nt, Human
guuauuuguuuaccacu

SEQ ID NO: 2414517 - RNA, 17 nt, Human
guuauuguacagcuguu

SEQ ID NO: 2414518 - RNA, 13 nt, Human
guuauuuaaagaa

SEQ ID NO: 2414519 - RNA, 10 nt, Human
guuauuuaaa

SEQ ID NO: 2414520 - RNA, 23 nt, Human
guuauugcaguuuaucauucaag

SEQ ID NO: 2414521 - RNA, 16 nt, Human
guuauugcaguuuauc

SEQ ID NO: 2414522 - RNA, 21 nt, Human
guuauugggcaagugauugaa

SEQ ID NO: 2414523 - RNA, 20 nt, Human
guuauugggcaagugauuga

SEQ ID NO: 2414524 - RNA, 23 nt, Human
guuauuuucuuugaaauuguuua

SEQ ID NO: 2414525 - RNA, 14 nt, Human
guuauuuucuacag

SEQ ID NO: 2414526 - RNA, 17 nt, Human
guuauuuucaguauuuu

SEQ ID NO: 2414527 - RNA, 12 nt, Human
guuauuuucuac

SEQ ID NO: 2414528 - RNA, 17 nt, Human
guuauuuucuacagugg

SEQ ID NO: 2414529 - RNA, 15 nt, Human
guuauuuucuacagu

SEQ ID NO: 2414530 - RNA, 20 nt, Human
guuauuuucuacagugguuu

SEQ ID NO: 2414531 - RNA, 23 nt, Human
guucagcuuguaaauagcucagg

SEQ ID NO: 2414532 - RNA, 12 nt, Human
guucagcuuggg

SEQ ID NO: 2414533 - RNA, 15 nt, Human
guucaggagucccaa

SEQ ID NO: 2414534 - RNA, 18 nt, Human
guucaggagucccaagga

SEQ ID NO: 2414535 - RNA, 22 nt, Human
guucaggguuggccccugcccg

SEQ ID NO: 2414536 - RNA, 21 nt, Human
guucaggguuggccccugccc

SEQ ID NO: 2414537 - RNA, 15 nt, Human
guucagcugccccac

SEQ ID NO: 2414538 - RNA, 20 nt, Human
guucaggagucccaaggaaa

SEQ ID NO: 2414539 - RNA, 21 nt, Human
guucaggagucccaaggaaag

SEQ ID NO: 2414540 - RNA, 20 nt, Human
guucaggguuggccccugcc

SEQ ID NO: 2414541 - RNA, 22 nt, Human
guucaguggcagggcucaggau

SEQ ID NO: 2414542 - RNA, 21 nt, Human
guucaguggcagggcucagga

SEQ ID NO: 2414543 - RNA, 12 nt, Human
guucaguguaau

SEQ ID NO: 2414544 - RNA, 16 nt, Human
guucaguguaaauagu

SEQ ID NO: 2414545 - RNA, 13 nt, Human
guucaguguaauu

SEQ ID NO: 2414546 - RNA, 22 nt, Human
aagccgugcucgccccagcagg

SEQ ID NO: 2414547 - RNA, 21 nt, Human
aagccgugauuuucauugcug

SEQ ID NO: 2414548 - RNA, 14 nt, Human
aagccguggcuucc

SEQ ID NO: 2414549 - RNA, 13 nt, Human
aagccguggcuuc

SEQ ID NO: 2414550 - RNA, 15 nt, Human
aagccguggcuuccc

SEQ ID NO: 2414551 - RNA, 22 nt, Human
aagccguuguuuacuuaaagau

SEQ ID NO: 2414552 - RNA, 14 nt, Human
aagccgugcccugc

SEQ ID NO: 2414553 - RNA, 18 nt, Human
guucagguaacaggcaga

SEQ ID NO: 2414554 - RNA, 17 nt, Human
guucagguaacaggcag

SEQ ID NO: 2414555 - RNA, 13 nt, Human
guucaguaccugg

SEQ ID NO: 2414556 - RNA, 19 nt, Human
guucaggggacucagcccu

SEQ ID NO: 2414557 - RNA, 13 nt, Human
guucagguagcug

SEQ ID NO: 2414558 - RNA, 15 nt, Human
guucaggggacucag

SEQ ID NO: 2414559 - RNA, 18 nt, Human
guucaggggacucagccc

SEQ ID NO: 2414560 - RNA, 17 nt, Human
guucaguaccuggagga

SEQ ID NO: 2414561 - RNA, 14 nt, Human
guucaguaccugga

SEQ ID NO: 2414562 - RNA, 20 nt, Human
guucaguggcagggcucagg

SEQ ID NO: 2414563 - RNA, 18 nt, Human
guucaguggcagggcuca

SEQ ID NO: 2414564 - RNA, 16 nt, Human
guucaguaccuggagg

SEQ ID NO: 2414565 - RNA, 17 nt, Human
guucaguggcagggcuc

SEQ ID NO: 2414566 - RNA, 16 nt, Human
aagccucccacgacug

SEQ ID NO: 2414567 - RNA, 14 nt, Human
aagccucauauuua

SEQ ID NO: 2414568 - RNA, 20 nt, Human
aagccucauauuuaaagaca

SEQ ID NO: 2414569 - RNA, 19 nt, Human
aagccuccauuuaguucuu

SEQ ID NO: 2414570 - RNA, 18 nt, Human
aagccuggucagcccaaa

SEQ ID NO: 2414571 - RNA, 15 nt, Human
aagccuccuccagcc

SEQ ID NO: 2414572 - RNA, 15 nt, Human
aagccuguuuaagag

SEQ ID NO: 2414573 - RNA, 21 nt, Human
aagccuguauucucaaacaca

SEQ ID NO: 2414574 - RNA, 14 nt, Human
aagccuccccagcu

SEQ ID NO: 2414575 - RNA, 20 nt, Human
aagccuccauuuaguucuuu

SEQ ID NO: 2414576 - RNA, 22 nt, Human
aagccuccauuuaguucuuugu

SEQ ID NO: 2414577 - RNA, 18 nt, Human
aagccuguuuaagagaca

SEQ ID NO: 2414578 - RNA, 19 nt, Human
aagccuguuuuguuggaag

SEQ ID NO: 2414579 - RNA, 18 nt, Human
aagccuguuccccucacu

SEQ ID NO: 2414580 - RNA, 20 nt, Human
aagccuguuccccucacugg

SEQ ID NO: 2414581 - RNA, 16 nt, Human
aagccuguuccccuca

SEQ ID NO: 2414582 - RNA, 17 nt, Human
aagccuguaaucccagc

SEQ ID NO: 2414583 - RNA, 18 nt, Human
aagcuaguggcuucaaaa

SEQ ID NO: 2414584 - RNA, 19 nt, Human
aagcuaguggcuucaaaau

SEQ ID NO: 2414585 - RNA, 22 nt, Human
aagcuaggguggcccuugcagu

SEQ ID NO: 2414586 - RNA, 15 nt, Human
aagcuaggguggccc

SEQ ID NO: 2414587 - RNA, 19 nt, Human
aagcuaggguggcccuugc

SEQ ID NO: 2414588 - RNA, 23 nt, Human
aagccuuaucaagugucuuccau

SEQ ID NO: 2414589 - RNA, 22 nt, Human
aagccuuaucaagugucuucca

SEQ ID NO: 2414590 - RNA, 16 nt, Human
aagccuuaucaagugu

SEQ ID NO: 2414591 - RNA, 16 nt, Human
aagccuucauugccuu

SEQ ID NO: 2414592 - RNA, 21 nt, Human
aagccuuggggcugaugcagu

SEQ ID NO: 2414593 - RNA, 16 nt, Human
aagccuuccacacuca

SEQ ID NO: 2414594 - RNA, 19 nt, Human
guucuagcauggcugccaa

SEQ ID NO: 2414595 - RNA, 19 nt, Human
guuccggauuggcuugugu

SEQ ID NO: 2414596 - RNA, 20 nt, Human
guuccgaaaccaaagaagaa

SEQ ID NO: 2414597 - RNA, 14 nt, Human
guucuagucucucu

SEQ ID NO: 2414598 - RNA, 21 nt, Human
guucuagucuccuuugcacug

SEQ ID NO: 2414599 - RNA, 14 nt, Human
guucuagucuccuu

SEQ ID NO: 2414600 - RNA, 23 nt, Human
guucuagucuccuuugcacugag

SEQ ID NO: 2414601 - RNA, 13 nt, Human
guucucuccuucu

SEQ ID NO: 2414602 - RNA, 15 nt, Human
guucucugcccucca

SEQ ID NO: 2414603 - RNA, 13 nt, Human
guucucugcccuc

SEQ ID NO: 2414604 - RNA, 14 nt, Human
guucucugaggaca

SEQ ID NO: 2414605 - RNA, 12 nt, Human
guucucugagga

SEQ ID NO: 2414606 - RNA, 15 nt, Human
guucucucuucucca

SEQ ID NO: 2414607 - RNA, 14 nt, Human
guucuuaauucuua

SEQ ID NO: 2414608 - RNA, 17 nt, Human
guucuuaauucuuagcu

SEQ ID NO: 2414609 - RNA, 14 nt, Human
guucuucaucuaag

SEQ ID NO: 2414610 - RNA, 15 nt, Human
guucuuaauugcacu

SEQ ID NO: 2414611 - RNA, 13 nt, Human
guucuuaauugca

SEQ ID NO: 2414612 - RNA, 18 nt, Human
guucucugcccuccaaga

SEQ ID NO: 2414613 - RNA, 17 nt, Human
guucucugcccuccaag

SEQ ID NO: 2414614 - RNA, 13 nt, Human
guucuuaauucuu

SEQ ID NO: 2414615 - RNA, 16 nt, Human
guucuuaagacgugau

SEQ ID NO: 2414616 - RNA, 19 nt, Human
guugauagcacagacccug

SEQ ID NO: 2414617 - RNA, 14 nt, Human
guugauagcacaga

SEQ ID NO: 2414618 - RNA, 19 nt, Human
aaggaaaaagcacaagaag

SEQ ID NO: 2414619 - RNA, 16 nt, Human
aaggaaaaagcacaag

SEQ ID NO: 2414620 - RNA, 20 nt, Human
aaggaaaaacacaagcaaaa

SEQ ID NO: 2414621 - RNA, 19 nt, Human
aaggaaaaacacaagcaaa

SEQ ID NO: 2414622 - RNA, 17 nt, Human
aaggaaaaaauguugga

SEQ ID NO: 2414623 - RNA, 16 nt, Human
aaggaaaaacacaagc

SEQ ID NO: 2414624 - RNA, 15 nt, Human
aaggaaaaaauguug

SEQ ID NO: 2414625 - RNA, 23 nt, Human
guugauagcaagugaauuuuucu

SEQ ID NO: 2414626 - RNA, 15 nt, Human
guugauaacuuugcu

SEQ ID NO: 2414627 - RNA, 20 nt, Human
guugagaauugugcucaaaa

SEQ ID NO: 2414628 - RNA, 17 nt, Human
guugauaacuuugcuug

SEQ ID NO: 2414629 - RNA, 14 nt, Human
guugauaacuuugc

SEQ ID NO: 2414630 - RNA, 19 nt, Human
guugagaaucccaaauuug

SEQ ID NO: 2414631 - RNA, 22 nt, Human
guugauagcaagugaauuuuuc

SEQ ID NO: 2414632 - RNA, 16 nt, Human
guugagaaucccaaau

SEQ ID NO: 2414633 - RNA, 18 nt, Human
guugacuuuagggacuca

SEQ ID NO: 2414634 - RNA, 12 nt, Human
guugagaaauga

SEQ ID NO: 2414635 - RNA, 15 nt, Human
guugacuuuagggac

SEQ ID NO: 2414636 - RNA, 21 nt, Human
guugacuuauuuucucugugu

SEQ ID NO: 2414637 - RNA, 14 nt, Human
guugacuuucaggu

SEQ ID NO: 2414638 - RNA, 20 nt, Human
guugacuuauuuucucugug

SEQ ID NO: 2414639 - RNA, 20 nt, Human
guugacuugacagaacacug

SEQ ID NO: 2414640 - RNA, 19 nt, Human
guugacuugacagaacacu

SEQ ID NO: 2414641 - RNA, 15 nt, Human
guucuugguuuguaa

SEQ ID NO: 2414642 - RNA, 18 nt, Human
guucuugguuuguaaauu

SEQ ID NO: 2414643 - RNA, 14 nt, Human
guugaccccagagg

SEQ ID NO: 2414644 - RNA, 16 nt, Human
guucuugguagagauu

SEQ ID NO: 2414645 - RNA, 19 nt, Human
guucuuggggcccuacacc

SEQ ID NO: 2414646 - RNA, 15 nt, Human
guugaccccagagga

SEQ ID NO: 2414647 - RNA, 15 nt, Human
guucuugaagcagua

SEQ ID NO: 2414648 - RNA, 20 nt, Human
guucuucuuccugaagcuga

SEQ ID NO: 2414649 - RNA, 17 nt, Human
guucuucuuccugaagc

SEQ ID NO: 2414650 - RNA, 22 nt, Human
guucuucgggaagagaggaguu

SEQ ID NO: 2414651 - RNA, 21 nt, Human
guucuucgggaagagaggagu

SEQ ID NO: 2414652 - RNA, 16 nt, Human
guucuucgggaagaga

SEQ ID NO: 2414653 - RNA, 14 nt, Human
guucuucgggaaga

SEQ ID NO: 2414654 - RNA, 14 nt, Human
guucuucgaggugg

SEQ ID NO: 2414655 - RNA, 14 nt, Human
guucuugguuugua

SEQ ID NO: 2414656 - RNA, 21 nt, Human
aagcuuuuaugugaaacaugu

SEQ ID NO: 2414657 - RNA, 19 nt, Human
aagcuuuuaugugaaacau

SEQ ID NO: 2414658 - RNA, 12 nt, Human
guuccccagaga

SEQ ID NO: 2414659 - RNA, 13 nt, Human
guuccccagagaa

SEQ ID NO: 2414660 - RNA, 23 nt, Human
aagcuuuuuauuccuccugcuca

SEQ ID NO: 2414661 - RNA, 15 nt, Human
guuccccaagacauu

SEQ ID NO: 2414662 - RNA, 21 nt, Human
guucccccuucacaaagccca

SEQ ID NO: 2414663 - RNA, 15 nt, Human
guucccccagcccug

SEQ ID NO: 2414664 - RNA, 16 nt, Human
guucccccagcccugu

SEQ ID NO: 2414665 - RNA, 17 nt, Human
guucccccagcccugug

SEQ ID NO: 2414666 - RNA, 20 nt, Human
guucccccagcccuguggaa

SEQ ID NO: 2414667 - RNA, 19 nt, Human
guuccccaucuggguccuu

SEQ ID NO: 2414668 - RNA, 18 nt, Human
guuccccaucuggguccu

SEQ ID NO: 2414669 - RNA, 14 nt, Human
guuccccagagaaa

SEQ ID NO: 2414670 - RNA, 14 nt, Human
guuccccaugcaga

SEQ ID NO: 2414671 - RNA, 23 nt, Human
guuccccaucuggguccuugcac

SEQ ID NO: 2414672 - RNA, 13 nt, Human
guucccccagccc

SEQ ID NO: 2414673 - RNA, 14 nt, Human
guucccccagcccu

SEQ ID NO: 2414674 - RNA, 18 nt, Human
guucccuugaugaagaag

SEQ ID NO: 2414675 - RNA, 21 nt, Human
guucccucugcuccuggagcc

SEQ ID NO: 2414676 - RNA, 16 nt, Human
guucccucugcuccug

SEQ ID NO: 2414677 - RNA, 20 nt, Human
guuccccuaguaagugccuu

SEQ ID NO: 2414678 - RNA, 17 nt, Human
guucccugaaaacccag

SEQ ID NO: 2414679 - RNA, 18 nt, Human
guucccugaaaacccaga

SEQ ID NO: 2414680 - RNA, 19 nt, Human
guucccugaaaacccagag

SEQ ID NO: 2414681 - RNA, 20 nt, Human
guucccugaaaacccagaga

SEQ ID NO: 2414682 - RNA, 16 nt, Human
guucccugucuugucc

SEQ ID NO: 2414683 - RNA, 21 nt, Human
guucccugaaaacccagagag

SEQ ID NO: 2414684 - RNA, 12 nt, Human
guucccuuggcc

SEQ ID NO: 2414685 - RNA, 13 nt, Human
guucccuuggccu

SEQ ID NO: 2414686 - RNA, 14 nt, Human
guucccuuggccuc

SEQ ID NO: 2414687 - RNA, 15 nt, Human
guucccuuggccuca

SEQ ID NO: 2414688 - RNA, 22 nt, Human
guucccuuuuuuggcugcugaa

SEQ ID NO: 2414689 - RNA, 21 nt, Human
guucccuuuuuuggcugcuga

SEQ ID NO: 2414690 - RNA, 21 nt, Human
guuccgaaaccaaagaagaaa

SEQ ID NO: 2414691 - RNA, 22 nt, Human
guuccggaauccuguccucagc

SEQ ID NO: 2414692 - RNA, 19 nt, Human
guuccggaauccuguccuc

SEQ ID NO: 2414693 - RNA, 14 nt, Human
aagcuugcucacau

SEQ ID NO: 2414694 - RNA, 20 nt, Human
aagcuucuuaaaugagaagg

SEQ ID NO: 2414695 - RNA, 22 nt, Human
aagcuucuuaaaugagaaggaa

SEQ ID NO: 2414696 - RNA, 14 nt, Human
aagcuuggcagccg

SEQ ID NO: 2414697 - RNA, 21 nt, Human
aagcuuggcagccgagcucgu

SEQ ID NO: 2414698 - RNA, 21 nt, Human
aagcuuggcuguagaaggaga

SEQ ID NO: 2414699 - RNA, 21 nt, Human
aagcuuccaugauucuauuua

SEQ ID NO: 2414700 - RNA, 22 nt, Human
aagcuucgaggcccagcgaccu

SEQ ID NO: 2414701 - RNA, 23 nt, Human
aagcuuccuuuguuuuuuuuucc

SEQ ID NO: 2414702 - RNA, 13 nt, Human
aagcuuccuuggc

SEQ ID NO: 2414703 - RNA, 18 nt, Human
aagcuuauuaaaacucau

SEQ ID NO: 2414704 - RNA, 13 nt, Human
aagcuuaggcagg

SEQ ID NO: 2414705 - RNA, 22 nt, Human
aagcuuagcaggagaggagagc

SEQ ID NO: 2414706 - RNA, 20 nt, Human
aagcuuagcaggagaggaga

SEQ ID NO: 2414707 - RNA, 16 nt, Human
aagcuuagcaggagag

SEQ ID NO: 2414708 - RNA, 15 nt, Human
aagcuuagcaggaga

SEQ ID NO: 2414709 - RNA, 13 nt, Human
aagcuuagcagga

SEQ ID NO: 2414710 - RNA, 11 nt, Human
aagcuuagaac

SEQ ID NO: 2414711 - RNA, 10 nt, Human
aagcuuagaa

SEQ ID NO: 2414712 - RNA, 21 nt, Human
aagcucuugaagacacugaaa

SEQ ID NO: 2414713 - RNA, 15 nt, Human
aagcucagaauccaa

SEQ ID NO: 2414714 - RNA, 14 nt, Human
aagcucagaaucca

SEQ ID NO: 2414715 - RNA, 13 nt, Human
aagcucagaaucc

SEQ ID NO: 2414716 - RNA, 12 nt, Human
aagcucagaauc

SEQ ID NO: 2414717 - RNA, 22 nt, Human
aagcucagaggcgcacugugac

SEQ ID NO: 2414718 - RNA, 23 nt, Human
aagcucagaggcgcacugugacc

SEQ ID NO: 2414719 - RNA, 14 nt, Human
aagcucacuucugg

SEQ ID NO: 2414720 - RNA, 23 nt, Human
aagcucacuucugggcuucaucu

SEQ ID NO: 2414721 - RNA, 16 nt, Human
aagcucagaaggcucu

SEQ ID NO: 2414722 - RNA, 14 nt, Human
aagcucagaaggcu

SEQ ID NO: 2414723 - RNA, 15 nt, Human
aagcucacaguuccu

SEQ ID NO: 2414724 - RNA, 19 nt, Human
aagcucacaguuccucgcc

SEQ ID NO: 2414725 - RNA, 20 nt, Human
aagcucacaguuccucgccc

SEQ ID NO: 2414726 - RNA, 22 nt, Human
aagcucacaguuccucgcccug

SEQ ID NO: 2414727 - RNA, 23 nt, Human
aagcucaccuguugcuuacaauu

SEQ ID NO: 2414728 - RNA, 22 nt, Human
aagcucaccuguugcuuacaau

SEQ ID NO: 2414729 - RNA, 18 nt, Human
aagcucaccuguugcuua

SEQ ID NO: 2414730 - RNA, 16 nt, Human
aagcucaccuguugcu

SEQ ID NO: 2414731 - RNA, 23 nt, Human
aagcucacaguuccucgcccugg

SEQ ID NO: 2414732 - RNA, 17 nt, Human
aagcucugcuccucucc

SEQ ID NO: 2414733 - RNA, 21 nt, Human
aagcucuggcugaacccugug

SEQ ID NO: 2414734 - RNA, 15 nt, Human
aagcucuggcugaac

SEQ ID NO: 2414735 - RNA, 13 nt, Human
aagcucuggcuga

SEQ ID NO: 2414736 - RNA, 11 nt, Human
aagcucuggcu

SEQ ID NO: 2414737 - RNA, 15 nt, Human
aagcucagccagccc

SEQ ID NO: 2414738 - RNA, 17 nt, Human
aagcucagacugguuga

SEQ ID NO: 2414739 - RNA, 13 nt, Human
aagcucagcccac

SEQ ID NO: 2414740 - RNA, 14 nt, Human
aagcucagcccacc

SEQ ID NO: 2414741 - RNA, 12 nt, Human
aagcugaaaaua

SEQ ID NO: 2414742 - RNA, 19 nt, Human
aagcucuugaagacacuga

SEQ ID NO: 2414743 - RNA, 20 nt, Human
aagcucuugaagacacugaa

SEQ ID NO: 2414744 - RNA, 23 nt, Human
aagcucuggcugaacccugugcu

SEQ ID NO: 2414745 - RNA, 22 nt, Human
aagcucuggcugaacccugugc

SEQ ID NO: 2414746 - RNA, 24 nt, Human
aagcucuggcugaacccugugcug

SEQ ID NO: 2414747 - RNA, 20 nt, Human
aagcucuggugacaccagcc

SEQ ID NO: 2414748 - RNA, 22 nt, Human
aagcucuuacacuacauuagaa

SEQ ID NO: 2414749 - RNA, 21 nt, Human
aagcucuggugacaccagccu

SEQ ID NO: 2414750 - RNA, 17 nt, Human
aagcucuugaagacacu

SEQ ID NO: 2414751 - RNA, 19 nt, Human
aaguuaauccacugugacu

SEQ ID NO: 2414752 - RNA, 23 nt, Human
aaguuaagaauguucuuauguug

SEQ ID NO: 2414753 - RNA, 20 nt, Human
aaguuacaaauugcuugaaa

SEQ ID NO: 2414754 - RNA, 22 nt, Human
aaguuagaauuccuucagggug

SEQ ID NO: 2414755 - RNA, 21 nt, Human
aaguuagaauuccuucagggu

SEQ ID NO: 2414756 - RNA, 17 nt, Human
aaguuagaauuccuuca

SEQ ID NO: 2414757 - RNA, 13 nt, Human
aaguuagcucagg

SEQ ID NO: 2414758 - RNA, 15 nt, Human
aaguuagaauuccuu

SEQ ID NO: 2414759 - RNA, 18 nt, Human
aaguuacaacuuccuaau

SEQ ID NO: 2414760 - RNA, 21 nt, Human
aaguguguguuuuucauaaag

SEQ ID NO: 2414761 - RNA, 16 nt, Human
aaguguguguuuuuca

SEQ ID NO: 2414762 - RNA, 13 nt, Human
aagugugugugcg

SEQ ID NO: 2414763 - RNA, 16 nt, Human
aaguguguuguugcuu

SEQ ID NO: 2414764 - RNA, 11 nt, Human
aagugugugug

SEQ ID NO: 2414765 - RNA, 17 nt, Human
aaguguguuuccuucag

SEQ ID NO: 2414766 - RNA, 21 nt, Human
aaguguguuuccuucagugca

SEQ ID NO: 2414767 - RNA, 11 nt, Human
aaguuaagaau

SEQ ID NO: 2414768 - RNA, 16 nt, Human
aaguguuaauacuagu

SEQ ID NO: 2414769 - RNA, 13 nt, Human
aaguuaacagaga

SEQ ID NO: 2414770 - RNA, 14 nt, Human
aaguuaaauuuuau

SEQ ID NO: 2414771 - RNA, 23 nt, Human
aaguuagucuacucuuaagccau

SEQ ID NO: 2414772 - RNA, 11 nt, Human
aaguuagucua

SEQ ID NO: 2414773 - RNA, 21 nt, Human
aaguuagcugagcgugguggc

SEQ ID NO: 2414774 - RNA, 14 nt, Human
aaguuagcugagcg

SEQ ID NO: 2414775 - RNA, 14 nt, Human
aaguuagcucagga

SEQ ID NO: 2414776 - RNA, 15 nt, Human
aaguuagcucaggag

SEQ ID NO: 2414777 - RNA, 18 nt, Human
aaguuauaaaucaauguc

SEQ ID NO: 2414778 - RNA, 19 nt, Human
aaguuauaaaucaauguca

SEQ ID NO: 2414779 - RNA, 20 nt, Human
aaguuauaaaucaaugucac

SEQ ID NO: 2414780 - RNA, 20 nt, Human
aaguuauuguacagcuguuu

SEQ ID NO: 2414781 - RNA, 12 nt, Human
aaguuauuguac

SEQ ID NO: 2414782 - RNA, 11 nt, Human
aaguuauugua

SEQ ID NO: 2414783 - RNA, 23 nt, Human
aaguuauugcaguuuaucauuca

SEQ ID NO: 2414784 - RNA, 17 nt, Human
aaguuauaguauaucug

SEQ ID NO: 2414785 - RNA, 16 nt, Human
aaguuauaguauaucu

SEQ ID NO: 2414786 - RNA, 23 nt, Human
aaguuauauagguuuuguuugcu

SEQ ID NO: 2414787 - RNA, 22 nt, Human
aaguuaucagacacucuggcug

SEQ ID NO: 2414788 - RNA, 12 nt, Human
aaguguguguuu

SEQ ID NO: 2414789 - RNA, 23 nt, Human
aaguguguggucccaaguuggaa

SEQ ID NO: 2414790 - RNA, 16 nt, Human
aaguguguauuaaaaa

SEQ ID NO: 2414791 - RNA, 15 nt, Human
aaguguguauuaaaa

SEQ ID NO: 2414792 - RNA, 13 nt, Human
aaguguguauuaa

SEQ ID NO: 2414793 - RNA, 12 nt, Human
aaguguguaugu

SEQ ID NO: 2414794 - RNA, 22 nt, Human
aaguguguaugugcgugugugc

SEQ ID NO: 2414795 - RNA, 19 nt, Human
aaguguggucccaacagga

SEQ ID NO: 2414796 - RNA, 23 nt, Human
aagugugcuuuaugcugaaacag

SEQ ID NO: 2414797 - RNA, 20 nt, Human
aagugugggucugugugugu

SEQ ID NO: 2414798 - RNA, 13 nt, Human
aagugugguagag

SEQ ID NO: 2414799 - RNA, 21 nt, Human
aagugugcauauuguacacuu

SEQ ID NO: 2414800 - RNA, 19 nt, Human
aagugugcauauuguacac

SEQ ID NO: 2414801 - RNA, 22 nt, Human
aagugugcauauuguacacuuu

SEQ ID NO: 2414802 - RNA, 21 nt, Human
aagugugcuuuaugcugaaac

SEQ ID NO: 2414803 - RNA, 10 nt, Human
aagugugggu

SEQ ID NO: 2414804 - RNA, 17 nt, Human
aagugugggucugugug

SEQ ID NO: 2414805 - RNA, 18 nt, Human
aagugugggucugugugu

SEQ ID NO: 2414806 - RNA, 15 nt, Human
aagugugagcaguga

SEQ ID NO: 2414807 - RNA, 13 nt, Human
aagugugagcaaa

SEQ ID NO: 2414808 - RNA, 11 nt, Human
aagugugagua

SEQ ID NO: 2414809 - RNA, 18 nt, Human
aagugugaguaagagcug

SEQ ID NO: 2414810 - RNA, 19 nt, Human
aagugugaguaagagcugg

SEQ ID NO: 2414811 - RNA, 20 nt, Human
aagugugaguaagagcuggu

SEQ ID NO: 2414812 - RNA, 18 nt, Human
aagugugcauauuguaca

SEQ ID NO: 2414813 - RNA, 17 nt, Human
aagugugcauauuguac

SEQ ID NO: 2414814 - RNA, 11 nt, Human
aagugugcaua

SEQ ID NO: 2414815 - RNA, 22 nt, Human
aagugugauugggaauaaauau

SEQ ID NO: 2414816 - RNA, 21 nt, Human
aagugugauugggaauaaaua

SEQ ID NO: 2414817 - RNA, 20 nt, Human
aagugugauugggaauaaau

SEQ ID NO: 2414818 - RNA, 11 nt, Human
aagugugauug

SEQ ID NO: 2414819 - RNA, 21 nt, Human
aagugugaguaagagcuggug

SEQ ID NO: 2414820 - RNA, 21 nt, Human
aagugugaacuggacccuguu

SEQ ID NO: 2414821 - RNA, 13 nt, Human
aagugugaacugg

SEQ ID NO: 2414822 - RNA, 23 nt, Human
aaguguccauugacauguacaga

SEQ ID NO: 2414823 - RNA, 22 nt, Human
aaguguccauugacauguacag

SEQ ID NO: 2414824 - RNA, 19 nt, Human
aagugucucaguccaccug

SEQ ID NO: 2414825 - RNA, 17 nt, Human
aagugugaacaaaagau

SEQ ID NO: 2414826 - RNA, 14 nt, Human
aagugucugugugc

SEQ ID NO: 2414827 - RNA, 21 nt, Human
aaguguccauugacauguaca

SEQ ID NO: 2414828 - RNA, 19 nt, Human
aaguguccauugacaugua

SEQ ID NO: 2414829 - RNA, 18 nt, Human
aaguguccauugacaugu

SEQ ID NO: 2414830 - RNA, 22 nt, Human
aagugucauauguaggugucug

SEQ ID NO: 2414831 - RNA, 24 nt, Human
aagugucauauguaggugucugca

SEQ ID NO: 2414832 - RNA, 12 nt, Human
aagugccccugc

SEQ ID NO: 2414833 - RNA, 21 nt, Human
aagugccagucuugugucugc

SEQ ID NO: 2414834 - RNA, 16 nt, Human
aagugcaugcucucug

SEQ ID NO: 2414835 - RNA, 20 nt, Human
aagugccacucauuccugua

SEQ ID NO: 2414836 - RNA, 19 nt, Human
aagugcauccaaaggugcu

SEQ ID NO: 2414837 - RNA, 16 nt, Human
aagugcauccaaaggu

SEQ ID NO: 2414838 - RNA, 15 nt, Human
aagugcauccaaagg

SEQ ID NO: 2414839 - RNA, 21 nt, Human
aagugccacucauuccuguag

SEQ ID NO: 2414840 - RNA, 21 nt, Human
aagugccacugcccgagcugg

SEQ ID NO: 2414841 - RNA, 22 nt, Human
aagugccacugcccgagcuggu

SEQ ID NO: 2414842 - RNA, 23 nt, Human
aagugccacugcccgagcuggug

SEQ ID NO: 2414843 - RNA, 23 nt, Human
aaguguauuuuuuuacuaauaga

SEQ ID NO: 2414844 - RNA, 20 nt, Human
aagugccagaggugggcagg

SEQ ID NO: 2414845 - RNA, 19 nt, Human
aagugccagaggugggcag

SEQ ID NO: 2414846 - RNA, 18 nt, Human
aagugccagaggugggca

SEQ ID NO: 2414847 - RNA, 15 nt, Human
aagugccagaggugg

SEQ ID NO: 2414848 - RNA, 14 nt, Human
aagugccagaggug

SEQ ID NO: 2414849 - RNA, 15 nt, Human
uaaaauuguaaaauu

SEQ ID NO: 2414850 - RNA, 14 nt, Human
uaaaauuguaaaau

SEQ ID NO: 2414851 - RNA, 19 nt, Human
uaaaauugccauauugcac

SEQ ID NO: 2414852 - RNA, 18 nt, Human
uaaaauugccauauugca

SEQ ID NO: 2414853 - RNA, 16 nt, Human
uaaaauugccauauug

SEQ ID NO: 2414854 - RNA, 15 nt, Human
uaaaauugccauauu

SEQ ID NO: 2414855 - RNA, 14 nt, Human
uaaaauugccauau

SEQ ID NO: 2414856 - RNA, 13 nt, Human
uaaaauugccaua

SEQ ID NO: 2414857 - RNA, 12 nt, Human
uaaaauugccau

SEQ ID NO: 2414858 - RNA, 15 nt, Human
uaaaauugugaugug

SEQ ID NO: 2414859 - RNA, 19 nt, Human
uaaaauuguaaaauuguau

SEQ ID NO: 2414860 - RNA, 16 nt, Human
uaaaauuguaaaauug

SEQ ID NO: 2414861 - RNA, 22 nt, Human
uaaaauuguaaaauuguauaga

SEQ ID NO: 2414862 - RNA, 23 nt, Human
uaaaauuguauagagauaugcag

SEQ ID NO: 2414863 - RNA, 16 nt, Human
uaaaauuguauagaga

SEQ ID NO: 2414864 - RNA, 14 nt, Human
uaaaauuguauaga

SEQ ID NO: 2414865 - RNA, 16 nt, Human
uaaaauugugaugugu

SEQ ID NO: 2414866 - RNA, 22 nt, Human
uaaaauuccacugcguugucca

SEQ ID NO: 2414867 - RNA, 12 nt, Human
uaaaauuccacu

SEQ ID NO: 2414868 - RNA, 21 nt, Human
uaaaauuauuuuggauuuugu

SEQ ID NO: 2414869 - RNA, 15 nt, Human
uaaaauuauuuugga

SEQ ID NO: 2414870 - RNA, 14 nt, Human
uaaaauuauuuugg

SEQ ID NO: 2414871 - RNA, 14 nt, Human
uaaaauugcacuuu

SEQ ID NO: 2414872 - RNA, 13 nt, Human
uaaaauugaaagg

SEQ ID NO: 2414873 - RNA, 16 nt, Human
uaaaauucuacuguau

SEQ ID NO: 2414874 - RNA, 13 nt, Human
uaaaaugugaagu

SEQ ID NO: 2414875 - RNA, 18 nt, Human
uaaaaugugauuuuucug

SEQ ID NO: 2414876 - RNA, 19 nt, Human
uaaaaugugauuuuucuga

SEQ ID NO: 2414877 - RNA, 9 nt, Human
uaaaauggu

SEQ ID NO: 2414878 - RNA, 15 nt, Human
aaguuugauuucauu

SEQ ID NO: 2414879 - RNA, 17 nt, Human
aaguuugaaggaaacag

SEQ ID NO: 2414880 - RNA, 20 nt, Human
aaguuugagaucagccuggg

SEQ ID NO: 2414881 - RNA, 11 nt, Human
uaaaaugugaa

SEQ ID NO: 2414882 - RNA, 22 nt, Human
uaaaauguauucuuaaauucau

SEQ ID NO: 2414883 - RNA, 23 nt, Human
uaaaauguauucuuaaauucauu

SEQ ID NO: 2414884 - RNA, 20 nt, Human
aaguucccuacuuccuguga

SEQ ID NO: 2414885 - RNA, 14 nt, Human
aaguuccucuagug

SEQ ID NO: 2414886 - RNA, 17 nt, Human
aaguucccuacuuccug

SEQ ID NO: 2414887 - RNA, 14 nt, Human
aaguucccuacuuc

SEQ ID NO: 2414888 - RNA, 18 nt, Human
aaguuuccauauguuaua

SEQ ID NO: 2414889 - RNA, 12 nt, Human
aaguuuccauau

SEQ ID NO: 2414890 - RNA, 14 nt, Human
aaguuccuuugggu

SEQ ID NO: 2414891 - RNA, 20 nt, Human
aaguuccuuauguauauuua

SEQ ID NO: 2414892 - RNA, 19 nt, Human
aaguuccaguguucucucu

SEQ ID NO: 2414893 - RNA, 15 nt, Human
aaguuccacugagcu

SEQ ID NO: 2414894 - RNA, 19 nt, Human
aaguuccaaguugcuaaua

SEQ ID NO: 2414895 - RNA, 19 nt, Human
aaguucaaucuguuuuuca

SEQ ID NO: 2414896 - RNA, 15 nt, Human
aaguucaccauuaaa

SEQ ID NO: 2414897 - RNA, 14 nt, Human
aaguuauuuucuac

SEQ ID NO: 2414898 - RNA, 21 nt, Human
aaguuauuuucuacagugguu

SEQ ID NO: 2414899 - RNA, 18 nt, Human
aaguuauuuucuacagug

SEQ ID NO: 2414900 - RNA, 23 nt, Human
aaguucaaauucuucugaacuca

SEQ ID NO: 2414901 - RNA, 21 nt, Human
aaguuucugccgcagcccugc

SEQ ID NO: 2414902 - RNA, 19 nt, Human
aaguuucugccgcagcccu

SEQ ID NO: 2414903 - RNA, 22 nt, Human
aaguuugaauguuaaauaaauu

SEQ ID NO: 2414904 - RNA, 18 nt, Human
aaguuugaauguuaaaua

SEQ ID NO: 2414905 - RNA, 16 nt, Human
aaguuugaauguuaaa

SEQ ID NO: 2414906 - RNA, 15 nt, Human
aaguuugaauguuaa

SEQ ID NO: 2414907 - RNA, 14 nt, Human
aaguuugaauguua

SEQ ID NO: 2414908 - RNA, 13 nt, Human
aaguuugaauguu

SEQ ID NO: 2414909 - RNA, 16 nt, Human
aaguuucuuugcuuca

SEQ ID NO: 2414910 - RNA, 18 nt, Human
aaguuucucagcucccau

SEQ ID NO: 2414911 - RNA, 17 nt, Human
aaguuucucagcuccca

SEQ ID NO: 2414912 - RNA, 16 nt, Human
aaguuucucagcuccc

SEQ ID NO: 2414913 - RNA, 14 nt, Human
aaguuucucagcuc

SEQ ID NO: 2414914 - RNA, 13 nt, Human
aaguuucucagcu

SEQ ID NO: 2414915 - RNA, 23 nt, Human
aaguuucucagauccuuguuuca

SEQ ID NO: 2414916 - RNA, 22 nt, Human
aaguuucucagauccuuguuuc

SEQ ID NO: 2414917 - RNA, 13 nt, Human
aaguuucucagau

SEQ ID NO: 2414918 - RNA, 23 nt, Human
aaguuucuagcuagaaauaugau

SEQ ID NO: 2414919 - RNA, 21 nt, Human
aaguuucuagcuagaaauaug

SEQ ID NO: 2414920 - RNA, 19 nt, Human
aaguuucuagcuagaaaua

SEQ ID NO: 2414921 - RNA, 18 nt, Human
aaguuuccuuggcuggug

SEQ ID NO: 2414922 - RNA, 17 nt, Human
aaguuuccuuggcuggu

SEQ ID NO: 2414923 - RNA, 20 nt, Human
aaguuuccuuggcuggugca

SEQ ID NO: 2414924 - RNA, 16 nt, Human
aaguuuccuuggcugg

SEQ ID NO: 2414925 - RNA, 20 nt, Human
aagugauccucccaccucag

SEQ ID NO: 2414926 - RNA, 19 nt, Human
aagugauccucccaccuca

SEQ ID NO: 2414927 - RNA, 13 nt, Human
aagugauccuccc

SEQ ID NO: 2414928 - RNA, 18 nt, Human
uaaaauagcuuguauagu

SEQ ID NO: 2414929 - RNA, 18 nt, Human
uaaaauauagcuguacaa

SEQ ID NO: 2414930 - RNA, 19 nt, Human
uaaaauauagcuguacaaa

SEQ ID NO: 2414931 - RNA, 17 nt, Human
uaaaauauauuucagau

SEQ ID NO: 2414932 - RNA, 21 nt, Human
uaaaauaccagccaguaaaug

SEQ ID NO: 2414933 - RNA, 14 nt, Human
uaaaauagcuugua

SEQ ID NO: 2414934 - RNA, 21 nt, Human
uaaaauagcaacacucuauau

SEQ ID NO: 2414935 - RNA, 23 nt, Human
uaaaauagccacuuaccuucaau

SEQ ID NO: 2414936 - RNA, 15 nt, Human
uaaaauagccacuua

SEQ ID NO: 2414937 - RNA, 21 nt, Human
uaaaauagccacuuaccuuca

SEQ ID NO: 2414938 - RNA, 13 nt, Human
aagugauucucau

SEQ ID NO: 2414939 - RNA, 16 nt, Human
aagugauucucaugcc

SEQ ID NO: 2414940 - RNA, 20 nt, Human
aagugauucuccugccucag

SEQ ID NO: 2414941 - RNA, 23 nt, Human
aagugauccucccaccucagccu

SEQ ID NO: 2414942 - RNA, 23 nt, Human
aagugaucaauaaaaugugauuu

SEQ ID NO: 2414943 - RNA, 22 nt, Human
aagugaucaauaaaaugugauu

SEQ ID NO: 2414944 - RNA, 15 nt, Human
aagugauuguuggca

SEQ ID NO: 2414945 - RNA, 18 nt, Human
aagugauugggacagagg

SEQ ID NO: 2414946 - RNA, 22 nt, Human
aagugcaauaaaucugacccag

SEQ ID NO: 2414947 - RNA, 23 nt, Human
aagugcaauaaaucugacccagu

SEQ ID NO: 2414948 - RNA, 17 nt, Human
aagugauuuuuuugucc

SEQ ID NO: 2414949 - RNA, 12 nt, Human
aagugcaggcug

SEQ ID NO: 2414950 - RNA, 13 nt, Human
aagugcaggcugg

SEQ ID NO: 2414951 - RNA, 17 nt, Human
aagugcaggcuggcacc

SEQ ID NO: 2414952 - RNA, 21 nt, Human
aagugcaggcuggcaccgccu

SEQ ID NO: 2414953 - RNA, 14 nt, Human
aagugauugaaaau

SEQ ID NO: 2414954 - RNA, 21 nt, Human
aagugauuaaacgugcagacu

SEQ ID NO: 2414955 - RNA, 19 nt, Human
aagugauggagcagagcaa

SEQ ID NO: 2414956 - RNA, 18 nt, Human
aagugauggagcagagca

SEQ ID NO: 2414957 - RNA, 18 nt, Human
aagugauuguaugaauuu

SEQ ID NO: 2414958 - RNA, 13 nt, Human
aagugauuguaug

SEQ ID NO: 2414959 - RNA, 17 nt, Human
aagugauucucaugccu

SEQ ID NO: 2414960 - RNA, 21 nt, Human
aagugauucuccugccucagc

SEQ ID NO: 2414961 - RNA, 19 nt, Human
uaaaagugggcuugauucu

SEQ ID NO: 2414962 - RNA, 13 nt, Human
uaaaagugaucaa

SEQ ID NO: 2414963 - RNA, 15 nt, Human
uaaaagugaucaaua

SEQ ID NO: 2414964 - RNA, 20 nt, Human
uaaaaguacauguuaaacuu

SEQ ID NO: 2414965 - RNA, 14 nt, Human
uaaaauaaauauau

SEQ ID NO: 2414966 - RNA, 13 nt, Human
uaaaauaaauaua

SEQ ID NO: 2414967 - RNA, 13 nt, Human
uaaaauaaauaaa

SEQ ID NO: 2414968 - RNA, 13 nt, Human
uaaaauaaaguau

SEQ ID NO: 2414969 - RNA, 17 nt, Human
uaaaauaaaguauauau

SEQ ID NO: 2414970 - RNA, 21 nt, Human
uaaaauaacuaguguugcuug

SEQ ID NO: 2414971 - RNA, 23 nt, Human
uaaaauaaauauauauaaaccua

SEQ ID NO: 2414972 - RNA, 21 nt, Human
uaaaauacacacucaaaucaa

SEQ ID NO: 2414973 - RNA, 22 nt, Human
uaaaauaauuuuuauauuugaa

SEQ ID NO: 2414974 - RNA, 20 nt, Human
uaaaauaagcacugugcuaa

SEQ ID NO: 2414975 - RNA, 24 nt, Human
uaaaauaacuaguguugcuuggac

SEQ ID NO: 2414976 - RNA, 13 nt, Human
uaaaagaauauuu

SEQ ID NO: 2414977 - RNA, 16 nt, Human
uaaaagaauauuuuaa

SEQ ID NO: 2414978 - RNA, 13 nt, Human
uaaaagucuugug

SEQ ID NO: 2414979 - RNA, 14 nt, Human
uaaaaguaaacauu

SEQ ID NO: 2414980 - RNA, 13 nt, Human
uaaaaguaaacau

SEQ ID NO: 2414981 - RNA, 12 nt, Human
uaaaaguaaaca

SEQ ID NO: 2414982 - RNA, 15 nt, Human
uaaaagguucaggga

SEQ ID NO: 2414983 - RNA, 21 nt, Human
uaaaagguucagggaaccguu

SEQ ID NO: 2414984 - RNA, 17 nt, Human
uaaaagaaaauaaaaaa

SEQ ID NO: 2414985 - RNA, 22 nt, Human
uaaaagaaaauaaaaaaaagaa

SEQ ID NO: 2414986 - RNA, 16 nt, Human
uaaaacuuugcugcca

SEQ ID NO: 2414987 - RNA, 13 nt, Human
uaaaacuuuuuau

SEQ ID NO: 2414988 - RNA, 14 nt, Human
uaaaagaaaauaaa

SEQ ID NO: 2414989 - RNA, 23 nt, Human
uaaaacuuuuuauauuuuauaca

SEQ ID NO: 2414990 - RNA, 18 nt, Human
uaaaagaacaguaaacau

SEQ ID NO: 2414991 - RNA, 17 nt, Human
uaaaagaacaguaaaca

SEQ ID NO: 2414992 - RNA, 21 nt, Human
uaaaagaaagccucagagaau

SEQ ID NO: 2414993 - RNA, 22 nt, Human
uaaaagaaagccucagagaauu

SEQ ID NO: 2414994 - RNA, 16 nt, Human
uaaaaaguauauguua

SEQ ID NO: 2414995 - RNA, 20 nt, Human
uaaaaagggcagggcaucuc

SEQ ID NO: 2414996 - RNA, 20 nt, Human
uaaaaaggaauccacuccca

SEQ ID NO: 2414997 - RNA, 19 nt, Human
uaaaaaggcaccuauaaaa

SEQ ID NO: 2414998 - RNA, 14 nt, Human
uaaaaauauugugu

SEQ ID NO: 2414999 - RNA, 19 nt, Human
uaaaaauauggaacuucua

SEQ ID NO: 2415000 - RNA, 15 nt, Human
uaaaaauauaaaacu

SEQ ID NO: 2415001 - RNA, 14 nt, Human
uaaaaauauaaaac

SEQ ID NO: 2415002 - RNA, 12 nt, Human
uaaaaauauaaa

SEQ ID NO: 2415003 - RNA, 10 nt, Human
uaaaaauaua

SEQ ID NO: 2415004 - RNA, 18 nt, Human
uaaaaagugacacagcag

SEQ ID NO: 2415005 - RNA, 17 nt, Human
uaaaaagugacacagca

SEQ ID NO: 2415006 - RNA, 15 nt, Human
uaaaaagugacacag

SEQ ID NO: 2415007 - RNA, 16 nt, Human
uaaaaagucaauguuu

SEQ ID NO: 2415008 - RNA, 17 nt, Human
uaaaaagucuucacucu

SEQ ID NO: 2415009 - RNA, 14 nt, Human
uaaaaagucuucac

SEQ ID NO: 2415010 - RNA, 21 nt, Human
uaaaaaaaaaccugagcccca

SEQ ID NO: 2415011 - RNA, 22 nt, Human
uaaaaagccugcaauuucauau

SEQ ID NO: 2415012 - RNA, 19 nt, Human
uaaaaagccugcaauuuca

SEQ ID NO: 2415013 - RNA, 13 nt, Human
uaaaaagcugacc

SEQ ID NO: 2415014 - RNA, 11 nt, Human
uaaaaagcuga

SEQ ID NO: 2415015 - RNA, 20 nt, Human
uaaaaagcuuccaugauucu

SEQ ID NO: 2415016 - RNA, 22 nt, Human
uaaaaagcuccaaaugcagcuu

SEQ ID NO: 2415017 - RNA, 20 nt, Human
uaaaaaaaaaaaaguuauau

SEQ ID NO: 2415018 - RNA, 22 nt, Human
uaaaaaaaaaaaccaaaacugu

SEQ ID NO: 2415019 - RNA, 19 nt, Human
uaaaaaaaaaaaaguuaua

SEQ ID NO: 2415020 - RNA, 18 nt, Human
uaaaaaaaaaaaaguuau

SEQ ID NO: 2415021 - RNA, 17 nt, Human
uaaaaaaaaaaaaguua

SEQ ID NO: 2415022 - RNA, 16 nt, Human
uaaaaaaaaaaaagua

SEQ ID NO: 2415023 - RNA, 21 nt, Human
aagucaggcccuuauuuucaa

SEQ ID NO: 2415024 - RNA, 16 nt, Human
aagucagguccaauuu

SEQ ID NO: 2415025 - RNA, 15 nt, Human
aagucagguccaauu

SEQ ID NO: 2415026 - RNA, 21 nt, Human
aagucagaugugguaacuguu

SEQ ID NO: 2415027 - RNA, 13 nt, Human
aagucagaugugg

SEQ ID NO: 2415028 - RNA, 23 nt, Human
aagucagaggauggccagugucu

SEQ ID NO: 2415029 - RNA, 19 nt, Human
aagucagcuuugccuucca

SEQ ID NO: 2415030 - RNA, 14 nt, Human
uaaaaccacagcag

SEQ ID NO: 2415031 - RNA, 22 nt, Human
uaaaaaugagguacucuccugg

SEQ ID NO: 2415032 - RNA, 15 nt, Human
uaaaaccacagcagu

SEQ ID NO: 2415033 - RNA, 21 nt, Human
uaaaaccauguagaaaauuug

SEQ ID NO: 2415034 - RNA, 14 nt, Human
uaaaaaugaauccu

SEQ ID NO: 2415035 - RNA, 22 nt, Human
uaaaaauauuguguugugaaug

SEQ ID NO: 2415036 - RNA, 21 nt, Human
uaaaaauauuguguugugaau

SEQ ID NO: 2415037 - RNA, 23 nt, Human
uaaaaaucucaaauuucuaaauc

SEQ ID NO: 2415038 - RNA, 14 nt, Human
uaaaaaugaaauuu

SEQ ID NO: 2415039 - RNA, 18 nt, Human
uaaaaaugaaauuauuua

SEQ ID NO: 2415040 - RNA, 14 nt, Human
uaaaaaugaaauua

SEQ ID NO: 2415041 - RNA, 23 nt, Human
uaaaaauauggaacuucuaauau

SEQ ID NO: 2415042 - RNA, 15 nt, Human
uaaaaauauguacaa

SEQ ID NO: 2415043 - RNA, 15 nt, Human
uaaaaaugagguacu

SEQ ID NO: 2415044 - RNA, 12 nt, Human
uaaaacuuuuua

SEQ ID NO: 2415045 - RNA, 15 nt, Human
uaaaacuuuuuaaaa

SEQ ID NO: 2415046 - RNA, 20 nt, Human
uaaaacuucucaagauacug

SEQ ID NO: 2415047 - RNA, 17 nt, Human
uaaaacuguuaaagucu

SEQ ID NO: 2415048 - RNA, 14 nt, Human
uaaaacuuugcugc

SEQ ID NO: 2415049 - RNA, 15 nt, Human
uaaaacuuugcugcc

SEQ ID NO: 2415050 - RNA, 13 nt, Human
uaaaacugucccu

SEQ ID NO: 2415051 - RNA, 10 nt, Human
uaaaacugcg

SEQ ID NO: 2415052 - RNA, 13 nt, Human
uaaaacugaauug

SEQ ID NO: 2415053 - RNA, 19 nt, Human
uaaaacugaagucugaaau

SEQ ID NO: 2415054 - RNA, 18 nt, Human
uaaaacugaagucugaaa

SEQ ID NO: 2415055 - RNA, 17 nt, Human
uaaaacugaagucugaa

SEQ ID NO: 2415056 - RNA, 17 nt, Human
uaaaacuggcuuuggcu

SEQ ID NO: 2415057 - RNA, 13 nt, Human
uaaaacuguacuu

SEQ ID NO: 2415058 - RNA, 18 nt, Human
uaaaacuggcuuuggcuu

SEQ ID NO: 2415059 - RNA, 20 nt, Human
uaaaacugaagucugaaauu

SEQ ID NO: 2415060 - RNA, 13 nt, Human
uaaaacccaagug

SEQ ID NO: 2415061 - RNA, 16 nt, Human
uaaaacugaagucuga

SEQ ID NO: 2415062 - RNA, 22 nt, Human
guuucaauugcaucucccagau

SEQ ID NO: 2415063 - RNA, 16 nt, Human
guuucaauugcaucuc

SEQ ID NO: 2415064 - RNA, 17 nt, Human
guuucaauugcaucucc

SEQ ID NO: 2415065 - RNA, 19 nt, Human
guuucacggugccagguuu

SEQ ID NO: 2415066 - RNA, 21 nt, Human
guuucaaugugauucuaaugu

SEQ ID NO: 2415067 - RNA, 19 nt, Human
guuucaaugugauucuaau

SEQ ID NO: 2415068 - RNA, 13 nt, Human
guuucaaugugau

SEQ ID NO: 2415069 - RNA, 22 nt, Human
guuucaauuccaccugcaauca

SEQ ID NO: 2415070 - RNA, 15 nt, Human
guuucaauucagugc

SEQ ID NO: 2415071 - RNA, 17 nt, Human
guuucaaacuuuacuau

SEQ ID NO: 2415072 - RNA, 23 nt, Human
guuucaaccaagucaugugcauu

SEQ ID NO: 2415073 - RNA, 17 nt, Human
guuuaugcaaggaagga

SEQ ID NO: 2415074 - RNA, 13 nt, Human
guuuauggccuca

SEQ ID NO: 2415075 - RNA, 14 nt, Human
guuuauggccucag

SEQ ID NO: 2415076 - RNA, 15 nt, Human
guuuauggccucagc

SEQ ID NO: 2415077 - RNA, 18 nt, Human
guuuauggccucagcugc

SEQ ID NO: 2415078 - RNA, 22 nt, Human
guuuauggccucagcugccuca

SEQ ID NO: 2415079 - RNA, 23 nt, Human
guuuauggccucagcugccucac

SEQ ID NO: 2415080 - RNA, 14 nt, Human
guuuaugauuccac

SEQ ID NO: 2415081 - RNA, 20 nt, Human
guuuaauacucauccuugua

SEQ ID NO: 2415082 - RNA, 13 nt, Human
guuuaugagccag

SEQ ID NO: 2415083 - RNA, 16 nt, Human
guuuaaagagagguua

SEQ ID NO: 2415084 - RNA, 15 nt, Human
guuuaaagagagguu

SEQ ID NO: 2415085 - RNA, 17 nt, Human
guuguuuguauguauaa

SEQ ID NO: 2415086 - RNA, 19 nt, Human
guuguuuuuugaaaacaug

SEQ ID NO: 2415087 - RNA, 19 nt, Human
guuuaaauauuucaagaca

SEQ ID NO: 2415088 - RNA, 13 nt, Human
guuuaauacucau

SEQ ID NO: 2415089 - RNA, 12 nt, Human
guuuaaguguug

SEQ ID NO: 2415090 - RNA, 21 nt, Human
guuuaagugacugauggcuaa

SEQ ID NO: 2415091 - RNA, 14 nt, Human
guuuaaauauuuca

SEQ ID NO: 2415092 - RNA, 13 nt, Human
guuuaaauauuuc

SEQ ID NO: 2415093 - RNA, 23 nt, Human
guuuaaauaaaguaucaugcauu

SEQ ID NO: 2415094 - RNA, 22 nt, Human
guuuaaauaaaguaucaugcau

SEQ ID NO: 2415095 - RNA, 19 nt, Human
guuuaaauaaaguaucaug

SEQ ID NO: 2415096 - RNA, 17 nt, Human
guuuaaauaaaguauca

SEQ ID NO: 2415097 - RNA, 16 nt, Human
guuuaaauaaaguauc

SEQ ID NO: 2415098 - RNA, 15 nt, Human
guuuaaauaaaguau

SEQ ID NO: 2415099 - RNA, 14 nt, Human
guuuaaauaaagua

SEQ ID NO: 2415100 - RNA, 14 nt, Human
guuuaaagcaacug

SEQ ID NO: 2415101 - RNA, 13 nt, Human
guuuaaauaaagu

SEQ ID NO: 2415102 - RNA, 21 nt, Human
aaggaaaaauguguaauuuug

SEQ ID NO: 2415103 - RNA, 17 nt, Human
aaggaaaaauguguaau

SEQ ID NO: 2415104 - RNA, 16 nt, Human
aaggaaaaauguguaa

SEQ ID NO: 2415105 - RNA, 15 nt, Human
aaggaaaaaugugua

SEQ ID NO: 2415106 - RNA, 14 nt, Human
aaggaaaaaugugu

SEQ ID NO: 2415107 - RNA, 17 nt, Human
aaggaaaaauaaauauu

SEQ ID NO: 2415108 - RNA, 21 nt, Human
aaggaaaaagcacaagaagcg

SEQ ID NO: 2415109 - RNA, 22 nt, Human
aaggaaacccagcucuggucca

SEQ ID NO: 2415110 - RNA, 17 nt, Human
aaggaaacccagcucug

SEQ ID NO: 2415111 - RNA, 23 nt, Human
guuguuugauucagacagcugcc

SEQ ID NO: 2415112 - RNA, 12 nt, Human
guuguuugcaug

SEQ ID NO: 2415113 - RNA, 21 nt, Human
aaggaaacuugaaucaaagca

SEQ ID NO: 2415114 - RNA, 13 nt, Human
guuguuuguaugu

SEQ ID NO: 2415115 - RNA, 19 nt, Human
aaggaaacucuuaucucag

SEQ ID NO: 2415116 - RNA, 16 nt, Human
aaggaaacucuuaucu

SEQ ID NO: 2415117 - RNA, 20 nt, Human
aaggaaacuggguuccugca

SEQ ID NO: 2415118 - RNA, 13 nt, Human
aaggaaacucuua

SEQ ID NO: 2415119 - RNA, 12 nt, Human
aaggaaacucuu

SEQ ID NO: 2415120 - RNA, 17 nt, Human
aaggaaaauaguaaugu

SEQ ID NO: 2415121 - RNA, 23 nt, Human
aagggggcugggacaugggaaag

SEQ ID NO: 2415122 - RNA, 12 nt, Human
aagggggcuggg

SEQ ID NO: 2415123 - RNA, 18 nt, Human
aaggggagagccugcugg

SEQ ID NO: 2415124 - RNA, 15 nt, Human
aaggggagagccugc

SEQ ID NO: 2415125 - RNA, 14 nt, Human
aaggggagagccug

SEQ ID NO: 2415126 - RNA, 12 nt, Human
aaggggagagcc

SEQ ID NO: 2415127 - RNA, 19 nt, Human
aaggggagagccugcuggc

SEQ ID NO: 2415128 - RNA, 13 nt, Human
aaggggagaguaa

SEQ ID NO: 2415129 - RNA, 14 nt, Human
aagguagccauccc

SEQ ID NO: 2415130 - RNA, 12 nt, Human
aagguaguuuuu

SEQ ID NO: 2415131 - RNA, 22 nt, Human
aagguaguuuuuaccuaccaca

SEQ ID NO: 2415132 - RNA, 20 nt, Human
aagguagcccuggccagagg

SEQ ID NO: 2415133 - RNA, 17 nt, Human
aagggggucccaguggg

SEQ ID NO: 2415134 - RNA, 12 nt, Human
aaggggguccca

SEQ ID NO: 2415135 - RNA, 17 nt, Human
aaggggguggugucucc

SEQ ID NO: 2415136 - RNA, 19 nt, Human
aagggggucccagugggag

SEQ ID NO: 2415137 - RNA, 16 nt, Human
aaggggguccacccag

SEQ ID NO: 2415138 - RNA, 15 nt, Human
aaggggggagcuggg

SEQ ID NO: 2415139 - RNA, 21 nt, Human
aagggggauaugaauggagau

SEQ ID NO: 2415140 - RNA, 12 nt, Human
aaguaaaugcua

SEQ ID NO: 2415141 - RNA, 20 nt, Human
aagguuuuauaaggcugaug

SEQ ID NO: 2415142 - RNA, 18 nt, Human
aagguauuaaauugaugu

SEQ ID NO: 2415143 - RNA, 22 nt, Human
aagguauuaaauugauguugcu

SEQ ID NO: 2415144 - RNA, 19 nt, Human
aagguaucaguugcaauaa

SEQ ID NO: 2415145 - RNA, 20 nt, Human
aagguaucaguugcaauaau

SEQ ID NO: 2415146 - RNA, 11 nt, Human
aagguauaauu

SEQ ID NO: 2415147 - RNA, 16 nt, Human
aagguuucguuucugu

SEQ ID NO: 2415148 - RNA, 22 nt, Human
aagguuuaggcugguggcccag

SEQ ID NO: 2415149 - RNA, 23 nt, Human
aagguuucagaaagaagugggga

SEQ ID NO: 2415150 - RNA, 22 nt, Human
aagguuucguuucuguauacaa

SEQ ID NO: 2415151 - RNA, 21 nt, Human
aagguuucguuucuguauaca

SEQ ID NO: 2415152 - RNA, 16 nt, Human
aagguuucugaaaauu

SEQ ID NO: 2415153 - RNA, 17 nt, Human
aagguuuguauauuguc

SEQ ID NO: 2415154 - RNA, 13 nt, Human
aagguuuggugug

SEQ ID NO: 2415155 - RNA, 11 nt, Human
guuucagaaau

SEQ ID NO: 2415156 - RNA, 13 nt, Human
guuucagaaaugu

SEQ ID NO: 2415157 - RNA, 16 nt, Human
aaggcugggggaagaa

SEQ ID NO: 2415158 - RNA, 14 nt, Human
aaggcugggggaag

SEQ ID NO: 2415159 - RNA, 19 nt, Human
aaggcugggggaagaagcu

SEQ ID NO: 2415160 - RNA, 22 nt, Human
aaggcugggggaagaagcucuc

SEQ ID NO: 2415161 - RNA, 20 nt, Human
aaggcugucaauuacaggaa

SEQ ID NO: 2415162 - RNA, 16 nt, Human
aaggcugugcucccug

SEQ ID NO: 2415163 - RNA, 22 nt, Human
aaggcuguccuuacccaucugc

SEQ ID NO: 2415164 - RNA, 20 nt, Human
guuucacugacuuagaacca

SEQ ID NO: 2415165 - RNA, 21 nt, Human
guuucacuuucacauagaugu

SEQ ID NO: 2415166 - RNA, 17 nt, Human
aaggggaauugaggaca

SEQ ID NO: 2415167 - RNA, 17 nt, Human
aagggcuguuauaaucu

SEQ ID NO: 2415168 - RNA, 18 nt, Human
aagggcuucugcacccuc

SEQ ID NO: 2415169 - RNA, 17 nt, Human
aagggcuucugcacccu

SEQ ID NO: 2415170 - RNA, 21 nt, Human
aagggcuuacacguggaggaa

SEQ ID NO: 2415171 - RNA, 20 nt, Human
aaggggacccccgcccccug

SEQ ID NO: 2415172 - RNA, 16 nt, Human
aaggggacccccgccc

SEQ ID NO: 2415173 - RNA, 15 nt, Human
aagggcuguuauaau

SEQ ID NO: 2415174 - RNA, 19 nt, Human
aagggcuagaaccuggagg

SEQ ID NO: 2415175 - RNA, 19 nt, Human
aagggcuagaaccuggaga

SEQ ID NO: 2415176 - RNA, 19 nt, Human
aaggcuguguacacugaca

SEQ ID NO: 2415177 - RNA, 22 nt, Human
aaggcugugcucccugguucug

SEQ ID NO: 2415178 - RNA, 13 nt, Human
aaggcuguugcau

SEQ ID NO: 2415179 - RNA, 23 nt, Human
aaggcuguugcaugggcuaauga

SEQ ID NO: 2415180 - RNA, 16 nt, Human
guuuggaccccagcug

SEQ ID NO: 2415181 - RNA, 15 nt, Human
guuuggaccccagcu

SEQ ID NO: 2415182 - RNA, 15 nt, Human
guuuggaaugcuucu

SEQ ID NO: 2415183 - RNA, 13 nt, Human
guuuggaaugcuu

SEQ ID NO: 2415184 - RNA, 19 nt, Human
guuuggaccccagcuggga

SEQ ID NO: 2415185 - RNA, 18 nt, Human
guuuggaccccagcuggg

SEQ ID NO: 2415186 - RNA, 17 nt, Human
guuuggaccccagcugg

SEQ ID NO: 2415187 - RNA, 13 nt, Human
guuuggagacaga

SEQ ID NO: 2415188 - RNA, 20 nt, Human
guuugcuuuguaugcacuuu

SEQ ID NO: 2415189 - RNA, 23 nt, Human
guuuggagacauuccugggcaca

SEQ ID NO: 2415190 - RNA, 13 nt, Human
guuuggagacauu

SEQ ID NO: 2415191 - RNA, 21 nt, Human
guuuggaggagcaaaggcuga

SEQ ID NO: 2415192 - RNA, 20 nt, Human
guuuggaugggagugagaca

SEQ ID NO: 2415193 - RNA, 17 nt, Human
guuuuaaaaugagaaau

SEQ ID NO: 2415194 - RNA, 12 nt, Human
guuuuaaaauua

SEQ ID NO: 2415195 - RNA, 19 nt, Human
guuuuaaacauagaaaguu

SEQ ID NO: 2415196 - RNA, 18 nt, Human
guuuggauucuuauguag

SEQ ID NO: 2415197 - RNA, 14 nt, Human
guuuuaaaauuaaa

SEQ ID NO: 2415198 - RNA, 22 nt, Human
guuuuaaauacgcacuacaugu

SEQ ID NO: 2415199 - RNA, 12 nt, Human
guuuuaaauucu

SEQ ID NO: 2415200 - RNA, 15 nt, Human
guuuuaaagugauua

SEQ ID NO: 2415201 - RNA, 19 nt, Human
guuuuaaauuuauuucaaa

SEQ ID NO: 2415202 - RNA, 22 nt, Human
guuuuaaagaccugacaccuuu

SEQ ID NO: 2415203 - RNA, 18 nt, Human
guuugcuguugauuucuu

SEQ ID NO: 2415204 - RNA, 13 nt, Human
guuugcuuauugu

SEQ ID NO: 2415205 - RNA, 14 nt, Human
guuugcuuauuguu

SEQ ID NO: 2415206 - RNA, 15 nt, Human
guuugcuuauuguuc

SEQ ID NO: 2415207 - RNA, 16 nt, Human
guuugcuuauuguucc

SEQ ID NO: 2415208 - RNA, 17 nt, Human
guuugcuuauuguucca

SEQ ID NO: 2415209 - RNA, 16 nt, Human
guuugcuucauaaaug

SEQ ID NO: 2415210 - RNA, 17 nt, Human
guuugcuucauaaauga

SEQ ID NO: 2415211 - RNA, 18 nt, Human
guuugcuuauuguuccaa

SEQ ID NO: 2415212 - RNA, 21 nt, Human
aaguaauaugcacacauuuuu

SEQ ID NO: 2415213 - RNA, 19 nt, Human
guuugcugaacaccuugug

SEQ ID NO: 2415214 - RNA, 18 nt, Human
aaguaagaaagugaagca

SEQ ID NO: 2415215 - RNA, 19 nt, Human
aaguaagaaaauauuuugu

SEQ ID NO: 2415216 - RNA, 18 nt, Human
aaguaauaugcacacauu

SEQ ID NO: 2415217 - RNA, 20 nt, Human
aaguaauaugcacacauuuu

SEQ ID NO: 2415218 - RNA, 17 nt, Human
aaguaauaugcacacau

SEQ ID NO: 2415219 - RNA, 18 nt, Human
aaguaagaaaauauuuug

SEQ ID NO: 2415220 - RNA, 16 nt, Human
aaguaagaaaauauuu

SEQ ID NO: 2415221 - RNA, 15 nt, Human
aaguaagaaaauauu

SEQ ID NO: 2415222 - RNA, 14 nt, Human
aaguaagaaaauau

SEQ ID NO: 2415223 - RNA, 13 nt, Human
aaguaagaaaaua

SEQ ID NO: 2415224 - RNA, 12 nt, Human
aaguaagaaaau

SEQ ID NO: 2415225 - RNA, 11 nt, Human
aaguaagaaaa

SEQ ID NO: 2415226 - RNA, 14 nt, Human
guuuucuguucuuu

SEQ ID NO: 2415227 - RNA, 15 nt, Human
guuuucuguucuuuc

SEQ ID NO: 2415228 - RNA, 16 nt, Human
guuuucuguucuuucu

SEQ ID NO: 2415229 - RNA, 18 nt, Human
guuuugaaugguguugua

SEQ ID NO: 2415230 - RNA, 21 nt, Human
guuuugaaggcaaaauugcaa

SEQ ID NO: 2415231 - RNA, 15 nt, Human
guuuugaaggcaaaa

SEQ ID NO: 2415232 - RNA, 17 nt, Human
guuuugacauuuuuagu

SEQ ID NO: 2415233 - RNA, 14 nt, Human
guuuugacauuuuu

SEQ ID NO: 2415234 - RNA, 16 nt, Human
guuuugacggaugauu

SEQ ID NO: 2415235 - RNA, 12 nt, Human
guuuugagcuuu

SEQ ID NO: 2415236 - RNA, 19 nt, Human
guuuugauugagaguaacu

SEQ ID NO: 2415237 - RNA, 13 nt, Human
guuuugauugaga

SEQ ID NO: 2415238 - RNA, 20 nt, Human
guuuugauuuaauguuuuca

SEQ ID NO: 2415239 - RNA, 22 nt, Human
guuuugauguuuguggccucag

SEQ ID NO: 2415240 - RNA, 23 nt, Human
guuuugauguuuguggccucaga

SEQ ID NO: 2415241 - RNA, 19 nt, Human
guuuugauaaaguaguaaa

SEQ ID NO: 2415242 - RNA, 14 nt, Human
guuuugauaaagua

SEQ ID NO: 2415243 - RNA, 23 nt, Human
guuuugagguuuccuucagacag

SEQ ID NO: 2415244 - RNA, 20 nt, Human
guuuugauaaaguaguaaaa

SEQ ID NO: 2415245 - RNA, 21 nt, Human
guuuugauguuuguggccuca

SEQ ID NO: 2415246 - RNA, 22 nt, Human
guuuuaauuccaugaaucgcuu

SEQ ID NO: 2415247 - RNA, 16 nt, Human
guuuuaauuccaugaa

SEQ ID NO: 2415248 - RNA, 14 nt, Human
guuuuaauuccaug

SEQ ID NO: 2415249 - RNA, 13 nt, Human
guuuuaauuccau

SEQ ID NO: 2415250 - RNA, 23 nt, Human
guuuuaauuccaauaugaugacu

SEQ ID NO: 2415251 - RNA, 20 nt, Human
guuuuaauuccaauaugaug

SEQ ID NO: 2415252 - RNA, 17 nt, Human
guuuuaaguuguuugca

SEQ ID NO: 2415253 - RNA, 18 nt, Human
guuuuaaguuguuugcau

SEQ ID NO: 2415254 - RNA, 22 nt, Human
guuuuaaggaugcuuguacaua

SEQ ID NO: 2415255 - RNA, 22 nt, Human
guuuuaacaauuuccuuuauau

SEQ ID NO: 2415256 - RNA, 14 nt, Human
guuuuaacaaaaac

SEQ ID NO: 2415257 - RNA, 19 nt, Human
guuuuaacuagaauuuauu

SEQ ID NO: 2415258 - RNA, 20 nt, Human
guuuuauuccuguauguugu

SEQ ID NO: 2415259 - RNA, 14 nt, Human
guuuuauuccugua

SEQ ID NO: 2415260 - RNA, 13 nt, Human
guuuuauuguguu

SEQ ID NO: 2415261 - RNA, 13 nt, Human
guuuuaugacuuc

SEQ ID NO: 2415262 - RNA, 18 nt, Human
guuuuaugacuucauuaa

SEQ ID NO: 2415263 - RNA, 22 nt, Human
guuuuaucaugacauguuauau

SEQ ID NO: 2415264 - RNA, 14 nt, Human
guuuuaucaugaca

SEQ ID NO: 2415265 - RNA, 22 nt, Human
guuuuaucacauguauguuuug

SEQ ID NO: 2415266 - RNA, 21 nt, Human
guuuuaucacauguauguuuu

SEQ ID NO: 2415267 - RNA, 20 nt, Human
guuuuaucacauguauguuu

SEQ ID NO: 2415268 - RNA, 18 nt, Human
guuuuaucacauguaugu

SEQ ID NO: 2415269 - RNA, 19 nt, Human
guuuuauauuuuuauagac

SEQ ID NO: 2415270 - RNA, 14 nt, Human
guuuuaauuuaaac

SEQ ID NO: 2415271 - RNA, 21 nt, Human
guuuuaauuuaaacaccuccu

SEQ ID NO: 2415272 - RNA, 19 nt, Human
aaguauguuagugcaaauu

SEQ ID NO: 2415273 - RNA, 18 nt, Human
aaguauguuagugcaaau

SEQ ID NO: 2415274 - RNA, 15 nt, Human
aaguauuauaccuuu

SEQ ID NO: 2415275 - RNA, 19 nt, Human
aaguauguguaaaauguga

SEQ ID NO: 2415276 - RNA, 20 nt, Human
aaguacuucuccacccugcu

SEQ ID NO: 2415277 - RNA, 19 nt, Human
aaguacuucuccacccugc

SEQ ID NO: 2415278 - RNA, 18 nt, Human
aaguacuucuccacccug

SEQ ID NO: 2415279 - RNA, 16 nt, Human
aaguacuguguacaga

SEQ ID NO: 2415280 - RNA, 22 nt, Human
aaguaauucugcugucucagcc

SEQ ID NO: 2415281 - RNA, 14 nt, Human
aaguaauuccucuc

SEQ ID NO: 2415282 - RNA, 16 nt, Human
aaguaauugugaaaaa

SEQ ID NO: 2415283 - RNA, 19 nt, Human
guuuugauuuguacugaaa

SEQ ID NO: 2415284 - RNA, 11 nt, Human
aaguaauuauc

SEQ ID NO: 2415285 - RNA, 13 nt, Human
aaguaauuaucgg

SEQ ID NO: 2415286 - RNA, 15 nt, Human
aaguaauuaucggga

SEQ ID NO: 2415287 - RNA, 22 nt, Human
aaguaauuaucgggaacagugu

SEQ ID NO: 2415288 - RNA, 23 nt, Human
aaguaauuaucgggaacaguguu

SEQ ID NO: 2415289 - RNA, 16 nt, Human
aaguacguuauuguug

SEQ ID NO: 2415290 - RNA, 15 nt, Human
aaguacguuauuguu

SEQ ID NO: 2415291 - RNA, 20 nt, Human
aaguacccguucacauuuuu

SEQ ID NO: 2415292 - RNA, 14 nt, Human
aaguacuauaauuu

SEQ ID NO: 2415293 - RNA, 17 nt, Human
aaguacuauaauuuacc

SEQ ID NO: 2415294 - RNA, 13 nt, Human
aaguacuauguau

SEQ ID NO: 2415295 - RNA, 22 nt, Human
aagucagaggauggccaguguc

SEQ ID NO: 2415296 - RNA, 21 nt, Human
aagucagaggauggccagugu

SEQ ID NO: 2415297 - RNA, 20 nt, Human
aagucagaggauggccagug

SEQ ID NO: 2415298 - RNA, 15 nt, Human
aagucagaggauggc

SEQ ID NO: 2415299 - RNA, 14 nt, Human
aagucacugcacag

SEQ ID NO: 2415300 - RNA, 16 nt, Human
aagucagacugcuggg

SEQ ID NO: 2415301 - RNA, 17 nt, Human
aagucagacugcuggga

SEQ ID NO: 2415302 - RNA, 12 nt, Human
aagucagaggau

SEQ ID NO: 2415303 - RNA, 20 nt, Human
aagucagacugcugggacug

SEQ ID NO: 2415304 - RNA, 15 nt, Human
aaguauuuuuuuauc

SEQ ID NO: 2415305 - RNA, 16 nt, Human
aagucaaaaggugccu

SEQ ID NO: 2415306 - RNA, 19 nt, Human
aagucaaaaggugccugug

SEQ ID NO: 2415307 - RNA, 23 nt, Human
aagucaaagacauucugacaucu

SEQ ID NO: 2415308 - RNA, 21 nt, Human
aagucacuggccaguggcugg

SEQ ID NO: 2415309 - RNA, 22 nt, Human
aagucacugcacagugcaucuc

SEQ ID NO: 2415310 - RNA, 15 nt, Human
aagucaaauuaauaa

SEQ ID NO: 2415311 - RNA, 19 nt, Human
aagucaaauuaauaaucuu

SEQ ID NO: 2415312 - RNA, 22 nt, Human
aagucaaaguaaaacuugcugc

SEQ ID NO: 2415313 - RNA, 20 nt, Human
aagucaaagcaaggaaacua

SEQ ID NO: 2415314 - RNA, 14 nt, Human
aagucaaaguaaaa

SEQ ID NO: 2415315 - RNA, 16 nt, Human
aaguauuauaccuuuu

SEQ ID NO: 2415316 - RNA, 19 nt, Human
aaguauuauaccuuuuuua

SEQ ID NO: 2415317 - RNA, 13 nt, Human
aaguauuauaaau

SEQ ID NO: 2415318 - RNA, 13 nt, Human
aaguauuaucaga

SEQ ID NO: 2415319 - RNA, 21 nt, Human
aaguauucuuauuuaaugaaa

SEQ ID NO: 2415320 - RNA, 18 nt, Human
aaguauugcaucuguaua

SEQ ID NO: 2415321 - RNA, 17 nt, Human
aaguauuauaaauuaug

SEQ ID NO: 2415322 - RNA, 15 nt, Human
aaguauuaugucucu

SEQ ID NO: 2415323 - RNA, 22 nt, Human
aaguauugcaucuguauaagua

SEQ ID NO: 2415324 - RNA, 19 nt, Human
aaguauugcaucuguauaa

SEQ ID NO: 2415325 - RNA, 23 nt, Human
aaguauucuuauuuaaugaaaga

SEQ ID NO: 2415326 - RNA, 15 nt, Human
aaguauuuugcugga

SEQ ID NO: 2415327 - RNA, 22 nt, Human
gucuaugggacucaaugcacug

SEQ ID NO: 2415328 - RNA, 22 nt, Human
gucuauguaaaugcaucugucc

SEQ ID NO: 2415329 - RNA, 19 nt, Human
gucuaguuaacauuucaag

SEQ ID NO: 2415330 - RNA, 12 nt, Human
gucuauucauua

SEQ ID NO: 2415331 - RNA, 13 nt, Human
gucuauucagcuu

SEQ ID NO: 2415332 - RNA, 13 nt, Human
gucuauucuaguc

SEQ ID NO: 2415333 - RNA, 10 nt, Human
gucuauuuaa

SEQ ID NO: 2415334 - RNA, 17 nt, Human
gucuauucuccagcuga

SEQ ID NO: 2415335 - RNA, 18 nt, Human
gucgcucugcuggccugg

SEQ ID NO: 2415336 - RNA, 18 nt, Human
gucgcgcugccugugugg

SEQ ID NO: 2415337 - RNA, 20 nt, Human
gucgcucugcuggccuggcc

SEQ ID NO: 2415338 - RNA, 19 nt, Human
gucuagauggcuccucuca

SEQ ID NO: 2415339 - RNA, 20 nt, Human
gucuagauggcuccucucag

SEQ ID NO: 2415340 - RNA, 21 nt, Human
gucuagauggcuccucucagu

SEQ ID NO: 2415341 - RNA, 12 nt, Human
gucuagggagag

SEQ ID NO: 2415342 - RNA, 14 nt, Human
gucuagggagagac

SEQ ID NO: 2415343 - RNA, 23 nt, Human
gucuaggcaggaccuguggccaa

SEQ ID NO: 2415344 - RNA, 21 nt, Human
gucuaggagcugggaggaaaa

SEQ ID NO: 2415345 - RNA, 13 nt, Human
gucuaggagcugg

SEQ ID NO: 2415346 - RNA, 19 nt, Human
gucuagcagagcaggggca

SEQ ID NO: 2415347 - RNA, 16 nt, Human
gucuaccugaggggcc

SEQ ID NO: 2415348 - RNA, 15 nt, Human
gucuaccugaggggc

SEQ ID NO: 2415349 - RNA, 13 nt, Human
gucuaccugaggg

SEQ ID NO: 2415350 - RNA, 14 nt, Human
gucuaccugagggg

SEQ ID NO: 2415351 - RNA, 20 nt, Human
gucgccuuagcauguuugcu

SEQ ID NO: 2415352 - RNA, 18 nt, Human
gucgccuuagcauguuug

SEQ ID NO: 2415353 - RNA, 17 nt, Human
gucgccuuagcauguuu

SEQ ID NO: 2415354 - RNA, 12 nt, Human
gucgccucugca

SEQ ID NO: 2415355 - RNA, 19 nt, Human
gucgccaccuggcauuccu

SEQ ID NO: 2415356 - RNA, 14 nt, Human
gucgaugaacuauu

SEQ ID NO: 2415357 - RNA, 15 nt, Human
gucgcuccugcccac

SEQ ID NO: 2415358 - RNA, 11 nt, Human
gucgcuccugc

SEQ ID NO: 2415359 - RNA, 21 nt, Human
gucgcucaugugugcaacagg

SEQ ID NO: 2415360 - RNA, 16 nt, Human
gucgcucaugugugca

SEQ ID NO: 2415361 - RNA, 17 nt, Human
gucgcgcugccugugug

SEQ ID NO: 2415362 - RNA, 16 nt, Human
gucgcgcugccugugu

SEQ ID NO: 2415363 - RNA, 13 nt, Human
gucgcgcugccug

SEQ ID NO: 2415364 - RNA, 12 nt, Human
gucgcgcugccu

SEQ ID NO: 2415365 - RNA, 13 nt, Human
gucgcgcucagca

SEQ ID NO: 2415366 - RNA, 22 nt, Human
guccuuuucagaagugagcuuu

SEQ ID NO: 2415367 - RNA, 15 nt, Human
guccuuuucagaagu

SEQ ID NO: 2415368 - RNA, 14 nt, Human
guccuuucccucca

SEQ ID NO: 2415369 - RNA, 15 nt, Human
guccuuucccuccac

SEQ ID NO: 2415370 - RNA, 15 nt, Human
guccuuuucacuaca

SEQ ID NO: 2415371 - RNA, 18 nt, Human
guccuuuucacuacacca

SEQ ID NO: 2415372 - RNA, 19 nt, Human
guccuggagcagaccaccc

SEQ ID NO: 2415373 - RNA, 22 nt, Human
guccuuuccaaggcuucuccaa

SEQ ID NO: 2415374 - RNA, 20 nt, Human
guccuuuccaaggcuucucc

SEQ ID NO: 2415375 - RNA, 18 nt, Human
guccuuuccaaggcuucu

SEQ ID NO: 2415376 - RNA, 22 nt, Human
guccuuuauguggaaaacagaa

SEQ ID NO: 2415377 - RNA, 11 nt, Human
guccuuucccu

SEQ ID NO: 2415378 - RNA, 13 nt, Human
guccuuucccucc

SEQ ID NO: 2415379 - RNA, 16 nt, Human
gucgaggacagggagg

SEQ ID NO: 2415380 - RNA, 12 nt, Human
gucgaggcagga

SEQ ID NO: 2415381 - RNA, 19 nt, Human
gucgaggggcucucagcuc

SEQ ID NO: 2415382 - RNA, 16 nt, Human
gucgaggggcucucag

SEQ ID NO: 2415383 - RNA, 15 nt, Human
gucgaggggcucuca

SEQ ID NO: 2415384 - RNA, 14 nt, Human
gucgaggggcucuc

SEQ ID NO: 2415385 - RNA, 14 nt, Human
gucgauagagcugu

SEQ ID NO: 2415386 - RNA, 14 nt, Human
gucgauaaucagag

SEQ ID NO: 2415387 - RNA, 15 nt, Human
guccugaccacccuc

SEQ ID NO: 2415388 - RNA, 14 nt, Human
guccugaccacccu

SEQ ID NO: 2415389 - RNA, 13 nt, Human
guccugaccaccc

SEQ ID NO: 2415390 - RNA, 20 nt, Human
guccuggacaccgggccagu

SEQ ID NO: 2415391 - RNA, 21 nt, Human
guccuggaagcgcgagggccu

SEQ ID NO: 2415392 - RNA, 16 nt, Human
guccuggcaugggaau

SEQ ID NO: 2415393 - RNA, 12 nt, Human
guccugaccacc

SEQ ID NO: 2415394 - RNA, 23 nt, Human
guccugaagaggcgggccagcca

SEQ ID NO: 2415395 - RNA, 19 nt, Human
guccugcugcaguugccag

SEQ ID NO: 2415396 - RNA, 22 nt, Human
guccugaagaggcgggccagcc

SEQ ID NO: 2415397 - RNA, 21 nt, Human
guccugaagaggcgggccagc

SEQ ID NO: 2415398 - RNA, 20 nt, Human
guccugaagaggcgggccag

SEQ ID NO: 2415399 - RNA, 17 nt, Human
guccugaagaggcgggc

SEQ ID NO: 2415400 - RNA, 16 nt, Human
guccugaagaggcggg

SEQ ID NO: 2415401 - RNA, 14 nt, Human
guccucuuuucuga

SEQ ID NO: 2415402 - RNA, 18 nt, Human
guccucuccaccuagugg

SEQ ID NO: 2415403 - RNA, 14 nt, Human
guccucuccaccua

SEQ ID NO: 2415404 - RNA, 13 nt, Human
guccucuccaccu

SEQ ID NO: 2415405 - RNA, 18 nt, Human
guccucuugccuccugga

SEQ ID NO: 2415406 - RNA, 20 nt, Human
guccucuccaccuaguggcu

SEQ ID NO: 2415407 - RNA, 15 nt, Human
guccucuuucaaagg

SEQ ID NO: 2415408 - RNA, 17 nt, Human
guccgguguccuuuuca

SEQ ID NO: 2415409 - RNA, 14 nt, Human
gucccuugagaccu

SEQ ID NO: 2415410 - RNA, 24 nt, Human
guccgguguccuuuucacuacacc

SEQ ID NO: 2415411 - RNA, 19 nt, Human
gucccuuccccucccuggc

SEQ ID NO: 2415412 - RNA, 20 nt, Human
gucccuuccccucccuggcu

SEQ ID NO: 2415413 - RNA, 22 nt, Human
gucccuuccccucccuggcucc

SEQ ID NO: 2415414 - RNA, 19 nt, Human
gucccuucucuuaauuuaa

SEQ ID NO: 2415415 - RNA, 13 nt, Human
aacagucucagga

SEQ ID NO: 2415416 - RNA, 18 nt, Human
aacaguccauugaaaggg

SEQ ID NO: 2415417 - RNA, 19 nt, Human
guccgugggacggugccca

SEQ ID NO: 2415418 - RNA, 15 nt, Human
guccgugcugacagc

SEQ ID NO: 2415419 - RNA, 19 nt, Human
guccgugcugacagcugcu

SEQ ID NO: 2415420 - RNA, 20 nt, Human
guccgugcugacagcugcuc

SEQ ID NO: 2415421 - RNA, 21 nt, Human
guccgugcugacagcugcucc

SEQ ID NO: 2415422 - RNA, 13 nt, Human
aacagucauuuaa

SEQ ID NO: 2415423 - RNA, 22 nt, Human
guccgugcugacagcugcuccu

SEQ ID NO: 2415424 - RNA, 17 nt, Human
aacagucaaaacagaga

SEQ ID NO: 2415425 - RNA, 14 nt, Human
aacauaaaauacaa

SEQ ID NO: 2415426 - RNA, 14 nt, Human
aacagucucaggaa

SEQ ID NO: 2415427 - RNA, 14 nt, Human
aacagucauuuaaa

SEQ ID NO: 2415428 - RNA, 21 nt, Human
aacaguuuuuuaugcuaauca

SEQ ID NO: 2415429 - RNA, 12 nt, Human
aacauauauaac

SEQ ID NO: 2415430 - RNA, 21 nt, Human
aacauauaauguuguuauuua

SEQ ID NO: 2415431 - RNA, 18 nt, Human
aacauauaauguuguuau

SEQ ID NO: 2415432 - RNA, 13 nt, Human
aacauauaauguu

SEQ ID NO: 2415433 - RNA, 15 nt, Human
aacauauaaagcacu

SEQ ID NO: 2415434 - RNA, 17 nt, Human
aacauaaauaaaaugac

SEQ ID NO: 2415435 - RNA, 14 nt, Human
aacauaaauaaaau

SEQ ID NO: 2415436 - RNA, 18 nt, Human
aacauugguucuuguauu

SEQ ID NO: 2415437 - RNA, 19 nt, Human
aacauugguucuuguauua

SEQ ID NO: 2415438 - RNA, 22 nt, Human
aacauugguucuuguauuaaga

SEQ ID NO: 2415439 - RNA, 23 nt, Human
aacauugguucuuguauuaagaa

SEQ ID NO: 2415440 - RNA, 16 nt, Human
aacauugguucuugua

SEQ ID NO: 2415441 - RNA, 20 nt, Human
aacauugccuauuucagugg

SEQ ID NO: 2415442 - RNA, 16 nt, Human
aacauugccuauuuca

SEQ ID NO: 2415443 - RNA, 14 nt, Human
aacauugccuauuu

SEQ ID NO: 2415444 - RNA, 22 nt, Human
aacauugcauauaacuuauauu

SEQ ID NO: 2415445 - RNA, 13 nt, Human
guccuccucugug

SEQ ID NO: 2415446 - RNA, 14 nt, Human
guccuccucuguga

SEQ ID NO: 2415447 - RNA, 23 nt, Human
guccuccugguggguccaggggc

SEQ ID NO: 2415448 - RNA, 22 nt, Human
guccuccugguggguccagggg

SEQ ID NO: 2415449 - RNA, 21 nt, Human
guccuccugguggguccaggg

SEQ ID NO: 2415450 - RNA, 12 nt, Human
guccucuccacc

SEQ ID NO: 2415451 - RNA, 17 nt, Human
guccucguagccaucuc

SEQ ID NO: 2415452 - RNA, 17 nt, Human
guccuccucaccucaug

SEQ ID NO: 2415453 - RNA, 15 nt, Human
guccuccucaccuca

SEQ ID NO: 2415454 - RNA, 21 nt, Human
guccuccucaccucaugccca

SEQ ID NO: 2415455 - RNA, 13 nt, Human
guccuccucaccu

SEQ ID NO: 2415456 - RNA, 18 nt, Human
aacauugggaaaucuuau

SEQ ID NO: 2415457 - RNA, 22 nt, Human
guccuccuaccgaaaccuugcc

SEQ ID NO: 2415458 - RNA, 12 nt, Human
guccuccucugu

SEQ ID NO: 2415459 - RNA, 22 nt, Human
guccuccucggaucaccgagag

SEQ ID NO: 2415460 - RNA, 21 nt, Human
guccuccucggaucaccgaga

SEQ ID NO: 2415461 - RNA, 13 nt, Human
aacaugucuccua

SEQ ID NO: 2415462 - RNA, 15 nt, Human
aacauguacuguucu

SEQ ID NO: 2415463 - RNA, 13 nt, Human
aacauguguuuua

SEQ ID NO: 2415464 - RNA, 19 nt, Human
aacaugucuccuauccugg

SEQ ID NO: 2415465 - RNA, 13 nt, Human
aacauguguacuu

SEQ ID NO: 2415466 - RNA, 15 nt, Human
aacauguaggaagua

SEQ ID NO: 2415467 - RNA, 22 nt, Human
aacauauaauguuguuauuuaa

SEQ ID NO: 2415468 - RNA, 17 nt, Human
aacauguauaauauuuu

SEQ ID NO: 2415469 - RNA, 10 nt, Human
aacauuccau

SEQ ID NO: 2415470 - RNA, 13 nt, Human
aacauuccauccu

SEQ ID NO: 2415471 - RNA, 14 nt, Human
aacauuccauccuu

SEQ ID NO: 2415472 - RNA, 23 nt, Human
aacauuccauccuugagucaaaa

SEQ ID NO: 2415473 - RNA, 23 nt, Human
aacauuauuuauucagcuucauu

SEQ ID NO: 2415474 - RNA, 16 nt, Human
aacauuauuuauucag

SEQ ID NO: 2415475 - RNA, 18 nt, Human
aacacuguucucugcccu

SEQ ID NO: 2415476 - RNA, 17 nt, Human
aacacuguucucugccc

SEQ ID NO: 2415477 - RNA, 16 nt, Human
aacacuguucucugcc

SEQ ID NO: 2415478 - RNA, 22 nt, Human
aacacuggugugaccugagggc

SEQ ID NO: 2415479 - RNA, 20 nt, Human
aacacuggugugaccugagg

SEQ ID NO: 2415480 - RNA, 17 nt, Human
aacacuggugugaccug

SEQ ID NO: 2415481 - RNA, 23 nt, Human
aacacugguggaggauggaaagg

SEQ ID NO: 2415482 - RNA, 23 nt, Human
gucauuuauauagauuauaacuu

SEQ ID NO: 2415483 - RNA, 14 nt, Human
gucauuuauaaaac

SEQ ID NO: 2415484 - RNA, 19 nt, Human
aacacuguucucugcccuc

SEQ ID NO: 2415485 - RNA, 15 nt, Human
gucauuucauuuccu

SEQ ID NO: 2415486 - RNA, 17 nt, Human
gucauuugagcagggcu

SEQ ID NO: 2415487 - RNA, 16 nt, Human
aacacuauuuuaugca

SEQ ID NO: 2415488 - RNA, 21 nt, Human
aacacucacauuuauucugcu

SEQ ID NO: 2415489 - RNA, 13 nt, Human
aacacuauuuuau

SEQ ID NO: 2415490 - RNA, 16 nt, Human
aacacuauguuuauuu

SEQ ID NO: 2415491 - RNA, 21 nt, Human
aacacuauauggcagugucuu

SEQ ID NO: 2415492 - RNA, 17 nt, Human
aacacucaagaagcagg

SEQ ID NO: 2415493 - RNA, 19 nt, Human
aacacagcugagagacuuu

SEQ ID NO: 2415494 - RNA, 15 nt, Human
aacacaggcaaaauc

SEQ ID NO: 2415495 - RNA, 19 nt, Human
aacacagcgagacuccguc

SEQ ID NO: 2415496 - RNA, 14 nt, Human
aacacucaugcuga

SEQ ID NO: 2415497 - RNA, 19 nt, Human
aacacuggcaacaacaaag

SEQ ID NO: 2415498 - RNA, 21 nt, Human
aacacugggagaaaugaaaaa

SEQ ID NO: 2415499 - RNA, 14 nt, Human
aacacuggggcugg

SEQ ID NO: 2415500 - RNA, 15 nt, Human
aacacuggccccuag

SEQ ID NO: 2415501 - RNA, 16 nt, Human
aacacucaugcugaaa

SEQ ID NO: 2415502 - RNA, 15 nt, Human
aacacucaugcugaa

SEQ ID NO: 2415503 - RNA, 12 nt, Human
aacacuggcccc

SEQ ID NO: 2415504 - RNA, 13 nt, Human
aacacuggccccu

SEQ ID NO: 2415505 - RNA, 17 nt, Human
aacacugggggagggga

SEQ ID NO: 2415506 - RNA, 18 nt, Human
aacacuggggcuggcaca

SEQ ID NO: 2415507 - RNA, 15 nt, Human
aacacuggggcuggc

SEQ ID NO: 2415508 - RNA, 16 nt, Human
aacacugggggagggg

SEQ ID NO: 2415509 - RNA, 18 nt, Human
aacacagcaagggugaug

SEQ ID NO: 2415510 - RNA, 15 nt, Human
aacacaagcuggaag

SEQ ID NO: 2415511 - RNA, 12 nt, Human
aacacacagaca

SEQ ID NO: 2415512 - RNA, 16 nt, Human
aacacaccaggcugug

SEQ ID NO: 2415513 - RNA, 15 nt, Human
aacacaccaggcugu

SEQ ID NO: 2415514 - RNA, 20 nt, Human
aacacagcaagggugauggg

SEQ ID NO: 2415515 - RNA, 16 nt, Human
aacacagcauguguau

SEQ ID NO: 2415516 - RNA, 18 nt, Human
aacacagcauguguauuu

SEQ ID NO: 2415517 - RNA, 17 nt, Human
aacacaagccacagaag

SEQ ID NO: 2415518 - RNA, 16 nt, Human
aacacaagccacagaa

SEQ ID NO: 2415519 - RNA, 14 nt, Human
aacacaagccacag

SEQ ID NO: 2415520 - RNA, 16 nt, Human
aacacaagcaaaaaaa

SEQ ID NO: 2415521 - RNA, 13 nt, Human
aacacaagcaaaa

SEQ ID NO: 2415522 - RNA, 12 nt, Human
aacacaagcaaa

SEQ ID NO: 2415523 - RNA, 14 nt, Human
aacacacaaaggua

SEQ ID NO: 2415524 - RNA, 18 nt, Human
aacacaagcuggaagcac

SEQ ID NO: 2415525 - RNA, 16 nt, Human
aacacaaguccuguga

SEQ ID NO: 2415526 - RNA, 16 nt, Human
aaauuugaagaaugaa

SEQ ID NO: 2415527 - RNA, 10 nt, Human
aaauuugaau

SEQ ID NO: 2415528 - RNA, 19 nt, Human
aaauuucuaaaucuccaaa

SEQ ID NO: 2415529 - RNA, 24 nt, Human
gucaguguccaaagcagggucugg

SEQ ID NO: 2415530 - RNA, 14 nt, Human
aaauuucuggaccu

SEQ ID NO: 2415531 - RNA, 19 nt, Human
aacacaaacgggcucagca

SEQ ID NO: 2415532 - RNA, 13 nt, Human
aacacaaacugua

SEQ ID NO: 2415533 - RNA, 20 nt, Human
aaauuugaauggguccauuu

SEQ ID NO: 2415534 - RNA, 15 nt, Human
aacacaaacuguaaa

SEQ ID NO: 2415535 - RNA, 16 nt, Human
aacacaaacuguaaau

SEQ ID NO: 2415536 - RNA, 19 nt, Human
aacacaaacuguaaauaaa

SEQ ID NO: 2415537 - RNA, 17 nt, Human
aacacaaacccccacuc

SEQ ID NO: 2415538 - RNA, 22 nt, Human
guccaugaagauguagaggaga

SEQ ID NO: 2415539 - RNA, 23 nt, Human
guccaugaagauguagaggagaa

SEQ ID NO: 2415540 - RNA, 20 nt, Human
guccaaccuaaccccuuucc

SEQ ID NO: 2415541 - RNA, 21 nt, Human
guccaaccuaaccccuuuccu

SEQ ID NO: 2415542 - RNA, 20 nt, Human
guccaacccgaggcccgcau

SEQ ID NO: 2415543 - RNA, 14 nt, Human
guccaaccuaaccc

SEQ ID NO: 2415544 - RNA, 17 nt, Human
guccaaccuaaccccuu

SEQ ID NO: 2415545 - RNA, 18 nt, Human
guccaaauguuuacaggg

SEQ ID NO: 2415546 - RNA, 20 nt, Human
guccaaauaaaaacuaaauu

SEQ ID NO: 2415547 - RNA, 22 nt, Human
guccaaauguccuccagaagcc

SEQ ID NO: 2415548 - RNA, 18 nt, Human
guccaaaagauugcugaa

SEQ ID NO: 2415549 - RNA, 21 nt, Human
guccaaacugccuaagcccuc

SEQ ID NO: 2415550 - RNA, 14 nt, Human
guccaaacugccua

SEQ ID NO: 2415551 - RNA, 19 nt, Human
gucauuugagcagggcuca

SEQ ID NO: 2415552 - RNA, 17 nt, Human
guccaaagcagggucug

SEQ ID NO: 2415553 - RNA, 14 nt, Human
guccaaaggaggcu

SEQ ID NO: 2415554 - RNA, 18 nt, Human
guccaaauaaaaacuaaa

SEQ ID NO: 2415555 - RNA, 15 nt, Human
guccaaauaaaaacu

SEQ ID NO: 2415556 - RNA, 13 nt, Human
guccaaauaaaaa

SEQ ID NO: 2415557 - RNA, 11 nt, Human
guccaaauaaa

SEQ ID NO: 2415558 - RNA, 16 nt, Human
guccaaaggaggcugg

SEQ ID NO: 2415559 - RNA, 20 nt, Human
guccaaaggaggcuggcagg

SEQ ID NO: 2415560 - RNA, 18 nt, Human
guccccaccgcagacagg

SEQ ID NO: 2415561 - RNA, 20 nt, Human
gucccaccccacacacgcca

SEQ ID NO: 2415562 - RNA, 14 nt, Human
guccccaccuggga

SEQ ID NO: 2415563 - RNA, 20 nt, Human
gucccaccaugcagugcccc

SEQ ID NO: 2415564 - RNA, 22 nt, Human
guccccagacuccaccaagccu

SEQ ID NO: 2415565 - RNA, 22 nt, Human
guccccaccgcagacaggacca

SEQ ID NO: 2415566 - RNA, 15 nt, Human
gucccaccccacaca

SEQ ID NO: 2415567 - RNA, 23 nt, Human
gucccaaggaaagccccagcacu

SEQ ID NO: 2415568 - RNA, 17 nt, Human
gucccacacuggugacu

SEQ ID NO: 2415569 - RNA, 19 nt, Human
gucccugguggcagcucac

SEQ ID NO: 2415570 - RNA, 19 nt, Human
gucccuguuuucugagccc

SEQ ID NO: 2415571 - RNA, 18 nt, Human
gucccuguuuucugagcc

SEQ ID NO: 2415572 - RNA, 17 nt, Human
gucccuguuuucugagc

SEQ ID NO: 2415573 - RNA, 15 nt, Human
gucccuguuuucuga

SEQ ID NO: 2415574 - RNA, 15 nt, Human
gucccugugccuaac

SEQ ID NO: 2415575 - RNA, 17 nt, Human
gucccuaaagaaaaaaa

SEQ ID NO: 2415576 - RNA, 18 nt, Human
gucccugguggcagcuca

SEQ ID NO: 2415577 - RNA, 15 nt, Human
gucccuaauaaagcu

SEQ ID NO: 2415578 - RNA, 15 nt, Human
gucccuaaagaaaaa

SEQ ID NO: 2415579 - RNA, 21 nt, Human
gucccgugcagcuucuguccu

SEQ ID NO: 2415580 - RNA, 23 nt, Human
gucccgggguccuguggcaggca

SEQ ID NO: 2415581 - RNA, 19 nt, Human
gucccgucaggacguugag

SEQ ID NO: 2415582 - RNA, 19 nt, Human
gucccuuacgugaguccug

SEQ ID NO: 2415583 - RNA, 18 nt, Human
gucccuuacgugaguccu

SEQ ID NO: 2415584 - RNA, 18 nt, Human
gucccuuccacaccccca

SEQ ID NO: 2415585 - RNA, 20 nt, Human
gucccuguuuucugagcccg

SEQ ID NO: 2415586 - RNA, 17 nt, Human
gucccuucacauaguuu

SEQ ID NO: 2415587 - RNA, 22 nt, Human
gucccuuccacacccccacccc

SEQ ID NO: 2415588 - RNA, 20 nt, Human
gucccuuccacacccccacc

SEQ ID NO: 2415589 - RNA, 12 nt, Human
gucccuuccccu

SEQ ID NO: 2415590 - RNA, 13 nt, Human
gucccuuccccuc

SEQ ID NO: 2415591 - RNA, 14 nt, Human
gucccuuccccucc

SEQ ID NO: 2415592 - RNA, 17 nt, Human
gucccuuccccucccug

SEQ ID NO: 2415593 - RNA, 18 nt, Human
gucccuuccccucccugg

SEQ ID NO: 2415594 - RNA, 22 nt, Human
guccccuguuuguuucugaaag

SEQ ID NO: 2415595 - RNA, 12 nt, Human
gucccuaauaaa

SEQ ID NO: 2415596 - RNA, 21 nt, Human
gucccgggguccuguggcagg

SEQ ID NO: 2415597 - RNA, 20 nt, Human
gucccgggguccuguggcag

SEQ ID NO: 2415598 - RNA, 19 nt, Human
gucccgggguccuguggca

SEQ ID NO: 2415599 - RNA, 16 nt, Human
gucccgggguccugug

SEQ ID NO: 2415600 - RNA, 14 nt, Human
gucccgggguccug

SEQ ID NO: 2415601 - RNA, 15 nt, Human
gucccggggcuccac

SEQ ID NO: 2415602 - RNA, 21 nt, Human
guccccucuugccccaacccc

SEQ ID NO: 2415603 - RNA, 16 nt, Human
guccccucuugcccca

SEQ ID NO: 2415604 - RNA, 15 nt, Human
guccccucuugcccc

SEQ ID NO: 2415605 - RNA, 23 nt, Human
guccccucuugccccaaccccca

SEQ ID NO: 2415606 - RNA, 18 nt, Human
guccccuguuuguuucug

SEQ ID NO: 2415607 - RNA, 19 nt, Human
guccccucccaucugggag

SEQ ID NO: 2415608 - RNA, 17 nt, Human
guccccucccaucuggg

SEQ ID NO: 2415609 - RNA, 16 nt, Human
guccccucccaucugg

SEQ ID NO: 2415610 - RNA, 22 nt, Human
guccccuccccggcccuaccag

SEQ ID NO: 2415611 - RNA, 16 nt, Human
guccccuccccggccc

SEQ ID NO: 2415612 - RNA, 13 nt, Human
guccccucuugcc

SEQ ID NO: 2415613 - RNA, 15 nt, Human
guccccaccugggac

SEQ ID NO: 2415614 - RNA, 16 nt, Human
gucacugagacagccc

SEQ ID NO: 2415615 - RNA, 15 nt, Human
gucacugagacagcc

SEQ ID NO: 2415616 - RNA, 15 nt, Human
gucacugaaggccug

SEQ ID NO: 2415617 - RNA, 20 nt, Human
gucacucuuccugcaaggac

SEQ ID NO: 2415618 - RNA, 19 nt, Human
gucacucuuccugcaagga

SEQ ID NO: 2415619 - RNA, 14 nt, Human
gucacugagacagc

SEQ ID NO: 2415620 - RNA, 23 nt, Human
gucacucuggcagcucagagagg

SEQ ID NO: 2415621 - RNA, 16 nt, Human
gucacauucaggaaga

SEQ ID NO: 2415622 - RNA, 17 nt, Human
gucaccaagcucacagu

SEQ ID NO: 2415623 - RNA, 14 nt, Human
gucacauucaggaa

SEQ ID NO: 2415624 - RNA, 15 nt, Human
gucaccaagcccagu

SEQ ID NO: 2415625 - RNA, 12 nt, Human
gucaccaagccc

SEQ ID NO: 2415626 - RNA, 23 nt, Human
gucacugagacagcccgggcucu

SEQ ID NO: 2415627 - RNA, 21 nt, Human
gucacugagacagcccgggcu

SEQ ID NO: 2415628 - RNA, 18 nt, Human
gucacugagacagcccgg

SEQ ID NO: 2415629 - RNA, 17 nt, Human
gucacugagacagcccg

SEQ ID NO: 2415630 - RNA, 14 nt, Human
gucacugcaggcac

SEQ ID NO: 2415631 - RNA, 23 nt, Human
gucacugcacagugcaucucagc

SEQ ID NO: 2415632 - RNA, 20 nt, Human
gucacugcacagugcaucuc

SEQ ID NO: 2415633 - RNA, 21 nt, Human
gucacugaaggccuggcccac

SEQ ID NO: 2415634 - RNA, 10 nt, Human
gucacugcuu

SEQ ID NO: 2415635 - RNA, 12 nt, Human
gucacugccucu

SEQ ID NO: 2415636 - RNA, 20 nt, Human
gucacugccucucccuggcc

SEQ ID NO: 2415637 - RNA, 22 nt, Human
gucacugccucucccuggcccu

SEQ ID NO: 2415638 - RNA, 23 nt, Human
gucacugccucucccuggcccuc

SEQ ID NO: 2415639 - RNA, 20 nt, Human
gucacugccauggaggcaca

SEQ ID NO: 2415640 - RNA, 16 nt, Human
gucacugccauggagg

SEQ ID NO: 2415641 - RNA, 13 nt, Human
gucacagggccaa

SEQ ID NO: 2415642 - RNA, 12 nt, Human
gucacagggcca

SEQ ID NO: 2415643 - RNA, 18 nt, Human
gucacagggccuggggag

SEQ ID NO: 2415644 - RNA, 20 nt, Human
gucacagggcaugccccggc

SEQ ID NO: 2415645 - RNA, 13 nt, Human
gucacaugaaaca

SEQ ID NO: 2415646 - RNA, 15 nt, Human
gucacaucacaggac

SEQ ID NO: 2415647 - RNA, 15 nt, Human
gucacagggccaacu

SEQ ID NO: 2415648 - RNA, 14 nt, Human
gucacauacaauua

SEQ ID NO: 2415649 - RNA, 23 nt, Human
gucacauggccuaugcacauaug

SEQ ID NO: 2415650 - RNA, 21 nt, Human
gucacauggccuaugcacaua

SEQ ID NO: 2415651 - RNA, 22 nt, Human
gucaccaaaucagcugcuacua

SEQ ID NO: 2415652 - RNA, 16 nt, Human
gucacaggagggaggg

SEQ ID NO: 2415653 - RNA, 19 nt, Human
gucacaggacucugccucc

SEQ ID NO: 2415654 - RNA, 12 nt, Human
gucacaggcagg

SEQ ID NO: 2415655 - RNA, 20 nt, Human
gucacaggaaguagaggagg

SEQ ID NO: 2415656 - RNA, 18 nt, Human
gucacaggacucugccuc

SEQ ID NO: 2415657 - RNA, 17 nt, Human
gucacaggacucugccu

SEQ ID NO: 2415658 - RNA, 22 nt, Human
gucaauuacaggaaguacugga

SEQ ID NO: 2415659 - RNA, 22 nt, Human
gucaauuucccugacuccucua

SEQ ID NO: 2415660 - RNA, 20 nt, Human
aaauuuaauauagcuauuuu

SEQ ID NO: 2415661 - RNA, 23 nt, Human
aaauuuaaaggguguacuuauau

SEQ ID NO: 2415662 - RNA, 12 nt, Human
aaauuuaagcau

SEQ ID NO: 2415663 - RNA, 13 nt, Human
aaauuuaagcauu

SEQ ID NO: 2415664 - RNA, 21 nt, Human
aaauuuaagugcguguguaga

SEQ ID NO: 2415665 - RNA, 16 nt, Human
aaauuuaagugcgugu

SEQ ID NO: 2415666 - RNA, 23 nt, Human
aaauuuaaguaucuuuuuucaaa

SEQ ID NO: 2415667 - RNA, 15 nt, Human
aaauuuaaguaucuu

SEQ ID NO: 2415668 - RNA, 14 nt, Human
aaauuuaagcauug

SEQ ID NO: 2415669 - RNA, 15 nt, Human
aaauuuaagcauugu

SEQ ID NO: 2415670 - RNA, 16 nt, Human
aaauuuaagcauuguu

SEQ ID NO: 2415671 - RNA, 17 nt, Human
aaauuuaagcauuguuu

SEQ ID NO: 2415672 - RNA, 13 nt, Human
gucacaggaagua

SEQ ID NO: 2415673 - RNA, 15 nt, Human
gucacaggaaguaga

SEQ ID NO: 2415674 - RNA, 21 nt, Human
gucaauuuuguuauguauauu

SEQ ID NO: 2415675 - RNA, 22 nt, Human
gucaauuucuguguugccaagc

SEQ ID NO: 2415676 - RNA, 17 nt, Human
gucaauuucuguguugc

SEQ ID NO: 2415677 - RNA, 17 nt, Human
gucaggggcagcugacc

SEQ ID NO: 2415678 - RNA, 14 nt, Human
gucaggggcagcug

SEQ ID NO: 2415679 - RNA, 20 nt, Human
gucagggcccaagucccugu

SEQ ID NO: 2415680 - RNA, 21 nt, Human
gucagggcccaagucccuguu

SEQ ID NO: 2415681 - RNA, 19 nt, Human
gucagggcccaagucccug

SEQ ID NO: 2415682 - RNA, 15 nt, Human
gucagggcccaaguc

SEQ ID NO: 2415683 - RNA, 14 nt, Human
gucagggcccaagu

SEQ ID NO: 2415684 - RNA, 12 nt, Human
gucagggcccaa

SEQ ID NO: 2415685 - RNA, 18 nt, Human
gucagggaccccugcccu

SEQ ID NO: 2415686 - RNA, 15 nt, Human
gucaggagagcagcg

SEQ ID NO: 2415687 - RNA, 14 nt, Human
gucaggagagcagc

SEQ ID NO: 2415688 - RNA, 12 nt, Human
gucaggagagca

SEQ ID NO: 2415689 - RNA, 17 nt, Human
gucaggaaggaugagca

SEQ ID NO: 2415690 - RNA, 18 nt, Human
gucaggaaggaugagcau

SEQ ID NO: 2415691 - RNA, 15 nt, Human
gucaggaagaaauca

SEQ ID NO: 2415692 - RNA, 17 nt, Human
gucaggaacagaaggau

SEQ ID NO: 2415693 - RNA, 15 nt, Human
gucaggaacagaagg

SEQ ID NO: 2415694 - RNA, 16 nt, Human
gucaggaacagaagga

SEQ ID NO: 2415695 - RNA, 22 nt, Human
gucagguggggcagcuugaggg

SEQ ID NO: 2415696 - RNA, 18 nt, Human
gucagguggggcagcuug

SEQ ID NO: 2415697 - RNA, 17 nt, Human
gucagguggggcagcuu

SEQ ID NO: 2415698 - RNA, 16 nt, Human
gucagguggggcagcu

SEQ ID NO: 2415699 - RNA, 13 nt, Human
aaauuucuaaauc

SEQ ID NO: 2415700 - RNA, 15 nt, Human
aaauuucuaaaucuc

SEQ ID NO: 2415701 - RNA, 12 nt, Human
aaauuucuaaau

SEQ ID NO: 2415702 - RNA, 23 nt, Human
gucagugccgccgccucgcccac

SEQ ID NO: 2415703 - RNA, 22 nt, Human
gucagugguccacaucccggga

SEQ ID NO: 2415704 - RNA, 23 nt, Human
gucaguguccaaagcagggucug

SEQ ID NO: 2415705 - RNA, 20 nt, Human
gucaguguccaaagcagggu

SEQ ID NO: 2415706 - RNA, 17 nt, Human
gucaguguccaaagcag

SEQ ID NO: 2415707 - RNA, 14 nt, Human
gucagugaggccca

SEQ ID NO: 2415708 - RNA, 18 nt, Human
gucagugcaaaugucaga

SEQ ID NO: 2415709 - RNA, 23 nt, Human
gucagugaggcccagggagaggc

SEQ ID NO: 2415710 - RNA, 22 nt, Human
gucagugggaacgugacugccc

SEQ ID NO: 2415711 - RNA, 22 nt, Human
gucagugccgccgccucgccca

SEQ ID NO: 2415712 - RNA, 17 nt, Human
gucagugccgccgccuc

SEQ ID NO: 2415713 - RNA, 16 nt, Human
gucagugcagcccgug

SEQ ID NO: 2415714 - RNA, 23 nt, Human
gucagugcagcccguguggcccc

SEQ ID NO: 2415715 - RNA, 13 nt, Human
gucagguuugagu

SEQ ID NO: 2415716 - RNA, 22 nt, Human
gucagucaugauggcaccacug

SEQ ID NO: 2415717 - RNA, 20 nt, Human
gucacuggcucuccaagugc

SEQ ID NO: 2415718 - RNA, 18 nt, Human
gucacuggcucuccaagu

SEQ ID NO: 2415719 - RNA, 17 nt, Human
gucacuggcucuccaag

SEQ ID NO: 2415720 - RNA, 16 nt, Human
gucacuggcucuccaa

SEQ ID NO: 2415721 - RNA, 15 nt, Human
gucacuggcucucca

SEQ ID NO: 2415722 - RNA, 14 nt, Human
gucacuggcucucc

SEQ ID NO: 2415723 - RNA, 12 nt, Human
gucacuggcucu

SEQ ID NO: 2415724 - RNA, 23 nt, Human
gucacuggagguugaagccaagu

SEQ ID NO: 2415725 - RNA, 19 nt, Human
gucacuggcugccuccacu

SEQ ID NO: 2415726 - RNA, 16 nt, Human
gucacuggcugccucc

SEQ ID NO: 2415727 - RNA, 14 nt, Human
gucacuggcugccu

SEQ ID NO: 2415728 - RNA, 21 nt, Human
gucacuggcucuccaagugcc

SEQ ID NO: 2415729 - RNA, 21 nt, Human
gucacuggcugccuccacucc

SEQ ID NO: 2415730 - RNA, 20 nt, Human
gucacuggcugccuccacuc

SEQ ID NO: 2415731 - RNA, 23 nt, Human
gucacuggcugccuccacuccca

SEQ ID NO: 2415732 - RNA, 17 nt, Human
gucacugucccucaaau

SEQ ID NO: 2415733 - RNA, 21 nt, Human
gucacugguagaccaaaauaa

SEQ ID NO: 2415734 - RNA, 14 nt, Human
gucacugugguccu

SEQ ID NO: 2415735 - RNA, 19 nt, Human
gucacuguuuauuuuuuua

SEQ ID NO: 2415736 - RNA, 17 nt, Human
gucacuguuccuuguca

SEQ ID NO: 2415737 - RNA, 13 nt, Human
gucacuguuucuc

SEQ ID NO: 2415738 - RNA, 15 nt, Human
gucacuguuucucug

SEQ ID NO: 2415739 - RNA, 15 nt, Human
gucacugcuuaacuu

SEQ ID NO: 2415740 - RNA, 21 nt, Human
gucacugcuuaacuucacaua

SEQ ID NO: 2415741 - RNA, 23 nt, Human
gucacuggaaaggggagagccug

SEQ ID NO: 2415742 - RNA, 20 nt, Human
gucacuggaaaggggagagc

SEQ ID NO: 2415743 - RNA, 18 nt, Human
gucacuggaaaggggaga

SEQ ID NO: 2415744 - RNA, 15 nt, Human
gucacuggaaagggg

SEQ ID NO: 2415745 - RNA, 20 nt, Human
gucacuggagguugaagcca

SEQ ID NO: 2415746 - RNA, 18 nt, Human
gucacuggagguugaagc

SEQ ID NO: 2415747 - RNA, 19 nt, Human
gucacuggaccacugggca

SEQ ID NO: 2415748 - RNA, 12 nt, Human
gucacuggaaag

SEQ ID NO: 2415749 - RNA, 12 nt, Human
gucacugcuguc

SEQ ID NO: 2415750 - RNA, 11 nt, Human
gucacugcugu

SEQ ID NO: 2415751 - RNA, 23 nt, Human
gucacugccugcagaggucugug

SEQ ID NO: 2415752 - RNA, 18 nt, Human
gucacugccugcagaggu

SEQ ID NO: 2415753 - RNA, 13 nt, Human
gucaggaaagaga

SEQ ID NO: 2415754 - RNA, 14 nt, Human
gucaggaaagagaa

SEQ ID NO: 2415755 - RNA, 21 nt, Human
gucagaaguuucugccgcagc

SEQ ID NO: 2415756 - RNA, 13 nt, Human
gucagaaacuguu

SEQ ID NO: 2415757 - RNA, 18 nt, Human
gucacuucgcgugcccuc

SEQ ID NO: 2415758 - RNA, 16 nt, Human
gucacuuauuucauaa

SEQ ID NO: 2415759 - RNA, 24 nt, Human
gucacuucgcgugcccucgcugcu

SEQ ID NO: 2415760 - RNA, 23 nt, Human
gucacuugaugugccauuuuaaa

SEQ ID NO: 2415761 - RNA, 18 nt, Human
gucacuuacuguuucugu

SEQ ID NO: 2415762 - RNA, 16 nt, Human
gucacuuacuguuucu

SEQ ID NO: 2415763 - RNA, 15 nt, Human
gucacuuauuucaua

SEQ ID NO: 2415764 - RNA, 16 nt, Human
gucacuguuucucugc

SEQ ID NO: 2415765 - RNA, 20 nt, Human
gucacuuaccuagauuuaca

SEQ ID NO: 2415766 - RNA, 17 nt, Human
gucacuuuguuuuacug

SEQ ID NO: 2415767 - RNA, 23 nt, Human
gucacuuugcucuggguggaagu

SEQ ID NO: 2415768 - RNA, 17 nt, Human
gucacuuugcucugggu

SEQ ID NO: 2415769 - RNA, 16 nt, Human
gucacuuugcucuggg

SEQ ID NO: 2415770 - RNA, 16 nt, Human
aaauuacacccaaaga

SEQ ID NO: 2415771 - RNA, 22 nt, Human
aaauuacacccaaagagguauu

SEQ ID NO: 2415772 - RNA, 15 nt, Human
aaauuagccgggcgu

SEQ ID NO: 2415773 - RNA, 18 nt, Human
aaaugugccuucauuuuu

SEQ ID NO: 2415774 - RNA, 15 nt, Human
aaaugugcuuuuaaa

SEQ ID NO: 2415775 - RNA, 19 nt, Human
aaauuaauuggcagcagau

SEQ ID NO: 2415776 - RNA, 18 nt, Human
aaauuaauuggcagcaga

SEQ ID NO: 2415777 - RNA, 21 nt, Human
aaauuaauuggcagcagauuu

SEQ ID NO: 2415778 - RNA, 16 nt, Human
aaauuaauuggcagca

SEQ ID NO: 2415779 - RNA, 14 nt, Human
aaauuaaucugggc

SEQ ID NO: 2415780 - RNA, 15 nt, Human
aaauguggcuccugg

SEQ ID NO: 2415781 - RNA, 17 nt, Human
aaauuauguauguuuac

SEQ ID NO: 2415782 - RNA, 23 nt, Human
aaauuaugugccagauuuaugca

SEQ ID NO: 2415783 - RNA, 21 nt, Human
aaauucaaaaaguguuuauuu

SEQ ID NO: 2415784 - RNA, 23 nt, Human
aaauuauguuuauauaaaugcuu

SEQ ID NO: 2415785 - RNA, 17 nt, Human
aaauuauguuuauauaa

SEQ ID NO: 2415786 - RNA, 14 nt, Human
aaauuauguuuaua

SEQ ID NO: 2415787 - RNA, 19 nt, Human
aaauuauguauguuuacau

SEQ ID NO: 2415788 - RNA, 20 nt, Human
aaauuauguuacaucuguuu

SEQ ID NO: 2415789 - RNA, 15 nt, Human
aaauucaauuguaaa

SEQ ID NO: 2415790 - RNA, 19 nt, Human
aaauuaggauuucaugauu

SEQ ID NO: 2415791 - RNA, 17 nt, Human
aaauuagcugugugaaa

SEQ ID NO: 2415792 - RNA, 18 nt, Human
aaauuagcugugugaaau

SEQ ID NO: 2415793 - RNA, 14 nt, Human
aaauuaggaauaaa

SEQ ID NO: 2415794 - RNA, 15 nt, Human
aaauuaggaauaaau

SEQ ID NO: 2415795 - RNA, 16 nt, Human
aaauuaggaauaaaua

SEQ ID NO: 2415796 - RNA, 18 nt, Human
aaauuaggauuucaugau

SEQ ID NO: 2415797 - RNA, 18 nt, Human
aaauuaggaauaaauaaa

SEQ ID NO: 2415798 - RNA, 19 nt, Human
aaauuagcugugugaaaua

SEQ ID NO: 2415799 - RNA, 20 nt, Human
aaauuguuuugagcuuucca

SEQ ID NO: 2415800 - RNA, 23 nt, Human
aaauuuaaaagacacuguuuaca

SEQ ID NO: 2415801 - RNA, 23 nt, Human
aaauuguccguguucauacauuu

SEQ ID NO: 2415802 - RNA, 21 nt, Human
aaauugucccuuaaacaaaaa

SEQ ID NO: 2415803 - RNA, 16 nt, Human
aaauucuccuggaggu

SEQ ID NO: 2415804 - RNA, 16 nt, Human
aaauuguauauucacu

SEQ ID NO: 2415805 - RNA, 14 nt, Human
aaauucuccuggag

SEQ ID NO: 2415806 - RNA, 17 nt, Human
aaauuguauauucacuu

SEQ ID NO: 2415807 - RNA, 18 nt, Human
aaauugucagaugcugug

SEQ ID NO: 2415808 - RNA, 22 nt, Human
aaauuguaucuagugcagcuga

SEQ ID NO: 2415809 - RNA, 17 nt, Human
aaauuguauuacaaauc

SEQ ID NO: 2415810 - RNA, 15 nt, Human
aaauucuacaacaca

SEQ ID NO: 2415811 - RNA, 19 nt, Human
aaauucuauaggaacauau

SEQ ID NO: 2415812 - RNA, 22 nt, Human
aaauucuauaggaacauaugaa

SEQ ID NO: 2415813 - RNA, 23 nt, Human
aaauucuauaggaacauaugaaa

SEQ ID NO: 2415814 - RNA, 21 nt, Human
aaauucuauucugaucuuauu

SEQ ID NO: 2415815 - RNA, 19 nt, Human
aaauucuauuacaguaugu

SEQ ID NO: 2415816 - RNA, 13 nt, Human
aaauucuccugga

SEQ ID NO: 2415817 - RNA, 20 nt, Human
aaauucucagucaguaauug

SEQ ID NO: 2415818 - RNA, 17 nt, Human
aaauuccaagugauuga

SEQ ID NO: 2415819 - RNA, 14 nt, Human
aaauucacaaacuu

SEQ ID NO: 2415820 - RNA, 15 nt, Human
aaauucacaaacuuu

SEQ ID NO: 2415821 - RNA, 17 nt, Human
aaauucaauuguaaauu

SEQ ID NO: 2415822 - RNA, 19 nt, Human
aaauucaauuguaaauuga

SEQ ID NO: 2415823 - RNA, 20 nt, Human
aaauucaauuguaaauugaa

SEQ ID NO: 2415824 - RNA, 23 nt, Human
aaauucaauuguaaauugaauca

SEQ ID NO: 2415825 - RNA, 17 nt, Human
aaauucacaaacuuuua

SEQ ID NO: 2415826 - RNA, 18 nt, Human
aaauucacaaacuuuuau

SEQ ID NO: 2415827 - RNA, 18 nt, Human
aaauucacaaguuguguu

SEQ ID NO: 2415828 - RNA, 19 nt, Human
aaauucacaaguuguguuu

SEQ ID NO: 2415829 - RNA, 16 nt, Human
aaauuccccacccuga

SEQ ID NO: 2415830 - RNA, 14 nt, Human
aaauuccuguagca

SEQ ID NO: 2415831 - RNA, 20 nt, Human
aaauuccucuuugcuuugcu

SEQ ID NO: 2415832 - RNA, 22 nt, Human
aaauuccuuagcuuagaccuca

SEQ ID NO: 2415833 - RNA, 23 nt, Human
aaauucgaccugauuuacaguuu

SEQ ID NO: 2415834 - RNA, 21 nt, Human
aaauucgcugcaaccuguuga

SEQ ID NO: 2415835 - RNA, 18 nt, Human
aaauucgaccugauuuac

SEQ ID NO: 2415836 - RNA, 17 nt, Human
aaauucgaccugauuua

SEQ ID NO: 2415837 - RNA, 23 nt, Human
aaauuccuuagcuuagaccucag

SEQ ID NO: 2415838 - RNA, 16 nt, Human
aaauucacaauagaaa

SEQ ID NO: 2415839 - RNA, 13 nt, Human
aaauuccacugga

SEQ ID NO: 2415840 - RNA, 23 nt, Human
guauucuuugauguuaacacauu

SEQ ID NO: 2415841 - RNA, 21 nt, Human
guauucuuugauguuaacaca

SEQ ID NO: 2415842 - RNA, 18 nt, Human
guauucuuugauguuaac

SEQ ID NO: 2415843 - RNA, 16 nt, Human
guauucuuugauguua

SEQ ID NO: 2415844 - RNA, 10 nt, Human
guauugaagc

SEQ ID NO: 2415845 - RNA, 13 nt, Human
guauugaagcauu

SEQ ID NO: 2415846 - RNA, 17 nt, Human
guauugaagcauuuuau

SEQ ID NO: 2415847 - RNA, 18 nt, Human
guauugaagcauuuuaua

SEQ ID NO: 2415848 - RNA, 22 nt, Human
guauugaagcauuuuauaaauc

SEQ ID NO: 2415849 - RNA, 17 nt, Human
guauuguaaacaugugu

SEQ ID NO: 2415850 - RNA, 14 nt, Human
guauugaaucaugu

SEQ ID NO: 2415851 - RNA, 12 nt, Human
guauugaaucau

SEQ ID NO: 2415852 - RNA, 17 nt, Human
guauugaaucauguagu

SEQ ID NO: 2415853 - RNA, 16 nt, Human
guauuguauuuauuca

SEQ ID NO: 2415854 - RNA, 15 nt, Human
guauuguauuuauuc

SEQ ID NO: 2415855 - RNA, 13 nt, Human
guauuguauuuau

SEQ ID NO: 2415856 - RNA, 12 nt, Human
guauuguauuua

SEQ ID NO: 2415857 - RNA, 18 nt, Human
guauuguauuuauucaau

SEQ ID NO: 2415858 - RNA, 17 nt, Human
guauuguauuuauucaa

SEQ ID NO: 2415859 - RNA, 22 nt, Human
guauuguauuuauucaauaaag

SEQ ID NO: 2415860 - RNA, 20 nt, Human
guauuguaccuuuuaacacc

SEQ ID NO: 2415861 - RNA, 21 nt, Human
aaaucaugaagauauuuuucc

SEQ ID NO: 2415862 - RNA, 17 nt, Human
aaaucauggaaugguua

SEQ ID NO: 2415863 - RNA, 16 nt, Human
aaaucauguacauuuc

SEQ ID NO: 2415864 - RNA, 16 nt, Human
aaaucauucauuuucu

SEQ ID NO: 2415865 - RNA, 11 nt, Human
aaaucauuucu

SEQ ID NO: 2415866 - RNA, 19 nt, Human
aaaucauuaauacucuucu

SEQ ID NO: 2415867 - RNA, 12 nt, Human
aaaucauguuug

SEQ ID NO: 2415868 - RNA, 17 nt, Human
aaaucauguacauuucu

SEQ ID NO: 2415869 - RNA, 18 nt, Human
guauucucuccuguaccu

SEQ ID NO: 2415870 - RNA, 14 nt, Human
guauucuugucaaa

SEQ ID NO: 2415871 - RNA, 14 nt, Human
guauucuuugaugu

SEQ ID NO: 2415872 - RNA, 11 nt, Human
guauucuuuga

SEQ ID NO: 2415873 - RNA, 19 nt, Human
guauucuagcuaauguaau

SEQ ID NO: 2415874 - RNA, 21 nt, Human
aaaucauugcuuugaagcagu

SEQ ID NO: 2415875 - RNA, 18 nt, Human
guauucuaguuuugucaa

SEQ ID NO: 2415876 - RNA, 18 nt, Human
aaaugucuucuguauuca

SEQ ID NO: 2415877 - RNA, 12 nt, Human
aaaugucuugug

SEQ ID NO: 2415878 - RNA, 14 nt, Human
aaaugucuuccugg

SEQ ID NO: 2415879 - RNA, 15 nt, Human
aaaugugauuuuucu

SEQ ID NO: 2415880 - RNA, 16 nt, Human
aaaugucuucuguauu

SEQ ID NO: 2415881 - RNA, 16 nt, Human
aaaugugauuuuucug

SEQ ID NO: 2415882 - RNA, 23 nt, Human
aaaugugcauucuuuuaaaagac

SEQ ID NO: 2415883 - RNA, 22 nt, Human
aaaugugcauucuuuuaaaaga

SEQ ID NO: 2415884 - RNA, 17 nt, Human
aaaugugcaaaacagcg

SEQ ID NO: 2415885 - RNA, 17 nt, Human
aaaugugauuuuucuga

SEQ ID NO: 2415886 - RNA, 21 nt, Human
aaaugucucuuuaaugucaca

SEQ ID NO: 2415887 - RNA, 16 nt, Human
aaaugucuauuaaggu

SEQ ID NO: 2415888 - RNA, 16 nt, Human
guauuuaauuuugaca

SEQ ID NO: 2415889 - RNA, 20 nt, Human
aaauguaucauagaaaugua

SEQ ID NO: 2415890 - RNA, 17 nt, Human
aaauguaucauagaaau

SEQ ID NO: 2415891 - RNA, 14 nt, Human
aaauguaucuuauu

SEQ ID NO: 2415892 - RNA, 17 nt, Human
aaauguaucuuauucac

SEQ ID NO: 2415893 - RNA, 14 nt, Human
aaauguauaugcac

SEQ ID NO: 2415894 - RNA, 15 nt, Human
aaauguauaugcacu

SEQ ID NO: 2415895 - RNA, 13 nt, Human
guauuuaucuuua

SEQ ID NO: 2415896 - RNA, 17 nt, Human
guauuuauauauuuaua

SEQ ID NO: 2415897 - RNA, 15 nt, Human
guauuuauauauuua

SEQ ID NO: 2415898 - RNA, 16 nt, Human
guauuuauauauuuau

SEQ ID NO: 2415899 - RNA, 16 nt, Human
guauuuacgcuuugau

SEQ ID NO: 2415900 - RNA, 17 nt, Human
guauuuacgcuuugauu

SEQ ID NO: 2415901 - RNA, 19 nt, Human
guauuuacgcuuugauuca

SEQ ID NO: 2415902 - RNA, 13 nt, Human
guauuuauaaaua

SEQ ID NO: 2415903 - RNA, 12 nt, Human
guauuuauauau

SEQ ID NO: 2415904 - RNA, 13 nt, Human
guauuuauauauu

SEQ ID NO: 2415905 - RNA, 21 nt, Human
guauugugucuuuugcaugau

SEQ ID NO: 2415906 - RNA, 18 nt, Human
guauugugucuuuugcau

SEQ ID NO: 2415907 - RNA, 17 nt, Human
guauugugucuuuugca

SEQ ID NO: 2415908 - RNA, 18 nt, Human
guauuguucccagugaca

SEQ ID NO: 2415909 - RNA, 11 nt, Human
guauuguuccc

SEQ ID NO: 2415910 - RNA, 14 nt, Human
guauuguucccagu

SEQ ID NO: 2415911 - RNA, 20 nt, Human
guauuguuuugguuugcuac

SEQ ID NO: 2415912 - RNA, 9 nt, Human
guauuuaac

SEQ ID NO: 2415913 - RNA, 22 nt, Human
gucuuaaugaaguuugaauguu

SEQ ID NO: 2415914 - RNA, 20 nt, Human
gucuuaaugaaguuugaaug

SEQ ID NO: 2415915 - RNA, 19 nt, Human
gucuuaaugaaguuugaau

SEQ ID NO: 2415916 - RNA, 18 nt, Human
gucuuaaugaaguuugaa

SEQ ID NO: 2415917 - RNA, 17 nt, Human
gucuuaaugaaguuuga

SEQ ID NO: 2415918 - RNA, 16 nt, Human
gucuuaaugaaguuug

SEQ ID NO: 2415919 - RNA, 23 nt, Human
gucuuaagccuuuugcucacaaa

SEQ ID NO: 2415920 - RNA, 14 nt, Human
gucuuaaugaaguu

SEQ ID NO: 2415921 - RNA, 14 nt, Human
gucuuaauuaaaag

SEQ ID NO: 2415922 - RNA, 19 nt, Human
gucuuauauauuguagaua

SEQ ID NO: 2415923 - RNA, 16 nt, Human
gucuggaaugcagugg

SEQ ID NO: 2415924 - RNA, 15 nt, Human
gucuggaaugcagug

SEQ ID NO: 2415925 - RNA, 18 nt, Human
gucuggaaugcaguggua

SEQ ID NO: 2415926 - RNA, 22 nt, Human
gucuuaaaauaacuuauaucau

SEQ ID NO: 2415927 - RNA, 15 nt, Human
gucuuaaaauaacuu

SEQ ID NO: 2415928 - RNA, 12 nt, Human
gucuuaaaauaa

SEQ ID NO: 2415929 - RNA, 12 nt, Human
gucuuguucugu

SEQ ID NO: 2415930 - RNA, 21 nt, Human
gucuuucaggaccuuuugaag

SEQ ID NO: 2415931 - RNA, 22 nt, Human
gucuuuccacuccuccuagcca

SEQ ID NO: 2415932 - RNA, 18 nt, Human
gucuuuccacggagccac

SEQ ID NO: 2415933 - RNA, 20 nt, Human
gucuuguuaagugcagucug

SEQ ID NO: 2415934 - RNA, 22 nt, Human
gucuuguuuuuuuuuuccacuu

SEQ ID NO: 2415935 - RNA, 23 nt, Human
gucuuguguuuccacagccugca

SEQ ID NO: 2415936 - RNA, 20 nt, Human
gucuuguguuucuuuaguuu

SEQ ID NO: 2415937 - RNA, 15 nt, Human
gucuuaucaagcagc

SEQ ID NO: 2415938 - RNA, 19 nt, Human
gucuucaacagcuccccau

SEQ ID NO: 2415939 - RNA, 14 nt, Human
gucuuauuuauuau

SEQ ID NO: 2415940 - RNA, 16 nt, Human
gucuucaacagcuccc

SEQ ID NO: 2415941 - RNA, 14 nt, Human
gucuuauuuccuca

SEQ ID NO: 2415942 - RNA, 14 nt, Human
gucuucaagggcuu

SEQ ID NO: 2415943 - RNA, 14 nt, Human
gucugacaggcaau

SEQ ID NO: 2415944 - RNA, 13 nt, Human
gucugacaggcaa

SEQ ID NO: 2415945 - RNA, 12 nt, Human
gucugacaggca

SEQ ID NO: 2415946 - RNA, 21 nt, Human
gucugaaggacacuuccugcc

SEQ ID NO: 2415947 - RNA, 20 nt, Human
gucugaaggacacuuccugc

SEQ ID NO: 2415948 - RNA, 22 nt, Human
gucugaaggacacuuccugccu

SEQ ID NO: 2415949 - RNA, 14 nt, Human
gucugaauguucug

SEQ ID NO: 2415950 - RNA, 15 nt, Human
gucugaauguucuga

SEQ ID NO: 2415951 - RNA, 17 nt, Human
gucugaauguucugaca

SEQ ID NO: 2415952 - RNA, 18 nt, Human
gucugaauguucugacau

SEQ ID NO: 2415953 - RNA, 20 nt, Human
gucugaauguucugacauua

SEQ ID NO: 2415954 - RNA, 18 nt, Human
gucugacaggcaaugcug

SEQ ID NO: 2415955 - RNA, 15 nt, Human
gucugacaggcaaug

SEQ ID NO: 2415956 - RNA, 20 nt, Human
gucugacaggcaaugcuggc

SEQ ID NO: 2415957 - RNA, 14 nt, Human
gucuggaaguccaa

SEQ ID NO: 2415958 - RNA, 17 nt, Human
gucucaaaaaaagaaaa

SEQ ID NO: 2415959 - RNA, 14 nt, Human
gucucaaaaaaaca

SEQ ID NO: 2415960 - RNA, 16 nt, Human
gucuauuuaagccuca

SEQ ID NO: 2415961 - RNA, 12 nt, Human
gucuauuuaagc

SEQ ID NO: 2415962 - RNA, 13 nt, Human
gucuauuucugcu

SEQ ID NO: 2415963 - RNA, 14 nt, Human
gucuauuucuaguu

SEQ ID NO: 2415964 - RNA, 17 nt, Human
gucuauuucugcugaau

SEQ ID NO: 2415965 - RNA, 11 nt, Human
gucugaaaugg

SEQ ID NO: 2415966 - RNA, 13 nt, Human
gucugaauguucu

SEQ ID NO: 2415967 - RNA, 15 nt, Human
gucugaacagcugua

SEQ ID NO: 2415968 - RNA, 19 nt, Human
gucugaaggacacuuccug

SEQ ID NO: 2415969 - RNA, 14 nt, Human
gucugaagcagaug

SEQ ID NO: 2415970 - RNA, 23 nt, Human
gucucuuuucuuuagagcauugc

SEQ ID NO: 2415971 - RNA, 16 nt, Human
gucuauuuuugucuua

SEQ ID NO: 2415972 - RNA, 22 nt, Human
gucucuuucaugaguuuuuccc

SEQ ID NO: 2415973 - RNA, 24 nt, Human
aacucauuuuuguuuucauuaucu

SEQ ID NO: 2415974 - RNA, 23 nt, Human
aacuauucaggagaguagaacag

SEQ ID NO: 2415975 - RNA, 21 nt, Human
aacucauuuuuguuuucauua

SEQ ID NO: 2415976 - RNA, 22 nt, Human
aacuauuaagaggcagaaaauu

SEQ ID NO: 2415977 - RNA, 15 nt, Human
aacuauguugauaaa

SEQ ID NO: 2415978 - RNA, 17 nt, Human
aacuagggccaagccca

SEQ ID NO: 2415979 - RNA, 22 nt, Human
aacuaggucugauauucaaaug

SEQ ID NO: 2415980 - RNA, 15 nt, Human
aacuaguccuuuacu

SEQ ID NO: 2415981 - RNA, 14 nt, Human
aacuauaugugaau

SEQ ID NO: 2415982 - RNA, 12 nt, Human
aacuauggccug

SEQ ID NO: 2415983 - RNA, 18 nt, Human
aacuauggaucagaauag

SEQ ID NO: 2415984 - RNA, 23 nt, Human
aacuaugcauggugccccaggac

SEQ ID NO: 2415985 - RNA, 23 nt, Human
aacguuuuuccuuuaaaaaaauu

SEQ ID NO: 2415986 - RNA, 21 nt, Human
aacuaggugcauauuuauaaa

SEQ ID NO: 2415987 - RNA, 17 nt, Human
aacuagggaagauaaua

SEQ ID NO: 2415988 - RNA, 13 nt, Human
aacguggcugcuu

SEQ ID NO: 2415989 - RNA, 12 nt, Human
aacguggcugcu

SEQ ID NO: 2415990 - RNA, 13 nt, Human
aacguuuuauugu

SEQ ID NO: 2415991 - RNA, 15 nt, Human
aacguuuuauugugu

SEQ ID NO: 2415992 - RNA, 23 nt, Human
aacguuuucuguuuggaggagca

SEQ ID NO: 2415993 - RNA, 15 nt, Human
aacguuuugaacuaa

SEQ ID NO: 2415994 - RNA, 20 nt, Human
aacguuuugaacuaauaaaa

SEQ ID NO: 2415995 - RNA, 17 nt, Human
aacguuuuuccuguucu

SEQ ID NO: 2415996 - RNA, 19 nt, Human
aaccuggguccaaauaaaa

SEQ ID NO: 2415997 - RNA, 18 nt, Human
aaccuggguccaaauaaa

SEQ ID NO: 2415998 - RNA, 22 nt, Human
aaccuggguccaaauaaaaacu

SEQ ID NO: 2415999 - RNA, 17 nt, Human
aaccuggguccaaauaa

SEQ ID NO: 2416000 - RNA, 22 nt, Human
aaccugggaggcggagaguaca

SEQ ID NO: 2416001 - RNA, 12 nt, Human
aaccuggggggc

SEQ ID NO: 2416002 - RNA, 14 nt, Human
aaccugggauucag

SEQ ID NO: 2416003 - RNA, 17 nt, Human
aaccugggauucaggaa

SEQ ID NO: 2416004 - RNA, 20 nt, Human
aaccugggauucaggaaugu

SEQ ID NO: 2416005 - RNA, 21 nt, Human
aaccugggauucaggaaugug

SEQ ID NO: 2416006 - RNA, 15 nt, Human
aaccuuauuguaccu

SEQ ID NO: 2416007 - RNA, 19 nt, Human
aaccuuauuguaccucucu

SEQ ID NO: 2416008 - RNA, 18 nt, Human
aaccuuauuguaccucuc

SEQ ID NO: 2416009 - RNA, 17 nt, Human
aaccuuauuguaccucu

SEQ ID NO: 2416010 - RNA, 16 nt, Human
aaccuuauuguaccuc

SEQ ID NO: 2416011 - RNA, 20 nt, Human
aaccuggaggggcuagaacc

SEQ ID NO: 2416012 - RNA, 22 nt, Human
aaccuggagggcuggaaucugg

SEQ ID NO: 2416013 - RNA, 19 nt, Human
aaccuggcaagcuagaacc

SEQ ID NO: 2416014 - RNA, 22 nt, Human
aaccuggagggcuagaaucugg

SEQ ID NO: 2416015 - RNA, 19 nt, Human
aaccuggagggcuagaacc

SEQ ID NO: 2416016 - RNA, 10 nt, Human
aaccuggagg

SEQ ID NO: 2416017 - RNA, 19 nt, Human
gucuuucccauggggaggg

SEQ ID NO: 2416018 - RNA, 20 nt, Human
gucuuuccauuggaucucau

SEQ ID NO: 2416019 - RNA, 20 nt, Human
gucuuucccauggggaggga

SEQ ID NO: 2416020 - RNA, 12 nt, Human
gucuuuccuaga

SEQ ID NO: 2416021 - RNA, 16 nt, Human
gucuuuccuggcacua

SEQ ID NO: 2416022 - RNA, 13 nt, Human
gucuuucuggaga

SEQ ID NO: 2416023 - RNA, 13 nt, Human
aacgucugugcca

SEQ ID NO: 2416024 - RNA, 12 nt, Human
aaccuucuggcc

SEQ ID NO: 2416025 - RNA, 21 nt, Human
aaccuucgccaccuggguucc

SEQ ID NO: 2416026 - RNA, 19 nt, Human
aaccuuccaucucgccacc

SEQ ID NO: 2416027 - RNA, 13 nt, Human
aaccuuccaucuc

SEQ ID NO: 2416028 - RNA, 17 nt, Human
aaccuuccaucucgcca

SEQ ID NO: 2416029 - RNA, 16 nt, Human
aacgugcauugugcuu

SEQ ID NO: 2416030 - RNA, 14 nt, Human
aacgugcauugugc

SEQ ID NO: 2416031 - RNA, 17 nt, Human
aacgugcagacuaugca

SEQ ID NO: 2416032 - RNA, 23 nt, Human
aacgugcauugugcuucuuucuu

SEQ ID NO: 2416033 - RNA, 17 nt, Human
aacguggcucugcuggc

SEQ ID NO: 2416034 - RNA, 16 nt, Human
aacguggcucugcugg

SEQ ID NO: 2416035 - RNA, 15 nt, Human
aacguggcucugcug

SEQ ID NO: 2416036 - RNA, 13 nt, Human
aacguggcccaga

SEQ ID NO: 2416037 - RNA, 12 nt, Human
aacgugaaaaug

SEQ ID NO: 2416038 - RNA, 11 nt, Human
aacgugcauug

SEQ ID NO: 2416039 - RNA, 15 nt, Human
aacgugaugaucagc

SEQ ID NO: 2416040 - RNA, 20 nt, Human
aacgugaugaucagcuguuu

SEQ ID NO: 2416041 - RNA, 16 nt, Human
gugagacucugucuca

SEQ ID NO: 2416042 - RNA, 14 nt, Human
gugagacucugucu

SEQ ID NO: 2416043 - RNA, 16 nt, Human
gugagaccugccccuc

SEQ ID NO: 2416044 - RNA, 23 nt, Human
gugagaccugccccuccucucug

SEQ ID NO: 2416045 - RNA, 22 nt, Human
gugagacucgagaacuuucauu

SEQ ID NO: 2416046 - RNA, 20 nt, Human
gugagacucgagaacuuuca

SEQ ID NO: 2416047 - RNA, 17 nt, Human
gugagacucgagaacuu

SEQ ID NO: 2416048 - RNA, 16 nt, Human
gugagacccugucucu

SEQ ID NO: 2416049 - RNA, 14 nt, Human
gugagaccugcccc

SEQ ID NO: 2416050 - RNA, 15 nt, Human
gugagaccugccccu

SEQ ID NO: 2416051 - RNA, 13 nt, Human
gugagaccugccc

SEQ ID NO: 2416052 - RNA, 16 nt, Human
gugagacccccacacc

SEQ ID NO: 2416053 - RNA, 17 nt, Human
gugagacccccacaccu

SEQ ID NO: 2416054 - RNA, 22 nt, Human
gugagacccugucucaaaaaaa

SEQ ID NO: 2416055 - RNA, 20 nt, Human
gugagacccagcccucaucc

SEQ ID NO: 2416056 - RNA, 14 nt, Human
gugagacccccaca

SEQ ID NO: 2416057 - RNA, 15 nt, Human
gugagacccccacac

SEQ ID NO: 2416058 - RNA, 23 nt, Human
gugacuugugucccaugaucccu

SEQ ID NO: 2416059 - RNA, 18 nt, Human
gugacuuuggcugcaugc

SEQ ID NO: 2416060 - RNA, 16 nt, Human
gugagacagugggaaa

SEQ ID NO: 2416061 - RNA, 20 nt, Human
gugagacaguccagccugga

SEQ ID NO: 2416062 - RNA, 17 nt, Human
gugacuugugucccaug

SEQ ID NO: 2416063 - RNA, 22 nt, Human
gugacuugcaucguggagacag

SEQ ID NO: 2416064 - RNA, 15 nt, Human
gugacuucuccaggu

SEQ ID NO: 2416065 - RNA, 21 nt, Human
gugacuugcaucguggagaca

SEQ ID NO: 2416066 - RNA, 16 nt, Human
gugacuucagcucugu

SEQ ID NO: 2416067 - RNA, 22 nt, Human
gugacaugugaaaccuuuuuua

SEQ ID NO: 2416068 - RNA, 20 nt, Human
gugacaugugaaaccuuuuu

SEQ ID NO: 2416069 - RNA, 19 nt, Human
gugacaugugaaaccuuuu

SEQ ID NO: 2416070 - RNA, 18 nt, Human
gugacaugugaaaccuuu

SEQ ID NO: 2416071 - RNA, 17 nt, Human
gugacaugugaaaccuu

SEQ ID NO: 2416072 - RNA, 16 nt, Human
gugacaugugaaaccu

SEQ ID NO: 2416073 - RNA, 15 nt, Human
gugacaugugaaacc

SEQ ID NO: 2416074 - RNA, 14 nt, Human
gugacaugugaaac

SEQ ID NO: 2416075 - RNA, 19 nt, Human
gugacaugucuuuucuugc

SEQ ID NO: 2416076 - RNA, 22 nt, Human
gugacauuugggagacauguga

SEQ ID NO: 2416077 - RNA, 21 nt, Human
gugacauuuauuuuucucaug

SEQ ID NO: 2416078 - RNA, 22 nt, Human
gugacauguguuggcagccucu

SEQ ID NO: 2416079 - RNA, 21 nt, Human
gugacuuagcagaugcugguc

SEQ ID NO: 2416080 - RNA, 18 nt, Human
gugacuguggcacacgcc

SEQ ID NO: 2416081 - RNA, 21 nt, Human
aacuccuagggccacugaaga

SEQ ID NO: 2416082 - RNA, 19 nt, Human
aacuccaccuugcggggau

SEQ ID NO: 2416083 - RNA, 16 nt, Human
aacuccacaucugccu

SEQ ID NO: 2416084 - RNA, 15 nt, Human
aacuccacaucugcc

SEQ ID NO: 2416085 - RNA, 14 nt, Human
aacuccacaucugc

SEQ ID NO: 2416086 - RNA, 18 nt, Human
aacuccacaucugccuua

SEQ ID NO: 2416087 - RNA, 17 nt, Human
aacuccacaucugccuu

SEQ ID NO: 2416088 - RNA, 15 nt, Human
aacuccaccaaccca

SEQ ID NO: 2416089 - RNA, 23 nt, Human
aacuccaccaacccaucagaagg

SEQ ID NO: 2416090 - RNA, 12 nt, Human
aacuccugaccu

SEQ ID NO: 2416091 - RNA, 14 nt, Human
aacuccugaccuca

SEQ ID NO: 2416092 - RNA, 16 nt, Human
aacuccugacagucuu

SEQ ID NO: 2416093 - RNA, 12 nt, Human
aacuccugcccc

SEQ ID NO: 2416094 - RNA, 18 nt, Human
aacuccugccccuguucu

SEQ ID NO: 2416095 - RNA, 17 nt, Human
aacuccugccccuguuc

SEQ ID NO: 2416096 - RNA, 18 nt, Human
aacuccuggaaauaucag

SEQ ID NO: 2416097 - RNA, 19 nt, Human
gugaaguuuaauugacuua

SEQ ID NO: 2416098 - RNA, 23 nt, Human
gugaauaauacaguaucucaggg

SEQ ID NO: 2416099 - RNA, 14 nt, Human
gugaaguuuacauu

SEQ ID NO: 2416100 - RNA, 18 nt, Human
gugacaguggauugcauu

SEQ ID NO: 2416101 - RNA, 14 nt, Human
gugacaucaguggc

SEQ ID NO: 2416102 - RNA, 15 nt, Human
gugacaucaguggca

SEQ ID NO: 2416103 - RNA, 19 nt, Human
gugacaguauuuugguucu

SEQ ID NO: 2416104 - RNA, 15 nt, Human
gugacagugccuggg

SEQ ID NO: 2416105 - RNA, 17 nt, Human
gugacagugccugggaa

SEQ ID NO: 2416106 - RNA, 23 nt, Human
gugacagugccugggaauguauu

SEQ ID NO: 2416107 - RNA, 20 nt, Human
gugacagggaagcuacaggu

SEQ ID NO: 2416108 - RNA, 19 nt, Human
gugacagggaagcuacagg

SEQ ID NO: 2416109 - RNA, 18 nt, Human
gugacagggaagcuacag

SEQ ID NO: 2416110 - RNA, 17 nt, Human
gugacagggaagcuaca

SEQ ID NO: 2416111 - RNA, 22 nt, Human
gugacagggaagcuacagguua

SEQ ID NO: 2416112 - RNA, 16 nt, Human
gugacagggaagcuac

SEQ ID NO: 2416113 - RNA, 13 nt, Human
gugacagggaagc

SEQ ID NO: 2416114 - RNA, 16 nt, Human
gugacaggcagcagag

SEQ ID NO: 2416115 - RNA, 15 nt, Human
gugacaggcagcaga

SEQ ID NO: 2416116 - RNA, 14 nt, Human
gugacaggcagcag

SEQ ID NO: 2416117 - RNA, 16 nt, Human
gugacagauuauacag

SEQ ID NO: 2416118 - RNA, 17 nt, Human
gugacagaguucacuau

SEQ ID NO: 2416119 - RNA, 18 nt, Human
gugacagaguucacuaua

SEQ ID NO: 2416120 - RNA, 22 nt, Human
gugacagagugagacucugucu

SEQ ID NO: 2416121 - RNA, 20 nt, Human
gugacagagugagacucugu

SEQ ID NO: 2416122 - RNA, 23 nt, Human
gugacagaggcagccccauucug

SEQ ID NO: 2416123 - RNA, 16 nt, Human
gugaauaaaugucuug

SEQ ID NO: 2416124 - RNA, 13 nt, Human
gugaauaaauguc

SEQ ID NO: 2416125 - RNA, 15 nt, Human
gugaauaauaaaagu

SEQ ID NO: 2416126 - RNA, 17 nt, Human
gugaggcucugcccuug

SEQ ID NO: 2416127 - RNA, 16 nt, Human
gugaggcucugcccuu

SEQ ID NO: 2416128 - RNA, 15 nt, Human
gugaggcucugcccu

SEQ ID NO: 2416129 - RNA, 14 nt, Human
gugaggcucugccc

SEQ ID NO: 2416130 - RNA, 13 nt, Human
gugaggcucugcc

SEQ ID NO: 2416131 - RNA, 12 nt, Human
gugaggcucugc

SEQ ID NO: 2416132 - RNA, 19 nt, Human
gugagacgccaccauuccu

SEQ ID NO: 2416133 - RNA, 17 nt, Human
gugagagagaugggagc

SEQ ID NO: 2416134 - RNA, 18 nt, Human
gugagacucugucucaaa

SEQ ID NO: 2416135 - RNA, 21 nt, Human
aacucuccucugcugcuggcu

SEQ ID NO: 2416136 - RNA, 19 nt, Human
aacucuccucugcugcugg

SEQ ID NO: 2416137 - RNA, 17 nt, Human
aacucuccucugcugcu

SEQ ID NO: 2416138 - RNA, 21 nt, Human
gugaguacuacaguccuccca

SEQ ID NO: 2416139 - RNA, 19 nt, Human
gugagucaccaagcccagu

SEQ ID NO: 2416140 - RNA, 23 nt, Human
gugaguacuacaguccucccauc

SEQ ID NO: 2416141 - RNA, 17 nt, Human
gugagucaccaagccca

SEQ ID NO: 2416142 - RNA, 18 nt, Human
gugaggcucugcccuugg

SEQ ID NO: 2416143 - RNA, 16 nt, Human
gugaggcuguccugua

SEQ ID NO: 2416144 - RNA, 14 nt, Human
gugaggcuguccug

SEQ ID NO: 2416145 - RNA, 19 nt, Human
aacucugaauuuuaaagca

SEQ ID NO: 2416146 - RNA, 16 nt, Human
aacucugacaacagac

SEQ ID NO: 2416147 - RNA, 17 nt, Human
aacucuugauuauccau

SEQ ID NO: 2416148 - RNA, 17 nt, Human
aacucuugguuucuuca

SEQ ID NO: 2416149 - RNA, 12 nt, Human
aacucuuucaaa

SEQ ID NO: 2416150 - RNA, 11 nt, Human
aacucuugauu

SEQ ID NO: 2416151 - RNA, 23 nt, Human
aacucuccucugcugcuggcugg

SEQ ID NO: 2416152 - RNA, 22 nt, Human
aacucuccucugcugcuggcug

SEQ ID NO: 2416153 - RNA, 19 nt, Human
aacucucuuugggaauguu

SEQ ID NO: 2416154 - RNA, 10 nt, Human
aacucucuuu

SEQ ID NO: 2416155 - RNA, 13 nt, Human
gugaggccuugcu

SEQ ID NO: 2416156 - RNA, 12 nt, Human
aacucucuccac

SEQ ID NO: 2416157 - RNA, 22 nt, Human
aacucucuccacccuauaugua

SEQ ID NO: 2416158 - RNA, 12 nt, Human
aacucucugaac

SEQ ID NO: 2416159 - RNA, 23 nt, Human
aacugauuuuuuuuuccuucagu

SEQ ID NO: 2416160 - RNA, 22 nt, Human
aacugauuuuuuuuuccuucag

SEQ ID NO: 2416161 - RNA, 16 nt, Human
aacugcauuggcuuug

SEQ ID NO: 2416162 - RNA, 18 nt, Human
aacugccaaaaugcucua

SEQ ID NO: 2416163 - RNA, 20 nt, Human
aacugcauugagaacugcau

SEQ ID NO: 2416164 - RNA, 16 nt, Human
aacugcauuagaaauu

SEQ ID NO: 2416165 - RNA, 14 nt, Human
aacugcauugagaa

SEQ ID NO: 2416166 - RNA, 21 nt, Human
aacugauuuuuuuuuccuuca

SEQ ID NO: 2416167 - RNA, 20 nt, Human
aacugauuuuuuuuuccuuc

SEQ ID NO: 2416168 - RNA, 19 nt, Human
aacucuuugaaugacaaag

SEQ ID NO: 2416169 - RNA, 13 nt, Human
aacucuuucaaaa

SEQ ID NO: 2416170 - RNA, 14 nt, Human
aacucuuugagaaa

SEQ ID NO: 2416171 - RNA, 23 nt, Human
aacucuuuuugggcuccuuuuuc

SEQ ID NO: 2416172 - RNA, 17 nt, Human
aacucuuuuugggcucc

SEQ ID NO: 2416173 - RNA, 17 nt, Human
aagaaaaaucauguuug

SEQ ID NO: 2416174 - RNA, 12 nt, Human
aagaaaaaauac

SEQ ID NO: 2416175 - RNA, 14 nt, Human
aagaaaaaauacau

SEQ ID NO: 2416176 - RNA, 16 nt, Human
aagaaaaaauacauuu

SEQ ID NO: 2416177 - RNA, 17 nt, Human
aagaaaaaugagccugg

SEQ ID NO: 2416178 - RNA, 14 nt, Human
aagaaaacaacuuc

SEQ ID NO: 2416179 - RNA, 22 nt, Human
aagaaaaaucauguuugcucuc

SEQ ID NO: 2416180 - RNA, 19 nt, Human
aagaaaaaucauguuugcu

SEQ ID NO: 2416181 - RNA, 18 nt, Human
aagaaaaaugagccuggc

SEQ ID NO: 2416182 - RNA, 19 nt, Human
aagaaaaaauauuuucccu

SEQ ID NO: 2416183 - RNA, 19 nt, Human
aacuuuacuaagaugacau

SEQ ID NO: 2416184 - RNA, 18 nt, Human
gugccagcaacugaauaa

SEQ ID NO: 2416185 - RNA, 16 nt, Human
gugccagcaacugaau

SEQ ID NO: 2416186 - RNA, 20 nt, Human
aacuuuacuaagaugacauu

SEQ ID NO: 2416187 - RNA, 22 nt, Human
aacuuuagaguagcaugagaga

SEQ ID NO: 2416188 - RNA, 13 nt, Human
aagaaaaagaaaa

SEQ ID NO: 2416189 - RNA, 18 nt, Human
aagaaaaagaaaaagaaa

SEQ ID NO: 2416190 - RNA, 12 nt, Human
gugccagcaacu

SEQ ID NO: 2416191 - RNA, 19 nt, Human
gugccagcaaagccccaug

SEQ ID NO: 2416192 - RNA, 18 nt, Human
gugccagcaaagccccau

SEQ ID NO: 2416193 - RNA, 17 nt, Human
gugccagcaaagcccca

SEQ ID NO: 2416194 - RNA, 16 nt, Human
gugccagcaaagcccc

SEQ ID NO: 2416195 - RNA, 15 nt, Human
gugccagcaaagccc

SEQ ID NO: 2416196 - RNA, 14 nt, Human
gugccagcaaagcc

SEQ ID NO: 2416197 - RNA, 22 nt, Human
gugccagaggugggcagguggu

SEQ ID NO: 2416198 - RNA, 21 nt, Human
aacuuuaccuuuuuuauacau

SEQ ID NO: 2416199 - RNA, 22 nt, Human
aacuuuaccuuuuuuauacaua

SEQ ID NO: 2416200 - RNA, 23 nt, Human
aacuuuaccuuuuuuauacauaa

SEQ ID NO: 2416201 - RNA, 21 nt, Human
gugccagaggugggcaggugg

SEQ ID NO: 2416202 - RNA, 20 nt, Human
gugccagaggugggcaggug

SEQ ID NO: 2416203 - RNA, 19 nt, Human
gugccagaggugggcaggu

SEQ ID NO: 2416204 - RNA, 18 nt, Human
gugccagaggugggcagg

SEQ ID NO: 2416205 - RNA, 17 nt, Human
gugccagaggugggcag

SEQ ID NO: 2416206 - RNA, 16 nt, Human
gugccagaggugggca

SEQ ID NO: 2416207 - RNA, 15 nt, Human
gugccagaggugggc

SEQ ID NO: 2416208 - RNA, 14 nt, Human
gugccagagguggg

SEQ ID NO: 2416209 - RNA, 19 nt, Human
gugccagauuuaugcauau

SEQ ID NO: 2416210 - RNA, 18 nt, Human
gugccaacacucaagaag

SEQ ID NO: 2416211 - RNA, 13 nt, Human
gugccaacacuca

SEQ ID NO: 2416212 - RNA, 20 nt, Human
gugccaacaauccuagugcu

SEQ ID NO: 2416213 - RNA, 18 nt, Human
gugcauuuuugugaaaug

SEQ ID NO: 2416214 - RNA, 22 nt, Human
gugcauuuuugugaaaugaaaa

SEQ ID NO: 2416215 - RNA, 16 nt, Human
aagaaaauaccaagga

SEQ ID NO: 2416216 - RNA, 13 nt, Human
aagaaaacaucua

SEQ ID NO: 2416217 - RNA, 16 nt, Human
aagaaaacaucuauuc

SEQ ID NO: 2416218 - RNA, 15 nt, Human
aagaaaauaguggug

SEQ ID NO: 2416219 - RNA, 21 nt, Human
aagaaaauaguggugugauuu

SEQ ID NO: 2416220 - RNA, 22 nt, Human
aagaaaauaguggugugauuug

SEQ ID NO: 2416221 - RNA, 11 nt, Human
aagaaacauuu

SEQ ID NO: 2416222 - RNA, 19 nt, Human
aagaaacagaucuccuggc

SEQ ID NO: 2416223 - RNA, 11 nt, Human
aagaaacccaa

SEQ ID NO: 2416224 - RNA, 14 nt, Human
aagaaacaacagaa

SEQ ID NO: 2416225 - RNA, 19 nt, Human
aagaaacaacucuuugaga

SEQ ID NO: 2416226 - RNA, 22 nt, Human
aagaaacacacugaggcaggga

SEQ ID NO: 2416227 - RNA, 14 nt, Human
aagaaagaaaauca

SEQ ID NO: 2416228 - RNA, 13 nt, Human
aagaaagaaaauc

SEQ ID NO: 2416229 - RNA, 16 nt, Human
aagaaagaaaaucagg

SEQ ID NO: 2416230 - RNA, 12 nt, Human
aagaaagagaga

SEQ ID NO: 2416231 - RNA, 13 nt, Human
aagaaagagagaa

SEQ ID NO: 2416232 - RNA, 16 nt, Human
aagaaacccgacagag

SEQ ID NO: 2416233 - RNA, 18 nt, Human
aagaaacccgacagaggg

SEQ ID NO: 2416234 - RNA, 14 nt, Human
aagaaagagagaaa

SEQ ID NO: 2416235 - RNA, 15 nt, Human
aagaaagagagaaaa

SEQ ID NO: 2416236 - RNA, 16 nt, Human
aagaaagagagaaaau

SEQ ID NO: 2416237 - RNA, 18 nt, Human
aagaaagagagaaaauaa

SEQ ID NO: 2416238 - RNA, 17 nt, Human
aagaaagaggagugcuu

SEQ ID NO: 2416239 - RNA, 20 nt, Human
aagaaagagagaaaauaaaa

SEQ ID NO: 2416240 - RNA, 23 nt, Human
aagaaagagcaacaauccaucuc

SEQ ID NO: 2416241 - RNA, 22 nt, Human
aagaaagcuucaaacugcauga

SEQ ID NO: 2416242 - RNA, 17 nt, Human
aagaaagcugguaaacu

SEQ ID NO: 2416243 - RNA, 16 nt, Human
aagaaagcauagacau

SEQ ID NO: 2416244 - RNA, 19 nt, Human
aagaaagcccuuaggaaga

SEQ ID NO: 2416245 - RNA, 22 nt, Human
gugcuccgugccuccaccacca

SEQ ID NO: 2416246 - RNA, 18 nt, Human
gugcuccgugccuccacc

SEQ ID NO: 2416247 - RNA, 14 nt, Human
gugcuccuccuugg

SEQ ID NO: 2416248 - RNA, 14 nt, Human
gugcucgccccagc

SEQ ID NO: 2416249 - RNA, 16 nt, Human
gugcucgccccagcag

SEQ ID NO: 2416250 - RNA, 19 nt, Human
gugcucgcuguugcugaau

SEQ ID NO: 2416251 - RNA, 18 nt, Human
gugcucgcuguugcugaa

SEQ ID NO: 2416252 - RNA, 15 nt, Human
gugcucgcuguugcu

SEQ ID NO: 2416253 - RNA, 14 nt, Human
gugcucgcccugcg

SEQ ID NO: 2416254 - RNA, 16 nt, Human
gugcuccagccuggcu

SEQ ID NO: 2416255 - RNA, 16 nt, Human
gugcucauuucaggau

SEQ ID NO: 2416256 - RNA, 22 nt, Human
gugcucaguuguagaauguauu

SEQ ID NO: 2416257 - RNA, 13 nt, Human
gugcuccaggcag

SEQ ID NO: 2416258 - RNA, 15 nt, Human
gugcucccuaccacc

SEQ ID NO: 2416259 - RNA, 17 nt, Human
gugcuccgugccuccac

SEQ ID NO: 2416260 - RNA, 16 nt, Human
gugcuccgugccucca

SEQ ID NO: 2416261 - RNA, 13 nt, Human
gugcuccgugccu

SEQ ID NO: 2416262 - RNA, 18 nt, Human
gugcucccuaccaccucc

SEQ ID NO: 2416263 - RNA, 16 nt, Human
gugcucaggagcccug

SEQ ID NO: 2416264 - RNA, 18 nt, Human
gugcucaggagcccuggg

SEQ ID NO: 2416265 - RNA, 19 nt, Human
gugcucaggagcccuggga

SEQ ID NO: 2416266 - RNA, 19 nt, Human
gugcucaguuguagaaugu

SEQ ID NO: 2416267 - RNA, 17 nt, Human
gugcucaguuguagaau

SEQ ID NO: 2416268 - RNA, 13 nt, Human
gugcucaguugua

SEQ ID NO: 2416269 - RNA, 21 nt, Human
gugcuauaggcuggagaagcu

SEQ ID NO: 2416270 - RNA, 13 nt, Human
gugcucagggcua

SEQ ID NO: 2416271 - RNA, 13 nt, Human
gugcucagggcug

SEQ ID NO: 2416272 - RNA, 15 nt, Human
gugcugcccugccca

SEQ ID NO: 2416273 - RNA, 14 nt, Human
gugcugcccugccc

SEQ ID NO: 2416274 - RNA, 13 nt, Human
gugcugcccugcc

SEQ ID NO: 2416275 - RNA, 12 nt, Human
gugcugcccugc

SEQ ID NO: 2416276 - RNA, 14 nt, Human
gugcucuggacagg

SEQ ID NO: 2416277 - RNA, 13 nt, Human
gugcucuggacag

SEQ ID NO: 2416278 - RNA, 21 nt, Human
gugcucgagacacagugaagc

SEQ ID NO: 2416279 - RNA, 22 nt, Human
gugcucgcuguugcugaauagg

SEQ ID NO: 2416280 - RNA, 15 nt, Human
gugcucuccaagccc

SEQ ID NO: 2416281 - RNA, 16 nt, Human
gugcucugaucaucca

SEQ ID NO: 2416282 - RNA, 14 nt, Human
aagaaguuuaagga

SEQ ID NO: 2416283 - RNA, 17 nt, Human
aagaaguuuaaggaaua

SEQ ID NO: 2416284 - RNA, 14 nt, Human
aagaagauguuuaa

SEQ ID NO: 2416285 - RNA, 18 nt, Human
aagaauaaaauguugaaa

SEQ ID NO: 2416286 - RNA, 15 nt, Human
aagaauaaaauguug

SEQ ID NO: 2416287 - RNA, 16 nt, Human
aagaauaaucacgcuu

SEQ ID NO: 2416288 - RNA, 22 nt, Human
aagaauaaucacgcuuuccuga

SEQ ID NO: 2416289 - RNA, 21 nt, Human
aagaauaaaauguugaaaagu

SEQ ID NO: 2416290 - RNA, 20 nt, Human
aagaauaaaauguugaaaag

SEQ ID NO: 2416291 - RNA, 23 nt, Human
aagaauaaaauguugaaaaguca

SEQ ID NO: 2416292 - RNA, 21 nt, Human
aagaauaauaugcugccaaau

SEQ ID NO: 2416293 - RNA, 21 nt, Human
aagaagaucacgcuccccgcc

SEQ ID NO: 2416294 - RNA, 17 nt, Human
aagaagaucacgcuccc

SEQ ID NO: 2416295 - RNA, 13 nt, Human
aagaagagggaga

SEQ ID NO: 2416296 - RNA, 22 nt, Human
aagaagaggagaaaaaaacuuc

SEQ ID NO: 2416297 - RNA, 19 nt, Human
aagaagauccuaaaacaaa

SEQ ID NO: 2416298 - RNA, 22 nt, Human
aagaagaucacgcuccccgccu

SEQ ID NO: 2416299 - RNA, 19 nt, Human
aagaagugugucacccuua

SEQ ID NO: 2416300 - RNA, 13 nt, Human
aagaagacuuuuu

SEQ ID NO: 2416301 - RNA, 11 nt, Human
aagaagagaca

SEQ ID NO: 2416302 - RNA, 10 nt, Human
aagaagagac

SEQ ID NO: 2416303 - RNA, 22 nt, Human
aagaagagagaagacccuucuc

SEQ ID NO: 2416304 - RNA, 14 nt, Human
aagaagagacagga

SEQ ID NO: 2416305 - RNA, 18 nt, Human
gugcuaucucccccagcc

SEQ ID NO: 2416306 - RNA, 15 nt, Human
gugcuaucuccccca

SEQ ID NO: 2416307 - RNA, 19 nt, Human
gugcuauaggcuggagaag

SEQ ID NO: 2416308 - RNA, 18 nt, Human
gugcuauaggcuggagaa

SEQ ID NO: 2416309 - RNA, 16 nt, Human
gugcuauaggcuggag

SEQ ID NO: 2416310 - RNA, 21 nt, Human
gugcuauacugcauacuuuuu

SEQ ID NO: 2416311 - RNA, 22 nt, Human
gugcuacaaaaacacagcaagg

SEQ ID NO: 2416312 - RNA, 16 nt, Human
gugcuacugauuguuu

SEQ ID NO: 2416313 - RNA, 20 nt, Human
gugcuacguacaugugaggc

SEQ ID NO: 2416314 - RNA, 19 nt, Human
gugcuaccuggguccuuuu

SEQ ID NO: 2416315 - RNA, 16 nt, Human
gugcuaccuggguccu

SEQ ID NO: 2416316 - RNA, 23 nt, Human
aagaauaaucacgcuuuccugaa

SEQ ID NO: 2416317 - RNA, 21 nt, Human
gugcuacacccuuuuccagcu

SEQ ID NO: 2416318 - RNA, 16 nt, Human
aacugccuacuccaaa

SEQ ID NO: 2416319 - RNA, 16 nt, Human
aacugcccccaacuuu

SEQ ID NO: 2416320 - RNA, 16 nt, Human
aacuguccagagagca

SEQ ID NO: 2416321 - RNA, 19 nt, Human
aacugucuauuucugcuga

SEQ ID NO: 2416322 - RNA, 17 nt, Human
aacugucuauuucugcu

SEQ ID NO: 2416323 - RNA, 23 nt, Human
aacugucucgaugcaaugaacac

SEQ ID NO: 2416324 - RNA, 16 nt, Human
aacugucuauuucugc

SEQ ID NO: 2416325 - RNA, 14 nt, Human
aacugucuauuucu

SEQ ID NO: 2416326 - RNA, 14 nt, Human
aacuguccagagag

SEQ ID NO: 2416327 - RNA, 18 nt, Human
aacugcccccucugcccu

SEQ ID NO: 2416328 - RNA, 19 nt, Human
aacugcccccucugcccug

SEQ ID NO: 2416329 - RNA, 20 nt, Human
aacugcccccucugcccugc

SEQ ID NO: 2416330 - RNA, 21 nt, Human
aacugcccccucugcccugcg

SEQ ID NO: 2416331 - RNA, 16 nt, Human
aacugcccccucugcc

SEQ ID NO: 2416332 - RNA, 17 nt, Human
aacugcccccucugccc

SEQ ID NO: 2416333 - RNA, 14 nt, Human
aacugccaguuuug

SEQ ID NO: 2416334 - RNA, 19 nt, Human
aacugccaguuuuguuucc

SEQ ID NO: 2416335 - RNA, 14 nt, Human
aacugcauuagaaa

SEQ ID NO: 2416336 - RNA, 22 nt, Human
aacuucacauauugauuuccgu

SEQ ID NO: 2416337 - RNA, 22 nt, Human
aacuucaccauauuaccacaga

SEQ ID NO: 2416338 - RNA, 14 nt, Human
aacuucacauauug

SEQ ID NO: 2416339 - RNA, 17 nt, Human
aacuguguucauuagaa

SEQ ID NO: 2416340 - RNA, 18 nt, Human
aacuguguggacugugau

SEQ ID NO: 2416341 - RNA, 19 nt, Human
aacugucucucaugaaccu

SEQ ID NO: 2416342 - RNA, 17 nt, Human
aacugugaaguuuacau

SEQ ID NO: 2416343 - RNA, 19 nt, Human
aacugugaaguuuacauug

SEQ ID NO: 2416344 - RNA, 22 nt, Human
aacugugcagagucuagaaguu

SEQ ID NO: 2416345 - RNA, 20 nt, Human
aacuguguacauaacugaaa

SEQ ID NO: 2416346 - RNA, 21 nt, Human
aacuguguacauaacugaaaa

SEQ ID NO: 2416347 - RNA, 23 nt, Human
aacuguguacauaacugaaaaug

SEQ ID NO: 2416348 - RNA, 11 nt, Human
aacuguggccg

SEQ ID NO: 2416349 - RNA, 20 nt, Human
aacuguggccguuaucugga

SEQ ID NO: 2416350 - RNA, 23 nt, Human
aacuucgcaucaaaagacaauuc

SEQ ID NO: 2416351 - RNA, 19 nt, Human
aacuucgcaucaaaagaca

SEQ ID NO: 2416352 - RNA, 17 nt, Human
aacuucgcaucaaaaga

SEQ ID NO: 2416353 - RNA, 18 nt, Human
aacuucagcaguaccuau

SEQ ID NO: 2416354 - RNA, 16 nt, Human
aacuucuaauauauuu

SEQ ID NO: 2416355 - RNA, 14 nt, Human
aacuucuaauauau

SEQ ID NO: 2416356 - RNA, 23 nt, Human
aacuuccuuggacucauuuuaaa

SEQ ID NO: 2416357 - RNA, 11 nt, Human
aacuucagcag

SEQ ID NO: 2416358 - RNA, 20 nt, Human
aacuucgaaagcaucauuau

SEQ ID NO: 2416359 - RNA, 22 nt, Human
aacuuccuuggacucauuuuaa

SEQ ID NO: 2416360 - RNA, 18 nt, Human
aacuucagcgguuuauau

SEQ ID NO: 2416361 - RNA, 13 nt, Human
aacuucagacaua

SEQ ID NO: 2416362 - RNA, 15 nt, Human
aacuucagacacaaa

SEQ ID NO: 2416363 - RNA, 22 nt, Human
aacuucagagggaaaguaaaua

SEQ ID NO: 2416364 - RNA, 24 nt, Human
aacuucuuuguaaucguuaugugu

SEQ ID NO: 2416365 - RNA, 19 nt, Human
aacuugagggcccagagca

SEQ ID NO: 2416366 - RNA, 17 nt, Human
gugcauuuaugagcucu

SEQ ID NO: 2416367 - RNA, 13 nt, Human
gugcauugugcuu

SEQ ID NO: 2416368 - RNA, 11 nt, Human
gugcauugugc

SEQ ID NO: 2416369 - RNA, 21 nt, Human
gugcauuuggugguuucagaa

SEQ ID NO: 2416370 - RNA, 23 nt, Human
gugccaaaaacaacaacaaaaug

SEQ ID NO: 2416371 - RNA, 22 nt, Human
gugccaaacaaaaagguucuca

SEQ ID NO: 2416372 - RNA, 17 nt, Human
gugcauuuucccagaua

SEQ ID NO: 2416373 - RNA, 16 nt, Human
gugcauuuuugugaaa

SEQ ID NO: 2416374 - RNA, 17 nt, Human
gugcauuugaggucugu

SEQ ID NO: 2416375 - RNA, 19 nt, Human
gugcauuugaggucuguuc

SEQ ID NO: 2416376 - RNA, 21 nt, Human
gugcauuggaagaccccaccc

SEQ ID NO: 2416377 - RNA, 20 nt, Human
gugcauuggaagaccccacc

SEQ ID NO: 2416378 - RNA, 23 nt, Human
gugcauucuuuuaaaagacaaga

SEQ ID NO: 2416379 - RNA, 22 nt, Human
gugcauucuuuuaaaagacaag

SEQ ID NO: 2416380 - RNA, 19 nt, Human
gugcauucuuuuaaaagac

SEQ ID NO: 2416381 - RNA, 21 nt, Human
gugcaccuuaccaacuuucug

SEQ ID NO: 2416382 - RNA, 20 nt, Human
gugcaccuuaccaacuuucu

SEQ ID NO: 2416383 - RNA, 18 nt, Human
gugcaccuguacucagga

SEQ ID NO: 2416384 - RNA, 21 nt, Human
gugcaccuguacucaggaggc

SEQ ID NO: 2416385 - RNA, 21 nt, Human
gugcacaagcuccaagcuccc

SEQ ID NO: 2416386 - RNA, 16 nt, Human
gugcacaagcuccaag

SEQ ID NO: 2416387 - RNA, 13 nt, Human
gugcacaagcucc

SEQ ID NO: 2416388 - RNA, 18 nt, Human
gugcaaugaccuuucaau

SEQ ID NO: 2416389 - RNA, 20 nt, Human
gugcacaaauauuuauuuuc

SEQ ID NO: 2416390 - RNA, 16 nt, Human
gugcaccaucccuuuu

SEQ ID NO: 2416391 - RNA, 23 nt, Human
gugcacccaugggcucugacaga

SEQ ID NO: 2416392 - RNA, 19 nt, Human
gugcacccaugggcucuga

SEQ ID NO: 2416393 - RNA, 23 nt, Human
gugcaccaucccuuuuugaagug

SEQ ID NO: 2416394 - RNA, 15 nt, Human
gugcacccacucugc

SEQ ID NO: 2416395 - RNA, 23 nt, Human
gugcacaagcuccaagcucccag

SEQ ID NO: 2416396 - RNA, 21 nt, Human
gugcacaugcacgugugugca

SEQ ID NO: 2416397 - RNA, 11 nt, Human
gugauuaccag

SEQ ID NO: 2416398 - RNA, 16 nt, Human
gugauuaccagggacu

SEQ ID NO: 2416399 - RNA, 17 nt, Human
gugauuaccagggacug

SEQ ID NO: 2416400 - RNA, 18 nt, Human
gugauuaaacgugcagac

SEQ ID NO: 2416401 - RNA, 15 nt, Human
gugauuaaacgugca

SEQ ID NO: 2416402 - RNA, 14 nt, Human
gugauuaaacgugc

SEQ ID NO: 2416403 - RNA, 22 nt, Human
gugauguuuaacaggaagaucu

SEQ ID NO: 2416404 - RNA, 19 nt, Human
gugauuaaacgugcagacu

SEQ ID NO: 2416405 - RNA, 19 nt, Human
gugauuagaggcagaucug

SEQ ID NO: 2416406 - RNA, 17 nt, Human
gugauuacauaaucugu

SEQ ID NO: 2416407 - RNA, 22 nt, Human
gugcaauaaaucugacccagug

SEQ ID NO: 2416408 - RNA, 23 nt, Human
gugcaauaaaucugacccagugc

SEQ ID NO: 2416409 - RNA, 19 nt, Human
gugcaauaaaucugaccca

SEQ ID NO: 2416410 - RNA, 21 nt, Human
gugcaauaaaucugacccagu

SEQ ID NO: 2416411 - RNA, 20 nt, Human
gugcaagugugugcaugugu

SEQ ID NO: 2416412 - RNA, 15 nt, Human
gugcaagugugugca

SEQ ID NO: 2416413 - RNA, 22 nt, Human
gugcaagugugugcacaugugu

SEQ ID NO: 2416414 - RNA, 14 nt, Human
gugauucaaucugu

SEQ ID NO: 2416415 - RNA, 16 nt, Human
gugauucaaucuguaa

SEQ ID NO: 2416416 - RNA, 22 nt, Human
gugauuagagggaggagaauga

SEQ ID NO: 2416417 - RNA, 16 nt, Human
gugauuauuucacuuu

SEQ ID NO: 2416418 - RNA, 21 nt, Human
gugauucaaucuguaaacugu

SEQ ID NO: 2416419 - RNA, 23 nt, Human
gugauucaaucuguaaacugugu

SEQ ID NO: 2416420 - RNA, 22 nt, Human
gugauucaauucaacacucccu

SEQ ID NO: 2416421 - RNA, 19 nt, Human
gugauuauuuguuauuugu

SEQ ID NO: 2416422 - RNA, 14 nt, Human
gugcaagugugugc

SEQ ID NO: 2416423 - RNA, 18 nt, Human
gugcaagugucugugugc

SEQ ID NO: 2416424 - RNA, 15 nt, Human
gugaugugaguugca

SEQ ID NO: 2416425 - RNA, 10 nt, Human
gugauguguc

SEQ ID NO: 2416426 - RNA, 14 nt, Human
gugauguuuguccu

SEQ ID NO: 2416427 - RNA, 14 nt, Human
gugaugucaucugu

SEQ ID NO: 2416428 - RNA, 15 nt, Human
gugaugugaagccaa

SEQ ID NO: 2416429 - RNA, 22 nt, Human
gugaugguuccccuguucacuc

SEQ ID NO: 2416430 - RNA, 14 nt, Human
gugauccuuuuaug

SEQ ID NO: 2416431 - RNA, 22 nt, Human
aacuugagcuuuaaaaaucauu

SEQ ID NO: 2416432 - RNA, 14 nt, Human
gugaucucagauca

SEQ ID NO: 2416433 - RNA, 15 nt, Human
gugaucucagaucag

SEQ ID NO: 2416434 - RNA, 14 nt, Human
gugaucucauuuaa

SEQ ID NO: 2416435 - RNA, 19 nt, Human
gugauccuuuuauguuauu

SEQ ID NO: 2416436 - RNA, 12 nt, Human
gugaucuccaua

SEQ ID NO: 2416437 - RNA, 13 nt, Human
gugaucuccauau

SEQ ID NO: 2416438 - RNA, 15 nt, Human
gugaucugaacagaa

SEQ ID NO: 2416439 - RNA, 22 nt, Human
gugaucuuggcuuacugcagcc

SEQ ID NO: 2416440 - RNA, 23 nt, Human
gugaugguuccccuguucacucu

SEQ ID NO: 2416441 - RNA, 15 nt, Human
gugaugaacuuucuc

SEQ ID NO: 2416442 - RNA, 14 nt, Human
gugaugaacuuucu

SEQ ID NO: 2416443 - RNA, 18 nt, Human
uaggaaauauuuauuuua

SEQ ID NO: 2416444 - RNA, 19 nt, Human
uaggaaauaaaaccuuuca

SEQ ID NO: 2416445 - RNA, 20 nt, Human
uagcuguuauuucuauuuuu

SEQ ID NO: 2416446 - RNA, 17 nt, Human
uagcuguuauuucuauu

SEQ ID NO: 2416447 - RNA, 13 nt, Human
uagcuguugagcu

SEQ ID NO: 2416448 - RNA, 17 nt, Human
uagcuguugagcuguuu

SEQ ID NO: 2416449 - RNA, 16 nt, Human
uagcuguugagcuguu

SEQ ID NO: 2416450 - RNA, 14 nt, Human
uagcugugggggug

SEQ ID NO: 2416451 - RNA, 13 nt, Human
uagcugugggggu

SEQ ID NO: 2416452 - RNA, 14 nt, Human
uagcugugugaaau

SEQ ID NO: 2416453 - RNA, 14 nt, Human
uagcuguggugagg

SEQ ID NO: 2416454 - RNA, 18 nt, Human
uagcuguggugagguggg

SEQ ID NO: 2416455 - RNA, 19 nt, Human
uaggaaauauuuauuuuaa

SEQ ID NO: 2416456 - RNA, 16 nt, Human
uaggaaauccagggug

SEQ ID NO: 2416457 - RNA, 14 nt, Human
uaggaaaugaaugu

SEQ ID NO: 2416458 - RNA, 20 nt, Human
uaggaaauaaaaccuuucaa

SEQ ID NO: 2416459 - RNA, 15 nt, Human
uaggacgccacccag

SEQ ID NO: 2416460 - RNA, 22 nt, Human
uaggaccuuuccaccacagcca

SEQ ID NO: 2416461 - RNA, 21 nt, Human
uaggaccuuuccaccacagcc

SEQ ID NO: 2416462 - RNA, 19 nt, Human
uaggaccuuuccaccacag

SEQ ID NO: 2416463 - RNA, 16 nt, Human
uaggacgccacccagc

SEQ ID NO: 2416464 - RNA, 19 nt, Human
uaggacucaaaguuucaga

SEQ ID NO: 2416465 - RNA, 14 nt, Human
uaggacucugaggc

SEQ ID NO: 2416466 - RNA, 15 nt, Human
uaggacucugaggcu

SEQ ID NO: 2416467 - RNA, 16 nt, Human
uaggacucugaggcuc

SEQ ID NO: 2416468 - RNA, 23 nt, Human
uaggagccugcuggucacagccu

SEQ ID NO: 2416469 - RNA, 15 nt, Human
uaggagccugcuggu

SEQ ID NO: 2416470 - RNA, 18 nt, Human
uaggagcugccuuggcuc

SEQ ID NO: 2416471 - RNA, 23 nt, Human
uaggagcugccuuggcucagaca

SEQ ID NO: 2416472 - RNA, 14 nt, Human
uaggagcugggagg

SEQ ID NO: 2416473 - RNA, 20 nt, Human
uaggaggaccagagcuacug

SEQ ID NO: 2416474 - RNA, 18 nt, Human
uaggagcugggaggaaaa

SEQ ID NO: 2416475 - RNA, 11 nt, Human
uaggagccugc

SEQ ID NO: 2416476 - RNA, 14 nt, Human
uaggagcagagcuc

SEQ ID NO: 2416477 - RNA, 18 nt, Human
uaggagaggaugagagcc

SEQ ID NO: 2416478 - RNA, 14 nt, Human
uaggagaggaugag

SEQ ID NO: 2416479 - RNA, 22 nt, Human
uaggagaggaugagagcccaga

SEQ ID NO: 2416480 - RNA, 16 nt, Human
uaggagauaccagguu

SEQ ID NO: 2416481 - RNA, 22 nt, Human
uaggagauaccagguugaaaga

SEQ ID NO: 2416482 - RNA, 15 nt, Human
uaggagaagccagga

SEQ ID NO: 2416483 - RNA, 16 nt, Human
uaggagaagccaggaa

SEQ ID NO: 2416484 - RNA, 22 nt, Human
uaggagaauugcuugaaccugg

SEQ ID NO: 2416485 - RNA, 14 nt, Human
uaggagagaccgag

SEQ ID NO: 2416486 - RNA, 14 nt, Human
uaggagaccaaggc

SEQ ID NO: 2416487 - RNA, 21 nt, Human
uaggagaccaaggcgggagca

SEQ ID NO: 2416488 - RNA, 20 nt, Human
uaggagaaccaaaucuggaa

SEQ ID NO: 2416489 - RNA, 12 nt, Human
uaggagaagcca

SEQ ID NO: 2416490 - RNA, 17 nt, Human
uaggagaaccaaaucug

SEQ ID NO: 2416491 - RNA, 18 nt, Human
uaggacucugaggcucuu

SEQ ID NO: 2416492 - RNA, 14 nt, Human
uaggacuguagaaa

SEQ ID NO: 2416493 - RNA, 13 nt, Human
uaggacuguagaa

SEQ ID NO: 2416494 - RNA, 14 nt, Human
uaggcauuguggga

SEQ ID NO: 2416495 - RNA, 12 nt, Human
uaggcagagccu

SEQ ID NO: 2416496 - RNA, 22 nt, Human
uaggcagacacagggacuugaa

SEQ ID NO: 2416497 - RNA, 17 nt, Human
uaggcagacuggguuuc

SEQ ID NO: 2416498 - RNA, 16 nt, Human
uaggcagagccuuugg

SEQ ID NO: 2416499 - RNA, 13 nt, Human
uaggcagagccuu

SEQ ID NO: 2416500 - RNA, 20 nt, Human
uaggcagauugaaaaggaca

SEQ ID NO: 2416501 - RNA, 13 nt, Human
uaggcagcagcuu

SEQ ID NO: 2416502 - RNA, 16 nt, Human
uaggcauuugcugaau

SEQ ID NO: 2416503 - RNA, 20 nt, Human
uaggcauuugcugaauacag

SEQ ID NO: 2416504 - RNA, 13 nt, Human
uaggaggaugggc

SEQ ID NO: 2416505 - RNA, 14 nt, Human
uaggagggagacac

SEQ ID NO: 2416506 - RNA, 16 nt, Human
uaggagggaguuaucu

SEQ ID NO: 2416507 - RNA, 18 nt, Human
uaggcaaccuuuauuuuu

SEQ ID NO: 2416508 - RNA, 18 nt, Human
uaggagggaguuaucuaa

SEQ ID NO: 2416509 - RNA, 21 nt, Human
uaggagggaguuaucuaaaag

SEQ ID NO: 2416510 - RNA, 15 nt, Human
uaggcagacacaggg

SEQ ID NO: 2416511 - RNA, 14 nt, Human
uaggcagacacagg

SEQ ID NO: 2416512 - RNA, 12 nt, Human
uaggcagacaca

SEQ ID NO: 2416513 - RNA, 11 nt, Human
uaggcagacac

SEQ ID NO: 2416514 - RNA, 14 nt, Human
uagggagagaagau

SEQ ID NO: 2416515 - RNA, 15 nt, Human
uagggagagaagaua

SEQ ID NO: 2416516 - RNA, 14 nt, Human
uagggaccccuccu

SEQ ID NO: 2416517 - RNA, 16 nt, Human
uagggaccccuccucc

SEQ ID NO: 2416518 - RNA, 15 nt, Human
uagggaccccuccuc

SEQ ID NO: 2416519 - RNA, 20 nt, Human
uagggacucaauuucucccc

SEQ ID NO: 2416520 - RNA, 17 nt, Human
uagggaccccuccuccc

SEQ ID NO: 2416521 - RNA, 13 nt, Human
uagggacuuaaaa

SEQ ID NO: 2416522 - RNA, 16 nt, Human
uagggagaaauguugu

SEQ ID NO: 2416523 - RNA, 14 nt, Human
uagggacuuaaaaa

SEQ ID NO: 2416524 - RNA, 16 nt, Human
uaggcaggacaugcug

SEQ ID NO: 2416525 - RNA, 12 nt, Human
uaggcauuuccu

SEQ ID NO: 2416526 - RNA, 21 nt, Human
uagggaaggauacaaaagcau

SEQ ID NO: 2416527 - RNA, 14 nt, Human
uagggaagggccug

SEQ ID NO: 2416528 - RNA, 14 nt, Human
uagggaaguaacag

SEQ ID NO: 2416529 - RNA, 20 nt, Human
uagggaagggugguggagcc

SEQ ID NO: 2416530 - RNA, 22 nt, Human
uagggacaauacagaacccauu

SEQ ID NO: 2416531 - RNA, 21 nt, Human
uagggaagggugguggagcca

SEQ ID NO: 2416532 - RNA, 21 nt, Human
uagggaauggcacagcccaaa

SEQ ID NO: 2416533 - RNA, 10 nt, Human
uagcuguggg

SEQ ID NO: 2416534 - RNA, 16 nt, Human
uagcuaucagaagacc

SEQ ID NO: 2416535 - RNA, 15 nt, Human
uagcuaucagaagac

SEQ ID NO: 2416536 - RNA, 14 nt, Human
uagcuaucagaaga

SEQ ID NO: 2416537 - RNA, 17 nt, Human
uagcuauaucuauauau

SEQ ID NO: 2416538 - RNA, 16 nt, Human
uagcugugaccucucc

SEQ ID NO: 2416539 - RNA, 14 nt, Human
uagcuauauccaug

SEQ ID NO: 2416540 - RNA, 15 nt, Human
uagcuauauccaugu

SEQ ID NO: 2416541 - RNA, 13 nt, Human
uagcuagaggaac

SEQ ID NO: 2416542 - RNA, 14 nt, Human
uagcuagaggaacc

SEQ ID NO: 2416543 - RNA, 15 nt, Human
uagcuagaggaacca

SEQ ID NO: 2416544 - RNA, 16 nt, Human
uagcuauauccaugua

SEQ ID NO: 2416545 - RNA, 17 nt, Human
uagcuauauccauguac

SEQ ID NO: 2416546 - RNA, 18 nt, Human
uagcuauauccauguacu

SEQ ID NO: 2416547 - RNA, 19 nt, Human
uagcuauauccauguacug

SEQ ID NO: 2416548 - RNA, 20 nt, Human
uagcuauauccauguacugu

SEQ ID NO: 2416549 - RNA, 21 nt, Human
uagcuauauccauguacugua

SEQ ID NO: 2416550 - RNA, 15 nt, Human
uagcuauaucuauau

SEQ ID NO: 2416551 - RNA, 22 nt, Human
uagcuauauccauguacuguag

SEQ ID NO: 2416552 - RNA, 15 nt, Human
uagcuacaggaagca

SEQ ID NO: 2416553 - RNA, 20 nt, Human
uagcuacaggaagcacccca

SEQ ID NO: 2416554 - RNA, 19 nt, Human
uagcuaauguaauaacugu

SEQ ID NO: 2416555 - RNA, 12 nt, Human
uagcuaauguaa

SEQ ID NO: 2416556 - RNA, 18 nt, Human
acaaucauuugcuuuuug

SEQ ID NO: 2416557 - RNA, 22 nt, Human
acaaucauugcugaaaauggua

SEQ ID NO: 2416558 - RNA, 21 nt, Human
acaaucauugcugaaaauggu

SEQ ID NO: 2416559 - RNA, 18 nt, Human
acaaucauugcugaaaau

SEQ ID NO: 2416560 - RNA, 14 nt, Human
acaaucauugcuga

SEQ ID NO: 2416561 - RNA, 13 nt, Human
acaaucauugcug

SEQ ID NO: 2416562 - RNA, 19 nt, Human
acaaucaugaaauaugcau

SEQ ID NO: 2416563 - RNA, 18 nt, Human
acaaucaugaaauaugca

SEQ ID NO: 2416564 - RNA, 12 nt, Human
acaaugacuuac

SEQ ID NO: 2416565 - RNA, 15 nt, Human
acaauccuagugcuu

SEQ ID NO: 2416566 - RNA, 16 nt, Human
acaauccuagugcuuu

SEQ ID NO: 2416567 - RNA, 17 nt, Human
acaauccuagugcuuuc

SEQ ID NO: 2416568 - RNA, 22 nt, Human
acaauccuagugcuuuccuuuu

SEQ ID NO: 2416569 - RNA, 16 nt, Human
acaaucgauggccuug

SEQ ID NO: 2416570 - RNA, 23 nt, Human
acaauccuagugcuuuccuuuuu

SEQ ID NO: 2416571 - RNA, 17 nt, Human
acaaucgauggccuugc

SEQ ID NO: 2416572 - RNA, 17 nt, Human
acaaugacuuacuguac

SEQ ID NO: 2416573 - RNA, 18 nt, Human
acaaugacuuacuguaca

SEQ ID NO: 2416574 - RNA, 16 nt, Human
acaaugacauuuauau

SEQ ID NO: 2416575 - RNA, 22 nt, Human
acaaggacagccccuccuccau

SEQ ID NO: 2416576 - RNA, 21 nt, Human
acaaggacagccccuccucca

SEQ ID NO: 2416577 - RNA, 18 nt, Human
acaaggacuaggguccug

SEQ ID NO: 2416578 - RNA, 19 nt, Human
acaaggacuaggguccugg

SEQ ID NO: 2416579 - RNA, 15 nt, Human
acaaggacuuccugu

SEQ ID NO: 2416580 - RNA, 16 nt, Human
acaaggauagaugcug

SEQ ID NO: 2416581 - RNA, 17 nt, Human
acaaggauagaugcugg

SEQ ID NO: 2416582 - RNA, 18 nt, Human
acaaggauagaugcuggc

SEQ ID NO: 2416583 - RNA, 21 nt, Human
acaaggauagaugcuggccca

SEQ ID NO: 2416584 - RNA, 21 nt, Human
acaauaaaauuuuuuuucaug

SEQ ID NO: 2416585 - RNA, 23 nt, Human
acaauaaaauuuuuuuucauguu

SEQ ID NO: 2416586 - RNA, 12 nt, Human
acaauaaagaga

SEQ ID NO: 2416587 - RNA, 14 nt, Human
acaagacugcacau

SEQ ID NO: 2416588 - RNA, 13 nt, Human
acaagacugcaca

SEQ ID NO: 2416589 - RNA, 14 nt, Human
acaagacuucagua

SEQ ID NO: 2416590 - RNA, 19 nt, Human
acaagaccccgucucaaaa

SEQ ID NO: 2416591 - RNA, 18 nt, Human
acaagaccacguuucuaa

SEQ ID NO: 2416592 - RNA, 17 nt, Human
acaagacuucaguaugu

SEQ ID NO: 2416593 - RNA, 16 nt, Human
acaagacuucaguaug

SEQ ID NO: 2416594 - RNA, 21 nt, Human
acaagacuucaguauguuguc

SEQ ID NO: 2416595 - RNA, 22 nt, Human
acaaucaguccccucccaucug

SEQ ID NO: 2416596 - RNA, 20 nt, Human
acaaucaguccccucccauc

SEQ ID NO: 2416597 - RNA, 19 nt, Human
acaaucaguccccucccau

SEQ ID NO: 2416598 - RNA, 18 nt, Human
acaaucaguccccuccca

SEQ ID NO: 2416599 - RNA, 17 nt, Human
acaaucaguccccuccc

SEQ ID NO: 2416600 - RNA, 16 nt, Human
acaaucaguccccucc

SEQ ID NO: 2416601 - RNA, 15 nt, Human
acaaucaguccccuc

SEQ ID NO: 2416602 - RNA, 13 nt, Human
acaauacccccag

SEQ ID NO: 2416603 - RNA, 16 nt, Human
acaauacaugcugcua

SEQ ID NO: 2416604 - RNA, 23 nt, Human
acaauacaucccuuaccugggaa

SEQ ID NO: 2416605 - RNA, 14 nt, Human
acaauaauuuucua

SEQ ID NO: 2416606 - RNA, 12 nt, Human
acaauaauuuca

SEQ ID NO: 2416607 - RNA, 13 nt, Human
acaauaauuucag

SEQ ID NO: 2416608 - RNA, 14 nt, Human
acaauaaauaaucu

SEQ ID NO: 2416609 - RNA, 23 nt, Human
acaauaaagaucgcccccaccuc

SEQ ID NO: 2416610 - RNA, 14 nt, Human
acaauaaagagauu

SEQ ID NO: 2416611 - RNA, 22 nt, Human
acaauaaaauuuuuuuucaugu

SEQ ID NO: 2416612 - RNA, 15 nt, Human
acaauaaaugugcuu

SEQ ID NO: 2416613 - RNA, 16 nt, Human
acaauaacuacugugu

SEQ ID NO: 2416614 - RNA, 17 nt, Human
acaauaacuacuguguu

SEQ ID NO: 2416615 - RNA, 14 nt, Human
acaauaaaugugca

SEQ ID NO: 2416616 - RNA, 22 nt, Human
acaauaacuacuguguuccugg

SEQ ID NO: 2416617 - RNA, 18 nt, Human
acaauaacuacuguguuc

SEQ ID NO: 2416618 - RNA, 19 nt, Human
acaauaacuacuguguucc

SEQ ID NO: 2416619 - RNA, 20 nt, Human
acaauaacuacuguguuccu

SEQ ID NO: 2416620 - RNA, 21 nt, Human
acaauaacuacuguguuccug

SEQ ID NO: 2416621 - RNA, 21 nt, Human
acaauaaguuaacuauuuuau

SEQ ID NO: 2416622 - RNA, 14 nt, Human
uagauggcuccucu

SEQ ID NO: 2416623 - RNA, 20 nt, Human
uagaugcugaugauuuguuu

SEQ ID NO: 2416624 - RNA, 14 nt, Human
uagauggauucucc

SEQ ID NO: 2416625 - RNA, 16 nt, Human
uagaugcuggcccagg

SEQ ID NO: 2416626 - RNA, 18 nt, Human
uagaugcuggcccagggc

SEQ ID NO: 2416627 - RNA, 21 nt, Human
uagaugcuggcccagggccca

SEQ ID NO: 2416628 - RNA, 22 nt, Human
uagaugcuggcccagggcccag

SEQ ID NO: 2416629 - RNA, 19 nt, Human
uagcauggcugccaauggg

SEQ ID NO: 2416630 - RNA, 13 nt, Human
uagaugggaauga

SEQ ID NO: 2416631 - RNA, 12 nt, Human
uagcauguaaug

SEQ ID NO: 2416632 - RNA, 19 nt, Human
uagaugcaagauauuuaua

SEQ ID NO: 2416633 - RNA, 15 nt, Human
uagaugcaguucuga

SEQ ID NO: 2416634 - RNA, 13 nt, Human
uagaugcuggccc

SEQ ID NO: 2416635 - RNA, 14 nt, Human
uagaugcuggccca

SEQ ID NO: 2416636 - RNA, 15 nt, Human
uagaugcuggcccag

SEQ ID NO: 2416637 - RNA, 14 nt, Human
uagaugcugacugu

SEQ ID NO: 2416638 - RNA, 23 nt, Human
uagaugcugacuguacuccuccc

SEQ ID NO: 2416639 - RNA, 21 nt, Human
uagccaaggccaaaggaagca

SEQ ID NO: 2416640 - RNA, 20 nt, Human
uagccaaggugggcugagcc

SEQ ID NO: 2416641 - RNA, 21 nt, Human
uagccaaggugggcugagccc

SEQ ID NO: 2416642 - RNA, 23 nt, Human
uagccaaggugggcugagcccug

SEQ ID NO: 2416643 - RNA, 14 nt, Human
uagccaaggccaaa

SEQ ID NO: 2416644 - RNA, 20 nt, Human
uagcauuuuugauuuaugca

SEQ ID NO: 2416645 - RNA, 14 nt, Human
uagcauuuuugauu

SEQ ID NO: 2416646 - RNA, 22 nt, Human
uagcauuuugcuaaaugugaau

SEQ ID NO: 2416647 - RNA, 23 nt, Human
uagcauguauugugucuuuugca

SEQ ID NO: 2416648 - RNA, 16 nt, Human
uagcauuuugcuaaau

SEQ ID NO: 2416649 - RNA, 19 nt, Human
uagcauguauugugucuuu

SEQ ID NO: 2416650 - RNA, 18 nt, Human
uagcauguauugugucuu

SEQ ID NO: 2416651 - RNA, 15 nt, Human
uagcauguauugugu

SEQ ID NO: 2416652 - RNA, 13 nt, Human
uagcauguauugu

SEQ ID NO: 2416653 - RNA, 20 nt, Human
acaagacccaaaaggcagaa

SEQ ID NO: 2416654 - RNA, 19 nt, Human
acaagacccuugugguccc

SEQ ID NO: 2416655 - RNA, 19 nt, Human
acaagaccacguuucuaaa

SEQ ID NO: 2416656 - RNA, 14 nt, Human
acaacagauuugug

SEQ ID NO: 2416657 - RNA, 13 nt, Human
acaacagauuugu

SEQ ID NO: 2416658 - RNA, 21 nt, Human
acaacacucauugaccugagg

SEQ ID NO: 2416659 - RNA, 23 nt, Human
acaacacucauugaccugaggcc

SEQ ID NO: 2416660 - RNA, 19 nt, Human
acaacagaagcuucagaag

SEQ ID NO: 2416661 - RNA, 13 nt, Human
acaacagaagcuu

SEQ ID NO: 2416662 - RNA, 11 nt, Human
acaacagaagu

SEQ ID NO: 2416663 - RNA, 13 nt, Human
acaacagaaguca

SEQ ID NO: 2416664 - RNA, 17 nt, Human
acaacaaaaagcuuccc

SEQ ID NO: 2416665 - RNA, 15 nt, Human
uagccagaggagaga

SEQ ID NO: 2416666 - RNA, 11 nt, Human
uagccagagga

SEQ ID NO: 2416667 - RNA, 18 nt, Human
uagccaauauuuuucuua

SEQ ID NO: 2416668 - RNA, 14 nt, Human
uagccaauguggga

SEQ ID NO: 2416669 - RNA, 20 nt, Human
uagccacaaaauugggaaag

SEQ ID NO: 2416670 - RNA, 19 nt, Human
uagccacaucccuuugaaa

SEQ ID NO: 2416671 - RNA, 18 nt, Human
uagccacuuaccuucaau

SEQ ID NO: 2416672 - RNA, 22 nt, Human
uagccacuuaccuucaauaaag

SEQ ID NO: 2416673 - RNA, 18 nt, Human
acaaauuuacagagacag

SEQ ID NO: 2416674 - RNA, 15 nt, Human
uagccagacacucug

SEQ ID NO: 2416675 - RNA, 14 nt, Human
uagccagacacucu

SEQ ID NO: 2416676 - RNA, 21 nt, Human
uagccacuuuggucccgugca

SEQ ID NO: 2416677 - RNA, 23 nt, Human
uagccacuuaccuucaauaaagu

SEQ ID NO: 2416678 - RNA, 16 nt, Human
uagccagacacucugc

SEQ ID NO: 2416679 - RNA, 19 nt, Human
acaaauuuacagagacaga

SEQ ID NO: 2416680 - RNA, 18 nt, Human
uagccagcacacagggca

SEQ ID NO: 2416681 - RNA, 19 nt, Human
uagccagcacacagggcag

SEQ ID NO: 2416682 - RNA, 21 nt, Human
uagagcaaaauugauguguuu

SEQ ID NO: 2416683 - RNA, 14 nt, Human
uagagcaaaauuga

SEQ ID NO: 2416684 - RNA, 21 nt, Human
uagagauuaccuccugagaaa

SEQ ID NO: 2416685 - RNA, 19 nt, Human
uagaggagaaacuggaacu

SEQ ID NO: 2416686 - RNA, 22 nt, Human
uagagcaaaauugauguguuua

SEQ ID NO: 2416687 - RNA, 16 nt, Human
uagagcacacuguagc

SEQ ID NO: 2416688 - RNA, 17 nt, Human
uagagcacacuguagca

SEQ ID NO: 2416689 - RNA, 20 nt, Human
uagagauguuuuuaaaaguu

SEQ ID NO: 2416690 - RNA, 19 nt, Human
uagagauguuuuuaaaagu

SEQ ID NO: 2416691 - RNA, 17 nt, Human
uagagauuaccuccuga

SEQ ID NO: 2416692 - RNA, 18 nt, Human
uagagauuaccuccugag

SEQ ID NO: 2416693 - RNA, 19 nt, Human
uagagauuaccuccugaga

SEQ ID NO: 2416694 - RNA, 21 nt, Human
uagagaucugguuuugcuauu

SEQ ID NO: 2416695 - RNA, 14 nt, Human
uagagauggaggag

SEQ ID NO: 2416696 - RNA, 19 nt, Human
uagagauggaggaggaggc

SEQ ID NO: 2416697 - RNA, 12 nt, Human
uagagauguuuu

SEQ ID NO: 2416698 - RNA, 19 nt, Human
uagagaucauccuuuccag

SEQ ID NO: 2416699 - RNA, 19 nt, Human
uagagauaugcagaaggaa

SEQ ID NO: 2416700 - RNA, 20 nt, Human
uagagauaugcagaaggaag

SEQ ID NO: 2416701 - RNA, 18 nt, Human
acaaaggguuuuaaugua

SEQ ID NO: 2416702 - RNA, 17 nt, Human
acaaaggguuuuaaugu

SEQ ID NO: 2416703 - RNA, 17 nt, Human
uagagauaguacauaaa

SEQ ID NO: 2416704 - RNA, 18 nt, Human
uagagaucugguuuugcu

SEQ ID NO: 2416705 - RNA, 17 nt, Human
uagagaucugguuuugc

SEQ ID NO: 2416706 - RNA, 23 nt, Human
uagagaucauccuuuccagcaug

SEQ ID NO: 2416707 - RNA, 20 nt, Human
uagagaucauccuuuccagc

SEQ ID NO: 2416708 - RNA, 20 nt, Human
uagagaucugguuuugcuau

SEQ ID NO: 2416709 - RNA, 19 nt, Human
uagagaucugguuuugcua

SEQ ID NO: 2416710 - RNA, 17 nt, Human
uagagaugacugagucc

SEQ ID NO: 2416711 - RNA, 15 nt, Human
uagaggccagccugg

SEQ ID NO: 2416712 - RNA, 20 nt, Human
uagaggccagccccacccag

SEQ ID NO: 2416713 - RNA, 16 nt, Human
uagaggccagccuggc

SEQ ID NO: 2416714 - RNA, 15 nt, Human
uagauauaugcucug

SEQ ID NO: 2416715 - RNA, 22 nt, Human
uagaggagaaacuggaacucuc

SEQ ID NO: 2416716 - RNA, 20 nt, Human
uagaggaucccucucuggau

SEQ ID NO: 2416717 - RNA, 18 nt, Human
uagaggccagccccaccc

SEQ ID NO: 2416718 - RNA, 20 nt, Human
uagagcaccuaguccaguga

SEQ ID NO: 2416719 - RNA, 23 nt, Human
uagagauguuuuuaaaaguuuca

SEQ ID NO: 2416720 - RNA, 19 nt, Human
uagaggcagggaggggacu

SEQ ID NO: 2416721 - RNA, 14 nt, Human
uagauauuauucau

SEQ ID NO: 2416722 - RNA, 21 nt, Human
uagaugagauuguuuuaucau

SEQ ID NO: 2416723 - RNA, 19 nt, Human
uagauauaugcucugcaug

SEQ ID NO: 2416724 - RNA, 19 nt, Human
uagauauccacuugagaca

SEQ ID NO: 2416725 - RNA, 23 nt, Human
uagauaucgacuuguuuuugcac

SEQ ID NO: 2416726 - RNA, 11 nt, Human
acaaaagcaug

SEQ ID NO: 2416727 - RNA, 22 nt, Human
acaaaagcaugugagacugguu

SEQ ID NO: 2416728 - RNA, 18 nt, Human
acaaaaggauaaugaaua

SEQ ID NO: 2416729 - RNA, 16 nt, Human
aauuguuacaaauugu

SEQ ID NO: 2416730 - RNA, 18 nt, Human
aauuguugacaguucuga

SEQ ID NO: 2416731 - RNA, 13 nt, Human
aauuguugacagu

SEQ ID NO: 2416732 - RNA, 21 nt, Human
aauuguguuuauaauuuuaaa

SEQ ID NO: 2416733 - RNA, 20 nt, Human
aauuguguuuauaauuuuaa

SEQ ID NO: 2416734 - RNA, 15 nt, Human
aauuguuaagauaug

SEQ ID NO: 2416735 - RNA, 11 nt, Human
acaaaggcaag

SEQ ID NO: 2416736 - RNA, 15 nt, Human
acaaaggguuuuaau

SEQ ID NO: 2416737 - RNA, 22 nt, Human
acaaaggaugcccaaagaugca

SEQ ID NO: 2416738 - RNA, 13 nt, Human
acaaagcagccac

SEQ ID NO: 2416739 - RNA, 18 nt, Human
acaaagcacaguuugaac

SEQ ID NO: 2416740 - RNA, 17 nt, Human
acaaagcacaguuugaa

SEQ ID NO: 2416741 - RNA, 16 nt, Human
acaaagcacaguuuga

SEQ ID NO: 2416742 - RNA, 16 nt, Human
acaaagcacaguguua

SEQ ID NO: 2416743 - RNA, 19 nt, Human
acaaagcacaguuugaaca

SEQ ID NO: 2416744 - RNA, 12 nt, Human
acaaagcagcca

SEQ ID NO: 2416745 - RNA, 21 nt, Human
acaaagauguuugucagauau

SEQ ID NO: 2416746 - RNA, 22 nt, Human
acaaagauguuugucagauaug

SEQ ID NO: 2416747 - RNA, 23 nt, Human
acaaagauguuugucagauauga

SEQ ID NO: 2416748 - RNA, 14 nt, Human
acaaagcacagugu

SEQ ID NO: 2416749 - RNA, 15 nt, Human
acaaagcacaguguu

SEQ ID NO: 2416750 - RNA, 24 nt, Human
acaaagauguuugucagauaugau

SEQ ID NO: 2416751 - RNA, 20 nt, Human
aauuguugacaguucugaag

SEQ ID NO: 2416752 - RNA, 22 nt, Human
uagugaaacucguuaauuugua

SEQ ID NO: 2416753 - RNA, 19 nt, Human
uagugaaggcuucucucug

SEQ ID NO: 2416754 - RNA, 23 nt, Human
uagugaaaugaauauuuaaauaa

SEQ ID NO: 2416755 - RNA, 18 nt, Human
uaguccuagaggaccuga

SEQ ID NO: 2416756 - RNA, 21 nt, Human
uaguccgugcugacagcugcu

SEQ ID NO: 2416757 - RNA, 22 nt, Human
uaguccgugcugacagcugcuc

SEQ ID NO: 2416758 - RNA, 14 nt, Human
uaguccuauucuau

SEQ ID NO: 2416759 - RNA, 23 nt, Human
uaguccgugcugacagcugcucc

SEQ ID NO: 2416760 - RNA, 24 nt, Human
uagugaaaccccaucucuacugaa

SEQ ID NO: 2416761 - RNA, 16 nt, Human
uagucccuuccccucc

SEQ ID NO: 2416762 - RNA, 20 nt, Human
uagucccuuccccucccugg

SEQ ID NO: 2416763 - RNA, 22 nt, Human
uagucccuuccccucccuggcu

SEQ ID NO: 2416764 - RNA, 23 nt, Human
uagucccuuccccucccuggcuc

SEQ ID NO: 2416765 - RNA, 23 nt, Human
uaguccagcuuuguucuucuuaa

SEQ ID NO: 2416766 - RNA, 22 nt, Human
uaguccagcuuuguucuucuua

SEQ ID NO: 2416767 - RNA, 14 nt, Human
uaguacuaacuccu

SEQ ID NO: 2416768 - RNA, 16 nt, Human
uaguaccugaaaagua

SEQ ID NO: 2416769 - RNA, 20 nt, Human
uaguaccauuuauacaaauu

SEQ ID NO: 2416770 - RNA, 18 nt, Human
uaguaccugaaaaguaac

SEQ ID NO: 2416771 - RNA, 18 nt, Human
uaguaccauuuauacaaa

SEQ ID NO: 2416772 - RNA, 19 nt, Human
uaguaccauuuauacaaau

SEQ ID NO: 2416773 - RNA, 15 nt, Human
uaguaccugaaaagu

SEQ ID NO: 2416774 - RNA, 17 nt, Human
uagucccuuccacaccc

SEQ ID NO: 2416775 - RNA, 12 nt, Human
uagucccuucca

SEQ ID NO: 2416776 - RNA, 15 nt, Human
uagucccagcuacuc

SEQ ID NO: 2416777 - RNA, 14 nt, Human
uagucccuuccccu

SEQ ID NO: 2416778 - RNA, 15 nt, Human
uagucccuuccccuc

SEQ ID NO: 2416779 - RNA, 18 nt, Human
uagucccucaugcaaauc

SEQ ID NO: 2416780 - RNA, 20 nt, Human
uagucccagcuacucaggag

SEQ ID NO: 2416781 - RNA, 14 nt, Human
uagucccagcuacu

SEQ ID NO: 2416782 - RNA, 21 nt, Human
uagucccagcuacucagaagc

SEQ ID NO: 2416783 - RNA, 14 nt, Human
uaguuacagcugug

SEQ ID NO: 2416784 - RNA, 13 nt, Human
uaguuaauucugu

SEQ ID NO: 2416785 - RNA, 19 nt, Human
uaguuaaauuucuggaccu

SEQ ID NO: 2416786 - RNA, 14 nt, Human
uaguuaagacauga

SEQ ID NO: 2416787 - RNA, 19 nt, Human
uaguuaagacaugauuucc

SEQ ID NO: 2416788 - RNA, 21 nt, Human
uaguuaagacaugauuuccuu

SEQ ID NO: 2416789 - RNA, 23 nt, Human
uaguuaagacaugauuuccuuga

SEQ ID NO: 2416790 - RNA, 23 nt, Human
uaguuaauauugugaagaaaaau

SEQ ID NO: 2416791 - RNA, 15 nt, Human
uaguuaaauuucugg

SEQ ID NO: 2416792 - RNA, 12 nt, Human
uaguuaaauuuc

SEQ ID NO: 2416793 - RNA, 17 nt, Human
uaguguuucugugcaug

SEQ ID NO: 2416794 - RNA, 16 nt, Human
uaguguuucugugcau

SEQ ID NO: 2416795 - RNA, 15 nt, Human
uaguguuucugugca

SEQ ID NO: 2416796 - RNA, 17 nt, Human
uagugacccggaggcca

SEQ ID NO: 2416797 - RNA, 20 nt, Human
uaguguuuggguauauucau

SEQ ID NO: 2416798 - RNA, 23 nt, Human
uaguguuggagaagaacugaaau

SEQ ID NO: 2416799 - RNA, 21 nt, Human
uagugaaggcuucucucugug

SEQ ID NO: 2416800 - RNA, 21 nt, Human
uagugaaucacguaaagcuag

SEQ ID NO: 2416801 - RNA, 22 nt, Human
uaguaaaauucuacuguaugga

SEQ ID NO: 2416802 - RNA, 12 nt, Human
uaguaaagaaau

SEQ ID NO: 2416803 - RNA, 13 nt, Human
uaguaaagaaaug

SEQ ID NO: 2416804 - RNA, 14 nt, Human
uaguaaagaaauga

SEQ ID NO: 2416805 - RNA, 13 nt, Human
uaguaaagaaauu

SEQ ID NO: 2416806 - RNA, 21 nt, Human
acacauaauuaaaguguccau

SEQ ID NO: 2416807 - RNA, 20 nt, Human
acacauaauuaaagugucca

SEQ ID NO: 2416808 - RNA, 19 nt, Human
acacauaauuaaagugucc

SEQ ID NO: 2416809 - RNA, 18 nt, Human
acacauaauuaaaguguc

SEQ ID NO: 2416810 - RNA, 17 nt, Human
acacauaauuaaagugu

SEQ ID NO: 2416811 - RNA, 16 nt, Human
acacauaauuaaagug

SEQ ID NO: 2416812 - RNA, 15 nt, Human
acacauaauuaaagu

SEQ ID NO: 2416813 - RNA, 13 nt, Human
acacauaauuaaa

SEQ ID NO: 2416814 - RNA, 15 nt, Human
acacaguugcuguca

SEQ ID NO: 2416815 - RNA, 22 nt, Human
acacaguugcugucauaagaau

SEQ ID NO: 2416816 - RNA, 18 nt, Human
uaguaacuucuuauggaa

SEQ ID NO: 2416817 - RNA, 19 nt, Human
uaguaacuucuuauggaau

SEQ ID NO: 2416818 - RNA, 16 nt, Human
uaguaccaaaugcuuu

SEQ ID NO: 2416819 - RNA, 23 nt, Human
uaguacagguaaggugagggaau

SEQ ID NO: 2416820 - RNA, 12 nt, Human
uaguacauaaag

SEQ ID NO: 2416821 - RNA, 23 nt, Human
uaguaccaaucauuuuaauuauu

SEQ ID NO: 2416822 - RNA, 20 nt, Human
uaguaccaaaugcuuuaaaa

SEQ ID NO: 2416823 - RNA, 16 nt, Human
uaguaccauuuauaca

SEQ ID NO: 2416824 - RNA, 16 nt, Human
uaguaccaaucauuuu

SEQ ID NO: 2416825 - RNA, 19 nt, Human
uaguaccaaaugcuuuaaa

SEQ ID NO: 2416826 - RNA, 21 nt, Human
uaguacauaaaggugguaugu

SEQ ID NO: 2416827 - RNA, 16 nt, Human
acacacuguguccugg

SEQ ID NO: 2416828 - RNA, 23 nt, Human
acacacugugcuuucuauuguac

SEQ ID NO: 2416829 - RNA, 22 nt, Human
acacacugugcuuucuauugua

SEQ ID NO: 2416830 - RNA, 21 nt, Human
acacacugugcuuucuauugu

SEQ ID NO: 2416831 - RNA, 19 nt, Human
acacacugugcuuucuauu

SEQ ID NO: 2416832 - RNA, 17 nt, Human
acacacugugcuuucua

SEQ ID NO: 2416833 - RNA, 16 nt, Human
acacacugugcuuucu

SEQ ID NO: 2416834 - RNA, 11 nt, Human
acacacugugc

SEQ ID NO: 2416835 - RNA, 15 nt, Human
acacacugaugcuua

SEQ ID NO: 2416836 - RNA, 17 nt, Human
acacacugaugcuuaga

SEQ ID NO: 2416837 - RNA, 16 nt, Human
acacaguauuacuucu

SEQ ID NO: 2416838 - RNA, 23 nt, Human
acacacuuuugguuaagucuguu

SEQ ID NO: 2416839 - RNA, 18 nt, Human
acacaguauuacuucugc

SEQ ID NO: 2416840 - RNA, 22 nt, Human
acacaguauuacuucugcuaca

SEQ ID NO: 2416841 - RNA, 19 nt, Human
acacaguauuacuucugcu

SEQ ID NO: 2416842 - RNA, 20 nt, Human
acacagugccuucaauaaau

SEQ ID NO: 2416843 - RNA, 19 nt, Human
acacagugccuucaauaaa

SEQ ID NO: 2416844 - RNA, 16 nt, Human
acacagugccuucaau

SEQ ID NO: 2416845 - RNA, 20 nt, Human
acacacuguguccuggugcu

SEQ ID NO: 2416846 - RNA, 13 nt, Human
acacagugagucg

SEQ ID NO: 2416847 - RNA, 18 nt, Human
acacaguuacacuugugc

SEQ ID NO: 2416848 - RNA, 20 nt, Human
acacagugggugguggaucu

SEQ ID NO: 2416849 - RNA, 21 nt, Human
acacaguguuuuuguaaagug

SEQ ID NO: 2416850 - RNA, 13 nt, Human
acacacuaaucga

SEQ ID NO: 2416851 - RNA, 22 nt, Human
acacacgugcaauuuguuugug

SEQ ID NO: 2416852 - RNA, 13 nt, Human
acacacugaugcu

SEQ ID NO: 2416853 - RNA, 21 nt, Human
acacacugcauguuugugauu

SEQ ID NO: 2416854 - RNA, 15 nt, Human
acacacucaaaucaa

SEQ ID NO: 2416855 - RNA, 19 nt, Human
acacacgugcaauuuguuu

SEQ ID NO: 2416856 - RNA, 21 nt, Human
acacacgcaggaacucccagc

SEQ ID NO: 2416857 - RNA, 21 nt, Human
acacacgcgugcacacaccag

SEQ ID NO: 2416858 - RNA, 20 nt, Human
acacaccagagcccaccuug

SEQ ID NO: 2416859 - RNA, 15 nt, Human
acacaccagagccca

SEQ ID NO: 2416860 - RNA, 14 nt, Human
acacaccagagccc

SEQ ID NO: 2416861 - RNA, 22 nt, Human
acacacacgcgugcacacacca

SEQ ID NO: 2416862 - RNA, 12 nt, Human
acacacacgcac

SEQ ID NO: 2416863 - RNA, 16 nt, Human
acacacacaugcauac

SEQ ID NO: 2416864 - RNA, 21 nt, Human
acacacacgcacgcacacaca

SEQ ID NO: 2416865 - RNA, 19 nt, Human
acacacacgcacgcacaca

SEQ ID NO: 2416866 - RNA, 14 nt, Human
acacacacgcacgc

SEQ ID NO: 2416867 - RNA, 17 nt, Human
acacacaccacacauac

SEQ ID NO: 2416868 - RNA, 13 nt, Human
acacacacaugca

SEQ ID NO: 2416869 - RNA, 14 nt, Human
acacacacaugcau

SEQ ID NO: 2416870 - RNA, 15 nt, Human
acacacacaugcaua

SEQ ID NO: 2416871 - RNA, 11 nt, Human
acacacacaug

SEQ ID NO: 2416872 - RNA, 12 nt, Human
acacacacaugc

SEQ ID NO: 2416873 - RNA, 15 nt, Human
acacacacacacaca

SEQ ID NO: 2416874 - RNA, 14 nt, Human
acacacagcucugu

SEQ ID NO: 2416875 - RNA, 13 nt, Human
acacacagcucug

SEQ ID NO: 2416876 - RNA, 17 nt, Human
acacacagcucuguccu

SEQ ID NO: 2416877 - RNA, 22 nt, Human
acaaugcugugcccuaaagugu

SEQ ID NO: 2416878 - RNA, 23 nt, Human
acaaugcugugcccuaaagugua

SEQ ID NO: 2416879 - RNA, 24 nt, Human
acaaugcugugcccuaaaguguau

SEQ ID NO: 2416880 - RNA, 19 nt, Human
acaauggauaggcacagga

SEQ ID NO: 2416881 - RNA, 22 nt, Human
acaaugcuguauuuuaaaagaa

SEQ ID NO: 2416882 - RNA, 21 nt, Human
acaaugcugugcccuaaagug

SEQ ID NO: 2416883 - RNA, 17 nt, Human
uagggagagucauauuu

SEQ ID NO: 2416884 - RNA, 12 nt, Human
uagggagaguca

SEQ ID NO: 2416885 - RNA, 23 nt, Human
uagggaggaccagggcagggcca

SEQ ID NO: 2416886 - RNA, 22 nt, Human
uagggaggaccuuaucugugcg

SEQ ID NO: 2416887 - RNA, 18 nt, Human
acaaugcuguauuuuaaa

SEQ ID NO: 2416888 - RNA, 14 nt, Human
acacacacauacac

SEQ ID NO: 2416889 - RNA, 14 nt, Human
acacacacacacac

SEQ ID NO: 2416890 - RNA, 12 nt, Human
acacacacacac

SEQ ID NO: 2416891 - RNA, 13 nt, Human
acacacacacaca

SEQ ID NO: 2416892 - RNA, 14 nt, Human
acacacaacaauua

SEQ ID NO: 2416893 - RNA, 22 nt, Human
acacacaaaauguacccaguau

SEQ ID NO: 2416894 - RNA, 14 nt, Human
acacaauaugaaua

SEQ ID NO: 2416895 - RNA, 14 nt, Human
acacaauacaauaa

SEQ ID NO: 2416896 - RNA, 23 nt, Human
acaauguauuuauuuaaaagauu

SEQ ID NO: 2416897 - RNA, 21 nt, Human
acaauguauuuauuuaaaaga

SEQ ID NO: 2416898 - RNA, 20 nt, Human
acaauguauuuauuuaaaag

SEQ ID NO: 2416899 - RNA, 16 nt, Human
acaauggaaacugaau

SEQ ID NO: 2416900 - RNA, 14 nt, Human
acaauggaaacuga

SEQ ID NO: 2416901 - RNA, 19 nt, Human
acaauggaaacugaaugcu

SEQ ID NO: 2416902 - RNA, 17 nt, Human
acaaugugaaaagaaaa

SEQ ID NO: 2416903 - RNA, 19 nt, Human
acaaugugaaaagaaaaau

SEQ ID NO: 2416904 - RNA, 12 nt, Human
acaaugugaacu

SEQ ID NO: 2416905 - RNA, 15 nt, Human
uauaaguguguguuu

SEQ ID NO: 2416906 - RNA, 16 nt, Human
uauaacuucuuaaaag

SEQ ID NO: 2416907 - RNA, 15 nt, Human
uauaacuucuuaaaa

SEQ ID NO: 2416908 - RNA, 17 nt, Human
acaccccuuauccagga

SEQ ID NO: 2416909 - RNA, 19 nt, Human
uauaacuugucuaaauaag

SEQ ID NO: 2416910 - RNA, 13 nt, Human
uauaacuugucua

SEQ ID NO: 2416911 - RNA, 19 nt, Human
uauaacuuauauuguaaga

SEQ ID NO: 2416912 - RNA, 21 nt, Human
uauaacuuauauuguaagaaa

SEQ ID NO: 2416913 - RNA, 22 nt, Human
uauaacuuauauuguaagaaau

SEQ ID NO: 2416914 - RNA, 24 nt, Human
uauaacuuauauuguaagaaauac

SEQ ID NO: 2416915 - RNA, 17 nt, Human
acacucaagaagcaggc

SEQ ID NO: 2416916 - RNA, 18 nt, Human
uauaacuuaaaauauuuu

SEQ ID NO: 2416917 - RNA, 17 nt, Human
uauaacuuauauuguaa

SEQ ID NO: 2416918 - RNA, 22 nt, Human
acacucacauuuauucugcuca

SEQ ID NO: 2416919 - RNA, 20 nt, Human
acacucacauuuauucugcu

SEQ ID NO: 2416920 - RNA, 16 nt, Human
acacucaagaagcagg

SEQ ID NO: 2416921 - RNA, 15 nt, Human
acacucaagaagcag

SEQ ID NO: 2416922 - RNA, 19 nt, Human
acacucaaaucaagaaacu

SEQ ID NO: 2416923 - RNA, 15 nt, Human
acacucaaaagcugg

SEQ ID NO: 2416924 - RNA, 18 nt, Human
acacuauuaccaugagaa

SEQ ID NO: 2416925 - RNA, 18 nt, Human
acacuauaucuguauaua

SEQ ID NO: 2416926 - RNA, 22 nt, Human
acacuaugguauuugaguguuu

SEQ ID NO: 2416927 - RNA, 15 nt, Human
acacuauuuuaugca

SEQ ID NO: 2416928 - RNA, 14 nt, Human
acacuauuuuaugc

SEQ ID NO: 2416929 - RNA, 13 nt, Human
acacuauuuuaug

SEQ ID NO: 2416930 - RNA, 19 nt, Human
acacuaugguauuugagug

SEQ ID NO: 2416931 - RNA, 18 nt, Human
acacuaugguauuugagu

SEQ ID NO: 2416932 - RNA, 21 nt, Human
acacuauaucuguauauaaaa

SEQ ID NO: 2416933 - RNA, 17 nt, Human
acacuaugguauuugag

SEQ ID NO: 2416934 - RNA, 13 nt, Human
acacuaagagaga

SEQ ID NO: 2416935 - RNA, 14 nt, Human
acacuaaccugacc

SEQ ID NO: 2416936 - RNA, 18 nt, Human
acacgaacuuuagcugca

SEQ ID NO: 2416937 - RNA, 15 nt, Human
acacuaaccuggguu

SEQ ID NO: 2416938 - RNA, 14 nt, Human
acacuaagagagaa

SEQ ID NO: 2416939 - RNA, 17 nt, Human
acacuauaucuguauau

SEQ ID NO: 2416940 - RNA, 15 nt, Human
acacuauaucuguau

SEQ ID NO: 2416941 - RNA, 14 nt, Human
acacuauaucugua

SEQ ID NO: 2416942 - RNA, 13 nt, Human
acacuauaucugu

SEQ ID NO: 2416943 - RNA, 23 nt, Human
acacuaguuuugugccagccgug

SEQ ID NO: 2416944 - RNA, 19 nt, Human
acacuaguuuugugccagc

SEQ ID NO: 2416945 - RNA, 18 nt, Human
acacuaguuuugugccag

SEQ ID NO: 2416946 - RNA, 20 nt, Human
acacccuucacauacccucc

SEQ ID NO: 2416947 - RNA, 16 nt, Human
acacccuuggacuuga

SEQ ID NO: 2416948 - RNA, 18 nt, Human
acacccuuggacuugagg

SEQ ID NO: 2416949 - RNA, 19 nt, Human
acacccugugauggggccc

SEQ ID NO: 2416950 - RNA, 17 nt, Human
acacccugcccucaugc

SEQ ID NO: 2416951 - RNA, 12 nt, Human
acacccugcccu

SEQ ID NO: 2416952 - RNA, 17 nt, Human
acacccucucccaggac

SEQ ID NO: 2416953 - RNA, 22 nt, Human
acaccgccacauggcuuccucc

SEQ ID NO: 2416954 - RNA, 15 nt, Human
acaccgagggcgacc

SEQ ID NO: 2416955 - RNA, 14 nt, Human
acaccgggccugga

SEQ ID NO: 2416956 - RNA, 16 nt, Human
acaccgggcacucaga

SEQ ID NO: 2416957 - RNA, 14 nt, Human
acaccucugccaga

SEQ ID NO: 2416958 - RNA, 13 nt, Human
acaccucugccag

SEQ ID NO: 2416959 - RNA, 12 nt, Human
acaccucugcca

SEQ ID NO: 2416960 - RNA, 14 nt, Human
acaccugaugugua

SEQ ID NO: 2416961 - RNA, 12 nt, Human
acaccugaugug

SEQ ID NO: 2416962 - RNA, 17 nt, Human
acaccugagccagccug

SEQ ID NO: 2416963 - RNA, 21 nt, Human
acaccugacucugaaaucuga

SEQ ID NO: 2416964 - RNA, 18 nt, Human
acaccugacucugaaauc

SEQ ID NO: 2416965 - RNA, 16 nt, Human
acaccugacucugaaa

SEQ ID NO: 2416966 - RNA, 14 nt, Human
acaccugacucuga

SEQ ID NO: 2416967 - RNA, 19 nt, Human
acaccucugcacaagcugc

SEQ ID NO: 2416968 - RNA, 21 nt, Human
acaccucugcacaagcugcac

SEQ ID NO: 2416969 - RNA, 21 nt, Human
acaccuuagccugcccuccuu

SEQ ID NO: 2416970 - RNA, 16 nt, Human
acaccuguagucccag

SEQ ID NO: 2416971 - RNA, 17 nt, Human
acaccuguagucccagc

SEQ ID NO: 2416972 - RNA, 19 nt, Human
acaccuguagucccagcua

SEQ ID NO: 2416973 - RNA, 17 nt, Human
acaccugggcuuaagaa

SEQ ID NO: 2416974 - RNA, 23 nt, Human
acaccuggcugagguuccucugc

SEQ ID NO: 2416975 - RNA, 20 nt, Human
acaccuguagcacuuacugg

SEQ ID NO: 2416976 - RNA, 19 nt, Human
acaccuggcugagguuccu

SEQ ID NO: 2416977 - RNA, 23 nt, Human
acaccuuggacauccuccuccca

SEQ ID NO: 2416978 - RNA, 20 nt, Human
acaccuuccagcuccuguaa

SEQ ID NO: 2416979 - RNA, 21 nt, Human
acaccuguagucccagcuacu

SEQ ID NO: 2416980 - RNA, 16 nt, Human
acaccuuccagcuccu

SEQ ID NO: 2416981 - RNA, 14 nt, Human
acaccuuccagcuc

SEQ ID NO: 2416982 - RNA, 15 nt, Human
acaccuuauauuuac

SEQ ID NO: 2416983 - RNA, 23 nt, Human
acaccuuuuauugacacagaaaa

SEQ ID NO: 2416984 - RNA, 21 nt, Human
acaccuuuuauugacacagaa

SEQ ID NO: 2416985 - RNA, 20 nt, Human
acacuaaccacgcuggaccu

SEQ ID NO: 2416986 - RNA, 22 nt, Human
acaccuuugcaggcaugcaugu

SEQ ID NO: 2416987 - RNA, 18 nt, Human
acaccuuugcaggcaugc

SEQ ID NO: 2416988 - RNA, 15 nt, Human
acaccuuuuaacuca

SEQ ID NO: 2416989 - RNA, 17 nt, Human
acaccuuuuaacucacc

SEQ ID NO: 2416990 - RNA, 16 nt, Human
acaccuuugcaggcau

SEQ ID NO: 2416991 - RNA, 22 nt, Human
acaccuuucuccuuuguacuuu

SEQ ID NO: 2416992 - RNA, 22 nt, Human
acaccuuggacauccuccuccc

SEQ ID NO: 2416993 - RNA, 17 nt, Human
acaccuuucuccuuugu

SEQ ID NO: 2416994 - RNA, 14 nt, Human
acaccuuucuccuu

SEQ ID NO: 2416995 - RNA, 15 nt, Human
acacaucagcuugcc

SEQ ID NO: 2416996 - RNA, 15 nt, Human
acacaugaaguccaa

SEQ ID NO: 2416997 - RNA, 18 nt, Human
acacaugauccugcaauu

SEQ ID NO: 2416998 - RNA, 21 nt, Human
acacaugagcaucaggccagg

SEQ ID NO: 2416999 - RNA, 13 nt, Human
acacauuuuauuu

SEQ ID NO: 2417000 - RNA, 14 nt, Human
acacauuuuauuuu

SEQ ID NO: 2417001 - RNA, 19 nt, Human
acacauuuuauuuuauuau

SEQ ID NO: 2417002 - RNA, 20 nt, Human
acacauuuuauuuuauuaug

SEQ ID NO: 2417003 - RNA, 20 nt, Human
acacccaaagagguauuuau

SEQ ID NO: 2417004 - RNA, 19 nt, Human
acacccaaagagguauuua

SEQ ID NO: 2417005 - RNA, 18 nt, Human
acaccccuuauccaggac

SEQ ID NO: 2417006 - RNA, 17 nt, Human
acacccucaaccucuuc

SEQ ID NO: 2417007 - RNA, 18 nt, Human
acacccucaaccucuucu

SEQ ID NO: 2417008 - RNA, 20 nt, Human
acaccccuuauccaggacuc

SEQ ID NO: 2417009 - RNA, 19 nt, Human
acaccccuuauccaggacu

SEQ ID NO: 2417010 - RNA, 17 nt, Human
acacccgacuccucaaa

SEQ ID NO: 2417011 - RNA, 16 nt, Human
acacccucacacuggg

SEQ ID NO: 2417012 - RNA, 13 nt, Human
acacccucccccg

SEQ ID NO: 2417013 - RNA, 13 nt, Human
acacccucacacu

SEQ ID NO: 2417014 - RNA, 16 nt, Human
acacccucccccgcca

SEQ ID NO: 2417015 - RNA, 14 nt, Human
acacccucccccgc

SEQ ID NO: 2417016 - RNA, 22 nt, Human
acacccucgaagcgcgccacuc

SEQ ID NO: 2417017 - RNA, 19 nt, Human
acacccucccccgccacuc

SEQ ID NO: 2417018 - RNA, 12 nt, Human
acacccucuccc

SEQ ID NO: 2417019 - RNA, 13 nt, Human
acacccucuccca

SEQ ID NO: 2417020 - RNA, 16 nt, Human
acacccucucccagga

SEQ ID NO: 2417021 - RNA, 18 nt, Human
acacaucacccuuaccau

SEQ ID NO: 2417022 - RNA, 14 nt, Human
acaccaucuuuugu

SEQ ID NO: 2417023 - RNA, 23 nt, Human
acaccauguuugagcucagaccc

SEQ ID NO: 2417024 - RNA, 20 nt, Human
uauaaaagccuguuuaagag

SEQ ID NO: 2417025 - RNA, 19 nt, Human
uauaaaaauaaaaaacacu

SEQ ID NO: 2417026 - RNA, 22 nt, Human
uauaaaagggacugagaaauuu

SEQ ID NO: 2417027 - RNA, 18 nt, Human
uauaaaagcuauggugag

SEQ ID NO: 2417028 - RNA, 19 nt, Human
uauaaaaggcaaaugugua

SEQ ID NO: 2417029 - RNA, 19 nt, Human
uauaaaagccuguuuaaga

SEQ ID NO: 2417030 - RNA, 17 nt, Human
uauaaaauaaauauaua

SEQ ID NO: 2417031 - RNA, 16 nt, Human
uauaaaauaaauauau

SEQ ID NO: 2417032 - RNA, 15 nt, Human
uauaaaauaaauaua

SEQ ID NO: 2417033 - RNA, 14 nt, Human
uauaaaauaaauau

SEQ ID NO: 2417034 - RNA, 13 nt, Human
uauaaaauaaaua

SEQ ID NO: 2417035 - RNA, 22 nt, Human
uauaaaagugauuguuggcaca

SEQ ID NO: 2417036 - RNA, 13 nt, Human
uauaaaagugauu

SEQ ID NO: 2417037 - RNA, 20 nt, Human
uauaaaaggcaaauguguac

SEQ ID NO: 2417038 - RNA, 19 nt, Human
uauaaaauaaauauauaua

SEQ ID NO: 2417039 - RNA, 15 nt, Human
acacauacccucuuc

SEQ ID NO: 2417040 - RNA, 13 nt, Human
acacauaugaggg

SEQ ID NO: 2417041 - RNA, 16 nt, Human
acacauaugucauaua

SEQ ID NO: 2417042 - RNA, 17 nt, Human
acacauaugagggggaa

SEQ ID NO: 2417043 - RNA, 22 nt, Human
acacauauaaacaucacacaca

SEQ ID NO: 2417044 - RNA, 14 nt, Human
acacauauaaacau

SEQ ID NO: 2417045 - RNA, 17 nt, Human
acacauagcauguaaug

SEQ ID NO: 2417046 - RNA, 11 nt, Human
uauaaaaacaa

SEQ ID NO: 2417047 - RNA, 17 nt, Human
uauaaaaaauggugccu

SEQ ID NO: 2417048 - RNA, 13 nt, Human
uauaaaaaauggu

SEQ ID NO: 2417049 - RNA, 19 nt, Human
uauaaaaaauggugccuga

SEQ ID NO: 2417050 - RNA, 23 nt, Human
uauaaaaagaaaagauaaagaug

SEQ ID NO: 2417051 - RNA, 21 nt, Human
uauaaaaagaaaagauaaaga

SEQ ID NO: 2417052 - RNA, 18 nt, Human
uauaaaaagcuuccauga

SEQ ID NO: 2417053 - RNA, 19 nt, Human
uauaaaaagaaaagauaaa

SEQ ID NO: 2417054 - RNA, 20 nt, Human
uauaaaaaccccaaacuguu

SEQ ID NO: 2417055 - RNA, 23 nt, Human
uauaaaaaaaauaguugagccag

SEQ ID NO: 2417056 - RNA, 14 nt, Human
uauaaaaaaaauag

SEQ ID NO: 2417057 - RNA, 20 nt, Human
uaguuccaccaucaagccac

SEQ ID NO: 2417058 - RNA, 18 nt, Human
uaguucauccaauccuca

SEQ ID NO: 2417059 - RNA, 20 nt, Human
uaguucauccaauccucacu

SEQ ID NO: 2417060 - RNA, 14 nt, Human
uaguuacucauuca

SEQ ID NO: 2417061 - RNA, 14 nt, Human
uaguucauccaauc

SEQ ID NO: 2417062 - RNA, 15 nt, Human
uaguuacuauaugcc

SEQ ID NO: 2417063 - RNA, 16 nt, Human
acagucaccucaugga

SEQ ID NO: 2417064 - RNA, 14 nt, Human
acaguaggagccca

SEQ ID NO: 2417065 - RNA, 22 nt, Human
acaguaggagcccagcucugaa

SEQ ID NO: 2417066 - RNA, 21 nt, Human
acaguaguaccaaaugcuuua

SEQ ID NO: 2417067 - RNA, 14 nt, Human
acaguagucuugau

SEQ ID NO: 2417068 - RNA, 23 nt, Human
acaguagucuugaugaccaaagu

SEQ ID NO: 2417069 - RNA, 18 nt, Human
acagucaccucauggaau

SEQ ID NO: 2417070 - RNA, 17 nt, Human
acagucaccucauggaa

SEQ ID NO: 2417071 - RNA, 15 nt, Human
acagucagauuucca

SEQ ID NO: 2417072 - RNA, 21 nt, Human
acagucagauuuccagucucc

SEQ ID NO: 2417073 - RNA, 18 nt, Human
acagucaaggaguggcuu

SEQ ID NO: 2417074 - RNA, 23 nt, Human
acaguaguaccaaaugcuuuaaa

SEQ ID NO: 2417075 - RNA, 22 nt, Human
acagucaaggaguggcuuacua

SEQ ID NO: 2417076 - RNA, 20 nt, Human
acaguaaguuccuacuaggc

SEQ ID NO: 2417077 - RNA, 16 nt, Human
acaguaaguuccuacu

SEQ ID NO: 2417078 - RNA, 14 nt, Human
acaguaaguuccua

SEQ ID NO: 2417079 - RNA, 14 nt, Human
acaguaagcugcuc

SEQ ID NO: 2417080 - RNA, 21 nt, Human
acaguaacuuuauguguaaau

SEQ ID NO: 2417081 - RNA, 19 nt, Human
acaguaacuuuauguguaa

SEQ ID NO: 2417082 - RNA, 12 nt, Human
acaguacaggca

SEQ ID NO: 2417083 - RNA, 13 nt, Human
acaguaggagccc

SEQ ID NO: 2417084 - RNA, 20 nt, Human
acaguacaggcagcacagag

SEQ ID NO: 2417085 - RNA, 13 nt, Human
acaguacaggcag

SEQ ID NO: 2417086 - RNA, 14 nt, Human
acaguacaggcagc

SEQ ID NO: 2417087 - RNA, 16 nt, Human
acaguacaggcagcac

SEQ ID NO: 2417088 - RNA, 18 nt, Human
acaguacaggcagcacag

SEQ ID NO: 2417089 - RNA, 23 nt, Human
acagggaugagcauggagcuggc

SEQ ID NO: 2417090 - RNA, 21 nt, Human
acagggaugagcauggagcug

SEQ ID NO: 2417091 - RNA, 18 nt, Human
acaguaacuuuaugugua

SEQ ID NO: 2417092 - RNA, 16 nt, Human
acaguaacuuuaugug

SEQ ID NO: 2417093 - RNA, 15 nt, Human
acaguaacuuuaugu

SEQ ID NO: 2417094 - RNA, 20 nt, Human
acagggcacaccgggcacuc

SEQ ID NO: 2417095 - RNA, 12 nt, Human
acagggcacacc

SEQ ID NO: 2417096 - RNA, 14 nt, Human
acagggaugagcau

SEQ ID NO: 2417097 - RNA, 13 nt, Human
acagggaugagca

SEQ ID NO: 2417098 - RNA, 12 nt, Human
acagggagggga

SEQ ID NO: 2417099 - RNA, 10 nt, Human
acagggaggg

SEQ ID NO: 2417100 - RNA, 13 nt, Human
acaggcuccugcc

SEQ ID NO: 2417101 - RNA, 15 nt, Human
acaggcuccugccac

SEQ ID NO: 2417102 - RNA, 21 nt, Human
acaggcuccugccaccacgcc

SEQ ID NO: 2417103 - RNA, 22 nt, Human
acaggcuccugccaccacgccc

SEQ ID NO: 2417104 - RNA, 20 nt, Human
acaggcucuuagcagcuucc

SEQ ID NO: 2417105 - RNA, 19 nt, Human
acaggcucuuagcagcuuc

SEQ ID NO: 2417106 - RNA, 15 nt, Human
acaggcucuuagcag

SEQ ID NO: 2417107 - RNA, 13 nt, Human
acaggcucuuagc

SEQ ID NO: 2417108 - RNA, 23 nt, Human
acaggcugggcuucaguggcagc

SEQ ID NO: 2417109 - RNA, 22 nt, Human
acaggcugggcuucaguggcag

SEQ ID NO: 2417110 - RNA, 12 nt, Human
acaggcugggcu

SEQ ID NO: 2417111 - RNA, 16 nt, Human
acagggaagcuacagg

SEQ ID NO: 2417112 - RNA, 15 nt, Human
acagggaagcuacag

SEQ ID NO: 2417113 - RNA, 14 nt, Human
acagggaagcuaca

SEQ ID NO: 2417114 - RNA, 13 nt, Human
acagggaagcuac

SEQ ID NO: 2417115 - RNA, 19 nt, Human
acagggaagcuacagguua

SEQ ID NO: 2417116 - RNA, 18 nt, Human
acagggaagcuacagguu

SEQ ID NO: 2417117 - RNA, 23 nt, Human
acagggaagcuacagguuacaac

SEQ ID NO: 2417118 - RNA, 22 nt, Human
acagggaacccugcuugcacuu

SEQ ID NO: 2417119 - RNA, 23 nt, Human
acagggaacccugcuugcacuuu

SEQ ID NO: 2417120 - RNA, 15 nt, Human
acagggaagagcaga

SEQ ID NO: 2417121 - RNA, 20 nt, Human
acagggaggacgcucucugg

SEQ ID NO: 2417122 - RNA, 21 nt, Human
acagggaggacgcucucuggc

SEQ ID NO: 2417123 - RNA, 16 nt, Human
acagggagccuccugc

SEQ ID NO: 2417124 - RNA, 15 nt, Human
acagggagccuccug

SEQ ID NO: 2417125 - RNA, 14 nt, Human
acagggagccuccu

SEQ ID NO: 2417126 - RNA, 13 nt, Human
acagggagccucc

SEQ ID NO: 2417127 - RNA, 18 nt, Human
acagggagccuccugccc

SEQ ID NO: 2417128 - RNA, 17 nt, Human
acagggagccuccugcc

SEQ ID NO: 2417129 - RNA, 19 nt, Human
acagggagccuccugccca

SEQ ID NO: 2417130 - RNA, 16 nt, Human
acagggagcugggaca

SEQ ID NO: 2417131 - RNA, 22 nt, Human
acagggaaugccugagugccug

SEQ ID NO: 2417132 - RNA, 12 nt, Human
acagggacccac

SEQ ID NO: 2417133 - RNA, 16 nt, Human
acagggacuugaaguu

SEQ ID NO: 2417134 - RNA, 13 nt, Human
acagggacuugaa

SEQ ID NO: 2417135 - RNA, 22 nt, Human
acagggacugaaaaccucuccu

SEQ ID NO: 2417136 - RNA, 14 nt, Human
uauuacuguaagaa

SEQ ID NO: 2417137 - RNA, 21 nt, Human
uauuacuagaagaugaauaca

SEQ ID NO: 2417138 - RNA, 22 nt, Human
uauuacuaaggaguaaucugug

SEQ ID NO: 2417139 - RNA, 22 nt, Human
uauuaaaaugauuguaaaauag

SEQ ID NO: 2417140 - RNA, 20 nt, Human
uauuaaaaugauuguaaaau

SEQ ID NO: 2417141 - RNA, 22 nt, Human
uauuaaaauauggcuauaaaua

SEQ ID NO: 2417142 - RNA, 20 nt, Human
uauuaaaauaagcacugugc

SEQ ID NO: 2417143 - RNA, 10 nt, Human
uauuaaaauc

SEQ ID NO: 2417144 - RNA, 19 nt, Human
uauuaaaaugauuguaaaa

SEQ ID NO: 2417145 - RNA, 18 nt, Human
uauuaaaaugauuguaaa

SEQ ID NO: 2417146 - RNA, 17 nt, Human
uauuaaaaugauuguaa

SEQ ID NO: 2417147 - RNA, 13 nt, Human
uauuaaaaucuua

SEQ ID NO: 2417148 - RNA, 22 nt, Human
uauuacuaugacugcuccccag

SEQ ID NO: 2417149 - RNA, 23 nt, Human
uauuacugucugguuuuaacaau

SEQ ID NO: 2417150 - RNA, 18 nt, Human
uauuacugucugguuuua

SEQ ID NO: 2417151 - RNA, 13 nt, Human
uauuacuucugcu

SEQ ID NO: 2417152 - RNA, 21 nt, Human
uauuacuguuugucuucuccc

SEQ ID NO: 2417153 - RNA, 23 nt, Human
uauuacuuauuuuugacaguguu

SEQ ID NO: 2417154 - RNA, 14 nt, Human
uauuacuucugcua

SEQ ID NO: 2417155 - RNA, 23 nt, Human
uauucaaacagucucaggaaauc

SEQ ID NO: 2417156 - RNA, 21 nt, Human
uauuagugaccucagcuuuga

SEQ ID NO: 2417157 - RNA, 21 nt, Human
uauuagucuuggggcaggaug

SEQ ID NO: 2417158 - RNA, 15 nt, Human
uauucaaacagucuc

SEQ ID NO: 2417159 - RNA, 19 nt, Human
uauuagugaccucagcuuu

SEQ ID NO: 2417160 - RNA, 16 nt, Human
uauuagucuuggggca

SEQ ID NO: 2417161 - RNA, 14 nt, Human
uauuagcuuuacug

SEQ ID NO: 2417162 - RNA, 21 nt, Human
uauuaguacugcucuuguuuc

SEQ ID NO: 2417163 - RNA, 14 nt, Human
uauuaguaccauag

SEQ ID NO: 2417164 - RNA, 18 nt, Human
uauuagggguaauauauu

SEQ ID NO: 2417165 - RNA, 17 nt, Human
uauuagggguaauauau

SEQ ID NO: 2417166 - RNA, 21 nt, Human
uauuagggagaaaauucaauu

SEQ ID NO: 2417167 - RNA, 15 nt, Human
uauuagggagaaaau

SEQ ID NO: 2417168 - RNA, 16 nt, Human
uauuagggagaaaauu

SEQ ID NO: 2417169 - RNA, 16 nt, Human
uauuagcuuuacuguu

SEQ ID NO: 2417170 - RNA, 12 nt, Human
acaggcuccugc

SEQ ID NO: 2417171 - RNA, 18 nt, Human
acaggcuacucuccucgg

SEQ ID NO: 2417172 - RNA, 14 nt, Human
acaggcucaauauu

SEQ ID NO: 2417173 - RNA, 23 nt, Human
uauucauaagccaauuuuucugc

SEQ ID NO: 2417174 - RNA, 20 nt, Human
uauucauaagccaauuuuuc

SEQ ID NO: 2417175 - RNA, 14 nt, Human
acaggcgaggccug

SEQ ID NO: 2417176 - RNA, 22 nt, Human
acaggcgugagccaccgugccu

SEQ ID NO: 2417177 - RNA, 15 nt, Human
uauucagugucacug

SEQ ID NO: 2417178 - RNA, 21 nt, Human
uauucagugcuguggccuggg

SEQ ID NO: 2417179 - RNA, 21 nt, Human
uauucaguucccagaaucaaa

SEQ ID NO: 2417180 - RNA, 17 nt, Human
uauucaguucccagaau

SEQ ID NO: 2417181 - RNA, 14 nt, Human
uauucaguucccag

SEQ ID NO: 2417182 - RNA, 14 nt, Human
uauucaggaagcuc

SEQ ID NO: 2417183 - RNA, 16 nt, Human
uauucaggaagcucag

SEQ ID NO: 2417184 - RNA, 19 nt, Human
uauucagcuuuaguagaua

SEQ ID NO: 2417185 - RNA, 17 nt, Human
uauucaggaaaagccuc

SEQ ID NO: 2417186 - RNA, 14 nt, Human
uauucaguaaaaaa

SEQ ID NO: 2417187 - RNA, 20 nt, Human
uauucaguaauaacucuacc

SEQ ID NO: 2417188 - RNA, 15 nt, Human
uauucagugcugugg

SEQ ID NO: 2417189 - RNA, 18 nt, Human
uauucagugcuguggccu

SEQ ID NO: 2417190 - RNA, 22 nt, Human
uauucagugcuguggccugggc

SEQ ID NO: 2417191 - RNA, 21 nt, Human
uauucagcucauggacuucug

SEQ ID NO: 2417192 - RNA, 16 nt, Human
uauucagcuucauuug

SEQ ID NO: 2417193 - RNA, 14 nt, Human
uauucagcuucauu

SEQ ID NO: 2417194 - RNA, 15 nt, Human
uauucagcucaugga

SEQ ID NO: 2417195 - RNA, 19 nt, Human
uauucagcuucauuugugu

SEQ ID NO: 2417196 - RNA, 17 nt, Human
uauucagcuucauuugu

SEQ ID NO: 2417197 - RNA, 21 nt, Human
uauucagcuucauuuguguca

SEQ ID NO: 2417198 - RNA, 18 nt, Human
uauucaauuccucuggga

SEQ ID NO: 2417199 - RNA, 17 nt, Human
uauucaauuccucuggg

SEQ ID NO: 2417200 - RNA, 16 nt, Human
uauucaauuccucugg

SEQ ID NO: 2417201 - RNA, 15 nt, Human
uauucaauuccucug

SEQ ID NO: 2417202 - RNA, 14 nt, Human
uauucaauuccucu

SEQ ID NO: 2417203 - RNA, 14 nt, Human
uauucaauaaagua

SEQ ID NO: 2417204 - RNA, 17 nt, Human
uauucaauaaaguauuu

SEQ ID NO: 2417205 - RNA, 15 nt, Human
uauucaauaaaguau

SEQ ID NO: 2417206 - RNA, 20 nt, Human
uauucaauaaaguauuuaau

SEQ ID NO: 2417207 - RNA, 19 nt, Human
uauucaauaaaguauuuaa

SEQ ID NO: 2417208 - RNA, 21 nt, Human
uauucaauaaaguauuuaauu

SEQ ID NO: 2417209 - RNA, 16 nt, Human
uauucaauauccuuug

SEQ ID NO: 2417210 - RNA, 17 nt, Human
acaggaaaagcugcuga

SEQ ID NO: 2417211 - RNA, 16 nt, Human
acaggaaaagcugcug

SEQ ID NO: 2417212 - RNA, 15 nt, Human
acaggaaaagcugcu

SEQ ID NO: 2417213 - RNA, 13 nt, Human
acaggaaguacug

SEQ ID NO: 2417214 - RNA, 22 nt, Human
acaggaagaucuuaaauuuugu

SEQ ID NO: 2417215 - RNA, 18 nt, Human
acaggaagaucuuaaauu

SEQ ID NO: 2417216 - RNA, 17 nt, Human
acaggaagaucuuaaau

SEQ ID NO: 2417217 - RNA, 10 nt, Human
acaggaagau

SEQ ID NO: 2417218 - RNA, 17 nt, Human
acaggaaguagaggagg

SEQ ID NO: 2417219 - RNA, 15 nt, Human
acaggaagcacccca

SEQ ID NO: 2417220 - RNA, 20 nt, Human
acaggaagcaccccaugcca

SEQ ID NO: 2417221 - RNA, 15 nt, Human
acaggaagugaagaa

SEQ ID NO: 2417222 - RNA, 20 nt, Human
acaggaagguggugcuuaca

SEQ ID NO: 2417223 - RNA, 17 nt, Human
acaggaagucuucaggg

SEQ ID NO: 2417224 - RNA, 13 nt, Human
acagcuaacaugg

SEQ ID NO: 2417225 - RNA, 15 nt, Human
acagcuaacacacag

SEQ ID NO: 2417226 - RNA, 19 nt, Human
acagcuaacaauugugaag

SEQ ID NO: 2417227 - RNA, 17 nt, Human
acagcguuuaagacugu

SEQ ID NO: 2417228 - RNA, 16 nt, Human
acagcguuuaagacug

SEQ ID NO: 2417229 - RNA, 21 nt, Human
acagcggcuggacuuggaggu

SEQ ID NO: 2417230 - RNA, 11 nt, Human
acagccuggca

SEQ ID NO: 2417231 - RNA, 22 nt, Human
acagcggcuggacuuggaggua

SEQ ID NO: 2417232 - RNA, 15 nt, Human
acagccugcaaguca

SEQ ID NO: 2417233 - RNA, 16 nt, Human
acagcggggccccagg

SEQ ID NO: 2417234 - RNA, 19 nt, Human
acagcuaacacacagcucc

SEQ ID NO: 2417235 - RNA, 18 nt, Human
acagcuaacacacagcuc

SEQ ID NO: 2417236 - RNA, 15 nt, Human
acagcuuguauuuug

SEQ ID NO: 2417237 - RNA, 17 nt, Human
acagcuuuaucaccaga

SEQ ID NO: 2417238 - RNA, 11 nt, Human
acagcuuugcu

SEQ ID NO: 2417239 - RNA, 12 nt, Human
acagcuuugcug

SEQ ID NO: 2417240 - RNA, 20 nt, Human
acagcuuucaugauuagcaa

SEQ ID NO: 2417241 - RNA, 23 nt, Human
acagcuuugugacuguauauaaa

SEQ ID NO: 2417242 - RNA, 21 nt, Human
acagcuuugugacuguauaua

SEQ ID NO: 2417243 - RNA, 20 nt, Human
acagcuuugugacuguauau

SEQ ID NO: 2417244 - RNA, 19 nt, Human
acagcuuugugacuguaua

SEQ ID NO: 2417245 - RNA, 21 nt, Human
acagcuuugcugcugaaggcu

SEQ ID NO: 2417246 - RNA, 15 nt, Human
acagcuuugugacug

SEQ ID NO: 2417247 - RNA, 15 nt, Human
acagcuuugcugcug

SEQ ID NO: 2417248 - RNA, 13 nt, Human
acaggcaggucca

SEQ ID NO: 2417249 - RNA, 14 nt, Human
acaggaucagucug

SEQ ID NO: 2417250 - RNA, 16 nt, Human
acaggagugagcacua

SEQ ID NO: 2417251 - RNA, 16 nt, Human
acaggcagguccaggg

SEQ ID NO: 2417252 - RNA, 14 nt, Human
acaggcagguccag

SEQ ID NO: 2417253 - RNA, 19 nt, Human
acaggcaguuacuucugag

SEQ ID NO: 2417254 - RNA, 19 nt, Human
acaggauaaagauaucaau

SEQ ID NO: 2417255 - RNA, 14 nt, Human
acaggcauguucuc

SEQ ID NO: 2417256 - RNA, 14 nt, Human
acaggacccccuuc

SEQ ID NO: 2417257 - RNA, 17 nt, Human
acaggacccccuucccc

SEQ ID NO: 2417258 - RNA, 14 nt, Human
acaggaccagauuu

SEQ ID NO: 2417259 - RNA, 18 nt, Human
acaggagggcaagggcca

SEQ ID NO: 2417260 - RNA, 22 nt, Human
acaggaggacaauucaugaacu

SEQ ID NO: 2417261 - RNA, 14 nt, Human
acaggacucugccu

SEQ ID NO: 2417262 - RNA, 23 nt, Human
acaggaccagggauuuccaugau

SEQ ID NO: 2417263 - RNA, 22 nt, Human
acaggacaugcgguagccagca

SEQ ID NO: 2417264 - RNA, 20 nt, Human
acaggacagugcuucagccu

SEQ ID NO: 2417265 - RNA, 22 nt, Human
acaggacagugcuucagccuga

SEQ ID NO: 2417266 - RNA, 19 nt, Human
acaggaaucaagagcugcc

SEQ ID NO: 2417267 - RNA, 14 nt, Human
acaggacacaguca

SEQ ID NO: 2417268 - RNA, 15 nt, Human
acaggacacagucag

SEQ ID NO: 2417269 - RNA, 16 nt, Human
acaggacacagucaga

SEQ ID NO: 2417270 - RNA, 17 nt, Human
acaggacagugcuucag

SEQ ID NO: 2417271 - RNA, 12 nt, Human
uauguuuuggua

SEQ ID NO: 2417272 - RNA, 22 nt, Human
uauguuuugacauuuuuaguuu

SEQ ID NO: 2417273 - RNA, 18 nt, Human
uauguuuugguaucuguu

SEQ ID NO: 2417274 - RNA, 14 nt, Human
uauguuuugguauc

SEQ ID NO: 2417275 - RNA, 20 nt, Human
uauguuuugguaucuguucu

SEQ ID NO: 2417276 - RNA, 21 nt, Human
uauguuuucaggcuagaugua

SEQ ID NO: 2417277 - RNA, 14 nt, Human
uauguguguagaca

SEQ ID NO: 2417278 - RNA, 16 nt, Human
uaugugugaggagcug

SEQ ID NO: 2417279 - RNA, 21 nt, Human
uaugugugaggagcugcuggc

SEQ ID NO: 2417280 - RNA, 12 nt, Human
uauguguaugua

SEQ ID NO: 2417281 - RNA, 13 nt, Human
uauguguauguac

SEQ ID NO: 2417282 - RNA, 15 nt, Human
uaugugugaggagcu

SEQ ID NO: 2417283 - RNA, 14 nt, Human
uauguguaaauaca

SEQ ID NO: 2417284 - RNA, 23 nt, Human
uaugugggcagauuuucagcaaa

SEQ ID NO: 2417285 - RNA, 17 nt, Human
uaugugggcagauuuuc

SEQ ID NO: 2417286 - RNA, 15 nt, Human
uauguuuuuguucaa

SEQ ID NO: 2417287 - RNA, 17 nt, Human
uauguuuuuuaaaauau

SEQ ID NO: 2417288 - RNA, 19 nt, Human
uauguuuuuuagaucaaau

SEQ ID NO: 2417289 - RNA, 17 nt, Human
uauguuuuuuagaucaa

SEQ ID NO: 2417290 - RNA, 23 nt, Human
uauguuuuuuagaucaaauacuu

SEQ ID NO: 2417291 - RNA, 13 nt, Human
uauuaaaaaacaa

SEQ ID NO: 2417292 - RNA, 23 nt, Human
uauuaaaaaaaacaaaaagaaca

SEQ ID NO: 2417293 - RNA, 14 nt, Human
uauuaaaaaaaaca

SEQ ID NO: 2417294 - RNA, 22 nt, Human
uauguuuuuuuucugcuggaaa

SEQ ID NO: 2417295 - RNA, 15 nt, Human
uauguuuuuuuucug

SEQ ID NO: 2417296 - RNA, 14 nt, Human
uauguuuuugaagg

SEQ ID NO: 2417297 - RNA, 16 nt, Human
uauguuuuugaaggca

SEQ ID NO: 2417298 - RNA, 16 nt, Human
uauguuuuuguucaaa

SEQ ID NO: 2417299 - RNA, 18 nt, Human
uauguuuuuguguauuug

SEQ ID NO: 2417300 - RNA, 14 nt, Human
uauguuuuugugua

SEQ ID NO: 2417301 - RNA, 21 nt, Human
uauuaaaaauauaaaacugcg

SEQ ID NO: 2417302 - RNA, 19 nt, Human
uauuaaaaauauaaaacug

SEQ ID NO: 2417303 - RNA, 18 nt, Human
uauuaaaaauauaaaacu

SEQ ID NO: 2417304 - RNA, 15 nt, Human
uauuaaaaauauaaa

SEQ ID NO: 2417305 - RNA, 14 nt, Human
uauuaaaaauauaa

SEQ ID NO: 2417306 - RNA, 13 nt, Human
uauuaaaaauaua

SEQ ID NO: 2417307 - RNA, 12 nt, Human
uauuaaaaauau

SEQ ID NO: 2417308 - RNA, 16 nt, Human
uauuaaaacucauuuu

SEQ ID NO: 2417309 - RNA, 21 nt, Human
uaugucuuggacacuguacaa

SEQ ID NO: 2417310 - RNA, 19 nt, Human
uaugucuuggacacuguac

SEQ ID NO: 2417311 - RNA, 17 nt, Human
uaugucuuggacacugu

SEQ ID NO: 2417312 - RNA, 14 nt, Human
uaugucuuggacac

SEQ ID NO: 2417313 - RNA, 14 nt, Human
uaugugaaacaugu

SEQ ID NO: 2417314 - RNA, 22 nt, Human
acaggcauguucucugaggaca

SEQ ID NO: 2417315 - RNA, 20 nt, Human
acaggcauguucucugagga

SEQ ID NO: 2417316 - RNA, 19 nt, Human
acaggcauguucucugagg

SEQ ID NO: 2417317 - RNA, 18 nt, Human
acaggcauguucucugag

SEQ ID NO: 2417318 - RNA, 15 nt, Human
acaggcauguucucu

SEQ ID NO: 2417319 - RNA, 12 nt, Human
uauguggaagug

SEQ ID NO: 2417320 - RNA, 16 nt, Human
uauguggaaguguggg

SEQ ID NO: 2417321 - RNA, 20 nt, Human
uauguggaguucaucuugaa

SEQ ID NO: 2417322 - RNA, 23 nt, Human
uaugugccagauuuaugcauauu

SEQ ID NO: 2417323 - RNA, 13 nt, Human
uaugugagugugu

SEQ ID NO: 2417324 - RNA, 17 nt, Human
uaugugaaacauguuuc

SEQ ID NO: 2417325 - RNA, 22 nt, Human
uaugugaaugaucucucugaau

SEQ ID NO: 2417326 - RNA, 19 nt, Human
uaugugacaauuuuguaca

SEQ ID NO: 2417327 - RNA, 22 nt, Human
uaugugaauauggacucaguuu

SEQ ID NO: 2417328 - RNA, 21 nt, Human
uaugugaauccucuucuuuau

SEQ ID NO: 2417329 - RNA, 12 nt, Human
uaugugaaugau

SEQ ID NO: 2417330 - RNA, 14 nt, Human
uaugugaacauuua

SEQ ID NO: 2417331 - RNA, 13 nt, Human
uauaaguuugaag

SEQ ID NO: 2417332 - RNA, 12 nt, Human
uauaaguuucuu

SEQ ID NO: 2417333 - RNA, 15 nt, Human
uauaaguguacauau

SEQ ID NO: 2417334 - RNA, 18 nt, Human
uauaaguguacauaugug

SEQ ID NO: 2417335 - RNA, 23 nt, Human
uauaaguguguguuuuucauaaa

SEQ ID NO: 2417336 - RNA, 17 nt, Human
uauaaguguguguuuuu

SEQ ID NO: 2417337 - RNA, 13 nt, Human
uauacaaauuaga

SEQ ID NO: 2417338 - RNA, 14 nt, Human
uauacaaauuagaa

SEQ ID NO: 2417339 - RNA, 16 nt, Human
uauacaaauuagaaaa

SEQ ID NO: 2417340 - RNA, 18 nt, Human
uauacaaauuagaaaaug

SEQ ID NO: 2417341 - RNA, 17 nt, Human
uauacaaauuagaaaau

SEQ ID NO: 2417342 - RNA, 16 nt, Human
acagaaaauauacugu

SEQ ID NO: 2417343 - RNA, 17 nt, Human
acagaaaauauacugua

SEQ ID NO: 2417344 - RNA, 12 nt, Human
uauacaacagug

SEQ ID NO: 2417345 - RNA, 21 nt, Human
uauaauuuuuuucaauauuua

SEQ ID NO: 2417346 - RNA, 15 nt, Human
uauaauuuuuuaaag

SEQ ID NO: 2417347 - RNA, 18 nt, Human
uauaauuuuuuucaauau

SEQ ID NO: 2417348 - RNA, 20 nt, Human
uauaauuuuuuuauuacuga

SEQ ID NO: 2417349 - RNA, 16 nt, Human
uauaaguuugaaggaa

SEQ ID NO: 2417350 - RNA, 19 nt, Human
uauaauuuuuaaaguauau

SEQ ID NO: 2417351 - RNA, 19 nt, Human
uauaauuuuuuagagagcu

SEQ ID NO: 2417352 - RNA, 17 nt, Human
acagaaaauucuucucc

SEQ ID NO: 2417353 - RNA, 13 nt, Human
acagaaauguaca

SEQ ID NO: 2417354 - RNA, 18 nt, Human
acagaaaauauacuguaa

SEQ ID NO: 2417355 - RNA, 19 nt, Human
acagaaaauauacuguaaa

SEQ ID NO: 2417356 - RNA, 20 nt, Human
acagaaaauauacuguaaag

SEQ ID NO: 2417357 - RNA, 21 nt, Human
acagaaaauauacuguaaaga

SEQ ID NO: 2417358 - RNA, 20 nt, Human
acagaaaauggaagacagcu

SEQ ID NO: 2417359 - RNA, 14 nt, Human
acagaaauguacag

SEQ ID NO: 2417360 - RNA, 16 nt, Human
acagaaauguacagca

SEQ ID NO: 2417361 - RNA, 17 nt, Human
acagaaauguacagcaa

SEQ ID NO: 2417362 - RNA, 17 nt, Human
acagaaauuagccgggc

SEQ ID NO: 2417363 - RNA, 15 nt, Human
acagacccugcccug

SEQ ID NO: 2417364 - RNA, 21 nt, Human
acagaccacaucuuuaucugu

SEQ ID NO: 2417365 - RNA, 20 nt, Human
acagaccacaucuuuaucug

SEQ ID NO: 2417366 - RNA, 16 nt, Human
acagacauuguuuugc

SEQ ID NO: 2417367 - RNA, 12 nt, Human
acagacauuguu

SEQ ID NO: 2417368 - RNA, 11 nt, Human
acagacauugu

SEQ ID NO: 2417369 - RNA, 14 nt, Human
acagacccugcccu

SEQ ID NO: 2417370 - RNA, 13 nt, Human
acagacccugccc

SEQ ID NO: 2417371 - RNA, 22 nt, Human
acagaccacaucuuuaucuguu

SEQ ID NO: 2417372 - RNA, 22 nt, Human
uauauuacuagcauaugaguuu

SEQ ID NO: 2417373 - RNA, 16 nt, Human
uauauuagcauuuagu

SEQ ID NO: 2417374 - RNA, 23 nt, Human
uauauuagcauuuaguccaaugu

SEQ ID NO: 2417375 - RNA, 14 nt, Human
uauauuaucaugca

SEQ ID NO: 2417376 - RNA, 20 nt, Human
uauauuaucaugcaaaugcu

SEQ ID NO: 2417377 - RNA, 18 nt, Human
uauauuguguuuguguau

SEQ ID NO: 2417378 - RNA, 20 nt, Human
uauauuguaagaaauacugu

SEQ ID NO: 2417379 - RNA, 22 nt, Human
uauauuguaagaaauacuguac

SEQ ID NO: 2417380 - RNA, 12 nt, Human
uauauuguaaga

SEQ ID NO: 2417381 - RNA, 15 nt, Human
uauauuguaagaaau

SEQ ID NO: 2417382 - RNA, 19 nt, Human
uauauuguaagaaauacug

SEQ ID NO: 2417383 - RNA, 15 nt, Human
uauauuguuugcuaa

SEQ ID NO: 2417384 - RNA, 19 nt, Human
uauauuguguuuguguauu

SEQ ID NO: 2417385 - RNA, 19 nt, Human
uauauugucagauauuuuu

SEQ ID NO: 2417386 - RNA, 16 nt, Human
uauauuuaguaucuuu

SEQ ID NO: 2417387 - RNA, 12 nt, Human
uauauuuauaac

SEQ ID NO: 2417388 - RNA, 14 nt, Human
uauauuuauaacuc

SEQ ID NO: 2417389 - RNA, 15 nt, Human
uauauuuauaacuca

SEQ ID NO: 2417390 - RNA, 16 nt, Human
uauauuuauaacucau

SEQ ID NO: 2417391 - RNA, 21 nt, Human
uauauuuagauuguuaaaaua

SEQ ID NO: 2417392 - RNA, 18 nt, Human
uauauuuaguuauaguuu

SEQ ID NO: 2417393 - RNA, 16 nt, Human
uauauuuaguuauagu

SEQ ID NO: 2417394 - RNA, 22 nt, Human
uaucauuuuuguacaguuugcu

SEQ ID NO: 2417395 - RNA, 21 nt, Human
uaucauuuuuguacaguuugc

SEQ ID NO: 2417396 - RNA, 17 nt, Human
uaucauuuuuguacagu

SEQ ID NO: 2417397 - RNA, 15 nt, Human
uaucauuuuuguaca

SEQ ID NO: 2417398 - RNA, 13 nt, Human
uauccaaaagcuu

SEQ ID NO: 2417399 - RNA, 19 nt, Human
uauccaaaccaaauaaaaa

SEQ ID NO: 2417400 - RNA, 21 nt, Human
uaucauuuaauaauauacuug

SEQ ID NO: 2417401 - RNA, 20 nt, Human
uaucauuuaauaauauacuu

SEQ ID NO: 2417402 - RNA, 19 nt, Human
uaucauuuaauaauauacu

SEQ ID NO: 2417403 - RNA, 18 nt, Human
uaucauuuaauaauauac

SEQ ID NO: 2417404 - RNA, 22 nt, Human
uaucauuuaauaauauacuugu

SEQ ID NO: 2417405 - RNA, 20 nt, Human
uaucauuuauuuuuuacauu

SEQ ID NO: 2417406 - RNA, 17 nt, Human
uaucauuuuagaagacu

SEQ ID NO: 2417407 - RNA, 14 nt, Human
uaucauuuucugca

SEQ ID NO: 2417408 - RNA, 21 nt, Human
uaucauuuucugcauuuaacc

SEQ ID NO: 2417409 - RNA, 12 nt, Human
uaucaagaaagu

SEQ ID NO: 2417410 - RNA, 21 nt, Human
uauauuuauaacucaucauaa

SEQ ID NO: 2417411 - RNA, 21 nt, Human
uaucaacacuguuacuuucgu

SEQ ID NO: 2417412 - RNA, 15 nt, Human
uaucaagcagccaag

SEQ ID NO: 2417413 - RNA, 23 nt, Human
uaucaagccaguacgugcuaaca

SEQ ID NO: 2417414 - RNA, 16 nt, Human
uaucauuuaauaauau

SEQ ID NO: 2417415 - RNA, 21 nt, Human
uauccagguaauccaagauau

SEQ ID NO: 2417416 - RNA, 18 nt, Human
uauccagguaauccaaga

SEQ ID NO: 2417417 - RNA, 17 nt, Human
uauccauauugagucaa

SEQ ID NO: 2417418 - RNA, 11 nt, Human
uauccagucua

SEQ ID NO: 2417419 - RNA, 15 nt, Human
uauccacuuugcaca

SEQ ID NO: 2417420 - RNA, 18 nt, Human
uauccacuuugcacagcu

SEQ ID NO: 2417421 - RNA, 19 nt, Human
uauccacccagcccauucu

SEQ ID NO: 2417422 - RNA, 20 nt, Human
uauccacccagcccauucuc

SEQ ID NO: 2417423 - RNA, 11 nt, Human
uauccaggacu

SEQ ID NO: 2417424 - RNA, 14 nt, Human
uaucccuuccuuuu

SEQ ID NO: 2417425 - RNA, 16 nt, Human
uauccggacuccugcc

SEQ ID NO: 2417426 - RNA, 19 nt, Human
acagagaacuaacacuauu

SEQ ID NO: 2417427 - RNA, 16 nt, Human
acagagaagacaaaau

SEQ ID NO: 2417428 - RNA, 18 nt, Human
acagagaacuaacacuau

SEQ ID NO: 2417429 - RNA, 14 nt, Human
acagagaaccugga

SEQ ID NO: 2417430 - RNA, 19 nt, Human
acagagaaagaggaagcuu

SEQ ID NO: 2417431 - RNA, 17 nt, Human
acagagaaagagagaga

SEQ ID NO: 2417432 - RNA, 18 nt, Human
acagagaaaguacuucuc

SEQ ID NO: 2417433 - RNA, 11 nt, Human
acagagaaagu

SEQ ID NO: 2417434 - RNA, 15 nt, Human
acagagaaggcagga

SEQ ID NO: 2417435 - RNA, 14 nt, Human
acagagaaggcagg

SEQ ID NO: 2417436 - RNA, 16 nt, Human
acagagaaggcaggaa

SEQ ID NO: 2417437 - RNA, 14 nt, Human
uaucuauauuuuug

SEQ ID NO: 2417438 - RNA, 13 nt, Human
uaucuaucuuaua

SEQ ID NO: 2417439 - RNA, 17 nt, Human
uaucucaaaacugcacu

SEQ ID NO: 2417440 - RNA, 22 nt, Human
uaucucagucaugcauaaauau

SEQ ID NO: 2417441 - RNA, 14 nt, Human
uaucucccccagcc

SEQ ID NO: 2417442 - RNA, 13 nt, Human
uaucucccccagc

SEQ ID NO: 2417443 - RNA, 23 nt, Human
uaucuccaggauugaagagcauu

SEQ ID NO: 2417444 - RNA, 18 nt, Human
uaucucagucaugcauaa

SEQ ID NO: 2417445 - RNA, 11 nt, Human
uaucucaucuc

SEQ ID NO: 2417446 - RNA, 15 nt, Human
uaucuccaagaccag

SEQ ID NO: 2417447 - RNA, 22 nt, Human
uaugaaauuuaauauagcuauu

SEQ ID NO: 2417448 - RNA, 15 nt, Human
uaucuuuuuucaaaa

SEQ ID NO: 2417449 - RNA, 20 nt, Human
uaugaaauuuaauauagcua

SEQ ID NO: 2417450 - RNA, 14 nt, Human
uaugaacauauugu

SEQ ID NO: 2417451 - RNA, 13 nt, Human
uaucuuuugaccu

SEQ ID NO: 2417452 - RNA, 19 nt, Human
uaucuuuugaccuguggug

SEQ ID NO: 2417453 - RNA, 22 nt, Human
uaucuuuuugcuuacaguuuua

SEQ ID NO: 2417454 - RNA, 22 nt, Human
uaucuuugccacccucaugcug

SEQ ID NO: 2417455 - RNA, 23 nt, Human
uaucuuuucuauuguuuauucuu

SEQ ID NO: 2417456 - RNA, 18 nt, Human
acagccguuuguucccca

SEQ ID NO: 2417457 - RNA, 19 nt, Human
acagccgucagccaaaugu

SEQ ID NO: 2417458 - RNA, 17 nt, Human
acagccgucagccaaau

SEQ ID NO: 2417459 - RNA, 19 nt, Human
acagccgcuccugucugcc

SEQ ID NO: 2417460 - RNA, 20 nt, Human
acagccgcuccugucugcca

SEQ ID NO: 2417461 - RNA, 23 nt, Human
acagccgcuccugucugccagcc

SEQ ID NO: 2417462 - RNA, 24 nt, Human
acagccgcuccugucugccagcca

SEQ ID NO: 2417463 - RNA, 14 nt, Human
uaucuuugccaccc

SEQ ID NO: 2417464 - RNA, 16 nt, Human
uaucuuugccacccuc

SEQ ID NO: 2417465 - RNA, 11 nt, Human
uaucuuugcca

SEQ ID NO: 2417466 - RNA, 22 nt, Human
uaucuuugauucuccuucagcc

SEQ ID NO: 2417467 - RNA, 19 nt, Human
uaucuuugauucuccuuca

SEQ ID NO: 2417468 - RNA, 14 nt, Human
acagccucacagaa

SEQ ID NO: 2417469 - RNA, 18 nt, Human
uaucuuugauucuccuuc

SEQ ID NO: 2417470 - RNA, 20 nt, Human
acagccgucagccaaaugua

SEQ ID NO: 2417471 - RNA, 17 nt, Human
acagccucacagaagaa

SEQ ID NO: 2417472 - RNA, 21 nt, Human
acagcaaggaggcuggcuggg

SEQ ID NO: 2417473 - RNA, 20 nt, Human
acagcaaggaggcuggcugg

SEQ ID NO: 2417474 - RNA, 19 nt, Human
acagcaaggaggcuggcug

SEQ ID NO: 2417475 - RNA, 18 nt, Human
acagcaaggaggcuggcu

SEQ ID NO: 2417476 - RNA, 17 nt, Human
acagcccgggcucugcc

SEQ ID NO: 2417477 - RNA, 21 nt, Human
acagcaaggagauuuacaacu

SEQ ID NO: 2417478 - RNA, 17 nt, Human
acagcaaggaggcuggc

SEQ ID NO: 2417479 - RNA, 16 nt, Human
acagcaaggaggcugg

SEQ ID NO: 2417480 - RNA, 16 nt, Human
acagcaaggagauuua

SEQ ID NO: 2417481 - RNA, 19 nt, Human
acagcccgggcucugccuc

SEQ ID NO: 2417482 - RNA, 18 nt, Human
acagcccgggcucugccu

SEQ ID NO: 2417483 - RNA, 22 nt, Human
acagccgcagccucccucugac

SEQ ID NO: 2417484 - RNA, 18 nt, Human
acagcaaggcaccugcag

SEQ ID NO: 2417485 - RNA, 16 nt, Human
acagcaaggcaccugc

SEQ ID NO: 2417486 - RNA, 23 nt, Human
acagcaaggaggcuggcuggggc

SEQ ID NO: 2417487 - RNA, 20 nt, Human
acagcccgggcucugccucc

SEQ ID NO: 2417488 - RNA, 23 nt, Human
acagccgcagccucccucugacc

SEQ ID NO: 2417489 - RNA, 14 nt, Human
acagccgcuccugu

SEQ ID NO: 2417490 - RNA, 18 nt, Human
acagccgcuccugucugc

SEQ ID NO: 2417491 - RNA, 18 nt, Human
acagaucaagcugugaga

SEQ ID NO: 2417492 - RNA, 16 nt, Human
acagaucaagcuguga

SEQ ID NO: 2417493 - RNA, 15 nt, Human
acagaucaagcugug

SEQ ID NO: 2417494 - RNA, 14 nt, Human
acagauauaaaugg

SEQ ID NO: 2417495 - RNA, 17 nt, Human
acagauccccaagccug

SEQ ID NO: 2417496 - RNA, 17 nt, Human
acagauauaaauggcug

SEQ ID NO: 2417497 - RNA, 14 nt, Human
acagaucaagcugu

SEQ ID NO: 2417498 - RNA, 13 nt, Human
acagauaguugug

SEQ ID NO: 2417499 - RNA, 23 nt, Human
acagauagucaaaccauaaacuu

SEQ ID NO: 2417500 - RNA, 21 nt, Human
acagauaguaucuagcaauca

SEQ ID NO: 2417501 - RNA, 22 nt, Human
acagaucucugcuuuggaaauc

SEQ ID NO: 2417502 - RNA, 12 nt, Human
acagaucuggaa

SEQ ID NO: 2417503 - RNA, 17 nt, Human
acagaucuccuggcaaa

SEQ ID NO: 2417504 - RNA, 18 nt, Human
acagauccccaagccugg

SEQ ID NO: 2417505 - RNA, 23 nt, Human
acagaucgaaccguuuugaagcu

SEQ ID NO: 2417506 - RNA, 19 nt, Human
acagagcccacgcccccac

SEQ ID NO: 2417507 - RNA, 18 nt, Human
acagagcccacgccccca

SEQ ID NO: 2417508 - RNA, 15 nt, Human
acagagcccacgccc

SEQ ID NO: 2417509 - RNA, 14 nt, Human
acagagcccacgcc

SEQ ID NO: 2417510 - RNA, 14 nt, Human
acagagacaccugc

SEQ ID NO: 2417511 - RNA, 17 nt, Human
acagcaaggagauuuac

SEQ ID NO: 2417512 - RNA, 14 nt, Human
acagauuugagcuc

SEQ ID NO: 2417513 - RNA, 15 nt, Human
acagauuugagcuca

SEQ ID NO: 2417514 - RNA, 20 nt, Human
acagaugcaaugugcuacug

SEQ ID NO: 2417515 - RNA, 14 nt, Human
acagaucuggaacc

SEQ ID NO: 2417516 - RNA, 16 nt, Human
acagaucuggaaccuc

SEQ ID NO: 2417517 - RNA, 20 nt, Human
acagaucuggaaccucagcc

SEQ ID NO: 2417518 - RNA, 21 nt, Human
acagaucuggaaccucagccu

SEQ ID NO: 2417519 - RNA, 22 nt, Human
acagaucuggaaccucagccug

SEQ ID NO: 2417520 - RNA, 20 nt, Human
acagaugaaacacaaacaau

SEQ ID NO: 2417521 - RNA, 19 nt, Human
acagaugaaacacaaacaa

SEQ ID NO: 2417522 - RNA, 14 nt, Human
acagaugaauguau

SEQ ID NO: 2417523 - RNA, 17 nt, Human
acagaugaauguauuua

SEQ ID NO: 2417524 - RNA, 16 nt, Human
acagaugcaaugugcu

SEQ ID NO: 2417525 - RNA, 17 nt, Human
acagaugcaaugugcua

SEQ ID NO: 2417526 - RNA, 18 nt, Human
acagaugccacacaagga

SEQ ID NO: 2417527 - RNA, 16 nt, Human
acagccucuuagaugc

SEQ ID NO: 2417528 - RNA, 20 nt, Human
acagccucugaccccuccuc

SEQ ID NO: 2417529 - RNA, 18 nt, Human
acagccucugaccccucc

SEQ ID NO: 2417530 - RNA, 13 nt, Human
acagccucugacu

SEQ ID NO: 2417531 - RNA, 23 nt, Human
acagccucugaccccuccucacu

SEQ ID NO: 2417532 - RNA, 22 nt, Human
acagccucugaccccuccucac

SEQ ID NO: 2417533 - RNA, 21 nt, Human
acagccucugaccccuccuca

SEQ ID NO: 2417534 - RNA, 19 nt, Human
acagcggcuggacuuggag

SEQ ID NO: 2417535 - RNA, 22 nt, Human
uauggguguguguuugugugag

SEQ ID NO: 2417536 - RNA, 23 nt, Human
uauggggggccaacaccagggau

SEQ ID NO: 2417537 - RNA, 23 nt, Human
uauggcuuuugugcauuaucuag

SEQ ID NO: 2417538 - RNA, 20 nt, Human
uauggggauagaugugugga

SEQ ID NO: 2417539 - RNA, 20 nt, Human
uauggggcugaacggggaga

SEQ ID NO: 2417540 - RNA, 22 nt, Human
uaugggggccuggauucauuuc

SEQ ID NO: 2417541 - RNA, 19 nt, Human
uauggggggccaacaccag

SEQ ID NO: 2417542 - RNA, 18 nt, Human
uauggcuuuugugcauua

SEQ ID NO: 2417543 - RNA, 21 nt, Human
uauggcuuuugugcauuaucu

SEQ ID NO: 2417544 - RNA, 17 nt, Human
uaugcuuaguaaugcua

SEQ ID NO: 2417545 - RNA, 16 nt, Human
uaugcuuacugauaua

SEQ ID NO: 2417546 - RNA, 21 nt, Human
uaugcuuacugauauauuuua

SEQ ID NO: 2417547 - RNA, 17 nt, Human
uauggcuuuugugcauu

SEQ ID NO: 2417548 - RNA, 20 nt, Human
uaugcugccaaauuuuggcc

SEQ ID NO: 2417549 - RNA, 22 nt, Human
uaugcugccaaauuuuggccaa

SEQ ID NO: 2417550 - RNA, 16 nt, Human
uaugcugccaaauuuu

SEQ ID NO: 2417551 - RNA, 16 nt, Human
uaugcuacuacaaaaa

SEQ ID NO: 2417552 - RNA, 15 nt, Human
uaugcuuauacacuu

SEQ ID NO: 2417553 - RNA, 15 nt, Human
uaugcuuacugauau

SEQ ID NO: 2417554 - RNA, 21 nt, Human
uaugauuaaguaaugauaacu

SEQ ID NO: 2417555 - RNA, 11 nt, Human
uaugcauuuga

SEQ ID NO: 2417556 - RNA, 23 nt, Human
uaugcauuugaaaauuuugaugu

SEQ ID NO: 2417557 - RNA, 24 nt, Human
uaugcauuugaaaauuuugauguu

SEQ ID NO: 2417558 - RNA, 20 nt, Human
uaugauuaaguaaugauaac

SEQ ID NO: 2417559 - RNA, 16 nt, Human
uaugauuaaguaauga

SEQ ID NO: 2417560 - RNA, 19 nt, Human
uaugaacauauuguugaaa

SEQ ID NO: 2417561 - RNA, 17 nt, Human
uaugaacauauuguuga

SEQ ID NO: 2417562 - RNA, 18 nt, Human
uaugaacggugagcauug

SEQ ID NO: 2417563 - RNA, 17 nt, Human
uaugccugggcagaagg

SEQ ID NO: 2417564 - RNA, 14 nt, Human
uaugccuucuuauu

SEQ ID NO: 2417565 - RNA, 22 nt, Human
uaugccuguacucgcuugugca

SEQ ID NO: 2417566 - RNA, 10 nt, Human
uaugccugug

SEQ ID NO: 2417567 - RNA, 12 nt, Human
uaugccuguacu

SEQ ID NO: 2417568 - RNA, 22 nt, Human
uaugccuuuaaaucugugauga

SEQ ID NO: 2417569 - RNA, 20 nt, Human
uaugccuuuaaaucugugau

SEQ ID NO: 2417570 - RNA, 19 nt, Human
uaugccuucuuauugcuuu

SEQ ID NO: 2417571 - RNA, 16 nt, Human
uaugccuuuaaaucug

SEQ ID NO: 2417572 - RNA, 13 nt, Human
uaugcuaaucagg

SEQ ID NO: 2417573 - RNA, 19 nt, Human
uaugccccauucaacaucu

SEQ ID NO: 2417574 - RNA, 21 nt, Human
uaugcauuuaaauacagucuu

SEQ ID NO: 2417575 - RNA, 22 nt, Human
uaugcauuuaaauacagucuuc

SEQ ID NO: 2417576 - RNA, 19 nt, Human
uaugccucuccuuuguaua

SEQ ID NO: 2417577 - RNA, 18 nt, Human
uaugccucuccuuuguau

SEQ ID NO: 2417578 - RNA, 17 nt, Human
uaugccucuccuuugua

SEQ ID NO: 2417579 - RNA, 15 nt, Human
uaugccucuccuuug

SEQ ID NO: 2417580 - RNA, 21 nt, Human
uaugccucuccuuuguauauu

SEQ ID NO: 2417581 - RNA, 20 nt, Human
uaugccucuccuuuguauau

SEQ ID NO: 2417582 - RNA, 16 nt, Human
uaugccucuguauuua

SEQ ID NO: 2417583 - RNA, 16 nt, Human
uaugccggaugugcuu

SEQ ID NO: 2417584 - RNA, 15 nt, Human
uaugccggaugugcu

SEQ ID NO: 2417585 - RNA, 20 nt, Human
uaugccgaaugcccucaggg

SEQ ID NO: 2417586 - RNA, 23 nt, Human
uaugccggaugugcuuuucucca

SEQ ID NO: 2417587 - RNA, 21 nt, Human
uaugccggaugugcuuuucuc

SEQ ID NO: 2417588 - RNA, 14 nt, Human
uaugccucuccuuu

SEQ ID NO: 2417589 - RNA, 23 nt, Human
aauugccauauugcacaugucuu

SEQ ID NO: 2417590 - RNA, 19 nt, Human
aauugccauauugcacaug

SEQ ID NO: 2417591 - RNA, 17 nt, Human
aauugccauauugcaca

SEQ ID NO: 2417592 - RNA, 16 nt, Human
aauugccauauugcac

SEQ ID NO: 2417593 - RNA, 23 nt, Human
aauugccugacgaacuccuugau

SEQ ID NO: 2417594 - RNA, 19 nt, Human
aauugccugcagagagaag

SEQ ID NO: 2417595 - RNA, 15 nt, Human
aauugccugacgaac

SEQ ID NO: 2417596 - RNA, 15 nt, Human
aauugccauauugca

SEQ ID NO: 2417597 - RNA, 13 nt, Human
aauugccauauug

SEQ ID NO: 2417598 - RNA, 12 nt, Human
aauugccauauu

SEQ ID NO: 2417599 - RNA, 22 nt, Human
aauugaucauuuuccccccacu

SEQ ID NO: 2417600 - RNA, 14 nt, Human
aauugccaaagcug

SEQ ID NO: 2417601 - RNA, 14 nt, Human
aauugauguguuua

SEQ ID NO: 2417602 - RNA, 12 nt, Human
aauugcauuucc

SEQ ID NO: 2417603 - RNA, 13 nt, Human
aauugauguguuu

SEQ ID NO: 2417604 - RNA, 22 nt, Human
aauugaucauagguauuucaaa

SEQ ID NO: 2417605 - RNA, 21 nt, Human
aauugaucauagguauuucaa

SEQ ID NO: 2417606 - RNA, 19 nt, Human
aauugaugggauuugguca

SEQ ID NO: 2417607 - RNA, 17 nt, Human
aauugaguuuucagugg

SEQ ID NO: 2417608 - RNA, 15 nt, Human
aauugacucaaaucu

SEQ ID NO: 2417609 - RNA, 14 nt, Human
aauugaggucugcu

SEQ ID NO: 2417610 - RNA, 19 nt, Human
aauugaggucugcucggcc

SEQ ID NO: 2417611 - RNA, 22 nt, Human
uacuguacaugaaaacacauuu

SEQ ID NO: 2417612 - RNA, 18 nt, Human
uacuguacaugaaaacac

SEQ ID NO: 2417613 - RNA, 14 nt, Human
uacuggcuggugau

SEQ ID NO: 2417614 - RNA, 21 nt, Human
uacuguacaugaaaacacauu

SEQ ID NO: 2417615 - RNA, 23 nt, Human
uacuguaauuugugauacaaugc

SEQ ID NO: 2417616 - RNA, 21 nt, Human
aauugacccacaagaaaugaa

SEQ ID NO: 2417617 - RNA, 12 nt, Human
uacuguaguuuu

SEQ ID NO: 2417618 - RNA, 14 nt, Human
uacuguacuuaaua

SEQ ID NO: 2417619 - RNA, 13 nt, Human
uacuguaguuuuu

SEQ ID NO: 2417620 - RNA, 15 nt, Human
uacuguaguuuuucu

SEQ ID NO: 2417621 - RNA, 22 nt, Human
aauugacccacaagaaaugaaa

SEQ ID NO: 2417622 - RNA, 14 nt, Human
aauugacugucacu

SEQ ID NO: 2417623 - RNA, 14 nt, Human
aauugacuuauuua

SEQ ID NO: 2417624 - RNA, 19 nt, Human
uacuguaauuugugauaca

SEQ ID NO: 2417625 - RNA, 20 nt, Human
uacuguaauuugugauacaa

SEQ ID NO: 2417626 - RNA, 18 nt, Human
uacuguaauuugugauac

SEQ ID NO: 2417627 - RNA, 19 nt, Human
uacuguaaggcaaucaugg

SEQ ID NO: 2417628 - RNA, 14 nt, Human
uacuguaagaaaau

SEQ ID NO: 2417629 - RNA, 18 nt, Human
uacuguaaggcaaucaug

SEQ ID NO: 2417630 - RNA, 21 nt, Human
uacuggccucgccuggccuga

SEQ ID NO: 2417631 - RNA, 19 nt, Human
uacuggccucgccuggccu

SEQ ID NO: 2417632 - RNA, 14 nt, Human
uacuggccucgccu

SEQ ID NO: 2417633 - RNA, 18 nt, Human
uacuggcaaaaggaucuu

SEQ ID NO: 2417634 - RNA, 22 nt, Human
uacuggcaaaaggaucuuugug

SEQ ID NO: 2417635 - RNA, 18 nt, Human
uacuggaaguuuugcauu

SEQ ID NO: 2417636 - RNA, 23 nt, Human
uacuggaaguuuugcauuuaugg

SEQ ID NO: 2417637 - RNA, 12 nt, Human
uacucuguguca

SEQ ID NO: 2417638 - RNA, 17 nt, Human
uacuggaaguuuugcau

SEQ ID NO: 2417639 - RNA, 16 nt, Human
uacuggagaaaaugga

SEQ ID NO: 2417640 - RNA, 14 nt, Human
uacuggagaagucu

SEQ ID NO: 2417641 - RNA, 15 nt, Human
uacucugguucuuug

SEQ ID NO: 2417642 - RNA, 15 nt, Human
uacucugucagaugg

SEQ ID NO: 2417643 - RNA, 17 nt, Human
uacucugguucuuuguu

SEQ ID NO: 2417644 - RNA, 20 nt, Human
uacucuccucggcccccucc

SEQ ID NO: 2417645 - RNA, 19 nt, Human
uacucuccucggcccccuc

SEQ ID NO: 2417646 - RNA, 12 nt, Human
uacucugaaggg

SEQ ID NO: 2417647 - RNA, 22 nt, Human
uacucugaagggcaucaugcau

SEQ ID NO: 2417648 - RNA, 19 nt, Human
uacucugaagggcaucaug

SEQ ID NO: 2417649 - RNA, 13 nt, Human
uacguacacauuu

SEQ ID NO: 2417650 - RNA, 15 nt, Human
uacguugugcauuug

SEQ ID NO: 2417651 - RNA, 16 nt, Human
uacguugugcauuugg

SEQ ID NO: 2417652 - RNA, 12 nt, Human
uacguacacauu

SEQ ID NO: 2417653 - RNA, 13 nt, Human
uacgcuaguuauc

SEQ ID NO: 2417654 - RNA, 16 nt, Human
uacgccugccuccccu

SEQ ID NO: 2417655 - RNA, 19 nt, Human
uacgcccaacccuucccca

SEQ ID NO: 2417656 - RNA, 17 nt, Human
uacgcccaacccuuccc

SEQ ID NO: 2417657 - RNA, 23 nt, Human
uacgcacuacaugugguuuauag

SEQ ID NO: 2417658 - RNA, 21 nt, Human
aauuccucucacuaaacuuua

SEQ ID NO: 2417659 - RNA, 22 nt, Human
uacgcagcgugcuuuaaaaaau

SEQ ID NO: 2417660 - RNA, 17 nt, Human
uacgccugcauguaaac

SEQ ID NO: 2417661 - RNA, 18 nt, Human
uacgggaggguaaggcug

SEQ ID NO: 2417662 - RNA, 16 nt, Human
uacgauggcacccagu

SEQ ID NO: 2417663 - RNA, 22 nt, Human
uacgccaggggaaaaucagccu

SEQ ID NO: 2417664 - RNA, 22 nt, Human
aauuccuauugugauuugacug

SEQ ID NO: 2417665 - RNA, 20 nt, Human
aauuccuauugugauuugac

SEQ ID NO: 2417666 - RNA, 19 nt, Human
aauuccuauugugauuuga

SEQ ID NO: 2417667 - RNA, 18 nt, Human
aauuccuauugugauuug

SEQ ID NO: 2417668 - RNA, 16 nt, Human
aauuccuauugugauu

SEQ ID NO: 2417669 - RNA, 15 nt, Human
aauuccuauugugau

SEQ ID NO: 2417670 - RNA, 12 nt, Human
aauuccuauugu

SEQ ID NO: 2417671 - RNA, 14 nt, Human
aauuccucugggaa

SEQ ID NO: 2417672 - RNA, 13 nt, Human
aauuccucuggga

SEQ ID NO: 2417673 - RNA, 20 nt, Human
aauucccuggccuuucauau

SEQ ID NO: 2417674 - RNA, 22 nt, Human
aauuccuauacgcagcgugcuu

SEQ ID NO: 2417675 - RNA, 14 nt, Human
aauucccugcuguc

SEQ ID NO: 2417676 - RNA, 13 nt, Human
aauucccugcugu

SEQ ID NO: 2417677 - RNA, 19 nt, Human
aauucccuggccuuucaua

SEQ ID NO: 2417678 - RNA, 23 nt, Human
aauucccucucucugacucucaa

SEQ ID NO: 2417679 - RNA, 21 nt, Human
aauucccucucucugacucuc

SEQ ID NO: 2417680 - RNA, 17 nt, Human
aauucccucucucugac

SEQ ID NO: 2417681 - RNA, 23 nt, Human
aauucccuaucuuuuaguuuuag

SEQ ID NO: 2417682 - RNA, 16 nt, Human
aauucccucucucuga

SEQ ID NO: 2417683 - RNA, 10 nt, Human
aauucccuau

SEQ ID NO: 2417684 - RNA, 22 nt, Human
aauucccuaucuuuuaguuuua

SEQ ID NO: 2417685 - RNA, 14 nt, Human
uacuauguaucaau

SEQ ID NO: 2417686 - RNA, 13 nt, Human
uacuaugccugug

SEQ ID NO: 2417687 - RNA, 14 nt, Human
uacuaugccugugu

SEQ ID NO: 2417688 - RNA, 14 nt, Human
uacucuccucaucu

SEQ ID NO: 2417689 - RNA, 16 nt, Human
uacucuccucaucucu

SEQ ID NO: 2417690 - RNA, 22 nt, Human
uacucuccuggaaauauuaaga

SEQ ID NO: 2417691 - RNA, 23 nt, Human
uacucuccuggaaauauuaagaa

SEQ ID NO: 2417692 - RNA, 23 nt, Human
uacuauggcccuggccuagcaua

SEQ ID NO: 2417693 - RNA, 15 nt, Human
uacuaucuacucucc

SEQ ID NO: 2417694 - RNA, 17 nt, Human
uacuaucuacucuccuc

SEQ ID NO: 2417695 - RNA, 12 nt, Human
uacuauguauca

SEQ ID NO: 2417696 - RNA, 13 nt, Human
uacuauguaucaa

SEQ ID NO: 2417697 - RNA, 17 nt, Human
uacuacugaaucucuaa

SEQ ID NO: 2417698 - RNA, 16 nt, Human
uacuacugaaucucua

SEQ ID NO: 2417699 - RNA, 20 nt, Human
uacuacuguggaaaaauauu

SEQ ID NO: 2417700 - RNA, 14 nt, Human
uacuagaagaugaa

SEQ ID NO: 2417701 - RNA, 18 nt, Human
uacuagaacacagaaagc

SEQ ID NO: 2417702 - RNA, 12 nt, Human
uacuagaacaca

SEQ ID NO: 2417703 - RNA, 20 nt, Human
uacuacuuuugcaugaaaau

SEQ ID NO: 2417704 - RNA, 22 nt, Human
uacuacuguggaaaaauauuua

SEQ ID NO: 2417705 - RNA, 19 nt, Human
uacuauauaugugaugauc

SEQ ID NO: 2417706 - RNA, 14 nt, Human
uacuauauuuaugg

SEQ ID NO: 2417707 - RNA, 20 nt, Human
uacuaucaugucaaacguga

SEQ ID NO: 2417708 - RNA, 16 nt, Human
uacuacuccuguaauu

SEQ ID NO: 2417709 - RNA, 17 nt, Human
uacuaaaaagaaggaaa

SEQ ID NO: 2417710 - RNA, 23 nt, Human
uacuaaaaagaaggaaaaugauc

SEQ ID NO: 2417711 - RNA, 16 nt, Human
uacuaaaaagaaggaa

SEQ ID NO: 2417712 - RNA, 13 nt, Human
uacguuuuuguaa

SEQ ID NO: 2417713 - RNA, 17 nt, Human
uacuacuccuguaggaa

SEQ ID NO: 2417714 - RNA, 13 nt, Human
uacuacuccugua

SEQ ID NO: 2417715 - RNA, 20 nt, Human
uacguuuguauguguguaga

SEQ ID NO: 2417716 - RNA, 14 nt, Human
uacguuuguaugug

SEQ ID NO: 2417717 - RNA, 13 nt, Human
uacguuuguaugu

SEQ ID NO: 2417718 - RNA, 17 nt, Human
uaccugucccccugaca

SEQ ID NO: 2417719 - RNA, 16 nt, Human
uaccugucccccugac

SEQ ID NO: 2417720 - RNA, 14 nt, Human
uaccugucccccug

SEQ ID NO: 2417721 - RNA, 13 nt, Human
uaccugucccccu

SEQ ID NO: 2417722 - RNA, 18 nt, Human
uaccugggugauuacaua

SEQ ID NO: 2417723 - RNA, 10 nt, Human
uaccuguccc

SEQ ID NO: 2417724 - RNA, 23 nt, Human
uaccugcucuccaagucucagug

SEQ ID NO: 2417725 - RNA, 14 nt, Human
uaccugcucuccaa

SEQ ID NO: 2417726 - RNA, 20 nt, Human
uaccugggcauacuaauaaa

SEQ ID NO: 2417727 - RNA, 14 nt, Human
uaccugggaagggg

SEQ ID NO: 2417728 - RNA, 17 nt, Human
uaccuggaggaggagca

SEQ ID NO: 2417729 - RNA, 21 nt, Human
uaccuggguccuuuucagaag

SEQ ID NO: 2417730 - RNA, 20 nt, Human
uaccugccaggaagccagca

SEQ ID NO: 2417731 - RNA, 18 nt, Human
uaccugccaggaagccag

SEQ ID NO: 2417732 - RNA, 16 nt, Human
uaccugcccugacaug

SEQ ID NO: 2417733 - RNA, 23 nt, Human
uaccugccaggaagccagcaggc

SEQ ID NO: 2417734 - RNA, 18 nt, Human
uaccaccccuuccugucc

SEQ ID NO: 2417735 - RNA, 17 nt, Human
uaccaccccuuccuguc

SEQ ID NO: 2417736 - RNA, 16 nt, Human
uaccaccccuuccugu

SEQ ID NO: 2417737 - RNA, 15 nt, Human
uaccaccccuuccug

SEQ ID NO: 2417738 - RNA, 14 nt, Human
uaccaccccuuccu

SEQ ID NO: 2417739 - RNA, 15 nt, Human
uaccacccccacacc

SEQ ID NO: 2417740 - RNA, 14 nt, Human
uaccacccccacac

SEQ ID NO: 2417741 - RNA, 15 nt, Human
uaccacccaaugcug

SEQ ID NO: 2417742 - RNA, 19 nt, Human
uacauuggcugguaacagu

SEQ ID NO: 2417743 - RNA, 19 nt, Human
uaccaccccuuccuguccc

SEQ ID NO: 2417744 - RNA, 10 nt, Human
uaccaccucc

SEQ ID NO: 2417745 - RNA, 13 nt, Human
uaccacuccugcc

SEQ ID NO: 2417746 - RNA, 14 nt, Human
uaccacucaggcca

SEQ ID NO: 2417747 - RNA, 12 nt, Human
aauuagcaauug

SEQ ID NO: 2417748 - RNA, 14 nt, Human
aauuagccgggcgu

SEQ ID NO: 2417749 - RNA, 15 nt, Human
aauuagccaagugug

SEQ ID NO: 2417750 - RNA, 14 nt, Human
aauuacugguccaa

SEQ ID NO: 2417751 - RNA, 19 nt, Human
aauuacucaggaagaacac

SEQ ID NO: 2417752 - RNA, 13 nt, Human
aauuacucaggaa

SEQ ID NO: 2417753 - RNA, 16 nt, Human
aauuacuacaaaauuu

SEQ ID NO: 2417754 - RNA, 17 nt, Human
aauuaggaagugauuau

SEQ ID NO: 2417755 - RNA, 21 nt, Human
aauuaggaaguguaacagcug

SEQ ID NO: 2417756 - RNA, 20 nt, Human
aauuaggaauaaauaaaaau

SEQ ID NO: 2417757 - RNA, 22 nt, Human
aauuaggaaguguaacagcuga

SEQ ID NO: 2417758 - RNA, 16 nt, Human
aauuagcugugugaaa

SEQ ID NO: 2417759 - RNA, 23 nt, Human
aauuaccuuagauuagcucugga

SEQ ID NO: 2417760 - RNA, 21 nt, Human
aauuaccuuagauuagcucug

SEQ ID NO: 2417761 - RNA, 21 nt, Human
aauuaccuugagccaguaauu

SEQ ID NO: 2417762 - RNA, 14 nt, Human
aauuacacccaaag

SEQ ID NO: 2417763 - RNA, 14 nt, Human
aauuacaauuguca

SEQ ID NO: 2417764 - RNA, 15 nt, Human
aauuacuacaaaauu

SEQ ID NO: 2417765 - RNA, 17 nt, Human
aauuacuacaaaauuug

SEQ ID NO: 2417766 - RNA, 11 nt, Human
aauuacaggaa

SEQ ID NO: 2417767 - RNA, 23 nt, Human
aauuacaauugucauuuauaaaa

SEQ ID NO: 2417768 - RNA, 23 nt, Human
aauuaauuuuuuuauuguuuaaa

SEQ ID NO: 2417769 - RNA, 22 nt, Human
aauuaauuuuuuuauuguuuaa

SEQ ID NO: 2417770 - RNA, 21 nt, Human
aauuaauuuuuuuauuguuua

SEQ ID NO: 2417771 - RNA, 18 nt, Human
aauuaauuuuuuuauugu

SEQ ID NO: 2417772 - RNA, 15 nt, Human
uaccuguauucccag

SEQ ID NO: 2417773 - RNA, 15 nt, Human
aauucauuuuuuuca

SEQ ID NO: 2417774 - RNA, 14 nt, Human
aauuccaaaggaau

SEQ ID NO: 2417775 - RNA, 23 nt, Human
aauuccaaggaguuccaugaaga

SEQ ID NO: 2417776 - RNA, 12 nt, Human
aauuccaaggag

SEQ ID NO: 2417777 - RNA, 13 nt, Human
aauuccacuggac

SEQ ID NO: 2417778 - RNA, 14 nt, Human
aauuccacuggacu

SEQ ID NO: 2417779 - RNA, 22 nt, Human
aauuccacuuauaggaauugac

SEQ ID NO: 2417780 - RNA, 16 nt, Human
aauuccaauaugauga

SEQ ID NO: 2417781 - RNA, 22 nt, Human
aauuccacugucaagaaagagc

SEQ ID NO: 2417782 - RNA, 14 nt, Human
aauuccacugucaa

SEQ ID NO: 2417783 - RNA, 21 nt, Human
aauuccacuggacuugagcuu

SEQ ID NO: 2417784 - RNA, 12 nt, Human
aauuccccagau

SEQ ID NO: 2417785 - RNA, 14 nt, Human
aauuccccacccug

SEQ ID NO: 2417786 - RNA, 11 nt, Human
aauuccaugaa

SEQ ID NO: 2417787 - RNA, 10 nt, Human
aauuccauga

SEQ ID NO: 2417788 - RNA, 18 nt, Human
aauuccaugaaucgcuuc

SEQ ID NO: 2417789 - RNA, 16 nt, Human
aauuccaugaaucgcu

SEQ ID NO: 2417790 - RNA, 17 nt, Human
aauucccauuuugcaaa

SEQ ID NO: 2417791 - RNA, 19 nt, Human
aauucccauuuugcaaaau

SEQ ID NO: 2417792 - RNA, 21 nt, Human
aauucccauuuugcaaaauuu

SEQ ID NO: 2417793 - RNA, 22 nt, Human
aauucccauuuugcaaaauuuc

SEQ ID NO: 2417794 - RNA, 16 nt, Human
aauucccauuuugcaa

SEQ ID NO: 2417795 - RNA, 18 nt, Human
aauuccaagugauugaaa

SEQ ID NO: 2417796 - RNA, 23 nt, Human
aauucacucccacacccaagaag

SEQ ID NO: 2417797 - RNA, 14 nt, Human
aauucaccaaagua

SEQ ID NO: 2417798 - RNA, 17 nt, Human
aauucaccaaaguauuu

SEQ ID NO: 2417799 - RNA, 21 nt, Human
aauucacccccuuuccuggac

SEQ ID NO: 2417800 - RNA, 13 nt, Human
aauucacucccac

SEQ ID NO: 2417801 - RNA, 21 nt, Human
aauucacaucuaaccucaucu

SEQ ID NO: 2417802 - RNA, 22 nt, Human
aauucacaucuaaccucaucuu

SEQ ID NO: 2417803 - RNA, 19 nt, Human
aauucacaaacuuuuauac

SEQ ID NO: 2417804 - RNA, 14 nt, Human
aauucacaaacuuu

SEQ ID NO: 2417805 - RNA, 13 nt, Human
aauucacaaacuu

SEQ ID NO: 2417806 - RNA, 14 nt, Human
aauucaacccuuug

SEQ ID NO: 2417807 - RNA, 21 nt, Human
aauucaaccacuguaaaauga

SEQ ID NO: 2417808 - RNA, 18 nt, Human
aauucaacccuuugcccc

SEQ ID NO: 2417809 - RNA, 15 nt, Human
aauucaacucagacu

SEQ ID NO: 2417810 - RNA, 19 nt, Human
aauuauuuugguacuuuua

SEQ ID NO: 2417811 - RNA, 18 nt, Human
aauuauuuuggauuuugu

SEQ ID NO: 2417812 - RNA, 11 nt, Human
aauuauuuugg

SEQ ID NO: 2417813 - RNA, 20 nt, Human
aauuauuuugguacuuuuau

SEQ ID NO: 2417814 - RNA, 17 nt, Human
aauuauuuuuacaguuc

SEQ ID NO: 2417815 - RNA, 14 nt, Human
aauucaaaaagugu

SEQ ID NO: 2417816 - RNA, 15 nt, Human
aauucaaaaaguguu

SEQ ID NO: 2417817 - RNA, 18 nt, Human
aauucaaagcucuauuaa

SEQ ID NO: 2417818 - RNA, 14 nt, Human
aauucaaagcucua

SEQ ID NO: 2417819 - RNA, 20 nt, Human
aauucaaacuggggccucca

SEQ ID NO: 2417820 - RNA, 16 nt, Human
aauucaaaaaguguuu

SEQ ID NO: 2417821 - RNA, 18 nt, Human
aauuagugcuaaguguga

SEQ ID NO: 2417822 - RNA, 14 nt, Human
aauuagugcuaagu

SEQ ID NO: 2417823 - RNA, 21 nt, Human
aauuauuauuuauauauguau

SEQ ID NO: 2417824 - RNA, 20 nt, Human
aauuagugcuaagugugaac

SEQ ID NO: 2417825 - RNA, 12 nt, Human
aauuauuauuug

SEQ ID NO: 2417826 - RNA, 22 nt, Human
aauuauuauuuauauauguauu

SEQ ID NO: 2417827 - RNA, 16 nt, Human
aauuauuauuuggccc

SEQ ID NO: 2417828 - RNA, 16 nt, Human
aauuauuauuuguguu

SEQ ID NO: 2417829 - RNA, 15 nt, Human
aauuauuauuugugu

SEQ ID NO: 2417830 - RNA, 18 nt, Human
aauuauuauuuguguuuu

SEQ ID NO: 2417831 - RNA, 17 nt, Human
aauuagggguugcuaag

SEQ ID NO: 2417832 - RNA, 20 nt, Human
aauuagggguugcuaagaag

SEQ ID NO: 2417833 - RNA, 17 nt, Human
aauuaguauuuauuuaa

SEQ ID NO: 2417834 - RNA, 18 nt, Human
aauuaguauuuauuuaau

SEQ ID NO: 2417835 - RNA, 17 nt, Human
aauuaguaacauguguu

SEQ ID NO: 2417836 - RNA, 16 nt, Human
aauuagguuuuguaca

SEQ ID NO: 2417837 - RNA, 17 nt, Human
aauuagguuuuguacaa

SEQ ID NO: 2417838 - RNA, 19 nt, Human
aauuaagaaggcaaaaaug

SEQ ID NO: 2417839 - RNA, 23 nt, Human
aauuaagaaggcaaaaauguaaa

SEQ ID NO: 2417840 - RNA, 15 nt, Human
aauuaauaaucuuau

SEQ ID NO: 2417841 - RNA, 14 nt, Human
aauuaagaaggcaa

SEQ ID NO: 2417842 - RNA, 16 nt, Human
aauuaagaaggcaaaa

SEQ ID NO: 2417843 - RNA, 13 nt, Human
aauuaagaaggca

SEQ ID NO: 2417844 - RNA, 16 nt, Human
aauuaagaagaaacua

SEQ ID NO: 2417845 - RNA, 21 nt, Human
aauuaagaaaggauaaaguug

SEQ ID NO: 2417846 - RNA, 17 nt, Human
aauuaacuugaguuuua

SEQ ID NO: 2417847 - RNA, 15 nt, Human
aauuaacuugaguuu

SEQ ID NO: 2417848 - RNA, 11 nt, Human
aauuaacuuga

SEQ ID NO: 2417849 - RNA, 20 nt, Human
aauuaagaaaggauaaaguu

SEQ ID NO: 2417850 - RNA, 12 nt, Human
aauuaagaagaa

SEQ ID NO: 2417851 - RNA, 17 nt, Human
aauuaauuggcagcaga

SEQ ID NO: 2417852 - RNA, 13 nt, Human
aauuaauuggcag

SEQ ID NO: 2417853 - RNA, 18 nt, Human
aauuaauuggcagcagau

SEQ ID NO: 2417854 - RNA, 17 nt, Human
aauuaaugaaauaucug

SEQ ID NO: 2417855 - RNA, 16 nt, Human
aauuaaugaaauaucu

SEQ ID NO: 2417856 - RNA, 19 nt, Human
aauuaaugaaauaucugua

SEQ ID NO: 2417857 - RNA, 13 nt, Human
aauuaaugacaga

SEQ ID NO: 2417858 - RNA, 16 nt, Human
aauuaaucaugaaugu

SEQ ID NO: 2417859 - RNA, 13 nt, Human
aauuaauagcuuu

SEQ ID NO: 2417860 - RNA, 21 nt, Human
aauuaauaucccuacauguau

SEQ ID NO: 2417861 - RNA, 22 nt, Human
aauuaaucugggccagaauuuc

SEQ ID NO: 2417862 - RNA, 14 nt, Human
aauuaauagcuuuu

SEQ ID NO: 2417863 - RNA, 19 nt, Human
aauuaauaucccuacaugu

SEQ ID NO: 2417864 - RNA, 13 nt, Human
uacauucuguuaa

SEQ ID NO: 2417865 - RNA, 18 nt, Human
uaccaccagucugacugu

SEQ ID NO: 2417866 - RNA, 17 nt, Human
uacauuguaaauaguau

SEQ ID NO: 2417867 - RNA, 17 nt, Human
uacauugaauuagaaac

SEQ ID NO: 2417868 - RNA, 13 nt, Human
uacauguauuugu

SEQ ID NO: 2417869 - RNA, 19 nt, Human
uacaugugccgaaugugca

SEQ ID NO: 2417870 - RNA, 17 nt, Human
uacaugugccgaaugug

SEQ ID NO: 2417871 - RNA, 22 nt, Human
uacauguauugcacauuguaaa

SEQ ID NO: 2417872 - RNA, 21 nt, Human
uacauguauugcacauuguaa

SEQ ID NO: 2417873 - RNA, 20 nt, Human
uacauguauugcacauugua

SEQ ID NO: 2417874 - RNA, 19 nt, Human
uacauguauugcacauugu

SEQ ID NO: 2417875 - RNA, 20 nt, Human
uacaugugccgaaugugcag

SEQ ID NO: 2417876 - RNA, 18 nt, Human
uacauguguagccugugc

SEQ ID NO: 2417877 - RNA, 19 nt, Human
uacauguguagccugugca

SEQ ID NO: 2417878 - RNA, 14 nt, Human
uacaugugguuuau

SEQ ID NO: 2417879 - RNA, 16 nt, Human
uacauguguagccugu

SEQ ID NO: 2417880 - RNA, 16 nt, Human
uacauguggcccaaca

SEQ ID NO: 2417881 - RNA, 13 nt, Human
uacaugugggagc

SEQ ID NO: 2417882 - RNA, 16 nt, Human
aauguugaaaagucaa

SEQ ID NO: 2417883 - RNA, 13 nt, Human
aauguugaaaagu

SEQ ID NO: 2417884 - RNA, 12 nt, Human
aauguugaaaag

SEQ ID NO: 2417885 - RNA, 21 nt, Human
aauguucucucuucuccaccu

SEQ ID NO: 2417886 - RNA, 21 nt, Human
aauguucugaauaauuucuua

SEQ ID NO: 2417887 - RNA, 12 nt, Human
aauguucugaca

SEQ ID NO: 2417888 - RNA, 14 nt, Human
aauguucugacauu

SEQ ID NO: 2417889 - RNA, 15 nt, Human
aauguucugacauua

SEQ ID NO: 2417890 - RNA, 17 nt, Human
aauguucugacauuaac

SEQ ID NO: 2417891 - RNA, 19 nt, Human
aauguucugacauuaacag

SEQ ID NO: 2417892 - RNA, 20 nt, Human
aauguucugacauuaacagu

SEQ ID NO: 2417893 - RNA, 19 nt, Human
aauguugaaaagucaaacu

SEQ ID NO: 2417894 - RNA, 12 nt, Human
aauuaaccuggu

SEQ ID NO: 2417895 - RNA, 17 nt, Human
aauuaaccaaaaaaguu

SEQ ID NO: 2417896 - RNA, 20 nt, Human
aauuaacauugggaaaucuu

SEQ ID NO: 2417897 - RNA, 11 nt, Human
aauuaacuuuu

SEQ ID NO: 2417898 - RNA, 18 nt, Human
aauuaaccuggugcugga

SEQ ID NO: 2417899 - RNA, 13 nt, Human
aauuaaccuggug

SEQ ID NO: 2417900 - RNA, 14 nt, Human
aauuaaccuggugc

SEQ ID NO: 2417901 - RNA, 15 nt, Human
aauuaaccuggugcu

SEQ ID NO: 2417902 - RNA, 16 nt, Human
aauuaaccuggugcug

SEQ ID NO: 2417903 - RNA, 16 nt, Human
aauguuaaaauguauu

SEQ ID NO: 2417904 - RNA, 15 nt, Human
aauguuaaaauguau

SEQ ID NO: 2417905 - RNA, 13 nt, Human
aauguguuucugu

SEQ ID NO: 2417906 - RNA, 15 nt, Human
aauguuaaauaaauu

SEQ ID NO: 2417907 - RNA, 13 nt, Human
aauguuaaauaaa

SEQ ID NO: 2417908 - RNA, 14 nt, Human
aauguuaaagucag

SEQ ID NO: 2417909 - RNA, 15 nt, Human
aauguuaaagucagu

SEQ ID NO: 2417910 - RNA, 21 nt, Human
aauguuaaauuuguaaguuuc

SEQ ID NO: 2417911 - RNA, 18 nt, Human
aauguuaaauuuguaagu

SEQ ID NO: 2417912 - RNA, 17 nt, Human
aauguuaaauuuguaag

SEQ ID NO: 2417913 - RNA, 16 nt, Human
aauguuaaauuuguaa

SEQ ID NO: 2417914 - RNA, 13 nt, Human
aauguuaaauuug

SEQ ID NO: 2417915 - RNA, 12 nt, Human
aauguuaaauuu

SEQ ID NO: 2417916 - RNA, 23 nt, Human
aauguuaaauaaauuguauauuc

SEQ ID NO: 2417917 - RNA, 22 nt, Human
aauguuaaauaaauuguauauu

SEQ ID NO: 2417918 - RNA, 21 nt, Human
aauguuaaauaaauuguauau

SEQ ID NO: 2417919 - RNA, 20 nt, Human
aauguuaaauaaauuguaua

SEQ ID NO: 2417920 - RNA, 18 nt, Human
aauguuaaauaaauugua

SEQ ID NO: 2417921 - RNA, 13 nt, Human
aauguuaagcaga

SEQ ID NO: 2417922 - RNA, 23 nt, Human
aauguuaauucagcacugauuuc

SEQ ID NO: 2417923 - RNA, 22 nt, Human
aauguuaaggaaacucuuaucu

SEQ ID NO: 2417924 - RNA, 18 nt, Human
aauguuaaggaaacucuu

SEQ ID NO: 2417925 - RNA, 22 nt, Human
aauguuaaauuuguaaguuuca

SEQ ID NO: 2417926 - RNA, 21 nt, Human
uacaguaaauaaauuguuuga

SEQ ID NO: 2417927 - RNA, 18 nt, Human
uacaguaaauaaauuguu

SEQ ID NO: 2417928 - RNA, 17 nt, Human
uacaguaaauaaauugu

SEQ ID NO: 2417929 - RNA, 16 nt, Human
uacaguaaauaaauug

SEQ ID NO: 2417930 - RNA, 21 nt, Human
uacauaaugcgugcauaccac

SEQ ID NO: 2417931 - RNA, 23 nt, Human
uacauaaugcgugcauaccacuu

SEQ ID NO: 2417932 - RNA, 13 nt, Human
uacaguaacuuua

SEQ ID NO: 2417933 - RNA, 19 nt, Human
uacauaauuuuuuauucaa

SEQ ID NO: 2417934 - RNA, 22 nt, Human
uacauaauuuuuuauucaaguu

SEQ ID NO: 2417935 - RNA, 24 nt, Human
uacauaaugcgugcauaccacuuu

SEQ ID NO: 2417936 - RNA, 15 nt, Human
uacaguaaauaaauu

SEQ ID NO: 2417937 - RNA, 13 nt, Human
uacaguaaauaaa

SEQ ID NO: 2417938 - RNA, 23 nt, Human
uacagguuacaacagauuuguga

SEQ ID NO: 2417939 - RNA, 21 nt, Human
uacagguuacaacagauuugu

SEQ ID NO: 2417940 - RNA, 18 nt, Human
uacagguuacaacagauu

SEQ ID NO: 2417941 - RNA, 17 nt, Human
uacagguuacaacagau

SEQ ID NO: 2417942 - RNA, 15 nt, Human
uacagguuacaacag

SEQ ID NO: 2417943 - RNA, 13 nt, Human
uacagguuacaac

SEQ ID NO: 2417944 - RNA, 16 nt, Human
uacaggugugagucac

SEQ ID NO: 2417945 - RNA, 18 nt, Human
uacagaugaauguauuua

SEQ ID NO: 2417946 - RNA, 22 nt, Human
uacagaugaauguauuuauuug

SEQ ID NO: 2417947 - RNA, 22 nt, Human
uacauaugaguguggaagccgg

SEQ ID NO: 2417948 - RNA, 16 nt, Human
uacauaugagugugga

SEQ ID NO: 2417949 - RNA, 13 nt, Human
uacauaugaaauu

SEQ ID NO: 2417950 - RNA, 15 nt, Human
uacauauguaaaaua

SEQ ID NO: 2417951 - RNA, 16 nt, Human
uacauauguaaaauaa

SEQ ID NO: 2417952 - RNA, 20 nt, Human
uacauauguaaaauaaaauu

SEQ ID NO: 2417953 - RNA, 20 nt, Human
uacauaucaccucauggccu

SEQ ID NO: 2417954 - RNA, 18 nt, Human
uacauaucaccucauggc

SEQ ID NO: 2417955 - RNA, 12 nt, Human
uacauaucuuua

SEQ ID NO: 2417956 - RNA, 16 nt, Human
uacauaucuuuauuaa

SEQ ID NO: 2417957 - RNA, 22 nt, Human
uacauaucuuuauuaaucacua

SEQ ID NO: 2417958 - RNA, 22 nt, Human
uacauauaagugauugcugguu

SEQ ID NO: 2417959 - RNA, 20 nt, Human
uacaucccuuaccugggaaa

SEQ ID NO: 2417960 - RNA, 21 nt, Human
uacaucccauguaacagaaag

SEQ ID NO: 2417961 - RNA, 20 nt, Human
uacaucccauguaacagaaa

SEQ ID NO: 2417962 - RNA, 19 nt, Human
uacaucccauguaacagaa

SEQ ID NO: 2417963 - RNA, 18 nt, Human
uacaucccauguaacaga

SEQ ID NO: 2417964 - RNA, 22 nt, Human
uacaucccauguaacagaaagg

SEQ ID NO: 2417965 - RNA, 19 nt, Human
uacauccaaagcagacagc

SEQ ID NO: 2417966 - RNA, 20 nt, Human
uacauccaaagcagacagcu

SEQ ID NO: 2417967 - RNA, 17 nt, Human
uacaucccauguaacag

SEQ ID NO: 2417968 - RNA, 16 nt, Human
uacaucccauguaaca

SEQ ID NO: 2417969 - RNA, 23 nt, Human
uacauccaaagcagacagcucca

SEQ ID NO: 2417970 - RNA, 16 nt, Human
uacaucacuugagaca

SEQ ID NO: 2417971 - RNA, 17 nt, Human
uacauauguaaaauaaa

SEQ ID NO: 2417972 - RNA, 13 nt, Human
aauguauaugcac

SEQ ID NO: 2417973 - RNA, 14 nt, Human
aauguauaugcacu

SEQ ID NO: 2417974 - RNA, 19 nt, Human
aauguauguguaaguauuc

SEQ ID NO: 2417975 - RNA, 20 nt, Human
aauguauguguaaguauucu

SEQ ID NO: 2417976 - RNA, 21 nt, Human
aauguauauguuuugugggaa

SEQ ID NO: 2417977 - RNA, 13 nt, Human
aauguaucaggaa

SEQ ID NO: 2417978 - RNA, 14 nt, Human
aauguaucaggaaa

SEQ ID NO: 2417979 - RNA, 15 nt, Human
aaugugaaacuggau

SEQ ID NO: 2417980 - RNA, 22 nt, Human
aaugugaaaaugguccaggaga

SEQ ID NO: 2417981 - RNA, 14 nt, Human
aauguauuauucug

SEQ ID NO: 2417982 - RNA, 16 nt, Human
aauguauuauucugca

SEQ ID NO: 2417983 - RNA, 14 nt, Human
aaugugaaacugga

SEQ ID NO: 2417984 - RNA, 19 nt, Human
aaugugaaaagaaaaauga

SEQ ID NO: 2417985 - RNA, 22 nt, Human
aaugugauuccuuugaagagga

SEQ ID NO: 2417986 - RNA, 21 nt, Human
aaugugauuccuuugaagagg

SEQ ID NO: 2417987 - RNA, 19 nt, Human
aaugugauucuaaugucuu

SEQ ID NO: 2417988 - RNA, 14 nt, Human
aaugugauucuaau

SEQ ID NO: 2417989 - RNA, 20 nt, Human
aaugugauuuacgcucauug

SEQ ID NO: 2417990 - RNA, 22 nt, Human
aaugugcagguuuguuacauag

SEQ ID NO: 2417991 - RNA, 20 nt, Human
aaugugcagguuuguuacau

SEQ ID NO: 2417992 - RNA, 19 nt, Human
aaugugcagguuuguuaca

SEQ ID NO: 2417993 - RNA, 22 nt, Human
aaugugauucuaaugucuucau

SEQ ID NO: 2417994 - RNA, 16 nt, Human
aaugugauuuuucuga

SEQ ID NO: 2417995 - RNA, 18 nt, Human
aaugugcuauacugcaua

SEQ ID NO: 2417996 - RNA, 22 nt, Human
aaugugugugguuuuuuuucua

SEQ ID NO: 2417997 - RNA, 11 nt, Human
aaugugugugu

SEQ ID NO: 2417998 - RNA, 24 nt, Human
aaugugcauucuuuuaaaagacaa

SEQ ID NO: 2417999 - RNA, 23 nt, Human
aaugugcauucuuuuaaaagaca

SEQ ID NO: 2418000 - RNA, 13 nt, Human
aaugugcccccag

SEQ ID NO: 2418001 - RNA, 19 nt, Human
aaugugcuacugauuguuu

SEQ ID NO: 2418002 - RNA, 17 nt, Human
aaugugccuaguucuuu

SEQ ID NO: 2418003 - RNA, 12 nt, Human
aaugcccagccc

SEQ ID NO: 2418004 - RNA, 11 nt, Human
aaugcccagcc

SEQ ID NO: 2418005 - RNA, 12 nt, Human
aaugcuguacau

SEQ ID NO: 2418006 - RNA, 13 nt, Human
aaugcuguacauc

SEQ ID NO: 2418007 - RNA, 15 nt, Human
aaugcuguacaucua

SEQ ID NO: 2418008 - RNA, 17 nt, Human
aaugcuguacaucuauu

SEQ ID NO: 2418009 - RNA, 16 nt, Human
aaugcuguauuuuaaa

SEQ ID NO: 2418010 - RNA, 22 nt, Human
aaugcuguauuagucacagaga

SEQ ID NO: 2418011 - RNA, 20 nt, Human
aaugcuuaucaucuaaagau

SEQ ID NO: 2418012 - RNA, 13 nt, Human
aaugcuguguuaa

SEQ ID NO: 2418013 - RNA, 23 nt, Human
aaugcuguacaucuauuuuggau

SEQ ID NO: 2418014 - RNA, 16 nt, Human
aaugcuguugccucau

SEQ ID NO: 2418015 - RNA, 18 nt, Human
aaugcugguuuuucaguu

SEQ ID NO: 2418016 - RNA, 20 nt, Human
aauggacuaacuugucuuug

SEQ ID NO: 2418017 - RNA, 23 nt, Human
aauggacguguuaugacuccaga

SEQ ID NO: 2418018 - RNA, 14 nt, Human
aauggaaccacucu

SEQ ID NO: 2418019 - RNA, 21 nt, Human
aauggacguguuaugacucca

SEQ ID NO: 2418020 - RNA, 15 nt, Human
aauggaaaggagagg

SEQ ID NO: 2418021 - RNA, 17 nt, Human
aauggaaacugaaugcu

SEQ ID NO: 2418022 - RNA, 21 nt, Human
aauggaaaugggcagagcaga

SEQ ID NO: 2418023 - RNA, 20 nt, Human
aauggaaaugggcagagcag

SEQ ID NO: 2418024 - RNA, 16 nt, Human
aaugcuucaucccuuu

SEQ ID NO: 2418025 - RNA, 23 nt, Human
aaugcuuccuagaaguuacugaa

SEQ ID NO: 2418026 - RNA, 16 nt, Human
aauggaaacugaaugc

SEQ ID NO: 2418027 - RNA, 20 nt, Human
uacaauguauuuauuuaaaa

SEQ ID NO: 2418028 - RNA, 19 nt, Human
uacaauguauuuauuuaaa

SEQ ID NO: 2418029 - RNA, 18 nt, Human
uacaauguauuuauuuaa

SEQ ID NO: 2418030 - RNA, 17 nt, Human
uacaauguauuuauuua

SEQ ID NO: 2418031 - RNA, 14 nt, Human
uacaauguauuuau

SEQ ID NO: 2418032 - RNA, 16 nt, Human
aaugacaacagaagcu

SEQ ID NO: 2418033 - RNA, 22 nt, Human
uacaauguauuuauuuaaaaga

SEQ ID NO: 2418034 - RNA, 14 nt, Human
uacaaugugaacuu

SEQ ID NO: 2418035 - RNA, 15 nt, Human
uacaaugugaacuuu

SEQ ID NO: 2418036 - RNA, 16 nt, Human
uacaaugugaacuuua

SEQ ID NO: 2418037 - RNA, 17 nt, Human
uacaaugugaacuuuau

SEQ ID NO: 2418038 - RNA, 20 nt, Human
uacaaugugaacuuuauuaa

SEQ ID NO: 2418039 - RNA, 21 nt, Human
uacaaugugaacuuuauuaaa

SEQ ID NO: 2418040 - RNA, 21 nt, Human
aaugcacuuuguucuggcucu

SEQ ID NO: 2418041 - RNA, 17 nt, Human
aaugaccuuucaauagg

SEQ ID NO: 2418042 - RNA, 16 nt, Human
aaugaccuuucaauag

SEQ ID NO: 2418043 - RNA, 18 nt, Human
aaugaccuuucaauagga

SEQ ID NO: 2418044 - RNA, 21 nt, Human
uacaaugcugugcccuaaagu

SEQ ID NO: 2418045 - RNA, 20 nt, Human
aaugcagcagggaugcccug

SEQ ID NO: 2418046 - RNA, 22 nt, Human
aaugcagcagggaugcccugga

SEQ ID NO: 2418047 - RNA, 22 nt, Human
uacaaugugaacuuuauuaaau

SEQ ID NO: 2418048 - RNA, 22 nt, Human
aaugcacuuuguucuggcucuu

SEQ ID NO: 2418049 - RNA, 22 nt, Human
aaugccacugccuucgcuucuu

SEQ ID NO: 2418050 - RNA, 14 nt, Human
aaugcagcgugaag

SEQ ID NO: 2418051 - RNA, 12 nt, Human
aaugcagccaga

SEQ ID NO: 2418052 - RNA, 23 nt, Human
aaugcagggauugcugccacuuu

SEQ ID NO: 2418053 - RNA, 22 nt, Human
aaugcagggauugcugccacuu

SEQ ID NO: 2418054 - RNA, 22 nt, Human
aaugcagcgaaccaauauuugu

SEQ ID NO: 2418055 - RNA, 23 nt, Human
aaugccaguaacgcgucuuccug

SEQ ID NO: 2418056 - RNA, 22 nt, Human
aaugccagagacggaagccuuu

SEQ ID NO: 2418057 - RNA, 21 nt, Human
aaugccaguaacgcgucuucc

SEQ ID NO: 2418058 - RNA, 21 nt, Human
aaugccauccucaaacacugc

SEQ ID NO: 2418059 - RNA, 17 nt, Human
aaugccauccucaaaca

SEQ ID NO: 2418060 - RNA, 15 nt, Human
aaugccaucaucucc

SEQ ID NO: 2418061 - RNA, 22 nt, Human
aaugccauccucaaacacugca

SEQ ID NO: 2418062 - RNA, 16 nt, Human
aaugccauuaucccug

SEQ ID NO: 2418063 - RNA, 21 nt, Human
aaugccauggacagaagaagg

SEQ ID NO: 2418064 - RNA, 20 nt, Human
uacagauccccaagccuggc

SEQ ID NO: 2418065 - RNA, 19 nt, Human
uacagauagucaaaccaua

SEQ ID NO: 2418066 - RNA, 23 nt, Human
uacagaggucucugccggcucuu

SEQ ID NO: 2418067 - RNA, 20 nt, Human
uacagaggucucugccggcu

SEQ ID NO: 2418068 - RNA, 18 nt, Human
uacagacacuaaguuaua

SEQ ID NO: 2418069 - RNA, 16 nt, Human
uacagagugauagccu

SEQ ID NO: 2418070 - RNA, 13 nt, Human
uacagacguaugc

SEQ ID NO: 2418071 - RNA, 19 nt, Human
uacagacaaagcguggugg

SEQ ID NO: 2418072 - RNA, 17 nt, Human
uacacguguccuguagu

SEQ ID NO: 2418073 - RNA, 13 nt, Human
uacacguguccug

SEQ ID NO: 2418074 - RNA, 22 nt, Human
uacagacaacaaaccuguuucu

SEQ ID NO: 2418075 - RNA, 19 nt, Human
uacagaccgaacuguugua

SEQ ID NO: 2418076 - RNA, 20 nt, Human
uacagaccgaacuguuguau

SEQ ID NO: 2418077 - RNA, 21 nt, Human
uacagaccgaacuguuguaua

SEQ ID NO: 2418078 - RNA, 23 nt, Human
uacagaccgaacuguuguauaaa

SEQ ID NO: 2418079 - RNA, 19 nt, Human
uacagacacuaaguuauag

SEQ ID NO: 2418080 - RNA, 14 nt, Human
uacagacacuaagu

SEQ ID NO: 2418081 - RNA, 13 nt, Human
uacagacacuaag

SEQ ID NO: 2418082 - RNA, 11 nt, Human
uacagacacua

SEQ ID NO: 2418083 - RNA, 21 nt, Human
uacacauuuuauuuuauuaug

SEQ ID NO: 2418084 - RNA, 22 nt, Human
uacacauuuuauuuuauuaugc

SEQ ID NO: 2418085 - RNA, 19 nt, Human
uacacauuuuauuuuauua

SEQ ID NO: 2418086 - RNA, 16 nt, Human
aauguaacuuuuguaa

SEQ ID NO: 2418087 - RNA, 22 nt, Human
aauguaacuuuuguaagacaaa

SEQ ID NO: 2418088 - RNA, 15 nt, Human
aauguaacuuuugua

SEQ ID NO: 2418089 - RNA, 18 nt, Human
uacacuaagagagaauga

SEQ ID NO: 2418090 - RNA, 14 nt, Human
uacacuaagagaga

SEQ ID NO: 2418091 - RNA, 23 nt, Human
uacacauuuuauuuuauuaugca

SEQ ID NO: 2418092 - RNA, 15 nt, Human
uacacuaaaagguga

SEQ ID NO: 2418093 - RNA, 15 nt, Human
aauggccucaugugg

SEQ ID NO: 2418094 - RNA, 16 nt, Human
aauggccggcuggaaa

SEQ ID NO: 2418095 - RNA, 17 nt, Human
aauggccauuugcuuuu

SEQ ID NO: 2418096 - RNA, 22 nt, Human
aauggccucauguggcuggaag

SEQ ID NO: 2418097 - RNA, 20 nt, Human
aauggccucauguggcugga

SEQ ID NO: 2418098 - RNA, 14 nt, Human
aauggccugccuug

SEQ ID NO: 2418099 - RNA, 20 nt, Human
aauggccugccuugaagcca

SEQ ID NO: 2418100 - RNA, 18 nt, Human
aauggcgugaucucggcu

SEQ ID NO: 2418101 - RNA, 20 nt, Human
aauggcgcagugccucuggu

SEQ ID NO: 2418102 - RNA, 16 nt, Human
aauggcuaauucccag

SEQ ID NO: 2418103 - RNA, 20 nt, Human
aauggcgucuggaaguccaa

SEQ ID NO: 2418104 - RNA, 19 nt, Human
aauggcgugaacccgggag

SEQ ID NO: 2418105 - RNA, 19 nt, Human
aauggcgcagugccucugg

SEQ ID NO: 2418106 - RNA, 18 nt, Human
aauggcgcagugccucug

SEQ ID NO: 2418107 - RNA, 17 nt, Human
aauggccuccucccuua

SEQ ID NO: 2418108 - RNA, 22 nt, Human
aauggccugccuugaagccacu

SEQ ID NO: 2418109 - RNA, 17 nt, Human
aauguaacagucugauc

SEQ ID NO: 2418110 - RNA, 21 nt, Human
aauggcucacuauggugccaa

SEQ ID NO: 2418111 - RNA, 15 nt, Human
aauggcucagaugcc

SEQ ID NO: 2418112 - RNA, 12 nt, Human
aauggcucagau

SEQ ID NO: 2418113 - RNA, 23 nt, Human
aauggcacaaucucggcucacug

SEQ ID NO: 2418114 - RNA, 23 nt, Human
aauggcaaggcagcccugucuga

SEQ ID NO: 2418115 - RNA, 21 nt, Human
aauggcaaggcagcccugucu

SEQ ID NO: 2418116 - RNA, 21 nt, Human
aauggauuugaugcuguuuga

SEQ ID NO: 2418117 - RNA, 22 nt, Human
aauggauuggauuauuuaauaa

SEQ ID NO: 2418118 - RNA, 23 nt, Human
aauggauuggauuauuuaauaac

SEQ ID NO: 2418119 - RNA, 23 nt, Human
aauggacuggaaggggaagggac

SEQ ID NO: 2418120 - RNA, 17 nt, Human
aauggacuggaagggga

SEQ ID NO: 2418121 - RNA, 13 nt, Human
aauggaaaggaga

SEQ ID NO: 2418122 - RNA, 14 nt, Human
aauggacucaaacu

SEQ ID NO: 2418123 - RNA, 16 nt, Human
aauggcagccuuggca

SEQ ID NO: 2418124 - RNA, 19 nt, Human
aauggcacagcccaaagaa

SEQ ID NO: 2418125 - RNA, 12 nt, Human
aauggcagccuu

SEQ ID NO: 2418126 - RNA, 20 nt, Human
aauggcacagcccaaagaag

SEQ ID NO: 2418127 - RNA, 17 nt, Human
aauggcacagcccaaag

SEQ ID NO: 2418128 - RNA, 21 nt, Human
uaauauuuaugucuauuuaag

SEQ ID NO: 2418129 - RNA, 16 nt, Human
uaauauuuauauauuu

SEQ ID NO: 2418130 - RNA, 23 nt, Human
uaauauuuaugucuauuuaagcc

SEQ ID NO: 2418131 - RNA, 17 nt, Human
uaauauuuauugcuuua

SEQ ID NO: 2418132 - RNA, 16 nt, Human
uaauauuuauugcuuu

SEQ ID NO: 2418133 - RNA, 15 nt, Human
uaauauuuauugcuu

SEQ ID NO: 2418134 - RNA, 14 nt, Human
uaauauuuauugcu

SEQ ID NO: 2418135 - RNA, 20 nt, Human
uaauauuuauugcuuuauaa

SEQ ID NO: 2418136 - RNA, 18 nt, Human
uaauauuuauugcuuuau

SEQ ID NO: 2418137 - RNA, 14 nt, Human
uaauauuugcugac

SEQ ID NO: 2418138 - RNA, 22 nt, Human
uaauagcggguuacuuucacau

SEQ ID NO: 2418139 - RNA, 19 nt, Human
uaauagcggguuacuuuca

SEQ ID NO: 2418140 - RNA, 18 nt, Human
uaauagacaauuuauuau

SEQ ID NO: 2418141 - RNA, 22 nt, Human
uaauagacaauuuauuauggca

SEQ ID NO: 2418142 - RNA, 21 nt, Human
uaauagagcaaaauugaugug

SEQ ID NO: 2418143 - RNA, 12 nt, Human
uaauagagcaaa

SEQ ID NO: 2418144 - RNA, 18 nt, Human
uaauacaccacuacauuc

SEQ ID NO: 2418145 - RNA, 19 nt, Human
uaauacaccacuacauucu

SEQ ID NO: 2418146 - RNA, 14 nt, Human
uaauagacaauuua

SEQ ID NO: 2418147 - RNA, 16 nt, Human
uaauagacaauuuauu

SEQ ID NO: 2418148 - RNA, 16 nt, Human
uaauacaccacuacau

SEQ ID NO: 2418149 - RNA, 14 nt, Human
uaauacaccacuac

SEQ ID NO: 2418150 - RNA, 15 nt, Human
aaucuuaucaugguc

SEQ ID NO: 2418151 - RNA, 21 nt, Human
aaucuuaucauggucucaguc

SEQ ID NO: 2418152 - RNA, 15 nt, Human
aaucuuauauuccau

SEQ ID NO: 2418153 - RNA, 18 nt, Human
uaaucuuuucacaaauaa

SEQ ID NO: 2418154 - RNA, 17 nt, Human
uaaucuuuucacaaaua

SEQ ID NO: 2418155 - RNA, 19 nt, Human
uaaucuuuucacaaauaaa

SEQ ID NO: 2418156 - RNA, 23 nt, Human
uaaucuuucuuuaccugagacca

SEQ ID NO: 2418157 - RNA, 16 nt, Human
uaaucuuuucacaaau

SEQ ID NO: 2418158 - RNA, 15 nt, Human
uaaucuuuucacaaa

SEQ ID NO: 2418159 - RNA, 22 nt, Human
uaaucuuuggguaacuucaaaa

SEQ ID NO: 2418160 - RNA, 20 nt, Human
uaauccccaguaaaauugcc

SEQ ID NO: 2418161 - RNA, 18 nt, Human
uaauccccaguaaaauug

SEQ ID NO: 2418162 - RNA, 17 nt, Human
uaauccccaguaaaauu

SEQ ID NO: 2418163 - RNA, 20 nt, Human
uaaucccagcuacuugggaa

SEQ ID NO: 2418164 - RNA, 20 nt, Human
uaaucccagcuacucaggag

SEQ ID NO: 2418165 - RNA, 21 nt, Human
uaaucuuucuuuaccugagac

SEQ ID NO: 2418166 - RNA, 18 nt, Human
uaaucuuucuuuaccuga

SEQ ID NO: 2418167 - RNA, 12 nt, Human
uaaucuuugggu

SEQ ID NO: 2418168 - RNA, 19 nt, Human
uaaugaaguuugaauguua

SEQ ID NO: 2418169 - RNA, 20 nt, Human
uaaugaaguuugaauguuaa

SEQ ID NO: 2418170 - RNA, 22 nt, Human
uaaugaaguuugaauguuaaau

SEQ ID NO: 2418171 - RNA, 21 nt, Human
uaaugaaguuugaauguuaaa

SEQ ID NO: 2418172 - RNA, 13 nt, Human
uaaugaaaauguc

SEQ ID NO: 2418173 - RNA, 14 nt, Human
uaaugaaaauguca

SEQ ID NO: 2418174 - RNA, 15 nt, Human
uaaugaaaaugucag

SEQ ID NO: 2418175 - RNA, 18 nt, Human
uaaugaaucuaagcagca

SEQ ID NO: 2418176 - RNA, 17 nt, Human
uaaugaaugaaacauuu

SEQ ID NO: 2418177 - RNA, 18 nt, Human
uaauccaggcagauccag

SEQ ID NO: 2418178 - RNA, 19 nt, Human
uaauccaggcagauccagg

SEQ ID NO: 2418179 - RNA, 17 nt, Human
uaauccaggcagaucca

SEQ ID NO: 2418180 - RNA, 11 nt, Human
uaaucagccuc

SEQ ID NO: 2418181 - RNA, 19 nt, Human
uaaucacuuuuuuccacau

SEQ ID NO: 2418182 - RNA, 18 nt, Human
uaaucacuuuuuuccaca

SEQ ID NO: 2418183 - RNA, 20 nt, Human
uaaucagcaagaauuugauc

SEQ ID NO: 2418184 - RNA, 21 nt, Human
uaaucagcaagaauuugaucg

SEQ ID NO: 2418185 - RNA, 21 nt, Human
uaaucccagcaugcugagauu

SEQ ID NO: 2418186 - RNA, 19 nt, Human
uaaucccagcacuuuggga

SEQ ID NO: 2418187 - RNA, 19 nt, Human
uaaucccagcuacuuggga

SEQ ID NO: 2418188 - RNA, 22 nt, Human
uaauccaggcagauccaggacu

SEQ ID NO: 2418189 - RNA, 23 nt, Human
uaauccaggcagauccaggacua

SEQ ID NO: 2418190 - RNA, 16 nt, Human
uaaucccagcacuuug

SEQ ID NO: 2418191 - RNA, 16 nt, Human
uaaucacuuuuuucca

SEQ ID NO: 2418192 - RNA, 17 nt, Human
uaaucacuuuuuuccac

SEQ ID NO: 2418193 - RNA, 13 nt, Human
uaauauuuugcac

SEQ ID NO: 2418194 - RNA, 14 nt, Human
uaauauuuuuaauu

SEQ ID NO: 2418195 - RNA, 18 nt, Human
uaaucacgcuuuccugaa

SEQ ID NO: 2418196 - RNA, 17 nt, Human
uaaucacgcuuuccuga

SEQ ID NO: 2418197 - RNA, 15 nt, Human
uaauauuuuuaauua

SEQ ID NO: 2418198 - RNA, 18 nt, Human
aaugaaacccccacacac

SEQ ID NO: 2418199 - RNA, 19 nt, Human
aaugaaacccccacacaca

SEQ ID NO: 2418200 - RNA, 14 nt, Human
aaugaaacuuggau

SEQ ID NO: 2418201 - RNA, 17 nt, Human
aaugaaaccugugucuc

SEQ ID NO: 2418202 - RNA, 16 nt, Human
aaugaaagacuguaca

SEQ ID NO: 2418203 - RNA, 17 nt, Human
aaugaaagacuguacaa

SEQ ID NO: 2418204 - RNA, 20 nt, Human
aaugaaacaccuucucugga

SEQ ID NO: 2418205 - RNA, 17 nt, Human
aaugaaacaccuucucu

SEQ ID NO: 2418206 - RNA, 14 nt, Human
aaugaaacccccac

SEQ ID NO: 2418207 - RNA, 19 nt, Human
aaugaaacacucaguuguu

SEQ ID NO: 2418208 - RNA, 17 nt, Human
aaugaaacauuuuguca

SEQ ID NO: 2418209 - RNA, 16 nt, Human
aaugaaacaccuucuc

SEQ ID NO: 2418210 - RNA, 16 nt, Human
aaugaaaaugucuugu

SEQ ID NO: 2418211 - RNA, 20 nt, Human
aaugaaaauuguauguuaag

SEQ ID NO: 2418212 - RNA, 15 nt, Human
aaugaaaaugucuug

SEQ ID NO: 2418213 - RNA, 18 nt, Human
aaucuuuauugagaaaga

SEQ ID NO: 2418214 - RNA, 15 nt, Human
aaucuuuauugagaa

SEQ ID NO: 2418215 - RNA, 22 nt, Human
aaugaauggcuaagcaaaaugu

SEQ ID NO: 2418216 - RNA, 20 nt, Human
aaugaaacccccacacacac

SEQ ID NO: 2418217 - RNA, 17 nt, Human
aaugaaugcauaaaaug

SEQ ID NO: 2418218 - RNA, 13 nt, Human
aaugaaugucagu

SEQ ID NO: 2418219 - RNA, 19 nt, Human
aaugaauggacucaaacug

SEQ ID NO: 2418220 - RNA, 12 nt, Human
aaugaaugaccu

SEQ ID NO: 2418221 - RNA, 17 nt, Human
aaugaauuaaauaaacc

SEQ ID NO: 2418222 - RNA, 16 nt, Human
aaugaauguguguggu

SEQ ID NO: 2418223 - RNA, 13 nt, Human
aaugaaugugugu

SEQ ID NO: 2418224 - RNA, 23 nt, Human
aaugaauguuuacacucuuugua

SEQ ID NO: 2418225 - RNA, 22 nt, Human
aaugaaugucagugugacugau

SEQ ID NO: 2418226 - RNA, 15 nt, Human
aaugacaacagaagc

SEQ ID NO: 2418227 - RNA, 14 nt, Human
aaugacaacagaag

SEQ ID NO: 2418228 - RNA, 13 nt, Human
aaugacaacagaa

SEQ ID NO: 2418229 - RNA, 20 nt, Human
aaugaaugugugugguuuuu

SEQ ID NO: 2418230 - RNA, 13 nt, Human
aaugaauuuuguu

SEQ ID NO: 2418231 - RNA, 17 nt, Human
aaugaauuuuuaugaua

SEQ ID NO: 2418232 - RNA, 15 nt, Human
aaugaccuuucaaua

SEQ ID NO: 2418233 - RNA, 19 nt, Human
uaauguguauuacaaauau

SEQ ID NO: 2418234 - RNA, 21 nt, Human
uaaugucuucauuucauugua

SEQ ID NO: 2418235 - RNA, 19 nt, Human
uaaugucuucauuucauug

SEQ ID NO: 2418236 - RNA, 16 nt, Human
uaaugugguuauuucu

SEQ ID NO: 2418237 - RNA, 18 nt, Human
uaauguuaaauuuguaag

SEQ ID NO: 2418238 - RNA, 17 nt, Human
uaauguuaaauuuguaa

SEQ ID NO: 2418239 - RNA, 16 nt, Human
uaauguuaaauuugua

SEQ ID NO: 2418240 - RNA, 13 nt, Human
uaauguuaaauuu

SEQ ID NO: 2418241 - RNA, 22 nt, Human
uaauguuaaauuuguaaguuuc

SEQ ID NO: 2418242 - RNA, 20 nt, Human
uaauguuaaauuuguaaguu

SEQ ID NO: 2418243 - RNA, 15 nt, Human
uaauguuaauucagc

SEQ ID NO: 2418244 - RNA, 11 nt, Human
uaauguuacug

SEQ ID NO: 2418245 - RNA, 16 nt, Human
aaucuuuaauuuuaca

SEQ ID NO: 2418246 - RNA, 15 nt, Human
aaucuuuaauuuuac

SEQ ID NO: 2418247 - RNA, 14 nt, Human
aaucuuuauugaga

SEQ ID NO: 2418248 - RNA, 22 nt, Human
aaucuuuagagaaguauacaua

SEQ ID NO: 2418249 - RNA, 21 nt, Human
aaucuuuagagaaguauacau

SEQ ID NO: 2418250 - RNA, 14 nt, Human
uaauguuacugauc

SEQ ID NO: 2418251 - RNA, 12 nt, Human
uaauguuacuga

SEQ ID NO: 2418252 - RNA, 13 nt, Human
uaauguuacugau

SEQ ID NO: 2418253 - RNA, 15 nt, Human
uaaugaaugcauaaa

SEQ ID NO: 2418254 - RNA, 18 nt, Human
uaauguaauaacugugaa

SEQ ID NO: 2418255 - RNA, 15 nt, Human
uaauguacaucuggc

SEQ ID NO: 2418256 - RNA, 16 nt, Human
uaauguagccauggga

SEQ ID NO: 2418257 - RNA, 13 nt, Human
uaauguacugcau

SEQ ID NO: 2418258 - RNA, 14 nt, Human
uaauguagccaugg

SEQ ID NO: 2418259 - RNA, 18 nt, Human
uaaugucacaggcagguc

SEQ ID NO: 2418260 - RNA, 15 nt, Human
uaaugucaccaccuu

SEQ ID NO: 2418261 - RNA, 21 nt, Human
uaaugucaccaccuucccagc

SEQ ID NO: 2418262 - RNA, 22 nt, Human
uaaugucaccaccuucccagcu

SEQ ID NO: 2418263 - RNA, 19 nt, Human
uaaugucucugugagacuc

SEQ ID NO: 2418264 - RNA, 11 nt, Human
uaaugucucug

SEQ ID NO: 2418265 - RNA, 17 nt, Human
uaaugucuucauuucau

SEQ ID NO: 2418266 - RNA, 13 nt, Human
uaaugucuucauu

SEQ ID NO: 2418267 - RNA, 17 nt, Human
aaucuguuugaucccug

SEQ ID NO: 2418268 - RNA, 20 nt, Human
aaucuguguacaaagaaaua

SEQ ID NO: 2418269 - RNA, 17 nt, Human
aaucuguguacaaagaa

SEQ ID NO: 2418270 - RNA, 12 nt, Human
aaucugugauga

SEQ ID NO: 2418271 - RNA, 13 nt, Human
aaucuguguacaa

SEQ ID NO: 2418272 - RNA, 19 nt, Human
aaucuguguacaaagaaau

SEQ ID NO: 2418273 - RNA, 18 nt, Human
aaucuguguacaaagaaa

SEQ ID NO: 2418274 - RNA, 19 nt, Human
aaucuuauaauuuaaaaua

SEQ ID NO: 2418275 - RNA, 18 nt, Human
aaucuuacagcugggugg

SEQ ID NO: 2418276 - RNA, 14 nt, Human
aaucuuacagcugg

SEQ ID NO: 2418277 - RNA, 23 nt, Human
aaucuuacagcuggguggcacug

SEQ ID NO: 2418278 - RNA, 19 nt, Human
aaucuuaggggagagcuuu

SEQ ID NO: 2418279 - RNA, 16 nt, Human
aaucugggccagaauu

SEQ ID NO: 2418280 - RNA, 17 nt, Human
aaucugggccagaauuu

SEQ ID NO: 2418281 - RNA, 19 nt, Human
aaucuggagagcuagaacc

SEQ ID NO: 2418282 - RNA, 16 nt, Human
aaucugggaagggaag

SEQ ID NO: 2418283 - RNA, 17 nt, Human
aaucuaccuucuguagu

SEQ ID NO: 2418284 - RNA, 16 nt, Human
aaucuaccuucuguag

SEQ ID NO: 2418285 - RNA, 15 nt, Human
aaucuaccuucugua

SEQ ID NO: 2418286 - RNA, 17 nt, Human
aaucuacccaaaggaua

SEQ ID NO: 2418287 - RNA, 16 nt, Human
aaucuacccaaaggau

SEQ ID NO: 2418288 - RNA, 15 nt, Human
aaucuacccaaagga

SEQ ID NO: 2418289 - RNA, 14 nt, Human
aaucuggagugagg

SEQ ID NO: 2418290 - RNA, 15 nt, Human
aaucuggagaccagg

SEQ ID NO: 2418291 - RNA, 19 nt, Human
aaucuacacuccagugaga

SEQ ID NO: 2418292 - RNA, 20 nt, Human
aaucuaauauuaaaaauaug

SEQ ID NO: 2418293 - RNA, 20 nt, Human
aaucuaaccacaucaauauu

SEQ ID NO: 2418294 - RNA, 19 nt, Human
aaucuaauauuaaaaauau

SEQ ID NO: 2418295 - RNA, 17 nt, Human
aaucuaauauuaaaaau

SEQ ID NO: 2418296 - RNA, 16 nt, Human
aaucuaauauuaaaaa

SEQ ID NO: 2418297 - RNA, 12 nt, Human
aauccgcccauc

SEQ ID NO: 2418298 - RNA, 13 nt, Human
aauccgaaccucc

SEQ ID NO: 2418299 - RNA, 19 nt, Human
aauccgaaccuccucugug

SEQ ID NO: 2418300 - RNA, 21 nt, Human
aauccgaccacuaauugccaa

SEQ ID NO: 2418301 - RNA, 12 nt, Human
aauccgaaccuc

SEQ ID NO: 2418302 - RNA, 23 nt, Human
aaucccuuuauuacccccuccuu

SEQ ID NO: 2418303 - RNA, 19 nt, Human
aaucccuuuauuacccccu

SEQ ID NO: 2418304 - RNA, 23 nt, Human
aaucccuguuuaauauuuaaaca

SEQ ID NO: 2418305 - RNA, 17 nt, Human
aaucccuguuuaauauu

SEQ ID NO: 2418306 - RNA, 17 nt, Human
aaucauuaggugugacu

SEQ ID NO: 2418307 - RNA, 23 nt, Human
aaucauuaggugugacugaauuu

SEQ ID NO: 2418308 - RNA, 15 nt, Human
aaucauuagguguga

SEQ ID NO: 2418309 - RNA, 22 nt, Human
aaucaugaauguguaacacagu

SEQ ID NO: 2418310 - RNA, 16 nt, Human
aaucaugaaauuacuu

SEQ ID NO: 2418311 - RNA, 18 nt, Human
aaucgaggaaccagagcc

SEQ ID NO: 2418312 - RNA, 13 nt, Human
aaucgauuggcuu

SEQ ID NO: 2418313 - RNA, 17 nt, Human
aaucuaagugauauaaa

SEQ ID NO: 2418314 - RNA, 15 nt, Human
aaucuaagugauaua

SEQ ID NO: 2418315 - RNA, 22 nt, Human
aaucuaagcagcauuucugaag

SEQ ID NO: 2418316 - RNA, 14 nt, Human
aaucgauuggcuuu

SEQ ID NO: 2418317 - RNA, 13 nt, Human
aaucgauggggga

SEQ ID NO: 2418318 - RNA, 15 nt, Human
aaucgaccugccucg

SEQ ID NO: 2418319 - RNA, 17 nt, Human
aaucgaggaaccagagc

SEQ ID NO: 2418320 - RNA, 19 nt, Human
aaucgaggaaccagagcca

SEQ ID NO: 2418321 - RNA, 20 nt, Human
aauccuuuuucuuuauaaac

SEQ ID NO: 2418322 - RNA, 12 nt, Human
aauccugucuuu

SEQ ID NO: 2418323 - RNA, 13 nt, Human
aauccuuuacugu

SEQ ID NO: 2418324 - RNA, 21 nt, Human
aauccuguccucagcuucuua

SEQ ID NO: 2418325 - RNA, 18 nt, Human
aauccuguccucagcuuc

SEQ ID NO: 2418326 - RNA, 15 nt, Human
aauccuguccucagc

SEQ ID NO: 2418327 - RNA, 19 nt, Human
aauccuggcccucuguguu

SEQ ID NO: 2418328 - RNA, 20 nt, Human
aauccgaaccuccucuguga

SEQ ID NO: 2418329 - RNA, 15 nt, Human
aauccuaaaagaagc

SEQ ID NO: 2418330 - RNA, 14 nt, Human
aauccuggggaaca

SEQ ID NO: 2418331 - RNA, 21 nt, Human
aauccuggggaacauagaacu

SEQ ID NO: 2418332 - RNA, 13 nt, Human
uaaguacuaugua

SEQ ID NO: 2418333 - RNA, 16 nt, Human
uaaguacuauguauca

SEQ ID NO: 2418334 - RNA, 17 nt, Human
uaaguacuauguaucaa

SEQ ID NO: 2418335 - RNA, 20 nt, Human
uaaguaagaaaauauuuugu

SEQ ID NO: 2418336 - RNA, 18 nt, Human
uaaguaccacucaggcca

SEQ ID NO: 2418337 - RNA, 19 nt, Human
uaaguaagcaacagcauaa

SEQ ID NO: 2418338 - RNA, 20 nt, Human
uaaguauucuuauuuaauga

SEQ ID NO: 2418339 - RNA, 21 nt, Human
uaaguauuaugucucuucuga

SEQ ID NO: 2418340 - RNA, 22 nt, Human
uaaguucauauuccauauuuau

SEQ ID NO: 2418341 - RNA, 17 nt, Human
uaaguauuaugucucuu

SEQ ID NO: 2418342 - RNA, 19 nt, Human
uaaguauucuuauuuaaug

SEQ ID NO: 2418343 - RNA, 19 nt, Human
uaaguaaugauaacuggaa

SEQ ID NO: 2418344 - RNA, 19 nt, Human
uaaguaagaaaauauuuug

SEQ ID NO: 2418345 - RNA, 15 nt, Human
uaaguaagaaaauau

SEQ ID NO: 2418346 - RNA, 14 nt, Human
uaaguaagaaaaua

SEQ ID NO: 2418347 - RNA, 13 nt, Human
uaaguaagaaaau

SEQ ID NO: 2418348 - RNA, 12 nt, Human
uaaguaagaaaa

SEQ ID NO: 2418349 - RNA, 13 nt, Human
uaaguaaaugcua

SEQ ID NO: 2418350 - RNA, 16 nt, Human
uaagcuuguauuccuu

SEQ ID NO: 2418351 - RNA, 16 nt, Human
uaagcuuaugucagac

SEQ ID NO: 2418352 - RNA, 14 nt, Human
uaagcuuauuuaau

SEQ ID NO: 2418353 - RNA, 22 nt, Human
uaagcuuugccagcugcugcug

SEQ ID NO: 2418354 - RNA, 21 nt, Human
uaagcuuugccagcugcugcu

SEQ ID NO: 2418355 - RNA, 19 nt, Human
uaagcuuugccagcugcug

SEQ ID NO: 2418356 - RNA, 18 nt, Human
uaagcuuugccagcugcu

SEQ ID NO: 2418357 - RNA, 17 nt, Human
uaaggaaaaaaagacaa

SEQ ID NO: 2418358 - RNA, 18 nt, Human
uaagcuuauuuaauuaaa

SEQ ID NO: 2418359 - RNA, 17 nt, Human
uaagcuuugccagcugc

SEQ ID NO: 2418360 - RNA, 18 nt, Human
uaauaaacacucuugaaa

SEQ ID NO: 2418361 - RNA, 12 nt, Human
uaauaaacacuc

SEQ ID NO: 2418362 - RNA, 13 nt, Human
uaauaaacauucu

SEQ ID NO: 2418363 - RNA, 22 nt, Human
uaauaaacauccuucaagaacu

SEQ ID NO: 2418364 - RNA, 17 nt, Human
uaaguugaauggccugc

SEQ ID NO: 2418365 - RNA, 19 nt, Human
uaaguuccacugagcucca

SEQ ID NO: 2418366 - RNA, 17 nt, Human
uaaguuccacugagcuc

SEQ ID NO: 2418367 - RNA, 15 nt, Human
uaaguuccacugagc

SEQ ID NO: 2418368 - RNA, 14 nt, Human
uaaguuccacugag

SEQ ID NO: 2418369 - RNA, 23 nt, Human
uaaguucuggaugcauuucucug

SEQ ID NO: 2418370 - RNA, 20 nt, Human
uaaguucuggaugcauuucu

SEQ ID NO: 2418371 - RNA, 19 nt, Human
uaaguuuaccuauguaaca

SEQ ID NO: 2418372 - RNA, 15 nt, Human
uaaguuguuugcaug

SEQ ID NO: 2418373 - RNA, 13 nt, Human
uaaguuguuugca

SEQ ID NO: 2418374 - RNA, 17 nt, Human
uaauaaacuuagaauaa

SEQ ID NO: 2418375 - RNA, 23 nt, Human
aaucauaagauauuuuucaugau

SEQ ID NO: 2418376 - RNA, 14 nt, Human
uaauaaacuguguu

SEQ ID NO: 2418377 - RNA, 15 nt, Human
uaauaaacuguguuu

SEQ ID NO: 2418378 - RNA, 19 nt, Human
aaucauaguacucuuugua

SEQ ID NO: 2418379 - RNA, 21 nt, Human
aaucauauaauaaauguacau

SEQ ID NO: 2418380 - RNA, 18 nt, Human
aaucauauaauaaaugua

SEQ ID NO: 2418381 - RNA, 22 nt, Human
aaucauaguacucuuuguagca

SEQ ID NO: 2418382 - RNA, 15 nt, Human
aaucaugaauuaguu

SEQ ID NO: 2418383 - RNA, 12 nt, Human
aaucaugaauua

SEQ ID NO: 2418384 - RNA, 20 nt, Human
aaucaugaagauauuuuucc

SEQ ID NO: 2418385 - RNA, 17 nt, Human
aaucaugaaauaugcau

SEQ ID NO: 2418386 - RNA, 16 nt, Human
aaucaugaaauaugca

SEQ ID NO: 2418387 - RNA, 18 nt, Human
aaucaucugugugaaaau

SEQ ID NO: 2418388 - RNA, 15 nt, Human
aaucauaugauucug

SEQ ID NO: 2418389 - RNA, 14 nt, Human
aaucauaugauucu

SEQ ID NO: 2418390 - RNA, 20 nt, Human
uaagaauaaaauguugaaaa

SEQ ID NO: 2418391 - RNA, 19 nt, Human
uaagaauaaaauguugaaa

SEQ ID NO: 2418392 - RNA, 17 nt, Human
uaagaauaaaauguuga

SEQ ID NO: 2418393 - RNA, 16 nt, Human
uaagaauaaaauguug

SEQ ID NO: 2418394 - RNA, 13 nt, Human
uaagaauauuuga

SEQ ID NO: 2418395 - RNA, 21 nt, Human
uaagaauaaaauguugaaaag

SEQ ID NO: 2418396 - RNA, 18 nt, Human
uaagaagugaaaaucuac

SEQ ID NO: 2418397 - RNA, 24 nt, Human
uaacuuugcuugcaguagauuuuc

SEQ ID NO: 2418398 - RNA, 22 nt, Human
uaacuuugcuugcaguagauuu

SEQ ID NO: 2418399 - RNA, 12 nt, Human
uaacuuugcuug

SEQ ID NO: 2418400 - RNA, 15 nt, Human
uaagaauaaaauguu

SEQ ID NO: 2418401 - RNA, 23 nt, Human
uaagacacugaaaaaucuaagug

SEQ ID NO: 2418402 - RNA, 20 nt, Human
uaagacacugaaaaaucuaa

SEQ ID NO: 2418403 - RNA, 14 nt, Human
uaagaauauuugaa

SEQ ID NO: 2418404 - RNA, 13 nt, Human
uaagacaaauaug

SEQ ID NO: 2418405 - RNA, 14 nt, Human
uaagacacuuuuug

SEQ ID NO: 2418406 - RNA, 12 nt, Human
uaagacauaacg

SEQ ID NO: 2418407 - RNA, 19 nt, Human
uaagacagucccaucaaaa

SEQ ID NO: 2418408 - RNA, 21 nt, Human
uaagacauaacguuuuuccuu

SEQ ID NO: 2418409 - RNA, 20 nt, Human
uaagacauaacguuuuuccu

SEQ ID NO: 2418410 - RNA, 17 nt, Human
uaagacauaacguuuuu

SEQ ID NO: 2418411 - RNA, 16 nt, Human
uaagacauaacguuuu

SEQ ID NO: 2418412 - RNA, 16 nt, Human
uaagacaugauuuccu

SEQ ID NO: 2418413 - RNA, 20 nt, Human
uaagacauacuccuuccauc

SEQ ID NO: 2418414 - RNA, 19 nt, Human
uaacuuggauguagccaug

SEQ ID NO: 2418415 - RNA, 16 nt, Human
uaacuuggagccccag

SEQ ID NO: 2418416 - RNA, 15 nt, Human
uaacuuuaucacauu

SEQ ID NO: 2418417 - RNA, 17 nt, Human
uaacuuuaucacauuau

SEQ ID NO: 2418418 - RNA, 16 nt, Human
uaacuuuauguguaaa

SEQ ID NO: 2418419 - RNA, 15 nt, Human
uaacuuuauguguaa

SEQ ID NO: 2418420 - RNA, 14 nt, Human
uaacuuuaugugua

SEQ ID NO: 2418421 - RNA, 21 nt, Human
uaacuuuaucacauuauuugc

SEQ ID NO: 2418422 - RNA, 16 nt, Human
uaacuuucugaaauaa

SEQ ID NO: 2418423 - RNA, 15 nt, Human
uaacuuucucuauga

SEQ ID NO: 2418424 - RNA, 19 nt, Human
uaacuuucauuaaagcauu

SEQ ID NO: 2418425 - RNA, 23 nt, Human
uaacuuucauuaaagcauuuacu

SEQ ID NO: 2418426 - RNA, 18 nt, Human
uaacuuuauguguaaaua

SEQ ID NO: 2418427 - RNA, 13 nt, Human
uaacuuucagaag

SEQ ID NO: 2418428 - RNA, 23 nt, Human
uaacuuucagaagagaugggcuu

SEQ ID NO: 2418429 - RNA, 23 nt, Human
uaacuucuuauggaauugauuug

SEQ ID NO: 2418430 - RNA, 15 nt, Human
uaacuugcaccucug

SEQ ID NO: 2418431 - RNA, 21 nt, Human
uaacuugaguuuuauuuauuu

SEQ ID NO: 2418432 - RNA, 15 nt, Human
uaacuugaguuuuau

SEQ ID NO: 2418433 - RNA, 22 nt, Human
uaacuugaggguaauaaacuua

SEQ ID NO: 2418434 - RNA, 22 nt, Human
uaacuugagaguagaugguuug

SEQ ID NO: 2418435 - RNA, 14 nt, Human
uaacuucaccauau

SEQ ID NO: 2418436 - RNA, 17 nt, Human
uaacuuccaauuuacau

SEQ ID NO: 2418437 - RNA, 21 nt, Human
uaacuucacauauugauuucc

SEQ ID NO: 2418438 - RNA, 13 nt, Human
uaacuucacauau

SEQ ID NO: 2418439 - RNA, 14 nt, Human
uaacuuaaucaauu

SEQ ID NO: 2418440 - RNA, 16 nt, Human
uaacuuaauaguauuu

SEQ ID NO: 2418441 - RNA, 22 nt, Human
uaacuuaaaagaacauguauau

SEQ ID NO: 2418442 - RNA, 21 nt, Human
uaacuuaaaaauguaaauauu

SEQ ID NO: 2418443 - RNA, 20 nt, Human
uaacuuaaaaauguaaauau

SEQ ID NO: 2418444 - RNA, 23 nt, Human
uaacuuaaaaauguaaauauucu

SEQ ID NO: 2418445 - RNA, 16 nt, Human
uaacuuaaaauauuuu

SEQ ID NO: 2418446 - RNA, 21 nt, Human
uaacuagagcagcccuggagu

SEQ ID NO: 2418447 - RNA, 18 nt, Human
uaacuagagcagcccugg

SEQ ID NO: 2418448 - RNA, 21 nt, Human
uaacuguuauuuauaaucacu

SEQ ID NO: 2418449 - RNA, 19 nt, Human
uaacuuaaaaauguaaaua

SEQ ID NO: 2418450 - RNA, 17 nt, Human
uaacuuaaaaauguaaa

SEQ ID NO: 2418451 - RNA, 18 nt, Human
uaacuuaaaaaaaugaca

SEQ ID NO: 2418452 - RNA, 18 nt, Human
uaacuagaauuuauucaa

SEQ ID NO: 2418453 - RNA, 17 nt, Human
uaacuagaauuuauuca

SEQ ID NO: 2418454 - RNA, 15 nt, Human
uaacuagaauuuauu

SEQ ID NO: 2418455 - RNA, 17 nt, Human
uaacgaccacagggucu

SEQ ID NO: 2418456 - RNA, 14 nt, Human
uaacgacuucaggg

SEQ ID NO: 2418457 - RNA, 23 nt, Human
uaacgacuucagggcagggcucu

SEQ ID NO: 2418458 - RNA, 20 nt, Human
uaacgauaaaagacagugaa

SEQ ID NO: 2418459 - RNA, 21 nt, Human
uaaccuuaccagauuuuuaca

SEQ ID NO: 2418460 - RNA, 18 nt, Human
uaacauggugugcuucuu

SEQ ID NO: 2418461 - RNA, 23 nt, Human
aauaguauuugagaguucuaaau

SEQ ID NO: 2418462 - RNA, 16 nt, Human
aauaguggugugauuu

SEQ ID NO: 2418463 - RNA, 22 nt, Human
aauaguggugugauuuggggau

SEQ ID NO: 2418464 - RNA, 12 nt, Human
aauaguguggaa

SEQ ID NO: 2418465 - RNA, 22 nt, Human
aauaguauuugagaguucuaaa

SEQ ID NO: 2418466 - RNA, 20 nt, Human
aauaguauuugagaguucua

SEQ ID NO: 2418467 - RNA, 16 nt, Human
aauagucaaauugugu

SEQ ID NO: 2418468 - RNA, 21 nt, Human
uaaaauuugcccucccauccc

SEQ ID NO: 2418469 - RNA, 16 nt, Human
uaaaauuugcccuccc

SEQ ID NO: 2418470 - RNA, 13 nt, Human
uaaaauuucaaca

SEQ ID NO: 2418471 - RNA, 17 nt, Human
uaaaauuuaaguaucuu

SEQ ID NO: 2418472 - RNA, 23 nt, Human
uaaaauuuauugcuugauacuuu

SEQ ID NO: 2418473 - RNA, 15 nt, Human
aauauauuuuaagac

SEQ ID NO: 2418474 - RNA, 14 nt, Human
aauauauuuuaaga

SEQ ID NO: 2418475 - RNA, 14 nt, Human
aauaguugagcccc

SEQ ID NO: 2418476 - RNA, 23 nt, Human
aauaguugagccagcagacauug

SEQ ID NO: 2418477 - RNA, 22 nt, Human
aauaguugagccagcagacauu

SEQ ID NO: 2418478 - RNA, 14 nt, Human
aauaguuguugauu

SEQ ID NO: 2418479 - RNA, 15 nt, Human
aauauauuucagaua

SEQ ID NO: 2418480 - RNA, 19 nt, Human
aauaguuuacauguaguag

SEQ ID NO: 2418481 - RNA, 14 nt, Human
aauauauuugugua

SEQ ID NO: 2418482 - RNA, 13 nt, Human
aauauauuugugu

SEQ ID NO: 2418483 - RNA, 14 nt, Human
aauaguguguucug

SEQ ID NO: 2418484 - RNA, 15 nt, Human
aauaguguguucuga

SEQ ID NO: 2418485 - RNA, 17 nt, Human
aauaguguguucugauu

SEQ ID NO: 2418486 - RNA, 19 nt, Human
aauaguguggaaauuaaga

SEQ ID NO: 2418487 - RNA, 20 nt, Human
aauaguguggaaauuaagaa

SEQ ID NO: 2418488 - RNA, 22 nt, Human
aauaguguggaaauuaagaaga

SEQ ID NO: 2418489 - RNA, 13 nt, Human
aauaguguguucu

SEQ ID NO: 2418490 - RNA, 13 nt, Human
aauaguuggcuag

SEQ ID NO: 2418491 - RNA, 21 nt, Human
aauaguugagccagcagacau

SEQ ID NO: 2418492 - RNA, 20 nt, Human
aauaguugagccagcagaca

SEQ ID NO: 2418493 - RNA, 19 nt, Human
aauaguugagccagcagac

SEQ ID NO: 2418494 - RNA, 18 nt, Human
aauaguugagccagcaga

SEQ ID NO: 2418495 - RNA, 16 nt, Human
aauaguugagccagca

SEQ ID NO: 2418496 - RNA, 20 nt, Human
uaacaguuuuccaugaaaac

SEQ ID NO: 2418497 - RNA, 23 nt, Human
uaacauauaauguuguuauuuaa

SEQ ID NO: 2418498 - RNA, 14 nt, Human
uaacauauaauguu

SEQ ID NO: 2418499 - RNA, 13 nt, Human
uaacauauuuacu

SEQ ID NO: 2418500 - RNA, 20 nt, Human
uaacaucuaaaaauagacuu

SEQ ID NO: 2418501 - RNA, 14 nt, Human
uaacaucuaaaaau

SEQ ID NO: 2418502 - RNA, 13 nt, Human
uaacaucugagaa

SEQ ID NO: 2418503 - RNA, 23 nt, Human
uaacauauuuacuaagccacaag

SEQ ID NO: 2418504 - RNA, 22 nt, Human
uaacauauuuacuaagccacaa

SEQ ID NO: 2418505 - RNA, 14 nt, Human
uaacauauuuacua

SEQ ID NO: 2418506 - RNA, 23 nt, Human
uaacauccuuucuauugaaaaau

SEQ ID NO: 2418507 - RNA, 23 nt, Human
uaacauggacaugaucuucuuua

SEQ ID NO: 2418508 - RNA, 18 nt, Human
uaacauggacaugaucuu

SEQ ID NO: 2418509 - RNA, 21 nt, Human
uaacagugcauauuccuuucu

SEQ ID NO: 2418510 - RNA, 21 nt, Human
aauaucaguuacucagcccug

SEQ ID NO: 2418511 - RNA, 19 nt, Human
aauaucaguagaaacucua

SEQ ID NO: 2418512 - RNA, 19 nt, Human
aauaucaguuacucagccc

SEQ ID NO: 2418513 - RNA, 22 nt, Human
aauaucaguuacucagcccugg

SEQ ID NO: 2418514 - RNA, 18 nt, Human
uaacaguucauguuugcu

SEQ ID NO: 2418515 - RNA, 14 nt, Human
uaacaguucauguu

SEQ ID NO: 2418516 - RNA, 13 nt, Human
uaacaguuuucca

SEQ ID NO: 2418517 - RNA, 14 nt, Human
uaacaguuuuccau

SEQ ID NO: 2418518 - RNA, 15 nt, Human
uaacaguuuuccaug

SEQ ID NO: 2418519 - RNA, 16 nt, Human
uaacaguuuuccauga

SEQ ID NO: 2418520 - RNA, 17 nt, Human
uaacaguuuuccaugaa

SEQ ID NO: 2418521 - RNA, 19 nt, Human
uaacaguuuuccaugaaaa

SEQ ID NO: 2418522 - RNA, 21 nt, Human
uaacaguuuuccaugaaaacg

SEQ ID NO: 2418523 - RNA, 22 nt, Human
aauaucacuugucaauaaaauc

SEQ ID NO: 2418524 - RNA, 15 nt, Human
aauaucagacuagug

SEQ ID NO: 2418525 - RNA, 24 nt, Human
aauauauuuguguauuuaacaggg

SEQ ID NO: 2418526 - RNA, 20 nt, Human
aauaucagcaagucucuuua

SEQ ID NO: 2418527 - RNA, 13 nt, Human
aauaucagacuuu

SEQ ID NO: 2418528 - RNA, 20 nt, Human
aauaucacuugucaauaaaa

SEQ ID NO: 2418529 - RNA, 18 nt, Human
aauauauuuuaagacgaa

SEQ ID NO: 2418530 - RNA, 21 nt, Human
aauauauuuguguauuuaaca

SEQ ID NO: 2418531 - RNA, 19 nt, Human
aauauauuuguguauuuaa

SEQ ID NO: 2418532 - RNA, 18 nt, Human
uaagagaaagaaaaugaa

SEQ ID NO: 2418533 - RNA, 13 nt, Human
uaagagaaagaaa

SEQ ID NO: 2418534 - RNA, 15 nt, Human
uaagacuuugggaua

SEQ ID NO: 2418535 - RNA, 15 nt, Human
uaagagaaaugagcu

SEQ ID NO: 2418536 - RNA, 22 nt, Human
uaagacauaacguuuuuccuuu

SEQ ID NO: 2418537 - RNA, 17 nt, Human
uaagacaugauuuccuu

SEQ ID NO: 2418538 - RNA, 19 nt, Human
uaagacaugauuuccuuga

SEQ ID NO: 2418539 - RNA, 20 nt, Human
uaagacuuugggauaggaaa

SEQ ID NO: 2418540 - RNA, 16 nt, Human
aauaugcacacauuuu

SEQ ID NO: 2418541 - RNA, 17 nt, Human
aauaugcacacauuuuu

SEQ ID NO: 2418542 - RNA, 22 nt, Human
aauaugcacacauuuuuuaaau

SEQ ID NO: 2418543 - RNA, 13 nt, Human
uaagagacaguca

SEQ ID NO: 2418544 - RNA, 19 nt, Human
uaagagaauauuuuaagua

SEQ ID NO: 2418545 - RNA, 24 nt, Human
aauaugccccauucaacaucuagu

SEQ ID NO: 2418546 - RNA, 21 nt, Human
aauaugccccauucaacaucu

SEQ ID NO: 2418547 - RNA, 23 nt, Human
aauaugccucuccuuuguauauu

SEQ ID NO: 2418548 - RNA, 21 nt, Human
aauaugccucuccuuuguaua

SEQ ID NO: 2418549 - RNA, 15 nt, Human
aauaugcaguucugc

SEQ ID NO: 2418550 - RNA, 22 nt, Human
aauaugcagugauauggcagaa

SEQ ID NO: 2418551 - RNA, 19 nt, Human
aauaugccucuccuuugua

SEQ ID NO: 2418552 - RNA, 16 nt, Human
aauaugccucuccuuu

SEQ ID NO: 2418553 - RNA, 20 nt, Human
aauaugcaucuaauaaaaaa

SEQ ID NO: 2418554 - RNA, 15 nt, Human
aauauucccuagaaa

SEQ ID NO: 2418555 - RNA, 13 nt, Human
aauauucccaagc

SEQ ID NO: 2418556 - RNA, 17 nt, Human
aauauucccuagaaacu

SEQ ID NO: 2418557 - RNA, 20 nt, Human
aauauuccccuaucucuaga

SEQ ID NO: 2418558 - RNA, 12 nt, Human
aauauuccugaa

SEQ ID NO: 2418559 - RNA, 18 nt, Human
aauauucauaguuuaauu

SEQ ID NO: 2418560 - RNA, 12 nt, Human
aauauuccagag

SEQ ID NO: 2418561 - RNA, 15 nt, Human
aauauuccugcauuu

SEQ ID NO: 2418562 - RNA, 20 nt, Human
aauauucuauaugaauuuaa

SEQ ID NO: 2418563 - RNA, 16 nt, Human
aauauucuauaugaau

SEQ ID NO: 2418564 - RNA, 15 nt, Human
aauauuccugaauga

SEQ ID NO: 2418565 - RNA, 23 nt, Human
aauauucuauuuucauuuucugc

SEQ ID NO: 2418566 - RNA, 19 nt, Human
aauauuuauuuuaauaaug

SEQ ID NO: 2418567 - RNA, 14 nt, Human
aauauuucagauaa

SEQ ID NO: 2418568 - RNA, 19 nt, Human
aauauuuauaaaacuucuc

SEQ ID NO: 2418569 - RNA, 21 nt, Human
aauauuugaauguaugcuuca

SEQ ID NO: 2418570 - RNA, 23 nt, Human
aauauuugaauguaugcuucaua

SEQ ID NO: 2418571 - RNA, 15 nt, Human
aauauuucaagacau

SEQ ID NO: 2418572 - RNA, 14 nt, Human
aauauuucaagaca

SEQ ID NO: 2418573 - RNA, 16 nt, Human
aauauuucaagacauu

SEQ ID NO: 2418574 - RNA, 16 nt, Human
aauauuugaaucuugu

SEQ ID NO: 2418575 - RNA, 14 nt, Human
aauauuugaaugua

SEQ ID NO: 2418576 - RNA, 12 nt, Human
aauauuuagugu

SEQ ID NO: 2418577 - RNA, 15 nt, Human
aauauuuaaacaugg

SEQ ID NO: 2418578 - RNA, 17 nt, Human
aauauuuaagauaguuu

SEQ ID NO: 2418579 - RNA, 18 nt, Human
aauauuuauuuuaauaau

SEQ ID NO: 2418580 - RNA, 20 nt, Human
aauauuuagcaaauaauuuc

SEQ ID NO: 2418581 - RNA, 13 nt, Human
aauauuuauaaaa

SEQ ID NO: 2418582 - RNA, 16 nt, Human
aauauuuauaaaacuu

SEQ ID NO: 2418583 - RNA, 17 nt, Human
aauauuuauaaaacuuc

SEQ ID NO: 2418584 - RNA, 14 nt, Human
aauauuuagcaaau

SEQ ID NO: 2418585 - RNA, 15 nt, Human
aauauuuacauauga

SEQ ID NO: 2418586 - RNA, 20 nt, Human
aauauugagaaagaaacuaa

SEQ ID NO: 2418587 - RNA, 14 nt, Human
aauauuguacaguu

SEQ ID NO: 2418588 - RNA, 16 nt, Human
aauauugagaaagaaa

SEQ ID NO: 2418589 - RNA, 19 nt, Human
aauauugagaaagaaacua

SEQ ID NO: 2418590 - RNA, 16 nt, Human
aauauugacuuugucu

SEQ ID NO: 2418591 - RNA, 15 nt, Human
aauauugacuuuguc

SEQ ID NO: 2418592 - RNA, 15 nt, Human
aauauugaacuuuuu

SEQ ID NO: 2418593 - RNA, 14 nt, Human
aauauugacuugua

SEQ ID NO: 2418594 - RNA, 17 nt, Human
aauauugacuuguauau

SEQ ID NO: 2418595 - RNA, 14 nt, Human
aauauugacuuugu

SEQ ID NO: 2418596 - RNA, 17 nt, Human
aauauuguacaguuuuu

SEQ ID NO: 2418597 - RNA, 15 nt, Human
aauauuguacaguuu

SEQ ID NO: 2418598 - RNA, 23 nt, Human
aauauuguacaguuuuuauugcu

SEQ ID NO: 2418599 - RNA, 13 nt, Human
aauauuguccauu

SEQ ID NO: 2418600 - RNA, 16 nt, Human
aauauugucauuccug

SEQ ID NO: 2418601 - RNA, 17 nt, Human
aauauuguguugugaau

SEQ ID NO: 2418602 - RNA, 23 nt, Human
aauauugugaagaaaaauaaagu

SEQ ID NO: 2418603 - RNA, 22 nt, Human
aauauuuaaacaugguuacaau

SEQ ID NO: 2418604 - RNA, 12 nt, Human
aauauuuaagac

SEQ ID NO: 2418605 - RNA, 13 nt, Human
aauauuuaaacau

SEQ ID NO: 2418606 - RNA, 19 nt, Human
aauauuuaaacagcagugu

SEQ ID NO: 2418607 - RNA, 17 nt, Human
uaagcagaccacugaua

SEQ ID NO: 2418608 - RNA, 20 nt, Human
uaagcagaccacugauaaaa

SEQ ID NO: 2418609 - RNA, 16 nt, Human
uaagcacugugcuaau

SEQ ID NO: 2418610 - RNA, 17 nt, Human
uaagcacugugcuaaua

SEQ ID NO: 2418611 - RNA, 14 nt, Human
uaagcacugugcua

SEQ ID NO: 2418612 - RNA, 13 nt, Human
uaagcacugugcu

SEQ ID NO: 2418613 - RNA, 22 nt, Human
uaagcacuacauaaacugacuu

SEQ ID NO: 2418614 - RNA, 17 nt, Human
uaagcacuacauaaacu

SEQ ID NO: 2418615 - RNA, 16 nt, Human
uaagcacuacauaaac

SEQ ID NO: 2418616 - RNA, 13 nt, Human
uaagcacuacaua

SEQ ID NO: 2418617 - RNA, 13 nt, Human
uaagcaagagaga

SEQ ID NO: 2418618 - RNA, 18 nt, Human
uaagcaagagagauguuu

SEQ ID NO: 2418619 - RNA, 22 nt, Human
uaagcuguuacugucuucagua

SEQ ID NO: 2418620 - RNA, 21 nt, Human
uaagcuguuuauuuuauauua

SEQ ID NO: 2418621 - RNA, 13 nt, Human
uaagcuguuuauu

SEQ ID NO: 2418622 - RNA, 15 nt, Human
uaagcuguaaaaaga

SEQ ID NO: 2418623 - RNA, 16 nt, Human
uaagcuguuuccauag

SEQ ID NO: 2418624 - RNA, 11 nt, Human
uaagcuguuuc

SEQ ID NO: 2418625 - RNA, 14 nt, Human
uaagcugaaaauau

SEQ ID NO: 2418626 - RNA, 15 nt, Human
uaagcagaggagggg

SEQ ID NO: 2418627 - RNA, 16 nt, Human
uaagcagaggaggggc

SEQ ID NO: 2418628 - RNA, 13 nt, Human
uaagcagaggagg

SEQ ID NO: 2418629 - RNA, 16 nt, Human
uaagcugcucuauugu

SEQ ID NO: 2418630 - RNA, 17 nt, Human
uaagcagaggaggggcc

SEQ ID NO: 2418631 - RNA, 12 nt, Human
uaagcuguaaaa

SEQ ID NO: 2418632 - RNA, 13 nt, Human
uaagcuguaaaaa

SEQ ID NO: 2418633 - RNA, 18 nt, Human
uaagcacacuugacauca

SEQ ID NO: 2418634 - RNA, 23 nt, Human
uaagcaacaucuagcaaauguua

SEQ ID NO: 2418635 - RNA, 21 nt, Human
uaagauuuuucucaaaguuuu

SEQ ID NO: 2418636 - RNA, 20 nt, Human
uaagauuuuucucaaaguuu

SEQ ID NO: 2418637 - RNA, 18 nt, Human
uaagauuuuucucaaagu

SEQ ID NO: 2418638 - RNA, 16 nt, Human
uaagauuuuucucaaa

SEQ ID NO: 2418639 - RNA, 23 nt, Human
uaagcaaagggagcacuggguug

SEQ ID NO: 2418640 - RNA, 19 nt, Human
uaagauuuagagaugaauu

SEQ ID NO: 2418641 - RNA, 15 nt, Human
uaagauuuuucucaa

SEQ ID NO: 2418642 - RNA, 22 nt, Human
aaucaggguuaguauuguccag

SEQ ID NO: 2418643 - RNA, 21 nt, Human
aauauuuuuuauauauacagu

SEQ ID NO: 2418644 - RNA, 19 nt, Human
aauauuuuuuauauauaca

SEQ ID NO: 2418645 - RNA, 15 nt, Human
uaagaugacauugcu

SEQ ID NO: 2418646 - RNA, 17 nt, Human
uaagaugacauugcuaa

SEQ ID NO: 2418647 - RNA, 16 nt, Human
uaagaugacauugcua

SEQ ID NO: 2418648 - RNA, 17 nt, Human
uaagaugcuaccuugug

SEQ ID NO: 2418649 - RNA, 19 nt, Human
uaagauggaagcuuccagu

SEQ ID NO: 2418650 - RNA, 18 nt, Human
uaagauggaagcuuccag

SEQ ID NO: 2418651 - RNA, 17 nt, Human
uaagauggaagcuucca

SEQ ID NO: 2418652 - RNA, 13 nt, Human
uaagaugcugggu

SEQ ID NO: 2418653 - RNA, 12 nt, Human
uaagaugcuggg

SEQ ID NO: 2418654 - RNA, 11 nt, Human
uaagaugcugg

SEQ ID NO: 2418655 - RNA, 24 nt, Human
uaagaugcucuaucuugcucugua

SEQ ID NO: 2418656 - RNA, 23 nt, Human
uaagaugcuaccuugugacccag

SEQ ID NO: 2418657 - RNA, 15 nt, Human
uaagauggauucuca

SEQ ID NO: 2418658 - RNA, 17 nt, Human
uaagauggauucucaga

SEQ ID NO: 2418659 - RNA, 18 nt, Human
uaagauggauucucagau

SEQ ID NO: 2418660 - RNA, 20 nt, Human
uaagauggauucucagauau

SEQ ID NO: 2418661 - RNA, 18 nt, Human
uaagaugggcagcuaguu

SEQ ID NO: 2418662 - RNA, 22 nt, Human
uaagauggauucucagauauuu

SEQ ID NO: 2418663 - RNA, 21 nt, Human
uaagauuccagagaguggcuc

SEQ ID NO: 2418664 - RNA, 14 nt, Human
uaagauuccagaga

SEQ ID NO: 2418665 - RNA, 21 nt, Human
uaagauggauucucagauauu

SEQ ID NO: 2418666 - RNA, 21 nt, Human
aaucaggguuaguauugucca

SEQ ID NO: 2418667 - RNA, 16 nt, Human
aaucaggguuaguauu

SEQ ID NO: 2418668 - RNA, 22 nt, Human
aauauuuuuauagauuugaccu

SEQ ID NO: 2418669 - RNA, 17 nt, Human
aauauuuuuuauauaua

SEQ ID NO: 2418670 - RNA, 23 nt, Human
aauauuuuugaaaggcauguucc

SEQ ID NO: 2418671 - RNA, 13 nt, Human
aauauuuuucuua

SEQ ID NO: 2418672 - RNA, 21 nt, Human
aauauuuugucuaaaaugccu

SEQ ID NO: 2418673 - RNA, 20 nt, Human
aauauuuugucuaaaaugcc

SEQ ID NO: 2418674 - RNA, 19 nt, Human
aauauuuugucuaaaaugc

SEQ ID NO: 2418675 - RNA, 16 nt, Human
aauauuuugucuaaaa

SEQ ID NO: 2418676 - RNA, 17 nt, Human
aauauuuuuaauauaua

SEQ ID NO: 2418677 - RNA, 14 nt, Human
aauauuuuuagaua

SEQ ID NO: 2418678 - RNA, 12 nt, Human
aauauuuguaca

SEQ ID NO: 2418679 - RNA, 14 nt, Human
aauauuuguacaua

SEQ ID NO: 2418680 - RNA, 20 nt, Human
aauauuugaaucuugucuca

SEQ ID NO: 2418681 - RNA, 12 nt, Human
aauauuugcuga

SEQ ID NO: 2418682 - RNA, 20 nt, Human
aauauuuugcuaguuuuuga

SEQ ID NO: 2418683 - RNA, 15 nt, Human
aauauuuugucuaaa

SEQ ID NO: 2418684 - RNA, 14 nt, Human
aauauuuugucuaa

SEQ ID NO: 2418685 - RNA, 13 nt, Human
aauauuuugucua

SEQ ID NO: 2418686 - RNA, 22 nt, Human
accacaggcccuuuccucaggc

SEQ ID NO: 2418687 - RNA, 21 nt, Human
accacaggcccuuuccucagg

SEQ ID NO: 2418688 - RNA, 16 nt, Human
accacagcugcuggag

SEQ ID NO: 2418689 - RNA, 15 nt, Human
accacagcugcugga

SEQ ID NO: 2418690 - RNA, 14 nt, Human
accacagcugcugg

SEQ ID NO: 2418691 - RNA, 13 nt, Human
accacagcugcug

SEQ ID NO: 2418692 - RNA, 12 nt, Human
accacagcugcu

SEQ ID NO: 2418693 - RNA, 14 nt, Human
accacagcccuguc

SEQ ID NO: 2418694 - RNA, 15 nt, Human
accacagcccuguca

SEQ ID NO: 2418695 - RNA, 16 nt, Human
accacagcccugucag

SEQ ID NO: 2418696 - RNA, 17 nt, Human
accacagcccugucagu

SEQ ID NO: 2418697 - RNA, 13 nt, Human
ucacccccuucuc

SEQ ID NO: 2418698 - RNA, 16 nt, Human
ucacccccuucuccau

SEQ ID NO: 2418699 - RNA, 22 nt, Human
ucacccccuucuccauccacau

SEQ ID NO: 2418700 - RNA, 19 nt, Human
accacagccagcaccuggc

SEQ ID NO: 2418701 - RNA, 18 nt, Human
ucacccccuucuccaucc

SEQ ID NO: 2418702 - RNA, 20 nt, Human
accacagccagcaccuggca

SEQ ID NO: 2418703 - RNA, 13 nt, Human
accacagcccugu

SEQ ID NO: 2418704 - RNA, 17 nt, Human
accacagccagcaccug

SEQ ID NO: 2418705 - RNA, 19 nt, Human
accacaucuugcucugcug

SEQ ID NO: 2418706 - RNA, 18 nt, Human
accacaucuugcucugcu

SEQ ID NO: 2418707 - RNA, 22 nt, Human
accacaggguucaaaaugucug

SEQ ID NO: 2418708 - RNA, 23 nt, Human
accacaggguucaaaaugucugu

SEQ ID NO: 2418709 - RNA, 17 nt, Human
accacaggguucaaaau

SEQ ID NO: 2418710 - RNA, 17 nt, Human
accacaucuugcucugc

SEQ ID NO: 2418711 - RNA, 24 nt, Human
accacauuggagauguuuaguaau

SEQ ID NO: 2418712 - RNA, 18 nt, Human
accacaugcggagaacaa

SEQ ID NO: 2418713 - RNA, 19 nt, Human
accacauuuuauauuuauu

SEQ ID NO: 2418714 - RNA, 22 nt, Human
accacaugccaagcacugugcu

SEQ ID NO: 2418715 - RNA, 20 nt, Human
accacaugccaagcacugug

SEQ ID NO: 2418716 - RNA, 22 nt, Human
accacagguucaugccaccaug

SEQ ID NO: 2418717 - RNA, 18 nt, Human
accacaugugcacaugca

SEQ ID NO: 2418718 - RNA, 16 nt, Human
accaccaagccaaggg

SEQ ID NO: 2418719 - RNA, 22 nt, Human
accaccacuggccaccaggcug

SEQ ID NO: 2418720 - RNA, 21 nt, Human
accaccacuggccaccaggcu

SEQ ID NO: 2418721 - RNA, 20 nt, Human
accaccacuggccaccaggc

SEQ ID NO: 2418722 - RNA, 16 nt, Human
accaccacuggccacc

SEQ ID NO: 2418723 - RNA, 15 nt, Human
accaccacuggccac

SEQ ID NO: 2418724 - RNA, 14 nt, Human
accaccacuggcca

SEQ ID NO: 2418725 - RNA, 20 nt, Human
accaccacacccagcccacu

SEQ ID NO: 2418726 - RNA, 15 nt, Human
accaccacacccagc

SEQ ID NO: 2418727 - RNA, 20 nt, Human
ucacaguuuugguugcuuua

SEQ ID NO: 2418728 - RNA, 17 nt, Human
ucacaguuggccuucag

SEQ ID NO: 2418729 - RNA, 13 nt, Human
ucacaguugacaa

SEQ ID NO: 2418730 - RNA, 22 nt, Human
ucacaguucuuugggccagaca

SEQ ID NO: 2418731 - RNA, 19 nt, Human
ucacaguucuuugggccag

SEQ ID NO: 2418732 - RNA, 20 nt, Human
ucacaguucuuugggccaga

SEQ ID NO: 2418733 - RNA, 13 nt, Human
ucacagcggaggu

SEQ ID NO: 2418734 - RNA, 22 nt, Human
ucacagccucugaccccuccuc

SEQ ID NO: 2418735 - RNA, 22 nt, Human
ucacaguuggcuggaugaaauu

SEQ ID NO: 2418736 - RNA, 21 nt, Human
ucacaguuuugguugcuuuaa

SEQ ID NO: 2418737 - RNA, 23 nt, Human
ucacaguuuugguugcuuuaaua

SEQ ID NO: 2418738 - RNA, 17 nt, Human
ucacauaaaaccucauu

SEQ ID NO: 2418739 - RNA, 18 nt, Human
ucacauaaaauagauuuu

SEQ ID NO: 2418740 - RNA, 20 nt, Human
ucacauaagcucagaaucca

SEQ ID NO: 2418741 - RNA, 19 nt, Human
ucacauaagcucagaaucc

SEQ ID NO: 2418742 - RNA, 17 nt, Human
ucacauaagcucagaau

SEQ ID NO: 2418743 - RNA, 16 nt, Human
ucacauagaugucccu

SEQ ID NO: 2418744 - RNA, 17 nt, Human
ucacauagaugucccuu

SEQ ID NO: 2418745 - RNA, 15 nt, Human
ucacauacccucccc

SEQ ID NO: 2418746 - RNA, 14 nt, Human
ucacauacccuccc

SEQ ID NO: 2418747 - RNA, 18 nt, Human
ucacauacaauuauuuuu

SEQ ID NO: 2418748 - RNA, 18 nt, Human
ucacauagagaucauccu

SEQ ID NO: 2418749 - RNA, 16 nt, Human
ucacauacccuccccc

SEQ ID NO: 2418750 - RNA, 15 nt, Human
ucacauagauguccc

SEQ ID NO: 2418751 - RNA, 17 nt, Human
ucaccaucucaggccac

SEQ ID NO: 2418752 - RNA, 15 nt, Human
ucaccaucuuggcca

SEQ ID NO: 2418753 - RNA, 14 nt, Human
ucaccaucugugca

SEQ ID NO: 2418754 - RNA, 21 nt, Human
ucaccaucucaggccaccugc

SEQ ID NO: 2418755 - RNA, 23 nt, Human
ucaccaucucaggccaccugccc

SEQ ID NO: 2418756 - RNA, 15 nt, Human
ucaccauguuggcca

SEQ ID NO: 2418757 - RNA, 15 nt, Human
ucacccacagggcua

SEQ ID NO: 2418758 - RNA, 22 nt, Human
ucacccacagggcuaagagcua

SEQ ID NO: 2418759 - RNA, 11 nt, Human
ucacccacagg

SEQ ID NO: 2418760 - RNA, 12 nt, Human
ucacccacaggg

SEQ ID NO: 2418761 - RNA, 14 nt, Human
ucacccacagggcu

SEQ ID NO: 2418762 - RNA, 16 nt, Human
ucacccagacagcucc

SEQ ID NO: 2418763 - RNA, 17 nt, Human
ucacccagacagcuccc

SEQ ID NO: 2418764 - RNA, 19 nt, Human
ucaccccaucccacacccu

SEQ ID NO: 2418765 - RNA, 14 nt, Human
ucaccccccacuca

SEQ ID NO: 2418766 - RNA, 13 nt, Human
ucaccccccacuc

SEQ ID NO: 2418767 - RNA, 19 nt, Human
ucacccccucgggucuccu

SEQ ID NO: 2418768 - RNA, 14 nt, Human
ucacccccucgggu

SEQ ID NO: 2418769 - RNA, 18 nt, Human
ucaccccccacucaccag

SEQ ID NO: 2418770 - RNA, 13 nt, Human
ucacccccucggg

SEQ ID NO: 2418771 - RNA, 18 nt, Human
ucacccccagcuuugcua

SEQ ID NO: 2418772 - RNA, 18 nt, Human
ucaccccccacacucacu

SEQ ID NO: 2418773 - RNA, 19 nt, Human
ucacccccaaggggcaguc

SEQ ID NO: 2418774 - RNA, 13 nt, Human
ucacccccagcuu

SEQ ID NO: 2418775 - RNA, 13 nt, Human
ucacccccaaggg

SEQ ID NO: 2418776 - RNA, 17 nt, Human
ucaccauuugauuaugu

SEQ ID NO: 2418777 - RNA, 22 nt, Human
ucaccauuugauuauguagcaa

SEQ ID NO: 2418778 - RNA, 19 nt, Human
ucacccaagagauuguugu

SEQ ID NO: 2418779 - RNA, 19 nt, Human
ucacccaagcaaggccaaa

SEQ ID NO: 2418780 - RNA, 23 nt, Human
ucaccauuuggcaaugccaucau

SEQ ID NO: 2418781 - RNA, 22 nt, Human
ucaccauguuggccaggcuggu

SEQ ID NO: 2418782 - RNA, 21 nt, Human
ucaccauguuggccaggcugg

SEQ ID NO: 2418783 - RNA, 21 nt, Human
ucacagaugugugauucacag

SEQ ID NO: 2418784 - RNA, 22 nt, Human
ucacacuucugugagaccccca

SEQ ID NO: 2418785 - RNA, 23 nt, Human
ucacacuucugugagacccccac

SEQ ID NO: 2418786 - RNA, 23 nt, Human
ucacagcaagucacuggccagug

SEQ ID NO: 2418787 - RNA, 23 nt, Human
ucacagaugugugauucacagug

SEQ ID NO: 2418788 - RNA, 22 nt, Human
ucacagccuccucugucugccc

SEQ ID NO: 2418789 - RNA, 20 nt, Human
ucacagccuccucugucugc

SEQ ID NO: 2418790 - RNA, 19 nt, Human
ucacagccuccucugucug

SEQ ID NO: 2418791 - RNA, 17 nt, Human
ucacagccuccucuguc

SEQ ID NO: 2418792 - RNA, 15 nt, Human
ucacagccuccucug

SEQ ID NO: 2418793 - RNA, 14 nt, Human
ucacagccuccucu

SEQ ID NO: 2418794 - RNA, 15 nt, Human
ucacagcagcuucua

SEQ ID NO: 2418795 - RNA, 13 nt, Human
ucacagccuccuc

SEQ ID NO: 2418796 - RNA, 18 nt, Human
ucacagcacagagaagac

SEQ ID NO: 2418797 - RNA, 12 nt, Human
ucacagaaauga

SEQ ID NO: 2418798 - RNA, 20 nt, Human
ucacacuuccaccagccugc

SEQ ID NO: 2418799 - RNA, 16 nt, Human
ucacagaaaugagauc

SEQ ID NO: 2418800 - RNA, 17 nt, Human
ucacagcacagagaaga

SEQ ID NO: 2418801 - RNA, 20 nt, Human
ucacaguucucuccuucuuc

SEQ ID NO: 2418802 - RNA, 16 nt, Human
ucacaguucucuccuu

SEQ ID NO: 2418803 - RNA, 21 nt, Human
ucacagccucugaccccuccu

SEQ ID NO: 2418804 - RNA, 20 nt, Human
ucacagccucugaccccucc

SEQ ID NO: 2418805 - RNA, 19 nt, Human
ucacagccucugaccccuc

SEQ ID NO: 2418806 - RNA, 18 nt, Human
ucacagccucugaccccu

SEQ ID NO: 2418807 - RNA, 17 nt, Human
ucacagccucugacccc

SEQ ID NO: 2418808 - RNA, 16 nt, Human
ucacagccucugaccc

SEQ ID NO: 2418809 - RNA, 12 nt, Human
ucacagccucug

SEQ ID NO: 2418810 - RNA, 11 nt, Human
ucacagccucu

SEQ ID NO: 2418811 - RNA, 13 nt, Human
ucacagccucuga

SEQ ID NO: 2418812 - RNA, 20 nt, Human
ucacagaugggugcuuggag

SEQ ID NO: 2418813 - RNA, 18 nt, Human
ucacacuuccaccagccu

SEQ ID NO: 2418814 - RNA, 19 nt, Human
ucacacuuccaccagccug

SEQ ID NO: 2418815 - RNA, 16 nt, Human
ucacacuucugugaga

SEQ ID NO: 2418816 - RNA, 11 nt, Human
ucacacuggga

SEQ ID NO: 2418817 - RNA, 20 nt, Human
ucacacugcaagagccuugg

SEQ ID NO: 2418818 - RNA, 19 nt, Human
ucacaacgugcauugugcu

SEQ ID NO: 2418819 - RNA, 18 nt, Human
ucacaacgugcauugugc

SEQ ID NO: 2418820 - RNA, 17 nt, Human
ucacaacgugcauugug

SEQ ID NO: 2418821 - RNA, 16 nt, Human
ucacaacgugcauugu

SEQ ID NO: 2418822 - RNA, 21 nt, Human
ucacaacgugcauugugcuuc

SEQ ID NO: 2418823 - RNA, 20 nt, Human
ucacaacgugcauugugcuu

SEQ ID NO: 2418824 - RNA, 14 nt, Human
ucacaagaagacca

SEQ ID NO: 2418825 - RNA, 18 nt, Human
ucacacugcaagagccuu

SEQ ID NO: 2418826 - RNA, 21 nt, Human
ucacacugcaagagccuuggu

SEQ ID NO: 2418827 - RNA, 16 nt, Human
ucacaaagcccaaggg

SEQ ID NO: 2418828 - RNA, 14 nt, Human
ucacaaccugaacc

SEQ ID NO: 2418829 - RNA, 14 nt, Human
ucacaaccuucugu

SEQ ID NO: 2418830 - RNA, 19 nt, Human
ucacaaccugaaccuagga

SEQ ID NO: 2418831 - RNA, 16 nt, Human
ucacaaccugaaccua

SEQ ID NO: 2418832 - RNA, 16 nt, Human
ucaauugcaucuccca

SEQ ID NO: 2418833 - RNA, 17 nt, Human
ucaauugcaucucccag

SEQ ID NO: 2418834 - RNA, 18 nt, Human
ucaauugcaucucccaga

SEQ ID NO: 2418835 - RNA, 22 nt, Human
ucaauugcaucucccagauaau

SEQ ID NO: 2418836 - RNA, 13 nt, Human
ucaauuguaaauu

SEQ ID NO: 2418837 - RNA, 15 nt, Human
ucaauugaaugguca

SEQ ID NO: 2418838 - RNA, 14 nt, Human
ucaauuguaaauug

SEQ ID NO: 2418839 - RNA, 18 nt, Human
ucaauuguaaauugaauc

SEQ ID NO: 2418840 - RNA, 16 nt, Human
ucaauucuugccaaau

SEQ ID NO: 2418841 - RNA, 19 nt, Human
accaaaggugaaggaauau

SEQ ID NO: 2418842 - RNA, 18 nt, Human
accaaaggugaaggaaua

SEQ ID NO: 2418843 - RNA, 17 nt, Human
accaaaggugaaggaau

SEQ ID NO: 2418844 - RNA, 13 nt, Human
accaaaggccagg

SEQ ID NO: 2418845 - RNA, 18 nt, Human
accaaaguauuuuuuuau

SEQ ID NO: 2418846 - RNA, 15 nt, Human
accaaaguauuuuuu

SEQ ID NO: 2418847 - RNA, 21 nt, Human
accaaaggugaaggaauauau

SEQ ID NO: 2418848 - RNA, 20 nt, Human
accaaaggugaaggaauaua

SEQ ID NO: 2418849 - RNA, 21 nt, Human
accaaaguccuuuuuuuccau

SEQ ID NO: 2418850 - RNA, 16 nt, Human
accaaagcgaauuuua

SEQ ID NO: 2418851 - RNA, 20 nt, Human
accaaagcaccuuagcuggc

SEQ ID NO: 2418852 - RNA, 14 nt, Human
accaaagccaccag

SEQ ID NO: 2418853 - RNA, 15 nt, Human
ucaauuucuccccag

SEQ ID NO: 2418854 - RNA, 14 nt, Human
ucaauuucucccca

SEQ ID NO: 2418855 - RNA, 15 nt, Human
ucaauuucuguguug

SEQ ID NO: 2418856 - RNA, 23 nt, Human
ucaauuucuguguugccaagcuc

SEQ ID NO: 2418857 - RNA, 20 nt, Human
ucaauuuguaauugcuuaca

SEQ ID NO: 2418858 - RNA, 20 nt, Human
ucaauuuauucaagaaaagu

SEQ ID NO: 2418859 - RNA, 21 nt, Human
ucaauuucccugacuccucua

SEQ ID NO: 2418860 - RNA, 18 nt, Human
ucaauuucccugacuccu

SEQ ID NO: 2418861 - RNA, 20 nt, Human
ucaauuuccaagagcugagg

SEQ ID NO: 2418862 - RNA, 18 nt, Human
ucaauuuccaagagcuga

SEQ ID NO: 2418863 - RNA, 13 nt, Human
ucaauuuccaaga

SEQ ID NO: 2418864 - RNA, 21 nt, Human
ucacaaacuuuuauacucuuu

SEQ ID NO: 2418865 - RNA, 12 nt, Human
ucacaaagccca

SEQ ID NO: 2418866 - RNA, 15 nt, Human
ucacaaagcccaagg

SEQ ID NO: 2418867 - RNA, 17 nt, Human
ucacaaaggaugcccaa

SEQ ID NO: 2418868 - RNA, 15 nt, Human
ucacaaacuuuuaua

SEQ ID NO: 2418869 - RNA, 17 nt, Human
ucacaaacuuuuauacu

SEQ ID NO: 2418870 - RNA, 22 nt, Human
ucacaaaauuuuauuccuauau

SEQ ID NO: 2418871 - RNA, 21 nt, Human
ucacaaaaccuggcacaaugg

SEQ ID NO: 2418872 - RNA, 17 nt, Human
ucacaaaaccuggcaca

SEQ ID NO: 2418873 - RNA, 14 nt, Human
ucacaaaauuuuau

SEQ ID NO: 2418874 - RNA, 13 nt, Human
ucaccucauggaa

SEQ ID NO: 2418875 - RNA, 12 nt, Human
ucaccucaugga

SEQ ID NO: 2418876 - RNA, 14 nt, Human
ucaccucauggaau

SEQ ID NO: 2418877 - RNA, 14 nt, Human
accaggacucccuc

SEQ ID NO: 2418878 - RNA, 15 nt, Human
accaggacucccucc

SEQ ID NO: 2418879 - RNA, 20 nt, Human
ucaccucaugcccacccccu

SEQ ID NO: 2418880 - RNA, 23 nt, Human
ucaccucaugcccacccccugcc

SEQ ID NO: 2418881 - RNA, 20 nt, Human
ucaccugggcaccuggggag

SEQ ID NO: 2418882 - RNA, 16 nt, Human
ucaccuguaaaccuga

SEQ ID NO: 2418883 - RNA, 17 nt, Human
ucaccuguaaaccugag

SEQ ID NO: 2418884 - RNA, 16 nt, Human
ucaccuguacucuucc

SEQ ID NO: 2418885 - RNA, 15 nt, Human
ucaccuguacucuuc

SEQ ID NO: 2418886 - RNA, 19 nt, Human
ucaccuguaaaccugaguc

SEQ ID NO: 2418887 - RNA, 20 nt, Human
ucaccuggggcugcuggccu

SEQ ID NO: 2418888 - RNA, 18 nt, Human
ucaccuggggcugcuggc

SEQ ID NO: 2418889 - RNA, 17 nt, Human
ucaccuggggcugcugg

SEQ ID NO: 2418890 - RNA, 16 nt, Human
ucaccuggggcugcug

SEQ ID NO: 2418891 - RNA, 22 nt, Human
ucaccuggggcugcuggccuga

SEQ ID NO: 2418892 - RNA, 19 nt, Human
ucaccuggggugugggagg

SEQ ID NO: 2418893 - RNA, 18 nt, Human
ucaccuguacucuuccga

SEQ ID NO: 2418894 - RNA, 17 nt, Human
ucaccuguacucuuccg

SEQ ID NO: 2418895 - RNA, 17 nt, Human
ucacggugccagguuuu

SEQ ID NO: 2418896 - RNA, 18 nt, Human
ucacguaaagcuagaaau

SEQ ID NO: 2418897 - RNA, 16 nt, Human
ucacguggaggagcag

SEQ ID NO: 2418898 - RNA, 21 nt, Human
ucacguggaggagcagugcag

SEQ ID NO: 2418899 - RNA, 12 nt, Human
ucacguguguga

SEQ ID NO: 2418900 - RNA, 22 nt, Human
ucacguuucauguaauccucaa

SEQ ID NO: 2418901 - RNA, 16 nt, Human
ucacgugugugacuca

SEQ ID NO: 2418902 - RNA, 17 nt, Human
ucacgugugugacucag

SEQ ID NO: 2418903 - RNA, 17 nt, Human
ucacgugcagcucaagg

SEQ ID NO: 2418904 - RNA, 17 nt, Human
ucaccugucaggccuga

SEQ ID NO: 2418905 - RNA, 13 nt, Human
ucacgucacacuu

SEQ ID NO: 2418906 - RNA, 20 nt, Human
ucacguaaagcuagaaauga

SEQ ID NO: 2418907 - RNA, 19 nt, Human
ucacguaaagcuagaaaug

SEQ ID NO: 2418908 - RNA, 19 nt, Human
ucacuaauacuaauucauu

SEQ ID NO: 2418909 - RNA, 13 nt, Human
ucacuaaacuuua

SEQ ID NO: 2418910 - RNA, 22 nt, Human
ucacuaccauuguaacuuggau

SEQ ID NO: 2418911 - RNA, 16 nt, Human
ucacuaggcuucuggu

SEQ ID NO: 2418912 - RNA, 23 nt, Human
ucacuaggcccccacuugccucu

SEQ ID NO: 2418913 - RNA, 19 nt, Human
ucacuacccuauucucucu

SEQ ID NO: 2418914 - RNA, 23 nt, Human
accagcgcccgcugggcugagcc

SEQ ID NO: 2418915 - RNA, 23 nt, Human
accagcuaagaaaagauuuuaau

SEQ ID NO: 2418916 - RNA, 22 nt, Human
accagcuaagaaaagauuuuaa

SEQ ID NO: 2418917 - RNA, 13 nt, Human
accagcucaggac

SEQ ID NO: 2418918 - RNA, 14 nt, Human
accagcucaggaca

SEQ ID NO: 2418919 - RNA, 15 nt, Human
accagcucaggacag

SEQ ID NO: 2418920 - RNA, 16 nt, Human
accagcucaggacaga

SEQ ID NO: 2418921 - RNA, 22 nt, Human
accagcgugugacuacuccccc

SEQ ID NO: 2418922 - RNA, 20 nt, Human
accagcgcccgcugggcuga

SEQ ID NO: 2418923 - RNA, 19 nt, Human
accagcgcccgcugggcug

SEQ ID NO: 2418924 - RNA, 18 nt, Human
accagcgcccgcugggcu

SEQ ID NO: 2418925 - RNA, 17 nt, Human
accagcgcccgcugggc

SEQ ID NO: 2418926 - RNA, 15 nt, Human
accacuaugaagcua

SEQ ID NO: 2418927 - RNA, 15 nt, Human
accagcgcccgcugg

SEQ ID NO: 2418928 - RNA, 16 nt, Human
accacuacauucuguu

SEQ ID NO: 2418929 - RNA, 24 nt, Human
accaccacuggccaccaggcuggc

SEQ ID NO: 2418930 - RNA, 23 nt, Human
accaccacuggccaccaggcugg

SEQ ID NO: 2418931 - RNA, 15 nt, Human
accacuacauucugu

SEQ ID NO: 2418932 - RNA, 17 nt, Human
accacuacauucuguua

SEQ ID NO: 2418933 - RNA, 17 nt, Human
accacuaggacucugag

SEQ ID NO: 2418934 - RNA, 13 nt, Human
accacuagaacuc

SEQ ID NO: 2418935 - RNA, 20 nt, Human
accacuagaacucuccaucu

SEQ ID NO: 2418936 - RNA, 15 nt, Human
accagcuucuccagg

SEQ ID NO: 2418937 - RNA, 23 nt, Human
accagcuguucugucccuuggag

SEQ ID NO: 2418938 - RNA, 20 nt, Human
accagcuucuccaggcucuu

SEQ ID NO: 2418939 - RNA, 18 nt, Human
accagcuucuccaggcuc

SEQ ID NO: 2418940 - RNA, 16 nt, Human
accagcuucuccaggc

SEQ ID NO: 2418941 - RNA, 17 nt, Human
accaggaaccucuucag

SEQ ID NO: 2418942 - RNA, 20 nt, Human
accaggaauguuaaagucag

SEQ ID NO: 2418943 - RNA, 21 nt, Human
accaggacuauagcccagguc

SEQ ID NO: 2418944 - RNA, 20 nt, Human
accaggacuauagcccaggu

SEQ ID NO: 2418945 - RNA, 19 nt, Human
accaggacuauagcccagg

SEQ ID NO: 2418946 - RNA, 17 nt, Human
accaggacaggaccaga

SEQ ID NO: 2418947 - RNA, 14 nt, Human
accaggacaggacc

SEQ ID NO: 2418948 - RNA, 15 nt, Human
accaggacaggacca

SEQ ID NO: 2418949 - RNA, 20 nt, Human
accagcuggggcguggggag

SEQ ID NO: 2418950 - RNA, 11 nt, Human
accagcugggg

SEQ ID NO: 2418951 - RNA, 10 nt, Human
accagcuggg

SEQ ID NO: 2418952 - RNA, 20 nt, Human
accagcugcgcuugcuuuuc

SEQ ID NO: 2418953 - RNA, 19 nt, Human
accagcugcgcuugcuuuu

SEQ ID NO: 2418954 - RNA, 18 nt, Human
accagcugcgcuugcuuu

SEQ ID NO: 2418955 - RNA, 23 nt, Human
accagcuggggcguggggagggc

SEQ ID NO: 2418956 - RNA, 21 nt, Human
accagcuggggcguggggagg

SEQ ID NO: 2418957 - RNA, 17 nt, Human
accagcuguaacacagc

SEQ ID NO: 2418958 - RNA, 22 nt, Human
accagcuguucugucccuugga

SEQ ID NO: 2418959 - RNA, 16 nt, Human
accagcuuagauuuua

SEQ ID NO: 2418960 - RNA, 13 nt, Human
accagcuccuccc

SEQ ID NO: 2418961 - RNA, 23 nt, Human
accagcucaggacagaugccaca

SEQ ID NO: 2418962 - RNA, 14 nt, Human
accagcuccucccu

SEQ ID NO: 2418963 - RNA, 14 nt, Human
accagcugccucuu

SEQ ID NO: 2418964 - RNA, 16 nt, Human
accagcugcgcuugcu

SEQ ID NO: 2418965 - RNA, 16 nt, Human
accagcugccucuucu

SEQ ID NO: 2418966 - RNA, 15 nt, Human
accagcugccucuuc

SEQ ID NO: 2418967 - RNA, 10 nt, Human
ucacuugagu

SEQ ID NO: 2418968 - RNA, 19 nt, Human
ucacuugaugugccauuuu

SEQ ID NO: 2418969 - RNA, 18 nt, Human
ucacuugaugugccauuu

SEQ ID NO: 2418970 - RNA, 22 nt, Human
ucacuugaggucaggaguuccu

SEQ ID NO: 2418971 - RNA, 16 nt, Human
ucacuguucccucugc

SEQ ID NO: 2418972 - RNA, 14 nt, Human
ucacuguuucucug

SEQ ID NO: 2418973 - RNA, 17 nt, Human
ucacuguuucucugcug

SEQ ID NO: 2418974 - RNA, 23 nt, Human
ucacuugaacccgggaggcagag

SEQ ID NO: 2418975 - RNA, 18 nt, Human
ucacuguuucucugcugu

SEQ ID NO: 2418976 - RNA, 21 nt, Human
ucacuugaauccuagggccug

SEQ ID NO: 2418977 - RNA, 13 nt, Human
ucacuugaaugug

SEQ ID NO: 2418978 - RNA, 14 nt, Human
ucacuugagacaaa

SEQ ID NO: 2418979 - RNA, 12 nt, Human
ucacuugagacc

SEQ ID NO: 2418980 - RNA, 15 nt, Human
accaguguuguggau

SEQ ID NO: 2418981 - RNA, 17 nt, Human
accaguguuguggauuu

SEQ ID NO: 2418982 - RNA, 18 nt, Human
accaguguccccuccacu

SEQ ID NO: 2418983 - RNA, 18 nt, Human
accagugaaccaaagaga

SEQ ID NO: 2418984 - RNA, 13 nt, Human
accaguguccccu

SEQ ID NO: 2418985 - RNA, 17 nt, Human
accagugaaccaaagag

SEQ ID NO: 2418986 - RNA, 16 nt, Human
accagugaaccaaaga

SEQ ID NO: 2418987 - RNA, 14 nt, Human
accagugaaccaaa

SEQ ID NO: 2418988 - RNA, 17 nt, Human
accaguccccccacccu

SEQ ID NO: 2418989 - RNA, 14 nt, Human
accagucugacccu

SEQ ID NO: 2418990 - RNA, 20 nt, Human
accaguaucgcucauagauc

SEQ ID NO: 2418991 - RNA, 14 nt, Human
accagucugacugu

SEQ ID NO: 2418992 - RNA, 15 nt, Human
accaguccccccacc

SEQ ID NO: 2418993 - RNA, 21 nt, Human
ucacugagacagcccgggcuc

SEQ ID NO: 2418994 - RNA, 17 nt, Human
ucacugagacagcccgg

SEQ ID NO: 2418995 - RNA, 22 nt, Human
ucacugagacagcccgggcucu

SEQ ID NO: 2418996 - RNA, 14 nt, Human
ucacugcagccuca

SEQ ID NO: 2418997 - RNA, 20 nt, Human
ucacuaucccggcugcccuu

SEQ ID NO: 2418998 - RNA, 21 nt, Human
ucacuaugaaucuauuauacu

SEQ ID NO: 2418999 - RNA, 21 nt, Human
ucacuauauaggcaucacauu

SEQ ID NO: 2419000 - RNA, 23 nt, Human
ucacuauaggucauacaauccau

SEQ ID NO: 2419001 - RNA, 13 nt, Human
ucacuauaaaugg

SEQ ID NO: 2419002 - RNA, 19 nt, Human
ucacuaucccggcugcccu

SEQ ID NO: 2419003 - RNA, 17 nt, Human
ucacuauaaaugguguu

SEQ ID NO: 2419004 - RNA, 16 nt, Human
ucacugagacagcccg

SEQ ID NO: 2419005 - RNA, 19 nt, Human
ucacuauggugccaaugga

SEQ ID NO: 2419006 - RNA, 22 nt, Human
ucacuaugaaucuauuauacug

SEQ ID NO: 2419007 - RNA, 14 nt, Human
ucacuauggugcca

SEQ ID NO: 2419008 - RNA, 21 nt, Human
ucacugugggaaggccagcug

SEQ ID NO: 2419009 - RNA, 17 nt, Human
ucacugugguccuaugc

SEQ ID NO: 2419010 - RNA, 18 nt, Human
ucacugugggaaggccag

SEQ ID NO: 2419011 - RNA, 16 nt, Human
ucacuguggugucugu

SEQ ID NO: 2419012 - RNA, 15 nt, Human
ucacuguucccucug

SEQ ID NO: 2419013 - RNA, 23 nt, Human
ucacuguugcccaggcuggcgug

SEQ ID NO: 2419014 - RNA, 13 nt, Human
ucacugcagccuc

SEQ ID NO: 2419015 - RNA, 23 nt, Human
ucacuauggugccaauggaaccu

SEQ ID NO: 2419016 - RNA, 15 nt, Human
ucacugcagccucaa

SEQ ID NO: 2419017 - RNA, 21 nt, Human
ucacugcaggcacucaaugca

SEQ ID NO: 2419018 - RNA, 22 nt, Human
ucacugcagccuccuucuccug

SEQ ID NO: 2419019 - RNA, 13 nt, Human
ucacugcaggcac

SEQ ID NO: 2419020 - RNA, 17 nt, Human
ucacugucuuuccuaga

SEQ ID NO: 2419021 - RNA, 15 nt, Human
ucacugucuuuccua

SEQ ID NO: 2419022 - RNA, 16 nt, Human
ucacugucuuuccuag

SEQ ID NO: 2419023 - RNA, 14 nt, Human
acauuuuuuaaaug

SEQ ID NO: 2419024 - RNA, 16 nt, Human
acauuuuuuaaaugca

SEQ ID NO: 2419025 - RNA, 17 nt, Human
acauuuuuuaaaugcac

SEQ ID NO: 2419026 - RNA, 23 nt, Human
accaaaaaucucaauauuucaga

SEQ ID NO: 2419027 - RNA, 21 nt, Human
acauuuuuuaaaugcaccugg

SEQ ID NO: 2419028 - RNA, 21 nt, Human
acauuuuuaagugcugcauuu

SEQ ID NO: 2419029 - RNA, 22 nt, Human
acauuuuuaagugcugcauuua

SEQ ID NO: 2419030 - RNA, 23 nt, Human
acauuuuuaagugcugcauuuaa

SEQ ID NO: 2419031 - RNA, 19 nt, Human
acauuuuuaagugcugcau

SEQ ID NO: 2419032 - RNA, 12 nt, Human
acauuuuuacaa

SEQ ID NO: 2419033 - RNA, 18 nt, Human
acauuuuggugagaaaug

SEQ ID NO: 2419034 - RNA, 18 nt, Human
accaaagagggcuuccuc

SEQ ID NO: 2419035 - RNA, 15 nt, Human
accaaagagggcuuc

SEQ ID NO: 2419036 - RNA, 22 nt, Human
accaaagagacuggagcaucug

SEQ ID NO: 2419037 - RNA, 21 nt, Human
accaaagagacuggagcaucu

SEQ ID NO: 2419038 - RNA, 23 nt, Human
accaaagauauauacacaggauc

SEQ ID NO: 2419039 - RNA, 22 nt, Human
accaaagauauauacacaggau

SEQ ID NO: 2419040 - RNA, 17 nt, Human
accaaagagacuggagc

SEQ ID NO: 2419041 - RNA, 18 nt, Human
accaaagagacuggagca

SEQ ID NO: 2419042 - RNA, 13 nt, Human
accaaagaagaaa

SEQ ID NO: 2419043 - RNA, 12 nt, Human
accaaagaagaa

SEQ ID NO: 2419044 - RNA, 17 nt, Human
accaaaauuauuucaga

SEQ ID NO: 2419045 - RNA, 17 nt, Human
accaaaauccccuucuc

SEQ ID NO: 2419046 - RNA, 16 nt, Human
accaaaauccccuucu

SEQ ID NO: 2419047 - RNA, 14 nt, Human
accaaaccuagccc

SEQ ID NO: 2419048 - RNA, 23 nt, Human
accaaaccgccagcgaacuugac

SEQ ID NO: 2419049 - RNA, 16 nt, Human
accaaaauuauuucag

SEQ ID NO: 2419050 - RNA, 13 nt, Human
accaaaauaagaa

SEQ ID NO: 2419051 - RNA, 15 nt, Human
accaaaauaagaaaa

SEQ ID NO: 2419052 - RNA, 16 nt, Human
accaaaauaagaaaag

SEQ ID NO: 2419053 - RNA, 17 nt, Human
accaaaauaagaaaaga

SEQ ID NO: 2419054 - RNA, 18 nt, Human
accaaaauaagaaaagau

SEQ ID NO: 2419055 - RNA, 14 nt, Human
accaaaauccccuu

SEQ ID NO: 2419056 - RNA, 18 nt, Human
accaaaacugugcagagu

SEQ ID NO: 2419057 - RNA, 12 nt, Human
accaaaacugug

SEQ ID NO: 2419058 - RNA, 12 nt, Human
accaaaacaugu

SEQ ID NO: 2419059 - RNA, 17 nt, Human
accaaaacugugcagag

SEQ ID NO: 2419060 - RNA, 15 nt, Human
accaaaagaacaaga

SEQ ID NO: 2419061 - RNA, 22 nt, Human
acauugaauuagaaacauaaau

SEQ ID NO: 2419062 - RNA, 18 nt, Human
acauugaauuagaaacau

SEQ ID NO: 2419063 - RNA, 14 nt, Human
acauugaauuagaa

SEQ ID NO: 2419064 - RNA, 19 nt, Human
acauugcauauaacuuaua

SEQ ID NO: 2419065 - RNA, 17 nt, Human
acauugucauuuauaua

SEQ ID NO: 2419066 - RNA, 19 nt, Human
acauugucauuuauauaga

SEQ ID NO: 2419067 - RNA, 15 nt, Human
acauugucauuuaua

SEQ ID NO: 2419068 - RNA, 18 nt, Human
acauugucagcaaauuaa

SEQ ID NO: 2419069 - RNA, 12 nt, Human
acauugucaaua

SEQ ID NO: 2419070 - RNA, 13 nt, Human
acauugucaauaa

SEQ ID NO: 2419071 - RNA, 14 nt, Human
acauugucagcaaa

SEQ ID NO: 2419072 - RNA, 14 nt, Human
acauugucaauaaa

SEQ ID NO: 2419073 - RNA, 17 nt, Human
acauuguugagcuauug

SEQ ID NO: 2419074 - RNA, 22 nt, Human
acauugucucuaaauugugggu

SEQ ID NO: 2419075 - RNA, 16 nt, Human
acauuguucaauuaga

SEQ ID NO: 2419076 - RNA, 20 nt, Human
acauuguucaauuagaauag

SEQ ID NO: 2419077 - RNA, 17 nt, Human
acauuguggcacauucu

SEQ ID NO: 2419078 - RNA, 12 nt, Human
acauugucugcg

SEQ ID NO: 2419079 - RNA, 18 nt, Human
acauuuuauuuuauuaug

SEQ ID NO: 2419080 - RNA, 14 nt, Human
acauuuuauuuuau

SEQ ID NO: 2419081 - RNA, 19 nt, Human
acauuuuauuuuauuaugc

SEQ ID NO: 2419082 - RNA, 20 nt, Human
acauuuuauuuuauuaugca

SEQ ID NO: 2419083 - RNA, 20 nt, Human
acauuuuguaacaaagaacu

SEQ ID NO: 2419084 - RNA, 14 nt, Human
acauuuugccaaaa

SEQ ID NO: 2419085 - RNA, 17 nt, Human
acauuuuggugagaaau

SEQ ID NO: 2419086 - RNA, 12 nt, Human
acauuuucauuu

SEQ ID NO: 2419087 - RNA, 12 nt, Human
acauuuuccuuu

SEQ ID NO: 2419088 - RNA, 19 nt, Human
acauuuuccuuuucaaaua

SEQ ID NO: 2419089 - RNA, 14 nt, Human
acauuguugagcua

SEQ ID NO: 2419090 - RNA, 13 nt, Human
acauuuucacaca

SEQ ID NO: 2419091 - RNA, 15 nt, Human
acauuuucacacaau

SEQ ID NO: 2419092 - RNA, 20 nt, Human
acauuuucacacaauacaau

SEQ ID NO: 2419093 - RNA, 18 nt, Human
ucaaugacagagccuucu

SEQ ID NO: 2419094 - RNA, 17 nt, Human
ucaaugacagagccuuc

SEQ ID NO: 2419095 - RNA, 23 nt, Human
ucaaugaaugaaugaauggcuaa

SEQ ID NO: 2419096 - RNA, 15 nt, Human
ucaaugacagagccu

SEQ ID NO: 2419097 - RNA, 17 nt, Human
acauucuuauaaauaug

SEQ ID NO: 2419098 - RNA, 11 nt, Human
ucaaugaucua

SEQ ID NO: 2419099 - RNA, 16 nt, Human
acauucuuauaaauau

SEQ ID NO: 2419100 - RNA, 10 nt, Human
ucaaugaucu

SEQ ID NO: 2419101 - RNA, 22 nt, Human
acauucuuauaaauaugaagcu

SEQ ID NO: 2419102 - RNA, 18 nt, Human
acauucuuauaaauauga

SEQ ID NO: 2419103 - RNA, 23 nt, Human
acauucuuauaaauaugaagcuc

SEQ ID NO: 2419104 - RNA, 19 nt, Human
acauucuuccaaaaagauu

SEQ ID NO: 2419105 - RNA, 12 nt, Human
acauugaaagag

SEQ ID NO: 2419106 - RNA, 15 nt, Human
acauugaaguaauga

SEQ ID NO: 2419107 - RNA, 18 nt, Human
acauugaaguaaugaauu

SEQ ID NO: 2419108 - RNA, 19 nt, Human
acauugaaguaaugaauuu

SEQ ID NO: 2419109 - RNA, 20 nt, Human
acauugaaguaaugaauuuu

SEQ ID NO: 2419110 - RNA, 17 nt, Human
ucaaucuguaaacugug

SEQ ID NO: 2419111 - RNA, 16 nt, Human
ucaaucuguuuuucau

SEQ ID NO: 2419112 - RNA, 14 nt, Human
ucaaucuguaaacu

SEQ ID NO: 2419113 - RNA, 16 nt, Human
ucaaucuguaaacugu

SEQ ID NO: 2419114 - RNA, 13 nt, Human
ucaaucuguaaac

SEQ ID NO: 2419115 - RNA, 18 nt, Human
ucaaucucccgcugcugc

SEQ ID NO: 2419116 - RNA, 20 nt, Human
ucaaucucccgcugcugcug

SEQ ID NO: 2419117 - RNA, 17 nt, Human
ucaauauuuaaacaugg

SEQ ID NO: 2419118 - RNA, 15 nt, Human
ucaauccuuguucag

SEQ ID NO: 2419119 - RNA, 15 nt, Human
ucaaucucucuuaga

SEQ ID NO: 2419120 - RNA, 19 nt, Human
ucaauauuucagauaauca

SEQ ID NO: 2419121 - RNA, 13 nt, Human
ucaauauuuauua

SEQ ID NO: 2419122 - RNA, 12 nt, Human
ucaauauuuauu

SEQ ID NO: 2419123 - RNA, 20 nt, Human
ucaauauuuauuauuuucac

SEQ ID NO: 2419124 - RNA, 14 nt, Human
ucaauccucuaagc

SEQ ID NO: 2419125 - RNA, 15 nt, Human
ucaauauuucagaua

SEQ ID NO: 2419126 - RNA, 13 nt, Human
ucaauauuuaaac

SEQ ID NO: 2419127 - RNA, 18 nt, Human
ucaauauugucauuccug

SEQ ID NO: 2419128 - RNA, 11 nt, Human
ucaauauuuau

SEQ ID NO: 2419129 - RNA, 17 nt, Human
ucaauauugucauuccu

SEQ ID NO: 2419130 - RNA, 15 nt, Human
ucaauauugucauuc

SEQ ID NO: 2419131 - RNA, 10 nt, Human
ucaauauuua

SEQ ID NO: 2419132 - RNA, 21 nt, Human
ucaagaaaaauuauuguauaa

SEQ ID NO: 2419133 - RNA, 18 nt, Human
ucaagaaaaauuauugua

SEQ ID NO: 2419134 - RNA, 21 nt, Human
ucaacuuuuccuuugaauccu

SEQ ID NO: 2419135 - RNA, 17 nt, Human
ucaagaaaacaacuuca

SEQ ID NO: 2419136 - RNA, 22 nt, Human
ucaaguccucuuuucugagagg

SEQ ID NO: 2419137 - RNA, 22 nt, Human
ucaaguccuuaccucuuccgga

SEQ ID NO: 2419138 - RNA, 18 nt, Human
ucaaguccuuaccucuuc

SEQ ID NO: 2419139 - RNA, 14 nt, Human
ucaagucucugcug

SEQ ID NO: 2419140 - RNA, 16 nt, Human
ucaagucucugcuggc

SEQ ID NO: 2419141 - RNA, 17 nt, Human
ucaagucucugcuggcc

SEQ ID NO: 2419142 - RNA, 19 nt, Human
ucaagucucugcuggccca

SEQ ID NO: 2419143 - RNA, 20 nt, Human
ucaacugccaaaaugcucua

SEQ ID NO: 2419144 - RNA, 12 nt, Human
ucaacugggcug

SEQ ID NO: 2419145 - RNA, 18 nt, Human
ucaacuucuggcuccuca

SEQ ID NO: 2419146 - RNA, 16 nt, Human
ucaacuucuggcuccu

SEQ ID NO: 2419147 - RNA, 19 nt, Human
ucaacuucuggcuccucaa

SEQ ID NO: 2419148 - RNA, 15 nt, Human
ucaacuuuuccuuug

SEQ ID NO: 2419149 - RNA, 22 nt, Human
ucaacuuucuuuugauuagugu

SEQ ID NO: 2419150 - RNA, 19 nt, Human
ucaacuugcauccaacucc

SEQ ID NO: 2419151 - RNA, 22 nt, Human
ucaauauuaaauacagacacua

SEQ ID NO: 2419152 - RNA, 21 nt, Human
ucaauauuaaauacagacacu

SEQ ID NO: 2419153 - RNA, 19 nt, Human
ucaauauuaaauacagaca

SEQ ID NO: 2419154 - RNA, 17 nt, Human
ucaauauuaaauacaga

SEQ ID NO: 2419155 - RNA, 16 nt, Human
ucaauauuaaauacag

SEQ ID NO: 2419156 - RNA, 15 nt, Human
ucaauauuaaauaca

SEQ ID NO: 2419157 - RNA, 14 nt, Human
ucaauauuaaauac

SEQ ID NO: 2419158 - RNA, 13 nt, Human
ucaauaugcuuac

SEQ ID NO: 2419159 - RNA, 22 nt, Human
ucaauaucuuuuuuuuaauaaa

SEQ ID NO: 2419160 - RNA, 17 nt, Human
ucaauauuccugaauga

SEQ ID NO: 2419161 - RNA, 18 nt, Human
ucaauauuccugaaugaa

SEQ ID NO: 2419162 - RNA, 21 nt, Human
ucaauauuccugaaugaaaua

SEQ ID NO: 2419163 - RNA, 22 nt, Human
ucaauauuccugaaugaaauau

SEQ ID NO: 2419164 - RNA, 14 nt, Human
ucaauauuccugaa

SEQ ID NO: 2419165 - RNA, 17 nt, Human
ucaauagucaagaaaaa

SEQ ID NO: 2419166 - RNA, 14 nt, Human
ucaauagucaagaa

SEQ ID NO: 2419167 - RNA, 19 nt, Human
ucaauaguaaaagauaaca

SEQ ID NO: 2419168 - RNA, 12 nt, Human
ucaagucuuccc

SEQ ID NO: 2419169 - RNA, 18 nt, Human
ucaauauccaaaccaaau

SEQ ID NO: 2419170 - RNA, 16 nt, Human
ucaauauccuuugccu

SEQ ID NO: 2419171 - RNA, 14 nt, Human
ucaauauccuuugc

SEQ ID NO: 2419172 - RNA, 15 nt, Human
ucaaauugugugaaa

SEQ ID NO: 2419173 - RNA, 18 nt, Human
ucaaauugugugaaaggu

SEQ ID NO: 2419174 - RNA, 16 nt, Human
acauucugauuuggaa

SEQ ID NO: 2419175 - RNA, 20 nt, Human
acauucugacaucuuaguau

SEQ ID NO: 2419176 - RNA, 14 nt, Human
acauuccugaugcu

SEQ ID NO: 2419177 - RNA, 18 nt, Human
acauuccuugccugcaca

SEQ ID NO: 2419178 - RNA, 17 nt, Human
acauucggcucccugga

SEQ ID NO: 2419179 - RNA, 20 nt, Human
acauucggcucccuggagcc

SEQ ID NO: 2419180 - RNA, 17 nt, Human
acauuccuugccugcac

SEQ ID NO: 2419181 - RNA, 15 nt, Human
acauucggcucccug

SEQ ID NO: 2419182 - RNA, 23 nt, Human
acaugucaccguggaccuuccug

SEQ ID NO: 2419183 - RNA, 18 nt, Human
acaugucaguaccuucaa

SEQ ID NO: 2419184 - RNA, 19 nt, Human
acaugucaguaccuucaaa

SEQ ID NO: 2419185 - RNA, 21 nt, Human
acaugucaguaccuucaaacu

SEQ ID NO: 2419186 - RNA, 15 nt, Human
acauguccaagaagc

SEQ ID NO: 2419187 - RNA, 17 nt, Human
acauucccaucugucac

SEQ ID NO: 2419188 - RNA, 20 nt, Human
acauuccuaaacuaucuuuu

SEQ ID NO: 2419189 - RNA, 13 nt, Human
acauuccauccuu

SEQ ID NO: 2419190 - RNA, 23 nt, Human
acauuccgacaaccgaugcucca

SEQ ID NO: 2419191 - RNA, 19 nt, Human
acauuccuaaacuaucuuu

SEQ ID NO: 2419192 - RNA, 18 nt, Human
acauggugccugagaggc

SEQ ID NO: 2419193 - RNA, 16 nt, Human
acauggugccugagag

SEQ ID NO: 2419194 - RNA, 13 nt, Human
acauggugccuga

SEQ ID NO: 2419195 - RNA, 13 nt, Human
acauguacagaga

SEQ ID NO: 2419196 - RNA, 11 nt, Human
acauguacaga

SEQ ID NO: 2419197 - RNA, 18 nt, Human
acauguaauauaaagaug

SEQ ID NO: 2419198 - RNA, 23 nt, Human
acauguaauuaaguacuauguau

SEQ ID NO: 2419199 - RNA, 19 nt, Human
acauguauuuguuugcaua

SEQ ID NO: 2419200 - RNA, 17 nt, Human
acauguauuuguuugca

SEQ ID NO: 2419201 - RNA, 18 nt, Human
acauguauuuguuugcau

SEQ ID NO: 2419202 - RNA, 23 nt, Human
acauguagguguuuguucaucug

SEQ ID NO: 2419203 - RNA, 15 nt, Human
acauguagguguuug

SEQ ID NO: 2419204 - RNA, 16 nt, Human
acauguauuuguuugc

SEQ ID NO: 2419205 - RNA, 17 nt, Human
acauguaggaaguagga

SEQ ID NO: 2419206 - RNA, 20 nt, Human
acauguacuguucucuucuu

SEQ ID NO: 2419207 - RNA, 20 nt, Human
ucaacugcaucaagauguga

SEQ ID NO: 2419208 - RNA, 23 nt, Human
ucaacccaggagcauccaccucc

SEQ ID NO: 2419209 - RNA, 20 nt, Human
ucaaccccaccacuucuuuu

SEQ ID NO: 2419210 - RNA, 18 nt, Human
ucaacugccuacuccaaa

SEQ ID NO: 2419211 - RNA, 20 nt, Human
ucaacugccuacuccaaaau

SEQ ID NO: 2419212 - RNA, 18 nt, Human
ucaacugggcugaacacu

SEQ ID NO: 2419213 - RNA, 14 nt, Human
ucaacugccuacuc

SEQ ID NO: 2419214 - RNA, 19 nt, Human
ucaacugccaaaaugcucu

SEQ ID NO: 2419215 - RNA, 18 nt, Human
ucaacccccauuucuauu

SEQ ID NO: 2419216 - RNA, 24 nt, Human
ucaacugaccagccuccaugcugc

SEQ ID NO: 2419217 - RNA, 17 nt, Human
ucaaccaccuuucagau

SEQ ID NO: 2419218 - RNA, 23 nt, Human
ucaaccacuguaaaaugaaauua

SEQ ID NO: 2419219 - RNA, 14 nt, Human
ucaaccagcagaug

SEQ ID NO: 2419220 - RNA, 18 nt, Human
ucaaccauuccccauggg

SEQ ID NO: 2419221 - RNA, 16 nt, Human
ucaaccaucgcuuuau

SEQ ID NO: 2419222 - RNA, 15 nt, Human
ucaacccaggagcau

SEQ ID NO: 2419223 - RNA, 15 nt, Human
ucaaccauuccccau

SEQ ID NO: 2419224 - RNA, 18 nt, Human
ucaacaaacuauuucuua

SEQ ID NO: 2419225 - RNA, 15 nt, Human
ucaacaaaaauuguc

SEQ ID NO: 2419226 - RNA, 14 nt, Human
ucaacaaacuauuu

SEQ ID NO: 2419227 - RNA, 18 nt, Human
ucaacaaaaauugucccu

SEQ ID NO: 2419228 - RNA, 13 nt, Human
ucaaauuucuaaa

SEQ ID NO: 2419229 - RNA, 12 nt, Human
ucaaauuucaca

SEQ ID NO: 2419230 - RNA, 14 nt, Human
ucaacauuuacaug

SEQ ID NO: 2419231 - RNA, 23 nt, Human
ucaacaaagcacaguguuaaaug

SEQ ID NO: 2419232 - RNA, 18 nt, Human
ucaacaaagcacaguguu

SEQ ID NO: 2419233 - RNA, 15 nt, Human
ucaacaaagcacagu

SEQ ID NO: 2419234 - RNA, 14 nt, Human
ucaacaaagcacag

SEQ ID NO: 2419235 - RNA, 14 nt, Human
ucaacaaccaggga

SEQ ID NO: 2419236 - RNA, 16 nt, Human
ucaacauuuacaugua

SEQ ID NO: 2419237 - RNA, 16 nt, Human
ucaacaagggagagac

SEQ ID NO: 2419238 - RNA, 14 nt, Human
ucaacauuucucaa

SEQ ID NO: 2419239 - RNA, 17 nt, Human
ucaacauuuacauguau

SEQ ID NO: 2419240 - RNA, 15 nt, Human
ucaaccaauguagaa

SEQ ID NO: 2419241 - RNA, 17 nt, Human
ucaaccaaugccaaaaa

SEQ ID NO: 2419242 - RNA, 18 nt, Human
acaugcgguagccagcac

SEQ ID NO: 2419243 - RNA, 13 nt, Human
acaugagucccag

SEQ ID NO: 2419244 - RNA, 13 nt, Human
acaugagucaaga

SEQ ID NO: 2419245 - RNA, 20 nt, Human
acaugcgguagccagcacac

SEQ ID NO: 2419246 - RNA, 22 nt, Human
acaugcgguagccagcacacag

SEQ ID NO: 2419247 - RNA, 23 nt, Human
acaugcgguagccagcacacagg

SEQ ID NO: 2419248 - RNA, 23 nt, Human
acaugagguacugagagugaaca

SEQ ID NO: 2419249 - RNA, 15 nt, Human
acaugcuacacacug

SEQ ID NO: 2419250 - RNA, 21 nt, Human
acaugcuacacacugcauguu

SEQ ID NO: 2419251 - RNA, 16 nt, Human
acaugagguacugaga

SEQ ID NO: 2419252 - RNA, 20 nt, Human
acaugagguacugagaguga

SEQ ID NO: 2419253 - RNA, 23 nt, Human
acaugaaucccacccacauguga

SEQ ID NO: 2419254 - RNA, 21 nt, Human
acaugaaucccacccacaugu

SEQ ID NO: 2419255 - RNA, 20 nt, Human
acaugaaucccacccacaug

SEQ ID NO: 2419256 - RNA, 13 nt, Human
acaugaauaugau

SEQ ID NO: 2419257 - RNA, 18 nt, Human
acaugaauugcauuuuac

SEQ ID NO: 2419258 - RNA, 15 nt, Human
acaugaaugcacacu

SEQ ID NO: 2419259 - RNA, 20 nt, Human
acaugaauauuuaguguuca

SEQ ID NO: 2419260 - RNA, 17 nt, Human
acagucccuaaagaaaa

SEQ ID NO: 2419261 - RNA, 16 nt, Human
acaguccagccuggag

SEQ ID NO: 2419262 - RNA, 18 nt, Human
acaguccagccuggagau

SEQ ID NO: 2419263 - RNA, 19 nt, Human
acaugaaguguguuuccuu

SEQ ID NO: 2419264 - RNA, 21 nt, Human
acaugaaguguguuuccuuca

SEQ ID NO: 2419265 - RNA, 20 nt, Human
acagucagauuuccagucuc

SEQ ID NO: 2419266 - RNA, 13 nt, Human
acagucauuuaaa

SEQ ID NO: 2419267 - RNA, 15 nt, Human
acaguccagccugga

SEQ ID NO: 2419268 - RNA, 14 nt, Human
acagucauuuaaaa

SEQ ID NO: 2419269 - RNA, 14 nt, Human
acaguccagccugg

SEQ ID NO: 2419270 - RNA, 20 nt, Human
acaugggacauuugcucaug

SEQ ID NO: 2419271 - RNA, 15 nt, Human
acaugggacauuugc

SEQ ID NO: 2419272 - RNA, 21 nt, Human
acaugggacauuugcucaugg

SEQ ID NO: 2419273 - RNA, 20 nt, Human
acaugggagccgggucugcc

SEQ ID NO: 2419274 - RNA, 20 nt, Human
acauggcuugccacagcucu

SEQ ID NO: 2419275 - RNA, 14 nt, Human
acaugggacauuug

SEQ ID NO: 2419276 - RNA, 11 nt, Human
acaugggacau

SEQ ID NO: 2419277 - RNA, 17 nt, Human
acauggaacucauuccu

SEQ ID NO: 2419278 - RNA, 13 nt, Human
acaugcuuuguga

SEQ ID NO: 2419279 - RNA, 16 nt, Human
acauggcuuccuccug

SEQ ID NO: 2419280 - RNA, 13 nt, Human
acauggcuuccuc

SEQ ID NO: 2419281 - RNA, 14 nt, Human
acauggcuuaguuu

SEQ ID NO: 2419282 - RNA, 19 nt, Human
acauggcuuaguuuucaua

SEQ ID NO: 2419283 - RNA, 17 nt, Human
acauguaauuaaguacu

SEQ ID NO: 2419284 - RNA, 19 nt, Human
acauguaauuaaguacuau

SEQ ID NO: 2419285 - RNA, 21 nt, Human
acauguaauuaaguacuaugu

SEQ ID NO: 2419286 - RNA, 22 nt, Human
acauguaauuaaguacuaugua

SEQ ID NO: 2419287 - RNA, 23 nt, Human
acaugggagccgggucugccucu

SEQ ID NO: 2419288 - RNA, 16 nt, Human
acauggggaggaagga

SEQ ID NO: 2419289 - RNA, 18 nt, Human
acauggggcugggcagcu

SEQ ID NO: 2419290 - RNA, 17 nt, Human
acaugggguuggcuggg

SEQ ID NO: 2419291 - RNA, 20 nt, Human
acaugggguuggcugggccc

SEQ ID NO: 2419292 - RNA, 21 nt, Human
acaugggguuggcugggccca

SEQ ID NO: 2419293 - RNA, 16 nt, Human
acaugggguuuucaau

SEQ ID NO: 2419294 - RNA, 18 nt, Human
acaugggguuuucaauuu

SEQ ID NO: 2419295 - RNA, 22 nt, Human
acaugggguuuucaauuuugca

SEQ ID NO: 2419296 - RNA, 15 nt, Human
acauguaauuaagua

SEQ ID NO: 2419297 - RNA, 21 nt, Human
acauggugaaaccucaucucu

SEQ ID NO: 2419298 - RNA, 22 nt, Human
acaugguagccaguugaauuua

SEQ ID NO: 2419299 - RNA, 21 nt, Human
acaugguaaacgcugucccua

SEQ ID NO: 2419300 - RNA, 13 nt, Human
acccgggaagggg

SEQ ID NO: 2419301 - RNA, 12 nt, Human
acccgggaaggg

SEQ ID NO: 2419302 - RNA, 14 nt, Human
acccggcugcagag

SEQ ID NO: 2419303 - RNA, 17 nt, Human
acccgggaggcagaggu

SEQ ID NO: 2419304 - RNA, 20 nt, Human
acccggccccugcugguuca

SEQ ID NO: 2419305 - RNA, 17 nt, Human
acccggccccugcuggu

SEQ ID NO: 2419306 - RNA, 22 nt, Human
acccggccccugcugguucagg

SEQ ID NO: 2419307 - RNA, 22 nt, Human
acccggcaggcuagaaccuggc

SEQ ID NO: 2419308 - RNA, 21 nt, Human
acccggcgguccccuccgcca

SEQ ID NO: 2419309 - RNA, 16 nt, Human
acccggccccugcugg

SEQ ID NO: 2419310 - RNA, 15 nt, Human
acccggccccugcug

SEQ ID NO: 2419311 - RNA, 21 nt, Human
acccggaggggccuggcagcc

SEQ ID NO: 2419312 - RNA, 18 nt, Human
acccggaggggccuggca

SEQ ID NO: 2419313 - RNA, 14 nt, Human
acccggccccugcu

SEQ ID NO: 2419314 - RNA, 22 nt, Human
ucagguaacaggcagauacagg

SEQ ID NO: 2419315 - RNA, 21 nt, Human
ucagguaacaggcagauacag

SEQ ID NO: 2419316 - RNA, 23 nt, Human
ucagguaacaggcagauacagga

SEQ ID NO: 2419317 - RNA, 15 nt, Human
acccggaggggccug

SEQ ID NO: 2419318 - RNA, 21 nt, Human
ucaggguucuccucuccccuc

SEQ ID NO: 2419319 - RNA, 22 nt, Human
ucagcuuguaaauagcucaggu

SEQ ID NO: 2419320 - RNA, 21 nt, Human
ucagcuuguaaauagcucagg

SEQ ID NO: 2419321 - RNA, 14 nt, Human
ucagcuccagcuca

SEQ ID NO: 2419322 - RNA, 22 nt, Human
ucaggccaggcccucugcccac

SEQ ID NO: 2419323 - RNA, 21 nt, Human
ucaggccaggcccucugccca

SEQ ID NO: 2419324 - RNA, 16 nt, Human
ucagcuugugcacaau

SEQ ID NO: 2419325 - RNA, 23 nt, Human
ucagcuccagacguaggggaggg

SEQ ID NO: 2419326 - RNA, 15 nt, Human
ucagcuacugauuuu

SEQ ID NO: 2419327 - RNA, 20 nt, Human
ucaggccaggcccucugccc

SEQ ID NO: 2419328 - RNA, 15 nt, Human
ucagcuuugccuucc

SEQ ID NO: 2419329 - RNA, 16 nt, Human
ucagcuuugccuucca

SEQ ID NO: 2419330 - RNA, 16 nt, Human
ucagcuuuugcuucau

SEQ ID NO: 2419331 - RNA, 22 nt, Human
ucagcuuugccuuccacgcugu

SEQ ID NO: 2419332 - RNA, 23 nt, Human
ucaggccaggcccucugcccacu

SEQ ID NO: 2419333 - RNA, 12 nt, Human
ucagggcugaca

SEQ ID NO: 2419334 - RNA, 14 nt, Human
ucagggcuccuggg

SEQ ID NO: 2419335 - RNA, 18 nt, Human
ucagcuuuuugucuuuuc

SEQ ID NO: 2419336 - RNA, 22 nt, Human
ucagggcugacacguccacccc

SEQ ID NO: 2419337 - RNA, 16 nt, Human
ucaggggacucagccc

SEQ ID NO: 2419338 - RNA, 20 nt, Human
ucaggggcugcccgcuccca

SEQ ID NO: 2419339 - RNA, 16 nt, Human
ucaggggcugcccgcu

SEQ ID NO: 2419340 - RNA, 14 nt, Human
ucaggggcugcccg

SEQ ID NO: 2419341 - RNA, 13 nt, Human
ucaggggcugccc

SEQ ID NO: 2419342 - RNA, 16 nt, Human
ucaggggccagaggaa

SEQ ID NO: 2419343 - RNA, 15 nt, Human
ucaggggccagagga

SEQ ID NO: 2419344 - RNA, 18 nt, Human
ucaggggacucagcccug

SEQ ID NO: 2419345 - RNA, 14 nt, Human
ucaggggccagagg

SEQ ID NO: 2419346 - RNA, 12 nt, Human
ucaggggccaga

SEQ ID NO: 2419347 - RNA, 16 nt, Human
ucaggggagucccguc

SEQ ID NO: 2419348 - RNA, 20 nt, Human
ucaggggagucccgucagga

SEQ ID NO: 2419349 - RNA, 16 nt, Human
ucaggguuggccccug

SEQ ID NO: 2419350 - RNA, 17 nt, Human
ucagggucucugcugcc

SEQ ID NO: 2419351 - RNA, 16 nt, Human
ucagggucucugcugc

SEQ ID NO: 2419352 - RNA, 12 nt, Human
ucagggucucug

SEQ ID NO: 2419353 - RNA, 14 nt, Human
ucaggggcuguuug

SEQ ID NO: 2419354 - RNA, 16 nt, Human
ucagggugaugccagg

SEQ ID NO: 2419355 - RNA, 18 nt, Human
ucagggucucugcugccg

SEQ ID NO: 2419356 - RNA, 15 nt, Human
ucaggguucuccucu

SEQ ID NO: 2419357 - RNA, 19 nt, Human
ucagggucccugguggcag

SEQ ID NO: 2419358 - RNA, 18 nt, Human
ucaggggcuguuugagga

SEQ ID NO: 2419359 - RNA, 22 nt, Human
ucaggggcugcccgcucccagu

SEQ ID NO: 2419360 - RNA, 21 nt, Human
ucaggggcugcccgcucccag

SEQ ID NO: 2419361 - RNA, 13 nt, Human
ucagggggccagg

SEQ ID NO: 2419362 - RNA, 12 nt, Human
ucagggggccag

SEQ ID NO: 2419363 - RNA, 14 nt, Human
acccguccagaccu

SEQ ID NO: 2419364 - RNA, 15 nt, Human
acccguacaacgugu

SEQ ID NO: 2419365 - RNA, 23 nt, Human
acccgggcucagggaccacagca

SEQ ID NO: 2419366 - RNA, 13 nt, Human
acccgggcucagg

SEQ ID NO: 2419367 - RNA, 12 nt, Human
acccgggcucag

SEQ ID NO: 2419368 - RNA, 21 nt, Human
acccgggaggcggagcuugca

SEQ ID NO: 2419369 - RNA, 18 nt, Human
acccucgaggcggaucuu

SEQ ID NO: 2419370 - RNA, 19 nt, Human
acccucgaggcggaucuuu

SEQ ID NO: 2419371 - RNA, 17 nt, Human
acccucgggcccaccug

SEQ ID NO: 2419372 - RNA, 16 nt, Human
acccucgggcccaccu

SEQ ID NO: 2419373 - RNA, 15 nt, Human
acccucgggcccacc

SEQ ID NO: 2419374 - RNA, 14 nt, Human
acccucgggcccac

SEQ ID NO: 2419375 - RNA, 13 nt, Human
acccucgggccca

SEQ ID NO: 2419376 - RNA, 21 nt, Human
acccucgggcccaccuggcca

SEQ ID NO: 2419377 - RNA, 20 nt, Human
acccucgggcccaccuggcc

SEQ ID NO: 2419378 - RNA, 19 nt, Human
acccucgggcccaccuggc

SEQ ID NO: 2419379 - RNA, 18 nt, Human
acccucgggcccaccugg

SEQ ID NO: 2419380 - RNA, 22 nt, Human
acccucgggcccaccuggccac

SEQ ID NO: 2419381 - RNA, 20 nt, Human
acccucguggccuuccccag

SEQ ID NO: 2419382 - RNA, 14 nt, Human
acccucguggccuu

SEQ ID NO: 2419383 - RNA, 16 nt, Human
acccugaaagcccuga

SEQ ID NO: 2419384 - RNA, 18 nt, Human
acccugaaagcccugagc

SEQ ID NO: 2419385 - RNA, 16 nt, Human
acccucucagcuccag

SEQ ID NO: 2419386 - RNA, 15 nt, Human
acccucucagcucca

SEQ ID NO: 2419387 - RNA, 19 nt, Human
acccucucaggugaccaaa

SEQ ID NO: 2419388 - RNA, 14 nt, Human
acccucuccacccc

SEQ ID NO: 2419389 - RNA, 15 nt, Human
acccucuccacccca

SEQ ID NO: 2419390 - RNA, 16 nt, Human
acccucuccaccccau

SEQ ID NO: 2419391 - RNA, 19 nt, Human
acccucugaaugguccagg

SEQ ID NO: 2419392 - RNA, 14 nt, Human
acccucucccagga

SEQ ID NO: 2419393 - RNA, 15 nt, Human
acccucucccaggac

SEQ ID NO: 2419394 - RNA, 21 nt, Human
acccucugaaugguccagggu

SEQ ID NO: 2419395 - RNA, 22 nt, Human
acccucugaaugguccaggguu

SEQ ID NO: 2419396 - RNA, 12 nt, Human
acccugaagggg

SEQ ID NO: 2419397 - RNA, 17 nt, Human
acccugaaggggccaug

SEQ ID NO: 2419398 - RNA, 13 nt, Human
acccucugccacc

SEQ ID NO: 2419399 - RNA, 21 nt, Human
acccucugagcuuugcauguu

SEQ ID NO: 2419400 - RNA, 18 nt, Human
acccucugagcuuugcau

SEQ ID NO: 2419401 - RNA, 13 nt, Human
acccucugagcuu

SEQ ID NO: 2419402 - RNA, 17 nt, Human
acccucugccaccagag

SEQ ID NO: 2419403 - RNA, 14 nt, Human
acccucugccacca

SEQ ID NO: 2419404 - RNA, 14 nt, Human
acccugaggcccag

SEQ ID NO: 2419405 - RNA, 22 nt, Human
acccugaaugguuccaugccug

SEQ ID NO: 2419406 - RNA, 21 nt, Human
acccugaaugguuccaugccu

SEQ ID NO: 2419407 - RNA, 18 nt, Human
acccugaaggggccauga

SEQ ID NO: 2419408 - RNA, 21 nt, Human
acccugaauuuggccugcacu

SEQ ID NO: 2419409 - RNA, 15 nt, Human
acccugcccuguggg

SEQ ID NO: 2419410 - RNA, 16 nt, Human
acccugaggcccagag

SEQ ID NO: 2419411 - RNA, 15 nt, Human
acccugaggcccaga

SEQ ID NO: 2419412 - RNA, 22 nt, Human
acccugcccugugggcccccaa

SEQ ID NO: 2419413 - RNA, 17 nt, Human
acccugcccugugggcc

SEQ ID NO: 2419414 - RNA, 15 nt, Human
acccuucuuuccucu

SEQ ID NO: 2419415 - RNA, 14 nt, Human
acccuucuuuccuc

SEQ ID NO: 2419416 - RNA, 12 nt, Human
acccuucuuuuc

SEQ ID NO: 2419417 - RNA, 23 nt, Human
acccuucuccucuuguaaauaaa

SEQ ID NO: 2419418 - RNA, 23 nt, Human
acccuuguggucccaccccacac

SEQ ID NO: 2419419 - RNA, 20 nt, Human
acccuuguggucccacccca

SEQ ID NO: 2419420 - RNA, 17 nt, Human
acccuugccgucuaccu

SEQ ID NO: 2419421 - RNA, 20 nt, Human
acccuucuuuccucuucccc

SEQ ID NO: 2419422 - RNA, 18 nt, Human
acccuucuuuccucuucc

SEQ ID NO: 2419423 - RNA, 16 nt, Human
acccuucuuuccucuu

SEQ ID NO: 2419424 - RNA, 11 nt, Human
acccuugacac

SEQ ID NO: 2419425 - RNA, 16 nt, Human
acccuugaaaagacau

SEQ ID NO: 2419426 - RNA, 23 nt, Human
acccuuuccuuccuucccuggcu

SEQ ID NO: 2419427 - RNA, 21 nt, Human
acccuuuccuuccuucccugg

SEQ ID NO: 2419428 - RNA, 22 nt, Human
acccuuuccuuccuucccuggc

SEQ ID NO: 2419429 - RNA, 15 nt, Human
acccuuuccuuccuu

SEQ ID NO: 2419430 - RNA, 17 nt, Human
acccuuuccuuccuucc

SEQ ID NO: 2419431 - RNA, 18 nt, Human
acccuuuccuuccuuccc

SEQ ID NO: 2419432 - RNA, 19 nt, Human
acccuuuccuuccuucccu

SEQ ID NO: 2419433 - RNA, 20 nt, Human
acccuuuagccaaacccuug

SEQ ID NO: 2419434 - RNA, 14 nt, Human
acccuuuccuuccu

SEQ ID NO: 2419435 - RNA, 17 nt, Human
acccuugcccaccccac

SEQ ID NO: 2419436 - RNA, 16 nt, Human
acccuugcccacccca

SEQ ID NO: 2419437 - RNA, 13 nt, Human
acccuugaaaaga

SEQ ID NO: 2419438 - RNA, 15 nt, Human
accgaaaacguggcu

SEQ ID NO: 2419439 - RNA, 14 nt, Human
acccuuuugucugc

SEQ ID NO: 2419440 - RNA, 17 nt, Human
acccuuuuucuccagcu

SEQ ID NO: 2419441 - RNA, 22 nt, Human
accccagccccaaaacucuccu

SEQ ID NO: 2419442 - RNA, 23 nt, Human
accccagccgcucggaggcccca

SEQ ID NO: 2419443 - RNA, 12 nt, Human
accccagccuaa

SEQ ID NO: 2419444 - RNA, 15 nt, Human
accccacccucccug

SEQ ID NO: 2419445 - RNA, 18 nt, Human
accccagacgaugucuuc

SEQ ID NO: 2419446 - RNA, 13 nt, Human
accccagcauccu

SEQ ID NO: 2419447 - RNA, 13 nt, Human
accccagccccaa

SEQ ID NO: 2419448 - RNA, 13 nt, Human
accccagagugug

SEQ ID NO: 2419449 - RNA, 17 nt, Human
accccacacacgccaga

SEQ ID NO: 2419450 - RNA, 20 nt, Human
accccacaccaggccguccu

SEQ ID NO: 2419451 - RNA, 17 nt, Human
accccacaccaggccgu

SEQ ID NO: 2419452 - RNA, 16 nt, Human
accccacaccaggccg

SEQ ID NO: 2419453 - RNA, 23 nt, Human
acccaggagguggagguugcagu

SEQ ID NO: 2419454 - RNA, 18 nt, Human
accccacacgcuccuccc

SEQ ID NO: 2419455 - RNA, 22 nt, Human
accccacaccaggccguccucc

SEQ ID NO: 2419456 - RNA, 11 nt, Human
accccacacuu

SEQ ID NO: 2419457 - RNA, 11 nt, Human
accccacccaa

SEQ ID NO: 2419458 - RNA, 22 nt, Human
accccaccacgauguggcccug

SEQ ID NO: 2419459 - RNA, 21 nt, Human
accccacacuuguuccagcuc

SEQ ID NO: 2419460 - RNA, 15 nt, Human
accccacccccaccc

SEQ ID NO: 2419461 - RNA, 12 nt, Human
accccacccccu

SEQ ID NO: 2419462 - RNA, 21 nt, Human
accccacccccuucagugccc

SEQ ID NO: 2419463 - RNA, 13 nt, Human
accccacccuccc

SEQ ID NO: 2419464 - RNA, 21 nt, Human
accccacccucagcaccccuu

SEQ ID NO: 2419465 - RNA, 15 nt, Human
accccacccucagca

SEQ ID NO: 2419466 - RNA, 14 nt, Human
accccacccucagc

SEQ ID NO: 2419467 - RNA, 13 nt, Human
accccacccucag

SEQ ID NO: 2419468 - RNA, 12 nt, Human
accccacccuca

SEQ ID NO: 2419469 - RNA, 21 nt, Human
accccacccuaguuucccuga

SEQ ID NO: 2419470 - RNA, 22 nt, Human
accccacccccuucagugccca

SEQ ID NO: 2419471 - RNA, 19 nt, Human
acccaggagggagggggcu

SEQ ID NO: 2419472 - RNA, 11 nt, Human
acccaggaggu

SEQ ID NO: 2419473 - RNA, 14 nt, Human
acccaggaggugga

SEQ ID NO: 2419474 - RNA, 20 nt, Human
acccaggagguggagguugc

SEQ ID NO: 2419475 - RNA, 21 nt, Human
acccaggagguggagguugca

SEQ ID NO: 2419476 - RNA, 23 nt, Human
acccaggagccccgaggccuucu

SEQ ID NO: 2419477 - RNA, 19 nt, Human
acccaggagccccgaggcc

SEQ ID NO: 2419478 - RNA, 16 nt, Human
ucagcccucccugccc

SEQ ID NO: 2419479 - RNA, 15 nt, Human
ucagcccucccugcc

SEQ ID NO: 2419480 - RNA, 14 nt, Human
ucagcccucccugc

SEQ ID NO: 2419481 - RNA, 13 nt, Human
ucagcccucccug

SEQ ID NO: 2419482 - RNA, 17 nt, Human
ucagccagccccaucag

SEQ ID NO: 2419483 - RNA, 15 nt, Human
ucagccagccccauc

SEQ ID NO: 2419484 - RNA, 14 nt, Human
ucagccagagaagc

SEQ ID NO: 2419485 - RNA, 12 nt, Human
ucagccaggagc

SEQ ID NO: 2419486 - RNA, 18 nt, Human
accauaauguuacauuau

SEQ ID NO: 2419487 - RNA, 15 nt, Human
accauaauguuacau

SEQ ID NO: 2419488 - RNA, 22 nt, Human
accauaagguuucguuucugua

SEQ ID NO: 2419489 - RNA, 13 nt, Human
accauaauguuac

SEQ ID NO: 2419490 - RNA, 12 nt, Human
ucagauuugaac

SEQ ID NO: 2419491 - RNA, 17 nt, Human
accauaccuuccuuccc

SEQ ID NO: 2419492 - RNA, 16 nt, Human
accauaccuuccuucc

SEQ ID NO: 2419493 - RNA, 15 nt, Human
accauaccuuccuuc

SEQ ID NO: 2419494 - RNA, 21 nt, Human
ucagauuugaacucuucaauc

SEQ ID NO: 2419495 - RNA, 18 nt, Human
accaguguuguggauuua

SEQ ID NO: 2419496 - RNA, 19 nt, Human
accaguugggagcacugga

SEQ ID NO: 2419497 - RNA, 18 nt, Human
accaguugggagcacugg

SEQ ID NO: 2419498 - RNA, 22 nt, Human
accaguguuagggaagggccug

SEQ ID NO: 2419499 - RNA, 20 nt, Human
accaguguccccuccacugu

SEQ ID NO: 2419500 - RNA, 21 nt, Human
accagugugguuuguguuuga

SEQ ID NO: 2419501 - RNA, 15 nt, Human
accauaaaaagcuga

SEQ ID NO: 2419502 - RNA, 15 nt, Human
accaguugggagcac

SEQ ID NO: 2419503 - RNA, 21 nt, Human
accaguuuaaccugaugcagu

SEQ ID NO: 2419504 - RNA, 20 nt, Human
accaguuuaaccugaugcag

SEQ ID NO: 2419505 - RNA, 19 nt, Human
accaguuuaaccugaugca

SEQ ID NO: 2419506 - RNA, 21 nt, Human
accaguugggagcacuggagu

SEQ ID NO: 2419507 - RNA, 20 nt, Human
accaguugggagcacuggag

SEQ ID NO: 2419508 - RNA, 19 nt, Human
accauaaccccggaagcca

SEQ ID NO: 2419509 - RNA, 17 nt, Human
ucagauuugccuuauug

SEQ ID NO: 2419510 - RNA, 20 nt, Human
ucagcaaaaagcaaaaucau

SEQ ID NO: 2419511 - RNA, 16 nt, Human
ucagcaaaaagcaaaa

SEQ ID NO: 2419512 - RNA, 15 nt, Human
ucagcaaaaagcaaa

SEQ ID NO: 2419513 - RNA, 14 nt, Human
ucagcaaaaagcaa

SEQ ID NO: 2419514 - RNA, 13 nt, Human
ucagcaaaaagca

SEQ ID NO: 2419515 - RNA, 17 nt, Human
ucagccaauuauguuaa

SEQ ID NO: 2419516 - RNA, 15 nt, Human
ucagccaauuauguu

SEQ ID NO: 2419517 - RNA, 13 nt, Human
ucagccaauuaug

SEQ ID NO: 2419518 - RNA, 23 nt, Human
ucagccaagguuuuauaaggcug

SEQ ID NO: 2419519 - RNA, 15 nt, Human
ucagcaaaagaugcu

SEQ ID NO: 2419520 - RNA, 14 nt, Human
ucagccagcacuug

SEQ ID NO: 2419521 - RNA, 23 nt, Human
ucagccagcacuuguccagcuga

SEQ ID NO: 2419522 - RNA, 12 nt, Human
ucagccagcacu

SEQ ID NO: 2419523 - RNA, 23 nt, Human
ucagccaccauccuauugcaaag

SEQ ID NO: 2419524 - RNA, 21 nt, Human
ucagcaaaaagcaaaaucauu

SEQ ID NO: 2419525 - RNA, 18 nt, Human
ucagccaauuauguuaaa

SEQ ID NO: 2419526 - RNA, 18 nt, Human
ucagcggggacagcuccu

SEQ ID NO: 2419527 - RNA, 24 nt, Human
ucagccuucccccucccagggcca

SEQ ID NO: 2419528 - RNA, 21 nt, Human
ucagccuuccccuugcccagg

SEQ ID NO: 2419529 - RNA, 22 nt, Human
ucagccuuccccuugcccaggg

SEQ ID NO: 2419530 - RNA, 23 nt, Human
ucagccuuccccuugcccagggc

SEQ ID NO: 2419531 - RNA, 17 nt, Human
ucagccugugcugcccg

SEQ ID NO: 2419532 - RNA, 21 nt, Human
ucagccuucccccucccaggg

SEQ ID NO: 2419533 - RNA, 22 nt, Human
ucagccuucccccucccagggc

SEQ ID NO: 2419534 - RNA, 18 nt, Human
ucagccugucucuuccau

SEQ ID NO: 2419535 - RNA, 17 nt, Human
ucagccugucucuucca

SEQ ID NO: 2419536 - RNA, 16 nt, Human
ucagccugucucuucc

SEQ ID NO: 2419537 - RNA, 12 nt, Human
ucagccugugcu

SEQ ID NO: 2419538 - RNA, 16 nt, Human
ucagccugugcugccc

SEQ ID NO: 2419539 - RNA, 21 nt, Human
accccuggcuuuucacugcug

SEQ ID NO: 2419540 - RNA, 20 nt, Human
accccuggcuuuucacugcu

SEQ ID NO: 2419541 - RNA, 19 nt, Human
accccuggcuuuucacugc

SEQ ID NO: 2419542 - RNA, 18 nt, Human
accccuggcuuuucacug

SEQ ID NO: 2419543 - RNA, 16 nt, Human
accccuggugguucac

SEQ ID NO: 2419544 - RNA, 15 nt, Human
accccugggggcucu

SEQ ID NO: 2419545 - RNA, 17 nt, Human
accccuggcuuuucacu

SEQ ID NO: 2419546 - RNA, 16 nt, Human
accccugggggcucuc

SEQ ID NO: 2419547 - RNA, 17 nt, Human
accccugggggcucuca

SEQ ID NO: 2419548 - RNA, 17 nt, Human
ucagccuggugggccuc

SEQ ID NO: 2419549 - RNA, 18 nt, Human
ucagccuggugggccucc

SEQ ID NO: 2419550 - RNA, 19 nt, Human
ucagccuggugggccuccu

SEQ ID NO: 2419551 - RNA, 23 nt, Human
ucagcggggacagcuccuucugu

SEQ ID NO: 2419552 - RNA, 21 nt, Human
ucagcggggacagcuccuucu

SEQ ID NO: 2419553 - RNA, 20 nt, Human
ucagcggggacagcuccuuc

SEQ ID NO: 2419554 - RNA, 19 nt, Human
ucagcggggacagcuccuu

SEQ ID NO: 2419555 - RNA, 13 nt, Human
ucagcguugcaug

SEQ ID NO: 2419556 - RNA, 16 nt, Human
ucagcgugcuuagccu

SEQ ID NO: 2419557 - RNA, 18 nt, Human
ucagcgugcuuagccucc

SEQ ID NO: 2419558 - RNA, 14 nt, Human
ucagcguugcaugu

SEQ ID NO: 2419559 - RNA, 18 nt, Human
ucagcuaaagcccaaccu

SEQ ID NO: 2419560 - RNA, 12 nt, Human
ucagcuccagcu

SEQ ID NO: 2419561 - RNA, 15 nt, Human
ucagcuacuaaugau

SEQ ID NO: 2419562 - RNA, 14 nt, Human
ucagcuacugauuu

SEQ ID NO: 2419563 - RNA, 20 nt, Human
ucagcuacuaaugauguuuu

SEQ ID NO: 2419564 - RNA, 12 nt, Human
ucagcucaugga

SEQ ID NO: 2419565 - RNA, 18 nt, Human
ucagcuccacuuucagug

SEQ ID NO: 2419566 - RNA, 21 nt, Human
accccugccuccacccucuga

SEQ ID NO: 2419567 - RNA, 20 nt, Human
accccugccuccacccucug

SEQ ID NO: 2419568 - RNA, 19 nt, Human
accccugccuccacccucu

SEQ ID NO: 2419569 - RNA, 18 nt, Human
accccugccuccacccuc

SEQ ID NO: 2419570 - RNA, 14 nt, Human
accccugcuucuga

SEQ ID NO: 2419571 - RNA, 23 nt, Human
accccugccuccacccucugagc

SEQ ID NO: 2419572 - RNA, 22 nt, Human
accccugccuccacccucugag

SEQ ID NO: 2419573 - RNA, 17 nt, Human
accccugcccccagccc

SEQ ID NO: 2419574 - RNA, 19 nt, Human
accccugcccccacuuccu

SEQ ID NO: 2419575 - RNA, 13 nt, Human
accccugccccca

SEQ ID NO: 2419576 - RNA, 12 nt, Human
accccugccccc

SEQ ID NO: 2419577 - RNA, 20 nt, Human
accccugcccccagccccgg

SEQ ID NO: 2419578 - RNA, 12 nt, Human
accccugcccug

SEQ ID NO: 2419579 - RNA, 13 nt, Human
accccugcccugg

SEQ ID NO: 2419580 - RNA, 14 nt, Human
accccugcccuggg

SEQ ID NO: 2419581 - RNA, 17 nt, Human
accccugccuccacccu

SEQ ID NO: 2419582 - RNA, 16 nt, Human
accccugccuccaccc

SEQ ID NO: 2419583 - RNA, 15 nt, Human
accccugccuccacc

SEQ ID NO: 2419584 - RNA, 14 nt, Human
accccugccuccac

SEQ ID NO: 2419585 - RNA, 13 nt, Human
accccugccucca

SEQ ID NO: 2419586 - RNA, 12 nt, Human
accccugccucc

SEQ ID NO: 2419587 - RNA, 15 nt, Human
accccugcccuggga

SEQ ID NO: 2419588 - RNA, 16 nt, Human
accccugcccuugucc

SEQ ID NO: 2419589 - RNA, 13 nt, Human
accccucuggcca

SEQ ID NO: 2419590 - RNA, 14 nt, Human
accccucuggccag

SEQ ID NO: 2419591 - RNA, 15 nt, Human
accccucuggccagg

SEQ ID NO: 2419592 - RNA, 13 nt, Human
accccucucugca

SEQ ID NO: 2419593 - RNA, 23 nt, Human
accccuccuuccuugaccagcag

SEQ ID NO: 2419594 - RNA, 20 nt, Human
accccuccuuccuugaccag

SEQ ID NO: 2419595 - RNA, 14 nt, Human
acccccucuagaaa

SEQ ID NO: 2419596 - RNA, 21 nt, Human
accccuccuuccuugaccagc

SEQ ID NO: 2419597 - RNA, 22 nt, Human
accccuccuuccuugaccagca

SEQ ID NO: 2419598 - RNA, 10 nt, Human
accccugccc

SEQ ID NO: 2419599 - RNA, 11 nt, Human
accccugcccc

SEQ ID NO: 2419600 - RNA, 15 nt, Human
accccugagcuugca

SEQ ID NO: 2419601 - RNA, 15 nt, Human
accccugaucugaca

SEQ ID NO: 2419602 - RNA, 19 nt, Human
accccugaggaagaugggg

SEQ ID NO: 2419603 - RNA, 18 nt, Human
accccucuggccaggaug

SEQ ID NO: 2419604 - RNA, 14 nt, Human
acccccuccugcug

SEQ ID NO: 2419605 - RNA, 13 nt, Human
acccccuccugcu

SEQ ID NO: 2419606 - RNA, 16 nt, Human
acccccuccucucugc

SEQ ID NO: 2419607 - RNA, 15 nt, Human
acccccuccucucug

SEQ ID NO: 2419608 - RNA, 16 nt, Human
acccccuccugcugca

SEQ ID NO: 2419609 - RNA, 15 nt, Human
acccccuccugcugc

SEQ ID NO: 2419610 - RNA, 11 nt, Human
acccccuccuu

SEQ ID NO: 2419611 - RNA, 14 nt, Human
accccaucugccca

SEQ ID NO: 2419612 - RNA, 16 nt, Human
acccccucccuggccu

SEQ ID NO: 2419613 - RNA, 17 nt, Human
acccccucccuggccug

SEQ ID NO: 2419614 - RNA, 14 nt, Human
acccccuccucucu

SEQ ID NO: 2419615 - RNA, 13 nt, Human
acccccuccucuc

SEQ ID NO: 2419616 - RNA, 20 nt, Human
acccccucccuggccuguuc

SEQ ID NO: 2419617 - RNA, 22 nt, Human
acccccucccuggccuguucug

SEQ ID NO: 2419618 - RNA, 12 nt, Human
acccccuccuuc

SEQ ID NO: 2419619 - RNA, 15 nt, Human
acccccuccuucaga

SEQ ID NO: 2419620 - RNA, 16 nt, Human
acccccuccuucagac

SEQ ID NO: 2419621 - RNA, 17 nt, Human
acccccuccuucagaca

SEQ ID NO: 2419622 - RNA, 21 nt, Human
acccccucgggucuccucacu

SEQ ID NO: 2419623 - RNA, 18 nt, Human
acccccucgggucuccuc

SEQ ID NO: 2419624 - RNA, 19 nt, Human
acccccuccuucagacacc

SEQ ID NO: 2419625 - RNA, 16 nt, Human
acccccucgcuuggac

SEQ ID NO: 2419626 - RNA, 18 nt, Human
accccaucucuacaaaaa

SEQ ID NO: 2419627 - RNA, 13 nt, Human
accccaucugccc

SEQ ID NO: 2419628 - RNA, 21 nt, Human
accccauagugaccggcugcu

SEQ ID NO: 2419629 - RNA, 17 nt, Human
accccaucccuccccag

SEQ ID NO: 2419630 - RNA, 15 nt, Human
accccaucccacacc

SEQ ID NO: 2419631 - RNA, 23 nt, Human
accccaguucugcuccucuccag

SEQ ID NO: 2419632 - RNA, 22 nt, Human
accccaguucugcuccucucca

SEQ ID NO: 2419633 - RNA, 21 nt, Human
accccaguucugcuccucucc

SEQ ID NO: 2419634 - RNA, 20 nt, Human
accccaguucugcuccucuc

SEQ ID NO: 2419635 - RNA, 19 nt, Human
accccaguucugcuccucu

SEQ ID NO: 2419636 - RNA, 17 nt, Human
accccaguucugcuccu

SEQ ID NO: 2419637 - RNA, 17 nt, Human
accccauccaguucaug

SEQ ID NO: 2419638 - RNA, 19 nt, Human
accccauagugaccggcug

SEQ ID NO: 2419639 - RNA, 14 nt, Human
ucaguauguggaag

SEQ ID NO: 2419640 - RNA, 16 nt, Human
ucaguauguggaagug

SEQ ID NO: 2419641 - RNA, 24 nt, Human
ucaguaucuguaucucucucucuu

SEQ ID NO: 2419642 - RNA, 12 nt, Human
ucaguaugugga

SEQ ID NO: 2419643 - RNA, 16 nt, Human
ucagugccaaaaacaa

SEQ ID NO: 2419644 - RNA, 12 nt, Human
ucagugccacua

SEQ ID NO: 2419645 - RNA, 19 nt, Human
accgaaaacguggcugcuu

SEQ ID NO: 2419646 - RNA, 17 nt, Human
accgaaaacguggcugc

SEQ ID NO: 2419647 - RNA, 16 nt, Human
ucaguauaauucugua

SEQ ID NO: 2419648 - RNA, 17 nt, Human
ucaguauaaacaaaguu

SEQ ID NO: 2419649 - RNA, 15 nt, Human
ucaguauaaacaaag

SEQ ID NO: 2419650 - RNA, 20 nt, Human
ucaguaucuguaucucucuc

SEQ ID NO: 2419651 - RNA, 18 nt, Human
ucaguaucuguaucucuc

SEQ ID NO: 2419652 - RNA, 13 nt, Human
ucaguaucaggcc

SEQ ID NO: 2419653 - RNA, 20 nt, Human
ucaguauaauucuguacuga

SEQ ID NO: 2419654 - RNA, 16 nt, Human
ucaguauaauuuuuua

SEQ ID NO: 2419655 - RNA, 15 nt, Human
ucagugccuuaugga

SEQ ID NO: 2419656 - RNA, 14 nt, Human
ucagugccuuaugg

SEQ ID NO: 2419657 - RNA, 12 nt, Human
ucagugccuuau

SEQ ID NO: 2419658 - RNA, 11 nt, Human
ucagugccuua

SEQ ID NO: 2419659 - RNA, 10 nt, Human
ucagugccuu

SEQ ID NO: 2419660 - RNA, 9 nt, Human
ucagugccu

SEQ ID NO: 2419661 - RNA, 20 nt, Human
ucagugcccuccaggauaga

SEQ ID NO: 2419662 - RNA, 16 nt, Human
ucagugccgccgccuc

SEQ ID NO: 2419663 - RNA, 14 nt, Human
ucagugccgccgcc

SEQ ID NO: 2419664 - RNA, 22 nt, Human
ucagugccaauaaaauuuagga

SEQ ID NO: 2419665 - RNA, 9 nt, Human
ucagugccc

SEQ ID NO: 2419666 - RNA, 16 nt, Human
ucagugcccaacuguu

SEQ ID NO: 2419667 - RNA, 13 nt, Human
ucagugcccacca

SEQ ID NO: 2419668 - RNA, 22 nt, Human
ucagugcccaccaacaucccau

SEQ ID NO: 2419669 - RNA, 15 nt, Human
ucaguuuuugugaaa

SEQ ID NO: 2419670 - RNA, 17 nt, Human
ucaguuuuaucauuuuc

SEQ ID NO: 2419671 - RNA, 16 nt, Human
ucaguuuuaucauuuu

SEQ ID NO: 2419672 - RNA, 19 nt, Human
ucaguuuuaucauuuucaa

SEQ ID NO: 2419673 - RNA, 14 nt, Human
ucagugggagaaaa

SEQ ID NO: 2419674 - RNA, 14 nt, Human
ucaguuuuaucuuu

SEQ ID NO: 2419675 - RNA, 14 nt, Human
ucaguggggcaguc

SEQ ID NO: 2419676 - RNA, 16 nt, Human
ucagugggagaaaaca

SEQ ID NO: 2419677 - RNA, 13 nt, Human
ucaguuuuaacua

SEQ ID NO: 2419678 - RNA, 17 nt, Human
ucaguuuuugugaaaag

SEQ ID NO: 2419679 - RNA, 22 nt, Human
ucauaaaaagccugcaauuuca

SEQ ID NO: 2419680 - RNA, 15 nt, Human
ucaguuuuuuuuuau

SEQ ID NO: 2419681 - RNA, 12 nt, Human
ucaguuuucauu

SEQ ID NO: 2419682 - RNA, 13 nt, Human
ucaguuuucauuu

SEQ ID NO: 2419683 - RNA, 16 nt, Human
ucaguuuucaggagug

SEQ ID NO: 2419684 - RNA, 19 nt, Human
ucaguggcagggcucagga

SEQ ID NO: 2419685 - RNA, 16 nt, Human
ucaguggcagggcuca

SEQ ID NO: 2419686 - RNA, 15 nt, Human
ucaguggcagggcuc

SEQ ID NO: 2419687 - RNA, 14 nt, Human
ucaguggcagggcu

SEQ ID NO: 2419688 - RNA, 12 nt, Human
ucaguggcagcu

SEQ ID NO: 2419689 - RNA, 16 nt, Human
ucaguggggaggggcu

SEQ ID NO: 2419690 - RNA, 22 nt, Human
ucagugggaacgugacugcccc

SEQ ID NO: 2419691 - RNA, 23 nt, Human
ucagugggaacgugacugcccca

SEQ ID NO: 2419692 - RNA, 12 nt, Human
ucagugggagaa

SEQ ID NO: 2419693 - RNA, 13 nt, Human
ucagugggagaaa

SEQ ID NO: 2419694 - RNA, 17 nt, Human
ucaguggcgagaaauaa

SEQ ID NO: 2419695 - RNA, 19 nt, Human
ucaguggcauggcuccagu

SEQ ID NO: 2419696 - RNA, 20 nt, Human
ucaguggcauggcuccaguc

SEQ ID NO: 2419697 - RNA, 20 nt, Human
ucaguggcuucaucugucaa

SEQ ID NO: 2419698 - RNA, 17 nt, Human
ucaguggcuucaucugu

SEQ ID NO: 2419699 - RNA, 15 nt, Human
ucagugggaacguga

SEQ ID NO: 2419700 - RNA, 19 nt, Human
ucagugggaacgugacugc

SEQ ID NO: 2419701 - RNA, 16 nt, Human
ucagugccuuauggaa

SEQ ID NO: 2419702 - RNA, 18 nt, Human
ucagugccuuauggaaca

SEQ ID NO: 2419703 - RNA, 21 nt, Human
ucagugccgccgccucgccca

SEQ ID NO: 2419704 - RNA, 20 nt, Human
ucagugccgccgccucgccc

SEQ ID NO: 2419705 - RNA, 15 nt, Human
ucagugcuucgcaga

SEQ ID NO: 2419706 - RNA, 11 nt, Human
ucaguggcagc

SEQ ID NO: 2419707 - RNA, 23 nt, Human
ucagugccgccgccucgcccacc

SEQ ID NO: 2419708 - RNA, 16 nt, Human
ucaguggaagaagcag

SEQ ID NO: 2419709 - RNA, 21 nt, Human
ucaguggaagaagcagaugag

SEQ ID NO: 2419710 - RNA, 19 nt, Human
ucaguggacuuuccacccc

SEQ ID NO: 2419711 - RNA, 21 nt, Human
ucaguggacuuuccacccccu

SEQ ID NO: 2419712 - RNA, 23 nt, Human
ucaguggacuuuccacccccucc

SEQ ID NO: 2419713 - RNA, 12 nt, Human
ucaguggagcca

SEQ ID NO: 2419714 - RNA, 15 nt, Human
ucauauaauaaaugu

SEQ ID NO: 2419715 - RNA, 18 nt, Human
ucauauaagauucauauu

SEQ ID NO: 2419716 - RNA, 16 nt, Human
ucauauaauaaaugua

SEQ ID NO: 2419717 - RNA, 16 nt, Human
ucauauaccagcaaua

SEQ ID NO: 2419718 - RNA, 14 nt, Human
ucauauacgugaaa

SEQ ID NO: 2419719 - RNA, 17 nt, Human
ucauauaccagcaauau

SEQ ID NO: 2419720 - RNA, 14 nt, Human
ucauauauaucuau

SEQ ID NO: 2419721 - RNA, 18 nt, Human
ucauauauggggggccaa

SEQ ID NO: 2419722 - RNA, 22 nt, Human
ucauauauggggggccaacacc

SEQ ID NO: 2419723 - RNA, 20 nt, Human
ucauauaaacuuuuuaaaga

SEQ ID NO: 2419724 - RNA, 20 nt, Human
ucauauaaaagcuaugguga

SEQ ID NO: 2419725 - RNA, 16 nt, Human
ucauauaaaagcuaug

SEQ ID NO: 2419726 - RNA, 13 nt, Human
ucauaguuuaauu

SEQ ID NO: 2419727 - RNA, 17 nt, Human
ucauaguuauuguuucu

SEQ ID NO: 2419728 - RNA, 16 nt, Human
ucauaguuauuguuuc

SEQ ID NO: 2419729 - RNA, 21 nt, Human
ucauaguuauuguuucugguc

SEQ ID NO: 2419730 - RNA, 21 nt, Human
ucauaguaugguggcuggguu

SEQ ID NO: 2419731 - RNA, 19 nt, Human
ucauaguaugguggcuggg

SEQ ID NO: 2419732 - RNA, 18 nt, Human
ucauaguaugguggcugg

SEQ ID NO: 2419733 - RNA, 23 nt, Human
ucauaacggaucagaaauacaga

SEQ ID NO: 2419734 - RNA, 22 nt, Human
ucauaguacucuuuguagcaaa

SEQ ID NO: 2419735 - RNA, 22 nt, Human
ucauaacggaucagaaauacag

SEQ ID NO: 2419736 - RNA, 15 nt, Human
ucauaguaugguggc

SEQ ID NO: 2419737 - RNA, 14 nt, Human
ucauaaccuagccu

SEQ ID NO: 2419738 - RNA, 22 nt, Human
ucaguuuuuuuuuauacacugu

SEQ ID NO: 2419739 - RNA, 20 nt, Human
ucauaaaaagcaaaacaaaa

SEQ ID NO: 2419740 - RNA, 12 nt, Human
ucauaaaauaaa

SEQ ID NO: 2419741 - RNA, 21 nt, Human
ucauaacggaucagaaauaca

SEQ ID NO: 2419742 - RNA, 19 nt, Human
ucauaacggaucagaaaua

SEQ ID NO: 2419743 - RNA, 18 nt, Human
ucauaacggaucagaaau

SEQ ID NO: 2419744 - RNA, 16 nt, Human
ucauaacggaucagaa

SEQ ID NO: 2419745 - RNA, 16 nt, Human
ucauaaauuuaugguu

SEQ ID NO: 2419746 - RNA, 14 nt, Human
ucauaacggaucag

SEQ ID NO: 2419747 - RNA, 23 nt, Human
accgcagaagccuccccagcuca

SEQ ID NO: 2419748 - RNA, 20 nt, Human
accgcagaagccuccccagc

SEQ ID NO: 2419749 - RNA, 17 nt, Human
accgagucucuucucca

SEQ ID NO: 2419750 - RNA, 17 nt, Human
accgaggggcucaggaa

SEQ ID NO: 2419751 - RNA, 19 nt, Human
accgaggggcucaggaaaa

SEQ ID NO: 2419752 - RNA, 16 nt, Human
accgagucucuucucc

SEQ ID NO: 2419753 - RNA, 16 nt, Human
accgaggcgcgggggc

SEQ ID NO: 2419754 - RNA, 15 nt, Human
accgaggacaugaaa

SEQ ID NO: 2419755 - RNA, 17 nt, Human
accgaggcgcgggggcc

SEQ ID NO: 2419756 - RNA, 17 nt, Human
accgaggcuggagcugg

SEQ ID NO: 2419757 - RNA, 18 nt, Human
accgaggcuggagcuggc

SEQ ID NO: 2419758 - RNA, 20 nt, Human
accgagcgcuuucuggaaaa

SEQ ID NO: 2419759 - RNA, 18 nt, Human
accgagcgcuuucuggaa

SEQ ID NO: 2419760 - RNA, 15 nt, Human
ucauauuuucuuuca

SEQ ID NO: 2419761 - RNA, 22 nt, Human
ucauauuucuuaucaccacagu

SEQ ID NO: 2419762 - RNA, 19 nt, Human
ucauauugaauguuuccaa

SEQ ID NO: 2419763 - RNA, 21 nt, Human
ucauauugugauucugccuuu

SEQ ID NO: 2419764 - RNA, 22 nt, Human
ucauauugugccaauauguauu

SEQ ID NO: 2419765 - RNA, 20 nt, Human
ucauauugugccaauaugua

SEQ ID NO: 2419766 - RNA, 15 nt, Human
ucauauugugccaau

SEQ ID NO: 2419767 - RNA, 14 nt, Human
ucauauugugccaa

SEQ ID NO: 2419768 - RNA, 12 nt, Human
ucauauuuaaag

SEQ ID NO: 2419769 - RNA, 14 nt, Human
ucauauuguuuccu

SEQ ID NO: 2419770 - RNA, 19 nt, Human
ucauauuuaaagacaggga

SEQ ID NO: 2419771 - RNA, 15 nt, Human
ucauauuuacuucuu

SEQ ID NO: 2419772 - RNA, 23 nt, Human
ucauauuuacuucuuauacauuu

SEQ ID NO: 2419773 - RNA, 18 nt, Human
ucauauccccuauuuaac

SEQ ID NO: 2419774 - RNA, 21 nt, Human
ucauaugaaaaaaaugcauuu

SEQ ID NO: 2419775 - RNA, 12 nt, Human
ucauaugaaaaa

SEQ ID NO: 2419776 - RNA, 20 nt, Human
ucauaugacauucaugccug

SEQ ID NO: 2419777 - RNA, 11 nt, Human
ucauaugaaaa

SEQ ID NO: 2419778 - RNA, 19 nt, Human
ucauaugauucugcuuuua

SEQ ID NO: 2419779 - RNA, 15 nt, Human
ucauaugauucugcu

SEQ ID NO: 2419780 - RNA, 17 nt, Human
ucauauggcccaguguc

SEQ ID NO: 2419781 - RNA, 18 nt, Human
ucauauggcccaguguca

SEQ ID NO: 2419782 - RNA, 21 nt, Human
ucauauguaccauguacauga

SEQ ID NO: 2419783 - RNA, 22 nt, Human
ucauauguaccauguacaugaa

SEQ ID NO: 2419784 - RNA, 14 nt, Human
ucauauugaauaua

SEQ ID NO: 2419785 - RNA, 15 nt, Human
accuccccugaggcu

SEQ ID NO: 2419786 - RNA, 21 nt, Human
accuccccuauccacccagcc

SEQ ID NO: 2419787 - RNA, 23 nt, Human
accuccccuauccacccagccca

SEQ ID NO: 2419788 - RNA, 13 nt, Human
accuccccuccuu

SEQ ID NO: 2419789 - RNA, 17 nt, Human
accuccccuccuugccu

SEQ ID NO: 2419790 - RNA, 19 nt, Human
accuccccuccuugccucc

SEQ ID NO: 2419791 - RNA, 20 nt, Human
accuccccuccuugccuccu

SEQ ID NO: 2419792 - RNA, 21 nt, Human
accuccccuccuugccuccug

SEQ ID NO: 2419793 - RNA, 22 nt, Human
accuccccuccuugccuccugu

SEQ ID NO: 2419794 - RNA, 13 nt, Human
accuccccagccc

SEQ ID NO: 2419795 - RNA, 12 nt, Human
accuccccagcc

SEQ ID NO: 2419796 - RNA, 23 nt, Human
accuccccagcauuccagccccu

SEQ ID NO: 2419797 - RNA, 21 nt, Human
accuccccagcauuccagccc

SEQ ID NO: 2419798 - RNA, 15 nt, Human
accuccccagcauuc

SEQ ID NO: 2419799 - RNA, 15 nt, Human
accucccccugcccc

SEQ ID NO: 2419800 - RNA, 21 nt, Human
accucccccucccccuucucc

SEQ ID NO: 2419801 - RNA, 14 nt, Human
accuccccuaucca

SEQ ID NO: 2419802 - RNA, 17 nt, Human
accuccccuauccaccc

SEQ ID NO: 2419803 - RNA, 18 nt, Human
accuccccuauccaccca

SEQ ID NO: 2419804 - RNA, 19 nt, Human
accuccccuauccacccag

SEQ ID NO: 2419805 - RNA, 20 nt, Human
accuccccuauccacccagc

SEQ ID NO: 2419806 - RNA, 13 nt, Human
accuccucuguga

SEQ ID NO: 2419807 - RNA, 14 nt, Human
accuccucugugaa

SEQ ID NO: 2419808 - RNA, 18 nt, Human
accuccucugugaagcau

SEQ ID NO: 2419809 - RNA, 11 nt, Human
accuccucugu

SEQ ID NO: 2419810 - RNA, 12 nt, Human
accuccucugug

SEQ ID NO: 2419811 - RNA, 16 nt, Human
accuccucuucugacg

SEQ ID NO: 2419812 - RNA, 13 nt, Human
accuccugagaaa

SEQ ID NO: 2419813 - RNA, 12 nt, Human
accuccugccca

SEQ ID NO: 2419814 - RNA, 13 nt, Human
accuccugcccag

SEQ ID NO: 2419815 - RNA, 14 nt, Human
accuccugcccagg

SEQ ID NO: 2419816 - RNA, 15 nt, Human
accuccugcccagga

SEQ ID NO: 2419817 - RNA, 16 nt, Human
accuccugcccaggag

SEQ ID NO: 2419818 - RNA, 17 nt, Human
accuccugcccaggaga

SEQ ID NO: 2419819 - RNA, 18 nt, Human
accuccugcccaggagag

SEQ ID NO: 2419820 - RNA, 15 nt, Human
accucacucuugcca

SEQ ID NO: 2419821 - RNA, 13 nt, Human
accucacuccugu

SEQ ID NO: 2419822 - RNA, 14 nt, Human
accucacuccuguu

SEQ ID NO: 2419823 - RNA, 18 nt, Human
accucacucuugccaacc

SEQ ID NO: 2419824 - RNA, 16 nt, Human
accucacucuugccaa

SEQ ID NO: 2419825 - RNA, 15 nt, Human
accuccacagcuucc

SEQ ID NO: 2419826 - RNA, 20 nt, Human
accuccacaguucaguggca

SEQ ID NO: 2419827 - RNA, 16 nt, Human
accuccacauccucca

SEQ ID NO: 2419828 - RNA, 19 nt, Human
accuccacaguucaguggc

SEQ ID NO: 2419829 - RNA, 18 nt, Human
accuccacaguucagugg

SEQ ID NO: 2419830 - RNA, 14 nt, Human
accuccacauccuc

SEQ ID NO: 2419831 - RNA, 21 nt, Human
accuccagaaacggccauuca

SEQ ID NO: 2419832 - RNA, 21 nt, Human
accucccagcccuauggaugu

SEQ ID NO: 2419833 - RNA, 20 nt, Human
accucccagcccuauggaug

SEQ ID NO: 2419834 - RNA, 19 nt, Human
accucccagcccuauggau

SEQ ID NO: 2419835 - RNA, 15 nt, Human
accucccagcccuau

SEQ ID NO: 2419836 - RNA, 14 nt, Human
accucccagcccua

SEQ ID NO: 2419837 - RNA, 13 nt, Human
accucccagcccu

SEQ ID NO: 2419838 - RNA, 22 nt, Human
accuccccacgcccuccccucc

SEQ ID NO: 2419839 - RNA, 21 nt, Human
accuccccacgcccuccccuc

SEQ ID NO: 2419840 - RNA, 20 nt, Human
accuccccacgcccuccccu

SEQ ID NO: 2419841 - RNA, 19 nt, Human
accuccccacgcccucccc

SEQ ID NO: 2419842 - RNA, 14 nt, Human
accuccccacgccc

SEQ ID NO: 2419843 - RNA, 11 nt, Human
accuccccacg

SEQ ID NO: 2419844 - RNA, 22 nt, Human
accucccagcccuauggaugug

SEQ ID NO: 2419845 - RNA, 15 nt, Human
accucccauccuaau

SEQ ID NO: 2419846 - RNA, 20 nt, Human
accucccacaaaggagagcu

SEQ ID NO: 2419847 - RNA, 10 nt, Human
accuccaucu

SEQ ID NO: 2419848 - RNA, 20 nt, Human
accuacuuugacuuuuugca

SEQ ID NO: 2419849 - RNA, 21 nt, Human
accuacuuugacuuuuugcau

SEQ ID NO: 2419850 - RNA, 22 nt, Human
accuagaaauugacacaagugg

SEQ ID NO: 2419851 - RNA, 20 nt, Human
accuagagacuucacccggg

SEQ ID NO: 2419852 - RNA, 14 nt, Human
accuagaagggcua

SEQ ID NO: 2419853 - RNA, 17 nt, Human
accuaggauaucuucuc

SEQ ID NO: 2419854 - RNA, 16 nt, Human
accgcagacaggacca

SEQ ID NO: 2419855 - RNA, 12 nt, Human
accgcagacagg

SEQ ID NO: 2419856 - RNA, 17 nt, Human
accgcagacaggaccag

SEQ ID NO: 2419857 - RNA, 20 nt, Human
accuaccucagguugcuggu

SEQ ID NO: 2419858 - RNA, 18 nt, Human
accuaccuucauuucagg

SEQ ID NO: 2419859 - RNA, 16 nt, Human
accuauuccuccuggg

SEQ ID NO: 2419860 - RNA, 23 nt, Human
accuauguccuaaggacacacua

SEQ ID NO: 2419861 - RNA, 22 nt, Human
accuauguccuaaggacacacu

SEQ ID NO: 2419862 - RNA, 19 nt, Human
accuauguccuaaggacac

SEQ ID NO: 2419863 - RNA, 17 nt, Human
accuauguccuaaggac

SEQ ID NO: 2419864 - RNA, 22 nt, Human
accuaugucauuucauuuccua

SEQ ID NO: 2419865 - RNA, 19 nt, Human
accuaugucauuucauuuc

SEQ ID NO: 2419866 - RNA, 20 nt, Human
accuagggauguucuggccc

SEQ ID NO: 2419867 - RNA, 16 nt, Human
accuagggugauauua

SEQ ID NO: 2419868 - RNA, 17 nt, Human
accuaggccacuccucc

SEQ ID NO: 2419869 - RNA, 18 nt, Human
accuaggccacuccucca

SEQ ID NO: 2419870 - RNA, 15 nt, Human
accuagggaggaccu

SEQ ID NO: 2419871 - RNA, 17 nt, Human
accuagggaggaccuua

SEQ ID NO: 2419872 - RNA, 24 nt, Human
accuagggaggaccuuaucugugc

SEQ ID NO: 2419873 - RNA, 15 nt, Human
accuaggggcgccgc

SEQ ID NO: 2419874 - RNA, 20 nt, Human
accucacuauucaaguauua

SEQ ID NO: 2419875 - RNA, 19 nt, Human
accucacgcaccucccauc

SEQ ID NO: 2419876 - RNA, 22 nt, Human
accucacgcaccucccauccua

SEQ ID NO: 2419877 - RNA, 15 nt, Human
accucacgcaccucc

SEQ ID NO: 2419878 - RNA, 16 nt, Human
accucacgcaccuccc

SEQ ID NO: 2419879 - RNA, 17 nt, Human
accucacgcaccuccca

SEQ ID NO: 2419880 - RNA, 18 nt, Human
accucacgcaccucccau

SEQ ID NO: 2419881 - RNA, 14 nt, Human
accucaccuagaaa

SEQ ID NO: 2419882 - RNA, 15 nt, Human
accucaccuagaaau

SEQ ID NO: 2419883 - RNA, 14 nt, Human
accucacccugcua

SEQ ID NO: 2419884 - RNA, 12 nt, Human
accucacccugc

SEQ ID NO: 2419885 - RNA, 21 nt, Human
accuauuuugaaaaauuccua

SEQ ID NO: 2419886 - RNA, 19 nt, Human
accucacccgaggcugccc

SEQ ID NO: 2419887 - RNA, 16 nt, Human
accucaaaaugucuaa

SEQ ID NO: 2419888 - RNA, 20 nt, Human
accuauuuugaaaaauuccu

SEQ ID NO: 2419889 - RNA, 14 nt, Human
accuauuugacaua

SEQ ID NO: 2419890 - RNA, 12 nt, Human
accuauuuccau

SEQ ID NO: 2419891 - RNA, 16 nt, Human
ucaugugaaaucauuc

SEQ ID NO: 2419892 - RNA, 17 nt, Human
ucaugugaaaucauuca

SEQ ID NO: 2419893 - RNA, 17 nt, Human
ucaugugaccacucugu

SEQ ID NO: 2419894 - RNA, 20 nt, Human
ucaugcaucuccaccugcuc

SEQ ID NO: 2419895 - RNA, 20 nt, Human
ucaugcauaaauaugcagug

SEQ ID NO: 2419896 - RNA, 16 nt, Human
ucaugcaucuccaccu

SEQ ID NO: 2419897 - RNA, 23 nt, Human
ucaugcagccgugaucaagggaa

SEQ ID NO: 2419898 - RNA, 14 nt, Human
ucaugcagccguga

SEQ ID NO: 2419899 - RNA, 13 nt, Human
ucaugcagccgug

SEQ ID NO: 2419900 - RNA, 19 nt, Human
ucaugcauaaauaugcagu

SEQ ID NO: 2419901 - RNA, 15 nt, Human
ucaugcauaaauaug

SEQ ID NO: 2419902 - RNA, 14 nt, Human
ucaugcauaaauau

SEQ ID NO: 2419903 - RNA, 23 nt, Human
ucaugcaaacuuuauuuuguguu

SEQ ID NO: 2419904 - RNA, 17 nt, Human
ucaugcaaaggcuggga

SEQ ID NO: 2419905 - RNA, 20 nt, Human
ucaugcaaaugcuguauucu

SEQ ID NO: 2419906 - RNA, 13 nt, Human
ucaugcaaugaca

SEQ ID NO: 2419907 - RNA, 15 nt, Human
ucaugcaaugacauc

SEQ ID NO: 2419908 - RNA, 16 nt, Human
ucaugcaaugacaucu

SEQ ID NO: 2419909 - RNA, 23 nt, Human
ucauguguaaucaauaaacgauu

SEQ ID NO: 2419910 - RNA, 22 nt, Human
ucauguguaaucaauaaacgau

SEQ ID NO: 2419911 - RNA, 21 nt, Human
ucauguguaaucaauaaacga

SEQ ID NO: 2419912 - RNA, 19 nt, Human
ucauguguaaucaauaaac

SEQ ID NO: 2419913 - RNA, 20 nt, Human
ucauguguacaaaaguuuca

SEQ ID NO: 2419914 - RNA, 21 nt, Human
ucauguggcuggaagauccug

SEQ ID NO: 2419915 - RNA, 16 nt, Human
ucauguggcuggaaga

SEQ ID NO: 2419916 - RNA, 18 nt, Human
ucauguguaaucaauaaa

SEQ ID NO: 2419917 - RNA, 20 nt, Human
ucaugugauccuuuuauguu

SEQ ID NO: 2419918 - RNA, 13 nt, Human
ucauguggcugga

SEQ ID NO: 2419919 - RNA, 19 nt, Human
ucauguggaauauaaagau

SEQ ID NO: 2419920 - RNA, 15 nt, Human
ucaugugauccuuuu

SEQ ID NO: 2419921 - RNA, 22 nt, Human
ucaugcaucuccaccugcuccc

SEQ ID NO: 2419922 - RNA, 18 nt, Human
ucauguggaauauaaaga

SEQ ID NO: 2419923 - RNA, 21 nt, Human
ucauguuugcuucauaaauga

SEQ ID NO: 2419924 - RNA, 17 nt, Human
ucauguuugcuucauaa

SEQ ID NO: 2419925 - RNA, 15 nt, Human
ucauguuugcuucau

SEQ ID NO: 2419926 - RNA, 21 nt, Human
ucauguuuuaaagcuugcuca

SEQ ID NO: 2419927 - RNA, 20 nt, Human
ucauguuugcuucauaaaug

SEQ ID NO: 2419928 - RNA, 13 nt, Human
ucauguuuuaaca

SEQ ID NO: 2419929 - RNA, 14 nt, Human
ucauguuugcuuca

SEQ ID NO: 2419930 - RNA, 15 nt, Human
ucauguuugcucucc

SEQ ID NO: 2419931 - RNA, 16 nt, Human
ucauguuucuuaaaug

SEQ ID NO: 2419932 - RNA, 19 nt, Human
ucauguguaugggcaaaaa

SEQ ID NO: 2419933 - RNA, 17 nt, Human
ucauguuuacagaggac

SEQ ID NO: 2419934 - RNA, 11 nt, Human
ucauguuucuu

SEQ ID NO: 2419935 - RNA, 15 nt, Human
ucauguuucuuaaau

SEQ ID NO: 2419936 - RNA, 14 nt, Human
ucauccauucuauu

SEQ ID NO: 2419937 - RNA, 17 nt, Human
ucauccaucaucaugug

SEQ ID NO: 2419938 - RNA, 19 nt, Human
ucauccauucuauuguuaa

SEQ ID NO: 2419939 - RNA, 16 nt, Human
ucaucccaacugucuu

SEQ ID NO: 2419940 - RNA, 15 nt, Human
ucauccaucaucaug

SEQ ID NO: 2419941 - RNA, 16 nt, Human
ucauccaucaucaugu

SEQ ID NO: 2419942 - RNA, 13 nt, Human
ucauccauccagg

SEQ ID NO: 2419943 - RNA, 21 nt, Human
ucauccagggcucugaccagu

SEQ ID NO: 2419944 - RNA, 14 nt, Human
ucauccagggcucu

SEQ ID NO: 2419945 - RNA, 11 nt, Human
ucauccaucau

SEQ ID NO: 2419946 - RNA, 12 nt, Human
ucauccaucauc

SEQ ID NO: 2419947 - RNA, 14 nt, Human
ucauccaucaucau

SEQ ID NO: 2419948 - RNA, 19 nt, Human
accuccugcccaggagagc

SEQ ID NO: 2419949 - RNA, 20 nt, Human
accuccugcccaggagagcc

SEQ ID NO: 2419950 - RNA, 11 nt, Human
accuccugccu

SEQ ID NO: 2419951 - RNA, 21 nt, Human
accuccugcccaggagagcca

SEQ ID NO: 2419952 - RNA, 17 nt, Human
ucauccuuuccagcaug

SEQ ID NO: 2419953 - RNA, 16 nt, Human
ucauccuuuccagcau

SEQ ID NO: 2419954 - RNA, 13 nt, Human
ucaucccagcugc

SEQ ID NO: 2419955 - RNA, 18 nt, Human
ucaucccacgcacuccau

SEQ ID NO: 2419956 - RNA, 14 nt, Human
ucaucgaaucuacu

SEQ ID NO: 2419957 - RNA, 21 nt, Human
ucaucgaaucuacuaauucca

SEQ ID NO: 2419958 - RNA, 13 nt, Human
ucaucuaggauuu

SEQ ID NO: 2419959 - RNA, 19 nt, Human
ucaucgggaauacuaggga

SEQ ID NO: 2419960 - RNA, 17 nt, Human
ucaucgcguccuccuac

SEQ ID NO: 2419961 - RNA, 18 nt, Human
ucaucgcguccuccuacc

SEQ ID NO: 2419962 - RNA, 14 nt, Human
ucaugcaaacuuua

SEQ ID NO: 2419963 - RNA, 21 nt, Human
ucaugauuuugaaaucaugaa

SEQ ID NO: 2419964 - RNA, 11 nt, Human
ucaugauuuuu

SEQ ID NO: 2419965 - RNA, 14 nt, Human
ucaugauuuugaaa

SEQ ID NO: 2419966 - RNA, 23 nt, Human
ucaugauuucauuucaacuguuu

SEQ ID NO: 2419967 - RNA, 17 nt, Human
ucaugauuucauuucaa

SEQ ID NO: 2419968 - RNA, 22 nt, Human
ucaugaacuucgcaucaaaaga

SEQ ID NO: 2419969 - RNA, 21 nt, Human
ucaugaacuucgcaucaaaag

SEQ ID NO: 2419970 - RNA, 19 nt, Human
ucaugaagauauuuuucca

SEQ ID NO: 2419971 - RNA, 22 nt, Human
ucaugauucacccccaaacagu

SEQ ID NO: 2419972 - RNA, 12 nt, Human
ucaugaagccca

SEQ ID NO: 2419973 - RNA, 16 nt, Human
ucaugauuagcaaguu

SEQ ID NO: 2419974 - RNA, 15 nt, Human
ucaugaaauaugcau

SEQ ID NO: 2419975 - RNA, 14 nt, Human
ucaugaaauaugca

SEQ ID NO: 2419976 - RNA, 18 nt, Human
ucaugaacuucgcaucaa

SEQ ID NO: 2419977 - RNA, 15 nt, Human
ucaugaacuucgcau

SEQ ID NO: 2419978 - RNA, 22 nt, Human
ucaugaaccucaagcugcaucu

SEQ ID NO: 2419979 - RNA, 11 nt, Human
ucaugaaccuc

SEQ ID NO: 2419980 - RNA, 23 nt, Human
ucaugaacauguuccugaauucu

SEQ ID NO: 2419981 - RNA, 18 nt, Human
acuaugcguuuuuauaaa

SEQ ID NO: 2419982 - RNA, 14 nt, Human
acuaugcguuuuua

SEQ ID NO: 2419983 - RNA, 12 nt, Human
acuaugccugug

SEQ ID NO: 2419984 - RNA, 18 nt, Human
acuaugccugugucuucu

SEQ ID NO: 2419985 - RNA, 19 nt, Human
acuaugccugugucuucuc

SEQ ID NO: 2419986 - RNA, 22 nt, Human
acuauggcccuggccuagcaua

SEQ ID NO: 2419987 - RNA, 14 nt, Human
acuauguugcccag

SEQ ID NO: 2419988 - RNA, 16 nt, Human
acuauguugcccaggc

SEQ ID NO: 2419989 - RNA, 15 nt, Human
acuauguugcccagg

SEQ ID NO: 2419990 - RNA, 15 nt, Human
acuaugguauuugag

SEQ ID NO: 2419991 - RNA, 16 nt, Human
acuaugguauuugagu

SEQ ID NO: 2419992 - RNA, 14 nt, Human
acucaagaggcuga

SEQ ID NO: 2419993 - RNA, 15 nt, Human
acucaagaggcugag

SEQ ID NO: 2419994 - RNA, 17 nt, Human
acucaagaggcugaggc

SEQ ID NO: 2419995 - RNA, 18 nt, Human
acucaagaggcugaggca

SEQ ID NO: 2419996 - RNA, 17 nt, Human
acucaaggacuuugcag

SEQ ID NO: 2419997 - RNA, 22 nt, Human
acucaagccaagcagccaagcu

SEQ ID NO: 2419998 - RNA, 17 nt, Human
acucaagccaagcagcc

SEQ ID NO: 2419999 - RNA, 19 nt, Human
acucaagccaagcagccaa

SEQ ID NO: 2420000 - RNA, 14 nt, Human
acucaagcccgcgg

SEQ ID NO: 2420001 - RNA, 14 nt, Human
acucaagccaagca

SEQ ID NO: 2420002 - RNA, 16 nt, Human
acucaagccaagcagc

SEQ ID NO: 2420003 - RNA, 11 nt, Human
acucaagccaa

SEQ ID NO: 2420004 - RNA, 16 nt, Human
acucaaugcacugaca

SEQ ID NO: 2420005 - RNA, 19 nt, Human
acucaagguucccagagau

SEQ ID NO: 2420006 - RNA, 20 nt, Human
acucaagguucccagagaug

SEQ ID NO: 2420007 - RNA, 14 nt, Human
acucacacaggacc

SEQ ID NO: 2420008 - RNA, 22 nt, Human
acucacacagccaggugccuug

SEQ ID NO: 2420009 - RNA, 15 nt, Human
acucacacagccagg

SEQ ID NO: 2420010 - RNA, 14 nt, Human
acucacacagccag

SEQ ID NO: 2420011 - RNA, 21 nt, Human
acucacaagaagaccagacug

SEQ ID NO: 2420012 - RNA, 18 nt, Human
acucacaagaagaccaga

SEQ ID NO: 2420013 - RNA, 16 nt, Human
acucacaagaagacca

SEQ ID NO: 2420014 - RNA, 14 nt, Human
acucacaagaagac

SEQ ID NO: 2420015 - RNA, 17 nt, Human
acucaauuucuccccag

SEQ ID NO: 2420016 - RNA, 16 nt, Human
acucaauuucucccca

SEQ ID NO: 2420017 - RNA, 14 nt, Human
acucaauuucuccc

SEQ ID NO: 2420018 - RNA, 21 nt, Human
acucacaaccugaaccuagga

SEQ ID NO: 2420019 - RNA, 21 nt, Human
acucaauguuacuaucugcuu

SEQ ID NO: 2420020 - RNA, 15 nt, Human
acucaauugauaaac

SEQ ID NO: 2420021 - RNA, 16 nt, Human
acucaauggauuugau

SEQ ID NO: 2420022 - RNA, 22 nt, Human
acucaagugucucaguccaccu

SEQ ID NO: 2420023 - RNA, 17 nt, Human
acuaucucauuuccaag

SEQ ID NO: 2420024 - RNA, 16 nt, Human
acuaucucauuuccaa

SEQ ID NO: 2420025 - RNA, 13 nt, Human
acuaucugcuuuu

SEQ ID NO: 2420026 - RNA, 12 nt, Human
acuaucugcuuu

SEQ ID NO: 2420027 - RNA, 20 nt, Human
acuaucugaaccauuaaagu

SEQ ID NO: 2420028 - RNA, 19 nt, Human
acuaucuacucuccucauc

SEQ ID NO: 2420029 - RNA, 17 nt, Human
acuaucugucugguggc

SEQ ID NO: 2420030 - RNA, 16 nt, Human
acuaugccugugucuu

SEQ ID NO: 2420031 - RNA, 14 nt, Human
acuaucugucuggu

SEQ ID NO: 2420032 - RNA, 12 nt, Human
acuaucugggug

SEQ ID NO: 2420033 - RNA, 17 nt, Human
acuaucuacucuccuca

SEQ ID NO: 2420034 - RNA, 16 nt, Human
acuaucuaaauguuga

SEQ ID NO: 2420035 - RNA, 21 nt, Human
acuaucuaaauguugaaagau

SEQ ID NO: 2420036 - RNA, 15 nt, Human
acuaucucauuucca

SEQ ID NO: 2420037 - RNA, 15 nt, Human
acuaucuacucuccu

SEQ ID NO: 2420038 - RNA, 16 nt, Human
acuaucuacucuccuc

SEQ ID NO: 2420039 - RNA, 14 nt, Human
acuaucaaacugaa

SEQ ID NO: 2420040 - RNA, 19 nt, Human
acuaucaaacugaagccag

SEQ ID NO: 2420041 - RNA, 22 nt, Human
acuauauuguuugcuaagcauu

SEQ ID NO: 2420042 - RNA, 23 nt, Human
acuauauuugggccugcuccaga

SEQ ID NO: 2420043 - RNA, 22 nt, Human
acuauauuugggccugcuccag

SEQ ID NO: 2420044 - RNA, 17 nt, Human
acuauauuguuugcuaa

SEQ ID NO: 2420045 - RNA, 18 nt, Human
acuauagccuaggugaca

SEQ ID NO: 2420046 - RNA, 16 nt, Human
acuagaggcagggagg

SEQ ID NO: 2420047 - RNA, 22 nt, Human
acuauagccuaggugacagagu

SEQ ID NO: 2420048 - RNA, 20 nt, Human
acuauagccuaggugacaga

SEQ ID NO: 2420049 - RNA, 19 nt, Human
acuagagcagcccuggagu

SEQ ID NO: 2420050 - RNA, 23 nt, Human
acuagagaucugguuuugcuauu

SEQ ID NO: 2420051 - RNA, 16 nt, Human
acuagagcagcccugg

SEQ ID NO: 2420052 - RNA, 17 nt, Human
acuagagaucugguuuu

SEQ ID NO: 2420053 - RNA, 14 nt, Human
acuagaggcaggga

SEQ ID NO: 2420054 - RNA, 15 nt, Human
acuagaggcagggag

SEQ ID NO: 2420055 - RNA, 21 nt, Human
acuagagcagcccuggaguca

SEQ ID NO: 2420056 - RNA, 18 nt, Human
acuagagggaccucuccc

SEQ ID NO: 2420057 - RNA, 11 nt, Human
ucccccagccc

SEQ ID NO: 2420058 - RNA, 23 nt, Human
uccccagguccagcucuggaggg

SEQ ID NO: 2420059 - RNA, 17 nt, Human
uccccagguccagcucu

SEQ ID NO: 2420060 - RNA, 15 nt, Human
uccccagguggcuga

SEQ ID NO: 2420061 - RNA, 18 nt, Human
uccccagguggcugaccc

SEQ ID NO: 2420062 - RNA, 19 nt, Human
uccccagguggcugaccca

SEQ ID NO: 2420063 - RNA, 20 nt, Human
uccccagguggcugacccag

SEQ ID NO: 2420064 - RNA, 15 nt, Human
uccccaggggaguug

SEQ ID NO: 2420065 - RNA, 17 nt, Human
uccccaggggucccagc

SEQ ID NO: 2420066 - RNA, 18 nt, Human
uccccaggggucccagcc

SEQ ID NO: 2420067 - RNA, 20 nt, Human
uccccaggggucccagccac

SEQ ID NO: 2420068 - RNA, 16 nt, Human
uccccagguccagcuc

SEQ ID NO: 2420069 - RNA, 15 nt, Human
uccccagguccagcu

SEQ ID NO: 2420070 - RNA, 22 nt, Human
uccccaggggucccagccaccc

SEQ ID NO: 2420071 - RNA, 23 nt, Human
uccccaggggucccagccacccc

SEQ ID NO: 2420072 - RNA, 21 nt, Human
uccccaggaggccagccuuga

SEQ ID NO: 2420073 - RNA, 20 nt, Human
uccccaggaggccagccuug

SEQ ID NO: 2420074 - RNA, 10 nt, Human
uccccagggg

SEQ ID NO: 2420075 - RNA, 19 nt, Human
uccccaggggaaaaugaag

SEQ ID NO: 2420076 - RNA, 18 nt, Human
uccccaggggaaaaugaa

SEQ ID NO: 2420077 - RNA, 14 nt, Human
uccccaggggagag

SEQ ID NO: 2420078 - RNA, 23 nt, Human
uccccaggggagagggucuggag

SEQ ID NO: 2420079 - RNA, 18 nt, Human
ucccauuuuggaaguuuu

SEQ ID NO: 2420080 - RNA, 19 nt, Human
ucccauuuuggaaguuuuc

SEQ ID NO: 2420081 - RNA, 17 nt, Human
uccccaggaggccagcc

SEQ ID NO: 2420082 - RNA, 18 nt, Human
acuacugggcaaagagug

SEQ ID NO: 2420083 - RNA, 20 nt, Human
acuacugcuaccacaacuau

SEQ ID NO: 2420084 - RNA, 13 nt, Human
acuacuguguucc

SEQ ID NO: 2420085 - RNA, 22 nt, Human
acuacuguggaaaaauauuuaa

SEQ ID NO: 2420086 - RNA, 15 nt, Human
acuacuguguuccug

SEQ ID NO: 2420087 - RNA, 18 nt, Human
acuacuguggaaaaauau

SEQ ID NO: 2420088 - RNA, 19 nt, Human
acuacuguggaaaaauauu

SEQ ID NO: 2420089 - RNA, 20 nt, Human
acuacuguggaaaaauauuu

SEQ ID NO: 2420090 - RNA, 21 nt, Human
acuacuguggaaaaauauuua

SEQ ID NO: 2420091 - RNA, 20 nt, Human
acuagacauucugucgccuu

SEQ ID NO: 2420092 - RNA, 16 nt, Human
acuagacauucugucg

SEQ ID NO: 2420093 - RNA, 15 nt, Human
acuagacauucuguc

SEQ ID NO: 2420094 - RNA, 21 nt, Human
acuacuguguuccuggcaaua

SEQ ID NO: 2420095 - RNA, 16 nt, Human
acuacuguguuccugg

SEQ ID NO: 2420096 - RNA, 18 nt, Human
acuacuguguuccuggca

SEQ ID NO: 2420097 - RNA, 19 nt, Human
acuagacucccaagcugga

SEQ ID NO: 2420098 - RNA, 15 nt, Human
ucccccagccccauc

SEQ ID NO: 2420099 - RNA, 13 nt, Human
ucccccagcccca

SEQ ID NO: 2420100 - RNA, 16 nt, Human
ucccccagccccaucc

SEQ ID NO: 2420101 - RNA, 13 nt, Human
acuacucugugcc

SEQ ID NO: 2420102 - RNA, 18 nt, Human
acuacugacauguggggc

SEQ ID NO: 2420103 - RNA, 23 nt, Human
acuacugacauguggggccaggu

SEQ ID NO: 2420104 - RNA, 18 nt, Human
uccccaggaggccagccu

SEQ ID NO: 2420105 - RNA, 16 nt, Human
uccccaccgcagacag

SEQ ID NO: 2420106 - RNA, 15 nt, Human
uccccaccgcagaca

SEQ ID NO: 2420107 - RNA, 23 nt, Human
uccccacccugaaagcccugagc

SEQ ID NO: 2420108 - RNA, 13 nt, Human
ucccauuucagcu

SEQ ID NO: 2420109 - RNA, 16 nt, Human
ucccauuguggcuccu

SEQ ID NO: 2420110 - RNA, 18 nt, Human
ucccauuucucacugaga

SEQ ID NO: 2420111 - RNA, 16 nt, Human
ucccauuucucacuga

SEQ ID NO: 2420112 - RNA, 15 nt, Human
ucccauuucucacug

SEQ ID NO: 2420113 - RNA, 14 nt, Human
ucccauuucuacuc

SEQ ID NO: 2420114 - RNA, 21 nt, Human
ucccauuucuaaaggccucuu

SEQ ID NO: 2420115 - RNA, 24 nt, Human
ucccauuucuaaaggccucuuccu

SEQ ID NO: 2420116 - RNA, 12 nt, Human
uccccacccuga

SEQ ID NO: 2420117 - RNA, 13 nt, Human
ucccauuuugcaa

SEQ ID NO: 2420118 - RNA, 21 nt, Human
ucccauuuugcaaaauuucca

SEQ ID NO: 2420119 - RNA, 22 nt, Human
ucccauuuugcaaaauuuccag

SEQ ID NO: 2420120 - RNA, 16 nt, Human
ucccagcucacgucac

SEQ ID NO: 2420121 - RNA, 17 nt, Human
ucccagcucacgucaca

SEQ ID NO: 2420122 - RNA, 17 nt, Human
ucccauugucccucugc

SEQ ID NO: 2420123 - RNA, 18 nt, Human
ucccauugucccucugcc

SEQ ID NO: 2420124 - RNA, 19 nt, Human
ucccauugucccucugccc

SEQ ID NO: 2420125 - RNA, 21 nt, Human
ucccauugucccucugcccca

SEQ ID NO: 2420126 - RNA, 21 nt, Human
ucccagcucuagacaacccug

SEQ ID NO: 2420127 - RNA, 20 nt, Human
ucccagcucuagacaacccu

SEQ ID NO: 2420128 - RNA, 16 nt, Human
ucccagcuacuuggga

SEQ ID NO: 2420129 - RNA, 17 nt, Human
ucccagcuacucaggag

SEQ ID NO: 2420130 - RNA, 15 nt, Human
ucccagcuacucagg

SEQ ID NO: 2420131 - RNA, 16 nt, Human
ucccagcuacucagga

SEQ ID NO: 2420132 - RNA, 16 nt, Human
ucccagcuacucggga

SEQ ID NO: 2420133 - RNA, 18 nt, Human
ucccagcuacuugggagg

SEQ ID NO: 2420134 - RNA, 17 nt, Human
ucccagcuacuugggag

SEQ ID NO: 2420135 - RNA, 17 nt, Human
ucccagcuacuugggaa

SEQ ID NO: 2420136 - RNA, 19 nt, Human
ucccagcuacuugggaggc

SEQ ID NO: 2420137 - RNA, 18 nt, Human
ucccagcccuauggaugu

SEQ ID NO: 2420138 - RNA, 10 nt, Human
ucccagccug

SEQ ID NO: 2420139 - RNA, 14 nt, Human
ucccagccuuggca

SEQ ID NO: 2420140 - RNA, 13 nt, Human
ucccagccuuggc

SEQ ID NO: 2420141 - RNA, 17 nt, Human
ucccagcccuauggaug

SEQ ID NO: 2420142 - RNA, 16 nt, Human
ucccagcccuauggau

SEQ ID NO: 2420143 - RNA, 15 nt, Human
ucccagcccuaugga

SEQ ID NO: 2420144 - RNA, 22 nt, Human
ucccagcccuuugggaggcuga

SEQ ID NO: 2420145 - RNA, 16 nt, Human
ucccagcuacucagaa

SEQ ID NO: 2420146 - RNA, 19 nt, Human
ucccagcuacucagaagcc

SEQ ID NO: 2420147 - RNA, 21 nt, Human
ucccagcuacucagaagccug

SEQ ID NO: 2420148 - RNA, 23 nt, Human
ucccagcuacucagaagccugag

SEQ ID NO: 2420149 - RNA, 21 nt, Human
ucccagccuuggcaucuagag

SEQ ID NO: 2420150 - RNA, 13 nt, Human
ucccagcuacuca

SEQ ID NO: 2420151 - RNA, 22 nt, Human
ucccagcuacucaagaggcuga

SEQ ID NO: 2420152 - RNA, 14 nt, Human
ucccagcuacucag

SEQ ID NO: 2420153 - RNA, 16 nt, Human
ucccagcuaccucaac

SEQ ID NO: 2420154 - RNA, 16 nt, Human
ucccagcuacaccuuu

SEQ ID NO: 2420155 - RNA, 21 nt, Human
acguggcugcuucaaggaucc

SEQ ID NO: 2420156 - RNA, 19 nt, Human
acguggcugcuucaaggau

SEQ ID NO: 2420157 - RNA, 11 nt, Human
acguguugccu

SEQ ID NO: 2420158 - RNA, 22 nt, Human
acguguuuuauuccuguauguu

SEQ ID NO: 2420159 - RNA, 16 nt, Human
acguguuugugcugug

SEQ ID NO: 2420160 - RNA, 23 nt, Human
acgugugugacucagaugucucu

SEQ ID NO: 2420161 - RNA, 15 nt, Human
acguccugccaccug

SEQ ID NO: 2420162 - RNA, 16 nt, Human
acguccugccaccugg

SEQ ID NO: 2420163 - RNA, 21 nt, Human
acgucacuggaccacugggca

SEQ ID NO: 2420164 - RNA, 18 nt, Human
acguccagaauuuuucau

SEQ ID NO: 2420165 - RNA, 23 nt, Human
acguccaccaugggguccuacca

SEQ ID NO: 2420166 - RNA, 13 nt, Human
acgucccccuggg

SEQ ID NO: 2420167 - RNA, 17 nt, Human
acgucaucuaguuuuaa

SEQ ID NO: 2420168 - RNA, 18 nt, Human
acguggcugcuucaagga

SEQ ID NO: 2420169 - RNA, 17 nt, Human
acguggcugcuucaagg

SEQ ID NO: 2420170 - RNA, 22 nt, Human
acgucccuccacguucaccccu

SEQ ID NO: 2420171 - RNA, 12 nt, Human
acgucccuccac

SEQ ID NO: 2420172 - RNA, 15 nt, Human
acguuucuaaaggcu

SEQ ID NO: 2420173 - RNA, 16 nt, Human
acguuucuaaaggcua

SEQ ID NO: 2420174 - RNA, 14 nt, Human
acguugugcauuug

SEQ ID NO: 2420175 - RNA, 15 nt, Human
acguugugcauuugg

SEQ ID NO: 2420176 - RNA, 22 nt, Human
acguuagucgugagcucuugug

SEQ ID NO: 2420177 - RNA, 21 nt, Human
acguuagucgugagcucuugu

SEQ ID NO: 2420178 - RNA, 17 nt, Human
acguuagaccacaaaua

SEQ ID NO: 2420179 - RNA, 12 nt, Human
acguuacauuuu

SEQ ID NO: 2420180 - RNA, 16 nt, Human
acguuagucgugagcu

SEQ ID NO: 2420181 - RNA, 21 nt, Human
acguuaagggaaggaacucug

SEQ ID NO: 2420182 - RNA, 15 nt, Human
acguuaccaggcagg

SEQ ID NO: 2420183 - RNA, 13 nt, Human
acguugugcauuu

SEQ ID NO: 2420184 - RNA, 17 nt, Human
acguuaugguguuucuc

SEQ ID NO: 2420185 - RNA, 16 nt, Human
acguuaugguguuucu

SEQ ID NO: 2420186 - RNA, 18 nt, Human
acguuagaccacaaauag

SEQ ID NO: 2420187 - RNA, 19 nt, Human
acguuggagaagcccgugu

SEQ ID NO: 2420188 - RNA, 13 nt, Human
acguucaccccuc

SEQ ID NO: 2420189 - RNA, 23 nt, Human
uccagugguuugagacacugguu

SEQ ID NO: 2420190 - RNA, 16 nt, Human
uccagugguuugagac

SEQ ID NO: 2420191 - RNA, 19 nt, Human
uccagugguugcuguugau

SEQ ID NO: 2420192 - RNA, 15 nt, Human
uccagugguugcugu

SEQ ID NO: 2420193 - RNA, 19 nt, Human
uccaguggugaagaaaacu

SEQ ID NO: 2420194 - RNA, 12 nt, Human
uccaguggugaa

SEQ ID NO: 2420195 - RNA, 22 nt, Human
uccagugguccauggaaugcuu

SEQ ID NO: 2420196 - RNA, 20 nt, Human
uccagugguccauggaaugc

SEQ ID NO: 2420197 - RNA, 20 nt, Human
uccaguggggcaagauuuuc

SEQ ID NO: 2420198 - RNA, 17 nt, Human
uccaguguccuuagaac

SEQ ID NO: 2420199 - RNA, 18 nt, Human
uccaguguccuuagaaca

SEQ ID NO: 2420200 - RNA, 21 nt, Human
uccaguguccuuagaacauuu

SEQ ID NO: 2420201 - RNA, 15 nt, Human
uccagugucucacag

SEQ ID NO: 2420202 - RNA, 20 nt, Human
uccaguguccuuagaacauu

SEQ ID NO: 2420203 - RNA, 12 nt, Human
uccauccugagg

SEQ ID NO: 2420204 - RNA, 15 nt, Human
uccauccugaggcuc

SEQ ID NO: 2420205 - RNA, 18 nt, Human
acggucuguucuugaagc

SEQ ID NO: 2420206 - RNA, 16 nt, Human
uccagugucucacagc

SEQ ID NO: 2420207 - RNA, 19 nt, Human
uccaguuaaaaaaaauuuu

SEQ ID NO: 2420208 - RNA, 16 nt, Human
uccagugucucggagg

SEQ ID NO: 2420209 - RNA, 14 nt, Human
acgucaaacaugaa

SEQ ID NO: 2420210 - RNA, 16 nt, Human
acgucaaacaugaagu

SEQ ID NO: 2420211 - RNA, 17 nt, Human
acgucaaacaugaagug

SEQ ID NO: 2420212 - RNA, 17 nt, Human
acgucaagucuccuucc

SEQ ID NO: 2420213 - RNA, 18 nt, Human
acguaaugaaacuuggau

SEQ ID NO: 2420214 - RNA, 17 nt, Human
acggugggccuugcugg

SEQ ID NO: 2420215 - RNA, 18 nt, Human
acguaaccacggaaaaga

SEQ ID NO: 2420216 - RNA, 21 nt, Human
acggugccuuuuuucacggaa

SEQ ID NO: 2420217 - RNA, 17 nt, Human
acggugcagucugggug

SEQ ID NO: 2420218 - RNA, 15 nt, Human
acggugcccaagcca

SEQ ID NO: 2420219 - RNA, 20 nt, Human
acggucuguucuugaagcag

SEQ ID NO: 2420220 - RNA, 14 nt, Human
acggugcccaagcc

SEQ ID NO: 2420221 - RNA, 22 nt, Human
acggugcuccaggcaggcuaag

SEQ ID NO: 2420222 - RNA, 18 nt, Human
acggugcuccaggcaggc

SEQ ID NO: 2420223 - RNA, 15 nt, Human
acggugcuccaggca

SEQ ID NO: 2420224 - RNA, 18 nt, Human
acggugggcauuugugag

SEQ ID NO: 2420225 - RNA, 19 nt, Human
acggugggcauuugugagg

SEQ ID NO: 2420226 - RNA, 18 nt, Human
acguaaagcuagaaauga

SEQ ID NO: 2420227 - RNA, 17 nt, Human
acguaaagcuagaaaug

SEQ ID NO: 2420228 - RNA, 21 nt, Human
ucccagauuggcucacacuga

SEQ ID NO: 2420229 - RNA, 20 nt, Human
ucccagauuggcucacacug

SEQ ID NO: 2420230 - RNA, 19 nt, Human
ucccagauuggcucacacu

SEQ ID NO: 2420231 - RNA, 18 nt, Human
ucccagauuggcucacac

SEQ ID NO: 2420232 - RNA, 18 nt, Human
ucccagauacuugggggg

SEQ ID NO: 2420233 - RNA, 17 nt, Human
ucccagaucggaucugu

SEQ ID NO: 2420234 - RNA, 16 nt, Human
ucccagauaaugugaa

SEQ ID NO: 2420235 - RNA, 15 nt, Human
ucccagagugcuggg

SEQ ID NO: 2420236 - RNA, 17 nt, Human
ucccagagcaggaggcc

SEQ ID NO: 2420237 - RNA, 21 nt, Human
ucccagagcaggaggccccug

SEQ ID NO: 2420238 - RNA, 18 nt, Human
ucccagagcaggaggccc

SEQ ID NO: 2420239 - RNA, 21 nt, Human
ucccagaggguuuccaugggg

SEQ ID NO: 2420240 - RNA, 16 nt, Human
ucccagaggcugcccc

SEQ ID NO: 2420241 - RNA, 17 nt, Human
ucccagaggcugcccca

SEQ ID NO: 2420242 - RNA, 16 nt, Human
ucccagauacuugggg

SEQ ID NO: 2420243 - RNA, 23 nt, Human
ucccacuuggccaagcagggagg

SEQ ID NO: 2420244 - RNA, 12 nt, Human
ucccagaaauua

SEQ ID NO: 2420245 - RNA, 17 nt, Human
ucccagaacacacucca

SEQ ID NO: 2420246 - RNA, 19 nt, Human
ucccagaacacacuccauc

SEQ ID NO: 2420247 - RNA, 20 nt, Human
ucccagaacacacuccauca

SEQ ID NO: 2420248 - RNA, 18 nt, Human
ucccagaaggaccuccug

SEQ ID NO: 2420249 - RNA, 19 nt, Human
ucccagaaucaaagcaaug

SEQ ID NO: 2420250 - RNA, 18 nt, Human
ucccagaaucaaagcaau

SEQ ID NO: 2420251 - RNA, 12 nt, Human
ucccagaaucaa

SEQ ID NO: 2420252 - RNA, 20 nt, Human
ucccagaaggaccuccugag

SEQ ID NO: 2420253 - RNA, 16 nt, Human
ucccagagcaaaauaa

SEQ ID NO: 2420254 - RNA, 20 nt, Human
ucccagagacaggaaaaucc

SEQ ID NO: 2420255 - RNA, 17 nt, Human
ucccagagacaggaaaa

SEQ ID NO: 2420256 - RNA, 18 nt, Human
ucccagagacaggaaaau

SEQ ID NO: 2420257 - RNA, 18 nt, Human
ucccagacacccacccuc

SEQ ID NO: 2420258 - RNA, 22 nt, Human
ucccagaaucaaagcaaugcau

SEQ ID NO: 2420259 - RNA, 23 nt, Human
ucccagaaucaaagcaaugcauu

SEQ ID NO: 2420260 - RNA, 22 nt, Human
ucccagaccugccucuuccccc

SEQ ID NO: 2420261 - RNA, 16 nt, Human
ucccagagacaggaaa

SEQ ID NO: 2420262 - RNA, 13 nt, Human
acuacaccuggcu

SEQ ID NO: 2420263 - RNA, 14 nt, Human
acuacaccuggcug

SEQ ID NO: 2420264 - RNA, 23 nt, Human
acuacaccauguuugagcucaga

SEQ ID NO: 2420265 - RNA, 15 nt, Human
acuacacuccagccu

SEQ ID NO: 2420266 - RNA, 17 nt, Human
acuacacuccagccuga

SEQ ID NO: 2420267 - RNA, 18 nt, Human
acuacacuccagccugag

SEQ ID NO: 2420268 - RNA, 19 nt, Human
acuacacuccagccugagc

SEQ ID NO: 2420269 - RNA, 20 nt, Human
acuacacuccagccugagca

SEQ ID NO: 2420270 - RNA, 14 nt, Human
ucccacuuggccaa

SEQ ID NO: 2420271 - RNA, 13 nt, Human
ucccacuuggcca

SEQ ID NO: 2420272 - RNA, 12 nt, Human
ucccacuuguca

SEQ ID NO: 2420273 - RNA, 23 nt, Human
ucccacuuggcaucagcuggcgu

SEQ ID NO: 2420274 - RNA, 21 nt, Human
ucccacuuggcaucagcuggc

SEQ ID NO: 2420275 - RNA, 17 nt, Human
ucccacuuggaggccuu

SEQ ID NO: 2420276 - RNA, 15 nt, Human
acuaauuuuaaaaug

SEQ ID NO: 2420277 - RNA, 18 nt, Human
acuaaauuguaaacuccu

SEQ ID NO: 2420278 - RNA, 15 nt, Human
acuaacacuauuuua

SEQ ID NO: 2420279 - RNA, 12 nt, Human
acuaacacuauu

SEQ ID NO: 2420280 - RNA, 21 nt, Human
acuacaaaaaaguuguuaacu

SEQ ID NO: 2420281 - RNA, 13 nt, Human
acuacaaaauuug

SEQ ID NO: 2420282 - RNA, 14 nt, Human
acuacaaaauuuga

SEQ ID NO: 2420283 - RNA, 18 nt, Human
acuacaaacaaaauuucu

SEQ ID NO: 2420284 - RNA, 16 nt, Human
acuacaaaauuugaaa

SEQ ID NO: 2420285 - RNA, 18 nt, Human
acuacaaaauuugaaauu

SEQ ID NO: 2420286 - RNA, 23 nt, Human
acuacacaucccuaaugugugcc

SEQ ID NO: 2420287 - RNA, 15 nt, Human
acuacacauucaaua

SEQ ID NO: 2420288 - RNA, 20 nt, Human
acuacacaucccuaaugugu

SEQ ID NO: 2420289 - RNA, 19 nt, Human
acuacacauucaauaagca

SEQ ID NO: 2420290 - RNA, 17 nt, Human
acuaauuugauguuuac

SEQ ID NO: 2420291 - RNA, 16 nt, Human
acuaacagauaagcaa

SEQ ID NO: 2420292 - RNA, 22 nt, Human
acuaacacuauuuuaugcaaau

SEQ ID NO: 2420293 - RNA, 13 nt, Human
acuaacagauaag

SEQ ID NO: 2420294 - RNA, 17 nt, Human
acuaaagcaguagaaau

SEQ ID NO: 2420295 - RNA, 21 nt, Human
acuaaagaaaauaucugaaau

SEQ ID NO: 2420296 - RNA, 13 nt, Human
acuaaacuuuacc

SEQ ID NO: 2420297 - RNA, 17 nt, Human
acuaaagaaagauuacu

SEQ ID NO: 2420298 - RNA, 15 nt, Human
acuaaagaaagauua

SEQ ID NO: 2420299 - RNA, 12 nt, Human
acuaaagagaga

SEQ ID NO: 2420300 - RNA, 14 nt, Human
acuaaagagagaau

SEQ ID NO: 2420301 - RNA, 16 nt, Human
acuaaagagagaaugu

SEQ ID NO: 2420302 - RNA, 21 nt, Human
acuaaagagagaauguagaua

SEQ ID NO: 2420303 - RNA, 22 nt, Human
acguuucuaaaggcuaccuuug

SEQ ID NO: 2420304 - RNA, 18 nt, Human
acguuggagaagcccgug

SEQ ID NO: 2420305 - RNA, 15 nt, Human
acuaaacuuucacac

SEQ ID NO: 2420306 - RNA, 16 nt, Human
acuaaacuuucacacc

SEQ ID NO: 2420307 - RNA, 13 nt, Human
acguuuguaugug

SEQ ID NO: 2420308 - RNA, 18 nt, Human
uccaguaucuugaagacu

SEQ ID NO: 2420309 - RNA, 16 nt, Human
uccaguaucuugaaga

SEQ ID NO: 2420310 - RNA, 20 nt, Human
uccagucaggccuaucuaaa

SEQ ID NO: 2420311 - RNA, 13 nt, Human
uccagucaggaug

SEQ ID NO: 2420312 - RNA, 22 nt, Human
uccagucaacaaacuauuucuu

SEQ ID NO: 2420313 - RNA, 13 nt, Human
uccagucaacaaa

SEQ ID NO: 2420314 - RNA, 19 nt, Human
uccaguauucuugucaaaa

SEQ ID NO: 2420315 - RNA, 13 nt, Human
uccaguauucuug

SEQ ID NO: 2420316 - RNA, 16 nt, Human
uccaguaggauccagu

SEQ ID NO: 2420317 - RNA, 17 nt, Human
uccaguaccuuugucac

SEQ ID NO: 2420318 - RNA, 23 nt, Human
uccaguagcuugggacaaaucaa

SEQ ID NO: 2420319 - RNA, 23 nt, Human
uccaguccaaggaaaccacagcu

SEQ ID NO: 2420320 - RNA, 16 nt, Human
uccaguccaaggaaac

SEQ ID NO: 2420321 - RNA, 17 nt, Human
uccaguccaaucucaug

SEQ ID NO: 2420322 - RNA, 15 nt, Human
uccagucuccaccag

SEQ ID NO: 2420323 - RNA, 16 nt, Human
uccagucuccaccagg

SEQ ID NO: 2420324 - RNA, 22 nt, Human
uccagucuaaaaauaucugucu

SEQ ID NO: 2420325 - RNA, 18 nt, Human
uccagugagacagcucug

SEQ ID NO: 2420326 - RNA, 15 nt, Human
uccagugaggcucug

SEQ ID NO: 2420327 - RNA, 16 nt, Human
uccagugaggcucugc

SEQ ID NO: 2420328 - RNA, 19 nt, Human
uccagucuccaccaggaac

SEQ ID NO: 2420329 - RNA, 13 nt, Human
uccagucugcugc

SEQ ID NO: 2420330 - RNA, 14 nt, Human
uccagucugcugcc

SEQ ID NO: 2420331 - RNA, 23 nt, Human
uccagugaggcucugcccuuggu

SEQ ID NO: 2420332 - RNA, 22 nt, Human
uccagugaggcucugcccuugg

SEQ ID NO: 2420333 - RNA, 19 nt, Human
uccaguggggcaagauuuu

SEQ ID NO: 2420334 - RNA, 20 nt, Human
uccagugcccauuccucacc

SEQ ID NO: 2420335 - RNA, 17 nt, Human
uccagugccagcaauga

SEQ ID NO: 2420336 - RNA, 14 nt, Human
uccagugccagcaa

SEQ ID NO: 2420337 - RNA, 18 nt, Human
uccagugccaacaauccu

SEQ ID NO: 2420338 - RNA, 19 nt, Human
uccagugccaacaauccua

SEQ ID NO: 2420339 - RNA, 18 nt, Human
uccagugagcuuaucaug

SEQ ID NO: 2420340 - RNA, 14 nt, Human
uccagugcaauugu

SEQ ID NO: 2420341 - RNA, 18 nt, Human
uccagugcaacacugaag

SEQ ID NO: 2420342 - RNA, 20 nt, Human
acggcaggcucacugccagg

SEQ ID NO: 2420343 - RNA, 18 nt, Human
acggcaggcucacugcca

SEQ ID NO: 2420344 - RNA, 17 nt, Human
acggcaggcucacugcc

SEQ ID NO: 2420345 - RNA, 15 nt, Human
acggcaggcucacug

SEQ ID NO: 2420346 - RNA, 16 nt, Human
acggaugauuggauua

SEQ ID NO: 2420347 - RNA, 17 nt, Human
acggaucugagaaucuu

SEQ ID NO: 2420348 - RNA, 22 nt, Human
acggcaggacaacgaggaagcc

SEQ ID NO: 2420349 - RNA, 15 nt, Human
acggaucugagaauc

SEQ ID NO: 2420350 - RNA, 21 nt, Human
acggauccauguagcaggacu

SEQ ID NO: 2420351 - RNA, 16 nt, Human
acggccaacaaagcug

SEQ ID NO: 2420352 - RNA, 22 nt, Human
acggcaggcucacugccaggcc

SEQ ID NO: 2420353 - RNA, 12 nt, Human
acggccaggcca

SEQ ID NO: 2420354 - RNA, 18 nt, Human
acggcucacugcagccuc

SEQ ID NO: 2420355 - RNA, 17 nt, Human
acggcucacugcagccu

SEQ ID NO: 2420356 - RNA, 16 nt, Human
acggcucacugcagcc

SEQ ID NO: 2420357 - RNA, 17 nt, Human
acgggaaguuuagagag

SEQ ID NO: 2420358 - RNA, 15 nt, Human
acgggaccgggccgc

SEQ ID NO: 2420359 - RNA, 13 nt, Human
acgggaccgggcc

SEQ ID NO: 2420360 - RNA, 19 nt, Human
uccaguaaucuaauauggc

SEQ ID NO: 2420361 - RNA, 15 nt, Human
uccaguaaucuaaua

SEQ ID NO: 2420362 - RNA, 15 nt, Human
uccaguaucuugaag

SEQ ID NO: 2420363 - RNA, 14 nt, Human
uccaguaucuugaa

SEQ ID NO: 2420364 - RNA, 18 nt, Human
acggcuuuuacuuaaacc

SEQ ID NO: 2420365 - RNA, 23 nt, Human
acggcuuagacuucgacucagga

SEQ ID NO: 2420366 - RNA, 22 nt, Human
acggcugggcacacgccuccca

SEQ ID NO: 2420367 - RNA, 11 nt, Human
acggcugggca

SEQ ID NO: 2420368 - RNA, 19 nt, Human
acggcucuagguggggcgg

SEQ ID NO: 2420369 - RNA, 18 nt, Human
acggcucuagguggggcg

SEQ ID NO: 2420370 - RNA, 17 nt, Human
acggcucuagguggggc

SEQ ID NO: 2420371 - RNA, 15 nt, Human
acggccacuggccau

SEQ ID NO: 2420372 - RNA, 18 nt, Human
acggcucgauuucuccag

SEQ ID NO: 2420373 - RNA, 19 nt, Human
acggcucgauuucuccagg

SEQ ID NO: 2420374 - RNA, 13 nt, Human
acggccacaucaa

SEQ ID NO: 2420375 - RNA, 18 nt, Human
acggccacaucaaagagg

SEQ ID NO: 2420376 - RNA, 16 nt, Human
acgcuggagugcagug

SEQ ID NO: 2420377 - RNA, 15 nt, Human
acgcuggagugcagu

SEQ ID NO: 2420378 - RNA, 23 nt, Human
acgcuggaccuugaacuggguac

SEQ ID NO: 2420379 - RNA, 20 nt, Human
acgcuggaccuugaacuggg

SEQ ID NO: 2420380 - RNA, 17 nt, Human
acgcuggagugcaguga

SEQ ID NO: 2420381 - RNA, 23 nt, Human
acggagucccaccuuggcugcag

SEQ ID NO: 2420382 - RNA, 16 nt, Human
acggaucagaaauaca

SEQ ID NO: 2420383 - RNA, 17 nt, Human
acggaucagaaauacag

SEQ ID NO: 2420384 - RNA, 13 nt, Human
acggagucucgcu

SEQ ID NO: 2420385 - RNA, 20 nt, Human
acggauccauguagcaggac

SEQ ID NO: 2420386 - RNA, 20 nt, Human
acgcuccccgccuguucccc

SEQ ID NO: 2420387 - RNA, 19 nt, Human
acgcuccccgccuguuccc

SEQ ID NO: 2420388 - RNA, 18 nt, Human
acgcuccccgccuguucc

SEQ ID NO: 2420389 - RNA, 17 nt, Human
acgcuccccgccuguuc

SEQ ID NO: 2420390 - RNA, 14 nt, Human
acgcuccccgccug

SEQ ID NO: 2420391 - RNA, 15 nt, Human
acgcgucuccuguuu

SEQ ID NO: 2420392 - RNA, 15 nt, Human
acgcuccuuccucug

SEQ ID NO: 2420393 - RNA, 23 nt, Human
acgcuccucccucugaggcugua

SEQ ID NO: 2420394 - RNA, 22 nt, Human
acgcuccucccucugaggcugu

SEQ ID NO: 2420395 - RNA, 14 nt, Human
acgcuccuuccucu

SEQ ID NO: 2420396 - RNA, 22 nt, Human
acgcuccccgccuguucccccg

SEQ ID NO: 2420397 - RNA, 11 nt, Human
acgcucucugg

SEQ ID NO: 2420398 - RNA, 14 nt, Human
acgcucucuggccu

SEQ ID NO: 2420399 - RNA, 13 nt, Human
acgcuggaccuug

SEQ ID NO: 2420400 - RNA, 22 nt, Human
acgcucuccuuucuuucuaacu

SEQ ID NO: 2420401 - RNA, 15 nt, Human
acgcgucuuccugag

SEQ ID NO: 2420402 - RNA, 21 nt, Human
acgcuacccgggaagggggcu

SEQ ID NO: 2420403 - RNA, 22 nt, Human
acgcgaaaguaucaccagggug

SEQ ID NO: 2420404 - RNA, 13 nt, Human
acgcgucuuccug

SEQ ID NO: 2420405 - RNA, 12 nt, Human
acgcgucuccug

SEQ ID NO: 2420406 - RNA, 12 nt, Human
acgcggccgaga

SEQ ID NO: 2420407 - RNA, 12 nt, Human
acgccugccucc

SEQ ID NO: 2420408 - RNA, 22 nt, Human
acgccugcccuccccagagcac

SEQ ID NO: 2420409 - RNA, 21 nt, Human
acgccugcccuccccagagca

SEQ ID NO: 2420410 - RNA, 19 nt, Human
acgccugcccuccccagag

SEQ ID NO: 2420411 - RNA, 22 nt, Human
acgccugcaaacgcugccugcc

SEQ ID NO: 2420412 - RNA, 23 nt, Human
acgccugcaaacgcugccugccc

SEQ ID NO: 2420413 - RNA, 15 nt, Human
acgccugccuccccu

SEQ ID NO: 2420414 - RNA, 18 nt, Human
acgccugggggugccagg

SEQ ID NO: 2420415 - RNA, 16 nt, Human
acgccuguaaucccag

SEQ ID NO: 2420416 - RNA, 17 nt, Human
acgccuguaaucccagc

SEQ ID NO: 2420417 - RNA, 20 nt, Human
acgccuguaaucccagcacu

SEQ ID NO: 2420418 - RNA, 18 nt, Human
acgccuguaaucccagca

SEQ ID NO: 2420419 - RNA, 19 nt, Human
acgccuguaaucccagcac

SEQ ID NO: 2420420 - RNA, 21 nt, Human
acgccuguaaucccagcacuu

SEQ ID NO: 2420421 - RNA, 16 nt, Human
acgccuguaguccuag

SEQ ID NO: 2420422 - RNA, 23 nt, Human
acgcgaaaguaucaccagggugc

SEQ ID NO: 2420423 - RNA, 19 nt, Human
acgccuguaaucccagcag

SEQ ID NO: 2420424 - RNA, 14 nt, Human
acgccuuguucuug

SEQ ID NO: 2420425 - RNA, 18 nt, Human
acgccuuguucuuggcca

SEQ ID NO: 2420426 - RNA, 13 nt, Human
acgccugaggaac

SEQ ID NO: 2420427 - RNA, 21 nt, Human
acgccugaggaacccuuacag

SEQ ID NO: 2420428 - RNA, 14 nt, Human
acgccugcaaacgc

SEQ ID NO: 2420429 - RNA, 17 nt, Human
acgccugcaaacgcugc

SEQ ID NO: 2420430 - RNA, 18 nt, Human
acgccugcaaacgcugcc

SEQ ID NO: 2420431 - RNA, 19 nt, Human
acgccugcaaacgcugccu

SEQ ID NO: 2420432 - RNA, 20 nt, Human
acgccugcaaacgcugccug

SEQ ID NO: 2420433 - RNA, 21 nt, Human
acgccugcaaacgcugccugc

SEQ ID NO: 2420434 - RNA, 21 nt, Human
acgaauauugcugauggugca

SEQ ID NO: 2420435 - RNA, 15 nt, Human
acgaacccaccugcu

SEQ ID NO: 2420436 - RNA, 16 nt, Human
acgaacccaccugcug

SEQ ID NO: 2420437 - RNA, 16 nt, Human
acgccuaugaucccag

SEQ ID NO: 2420438 - RNA, 17 nt, Human
acgccuaugaucccagc

SEQ ID NO: 2420439 - RNA, 18 nt, Human
acgccuaugaucccagca

SEQ ID NO: 2420440 - RNA, 14 nt, Human
acgccucccacugg

SEQ ID NO: 2420441 - RNA, 15 nt, Human
acgccucccacuggg

SEQ ID NO: 2420442 - RNA, 19 nt, Human
uccacugucacccuccacc

SEQ ID NO: 2420443 - RNA, 17 nt, Human
uccacugucacccucca

SEQ ID NO: 2420444 - RNA, 12 nt, Human
uccacugucacc

SEQ ID NO: 2420445 - RNA, 21 nt, Human
uccacuccuuccugccaccug

SEQ ID NO: 2420446 - RNA, 21 nt, Human
uccacugugccaugugccagg

SEQ ID NO: 2420447 - RNA, 18 nt, Human
uccagaauggucuuucua

SEQ ID NO: 2420448 - RNA, 21 nt, Human
uccagaaugcuguacaucuau

SEQ ID NO: 2420449 - RNA, 16 nt, Human
uccagaauugaccuuu

SEQ ID NO: 2420450 - RNA, 17 nt, Human
uccagaaugcuguacau

SEQ ID NO: 2420451 - RNA, 18 nt, Human
uccagaaugcuguacauc

SEQ ID NO: 2420452 - RNA, 19 nt, Human
uccacugucacuguuucuc

SEQ ID NO: 2420453 - RNA, 22 nt, Human
uccacugucacuguuucucugc

SEQ ID NO: 2420454 - RNA, 18 nt, Human
uccacucucccccacccc

SEQ ID NO: 2420455 - RNA, 16 nt, Human
uccacucucccccacc

SEQ ID NO: 2420456 - RNA, 14 nt, Human
uccacucuccccca

SEQ ID NO: 2420457 - RNA, 13 nt, Human
uccacucuccccc

SEQ ID NO: 2420458 - RNA, 22 nt, Human
uccacugguucuucuuggucuc

SEQ ID NO: 2420459 - RNA, 12 nt, Human
uccacucucccc

SEQ ID NO: 2420460 - RNA, 23 nt, Human
uccacucuacccucccacccccu

SEQ ID NO: 2420461 - RNA, 20 nt, Human
uccacucuacccucccaccc

SEQ ID NO: 2420462 - RNA, 21 nt, Human
uccacucuacccucccacccc

SEQ ID NO: 2420463 - RNA, 17 nt, Human
uccacucuacccuccca

SEQ ID NO: 2420464 - RNA, 18 nt, Human
uccacucuacccucccac

SEQ ID NO: 2420465 - RNA, 13 nt, Human
accuuuuuuauac

SEQ ID NO: 2420466 - RNA, 19 nt, Human
accuuuugaaguaguuugu

SEQ ID NO: 2420467 - RNA, 14 nt, Human
accuuuuuaucucc

SEQ ID NO: 2420468 - RNA, 19 nt, Human
accuuuuuauuugcaugug

SEQ ID NO: 2420469 - RNA, 14 nt, Human
accuuuuuccuucc

SEQ ID NO: 2420470 - RNA, 22 nt, Human
accuuuuuuaagauuuuucuca

SEQ ID NO: 2420471 - RNA, 20 nt, Human
accuuuuuuaagauuuuucu

SEQ ID NO: 2420472 - RNA, 13 nt, Human
uccacuccuuccu

SEQ ID NO: 2420473 - RNA, 14 nt, Human
uccacuccuuccug

SEQ ID NO: 2420474 - RNA, 16 nt, Human
accuuuuuuaagauuu

SEQ ID NO: 2420475 - RNA, 15 nt, Human
accuuuuuuaagauu

SEQ ID NO: 2420476 - RNA, 15 nt, Human
accuuuuuccuuccu

SEQ ID NO: 2420477 - RNA, 21 nt, Human
uccacuccuccuagccaccca

SEQ ID NO: 2420478 - RNA, 20 nt, Human
accuuuuauugacacagaaa

SEQ ID NO: 2420479 - RNA, 20 nt, Human
accuuuuauguaguaauuga

SEQ ID NO: 2420480 - RNA, 14 nt, Human
accuuuuauuacau

SEQ ID NO: 2420481 - RNA, 21 nt, Human
accuuuuaauuaaugaaauau

SEQ ID NO: 2420482 - RNA, 15 nt, Human
accuuuuauguagua

SEQ ID NO: 2420483 - RNA, 15 nt, Human
accuuuuauccacuu

SEQ ID NO: 2420484 - RNA, 20 nt, Human
accuuuuggucuggagggaa

SEQ ID NO: 2420485 - RNA, 21 nt, Human
accuuuugaggagccccagcu

SEQ ID NO: 2420486 - RNA, 17 nt, Human
accuuuugaggagcccc

SEQ ID NO: 2420487 - RNA, 16 nt, Human
accuuuuauugacaca

SEQ ID NO: 2420488 - RNA, 23 nt, Human
accuuugugggguuuuuggagaa

SEQ ID NO: 2420489 - RNA, 14 nt, Human
accuuugcaggcau

SEQ ID NO: 2420490 - RNA, 18 nt, Human
accuuuggagcaaagcug

SEQ ID NO: 2420491 - RNA, 18 nt, Human
accuuuguccccaccgca

SEQ ID NO: 2420492 - RNA, 22 nt, Human
accuuuguuugcaucugaaaau

SEQ ID NO: 2420493 - RNA, 12 nt, Human
accuuuuaacac

SEQ ID NO: 2420494 - RNA, 20 nt, Human
accuuuuaacaccugaugug

SEQ ID NO: 2420495 - RNA, 21 nt, Human
accuuuuaacaccugaugugu

SEQ ID NO: 2420496 - RNA, 14 nt, Human
accuuuuaacucac

SEQ ID NO: 2420497 - RNA, 18 nt, Human
accuuugacaaagguaaa

SEQ ID NO: 2420498 - RNA, 17 nt, Human
accuuugacaaagguaa

SEQ ID NO: 2420499 - RNA, 17 nt, Human
accuuuguccccaccgc

SEQ ID NO: 2420500 - RNA, 20 nt, Human
accuuucuccuuuguacuuu

SEQ ID NO: 2420501 - RNA, 19 nt, Human
accuuucuccuuuguacuu

SEQ ID NO: 2420502 - RNA, 23 nt, Human
accuuucuccuuuguacuuugug

SEQ ID NO: 2420503 - RNA, 14 nt, Human
ucauuccugaaaga

SEQ ID NO: 2420504 - RNA, 18 nt, Human
ucauuccuaacacagcau

SEQ ID NO: 2420505 - RNA, 16 nt, Human
ucauuccugaaagaaa

SEQ ID NO: 2420506 - RNA, 20 nt, Human
ucauuccugaaagaaacagu

SEQ ID NO: 2420507 - RNA, 21 nt, Human
ucauuccugaaagaaacaguu

SEQ ID NO: 2420508 - RNA, 22 nt, Human
ucauuccugaaagaaacaguua

SEQ ID NO: 2420509 - RNA, 13 nt, Human
ucauuccugccug

SEQ ID NO: 2420510 - RNA, 17 nt, Human
ucauuccugccugucuc

SEQ ID NO: 2420511 - RNA, 19 nt, Human
ucauuccugccugucuccu

SEQ ID NO: 2420512 - RNA, 19 nt, Human
ucauuccauucuggaagug

SEQ ID NO: 2420513 - RNA, 14 nt, Human
ucauguuuuaacaa

SEQ ID NO: 2420514 - RNA, 23 nt, Human
ucauuccccagguggcugaccca

SEQ ID NO: 2420515 - RNA, 12 nt, Human
ucauuccccagg

SEQ ID NO: 2420516 - RNA, 14 nt, Human
ucauuccccaggug

SEQ ID NO: 2420517 - RNA, 17 nt, Human
ucauuccuaacacagca

SEQ ID NO: 2420518 - RNA, 19 nt, Human
accuugaaaacuuuaugcu

SEQ ID NO: 2420519 - RNA, 14 nt, Human
ucauuccuguauuc

SEQ ID NO: 2420520 - RNA, 20 nt, Human
accuugaaaauaagaauaga

SEQ ID NO: 2420521 - RNA, 18 nt, Human
accuugaacacuggggga

SEQ ID NO: 2420522 - RNA, 21 nt, Human
accuugaacacugggggaggg

SEQ ID NO: 2420523 - RNA, 20 nt, Human
accuugaacuggguacuugu

SEQ ID NO: 2420524 - RNA, 18 nt, Human
accuugaacuccugggcu

SEQ ID NO: 2420525 - RNA, 16 nt, Human
accuuucuccuuugua

SEQ ID NO: 2420526 - RNA, 15 nt, Human
accuuucuccuuugu

SEQ ID NO: 2420527 - RNA, 15 nt, Human
uccagaauuucccaa

SEQ ID NO: 2420528 - RNA, 14 nt, Human
uccagaauuuccca

SEQ ID NO: 2420529 - RNA, 16 nt, Human
uccagacagccuguau

SEQ ID NO: 2420530 - RNA, 15 nt, Human
uccagacagccugua

SEQ ID NO: 2420531 - RNA, 12 nt, Human
uccagaccccca

SEQ ID NO: 2420532 - RNA, 18 nt, Human
uccagacagccuguaucu

SEQ ID NO: 2420533 - RNA, 13 nt, Human
uccagacccccac

SEQ ID NO: 2420534 - RNA, 14 nt, Human
uccagacagccugu

SEQ ID NO: 2420535 - RNA, 13 nt, Human
uccagacagccug

SEQ ID NO: 2420536 - RNA, 13 nt, Human
uccagacacuuuu

SEQ ID NO: 2420537 - RNA, 14 nt, Human
uccagacccccacc

SEQ ID NO: 2420538 - RNA, 16 nt, Human
uccagacccccacccc

SEQ ID NO: 2420539 - RNA, 17 nt, Human
uccagacccccaccccu

SEQ ID NO: 2420540 - RNA, 20 nt, Human
uccagacccccaccccuucc

SEQ ID NO: 2420541 - RNA, 21 nt, Human
uccagacccccaccccuuccc

SEQ ID NO: 2420542 - RNA, 22 nt, Human
uccagacccccaccccuucccc

SEQ ID NO: 2420543 - RNA, 14 nt, Human
uccagacccccagc

SEQ ID NO: 2420544 - RNA, 15 nt, Human
uccagacccccagca

SEQ ID NO: 2420545 - RNA, 20 nt, Human
uccagcccugaguuccuagc

SEQ ID NO: 2420546 - RNA, 22 nt, Human
uccagcccugaguuccuagcca

SEQ ID NO: 2420547 - RNA, 17 nt, Human
uccagcccuggcugaag

SEQ ID NO: 2420548 - RNA, 15 nt, Human
uccagcccuggcuga

SEQ ID NO: 2420549 - RNA, 16 nt, Human
uccagacccccagcaa

SEQ ID NO: 2420550 - RNA, 21 nt, Human
uccagacccccagcaacccuc

SEQ ID NO: 2420551 - RNA, 20 nt, Human
uccagcccuggcugaaggac

SEQ ID NO: 2420552 - RNA, 19 nt, Human
uccagcccuggcugaagga

SEQ ID NO: 2420553 - RNA, 16 nt, Human
uccagccgccauugcc

SEQ ID NO: 2420554 - RNA, 15 nt, Human
uccagccucuccccu

SEQ ID NO: 2420555 - RNA, 13 nt, Human
uccagccugccac

SEQ ID NO: 2420556 - RNA, 20 nt, Human
uccagccugcugccugcuuu

SEQ ID NO: 2420557 - RNA, 18 nt, Human
uccagccgccauugccac

SEQ ID NO: 2420558 - RNA, 19 nt, Human
uccagccgccauugccacc

SEQ ID NO: 2420559 - RNA, 20 nt, Human
uccagccgccauugccacca

SEQ ID NO: 2420560 - RNA, 21 nt, Human
uccagccgccauugccaccag

SEQ ID NO: 2420561 - RNA, 12 nt, Human
uccagccuagag

SEQ ID NO: 2420562 - RNA, 20 nt, Human
uccagccggcauggcuggga

SEQ ID NO: 2420563 - RNA, 21 nt, Human
uccagcccuggcugaaggacu

SEQ ID NO: 2420564 - RNA, 22 nt, Human
uccagccgccauugccaccagg

SEQ ID NO: 2420565 - RNA, 23 nt, Human
uccagccgccauugccaccagga

SEQ ID NO: 2420566 - RNA, 13 nt, Human
uccagccuggcuc

SEQ ID NO: 2420567 - RNA, 12 nt, Human
uccagccuggcu

SEQ ID NO: 2420568 - RNA, 14 nt, Human
uccagccuggagau

SEQ ID NO: 2420569 - RNA, 22 nt, Human
uccagccuggacccccagcuuu

SEQ ID NO: 2420570 - RNA, 21 nt, Human
uccagccuggacccccagcuu

SEQ ID NO: 2420571 - RNA, 20 nt, Human
uccagccuggacccccagcu

SEQ ID NO: 2420572 - RNA, 19 nt, Human
uccagccuggacccccagc

SEQ ID NO: 2420573 - RNA, 18 nt, Human
uccagccuggacccccag

SEQ ID NO: 2420574 - RNA, 17 nt, Human
uccagccuggaccccca

SEQ ID NO: 2420575 - RNA, 14 nt, Human
uccagccuggaccc

SEQ ID NO: 2420576 - RNA, 13 nt, Human
uccagccuggacc

SEQ ID NO: 2420577 - RNA, 12 nt, Human
uccagccuggac

SEQ ID NO: 2420578 - RNA, 16 nt, Human
uccagccugccuggca

SEQ ID NO: 2420579 - RNA, 19 nt, Human
uccagccugccuggcaggc

SEQ ID NO: 2420580 - RNA, 13 nt, Human
uccaggagccugg

SEQ ID NO: 2420581 - RNA, 14 nt, Human
uccaggagccuggc

SEQ ID NO: 2420582 - RNA, 23 nt, Human
uccaggagccuggcuccguccag

SEQ ID NO: 2420583 - RNA, 15 nt, Human
uccaggagccugugc

SEQ ID NO: 2420584 - RNA, 11 nt, Human
uccagccuggg

SEQ ID NO: 2420585 - RNA, 18 nt, Human
acgaauauugcugauggu

SEQ ID NO: 2420586 - RNA, 15 nt, Human
acgaauauugcugau

SEQ ID NO: 2420587 - RNA, 13 nt, Human
acgaaauguuauu

SEQ ID NO: 2420588 - RNA, 12 nt, Human
acgaaauguuau

SEQ ID NO: 2420589 - RNA, 23 nt, Human
acgaaauguuauuuuuuaauuau

SEQ ID NO: 2420590 - RNA, 16 nt, Human
acgaaauguuauuuuu

SEQ ID NO: 2420591 - RNA, 14 nt, Human
acgaacccaccugc

SEQ ID NO: 2420592 - RNA, 23 nt, Human
uccaggcugggagagccuuccag

SEQ ID NO: 2420593 - RNA, 13 nt, Human
uccaggcugguuc

SEQ ID NO: 2420594 - RNA, 11 nt, Human
uccaggcuggu

SEQ ID NO: 2420595 - RNA, 19 nt, Human
uccaggcgaugugcaagug

SEQ ID NO: 2420596 - RNA, 21 nt, Human
uccaggcugggagagccuucc

SEQ ID NO: 2420597 - RNA, 20 nt, Human
uccaggcugggagagccuuc

SEQ ID NO: 2420598 - RNA, 22 nt, Human
uccaggcuccuuuagcgcccag

SEQ ID NO: 2420599 - RNA, 12 nt, Human
uccaggcuccuu

SEQ ID NO: 2420600 - RNA, 10 nt, Human
uccaggcucc

SEQ ID NO: 2420601 - RNA, 19 nt, Human
uccaggauugaagagcauu

SEQ ID NO: 2420602 - RNA, 22 nt, Human
uccaggccugugaggugcagag

SEQ ID NO: 2420603 - RNA, 18 nt, Human
uccaggagccugugccuc

SEQ ID NO: 2420604 - RNA, 19 nt, Human
uccaggaugcuaacaucua

SEQ ID NO: 2420605 - RNA, 15 nt, Human
uccaggauccagaag

SEQ ID NO: 2420606 - RNA, 22 nt, Human
uccaggaugcuaacaucuaaaa

SEQ ID NO: 2420607 - RNA, 22 nt, Human
uccugcacacgcuccuuccucu

SEQ ID NO: 2420608 - RNA, 21 nt, Human
uccugcacaguuuucuggcug

SEQ ID NO: 2420609 - RNA, 20 nt, Human
uccugcacaguuuucuggcu

SEQ ID NO: 2420610 - RNA, 21 nt, Human
uccugcaaugaagucucugaa

SEQ ID NO: 2420611 - RNA, 14 nt, Human
uccugcacacgcuc

SEQ ID NO: 2420612 - RNA, 21 nt, Human
uccugcacacgcuccuuccuc

SEQ ID NO: 2420613 - RNA, 22 nt, Human
uccugcaaugaagucucugaag

SEQ ID NO: 2420614 - RNA, 14 nt, Human
uccugaucagagcc

SEQ ID NO: 2420615 - RNA, 21 nt, Human
uccugaugcuucuucagagac

SEQ ID NO: 2420616 - RNA, 20 nt, Human
uccugaugcuucuucagaga

SEQ ID NO: 2420617 - RNA, 19 nt, Human
uccugaugcuucuucagag

SEQ ID NO: 2420618 - RNA, 15 nt, Human
uccugaucagagccg

SEQ ID NO: 2420619 - RNA, 21 nt, Human
acugcacuauagccuagguga

SEQ ID NO: 2420620 - RNA, 14 nt, Human
acugcacuccagcc

SEQ ID NO: 2420621 - RNA, 22 nt, Human
acugcacccccuccugcugcag

SEQ ID NO: 2420622 - RNA, 21 nt, Human
acugcacccccuccugcugca

SEQ ID NO: 2420623 - RNA, 20 nt, Human
acugcacccccuccugcugc

SEQ ID NO: 2420624 - RNA, 19 nt, Human
acugcacccccuccugcug

SEQ ID NO: 2420625 - RNA, 15 nt, Human
acugcacuccagccu

SEQ ID NO: 2420626 - RNA, 17 nt, Human
acugcacuccagccugg

SEQ ID NO: 2420627 - RNA, 18 nt, Human
acugcacuccagccuggg

SEQ ID NO: 2420628 - RNA, 19 nt, Human
acugcacuccagccugggc

SEQ ID NO: 2420629 - RNA, 20 nt, Human
acugcacuccagccugggca

SEQ ID NO: 2420630 - RNA, 20 nt, Human
acugcacuccagccugggcg

SEQ ID NO: 2420631 - RNA, 21 nt, Human
acugcacuccagccugggcga

SEQ ID NO: 2420632 - RNA, 19 nt, Human
acugcacuccagccugggu

SEQ ID NO: 2420633 - RNA, 20 nt, Human
acugcacuccagccugggug

SEQ ID NO: 2420634 - RNA, 13 nt, Human
acugauaaagaug

SEQ ID NO: 2420635 - RNA, 21 nt, Human
acugauaaagaugagugagca

SEQ ID NO: 2420636 - RNA, 14 nt, Human
acugagcagagucu

SEQ ID NO: 2420637 - RNA, 14 nt, Human
acugagcagacugg

SEQ ID NO: 2420638 - RNA, 23 nt, Human
acugagcagacuggugagcagac

SEQ ID NO: 2420639 - RNA, 13 nt, Human
acugagcagacug

SEQ ID NO: 2420640 - RNA, 12 nt, Human
acugagcagacu

SEQ ID NO: 2420641 - RNA, 20 nt, Human
acugagccccgcagaccucc

SEQ ID NO: 2420642 - RNA, 18 nt, Human
acugagccccgcagaccu

SEQ ID NO: 2420643 - RNA, 14 nt, Human
acugagccccgcag

SEQ ID NO: 2420644 - RNA, 22 nt, Human
acugagcccccccaacacugug

SEQ ID NO: 2420645 - RNA, 15 nt, Human
acugagcccccccaa

SEQ ID NO: 2420646 - RNA, 13 nt, Human
acugagccccccc

SEQ ID NO: 2420647 - RNA, 20 nt, Human
acugagccagucccaggggc

SEQ ID NO: 2420648 - RNA, 17 nt, Human
acugauaguuacuguug

SEQ ID NO: 2420649 - RNA, 15 nt, Human
acugauaguuacugu

SEQ ID NO: 2420650 - RNA, 17 nt, Human
acugauaguguccaaau

SEQ ID NO: 2420651 - RNA, 16 nt, Human
acugauaguguccaaa

SEQ ID NO: 2420652 - RNA, 23 nt, Human
acugagccccgcagaccucccca

SEQ ID NO: 2420653 - RNA, 21 nt, Human
acugagccccgcagaccuccc

SEQ ID NO: 2420654 - RNA, 15 nt, Human
acugauaaagaaaga

SEQ ID NO: 2420655 - RNA, 20 nt, Human
acugauaguuacuguuguga

SEQ ID NO: 2420656 - RNA, 18 nt, Human
acugauaguuacuguugu

SEQ ID NO: 2420657 - RNA, 22 nt, Human
acugauauaucaugagugaaua

SEQ ID NO: 2420658 - RNA, 16 nt, Human
acugauauauuuuaca

SEQ ID NO: 2420659 - RNA, 23 nt, Human
acugauaguuacuguugugaccu

SEQ ID NO: 2420660 - RNA, 23 nt, Human
acugcaaccuucgccaccugggu

SEQ ID NO: 2420661 - RNA, 14 nt, Human
acugcaacuucugc

SEQ ID NO: 2420662 - RNA, 20 nt, Human
acugcaacuuguaaaugugg

SEQ ID NO: 2420663 - RNA, 16 nt, Human
acugcaacuucugccu

SEQ ID NO: 2420664 - RNA, 23 nt, Human
acugcacagugcaucucagccca

SEQ ID NO: 2420665 - RNA, 22 nt, Human
acugcacagugcaucucagccc

SEQ ID NO: 2420666 - RNA, 18 nt, Human
acugcaagagccuuggug

SEQ ID NO: 2420667 - RNA, 16 nt, Human
acugcaagaaaaugau

SEQ ID NO: 2420668 - RNA, 15 nt, Human
acugcaagagccuug

SEQ ID NO: 2420669 - RNA, 16 nt, Human
acugcaagagccuugg

SEQ ID NO: 2420670 - RNA, 17 nt, Human
acugcaagagccuuggu

SEQ ID NO: 2420671 - RNA, 20 nt, Human
acugcacuauagccuaggug

SEQ ID NO: 2420672 - RNA, 16 nt, Human
acugcaccgggccaca

SEQ ID NO: 2420673 - RNA, 14 nt, Human
acugcaccgggcca

SEQ ID NO: 2420674 - RNA, 18 nt, Human
acugcacccccuccugcu

SEQ ID NO: 2420675 - RNA, 17 nt, Human
acugcacccccuccugc

SEQ ID NO: 2420676 - RNA, 16 nt, Human
acugcacccccuccug

SEQ ID NO: 2420677 - RNA, 15 nt, Human
acugcacccccuccu

SEQ ID NO: 2420678 - RNA, 22 nt, Human
uccuggaaauugacgaggggug

SEQ ID NO: 2420679 - RNA, 16 nt, Human
uccuggaaaucagggu

SEQ ID NO: 2420680 - RNA, 15 nt, Human
uccuggaaauauuaa

SEQ ID NO: 2420681 - RNA, 18 nt, Human
uccugcuuugggaagccg

SEQ ID NO: 2420682 - RNA, 23 nt, Human
uccuggaagugcuaauuuugaaa

SEQ ID NO: 2420683 - RNA, 17 nt, Human
uccuggacacucagacc

SEQ ID NO: 2420684 - RNA, 21 nt, Human
uccuggaagcuguguccuugc

SEQ ID NO: 2420685 - RNA, 18 nt, Human
uccuggaagccagcuuuc

SEQ ID NO: 2420686 - RNA, 20 nt, Human
uccuggaagccagcuuuccc

SEQ ID NO: 2420687 - RNA, 22 nt, Human
uccuggaagcgcgagggccuca

SEQ ID NO: 2420688 - RNA, 14 nt, Human
uccuggaaaccaca

SEQ ID NO: 2420689 - RNA, 14 nt, Human
uccuggaagcugug

SEQ ID NO: 2420690 - RNA, 14 nt, Human
uccuggaagccagc

SEQ ID NO: 2420691 - RNA, 22 nt, Human
uccuggaaaggcucagucucag

SEQ ID NO: 2420692 - RNA, 16 nt, Human
uccuggaaaggcucag

SEQ ID NO: 2420693 - RNA, 19 nt, Human
uccuggaaaggcucagucu

SEQ ID NO: 2420694 - RNA, 17 nt, Human
uccugggagugagcugg

SEQ ID NO: 2420695 - RNA, 14 nt, Human
uccugggagugagc

SEQ ID NO: 2420696 - RNA, 12 nt, Human
uccugggaguga

SEQ ID NO: 2420697 - RNA, 19 nt, Human
uccugggagaaccucaggc

SEQ ID NO: 2420698 - RNA, 20 nt, Human
uccugggagaaccucaggcu

SEQ ID NO: 2420699 - RNA, 20 nt, Human
uccugggaaauauucccuag

SEQ ID NO: 2420700 - RNA, 21 nt, Human
uccugggaaauauucccuaga

SEQ ID NO: 2420701 - RNA, 17 nt, Human
uccugggagaaccucag

SEQ ID NO: 2420702 - RNA, 18 nt, Human
uccugggagaaccucagg

SEQ ID NO: 2420703 - RNA, 14 nt, Human
uccugggaaauauu

SEQ ID NO: 2420704 - RNA, 16 nt, Human
uccugggaaauauucc

SEQ ID NO: 2420705 - RNA, 19 nt, Human
uccuggacacucagaccug

SEQ ID NO: 2420706 - RNA, 23 nt, Human
uccuggcucuugauaccccccuc

SEQ ID NO: 2420707 - RNA, 13 nt, Human
uccuggcuccuga

SEQ ID NO: 2420708 - RNA, 16 nt, Human
uccuggcuccugaggg

SEQ ID NO: 2420709 - RNA, 14 nt, Human
uccugcaggcagcc

SEQ ID NO: 2420710 - RNA, 21 nt, Human
uccugccucgaacuggcugca

SEQ ID NO: 2420711 - RNA, 13 nt, Human
uccugcaggcagc

SEQ ID NO: 2420712 - RNA, 12 nt, Human
uccugcaggcag

SEQ ID NO: 2420713 - RNA, 13 nt, Human
uccugccuguggc

SEQ ID NO: 2420714 - RNA, 12 nt, Human
uccugccugugg

SEQ ID NO: 2420715 - RNA, 18 nt, Human
uccugccugucugaagcc

SEQ ID NO: 2420716 - RNA, 20 nt, Human
uccugccugccccucucccg

SEQ ID NO: 2420717 - RNA, 14 nt, Human
uccugccuggccag

SEQ ID NO: 2420718 - RNA, 16 nt, Human
uccugccuggccaggc

SEQ ID NO: 2420719 - RNA, 20 nt, Human
uccugccugucuccuuugca

SEQ ID NO: 2420720 - RNA, 17 nt, Human
uccugcagccuggaggc

SEQ ID NO: 2420721 - RNA, 14 nt, Human
uccugcagccugga

SEQ ID NO: 2420722 - RNA, 14 nt, Human
uccugccugccccu

SEQ ID NO: 2420723 - RNA, 12 nt, Human
uccugccuggcc

SEQ ID NO: 2420724 - RNA, 13 nt, Human
uccugccuggcca

SEQ ID NO: 2420725 - RNA, 16 nt, Human
uccugccuucuucuuu

SEQ ID NO: 2420726 - RNA, 23 nt, Human
uccugccuucuguccugguguca

SEQ ID NO: 2420727 - RNA, 22 nt, Human
uccugccuucuguccugguguc

SEQ ID NO: 2420728 - RNA, 17 nt, Human
uccugccuucuguccug

SEQ ID NO: 2420729 - RNA, 14 nt, Human
uccugccuucuguc

SEQ ID NO: 2420730 - RNA, 13 nt, Human
uccugccuucugu

SEQ ID NO: 2420731 - RNA, 23 nt, Human
uccugccuuccuccugggcccuc

SEQ ID NO: 2420732 - RNA, 22 nt, Human
uccugccuucuucuuuuugcug

SEQ ID NO: 2420733 - RNA, 19 nt, Human
uccugcggagugaagaggg

SEQ ID NO: 2420734 - RNA, 14 nt, Human
uccugccuuccucc

SEQ ID NO: 2420735 - RNA, 16 nt, Human
uccugccuuccuccug

SEQ ID NO: 2420736 - RNA, 19 nt, Human
uccugccuuccuccugggc

SEQ ID NO: 2420737 - RNA, 22 nt, Human
uccugccuuccuccugggcccu

SEQ ID NO: 2420738 - RNA, 18 nt, Human
uccugccuuagagccagg

SEQ ID NO: 2420739 - RNA, 17 nt, Human
uccugccuuagagccag

SEQ ID NO: 2420740 - RNA, 14 nt, Human
uccugccuguggcg

SEQ ID NO: 2420741 - RNA, 20 nt, Human
uccugcgggcuuuuccccgg

SEQ ID NO: 2420742 - RNA, 21 nt, Human
uccugcugcaguugccaguca

SEQ ID NO: 2420743 - RNA, 22 nt, Human
uccugcggagugaagaggggca

SEQ ID NO: 2420744 - RNA, 21 nt, Human
uccugcggagugaagaggggc

SEQ ID NO: 2420745 - RNA, 23 nt, Human
uccugcggagugaagaggggcag

SEQ ID NO: 2420746 - RNA, 12 nt, Human
uccugcgggcuu

SEQ ID NO: 2420747 - RNA, 15 nt, Human
uccugcugcuguguu

SEQ ID NO: 2420748 - RNA, 14 nt, Human
uccugcugcugugu

SEQ ID NO: 2420749 - RNA, 21 nt, Human
uccugaauuuuauuuuuuggg

SEQ ID NO: 2420750 - RNA, 22 nt, Human
uccugaauuuauuauuguucuu

SEQ ID NO: 2420751 - RNA, 21 nt, Human
uccugaauuuauuauuguucu

SEQ ID NO: 2420752 - RNA, 15 nt, Human
uccugaauucuauuu

SEQ ID NO: 2420753 - RNA, 14 nt, Human
uccugaaugaaaua

SEQ ID NO: 2420754 - RNA, 19 nt, Human
uccugaaugaaauaucaga

SEQ ID NO: 2420755 - RNA, 15 nt, Human
uccugaaauuucaga

SEQ ID NO: 2420756 - RNA, 14 nt, Human
uccugaaauuucag

SEQ ID NO: 2420757 - RNA, 22 nt, Human
uccugaauccaaacuaauccau

SEQ ID NO: 2420758 - RNA, 17 nt, Human
uccucuuugcauggaau

SEQ ID NO: 2420759 - RNA, 14 nt, Human
uccucuuugcaugg

SEQ ID NO: 2420760 - RNA, 15 nt, Human
uccucuuugcuuugc

SEQ ID NO: 2420761 - RNA, 16 nt, Human
uccucuuugcuuugcu

SEQ ID NO: 2420762 - RNA, 22 nt, Human
uccucuuuggucuacacugugc

SEQ ID NO: 2420763 - RNA, 17 nt, Human
uccugaaacaacuugga

SEQ ID NO: 2420764 - RNA, 20 nt, Human
uccucuuugcuuugcuuucu

SEQ ID NO: 2420765 - RNA, 23 nt, Human
uccucuuugcuuugcuuucugcu

SEQ ID NO: 2420766 - RNA, 19 nt, Human
uccugaaacuuacacacaa

SEQ ID NO: 2420767 - RNA, 16 nt, Human
uccugaaagacaauau

SEQ ID NO: 2420768 - RNA, 18 nt, Human
uccugaaagaaacaguua

SEQ ID NO: 2420769 - RNA, 21 nt, Human
uccugaaagaaacaguuaacu

SEQ ID NO: 2420770 - RNA, 21 nt, Human
uccucuuuggucuacacugug

SEQ ID NO: 2420771 - RNA, 19 nt, Human
uccucuuuggucuacacug

SEQ ID NO: 2420772 - RNA, 22 nt, Human
uccucccgggcccucccuugga

SEQ ID NO: 2420773 - RNA, 19 nt, Human
uccucuuuccaucuacccu

SEQ ID NO: 2420774 - RNA, 11 nt, Human
uccucccuccc

SEQ ID NO: 2420775 - RNA, 14 nt, Human
uccucccucccucu

SEQ ID NO: 2420776 - RNA, 11 nt, Human
uccucuuucca

SEQ ID NO: 2420777 - RNA, 12 nt, Human
uccucuuuccau

SEQ ID NO: 2420778 - RNA, 11 nt, Human
acucuuucaaa

SEQ ID NO: 2420779 - RNA, 13 nt, Human
acucuuucaaaac

SEQ ID NO: 2420780 - RNA, 19 nt, Human
acucuuucuauuguuucuu

SEQ ID NO: 2420781 - RNA, 14 nt, Human
acucuuugguggcu

SEQ ID NO: 2420782 - RNA, 12 nt, Human
acucuuuugcuu

SEQ ID NO: 2420783 - RNA, 14 nt, Human
acucuuuugcuuua

SEQ ID NO: 2420784 - RNA, 20 nt, Human
acucuuuugcuuuauuccag

SEQ ID NO: 2420785 - RNA, 13 nt, Human
acucuuuguaaga

SEQ ID NO: 2420786 - RNA, 14 nt, Human
acucuuuguaagag

SEQ ID NO: 2420787 - RNA, 13 nt, Human
uccugaccacccu

SEQ ID NO: 2420788 - RNA, 13 nt, Human
uccugacacuuua

SEQ ID NO: 2420789 - RNA, 15 nt, Human
acucuuguuuccuua

SEQ ID NO: 2420790 - RNA, 15 nt, Human
uccugaccacccucc

SEQ ID NO: 2420791 - RNA, 14 nt, Human
uccugaccacccuc

SEQ ID NO: 2420792 - RNA, 16 nt, Human
uccugaccacccuccc

SEQ ID NO: 2420793 - RNA, 18 nt, Human
acucuuguggauguuuua

SEQ ID NO: 2420794 - RNA, 21 nt, Human
acugaacuucaggauaauaaa

SEQ ID NO: 2420795 - RNA, 16 nt, Human
acugaacuuugcugag

SEQ ID NO: 2420796 - RNA, 19 nt, Human
acugaacuuugcugagccu

SEQ ID NO: 2420797 - RNA, 19 nt, Human
acugaaccggcuuuaccaa

SEQ ID NO: 2420798 - RNA, 18 nt, Human
acugaacucacuuuccuc

SEQ ID NO: 2420799 - RNA, 20 nt, Human
acugaacucugacaacagac

SEQ ID NO: 2420800 - RNA, 18 nt, Human
acugaaccggcuuuacca

SEQ ID NO: 2420801 - RNA, 16 nt, Human
acugaacauuccagag

SEQ ID NO: 2420802 - RNA, 13 nt, Human
acugaacauucca

SEQ ID NO: 2420803 - RNA, 19 nt, Human
acugaacauguacacuggu

SEQ ID NO: 2420804 - RNA, 13 nt, Human
acucuuuuuguac

SEQ ID NO: 2420805 - RNA, 18 nt, Human
acucuuuuugggcuccuu

SEQ ID NO: 2420806 - RNA, 17 nt, Human
acucuuuuugggcuccu

SEQ ID NO: 2420807 - RNA, 20 nt, Human
acucuuuuuagggccaggca

SEQ ID NO: 2420808 - RNA, 19 nt, Human
acucuuuuuagggccaggc

SEQ ID NO: 2420809 - RNA, 14 nt, Human
acucuuuuuagggc

SEQ ID NO: 2420810 - RNA, 21 nt, Human
acucuuuugcuuuauuccaga

SEQ ID NO: 2420811 - RNA, 20 nt, Human
acucuuuuuguaccugguga

SEQ ID NO: 2420812 - RNA, 16 nt, Human
acucuuuuuguaccug

SEQ ID NO: 2420813 - RNA, 20 nt, Human
acucuuuuuucauggacacu

SEQ ID NO: 2420814 - RNA, 18 nt, Human
acucuuuuuguuuuuugu

SEQ ID NO: 2420815 - RNA, 21 nt, Human
acugagaaauuuauaaacuuu

SEQ ID NO: 2420816 - RNA, 17 nt, Human
acugagaaauuuauaaa

SEQ ID NO: 2420817 - RNA, 12 nt, Human
acugagaaauuu

SEQ ID NO: 2420818 - RNA, 15 nt, Human
acugacuuuauccuc

SEQ ID NO: 2420819 - RNA, 14 nt, Human
acugacuuuauccu

SEQ ID NO: 2420820 - RNA, 21 nt, Human
acugagacagcccgggcucug

SEQ ID NO: 2420821 - RNA, 18 nt, Human
acugagacagcccgggcu

SEQ ID NO: 2420822 - RNA, 15 nt, Human
acugagacagcccgg

SEQ ID NO: 2420823 - RNA, 20 nt, Human
acugagaauguaagaacuac

SEQ ID NO: 2420824 - RNA, 19 nt, Human
acugagaauguaagaacua

SEQ ID NO: 2420825 - RNA, 23 nt, Human
acugagacagcccgggcucugcc

SEQ ID NO: 2420826 - RNA, 22 nt, Human
acugagacagcccgggcucugc

SEQ ID NO: 2420827 - RNA, 18 nt, Human
acugagagugaacaaauu

SEQ ID NO: 2420828 - RNA, 15 nt, Human
acugagaccaaagaa

SEQ ID NO: 2420829 - RNA, 22 nt, Human
acugagaugugaacacaucagc

SEQ ID NO: 2420830 - RNA, 17 nt, Human
acugagauuuugguauu

SEQ ID NO: 2420831 - RNA, 17 nt, Human
acugagaugugaacaca

SEQ ID NO: 2420832 - RNA, 18 nt, Human
acugagauaccagcgagg

SEQ ID NO: 2420833 - RNA, 19 nt, Human
acugagauaccagcgagga

SEQ ID NO: 2420834 - RNA, 20 nt, Human
acugagauccuuccuuuuga

SEQ ID NO: 2420835 - RNA, 13 nt, Human
acugacuucuaag

SEQ ID NO: 2420836 - RNA, 15 nt, Human
acugacuucuaagua

SEQ ID NO: 2420837 - RNA, 16 nt, Human
acugacuucuaaguaa

SEQ ID NO: 2420838 - RNA, 22 nt, Human
acugacuucuaaguaaaaccac

SEQ ID NO: 2420839 - RNA, 18 nt, Human
acugacucuuaagaagac

SEQ ID NO: 2420840 - RNA, 17 nt, Human
acugacucuuaagaaga

SEQ ID NO: 2420841 - RNA, 20 nt, Human
acugacucuuaagaagacug

SEQ ID NO: 2420842 - RNA, 14 nt, Human
acugacuccuuaga

SEQ ID NO: 2420843 - RNA, 16 nt, Human
acugacucuuaagaag

SEQ ID NO: 2420844 - RNA, 15 nt, Human
acugacucuuaagaa

SEQ ID NO: 2420845 - RNA, 14 nt, Human
acugacucuuaaga

SEQ ID NO: 2420846 - RNA, 13 nt, Human
acugacucuuaag

SEQ ID NO: 2420847 - RNA, 12 nt, Human
acugaagaagca

SEQ ID NO: 2420848 - RNA, 21 nt, Human
acugaacuuugcugagccugu

SEQ ID NO: 2420849 - RNA, 22 nt, Human
acugaccugucaugccccccuc

SEQ ID NO: 2420850 - RNA, 13 nt, Human
acugaacuucagg

SEQ ID NO: 2420851 - RNA, 21 nt, Human
acugaccugucaugccccccu

SEQ ID NO: 2420852 - RNA, 14 nt, Human
acuccuggccucaa

SEQ ID NO: 2420853 - RNA, 13 nt, Human
acuccuggccuca

SEQ ID NO: 2420854 - RNA, 12 nt, Human
acuccuggccuc

SEQ ID NO: 2420855 - RNA, 13 nt, Human
uccuaggcauuug

SEQ ID NO: 2420856 - RNA, 21 nt, Human
uccuagcuugggaggcuuccc

SEQ ID NO: 2420857 - RNA, 14 nt, Human
uccuaggaaaauac

SEQ ID NO: 2420858 - RNA, 22 nt, Human
uccuagcuugggaggcuucccc

SEQ ID NO: 2420859 - RNA, 18 nt, Human
uccuaggaguauccucau

SEQ ID NO: 2420860 - RNA, 20 nt, Human
uccuagcugcacagggcagc

SEQ ID NO: 2420861 - RNA, 17 nt, Human
uccuagcugcacagggc

SEQ ID NO: 2420862 - RNA, 16 nt, Human
uccuagcugcacaggg

SEQ ID NO: 2420863 - RNA, 14 nt, Human
uccuagcugcacag

SEQ ID NO: 2420864 - RNA, 15 nt, Human
uccguaguucccuga

SEQ ID NO: 2420865 - RNA, 20 nt, Human
uccguagccagcugcucccc

SEQ ID NO: 2420866 - RNA, 14 nt, Human
uccguaguucccug

SEQ ID NO: 2420867 - RNA, 15 nt, Human
uccuacucuguguca

SEQ ID NO: 2420868 - RNA, 16 nt, Human
uccguaacccaacucu

SEQ ID NO: 2420869 - RNA, 22 nt, Human
uccguaacccaacucuccugga

SEQ ID NO: 2420870 - RNA, 21 nt, Human
uccguagccagcugcucccca

SEQ ID NO: 2420871 - RNA, 14 nt, Human
uccuacucuguguc

SEQ ID NO: 2420872 - RNA, 13 nt, Human
uccuacucugugu

SEQ ID NO: 2420873 - RNA, 21 nt, Human
ucccuuuuuuuaaguaaggaa

SEQ ID NO: 2420874 - RNA, 16 nt, Human
ucccuuuuuuuaagua

SEQ ID NO: 2420875 - RNA, 18 nt, Human
uccgguguuuaagacauu

SEQ ID NO: 2420876 - RNA, 18 nt, Human
uccggugugccugcagcc

SEQ ID NO: 2420877 - RNA, 19 nt, Human
uccggugugccugcagccc

SEQ ID NO: 2420878 - RNA, 18 nt, Human
uccggucgugucucuggu

SEQ ID NO: 2420879 - RNA, 15 nt, Human
ucccuuugaaaugaa

SEQ ID NO: 2420880 - RNA, 12 nt, Human
uccggugugccu

SEQ ID NO: 2420881 - RNA, 15 nt, Human
uccggugugccugca

SEQ ID NO: 2420882 - RNA, 17 nt, Human
uccggugugccugcagc

SEQ ID NO: 2420883 - RNA, 19 nt, Human
ucccuuuuuuggcugcuga

SEQ ID NO: 2420884 - RNA, 17 nt, Human
ucccuuuuuuggcugcu

SEQ ID NO: 2420885 - RNA, 19 nt, Human
ucccuuugacgccauccca

SEQ ID NO: 2420886 - RNA, 17 nt, Human
ucccuuggguucugaua

SEQ ID NO: 2420887 - RNA, 21 nt, Human
ucccuuucuuggccaguuauc

SEQ ID NO: 2420888 - RNA, 21 nt, Human
ucccuuugacgccaucccagc

SEQ ID NO: 2420889 - RNA, 22 nt, Human
ucccuuuuuuggcugcugaagg

SEQ ID NO: 2420890 - RNA, 20 nt, Human
ucccuuuuuuggcugcugaa

SEQ ID NO: 2420891 - RNA, 23 nt, Human
ucccuuuuuuggcugcugaaggc

SEQ ID NO: 2420892 - RNA, 13 nt, Human
ucccuuuuuuuaa

SEQ ID NO: 2420893 - RNA, 18 nt, Human
ucccuuugacgccauccc

SEQ ID NO: 2420894 - RNA, 16 nt, Human
ucccuuugacgccauc

SEQ ID NO: 2420895 - RNA, 14 nt, Human
ucccuugggcuccc

SEQ ID NO: 2420896 - RNA, 12 nt, Human
ucccuugggcuc

SEQ ID NO: 2420897 - RNA, 16 nt, Human
ucccuuggccucagaa

SEQ ID NO: 2420898 - RNA, 12 nt, Human
ucccuuggccuc

SEQ ID NO: 2420899 - RNA, 13 nt, Human
ucccuuggccuca

SEQ ID NO: 2420900 - RNA, 14 nt, Human
ucccuuggccucag

SEQ ID NO: 2420901 - RNA, 20 nt, Human
ucccuuggauuguccccgac

SEQ ID NO: 2420902 - RNA, 19 nt, Human
ucccuuggauuguccccga

SEQ ID NO: 2420903 - RNA, 22 nt, Human
ucccugguggcagcucaccucu

SEQ ID NO: 2420904 - RNA, 13 nt, Human
acuccuggaagcu

SEQ ID NO: 2420905 - RNA, 16 nt, Human
acuccuggaagcugug

SEQ ID NO: 2420906 - RNA, 12 nt, Human
acuccuggaaau

SEQ ID NO: 2420907 - RNA, 21 nt, Human
ucccugguggcagcucaccuc

SEQ ID NO: 2420908 - RNA, 20 nt, Human
ucccugguggcagcucaccu

SEQ ID NO: 2420909 - RNA, 19 nt, Human
ucccugguggcagcucacc

SEQ ID NO: 2420910 - RNA, 18 nt, Human
ucccugguggcagcucac

SEQ ID NO: 2420911 - RNA, 17 nt, Human
ucccugguggcagcuca

SEQ ID NO: 2420912 - RNA, 16 nt, Human
ucccugguggcagcuc

SEQ ID NO: 2420913 - RNA, 22 nt, Human
acuccugcccuguuguguauag

SEQ ID NO: 2420914 - RNA, 14 nt, Human
acuccugcccuguu

SEQ ID NO: 2420915 - RNA, 21 nt, Human
acuccugccccuguucucuuc

SEQ ID NO: 2420916 - RNA, 11 nt, Human
acuccuggccu

SEQ ID NO: 2420917 - RNA, 16 nt, Human
acuccugcaggcagcc

SEQ ID NO: 2420918 - RNA, 15 nt, Human
acuccugcaggcagc

SEQ ID NO: 2420919 - RNA, 22 nt, Human
acuccugcaggcagccaggcca

SEQ ID NO: 2420920 - RNA, 17 nt, Human
acuccugccaaggagga

SEQ ID NO: 2420921 - RNA, 14 nt, Human
acuccugcaggcag

SEQ ID NO: 2420922 - RNA, 12 nt, Human
acuccugcaggc

SEQ ID NO: 2420923 - RNA, 12 nt, Human
acuccucccagg

SEQ ID NO: 2420924 - RNA, 16 nt, Human
acuccucaggguugag

SEQ ID NO: 2420925 - RNA, 19 nt, Human
acuccucaggguugagguc

SEQ ID NO: 2420926 - RNA, 20 nt, Human
acuccucaaaagcaaaugag

SEQ ID NO: 2420927 - RNA, 21 nt, Human
acuccucaaaagcaaaugaga

SEQ ID NO: 2420928 - RNA, 18 nt, Human
acuccuaugaucucaggu

SEQ ID NO: 2420929 - RNA, 14 nt, Human
acuccaugagaagc

SEQ ID NO: 2420930 - RNA, 19 nt, Human
acuccaucaguuagagcug

SEQ ID NO: 2420931 - RNA, 21 nt, Human
acuccuaggcaggacaugcug

SEQ ID NO: 2420932 - RNA, 18 nt, Human
acuccaguggugaagaaa

SEQ ID NO: 2420933 - RNA, 16 nt, Human
acuccaguggugaaga

SEQ ID NO: 2420934 - RNA, 22 nt, Human
acuccaguggggcaagauuuuc

SEQ ID NO: 2420935 - RNA, 10 nt, Human
acuccagugg

SEQ ID NO: 2420936 - RNA, 19 nt, Human
acuccagugccagcaauga

SEQ ID NO: 2420937 - RNA, 15 nt, Human
acuccagugccagca

SEQ ID NO: 2420938 - RNA, 14 nt, Human
acuccagugccagc

SEQ ID NO: 2420939 - RNA, 21 nt, Human
acuccagugccaacaauccua

SEQ ID NO: 2420940 - RNA, 18 nt, Human
acuccaguuaaaaaaaau

SEQ ID NO: 2420941 - RNA, 20 nt, Human
acuccaguuaaaaaaaauuu

SEQ ID NO: 2420942 - RNA, 14 nt, Human
acuccaucagcuua

SEQ ID NO: 2420943 - RNA, 19 nt, Human
acuccaucucaaaaaauaa

SEQ ID NO: 2420944 - RNA, 17 nt, Human
acuccagacucucugug

SEQ ID NO: 2420945 - RNA, 21 nt, Human
acuccagaccccuggcuuuuc

SEQ ID NO: 2420946 - RNA, 19 nt, Human
acuccagaccccuggcuuu

SEQ ID NO: 2420947 - RNA, 18 nt, Human
acuccagaccccuggcuu

SEQ ID NO: 2420948 - RNA, 19 nt, Human
acuccagugagacagcucu

SEQ ID NO: 2420949 - RNA, 20 nt, Human
acuccagugauguucuucaa

SEQ ID NO: 2420950 - RNA, 15 nt, Human
acucaccccagcccc

SEQ ID NO: 2420951 - RNA, 14 nt, Human
acucaccccagccc

SEQ ID NO: 2420952 - RNA, 16 nt, Human
acucaccccagcccca

SEQ ID NO: 2420953 - RNA, 15 nt, Human
acuccagaccccugg

SEQ ID NO: 2420954 - RNA, 13 nt, Human
acuccagaccccu

SEQ ID NO: 2420955 - RNA, 13 nt, Human
acucaccccagcc

SEQ ID NO: 2420956 - RNA, 22 nt, Human
acucacacaggacccccuuccc

SEQ ID NO: 2420957 - RNA, 23 nt, Human
acucacagaccuggagccccugg

SEQ ID NO: 2420958 - RNA, 22 nt, Human
acucacagaccuggagccccug

SEQ ID NO: 2420959 - RNA, 19 nt, Human
acucacagaccuggagccc

SEQ ID NO: 2420960 - RNA, 18 nt, Human
acucacagaccuggagcc

SEQ ID NO: 2420961 - RNA, 14 nt, Human
acucacagaccugg

SEQ ID NO: 2420962 - RNA, 24 nt, Human
acuccuugaaaacacuguucucug

SEQ ID NO: 2420963 - RNA, 23 nt, Human
acuccuugaaaacacuguucucu

SEQ ID NO: 2420964 - RNA, 16 nt, Human
acuccuggguugagcu

SEQ ID NO: 2420965 - RNA, 13 nt, Human
acuccuuccugcc

SEQ ID NO: 2420966 - RNA, 20 nt, Human
acuccuuccugccaccugcu

SEQ ID NO: 2420967 - RNA, 19 nt, Human
uccuaggcaggacaugcug

SEQ ID NO: 2420968 - RNA, 21 nt, Human
acuccugggcucaagcagucu

SEQ ID NO: 2420969 - RNA, 16 nt, Human
acuccuggggccucuu

SEQ ID NO: 2420970 - RNA, 14 nt, Human
acuccuggguugag

SEQ ID NO: 2420971 - RNA, 21 nt, Human
acuccuggggccucuuggguc

SEQ ID NO: 2420972 - RNA, 17 nt, Human
acucuccuccagaguca

SEQ ID NO: 2420973 - RNA, 14 nt, Human
acucuccuccagag

SEQ ID NO: 2420974 - RNA, 23 nt, Human
acuccuugagagaccaggcaaag

SEQ ID NO: 2420975 - RNA, 21 nt, Human
acuccuugagagaccaggcaa

SEQ ID NO: 2420976 - RNA, 20 nt, Human
acucucccccacccccuccc

SEQ ID NO: 2420977 - RNA, 18 nt, Human
acuccuugagagaccagg

SEQ ID NO: 2420978 - RNA, 17 nt, Human
acuccuugagagaccag

SEQ ID NO: 2420979 - RNA, 21 nt, Human
acuccuuccugccaccugcug

SEQ ID NO: 2420980 - RNA, 21 nt, Human
acucuccuagagacagaagca

SEQ ID NO: 2420981 - RNA, 13 nt, Human
acucuccuagaga

SEQ ID NO: 2420982 - RNA, 23 nt, Human
acucuccuagagacagaagcagg

SEQ ID NO: 2420983 - RNA, 22 nt, Human
acucucccccacccccuccccg

SEQ ID NO: 2420984 - RNA, 12 nt, Human
acucuccuagag

SEQ ID NO: 2420985 - RNA, 14 nt, Human
acucuccucugcug

SEQ ID NO: 2420986 - RNA, 13 nt, Human
acucuccucugcu

SEQ ID NO: 2420987 - RNA, 14 nt, Human
acucuccucugccu

SEQ ID NO: 2420988 - RNA, 22 nt, Human
acucuccucggcccccuccauc

SEQ ID NO: 2420989 - RNA, 20 nt, Human
acucuccucggcccccucca

SEQ ID NO: 2420990 - RNA, 19 nt, Human
acucuccucggcccccucc

SEQ ID NO: 2420991 - RNA, 14 nt, Human
acucuccucaucuc

SEQ ID NO: 2420992 - RNA, 15 nt, Human
acucuccucaucucu

SEQ ID NO: 2420993 - RNA, 12 nt, Human
acucuccucugc

SEQ ID NO: 2420994 - RNA, 16 nt, Human
acucuccucugccuca

SEQ ID NO: 2420995 - RNA, 21 nt, Human
acucuccucugcugcuggcug

SEQ ID NO: 2420996 - RNA, 16 nt, Human
acucuccucugcugcu

SEQ ID NO: 2420997 - RNA, 15 nt, Human
acucuccuugguguc

SEQ ID NO: 2420998 - RNA, 18 nt, Human
acucuccuggaaauauua

SEQ ID NO: 2420999 - RNA, 18 nt, Human
acucugcccccugcuggc

SEQ ID NO: 2421000 - RNA, 17 nt, Human
acucugcccccugcugg

SEQ ID NO: 2421001 - RNA, 15 nt, Human
acucugcccccugcu

SEQ ID NO: 2421002 - RNA, 13 nt, Human
acucugcccccug

SEQ ID NO: 2421003 - RNA, 12 nt, Human
acucugcccccu

SEQ ID NO: 2421004 - RNA, 21 nt, Human
acucugcccccugcuggcucu

SEQ ID NO: 2421005 - RNA, 19 nt, Human
acucugcccccugcuggcu

SEQ ID NO: 2421006 - RNA, 12 nt, Human
acucugccuccu

SEQ ID NO: 2421007 - RNA, 13 nt, Human
acucugccagcca

SEQ ID NO: 2421008 - RNA, 16 nt, Human
acucugccagccacau

SEQ ID NO: 2421009 - RNA, 15 nt, Human
acucuggcagcucag

SEQ ID NO: 2421010 - RNA, 13 nt, Human
acucuggcagcuc

SEQ ID NO: 2421011 - RNA, 17 nt, Human
acucuggcaaagcuuuu

SEQ ID NO: 2421012 - RNA, 23 nt, Human
acucuggcaaagcuuuuagaaau

SEQ ID NO: 2421013 - RNA, 15 nt, Human
acucuggcaaagcuu

SEQ ID NO: 2421014 - RNA, 16 nt, Human
acucuggcaaagcuuu

SEQ ID NO: 2421015 - RNA, 14 nt, Human
acucuggcaaagcu

SEQ ID NO: 2421016 - RNA, 22 nt, Human
acucugagacucgcgacaaugc

SEQ ID NO: 2421017 - RNA, 11 nt, Human
acucugagacu

SEQ ID NO: 2421018 - RNA, 21 nt, Human
acucugaggcucuuucugggc

SEQ ID NO: 2421019 - RNA, 23 nt, Human
acucugaggcucuuucugggcca

SEQ ID NO: 2421020 - RNA, 19 nt, Human
acucucugaaccccucccu

SEQ ID NO: 2421021 - RNA, 21 nt, Human
acucucugaaccccucccucc

SEQ ID NO: 2421022 - RNA, 23 nt, Human
acucuccuuggugucgggcauga

SEQ ID NO: 2421023 - RNA, 16 nt, Human
acucuccuuggugucg

SEQ ID NO: 2421024 - RNA, 17 nt, Human
acucuccuugcuaccca

SEQ ID NO: 2421025 - RNA, 15 nt, Human
acucuccuggacugc

SEQ ID NO: 2421026 - RNA, 13 nt, Human
acucucuccaccc

SEQ ID NO: 2421027 - RNA, 20 nt, Human
acucucuccacccuauaugu

SEQ ID NO: 2421028 - RNA, 21 nt, Human
acucucuccacccuauaugua

SEQ ID NO: 2421029 - RNA, 18 nt, Human
acucucugaaccccuccc

SEQ ID NO: 2421030 - RNA, 21 nt, Human
acucuuaagaagacugcauua

SEQ ID NO: 2421031 - RNA, 13 nt, Human
acucuuaagccau

SEQ ID NO: 2421032 - RNA, 21 nt, Human
acucuuaaguuucucagcucc

SEQ ID NO: 2421033 - RNA, 19 nt, Human
acucuuaaguuucucagcu

SEQ ID NO: 2421034 - RNA, 18 nt, Human
acucuuaaguuucucagc

SEQ ID NO: 2421035 - RNA, 17 nt, Human
acucuuaaguuucucag

SEQ ID NO: 2421036 - RNA, 16 nt, Human
acucuuaaguuucuca

SEQ ID NO: 2421037 - RNA, 14 nt, Human
acucuuaaguuucu

SEQ ID NO: 2421038 - RNA, 22 nt, Human
acucuuaagccaucuugguaaa

SEQ ID NO: 2421039 - RNA, 14 nt, Human
acucuuaagccauc

SEQ ID NO: 2421040 - RNA, 22 nt, Human
acucuuaaguuucucagcuccc

SEQ ID NO: 2421041 - RNA, 14 nt, Human
acucuuaaucaaau

SEQ ID NO: 2421042 - RNA, 14 nt, Human
acucuuagaaauga

SEQ ID NO: 2421043 - RNA, 19 nt, Human
acucuuagauggauucucc

SEQ ID NO: 2421044 - RNA, 17 nt, Human
acucuuaggaagagaaa

SEQ ID NO: 2421045 - RNA, 21 nt, Human
acucuugaaaaaugcauguug

SEQ ID NO: 2421046 - RNA, 14 nt, Human
acucuugaccucag

SEQ ID NO: 2421047 - RNA, 20 nt, Human
acucuuaggaagagaaacca

SEQ ID NO: 2421048 - RNA, 19 nt, Human
acucuuaggaagagaaacc

SEQ ID NO: 2421049 - RNA, 16 nt, Human
acucuugaccucaggu

SEQ ID NO: 2421050 - RNA, 15 nt, Human
acucuugaccucagg

SEQ ID NO: 2421051 - RNA, 16 nt, Human
acucuugauuauccau

SEQ ID NO: 2421052 - RNA, 15 nt, Human
acucuuaguuacuca

SEQ ID NO: 2421053 - RNA, 15 nt, Human
acucuuggagccugc

SEQ ID NO: 2421054 - RNA, 16 nt, Human
acucuuggagccugca

SEQ ID NO: 2421055 - RNA, 14 nt, Human
acucuugcucuuuc

SEQ ID NO: 2421056 - RNA, 13 nt, Human
acucuugcucuuu

SEQ ID NO: 2421057 - RNA, 14 nt, Human
acucuuggagccug

SEQ ID NO: 2421058 - RNA, 22 nt, Human
acucuuggagccugcagagcug

SEQ ID NO: 2421059 - RNA, 23 nt, Human
acucuuggagccugcagagcugc

SEQ ID NO: 2421060 - RNA, 21 nt, Human
uccucaccccuguccucacug

SEQ ID NO: 2421061 - RNA, 20 nt, Human
uccucaccccuguccucacu

SEQ ID NO: 2421062 - RNA, 16 nt, Human
acucuugguuucuuca

SEQ ID NO: 2421063 - RNA, 16 nt, Human
acucuugcucuuucua

SEQ ID NO: 2421064 - RNA, 21 nt, Human
uccucaccucaugcccacccc

SEQ ID NO: 2421065 - RNA, 16 nt, Human
uccucaccucaugccc

SEQ ID NO: 2421066 - RNA, 15 nt, Human
uccucaccucaugcc

SEQ ID NO: 2421067 - RNA, 20 nt, Human
uccucagccuugccagagau

SEQ ID NO: 2421068 - RNA, 14 nt, Human
uccucacucccuuc

SEQ ID NO: 2421069 - RNA, 18 nt, Human
uccucagccuugccagag

SEQ ID NO: 2421070 - RNA, 12 nt, Human
uccucacucccu

SEQ ID NO: 2421071 - RNA, 22 nt, Human
uccucaccuuuucccggggagg

SEQ ID NO: 2421072 - RNA, 17 nt, Human
uccucacucccagucca

SEQ ID NO: 2421073 - RNA, 19 nt, Human
uccucaccuuuucccgggg

SEQ ID NO: 2421074 - RNA, 15 nt, Human
uccucaccuuuuccc

SEQ ID NO: 2421075 - RNA, 12 nt, Human
uccucacuccca

SEQ ID NO: 2421076 - RNA, 13 nt, Human
uccucacucccag

SEQ ID NO: 2421077 - RNA, 14 nt, Human
uccucacucccagu

SEQ ID NO: 2421078 - RNA, 12 nt, Human
uccucaccucug

SEQ ID NO: 2421079 - RNA, 13 nt, Human
uccucaccucugg

SEQ ID NO: 2421080 - RNA, 15 nt, Human
uccucaccucuggac

SEQ ID NO: 2421081 - RNA, 16 nt, Human
uccucaccucuggacu

SEQ ID NO: 2421082 - RNA, 20 nt, Human
uccucaccucuggacuggcu

SEQ ID NO: 2421083 - RNA, 21 nt, Human
uccucaccucuggacuggcua

SEQ ID NO: 2421084 - RNA, 22 nt, Human
uccucaccucuggacuggcuag

SEQ ID NO: 2421085 - RNA, 23 nt, Human
uccucaccucuggacuggcuaga

SEQ ID NO: 2421086 - RNA, 21 nt, Human
uccucagccuugccagagauc

SEQ ID NO: 2421087 - RNA, 13 nt, Human
uccucaggcugcu

SEQ ID NO: 2421088 - RNA, 19 nt, Human
uccucaggcugcuggagga

SEQ ID NO: 2421089 - RNA, 16 nt, Human
uccucagggacagaga

SEQ ID NO: 2421090 - RNA, 18 nt, Human
uccucagggacagagaca

SEQ ID NO: 2421091 - RNA, 22 nt, Human
uccucagggacagagacaccug

SEQ ID NO: 2421092 - RNA, 23 nt, Human
uccucauacccacccccacccaa

SEQ ID NO: 2421093 - RNA, 24 nt, Human
uccucagggacagagacaccugca

SEQ ID NO: 2421094 - RNA, 16 nt, Human
uccucagguggccaug

SEQ ID NO: 2421095 - RNA, 13 nt, Human
uccucagguggcc

SEQ ID NO: 2421096 - RNA, 21 nt, Human
uccucccauguuaugcccagc

SEQ ID NO: 2421097 - RNA, 19 nt, Human
uccucccauccccuggacu

SEQ ID NO: 2421098 - RNA, 23 nt, Human
uccucccauccccuggacuggga

SEQ ID NO: 2421099 - RNA, 14 nt, Human
uccuccccuugggc

SEQ ID NO: 2421100 - RNA, 13 nt, Human
uccuccccuuggg

SEQ ID NO: 2421101 - RNA, 14 nt, Human
uccucccgggcccu

SEQ ID NO: 2421102 - RNA, 17 nt, Human
uccucccgggcccuccc

SEQ ID NO: 2421103 - RNA, 16 nt, Human
uccucccgggcccucc

SEQ ID NO: 2421104 - RNA, 15 nt, Human
uccucccgggcccuc

SEQ ID NO: 2421105 - RNA, 21 nt, Human
uccucccgggcccucccuugg

SEQ ID NO: 2421106 - RNA, 19 nt, Human
uccucccgggcccucccuu

SEQ ID NO: 2421107 - RNA, 15 nt, Human
uccucccucagugcc

SEQ ID NO: 2421108 - RNA, 18 nt, Human
uccucccauccccuggac

SEQ ID NO: 2421109 - RNA, 15 nt, Human
uccucccauccccug

SEQ ID NO: 2421110 - RNA, 13 nt, Human
uccucccaucccc

SEQ ID NO: 2421111 - RNA, 21 nt, Human
uccucccaggcgccccuuccc

SEQ ID NO: 2421112 - RNA, 19 nt, Human
uccucccaggcgccccuuc

SEQ ID NO: 2421113 - RNA, 18 nt, Human
uccucauccaccccaucc

SEQ ID NO: 2421114 - RNA, 17 nt, Human
uccucauccaccccauc

SEQ ID NO: 2421115 - RNA, 15 nt, Human
uccucauccacccca

SEQ ID NO: 2421116 - RNA, 14 nt, Human
uccucauccacccc

SEQ ID NO: 2421117 - RNA, 16 nt, Human
uccucauccagggcuc

SEQ ID NO: 2421118 - RNA, 21 nt, Human
uccucauauggcccaguguca

SEQ ID NO: 2421119 - RNA, 13 nt, Human
uccucccaggcgc

SEQ ID NO: 2421120 - RNA, 22 nt, Human
uccucauaguaugguggcuggg

SEQ ID NO: 2421121 - RNA, 15 nt, Human
uccucauauggccca

SEQ ID NO: 2421122 - RNA, 22 nt, Human
uccucagguggccagccuggau

SEQ ID NO: 2421123 - RNA, 18 nt, Human
uccucagguggccaugcc

SEQ ID NO: 2421124 - RNA, 16 nt, Human
agaaauaugauuuuau

SEQ ID NO: 2421125 - RNA, 15 nt, Human
agaaauaugauuuua

SEQ ID NO: 2421126 - RNA, 13 nt, Human
agaaauaugauuu

SEQ ID NO: 2421127 - RNA, 21 nt, Human
agaaauaugcacaauagcagu

SEQ ID NO: 2421128 - RNA, 22 nt, Human
agaaauaugauuuuauuugaca

SEQ ID NO: 2421129 - RNA, 16 nt, Human
agaaauauggaacuua

SEQ ID NO: 2421130 - RNA, 14 nt, Human
agaaauauggacac

SEQ ID NO: 2421131 - RNA, 17 nt, Human
agaaauauggaacuuac

SEQ ID NO: 2421132 - RNA, 20 nt, Human
agaaauauggaacuuacauu

SEQ ID NO: 2421133 - RNA, 17 nt, Human
agaaauauggacacuua

SEQ ID NO: 2421134 - RNA, 22 nt, Human
agaaauauggaacuuacauugu

SEQ ID NO: 2421135 - RNA, 15 nt, Human
agaaagccucagaga

SEQ ID NO: 2421136 - RNA, 21 nt, Human
agaaagccucagagaauugcu

SEQ ID NO: 2421137 - RNA, 20 nt, Human
agaaagcccuuaggaagaau

SEQ ID NO: 2421138 - RNA, 22 nt, Human
agaaagcccuuaggaagaauuu

SEQ ID NO: 2421139 - RNA, 14 nt, Human
agaaauaugugguu

SEQ ID NO: 2421140 - RNA, 15 nt, Human
agaaauaugugguuu

SEQ ID NO: 2421141 - RNA, 12 nt, Human
agaaaugaauaa

SEQ ID NO: 2421142 - RNA, 19 nt, Human
agaaaugaauaauuuccca

SEQ ID NO: 2421143 - RNA, 23 nt, Human
agaaaugaccaauauuauacuaa

SEQ ID NO: 2421144 - RNA, 20 nt, Human
agaaaugagaucaggcucug

SEQ ID NO: 2421145 - RNA, 19 nt, Human
agaaaugagaucaggcucu

SEQ ID NO: 2421146 - RNA, 17 nt, Human
agaaaugagaucaggcu

SEQ ID NO: 2421147 - RNA, 22 nt, Human
ucuccuuugcacugagggccac

SEQ ID NO: 2421148 - RNA, 21 nt, Human
ucuccuuugcacugagggcca

SEQ ID NO: 2421149 - RNA, 19 nt, Human
ucuccuuugcacugagggc

SEQ ID NO: 2421150 - RNA, 17 nt, Human
ucuccuuugcacugagg

SEQ ID NO: 2421151 - RNA, 16 nt, Human
ucuccuuugcacugag

SEQ ID NO: 2421152 - RNA, 23 nt, Human
ucuccuuugauaaaauaaaugag

SEQ ID NO: 2421153 - RNA, 17 nt, Human
ucuccuuugauaaaaua

SEQ ID NO: 2421154 - RNA, 20 nt, Human
ucuccuuucuuuuucuucuu

SEQ ID NO: 2421155 - RNA, 23 nt, Human
ucuccuuucaccccagggccuga

SEQ ID NO: 2421156 - RNA, 14 nt, Human
ucuccuuucaggga

SEQ ID NO: 2421157 - RNA, 15 nt, Human
ucuccuuucuuucua

SEQ ID NO: 2421158 - RNA, 18 nt, Human
ucuccuuguucugauaau

SEQ ID NO: 2421159 - RNA, 16 nt, Human
ucuccuuucacaaccu

SEQ ID NO: 2421160 - RNA, 14 nt, Human
ucuccuuguucuga

SEQ ID NO: 2421161 - RNA, 16 nt, Human
ucuccuuguucugaua

SEQ ID NO: 2421162 - RNA, 13 nt, Human
ucuccuuguucug

SEQ ID NO: 2421163 - RNA, 20 nt, Human
ucuccuuguggccugggccu

SEQ ID NO: 2421164 - RNA, 19 nt, Human
ucuccuuagucuucucaua

SEQ ID NO: 2421165 - RNA, 18 nt, Human
agaaagcauuugaaugca

SEQ ID NO: 2421166 - RNA, 17 nt, Human
agaaagcauuugaaugc

SEQ ID NO: 2421167 - RNA, 16 nt, Human
agaaagcauuugaaug

SEQ ID NO: 2421168 - RNA, 15 nt, Human
agaaagcauuugaau

SEQ ID NO: 2421169 - RNA, 21 nt, Human
agaaagcauuugaaugcauuu

SEQ ID NO: 2421170 - RNA, 20 nt, Human
agaaagcauuugaaugcauu

SEQ ID NO: 2421171 - RNA, 22 nt, Human
agaaagcauuugaaugcauuuu

SEQ ID NO: 2421172 - RNA, 15 nt, Human
agaaagccaggcagg

SEQ ID NO: 2421173 - RNA, 21 nt, Human
agaaagccaaaucaaaauaug

SEQ ID NO: 2421174 - RNA, 22 nt, Human
ucuccuuuguauauuauuucua

SEQ ID NO: 2421175 - RNA, 17 nt, Human
ucuccuuuuccucucuc

SEQ ID NO: 2421176 - RNA, 14 nt, Human
agaaagcauuugaa

SEQ ID NO: 2421177 - RNA, 23 nt, Human
ucuccuuugcacugagggccaca

SEQ ID NO: 2421178 - RNA, 17 nt, Human
ucuccuuugcaggcuca

SEQ ID NO: 2421179 - RNA, 19 nt, Human
ucuccuuuguacuuugugc

SEQ ID NO: 2421180 - RNA, 14 nt, Human
ucuccuuuguauau

SEQ ID NO: 2421181 - RNA, 22 nt, Human
ucuccuuugcugaggccuccag

SEQ ID NO: 2421182 - RNA, 20 nt, Human
ucuccuuuguacuuugugcu

SEQ ID NO: 2421183 - RNA, 20 nt, Human
ucugacucgguuucuccaaa

SEQ ID NO: 2421184 - RNA, 19 nt, Human
ucugacucgguuucuccaa

SEQ ID NO: 2421185 - RNA, 18 nt, Human
ucugacucgguuucucca

SEQ ID NO: 2421186 - RNA, 16 nt, Human
ucugacucgguuucuc

SEQ ID NO: 2421187 - RNA, 20 nt, Human
ucugacucagggcuccuggg

SEQ ID NO: 2421188 - RNA, 19 nt, Human
ucugacucauauccccuau

SEQ ID NO: 2421189 - RNA, 14 nt, Human
ucugacuccagugg

SEQ ID NO: 2421190 - RNA, 13 nt, Human
ucugacuccagug

SEQ ID NO: 2421191 - RNA, 23 nt, Human
ucugacuccaguggggcaagauu

SEQ ID NO: 2421192 - RNA, 16 nt, Human
ucugacucacaagaag

SEQ ID NO: 2421193 - RNA, 14 nt, Human
ucugacucacaaga

SEQ ID NO: 2421194 - RNA, 13 nt, Human
ucugacucagggc

SEQ ID NO: 2421195 - RNA, 14 nt, Human
ucugacucagggcu

SEQ ID NO: 2421196 - RNA, 15 nt, Human
ucugacucagggcuc

SEQ ID NO: 2421197 - RNA, 15 nt, Human
ucugacacacagcuc

SEQ ID NO: 2421198 - RNA, 14 nt, Human
ucugacacacagcu

SEQ ID NO: 2421199 - RNA, 13 nt, Human
ucugacacacagc

SEQ ID NO: 2421200 - RNA, 15 nt, Human
ucugaauuauuuucu

SEQ ID NO: 2421201 - RNA, 19 nt, Human
ucugaauuaguccuugcuu

SEQ ID NO: 2421202 - RNA, 18 nt, Human
ucugaauuaguccuugcu

SEQ ID NO: 2421203 - RNA, 23 nt, Human
ucugaauguucugacauuaacag

SEQ ID NO: 2421204 - RNA, 12 nt, Human
ucugacacacag

SEQ ID NO: 2421205 - RNA, 20 nt, Human
ucugaagcugacgaacuucc

SEQ ID NO: 2421206 - RNA, 21 nt, Human
ucugaagcugacgaacuucca

SEQ ID NO: 2421207 - RNA, 21 nt, Human
ucugaaggacauugcggacag

SEQ ID NO: 2421208 - RNA, 16 nt, Human
ucugaagccucuggga

SEQ ID NO: 2421209 - RNA, 13 nt, Human
ucugaagccucac

SEQ ID NO: 2421210 - RNA, 16 nt, Human
agaaaugcauauugua

SEQ ID NO: 2421211 - RNA, 15 nt, Human
agaaaugcauauugu

SEQ ID NO: 2421212 - RNA, 12 nt, Human
agaaaugcagaa

SEQ ID NO: 2421213 - RNA, 22 nt, Human
agaaaugcauccauuccucagg

SEQ ID NO: 2421214 - RNA, 18 nt, Human
agaaaugcauauuguauu

SEQ ID NO: 2421215 - RNA, 18 nt, Human
agaaaugcauccauuccu

SEQ ID NO: 2421216 - RNA, 10 nt, Human
ucugaauuau

SEQ ID NO: 2421217 - RNA, 13 nt, Human
ucugaauggucca

SEQ ID NO: 2421218 - RNA, 13 nt, Human
ucugaauguucug

SEQ ID NO: 2421219 - RNA, 14 nt, Human
ucugaauguucuga

SEQ ID NO: 2421220 - RNA, 16 nt, Human
ucugaauguucugaca

SEQ ID NO: 2421221 - RNA, 17 nt, Human
ucugaauguucugacau

SEQ ID NO: 2421222 - RNA, 19 nt, Human
ucugaauguucugacauua

SEQ ID NO: 2421223 - RNA, 22 nt, Human
ucugaauguucugacauuaaca

SEQ ID NO: 2421224 - RNA, 21 nt, Human
ucugaaggacacuuccugccu

SEQ ID NO: 2421225 - RNA, 12 nt, Human
ucugaauguucu

SEQ ID NO: 2421226 - RNA, 20 nt, Human
ucugaaggacacuuccugcc

SEQ ID NO: 2421227 - RNA, 19 nt, Human
ucugaaggacacuuccugc

SEQ ID NO: 2421228 - RNA, 16 nt, Human
ucugaaggacacuucc

SEQ ID NO: 2421229 - RNA, 15 nt, Human
ucugacucucaaauc

SEQ ID NO: 2421230 - RNA, 12 nt, Human
ucugacucucaa

SEQ ID NO: 2421231 - RNA, 14 nt, Human
ucugacucugagcu

SEQ ID NO: 2421232 - RNA, 16 nt, Human
ucugacugaugcuuuc

SEQ ID NO: 2421233 - RNA, 14 nt, Human
ucugacugugugug

SEQ ID NO: 2421234 - RNA, 12 nt, Human
ucugacugugug

SEQ ID NO: 2421235 - RNA, 13 nt, Human
ucugagaacucau

SEQ ID NO: 2421236 - RNA, 20 nt, Human
ucugagaauuccaaggaguu

SEQ ID NO: 2421237 - RNA, 18 nt, Human
ucugagaauuccaaggag

SEQ ID NO: 2421238 - RNA, 19 nt, Human
ucugagacaaagcaaugga

SEQ ID NO: 2421239 - RNA, 23 nt, Human
ucugagaaucuuuauugagaaag

SEQ ID NO: 2421240 - RNA, 22 nt, Human
ucugagaaucuuuauugagaaa

SEQ ID NO: 2421241 - RNA, 19 nt, Human
ucugagaaucuuuauugag

SEQ ID NO: 2421242 - RNA, 15 nt, Human
ucugagaaucuuuau

SEQ ID NO: 2421243 - RNA, 12 nt, Human
ucugagaaucuu

SEQ ID NO: 2421244 - RNA, 17 nt, Human
ucugagaagguccuuaa

SEQ ID NO: 2421245 - RNA, 18 nt, Human
ucugagaagguccuuaau

SEQ ID NO: 2421246 - RNA, 20 nt, Human
ucugagaagguccuuaauga

SEQ ID NO: 2421247 - RNA, 21 nt, Human
ucugaggugccugucccaccc

SEQ ID NO: 2421248 - RNA, 21 nt, Human
ucugagacucgcgacaaugca

SEQ ID NO: 2421249 - RNA, 24 nt, Human
ucugagucccaggagcugcccaga

SEQ ID NO: 2421250 - RNA, 23 nt, Human
ucugagucccaggagcugcccag

SEQ ID NO: 2421251 - RNA, 14 nt, Human
ucugagucccagga

SEQ ID NO: 2421252 - RNA, 20 nt, Human
ucugagugaaccuguauaag

SEQ ID NO: 2421253 - RNA, 23 nt, Human
ucugaguaucuccucgcaagcug

SEQ ID NO: 2421254 - RNA, 18 nt, Human
ucugaguaucuccucgca

SEQ ID NO: 2421255 - RNA, 21 nt, Human
ucugaucugugcuuuccagcu

SEQ ID NO: 2421256 - RNA, 18 nt, Human
ucugaucugugcuuucca

SEQ ID NO: 2421257 - RNA, 15 nt, Human
ucugaucugugcuuu

SEQ ID NO: 2421258 - RNA, 14 nt, Human
ucugaucugugcuu

SEQ ID NO: 2421259 - RNA, 23 nt, Human
ucugaucugugcuuuccagcuca

SEQ ID NO: 2421260 - RNA, 22 nt, Human
ucugaucugugcuuuccagcuc

SEQ ID NO: 2421261 - RNA, 16 nt, Human
ucugaugcaagcaaga

SEQ ID NO: 2421262 - RNA, 16 nt, Human
ucugaugaugugccug

SEQ ID NO: 2421263 - RNA, 20 nt, Human
ucugaucgugacgcugaaua

SEQ ID NO: 2421264 - RNA, 21 nt, Human
ucugaucccucuacagagcuu

SEQ ID NO: 2421265 - RNA, 22 nt, Human
ucugaucgugacgcugaauaaa

SEQ ID NO: 2421266 - RNA, 21 nt, Human
ucugaucgugacgcugaauaa

SEQ ID NO: 2421267 - RNA, 21 nt, Human
ucugaucuccauggcuuccuc

SEQ ID NO: 2421268 - RNA, 15 nt, Human
ucugaucuccauggc

SEQ ID NO: 2421269 - RNA, 17 nt, Human
ucugaucauccacugug

SEQ ID NO: 2421270 - RNA, 13 nt, Human
ucugagugaaccu

SEQ ID NO: 2421271 - RNA, 21 nt, Human
ucugaucauccacugugccau

SEQ ID NO: 2421272 - RNA, 18 nt, Human
ucugagugaaccuguaua

SEQ ID NO: 2421273 - RNA, 15 nt, Human
ucugcacuccccugc

SEQ ID NO: 2421274 - RNA, 14 nt, Human
ucugcacuccccug

SEQ ID NO: 2421275 - RNA, 16 nt, Human
ucugcacuccccugcu

SEQ ID NO: 2421276 - RNA, 17 nt, Human
ucugcacuccccugcug

SEQ ID NO: 2421277 - RNA, 21 nt, Human
ucugaugcaagcaagaaacac

SEQ ID NO: 2421278 - RNA, 18 nt, Human
ucugcagauaaacaguag

SEQ ID NO: 2421279 - RNA, 15 nt, Human
ucugcagauaaacag

SEQ ID NO: 2421280 - RNA, 17 nt, Human
ucugcagcaauaaagca

SEQ ID NO: 2421281 - RNA, 16 nt, Human
ucugcaggcagacacg

SEQ ID NO: 2421282 - RNA, 14 nt, Human
ucugcaggcagggc

SEQ ID NO: 2421283 - RNA, 15 nt, Human
ucugcaggcagacac

SEQ ID NO: 2421284 - RNA, 14 nt, Human
agaaauguacagca

SEQ ID NO: 2421285 - RNA, 15 nt, Human
agaaauguacagcaa

SEQ ID NO: 2421286 - RNA, 23 nt, Human
agaaaugguuguauuagauguuc

SEQ ID NO: 2421287 - RNA, 22 nt, Human
agaaaugguuguauuagauguu

SEQ ID NO: 2421288 - RNA, 21 nt, Human
agaaaugguuguauuagaugu

SEQ ID NO: 2421289 - RNA, 20 nt, Human
agaaaugguuguauuagaug

SEQ ID NO: 2421290 - RNA, 19 nt, Human
agaaaugguuguauuagau

SEQ ID NO: 2421291 - RNA, 18 nt, Human
agaaaugguuguauuaga

SEQ ID NO: 2421292 - RNA, 17 nt, Human
agaaaugguuguauuag

SEQ ID NO: 2421293 - RNA, 13 nt, Human
ucugcaggcaggg

SEQ ID NO: 2421294 - RNA, 12 nt, Human
ucugcagguccc

SEQ ID NO: 2421295 - RNA, 11 nt, Human
ucugcaggucc

SEQ ID NO: 2421296 - RNA, 13 nt, Human
ucugcaggucccu

SEQ ID NO: 2421297 - RNA, 19 nt, Human
ucugcagggggugugucug

SEQ ID NO: 2421298 - RNA, 17 nt, Human
ucugcccacucccugca

SEQ ID NO: 2421299 - RNA, 16 nt, Human
ucugcccacucccugc

SEQ ID NO: 2421300 - RNA, 22 nt, Human
agaagcccaggaaaggcuccag

SEQ ID NO: 2421301 - RNA, 21 nt, Human
agaagcccaggaaaggcucca

SEQ ID NO: 2421302 - RNA, 20 nt, Human
agaagcccaggaaaggcucc

SEQ ID NO: 2421303 - RNA, 18 nt, Human
agaagcccaggaaaggcu

SEQ ID NO: 2421304 - RNA, 16 nt, Human
agaagcccaggaaagg

SEQ ID NO: 2421305 - RNA, 12 nt, Human
agaagcccagga

SEQ ID NO: 2421306 - RNA, 12 nt, Human
agaagcccagaa

SEQ ID NO: 2421307 - RNA, 13 nt, Human
agaagcccagaau

SEQ ID NO: 2421308 - RNA, 11 nt, Human
agaagcccaga

SEQ ID NO: 2421309 - RNA, 17 nt, Human
agaagccacaggccuga

SEQ ID NO: 2421310 - RNA, 21 nt, Human
agaagcccaauauuauaauuu

SEQ ID NO: 2421311 - RNA, 19 nt, Human
agaagccaagggaaagggg

SEQ ID NO: 2421312 - RNA, 18 nt, Human
agaagccaagggaaaggg

SEQ ID NO: 2421313 - RNA, 16 nt, Human
agaagccaagggaaag

SEQ ID NO: 2421314 - RNA, 15 nt, Human
agaagccaagggaaa

SEQ ID NO: 2421315 - RNA, 22 nt, Human
agaagccaagggaaaggggugc

SEQ ID NO: 2421316 - RNA, 16 nt, Human
agaagccacaggccug

SEQ ID NO: 2421317 - RNA, 24 nt, Human
agaagcauuccuucuuugauaaug

SEQ ID NO: 2421318 - RNA, 17 nt, Human
agaagccaaaagauugg

SEQ ID NO: 2421319 - RNA, 23 nt, Human
agaagcauuccuucuuugauaau

SEQ ID NO: 2421320 - RNA, 22 nt, Human
agaagcauuccuucuuugauaa

SEQ ID NO: 2421321 - RNA, 20 nt, Human
agaagcauuccuucuuugau

SEQ ID NO: 2421322 - RNA, 19 nt, Human
agaagcauuccuucuuuga

SEQ ID NO: 2421323 - RNA, 17 nt, Human
agaagcauuccuucuuu

SEQ ID NO: 2421324 - RNA, 15 nt, Human
agaagcauuccuucu

SEQ ID NO: 2421325 - RNA, 23 nt, Human
agaagauuugaugcuggagaggu

SEQ ID NO: 2421326 - RNA, 17 nt, Human
agaagcaacagaaaaaa

SEQ ID NO: 2421327 - RNA, 14 nt, Human
agaagcauuccuuc

SEQ ID NO: 2421328 - RNA, 18 nt, Human
agaagauuuugaaauuuu

SEQ ID NO: 2421329 - RNA, 14 nt, Human
agaagauguuuaac

SEQ ID NO: 2421330 - RNA, 19 nt, Human
agaagauggcacuuauaac

SEQ ID NO: 2421331 - RNA, 22 nt, Human
agaagauuugaugcuggagagg

SEQ ID NO: 2421332 - RNA, 22 nt, Human
agaagauguuuaacuuaaucaa

SEQ ID NO: 2421333 - RNA, 19 nt, Human
agaagauuugaugcuggag

SEQ ID NO: 2421334 - RNA, 17 nt, Human
agaagaauugaacccag

SEQ ID NO: 2421335 - RNA, 20 nt, Human
agaagaauugaacccaggag

SEQ ID NO: 2421336 - RNA, 16 nt, Human
agaagaauauucagga

SEQ ID NO: 2421337 - RNA, 15 nt, Human
agaagaauauucagg

SEQ ID NO: 2421338 - RNA, 14 nt, Human
agaagaauauucag

SEQ ID NO: 2421339 - RNA, 19 nt, Human
agaagaauauucaggacuu

SEQ ID NO: 2421340 - RNA, 18 nt, Human
agaagaauauucaggacu

SEQ ID NO: 2421341 - RNA, 18 nt, Human
agaagaugguaccaccag

SEQ ID NO: 2421342 - RNA, 13 nt, Human
agaagacaaaauu

SEQ ID NO: 2421343 - RNA, 19 nt, Human
agaagaauugaacccagga

SEQ ID NO: 2421344 - RNA, 22 nt, Human
agaagaauuuucagaccccagc

SEQ ID NO: 2421345 - RNA, 23 nt, Human
agaagaauuuucagaccccagcg

SEQ ID NO: 2421346 - RNA, 14 nt, Human
agaagaacugaaau

SEQ ID NO: 2421347 - RNA, 14 nt, Human
agaagaaguguguc

SEQ ID NO: 2421348 - RNA, 20 nt, Human
agaagaauacaaacauauuu

SEQ ID NO: 2421349 - RNA, 19 nt, Human
agaagaacuauaugugaau

SEQ ID NO: 2421350 - RNA, 13 nt, Human
agaagaacugaaa

SEQ ID NO: 2421351 - RNA, 13 nt, Human
agaagaacaucca

SEQ ID NO: 2421352 - RNA, 19 nt, Human
agaacuguguuucaaguuc

SEQ ID NO: 2421353 - RNA, 21 nt, Human
agaacuguguuucaaguucaa

SEQ ID NO: 2421354 - RNA, 20 nt, Human
agaacuguguuucaaguuca

SEQ ID NO: 2421355 - RNA, 22 nt, Human
agaacuggacucaggaugccca

SEQ ID NO: 2421356 - RNA, 19 nt, Human
agaacuguaugucagacau

SEQ ID NO: 2421357 - RNA, 15 nt, Human
agaacuggacucagg

SEQ ID NO: 2421358 - RNA, 16 nt, Human
agaacuggacucagga

SEQ ID NO: 2421359 - RNA, 17 nt, Human
agaacuggacucaggau

SEQ ID NO: 2421360 - RNA, 20 nt, Human
agaacuggacucaggaugcc

SEQ ID NO: 2421361 - RNA, 23 nt, Human
agaacugcuuucuuucguuuguu

SEQ ID NO: 2421362 - RNA, 22 nt, Human
agaacugccuuuggcagaguuc

SEQ ID NO: 2421363 - RNA, 20 nt, Human
agaaauugcauuuccugaca

SEQ ID NO: 2421364 - RNA, 17 nt, Human
agaaauugcauuuccug

SEQ ID NO: 2421365 - RNA, 20 nt, Human
agaaauuccuguagcaucuu

SEQ ID NO: 2421366 - RNA, 19 nt, Human
agaaauuccuguagcaucu

SEQ ID NO: 2421367 - RNA, 16 nt, Human
agaaauuccuguagca

SEQ ID NO: 2421368 - RNA, 23 nt, Human
agaaauuccuguagcaucuucug

SEQ ID NO: 2421369 - RNA, 23 nt, Human
agaaauuccuugauucacaauga

SEQ ID NO: 2421370 - RNA, 19 nt, Human
ucugcccuccaagaccuuc

SEQ ID NO: 2421371 - RNA, 18 nt, Human
ucugcccuccaagaccuu

SEQ ID NO: 2421372 - RNA, 21 nt, Human
ucugcccacucccugcaaccu

SEQ ID NO: 2421373 - RNA, 18 nt, Human
ucugcccacucccugcaa

SEQ ID NO: 2421374 - RNA, 15 nt, Human
ucugccgcagcccug

SEQ ID NO: 2421375 - RNA, 14 nt, Human
ucugccgcagcccu

SEQ ID NO: 2421376 - RNA, 11 nt, Human
ucugcccugcg

SEQ ID NO: 2421377 - RNA, 12 nt, Human
ucugcccugcgg

SEQ ID NO: 2421378 - RNA, 10 nt, Human
ucugcccugc

SEQ ID NO: 2421379 - RNA, 21 nt, Human
agaagccaagggaaaggggug

SEQ ID NO: 2421380 - RNA, 18 nt, Human
ucugcccugcccuagcuc

SEQ ID NO: 2421381 - RNA, 22 nt, Human
ucugccgcagcccugcagaggg

SEQ ID NO: 2421382 - RNA, 18 nt, Human
ucugccgcaauacaggaa

SEQ ID NO: 2421383 - RNA, 22 nt, Human
ucugccugcccaggccccugcc

SEQ ID NO: 2421384 - RNA, 21 nt, Human
ucugccugcccaggccccugc

SEQ ID NO: 2421385 - RNA, 13 nt, Human
ucugccuggagug

SEQ ID NO: 2421386 - RNA, 12 nt, Human
ucugccuggagu

SEQ ID NO: 2421387 - RNA, 14 nt, Human
ucugccugccccgc

SEQ ID NO: 2421388 - RNA, 12 nt, Human
ucugccugcccc

SEQ ID NO: 2421389 - RNA, 23 nt, Human
ucugccuggagacuuagggcacc

SEQ ID NO: 2421390 - RNA, 21 nt, Human
ucugccuggaguguaugacug

SEQ ID NO: 2421391 - RNA, 16 nt, Human
ucugcgugacaauaaa

SEQ ID NO: 2421392 - RNA, 15 nt, Human
ucugcgucuguguug

SEQ ID NO: 2421393 - RNA, 22 nt, Human
ucugcgugguuccuuucucagc

SEQ ID NO: 2421394 - RNA, 16 nt, Human
ucugcgucaugcuugu

SEQ ID NO: 2421395 - RNA, 17 nt, Human
ucugcgucaugcuugug

SEQ ID NO: 2421396 - RNA, 22 nt, Human
ucugcucagacagaaccccuac

SEQ ID NO: 2421397 - RNA, 13 nt, Human
ucugcucagcagc

SEQ ID NO: 2421398 - RNA, 14 nt, Human
ucugcucagcagcu

SEQ ID NO: 2421399 - RNA, 23 nt, Human
ucugcucaucauucucugucuca

SEQ ID NO: 2421400 - RNA, 10 nt, Human
ucugcuccac

SEQ ID NO: 2421401 - RNA, 12 nt, Human
ucugcuccacca

SEQ ID NO: 2421402 - RNA, 14 nt, Human
ucugcuccaccaca

SEQ ID NO: 2421403 - RNA, 20 nt, Human
ucugcuccaccacauccucc

SEQ ID NO: 2421404 - RNA, 12 nt, Human
ucugcuccaccc

SEQ ID NO: 2421405 - RNA, 14 nt, Human
ucugcuccacccuu

SEQ ID NO: 2421406 - RNA, 15 nt, Human
ucugcuccacccuug

SEQ ID NO: 2421407 - RNA, 16 nt, Human
ucugcuccacccuugg

SEQ ID NO: 2421408 - RNA, 17 nt, Human
ucugcuccacccuuggc

SEQ ID NO: 2421409 - RNA, 18 nt, Human
ucugcuccacccuuggcc

SEQ ID NO: 2421410 - RNA, 19 nt, Human
ucugcuccacccuuggccu

SEQ ID NO: 2421411 - RNA, 20 nt, Human
ucugcucacauaucugucau

SEQ ID NO: 2421412 - RNA, 19 nt, Human
ucugcucacauaucuguca

SEQ ID NO: 2421413 - RNA, 17 nt, Human
ucugcucacauaucugu

SEQ ID NO: 2421414 - RNA, 15 nt, Human
ucugcgugucaccug

SEQ ID NO: 2421415 - RNA, 19 nt, Human
ucugcgugucaccugugcu

SEQ ID NO: 2421416 - RNA, 20 nt, Human
ucugcgugucaccugugcuu

SEQ ID NO: 2421417 - RNA, 14 nt, Human
ucugcuucagugga

SEQ ID NO: 2421418 - RNA, 13 nt, Human
ucugcuucagugg

SEQ ID NO: 2421419 - RNA, 18 nt, Human
ucugcuugcucuuguccu

SEQ ID NO: 2421420 - RNA, 15 nt, Human
ucugcuucagccucc

SEQ ID NO: 2421421 - RNA, 14 nt, Human
ucugcuucagccuc

SEQ ID NO: 2421422 - RNA, 13 nt, Human
ucugcuucagccu

SEQ ID NO: 2421423 - RNA, 20 nt, Human
ucugcuccacccuuggccug

SEQ ID NO: 2421424 - RNA, 21 nt, Human
ucugcuccacccuuggccugu

SEQ ID NO: 2421425 - RNA, 23 nt, Human
ucugcuccacccuuggccugucu

SEQ ID NO: 2421426 - RNA, 13 nt, Human
ucugucaagaaga

SEQ ID NO: 2421427 - RNA, 17 nt, Human
ucugucacccaggcugg

SEQ ID NO: 2421428 - RNA, 16 nt, Human
ucugucacccaggcug

SEQ ID NO: 2421429 - RNA, 19 nt, Human
ucugucaccaauugguuaa

SEQ ID NO: 2421430 - RNA, 15 nt, Human
ucugucacaccagcc

SEQ ID NO: 2421431 - RNA, 14 nt, Human
ucugucaaugaaaa

SEQ ID NO: 2421432 - RNA, 13 nt, Human
ucugucacuuaau

SEQ ID NO: 2421433 - RNA, 22 nt, Human
ucugugaaaggaaagagggagg

SEQ ID NO: 2421434 - RNA, 16 nt, Human
ucugugaaaguacauu

SEQ ID NO: 2421435 - RNA, 17 nt, Human
ucugucacugcaggcac

SEQ ID NO: 2421436 - RNA, 18 nt, Human
ucugucagaugggaagac

SEQ ID NO: 2421437 - RNA, 19 nt, Human
ucugucagaugggaagaca

SEQ ID NO: 2421438 - RNA, 14 nt, Human
ucugggccagaauu

SEQ ID NO: 2421439 - RNA, 15 nt, Human
ucugggccagaauuu

SEQ ID NO: 2421440 - RNA, 21 nt, Human
ucugggccauucuccacagca

SEQ ID NO: 2421441 - RNA, 23 nt, Human
ucugggccaaguuccucuagugc

SEQ ID NO: 2421442 - RNA, 18 nt, Human
ucugggcccccuccuccc

SEQ ID NO: 2421443 - RNA, 18 nt, Human
ucugggccaagucaaaga

SEQ ID NO: 2421444 - RNA, 20 nt, Human
ucugggcccggccauguccu

SEQ ID NO: 2421445 - RNA, 23 nt, Human
ucuguauuuuauuuagacaagag

SEQ ID NO: 2421446 - RNA, 19 nt, Human
ucugugagauucauucaug

SEQ ID NO: 2421447 - RNA, 17 nt, Human
ucugugagauucauuca

SEQ ID NO: 2421448 - RNA, 21 nt, Human
ucugugagacucgagaacuuu

SEQ ID NO: 2421449 - RNA, 17 nt, Human
ucugugagacucgagaa

SEQ ID NO: 2421450 - RNA, 23 nt, Human
ucugugagaugcuagaacucccu

SEQ ID NO: 2421451 - RNA, 17 nt, Human
ucugugagaugcuagaa

SEQ ID NO: 2421452 - RNA, 22 nt, Human
ucugugagaugcuagaacuccc

SEQ ID NO: 2421453 - RNA, 14 nt, Human
ucugugagaugcua

SEQ ID NO: 2421454 - RNA, 23 nt, Human
ucugugaccucaggcacuagccu

SEQ ID NO: 2421455 - RNA, 21 nt, Human
ucugugaacgauuuagaaaga

SEQ ID NO: 2421456 - RNA, 17 nt, Human
ucugugaacgauuuaga

SEQ ID NO: 2421457 - RNA, 17 nt, Human
ucugugaaaugcuggca

SEQ ID NO: 2421458 - RNA, 20 nt, Human
ucugugaaaugcuggcauuu

SEQ ID NO: 2421459 - RNA, 20 nt, Human
ucugugagcaucacaguuuu

SEQ ID NO: 2421460 - RNA, 13 nt, Human
ucuguucuuucca

SEQ ID NO: 2421461 - RNA, 22 nt, Human
ucuguucuuuccaaaguacacu

SEQ ID NO: 2421462 - RNA, 16 nt, Human
ucuguugcaagugcaa

SEQ ID NO: 2421463 - RNA, 12 nt, Human
ucuguugcaaac

SEQ ID NO: 2421464 - RNA, 18 nt, Human
ucuguucuuuaauuuauu

SEQ ID NO: 2421465 - RNA, 12 nt, Human
ucuguugaaguu

SEQ ID NO: 2421466 - RNA, 17 nt, Human
ucuguuggccaguguga

SEQ ID NO: 2421467 - RNA, 12 nt, Human
ucuguuggccag

SEQ ID NO: 2421468 - RNA, 15 nt, Human
ucuguugcugccuca

SEQ ID NO: 2421469 - RNA, 15 nt, Human
ucuguuggcaggcug

SEQ ID NO: 2421470 - RNA, 15 nt, Human
ucuguugccaggcua

SEQ ID NO: 2421471 - RNA, 18 nt, Human
ucuguugccacaacccug

SEQ ID NO: 2421472 - RNA, 16 nt, Human
ucuguugcccaggcug

SEQ ID NO: 2421473 - RNA, 13 nt, Human
ucuguuuagauaa

SEQ ID NO: 2421474 - RNA, 20 nt, Human
ucuguuuacaucaguuuuaa

SEQ ID NO: 2421475 - RNA, 23 nt, Human
ucuguuuaauacucauccuugua

SEQ ID NO: 2421476 - RNA, 16 nt, Human
agaauucuuacauguu

SEQ ID NO: 2421477 - RNA, 17 nt, Human
agaauucuuacauguuu

SEQ ID NO: 2421478 - RNA, 19 nt, Human
agaauucuuacauguuuuc

SEQ ID NO: 2421479 - RNA, 20 nt, Human
agaauucuuacauguuuucu

SEQ ID NO: 2421480 - RNA, 23 nt, Human
agaauucuuacauguuuucuuug

SEQ ID NO: 2421481 - RNA, 14 nt, Human
agaauucuuucaag

SEQ ID NO: 2421482 - RNA, 17 nt, Human
agaauucuucaggugga

SEQ ID NO: 2421483 - RNA, 13 nt, Human
agaauucuuucaa

SEQ ID NO: 2421484 - RNA, 16 nt, Human
agaauugaacccagga

SEQ ID NO: 2421485 - RNA, 17 nt, Human
agaauugaacccaggag

SEQ ID NO: 2421486 - RNA, 14 nt, Human
ucuguuuacagugu

SEQ ID NO: 2421487 - RNA, 17 nt, Human
ucuguuuaauacucauc

SEQ ID NO: 2421488 - RNA, 15 nt, Human
ucuguuuaauacuca

SEQ ID NO: 2421489 - RNA, 21 nt, Human
ucuguuguccuccccuugggc

SEQ ID NO: 2421490 - RNA, 17 nt, Human
ucuguuuaaaguagauu

SEQ ID NO: 2421491 - RNA, 20 nt, Human
ucuguuggcaggcuggccag

SEQ ID NO: 2421492 - RNA, 18 nt, Human
ucuguuggcaggcuggcc

SEQ ID NO: 2421493 - RNA, 19 nt, Human
ucuguuguccuccccuugg

SEQ ID NO: 2421494 - RNA, 17 nt, Human
ucuguuguccuccccuu

SEQ ID NO: 2421495 - RNA, 15 nt, Human
ucuguuguccucccc

SEQ ID NO: 2421496 - RNA, 18 nt, Human
ucuguugucauugcuguu

SEQ ID NO: 2421497 - RNA, 14 nt, Human
ucuguugucauugc

SEQ ID NO: 2421498 - RNA, 20 nt, Human
agacacuggcugccagcuau

SEQ ID NO: 2421499 - RNA, 18 nt, Human
agacacuggcugccagcu

SEQ ID NO: 2421500 - RNA, 16 nt, Human
agacacuggccccuca

SEQ ID NO: 2421501 - RNA, 15 nt, Human
agacacuggccccuc

SEQ ID NO: 2421502 - RNA, 13 nt, Human
agacacuggcccc

SEQ ID NO: 2421503 - RNA, 20 nt, Human
agacacugccacacaggguc

SEQ ID NO: 2421504 - RNA, 20 nt, Human
agacacuucuaaaugaagug

SEQ ID NO: 2421505 - RNA, 21 nt, Human
agacagagaccuccugccucc

SEQ ID NO: 2421506 - RNA, 16 nt, Human
agacagagaccuccug

SEQ ID NO: 2421507 - RNA, 13 nt, Human
agacacuugccuu

SEQ ID NO: 2421508 - RNA, 20 nt, Human
agacacugguuuacacuuua

SEQ ID NO: 2421509 - RNA, 18 nt, Human
agacacugguuuacacuu

SEQ ID NO: 2421510 - RNA, 18 nt, Human
agacacuguuuacaagaa

SEQ ID NO: 2421511 - RNA, 19 nt, Human
agacacuguuuacaagaaa

SEQ ID NO: 2421512 - RNA, 20 nt, Human
agacacuguuuacaagaaaa

SEQ ID NO: 2421513 - RNA, 22 nt, Human
agacacuguuuacaagaaaaaa

SEQ ID NO: 2421514 - RNA, 20 nt, Human
agacagagaggacuguaggg

SEQ ID NO: 2421515 - RNA, 15 nt, Human
agacagagaggacug

SEQ ID NO: 2421516 - RNA, 19 nt, Human
agacagagaccuccugccu

SEQ ID NO: 2421517 - RNA, 16 nt, Human
agacaggaccagggau

SEQ ID NO: 2421518 - RNA, 17 nt, Human
agacaccuugacagggc

SEQ ID NO: 2421519 - RNA, 14 nt, Human
agacaccugcaccu

SEQ ID NO: 2421520 - RNA, 16 nt, Human
agacaccugcaccucc

SEQ ID NO: 2421521 - RNA, 17 nt, Human
agacaccugcaccuccc

SEQ ID NO: 2421522 - RNA, 21 nt, Human
agacaccugcaccucccccca

SEQ ID NO: 2421523 - RNA, 18 nt, Human
agacaccuugacagggca

SEQ ID NO: 2421524 - RNA, 20 nt, Human
agacaccugcaccucccccc

SEQ ID NO: 2421525 - RNA, 19 nt, Human
agacacugaccauccacuc

SEQ ID NO: 2421526 - RNA, 22 nt, Human
agacacugaaauauacacacag

SEQ ID NO: 2421527 - RNA, 20 nt, Human
agacacauguccaagaagcc

SEQ ID NO: 2421528 - RNA, 16 nt, Human
agacacauguccaaga

SEQ ID NO: 2421529 - RNA, 14 nt, Human
agacacauaugagg

SEQ ID NO: 2421530 - RNA, 16 nt, Human
agacacauaugagggg

SEQ ID NO: 2421531 - RNA, 22 nt, Human
agaauugaacccaggaggugga

SEQ ID NO: 2421532 - RNA, 18 nt, Human
agaauugaacccaggagg

SEQ ID NO: 2421533 - RNA, 19 nt, Human
agaauugaacccaggaggu

SEQ ID NO: 2421534 - RNA, 20 nt, Human
agaauugauauacacggaug

SEQ ID NO: 2421535 - RNA, 21 nt, Human
agaauugaucauuuucccccc

SEQ ID NO: 2421536 - RNA, 22 nt, Human
agaauugaucauuuucccccca

SEQ ID NO: 2421537 - RNA, 20 nt, Human
agaauuuuaaaaaugaaucc

SEQ ID NO: 2421538 - RNA, 19 nt, Human
agaauuuuaaaaaugaauc

SEQ ID NO: 2421539 - RNA, 18 nt, Human
agaauuuuaaaaaugaau

SEQ ID NO: 2421540 - RNA, 17 nt, Human
agaauuuuaaaaaugaa

SEQ ID NO: 2421541 - RNA, 16 nt, Human
agaauuuuaaaaauga

SEQ ID NO: 2421542 - RNA, 14 nt, Human
agaauuuuaaaaau

SEQ ID NO: 2421543 - RNA, 12 nt, Human
agaauuuuaaaa

SEQ ID NO: 2421544 - RNA, 16 nt, Human
agaauuuuaagugcuu

SEQ ID NO: 2421545 - RNA, 21 nt, Human
agaauuuuaaaaaugaauccu

SEQ ID NO: 2421546 - RNA, 13 nt, Human
agaauuuuaaauu

SEQ ID NO: 2421547 - RNA, 15 nt, Human
agaauuuuaaauuau

SEQ ID NO: 2421548 - RNA, 18 nt, Human
agaauuuuaaauuauaac

SEQ ID NO: 2421549 - RNA, 21 nt, Human
agacacacacacgcacgcaca

SEQ ID NO: 2421550 - RNA, 20 nt, Human
agacacacacacgcacgcac

SEQ ID NO: 2421551 - RNA, 18 nt, Human
agacacacacacgcacgc

SEQ ID NO: 2421552 - RNA, 16 nt, Human
agacacacacacgcac

SEQ ID NO: 2421553 - RNA, 12 nt, Human
agacacagacug

SEQ ID NO: 2421554 - RNA, 15 nt, Human
agacacacaugaagu

SEQ ID NO: 2421555 - RNA, 12 nt, Human
agacacacauga

SEQ ID NO: 2421556 - RNA, 15 nt, Human
agacacacacacgca

SEQ ID NO: 2421557 - RNA, 14 nt, Human
agacacacacacgc

SEQ ID NO: 2421558 - RNA, 13 nt, Human
agacacacacaca

SEQ ID NO: 2421559 - RNA, 21 nt, Human
agaauuuuaagugcuuuguaa

SEQ ID NO: 2421560 - RNA, 22 nt, Human
agaauuuuaagugcuuuguaau

SEQ ID NO: 2421561 - RNA, 12 nt, Human
agacacacacac

SEQ ID NO: 2421562 - RNA, 13 nt, Human
agacacaggcccg

SEQ ID NO: 2421563 - RNA, 12 nt, Human
agacacaggccc

SEQ ID NO: 2421564 - RNA, 16 nt, Human
agacacaggcccggcu

SEQ ID NO: 2421565 - RNA, 22 nt, Human
agacacagggacuugaaguugu

SEQ ID NO: 2421566 - RNA, 20 nt, Human
agacacagggacuugaaguu

SEQ ID NO: 2421567 - RNA, 19 nt, Human
agacacagggacuugaagu

SEQ ID NO: 2421568 - RNA, 16 nt, Human
agacacagggacuuga

SEQ ID NO: 2421569 - RNA, 23 nt, Human
agacacacacacgcacgcacaca

SEQ ID NO: 2421570 - RNA, 22 nt, Human
agacacacacacgcacgcacac

SEQ ID NO: 2421571 - RNA, 14 nt, Human
ucugcuuguguuaa

SEQ ID NO: 2421572 - RNA, 19 nt, Human
ucugcuuguuauuagagau

SEQ ID NO: 2421573 - RNA, 13 nt, Human
ucugcuuuccaca

SEQ ID NO: 2421574 - RNA, 15 nt, Human
ucugcuuuauguugc

SEQ ID NO: 2421575 - RNA, 12 nt, Human
ucugcuuuccuc

SEQ ID NO: 2421576 - RNA, 13 nt, Human
ucugcuuuccucu

SEQ ID NO: 2421577 - RNA, 18 nt, Human
ucugcuuuccucuuccug

SEQ ID NO: 2421578 - RNA, 23 nt, Human
agaaguggaccaggacaggacca

SEQ ID NO: 2421579 - RNA, 18 nt, Human
agaaggcucuucugacua

SEQ ID NO: 2421580 - RNA, 17 nt, Human
agaaggccaagaggcug

SEQ ID NO: 2421581 - RNA, 13 nt, Human
agaaggccaagag

SEQ ID NO: 2421582 - RNA, 12 nt, Human
agaaggcucuuc

SEQ ID NO: 2421583 - RNA, 11 nt, Human
agaaggcucuu

SEQ ID NO: 2421584 - RNA, 14 nt, Human
agaaggccacaugu

SEQ ID NO: 2421585 - RNA, 15 nt, Human
agaaggcagggaaag

SEQ ID NO: 2421586 - RNA, 15 nt, Human
agaaggcaaaugacu

SEQ ID NO: 2421587 - RNA, 20 nt, Human
agaaggcaaaugacuuugga

SEQ ID NO: 2421588 - RNA, 14 nt, Human
agaaggcaaaugac

SEQ ID NO: 2421589 - RNA, 15 nt, Human
agaaggcaaaaaugu

SEQ ID NO: 2421590 - RNA, 22 nt, Human
agaaggcauaucagucucugag

SEQ ID NO: 2421591 - RNA, 13 nt, Human
agaaggccaagaa

SEQ ID NO: 2421592 - RNA, 22 nt, Human
agaaggcaaguuucuagcuaga

SEQ ID NO: 2421593 - RNA, 13 nt, Human
agaaggcagccac

SEQ ID NO: 2421594 - RNA, 20 nt, Human
agaauaaaauguugaaaagu

SEQ ID NO: 2421595 - RNA, 16 nt, Human
agaauaaaauguugaa

SEQ ID NO: 2421596 - RNA, 14 nt, Human
agaauaaaauguug

SEQ ID NO: 2421597 - RNA, 13 nt, Human
agaauaaaauguu

SEQ ID NO: 2421598 - RNA, 22 nt, Human
agaaguuuuuguacuguaaaga

SEQ ID NO: 2421599 - RNA, 21 nt, Human
agaaguuuuuguacuguaaag

SEQ ID NO: 2421600 - RNA, 20 nt, Human
agaaguuuuuguacuguaaa

SEQ ID NO: 2421601 - RNA, 23 nt, Human
agaaguuucugccgcagcccugc

SEQ ID NO: 2421602 - RNA, 22 nt, Human
agaaguuucugccgcagcccug

SEQ ID NO: 2421603 - RNA, 21 nt, Human
agaaguuucugccgcagcccu

SEQ ID NO: 2421604 - RNA, 20 nt, Human
agaaguggggacagagcaga

SEQ ID NO: 2421605 - RNA, 17 nt, Human
agaagugggccaggaca

SEQ ID NO: 2421606 - RNA, 18 nt, Human
agaagugggccaggacag

SEQ ID NO: 2421607 - RNA, 19 nt, Human
agaagugggccaggacagg

SEQ ID NO: 2421608 - RNA, 23 nt, Human
agaagugggccaggacaggcccg

SEQ ID NO: 2421609 - RNA, 23 nt, Human
agaagugugauugggaauaaaua

SEQ ID NO: 2421610 - RNA, 15 nt, Human
agaaguuaagcaaca

SEQ ID NO: 2421611 - RNA, 22 nt, Human
agaagugugauugggaauaaau

SEQ ID NO: 2421612 - RNA, 14 nt, Human
agaagugugauugg

SEQ ID NO: 2421613 - RNA, 12 nt, Human
agaagugugauu

SEQ ID NO: 2421614 - RNA, 23 nt, Human
agaaguuauuuucuacagugguu

SEQ ID NO: 2421615 - RNA, 15 nt, Human
agaaguuacugaaug

SEQ ID NO: 2421616 - RNA, 14 nt, Human
agaaguuacugaau

SEQ ID NO: 2421617 - RNA, 19 nt, Human
agaaguuaagcaacaucua

SEQ ID NO: 2421618 - RNA, 19 nt, Human
agaauauuagcuuuacugu

SEQ ID NO: 2421619 - RNA, 20 nt, Human
agaauauuagcuuuacuguu

SEQ ID NO: 2421620 - RNA, 21 nt, Human
agaauauuagcuuuacuguuu

SEQ ID NO: 2421621 - RNA, 19 nt, Human
agaauauccuacuucucca

SEQ ID NO: 2421622 - RNA, 11 nt, Human
agaauaucugg

SEQ ID NO: 2421623 - RNA, 17 nt, Human
agaauauccaugaccua

SEQ ID NO: 2421624 - RNA, 17 nt, Human
agaauagccacauuugg

SEQ ID NO: 2421625 - RNA, 16 nt, Human
agaauagaugcugacu

SEQ ID NO: 2421626 - RNA, 14 nt, Human
agaauacuuuucuc

SEQ ID NO: 2421627 - RNA, 20 nt, Human
agaauacuguuaaaggaaaa

SEQ ID NO: 2421628 - RNA, 22 nt, Human
agaauagaaauaaaggauguga

SEQ ID NO: 2421629 - RNA, 16 nt, Human
agaauacuuuucucuu

SEQ ID NO: 2421630 - RNA, 14 nt, Human
agaauaagagaaag

SEQ ID NO: 2421631 - RNA, 14 nt, Human
agaauaaaauugua

SEQ ID NO: 2421632 - RNA, 13 nt, Human
agaauaaaauugu

SEQ ID NO: 2421633 - RNA, 12 nt, Human
agaauaaaauug

SEQ ID NO: 2421634 - RNA, 17 nt, Human
agaauaaaauuuuuaau

SEQ ID NO: 2421635 - RNA, 14 nt, Human
agaauaaaauuuuu

SEQ ID NO: 2421636 - RNA, 12 nt, Human
agaauaaaauuu

SEQ ID NO: 2421637 - RNA, 17 nt, Human
agaauaaguuauugcag

SEQ ID NO: 2421638 - RNA, 16 nt, Human
agaauaaguuauugca

SEQ ID NO: 2421639 - RNA, 14 nt, Human
agaauaaguuauug

SEQ ID NO: 2421640 - RNA, 13 nt, Human
agaauaaguuauu

SEQ ID NO: 2421641 - RNA, 22 nt, Human
agaauaagagagucauaaaccu

SEQ ID NO: 2421642 - RNA, 21 nt, Human
agaauaagagaaagaaaauga

SEQ ID NO: 2421643 - RNA, 16 nt, Human
agaauaagagaaagaa

SEQ ID NO: 2421644 - RNA, 18 nt, Human
agaauaagucauguuccu

SEQ ID NO: 2421645 - RNA, 15 nt, Human
agaauaagucauguu

SEQ ID NO: 2421646 - RNA, 12 nt, Human
agaauaaguuau

SEQ ID NO: 2421647 - RNA, 19 nt, Human
agaauacuguuaaaggaaa

SEQ ID NO: 2421648 - RNA, 22 nt, Human
agaauaauaugcugccaaauuu

SEQ ID NO: 2421649 - RNA, 14 nt, Human
agaauaauaagagg

SEQ ID NO: 2421650 - RNA, 20 nt, Human
agaauaaguuauugcaguuu

SEQ ID NO: 2421651 - RNA, 19 nt, Human
agaauaaguuauugcaguu

SEQ ID NO: 2421652 - RNA, 21 nt, Human
agaauaaguuauugcaguuua

SEQ ID NO: 2421653 - RNA, 21 nt, Human
agaauaagucauguuccuuca

SEQ ID NO: 2421654 - RNA, 21 nt, Human
agaaugguugccuuaaagaaa

SEQ ID NO: 2421655 - RNA, 23 nt, Human
agaaugguugccuuaaagaaagu

SEQ ID NO: 2421656 - RNA, 15 nt, Human
agaaucccaaauuug

SEQ ID NO: 2421657 - RNA, 17 nt, Human
agaaucccaaauuugau

SEQ ID NO: 2421658 - RNA, 18 nt, Human
agaaucccaaauuugauu

SEQ ID NO: 2421659 - RNA, 18 nt, Human
agaaucccacuuucuaua

SEQ ID NO: 2421660 - RNA, 22 nt, Human
agaauccacccauccuaccaau

SEQ ID NO: 2421661 - RNA, 19 nt, Human
agaaucccaaauuugauug

SEQ ID NO: 2421662 - RNA, 18 nt, Human
agaaucccuggcaaaggg

SEQ ID NO: 2421663 - RNA, 16 nt, Human
agaaugggcaguuaca

SEQ ID NO: 2421664 - RNA, 17 nt, Human
agaaugggcaguuacau

SEQ ID NO: 2421665 - RNA, 18 nt, Human
agaauggggaucacagag

SEQ ID NO: 2421666 - RNA, 19 nt, Human
agaaugggcaguuacaugc

SEQ ID NO: 2421667 - RNA, 15 nt, Human
agaauggggugcaug

SEQ ID NO: 2421668 - RNA, 11 nt, Human
agaauauuuau

SEQ ID NO: 2421669 - RNA, 15 nt, Human
agaauauucaggacu

SEQ ID NO: 2421670 - RNA, 13 nt, Human
agaauauucagga

SEQ ID NO: 2421671 - RNA, 12 nt, Human
agaauauucagg

SEQ ID NO: 2421672 - RNA, 23 nt, Human
agaauauuagcuuuacuguuugu

SEQ ID NO: 2421673 - RNA, 17 nt, Human
agaaucagaucauuuca

SEQ ID NO: 2421674 - RNA, 22 nt, Human
agaauauuuauuaccucugaua

SEQ ID NO: 2421675 - RNA, 21 nt, Human
agaaucagucuauccacagag

SEQ ID NO: 2421676 - RNA, 19 nt, Human
agaaucagucuauccacag

SEQ ID NO: 2421677 - RNA, 13 nt, Human
agaaucagccuag

SEQ ID NO: 2421678 - RNA, 19 nt, Human
agaaguuuuuguacuguaa

SEQ ID NO: 2421679 - RNA, 19 nt, Human
agaauauuuauuaccucug

SEQ ID NO: 2421680 - RNA, 16 nt, Human
agaauauuuauuaccu

SEQ ID NO: 2421681 - RNA, 14 nt, Human
agaauauuuuaagu

SEQ ID NO: 2421682 - RNA, 12 nt, Human
agaauccaaacu

SEQ ID NO: 2421683 - RNA, 14 nt, Human
agaauccaaacuug

SEQ ID NO: 2421684 - RNA, 16 nt, Human
agaauccaaacuugga

SEQ ID NO: 2421685 - RNA, 18 nt, Human
agaauccaagugaacacu

SEQ ID NO: 2421686 - RNA, 21 nt, Human
agaauccaaacuuggauuuuu

SEQ ID NO: 2421687 - RNA, 22 nt, Human
agaaucauaugauucugcuuuu

SEQ ID NO: 2421688 - RNA, 18 nt, Human
agaaucaugugaacccgg

SEQ ID NO: 2421689 - RNA, 21 nt, Human
agaaucaugugaacccgggac

SEQ ID NO: 2421690 - RNA, 21 nt, Human
agaaucauaugauucugcuuu

SEQ ID NO: 2421691 - RNA, 20 nt, Human
agaaucauaugauucugcuu

SEQ ID NO: 2421692 - RNA, 17 nt, Human
agaaucauaugauucug

SEQ ID NO: 2421693 - RNA, 16 nt, Human
agaaucagugcaaaga

SEQ ID NO: 2421694 - RNA, 14 nt, Human
agaaucauacuuag

SEQ ID NO: 2421695 - RNA, 22 nt, Human
agaaucagucuauccacagaga

SEQ ID NO: 2421696 - RNA, 16 nt, Human
agaauguaagaacuac

SEQ ID NO: 2421697 - RNA, 15 nt, Human
agaauguaagaacua

SEQ ID NO: 2421698 - RNA, 12 nt, Human
agaauguauugu

SEQ ID NO: 2421699 - RNA, 14 nt, Human
agaauguagccauu

SEQ ID NO: 2421700 - RNA, 23 nt, Human
agaauguauuguaccuuuuaaca

SEQ ID NO: 2421701 - RNA, 22 nt, Human
agaauguauuguaccuuuuaac

SEQ ID NO: 2421702 - RNA, 21 nt, Human
agaauguauuguaccuuuuaa

SEQ ID NO: 2421703 - RNA, 17 nt, Human
agaauguauuguaccuu

SEQ ID NO: 2421704 - RNA, 16 nt, Human
agaauguauuguaccu

SEQ ID NO: 2421705 - RNA, 15 nt, Human
agaauguauuguacc

SEQ ID NO: 2421706 - RNA, 14 nt, Human
agaauguauuguac

SEQ ID NO: 2421707 - RNA, 13 nt, Human
agaauguauugua

SEQ ID NO: 2421708 - RNA, 15 nt, Human
agaauuaacacauga

SEQ ID NO: 2421709 - RNA, 17 nt, Human
agaauuaaaaaugaaau

SEQ ID NO: 2421710 - RNA, 23 nt, Human
agaauuaacacaugauccugcaa

SEQ ID NO: 2421711 - RNA, 22 nt, Human
agaauuauauagguugugcaaa

SEQ ID NO: 2421712 - RNA, 13 nt, Human
agaauuauauagg

SEQ ID NO: 2421713 - RNA, 21 nt, Human
ucugggcacugguaaucccaa

SEQ ID NO: 2421714 - RNA, 15 nt, Human
ucugggauucuacuu

SEQ ID NO: 2421715 - RNA, 14 nt, Human
ucugggcaggaccu

SEQ ID NO: 2421716 - RNA, 18 nt, Human
ucugggcaggaccucaga

SEQ ID NO: 2421717 - RNA, 21 nt, Human
ucugggcaggacucagcuccc

SEQ ID NO: 2421718 - RNA, 20 nt, Human
ucugggcaggacucagcucc

SEQ ID NO: 2421719 - RNA, 14 nt, Human
ucugggcaggacuc

SEQ ID NO: 2421720 - RNA, 19 nt, Human
ucugggcaggaccucagag

SEQ ID NO: 2421721 - RNA, 19 nt, Human
ucugggcaucuguucuggu

SEQ ID NO: 2421722 - RNA, 18 nt, Human
ucugggcaucuguucugg

SEQ ID NO: 2421723 - RNA, 12 nt, Human
ucugggccaagu

SEQ ID NO: 2421724 - RNA, 16 nt, Human
ucugggccaaguuccu

SEQ ID NO: 2421725 - RNA, 19 nt, Human
ucugggccaaguuccucua

SEQ ID NO: 2421726 - RNA, 13 nt, Human
ucugggagggcag

SEQ ID NO: 2421727 - RNA, 19 nt, Human
ucugggagggcagcagggc

SEQ ID NO: 2421728 - RNA, 21 nt, Human
ucugggagggcagcagggcua

SEQ ID NO: 2421729 - RNA, 19 nt, Human
ucugggauucuacuuuaag

SEQ ID NO: 2421730 - RNA, 18 nt, Human
ucugggauaaguaaguuu

SEQ ID NO: 2421731 - RNA, 16 nt, Human
ucugggaguccccuuu

SEQ ID NO: 2421732 - RNA, 19 nt, Human
ucugggaggaauggacaga

SEQ ID NO: 2421733 - RNA, 23 nt, Human
ucugggaggaauggacagacaga

SEQ ID NO: 2421734 - RNA, 15 nt, Human
ucugggagaggauuu

SEQ ID NO: 2421735 - RNA, 14 nt, Human
agaauuccaaggag

SEQ ID NO: 2421736 - RNA, 16 nt, Human
ucugggagaggauuuu

SEQ ID NO: 2421737 - RNA, 13 nt, Human
agaauuccaagga

SEQ ID NO: 2421738 - RNA, 20 nt, Human
agaauucaaacuggggccuc

SEQ ID NO: 2421739 - RNA, 11 nt, Human
agaauuauuua

SEQ ID NO: 2421740 - RNA, 19 nt, Human
acuugaugugccauuuuaa

SEQ ID NO: 2421741 - RNA, 18 nt, Human
acuugaugugccauuuua

SEQ ID NO: 2421742 - RNA, 17 nt, Human
acuugcaaaaaggguca

SEQ ID NO: 2421743 - RNA, 23 nt, Human
acuugcaaaaagggucaguaugg

SEQ ID NO: 2421744 - RNA, 21 nt, Human
acuugcaaccgucuguuaugc

SEQ ID NO: 2421745 - RNA, 13 nt, Human
acuugcaccucug

SEQ ID NO: 2421746 - RNA, 19 nt, Human
acuugcacgcccaugugug

SEQ ID NO: 2421747 - RNA, 20 nt, Human
acuugaugugccauuuuaaa

SEQ ID NO: 2421748 - RNA, 16 nt, Human
acuugaugugccauuu

SEQ ID NO: 2421749 - RNA, 23 nt, Human
ucucacuauguugcccaggcagg

SEQ ID NO: 2421750 - RNA, 22 nt, Human
ucucacuauguugcccaggcag

SEQ ID NO: 2421751 - RNA, 21 nt, Human
ucucacuauguugcccaggca

SEQ ID NO: 2421752 - RNA, 20 nt, Human
ucucacuauguugcccaggc

SEQ ID NO: 2421753 - RNA, 22 nt, Human
acuugcagacucuacagaggcc

SEQ ID NO: 2421754 - RNA, 19 nt, Human
acuugcagacucuacagag

SEQ ID NO: 2421755 - RNA, 16 nt, Human
acuugcucuugaugcc

SEQ ID NO: 2421756 - RNA, 23 nt, Human
acuugcagacucuacagaggcca

SEQ ID NO: 2421757 - RNA, 18 nt, Human
acuugcucuugaugccug

SEQ ID NO: 2421758 - RNA, 17 nt, Human
acuugcucuugaugccu

SEQ ID NO: 2421759 - RNA, 20 nt, Human
acuugcucuugaugccuggc

SEQ ID NO: 2421760 - RNA, 20 nt, Human
acuugcagcugauguuggaa

SEQ ID NO: 2421761 - RNA, 21 nt, Human
acuugcugcaguaugaaaaua

SEQ ID NO: 2421762 - RNA, 23 nt, Human
acuugcagcugauguuggaagag

SEQ ID NO: 2421763 - RNA, 22 nt, Human
acuuguggacacagcucuucuc

SEQ ID NO: 2421764 - RNA, 19 nt, Human
acuuguggacacagcucuu

SEQ ID NO: 2421765 - RNA, 20 nt, Human
acuuguggacuaaaagauau

SEQ ID NO: 2421766 - RNA, 19 nt, Human
acuuguggacuaaaagaua

SEQ ID NO: 2421767 - RNA, 18 nt, Human
acuuguggacuaaaagau

SEQ ID NO: 2421768 - RNA, 15 nt, Human
acuuguggacuaaaa

SEQ ID NO: 2421769 - RNA, 16 nt, Human
acuugucaaagaaggu

SEQ ID NO: 2421770 - RNA, 15 nt, Human
acuugucuuuuucug

SEQ ID NO: 2421771 - RNA, 18 nt, Human
acuugucuuuggacccug

SEQ ID NO: 2421772 - RNA, 20 nt, Human
acuugucuuuggacccugag

SEQ ID NO: 2421773 - RNA, 21 nt, Human
acuugucuuuggacccugagg

SEQ ID NO: 2421774 - RNA, 18 nt, Human
acuugucaaagaagguuu

SEQ ID NO: 2421775 - RNA, 15 nt, Human
acuugucaaagaagg

SEQ ID NO: 2421776 - RNA, 14 nt, Human
acuugucaaagaag

SEQ ID NO: 2421777 - RNA, 17 nt, Human
acuugucuuuuucugga

SEQ ID NO: 2421778 - RNA, 19 nt, Human
acuuguauuauguguguuu

SEQ ID NO: 2421779 - RNA, 18 nt, Human
acuuguauuauguguguu

SEQ ID NO: 2421780 - RNA, 15 nt, Human
acuugucaauaaaau

SEQ ID NO: 2421781 - RNA, 22 nt, Human
acuugcuuuaugccuucuuauu

SEQ ID NO: 2421782 - RNA, 13 nt, Human
acuugucaaagaa

SEQ ID NO: 2421783 - RNA, 14 nt, Human
acuugcuuuuaaaa

SEQ ID NO: 2421784 - RNA, 16 nt, Human
acuugcuuauuugaca

SEQ ID NO: 2421785 - RNA, 22 nt, Human
acuugcugcaguaugaaaauaa

SEQ ID NO: 2421786 - RNA, 17 nt, Human
acuugcugccugaagaa

SEQ ID NO: 2421787 - RNA, 23 nt, Human
acuugcugccugaagaacaguaa

SEQ ID NO: 2421788 - RNA, 18 nt, Human
acuugcuguuuuguucug

SEQ ID NO: 2421789 - RNA, 23 nt, Human
ucucagcagcgaccaccccugcc

SEQ ID NO: 2421790 - RNA, 18 nt, Human
ucucagcagcgaccaccc

SEQ ID NO: 2421791 - RNA, 16 nt, Human
acuugucuuuuucugg

SEQ ID NO: 2421792 - RNA, 15 nt, Human
ucucagccaacgagu

SEQ ID NO: 2421793 - RNA, 21 nt, Human
ucucagccgcuucugacugcu

SEQ ID NO: 2421794 - RNA, 21 nt, Human
ucucagcaaugauuacucuuu

SEQ ID NO: 2421795 - RNA, 14 nt, Human
ucucaggaaaucaa

SEQ ID NO: 2421796 - RNA, 21 nt, Human
ucucaggaaaucaaauaugca

SEQ ID NO: 2421797 - RNA, 23 nt, Human
ucucaggaaaucaaauaugcaaa

SEQ ID NO: 2421798 - RNA, 11 nt, Human
ucucagccucc

SEQ ID NO: 2421799 - RNA, 13 nt, Human
ucucaggccagcu

SEQ ID NO: 2421800 - RNA, 12 nt, Human
ucucaggccagc

SEQ ID NO: 2421801 - RNA, 12 nt, Human
ucucaggccaaa

SEQ ID NO: 2421802 - RNA, 20 nt, Human
ucucaggcaugaacauguac

SEQ ID NO: 2421803 - RNA, 18 nt, Human
ucucaggcaugccugugu

SEQ ID NO: 2421804 - RNA, 20 nt, Human
ucucaggcaugccuguguga

SEQ ID NO: 2421805 - RNA, 21 nt, Human
ucucaggcaugccugugugac

SEQ ID NO: 2421806 - RNA, 13 nt, Human
ucucaggccaccu

SEQ ID NO: 2421807 - RNA, 18 nt, Human
ucucaggccaccugcccc

SEQ ID NO: 2421808 - RNA, 19 nt, Human
ucucaggccaccugccccc

SEQ ID NO: 2421809 - RNA, 10 nt, Human
ucucaggcca

SEQ ID NO: 2421810 - RNA, 22 nt, Human
ucucaggauccccucucuuccu

SEQ ID NO: 2421811 - RNA, 20 nt, Human
ucucaggaucaagaaagugu

SEQ ID NO: 2421812 - RNA, 23 nt, Human
ucucaggaccaaagcuuucaugu

SEQ ID NO: 2421813 - RNA, 21 nt, Human
ucucaggaccuagggauguuc

SEQ ID NO: 2421814 - RNA, 14 nt, Human
ucucaggagcacag

SEQ ID NO: 2421815 - RNA, 16 nt, Human
ucucaggaccuaggga

SEQ ID NO: 2421816 - RNA, 19 nt, Human
ucucaggagcacaggcagc

SEQ ID NO: 2421817 - RNA, 18 nt, Human
ucucaggagcacaggcag

SEQ ID NO: 2421818 - RNA, 16 nt, Human
ucucaggagcacaggc

SEQ ID NO: 2421819 - RNA, 15 nt, Human
ucucaggagcacagg

SEQ ID NO: 2421820 - RNA, 23 nt, Human
ucucaggagcacaggcagcugga

SEQ ID NO: 2421821 - RNA, 20 nt, Human
ucucaggagcacaggcagcu

SEQ ID NO: 2421822 - RNA, 15 nt, Human
ucucaggagcauggg

SEQ ID NO: 2421823 - RNA, 15 nt, Human
ucucauuuccaagca

SEQ ID NO: 2421824 - RNA, 18 nt, Human
ucucauuuagaacuugca

SEQ ID NO: 2421825 - RNA, 16 nt, Human
ucucauuuaauccucu

SEQ ID NO: 2421826 - RNA, 17 nt, Human
ucucauuucaccccucc

SEQ ID NO: 2421827 - RNA, 16 nt, Human
ucucauuucaccccuc

SEQ ID NO: 2421828 - RNA, 22 nt, Human
ucucauuucaccccucccuuuc

SEQ ID NO: 2421829 - RNA, 19 nt, Human
ucucauuucaccccucccu

SEQ ID NO: 2421830 - RNA, 19 nt, Human
ucucauuugccaauaauaa

SEQ ID NO: 2421831 - RNA, 14 nt, Human
ucucauuugucaca

SEQ ID NO: 2421832 - RNA, 16 nt, Human
ucuccaagcaggacau

SEQ ID NO: 2421833 - RNA, 15 nt, Human
ucuccaagcaggaca

SEQ ID NO: 2421834 - RNA, 16 nt, Human
ucucauuugucacaca

SEQ ID NO: 2421835 - RNA, 19 nt, Human
ucucaugugauccuuuuau

SEQ ID NO: 2421836 - RNA, 18 nt, Human
ucucaugugauccuuuua

SEQ ID NO: 2421837 - RNA, 17 nt, Human
ucucaugugauccuuuu

SEQ ID NO: 2421838 - RNA, 16 nt, Human
ucucaugugauccuuu

SEQ ID NO: 2421839 - RNA, 21 nt, Human
ucucaugugugcucuucuucu

SEQ ID NO: 2421840 - RNA, 17 nt, Human
ucucauguuuucaacug

SEQ ID NO: 2421841 - RNA, 23 nt, Human
ucucaugugauccuuuuauguua

SEQ ID NO: 2421842 - RNA, 18 nt, Human
ucucauguuuucaacugc

SEQ ID NO: 2421843 - RNA, 18 nt, Human
ucucauguuuuccauugu

SEQ ID NO: 2421844 - RNA, 19 nt, Human
ucucauguuuucaacugcc

SEQ ID NO: 2421845 - RNA, 20 nt, Human
ucucauuggacccuuccaug

SEQ ID NO: 2421846 - RNA, 15 nt, Human
ucucaugugauccuu

SEQ ID NO: 2421847 - RNA, 14 nt, Human
ucucaugugauccu

SEQ ID NO: 2421848 - RNA, 18 nt, Human
ucucauguaucaucugga

SEQ ID NO: 2421849 - RNA, 16 nt, Human
ucucauggagaaguua

SEQ ID NO: 2421850 - RNA, 15 nt, Human
ucucauggagaaguu

SEQ ID NO: 2421851 - RNA, 22 nt, Human
ucucauggagaagcagaaauac

SEQ ID NO: 2421852 - RNA, 21 nt, Human
ucucaugccucagccuccuga

SEQ ID NO: 2421853 - RNA, 20 nt, Human
ucucauggagaagcagaaau

SEQ ID NO: 2421854 - RNA, 18 nt, Human
ucucaggccagcugcuug

SEQ ID NO: 2421855 - RNA, 17 nt, Human
ucucaggccagcugcuu

SEQ ID NO: 2421856 - RNA, 21 nt, Human
ucucaggccagcugcuugggc

SEQ ID NO: 2421857 - RNA, 20 nt, Human
ucucaugccucagccuccug

SEQ ID NO: 2421858 - RNA, 16 nt, Human
ucucaggccaucauca

SEQ ID NO: 2421859 - RNA, 21 nt, Human
ucucaggccaccugcccccuu

SEQ ID NO: 2421860 - RNA, 20 nt, Human
acuuuacaauguucauccca

SEQ ID NO: 2421861 - RNA, 19 nt, Human
acuuuacaauguucauccc

SEQ ID NO: 2421862 - RNA, 23 nt, Human
acuuuaauucucaugugauccuu

SEQ ID NO: 2421863 - RNA, 19 nt, Human
acuuuaauucucaugugau

SEQ ID NO: 2421864 - RNA, 20 nt, Human
ucuccuccaccgccauggcu

SEQ ID NO: 2421865 - RNA, 22 nt, Human
acuuuaauuaccaaccuguuac

SEQ ID NO: 2421866 - RNA, 20 nt, Human
acuuuaauuaccaaccuguu

SEQ ID NO: 2421867 - RNA, 18 nt, Human
ucuccucugcugcuggcu

SEQ ID NO: 2421868 - RNA, 17 nt, Human
ucuccucugcugcuggc

SEQ ID NO: 2421869 - RNA, 16 nt, Human
ucuccucugcugcugg

SEQ ID NO: 2421870 - RNA, 15 nt, Human
ucuccucugcugcug

SEQ ID NO: 2421871 - RNA, 15 nt, Human
ucuccuccagaguca

SEQ ID NO: 2421872 - RNA, 14 nt, Human
ucuccuccaccgcc

SEQ ID NO: 2421873 - RNA, 23 nt, Human
ucuccuccaagacacuguggacu

SEQ ID NO: 2421874 - RNA, 19 nt, Human
ucuccuccaagacacugug

SEQ ID NO: 2421875 - RNA, 18 nt, Human
ucuccucaucucuaacag

SEQ ID NO: 2421876 - RNA, 17 nt, Human
ucuccuccauacucagg

SEQ ID NO: 2421877 - RNA, 18 nt, Human
ucuccuccauacucagga

SEQ ID NO: 2421878 - RNA, 20 nt, Human
acuuucugaaauaacauggc

SEQ ID NO: 2421879 - RNA, 14 nt, Human
acuuucugaaauaa

SEQ ID NO: 2421880 - RNA, 17 nt, Human
acuuuacccaaaaacua

SEQ ID NO: 2421881 - RNA, 16 nt, Human
acuuuaccacccccac

SEQ ID NO: 2421882 - RNA, 15 nt, Human
acuuuaccaccccca

SEQ ID NO: 2421883 - RNA, 20 nt, Human
acuuuacaugacacagcuuu

SEQ ID NO: 2421884 - RNA, 18 nt, Human
acuuuacaugacacagcu

SEQ ID NO: 2421885 - RNA, 17 nt, Human
acuuuacaugacacagc

SEQ ID NO: 2421886 - RNA, 15 nt, Human
acuuuacaugacaca

SEQ ID NO: 2421887 - RNA, 12 nt, Human
acuuuaccuuuu

SEQ ID NO: 2421888 - RNA, 18 nt, Human
acuuucuguaaacucaaa

SEQ ID NO: 2421889 - RNA, 14 nt, Human
acuuucuguaaacu

SEQ ID NO: 2421890 - RNA, 14 nt, Human
acuuucugccugga

SEQ ID NO: 2421891 - RNA, 13 nt, Human
acuuucugccugg

SEQ ID NO: 2421892 - RNA, 19 nt, Human
acuuucuguaaacucaaaa

SEQ ID NO: 2421893 - RNA, 19 nt, Human
acuuucuguugccacaacc

SEQ ID NO: 2421894 - RNA, 22 nt, Human
ucuccccacacuaaccuggguu

SEQ ID NO: 2421895 - RNA, 23 nt, Human
ucuccacccucccagaccugccu

SEQ ID NO: 2421896 - RNA, 14 nt, Human
ucuccacccuccca

SEQ ID NO: 2421897 - RNA, 19 nt, Human
ucuccacccccagcugcuu

SEQ ID NO: 2421898 - RNA, 23 nt, Human
ucuccccagcaagugagagcugg

SEQ ID NO: 2421899 - RNA, 12 nt, Human
ucuccacccugc

SEQ ID NO: 2421900 - RNA, 14 nt, Human
ucuccacagcaacc

SEQ ID NO: 2421901 - RNA, 19 nt, Human
ucuccacagcaaccccagg

SEQ ID NO: 2421902 - RNA, 18 nt, Human
ucuccaauaucagugcuc

SEQ ID NO: 2421903 - RNA, 16 nt, Human
ucuccaccaggaaccu

SEQ ID NO: 2421904 - RNA, 18 nt, Human
ucuccaccaggaaccucu

SEQ ID NO: 2421905 - RNA, 19 nt, Human
ucuccaagcaggacaugga

SEQ ID NO: 2421906 - RNA, 18 nt, Human
ucuccaagcaggacaugg

SEQ ID NO: 2421907 - RNA, 23 nt, Human
ucuccaagggcuucugcacccuc

SEQ ID NO: 2421908 - RNA, 22 nt, Human
ucuccaagggcuucugcacccu

SEQ ID NO: 2421909 - RNA, 21 nt, Human
ucuccaagggcuucugcaccc

SEQ ID NO: 2421910 - RNA, 20 nt, Human
ucuccaagggcuucugcacc

SEQ ID NO: 2421911 - RNA, 16 nt, Human
ucuccaagggcuucug

SEQ ID NO: 2421912 - RNA, 16 nt, Human
ucuccaaggaccaggu

SEQ ID NO: 2421913 - RNA, 14 nt, Human
ucuccaaggaccag

SEQ ID NO: 2421914 - RNA, 21 nt, Human
ucuccaagugccagagguggg

SEQ ID NO: 2421915 - RNA, 20 nt, Human
ucuccaagugccagaggugg

SEQ ID NO: 2421916 - RNA, 14 nt, Human
ucuccaagugccag

SEQ ID NO: 2421917 - RNA, 17 nt, Human
ucuccaagucucagugg

SEQ ID NO: 2421918 - RNA, 16 nt, Human
ucuccaauaucagugc

SEQ ID NO: 2421919 - RNA, 23 nt, Human
ucuccaagugccagaggugggca

SEQ ID NO: 2421920 - RNA, 22 nt, Human
ucuccacacacagcugggcugu

SEQ ID NO: 2421921 - RNA, 14 nt, Human
ucuccccagcccag

SEQ ID NO: 2421922 - RNA, 15 nt, Human
ucuccccagcccaga

SEQ ID NO: 2421923 - RNA, 16 nt, Human
ucuccccagcccagag

SEQ ID NO: 2421924 - RNA, 17 nt, Human
ucuccccagcccagaga

SEQ ID NO: 2421925 - RNA, 20 nt, Human
ucuccccaggguucaguccu

SEQ ID NO: 2421926 - RNA, 12 nt, Human
ucuccccagagu

SEQ ID NO: 2421927 - RNA, 18 nt, Human
ucuccccagcccagagac

SEQ ID NO: 2421928 - RNA, 19 nt, Human
ucuccccagcccagagaca

SEQ ID NO: 2421929 - RNA, 15 nt, Human
ucucccuuucccuuc

SEQ ID NO: 2421930 - RNA, 23 nt, Human
ucuccgaccagacaccuugacag

SEQ ID NO: 2421931 - RNA, 17 nt, Human
ucuccgaccagacaccu

SEQ ID NO: 2421932 - RNA, 23 nt, Human
ucuccucacucccuucuaccugc

SEQ ID NO: 2421933 - RNA, 13 nt, Human
ucuccucacuccc

SEQ ID NO: 2421934 - RNA, 14 nt, Human
ucuccucagccucc

SEQ ID NO: 2421935 - RNA, 13 nt, Human
ucuccucagccuc

SEQ ID NO: 2421936 - RNA, 22 nt, Human
ucuccucagccuccucaucugg

SEQ ID NO: 2421937 - RNA, 20 nt, Human
ucuccucagccuccucaucu

SEQ ID NO: 2421938 - RNA, 14 nt, Human
ucuccucaucucua

SEQ ID NO: 2421939 - RNA, 15 nt, Human
ucuccucaucucuaa

SEQ ID NO: 2421940 - RNA, 16 nt, Human
ucuccucauguucugc

SEQ ID NO: 2421941 - RNA, 20 nt, Human
acuuuguuaguuucuccaag

SEQ ID NO: 2421942 - RNA, 22 nt, Human
acuuuguaccccccaaccccug

SEQ ID NO: 2421943 - RNA, 18 nt, Human
acuuuguaccccccaacc

SEQ ID NO: 2421944 - RNA, 14 nt, Human
acuuuguucuggcu

SEQ ID NO: 2421945 - RNA, 21 nt, Human
acuuuguuaguuucuccaagc

SEQ ID NO: 2421946 - RNA, 12 nt, Human
acuuuuguucuu

SEQ ID NO: 2421947 - RNA, 13 nt, Human
acuuuuguucuug

SEQ ID NO: 2421948 - RNA, 22 nt, Human
acuuuggaguccccucaccucc

SEQ ID NO: 2421949 - RNA, 18 nt, Human
acuuuggaguccccucac

SEQ ID NO: 2421950 - RNA, 23 nt, Human
acuuuggaguccccucaccuccu

SEQ ID NO: 2421951 - RNA, 18 nt, Human
acuuuggaauacauuucu

SEQ ID NO: 2421952 - RNA, 12 nt, Human
acuuugaccucu

SEQ ID NO: 2421953 - RNA, 13 nt, Human
acuuugaccucug

SEQ ID NO: 2421954 - RNA, 15 nt, Human
acuuuggaauacauu

SEQ ID NO: 2421955 - RNA, 15 nt, Human
ucuccuucaccuuug

SEQ ID NO: 2421956 - RNA, 14 nt, Human
ucuccuucaccuuu

SEQ ID NO: 2421957 - RNA, 14 nt, Human
agaaaaaauacauu

SEQ ID NO: 2421958 - RNA, 16 nt, Human
agaaaaaauacauuuu

SEQ ID NO: 2421959 - RNA, 18 nt, Human
agaaaaaauacauuuuau

SEQ ID NO: 2421960 - RNA, 18 nt, Human
agaaaaaauaacacacau

SEQ ID NO: 2421961 - RNA, 11 nt, Human
agaaaaaauac

SEQ ID NO: 2421962 - RNA, 17 nt, Human
agaaaaaauauuuuccc

SEQ ID NO: 2421963 - RNA, 13 nt, Human
ucuccuuguguua

SEQ ID NO: 2421964 - RNA, 21 nt, Human
ucuccuuguguuacuaaguuu

SEQ ID NO: 2421965 - RNA, 16 nt, Human
ucuccuucaccuuugu

SEQ ID NO: 2421966 - RNA, 19 nt, Human
ucuccuuguggccugggcc

SEQ ID NO: 2421967 - RNA, 17 nt, Human
ucuccuuagucuucuca

SEQ ID NO: 2421968 - RNA, 22 nt, Human
agaaaaaauacauuuuauauua

SEQ ID NO: 2421969 - RNA, 18 nt, Human
ucuccuuagucuucucau

SEQ ID NO: 2421970 - RNA, 17 nt, Human
acuuuuuauauuuuaua

SEQ ID NO: 2421971 - RNA, 10 nt, Human
agaaaaaaga

SEQ ID NO: 2421972 - RNA, 10 nt, Human
agaaaaaagu

SEQ ID NO: 2421973 - RNA, 12 nt, Human
agaaaaaaguug

SEQ ID NO: 2421974 - RNA, 14 nt, Human
agaaaaaaguugua

SEQ ID NO: 2421975 - RNA, 17 nt, Human
agaaaaaagagaaaaga

SEQ ID NO: 2421976 - RNA, 18 nt, Human
agaaaaaagagaaaagaa

SEQ ID NO: 2421977 - RNA, 12 nt, Human
agaaaaaagaag

SEQ ID NO: 2421978 - RNA, 21 nt, Human
acuuuuuauauuuuauacauu

SEQ ID NO: 2421979 - RNA, 15 nt, Human
acuuuuguucuuggu

SEQ ID NO: 2421980 - RNA, 23 nt, Human
acuuuuguucuugguuuguaaau

SEQ ID NO: 2421981 - RNA, 18 nt, Human
acuuuuuaauucaccaaa

SEQ ID NO: 2421982 - RNA, 19 nt, Human
acuuuuuaacuauuaagag

SEQ ID NO: 2421983 - RNA, 11 nt, Human
acuuuuuacaa

SEQ ID NO: 2421984 - RNA, 18 nt, Human
acuuuuuaaauguaaaga

SEQ ID NO: 2421985 - RNA, 21 nt, Human
acuuuuuaaaaucuuuucuau

SEQ ID NO: 2421986 - RNA, 11 nt, Human
acuuuguucac

SEQ ID NO: 2421987 - RNA, 14 nt, Human
acuuaacauauuua

SEQ ID NO: 2421988 - RNA, 21 nt, Human
acuuaacagaugcaaugugcu

SEQ ID NO: 2421989 - RNA, 15 nt, Human
acuuaacaagcuccc

SEQ ID NO: 2421990 - RNA, 20 nt, Human
acuuaacaagcucccaggcc

SEQ ID NO: 2421991 - RNA, 14 nt, Human
acuuaacagaugca

SEQ ID NO: 2421992 - RNA, 17 nt, Human
acuuaaauuuuaauuua

SEQ ID NO: 2421993 - RNA, 19 nt, Human
acuuaacggcuccaggauu

SEQ ID NO: 2421994 - RNA, 17 nt, Human
acuuaacggcuccagga

SEQ ID NO: 2421995 - RNA, 23 nt, Human
acuuaacuauucaggagaguaga

SEQ ID NO: 2421996 - RNA, 15 nt, Human
acuuaacggcuccag

SEQ ID NO: 2421997 - RNA, 23 nt, Human
acuguugaaaauuauuuuaaaca

SEQ ID NO: 2421998 - RNA, 21 nt, Human
acuguugaaaauuauuuuaaa

SEQ ID NO: 2421999 - RNA, 14 nt, Human
acuguugaaaauua

SEQ ID NO: 2422000 - RNA, 13 nt, Human
acuguugaaaauu

SEQ ID NO: 2422001 - RNA, 20 nt, Human
acuuaaauaaugugaaacug

SEQ ID NO: 2422002 - RNA, 19 nt, Human
acuuaaauggaaaaaauga

SEQ ID NO: 2422003 - RNA, 18 nt, Human
acuguugccagagaugga

SEQ ID NO: 2422004 - RNA, 13 nt, Human
acuuaaaugaaag

SEQ ID NO: 2422005 - RNA, 14 nt, Human
acuguugccagaga

SEQ ID NO: 2422006 - RNA, 13 nt, Human
acuuaaugaauga

SEQ ID NO: 2422007 - RNA, 19 nt, Human
acuuaagagaauauuuuaa

SEQ ID NO: 2422008 - RNA, 18 nt, Human
acuuaagagaauauuuua

SEQ ID NO: 2422009 - RNA, 22 nt, Human
acuuaaucuaaauggaaccacu

SEQ ID NO: 2422010 - RNA, 14 nt, Human
acuuaauugcuaca

SEQ ID NO: 2422011 - RNA, 16 nt, Human
acuuacacuuuaugca

SEQ ID NO: 2422012 - RNA, 17 nt, Human
acuuaaucuaaauggaa

SEQ ID NO: 2422013 - RNA, 19 nt, Human
acuuaaucuaaauggaacc

SEQ ID NO: 2422014 - RNA, 13 nt, Human
acuuaagcacacu

SEQ ID NO: 2422015 - RNA, 15 nt, Human
acuuaagagaauauu

SEQ ID NO: 2422016 - RNA, 14 nt, Human
acuuaagagaauau

SEQ ID NO: 2422017 - RNA, 13 nt, Human
acuuaagagaaua

SEQ ID NO: 2422018 - RNA, 16 nt, Human
acuuacuuacccucac

SEQ ID NO: 2422019 - RNA, 21 nt, Human
acuuacuguuucugucaggag

SEQ ID NO: 2422020 - RNA, 20 nt, Human
acuuacuguuucugucagga

SEQ ID NO: 2422021 - RNA, 16 nt, Human
acuuacuguuucuguc

SEQ ID NO: 2422022 - RNA, 13 nt, Human
acuuacuguuucu

SEQ ID NO: 2422023 - RNA, 24 nt, Human
acuuacuguuguccuaugggaguc

SEQ ID NO: 2422024 - RNA, 12 nt, Human
acuuacaugauu

SEQ ID NO: 2422025 - RNA, 22 nt, Human
acuuacuguacaugaaaacaca

SEQ ID NO: 2422026 - RNA, 16 nt, Human
acuuagcuaucagaag

SEQ ID NO: 2422027 - RNA, 13 nt, Human
acuuacuugcuua

SEQ ID NO: 2422028 - RNA, 14 nt, Human
acuuagcugggaga

SEQ ID NO: 2422029 - RNA, 22 nt, Human
acuuacuuacccucaccuguca

SEQ ID NO: 2422030 - RNA, 21 nt, Human
acuuagcuugaaggaucuguu

SEQ ID NO: 2422031 - RNA, 21 nt, Human
acuuacuguacaugaaaacac

SEQ ID NO: 2422032 - RNA, 16 nt, Human
acuuacuguacaugaa

SEQ ID NO: 2422033 - RNA, 21 nt, Human
acuuaauuucuuuauguaauc

SEQ ID NO: 2422034 - RNA, 22 nt, Human
acuuaauuucuuuauguaaucu

SEQ ID NO: 2422035 - RNA, 17 nt, Human
acuuacacuuuaugcac

SEQ ID NO: 2422036 - RNA, 21 nt, Human
acuucaguauguugucaaaga

SEQ ID NO: 2422037 - RNA, 19 nt, Human
acuucaguauguugucaaa

SEQ ID NO: 2422038 - RNA, 17 nt, Human
acuucaguauguuguca

SEQ ID NO: 2422039 - RNA, 23 nt, Human
acuucaguauguugucaaagaga

SEQ ID NO: 2422040 - RNA, 22 nt, Human
acuucaggggcugcccgcuccc

SEQ ID NO: 2422041 - RNA, 19 nt, Human
acuucaggggcugcccgcu

SEQ ID NO: 2422042 - RNA, 17 nt, Human
acuucaggggcugcccg

SEQ ID NO: 2422043 - RNA, 16 nt, Human
acuucaggggcugccc

SEQ ID NO: 2422044 - RNA, 23 nt, Human
acuucaggguucuccucuccccu

SEQ ID NO: 2422045 - RNA, 21 nt, Human
acuucaggguucuccucuccc

SEQ ID NO: 2422046 - RNA, 22 nt, Human
acuucaggguucuccucucccc

SEQ ID NO: 2422047 - RNA, 22 nt, Human
acuuauuaaucuguaugaagau

SEQ ID NO: 2422048 - RNA, 19 nt, Human
acuuauuacugcuaaguau

SEQ ID NO: 2422049 - RNA, 16 nt, Human
acuuauuacugcuaag

SEQ ID NO: 2422050 - RNA, 14 nt, Human
acuuauuacugcua

SEQ ID NO: 2422051 - RNA, 16 nt, Human
acuuauucucaagaag

SEQ ID NO: 2422052 - RNA, 20 nt, Human
acuuauuacugcuaaguauu

SEQ ID NO: 2422053 - RNA, 15 nt, Human
acuuagguguggggg

SEQ ID NO: 2422054 - RNA, 17 nt, Human
acuuaguauauuuucuu

SEQ ID NO: 2422055 - RNA, 16 nt, Human
acuuagggcaccaggg

SEQ ID NO: 2422056 - RNA, 23 nt, Human
acuuaugaccucuuccuuuagga

SEQ ID NO: 2422057 - RNA, 23 nt, Human
acuuagggcaccagggguuucuc

SEQ ID NO: 2422058 - RNA, 14 nt, Human
acuuaucuuaugcc

SEQ ID NO: 2422059 - RNA, 13 nt, Human
acuuaugauuuca

SEQ ID NO: 2422060 - RNA, 16 nt, Human
acuuaugauuucaugu

SEQ ID NO: 2422061 - RNA, 17 nt, Human
acuuaugauuucaugug

SEQ ID NO: 2422062 - RNA, 20 nt, Human
ucuacagcuaaucagcauuc

SEQ ID NO: 2422063 - RNA, 20 nt, Human
ucuaauaccucugugugcuc

SEQ ID NO: 2422064 - RNA, 23 nt, Human
ucuacagcuaaucagcauucuca

SEQ ID NO: 2422065 - RNA, 19 nt, Human
ucuacccagcgagcccugg

SEQ ID NO: 2422066 - RNA, 17 nt, Human
ucuaauaccucugugug

SEQ ID NO: 2422067 - RNA, 16 nt, Human
ucuaauaccucugugu

SEQ ID NO: 2422068 - RNA, 14 nt, Human
ucuaauaccucugu

SEQ ID NO: 2422069 - RNA, 21 nt, Human
ucuacagaggccaugggccuc

SEQ ID NO: 2422070 - RNA, 14 nt, Human
ucuaaguaaaacca

SEQ ID NO: 2422071 - RNA, 15 nt, Human
ucuaaguaaaaccac

SEQ ID NO: 2422072 - RNA, 19 nt, Human
ucuaaguaaaaccacagca

SEQ ID NO: 2422073 - RNA, 20 nt, Human
ucuaaguaaaaccacagcag

SEQ ID NO: 2422074 - RNA, 18 nt, Human
ucuaagguucucauagga

SEQ ID NO: 2422075 - RNA, 14 nt, Human
ucuaagguucucau

SEQ ID NO: 2422076 - RNA, 18 nt, Human
uccugggagugagcuggu

SEQ ID NO: 2422077 - RNA, 11 nt, Human
uccugggcaca

SEQ ID NO: 2422078 - RNA, 22 nt, Human
uccugggauguggcugcagcag

SEQ ID NO: 2422079 - RNA, 18 nt, Human
uccugggauguggcugca

SEQ ID NO: 2422080 - RNA, 17 nt, Human
uccugggauguggcugc

SEQ ID NO: 2422081 - RNA, 13 nt, Human
uccugggaugugg

SEQ ID NO: 2422082 - RNA, 23 nt, Human
uccugggagaaccucaggcuucc

SEQ ID NO: 2422083 - RNA, 14 nt, Human
ucuacccaggugcu

SEQ ID NO: 2422084 - RNA, 20 nt, Human
ucuacccagcgagcccuggu

SEQ ID NO: 2422085 - RNA, 19 nt, Human
ucuacccuggcacuauaau

SEQ ID NO: 2422086 - RNA, 14 nt, Human
ucuacccuggcacu

SEQ ID NO: 2422087 - RNA, 15 nt, Human
ucuaccucaggcagc

SEQ ID NO: 2422088 - RNA, 14 nt, Human
acuguuauuuauaa

SEQ ID NO: 2422089 - RNA, 15 nt, Human
acuguuauuuauaau

SEQ ID NO: 2422090 - RNA, 17 nt, Human
acuguuauuuauaauca

SEQ ID NO: 2422091 - RNA, 20 nt, Human
acuguuauuuauaaucacuu

SEQ ID NO: 2422092 - RNA, 21 nt, Human
ucuacccuggcacuauaaugu

SEQ ID NO: 2422093 - RNA, 13 nt, Human
ucuacccagggcc

SEQ ID NO: 2422094 - RNA, 16 nt, Human
ucuacccagggccugc

SEQ ID NO: 2422095 - RNA, 13 nt, Human
acuguucuugaau

SEQ ID NO: 2422096 - RNA, 16 nt, Human
acuguucccucugcuc

SEQ ID NO: 2422097 - RNA, 18 nt, Human
acuguucucugcccucca

SEQ ID NO: 2422098 - RNA, 15 nt, Human
acuguucccucugcu

SEQ ID NO: 2422099 - RNA, 14 nt, Human
acuguuccagccug

SEQ ID NO: 2422100 - RNA, 18 nt, Human
acuguucccccugugcag

SEQ ID NO: 2422101 - RNA, 19 nt, Human
acuguucucugcccuccaa

SEQ ID NO: 2422102 - RNA, 17 nt, Human
acuguucucugcccucc

SEQ ID NO: 2422103 - RNA, 16 nt, Human
acuguucucugcccuc

SEQ ID NO: 2422104 - RNA, 16 nt, Human
acuguucaagagcaca

SEQ ID NO: 2422105 - RNA, 15 nt, Human
acuguucaagagcac

SEQ ID NO: 2422106 - RNA, 13 nt, Human
acuguucaagagc

SEQ ID NO: 2422107 - RNA, 21 nt, Human
acuguuauuuauaaucacuuu

SEQ ID NO: 2422108 - RNA, 15 nt, Human
acuguucccccugug

SEQ ID NO: 2422109 - RNA, 16 nt, Human
acuguucccccugugc

SEQ ID NO: 2422110 - RNA, 18 nt, Human
acuguucccaccugcugg

SEQ ID NO: 2422111 - RNA, 17 nt, Human
ucuaggaaauauuuauu

SEQ ID NO: 2422112 - RNA, 23 nt, Human
ucuaggaagaauuuuaaaaauga

SEQ ID NO: 2422113 - RNA, 22 nt, Human
ucuaggaagaauuuuaaaaaug

SEQ ID NO: 2422114 - RNA, 20 nt, Human
ucuaggaagaauuuuaaaaa

SEQ ID NO: 2422115 - RNA, 23 nt, Human
ucuagccacuuuggucccgugca

SEQ ID NO: 2422116 - RNA, 15 nt, Human
ucuaggaagaauuuu

SEQ ID NO: 2422117 - RNA, 16 nt, Human
ucuagccaaaugguuu

SEQ ID NO: 2422118 - RNA, 16 nt, Human
ucuaggaaauauuuau

SEQ ID NO: 2422119 - RNA, 13 nt, Human
ucuagccagagga

SEQ ID NO: 2422120 - RNA, 12 nt, Human
ucuaggaagacu

SEQ ID NO: 2422121 - RNA, 13 nt, Human
ucuaguucuuugu

SEQ ID NO: 2422122 - RNA, 22 nt, Human
ucuaguuguuugauucagacag

SEQ ID NO: 2422123 - RNA, 14 nt, Human
ucuaguuucccaca

SEQ ID NO: 2422124 - RNA, 13 nt, Human
ucuaguuucccac

SEQ ID NO: 2422125 - RNA, 14 nt, Human
ucuaguuucuugug

SEQ ID NO: 2422126 - RNA, 22 nt, Human
ucuaguuugauuaaauucuugc

SEQ ID NO: 2422127 - RNA, 21 nt, Human
ucuaguuugauuaaauucuug

SEQ ID NO: 2422128 - RNA, 23 nt, Human
ucuaguuguuugauucagacagc

SEQ ID NO: 2422129 - RNA, 22 nt, Human
ucuaguuuaauuaaucuguaau

SEQ ID NO: 2422130 - RNA, 18 nt, Human
ucuaguugcuuguaaaau

SEQ ID NO: 2422131 - RNA, 13 nt, Human
ucuauaaauaacc

SEQ ID NO: 2422132 - RNA, 20 nt, Human
ucuauaaagaagaacuugca

SEQ ID NO: 2422133 - RNA, 13 nt, Human
ucuauaaggccau

SEQ ID NO: 2422134 - RNA, 14 nt, Human
ucuauaaggccaua

SEQ ID NO: 2422135 - RNA, 16 nt, Human
ucuauaaggccauaaa

SEQ ID NO: 2422136 - RNA, 16 nt, Human
ucuauaaauuguccgu

SEQ ID NO: 2422137 - RNA, 15 nt, Human
ucuauaacaugcauu

SEQ ID NO: 2422138 - RNA, 18 nt, Human
ucuagcauggcugccaau

SEQ ID NO: 2422139 - RNA, 13 nt, Human
ucuagauacugua

SEQ ID NO: 2422140 - RNA, 21 nt, Human
ucuagaggcuuccuucauuuc

SEQ ID NO: 2422141 - RNA, 16 nt, Human
ucuagaggcuuccuuc

SEQ ID NO: 2422142 - RNA, 17 nt, Human
ucuagagcuugaugcca

SEQ ID NO: 2422143 - RNA, 20 nt, Human
ucuagagccgugaugccucc

SEQ ID NO: 2422144 - RNA, 13 nt, Human
ucuagagaagagg

SEQ ID NO: 2422145 - RNA, 15 nt, Human
ucuagacuuucuguu

SEQ ID NO: 2422146 - RNA, 14 nt, Human
ucuagacuuucugu

SEQ ID NO: 2422147 - RNA, 13 nt, Human
ucuagacuuucug

SEQ ID NO: 2422148 - RNA, 16 nt, Human
ucuagagaagaggcug

SEQ ID NO: 2422149 - RNA, 13 nt, Human
ucuagagagggag

SEQ ID NO: 2422150 - RNA, 15 nt, Human
ucuagagcagggauu

SEQ ID NO: 2422151 - RNA, 23 nt, Human
ucuagagagggaggcaagcccug

SEQ ID NO: 2422152 - RNA, 16 nt, Human
ucuagagauaguacau

SEQ ID NO: 2422153 - RNA, 20 nt, Human
ucuagagauaguacauaaag

SEQ ID NO: 2422154 - RNA, 22 nt, Human
acuucccugacacugcggggcu

SEQ ID NO: 2422155 - RNA, 13 nt, Human
acuucccugggca

SEQ ID NO: 2422156 - RNA, 20 nt, Human
acuucccucuguuucucuuu

SEQ ID NO: 2422157 - RNA, 14 nt, Human
acuucccugggcaa

SEQ ID NO: 2422158 - RNA, 19 nt, Human
ucuagaauuuuaagugcuu

SEQ ID NO: 2422159 - RNA, 13 nt, Human
ucuagacaacccu

SEQ ID NO: 2422160 - RNA, 24 nt, Human
ucuagacucaagguucccagagau

SEQ ID NO: 2422161 - RNA, 14 nt, Human
ucuagacacugcca

SEQ ID NO: 2422162 - RNA, 17 nt, Human
ucuagacaacccugcaa

SEQ ID NO: 2422163 - RNA, 14 nt, Human
acuucccucuguuu

SEQ ID NO: 2422164 - RNA, 17 nt, Human
acuucccucaucucucc

SEQ ID NO: 2422165 - RNA, 23 nt, Human
acuucccgucccauauccugccu

SEQ ID NO: 2422166 - RNA, 22 nt, Human
acuucccgucccauauccugcc

SEQ ID NO: 2422167 - RNA, 21 nt, Human
acuuccccuccuaccccuccc

SEQ ID NO: 2422168 - RNA, 17 nt, Human
acuuccccuccuacccc

SEQ ID NO: 2422169 - RNA, 20 nt, Human
acuucccgucccauauccug

SEQ ID NO: 2422170 - RNA, 13 nt, Human
acuuccccuuccu

SEQ ID NO: 2422171 - RNA, 19 nt, Human
acuuccccuuccuaauucc

SEQ ID NO: 2422172 - RNA, 24 nt, Human
acuucauauugcugagagaaauau

SEQ ID NO: 2422173 - RNA, 14 nt, Human
acuucauauugcug

SEQ ID NO: 2422174 - RNA, 22 nt, Human
acuucauauugcugagagaaau

SEQ ID NO: 2422175 - RNA, 18 nt, Human
acuucauauaugaggacu

SEQ ID NO: 2422176 - RNA, 17 nt, Human
acuucauagauuuccuu

SEQ ID NO: 2422177 - RNA, 16 nt, Human
acuucaucccucuggg

SEQ ID NO: 2422178 - RNA, 16 nt, Human
acuuccccuccuaccc

SEQ ID NO: 2422179 - RNA, 12 nt, Human
acuuccccuccu

SEQ ID NO: 2422180 - RNA, 16 nt, Human
ucucacuauguugccc

SEQ ID NO: 2422181 - RNA, 19 nt, Human
ucucacuauguugcccagg

SEQ ID NO: 2422182 - RNA, 17 nt, Human
ucucacuauguugccca

SEQ ID NO: 2422183 - RNA, 24 nt, Human
ucuauuuuguaacuuucucuauga

SEQ ID NO: 2422184 - RNA, 17 nt, Human
ucuauuuuguaaacuca

SEQ ID NO: 2422185 - RNA, 18 nt, Human
ucuauuuuggauuguaua

SEQ ID NO: 2422186 - RNA, 15 nt, Human
ucucaccccauccca

SEQ ID NO: 2422187 - RNA, 16 nt, Human
ucucaccgcagucguc

SEQ ID NO: 2422188 - RNA, 21 nt, Human
ucucaccccaucccacacccu

SEQ ID NO: 2422189 - RNA, 17 nt, Human
ucucaccccaucccaca

SEQ ID NO: 2422190 - RNA, 19 nt, Human
ucucaccccaucccacacc

SEQ ID NO: 2422191 - RNA, 13 nt, Human
ucuauuuggaauu

SEQ ID NO: 2422192 - RNA, 12 nt, Human
ucuauuuggaau

SEQ ID NO: 2422193 - RNA, 16 nt, Human
ucuauuuggaauuuau

SEQ ID NO: 2422194 - RNA, 16 nt, Human
ucuauuuucauuuucu

SEQ ID NO: 2422195 - RNA, 15 nt, Human
ucuauuuuggauugu

SEQ ID NO: 2422196 - RNA, 22 nt, Human
ucuauugcuggcaaagacagaa

SEQ ID NO: 2422197 - RNA, 13 nt, Human
ucuauuuaauauu

SEQ ID NO: 2422198 - RNA, 12 nt, Human
ucuauuuaauau

SEQ ID NO: 2422199 - RNA, 17 nt, Human
ucuauugcuggcaaaga

SEQ ID NO: 2422200 - RNA, 15 nt, Human
ucuauuuaaguaaaa

SEQ ID NO: 2422201 - RNA, 13 nt, Human
ucuauuuauguuu

SEQ ID NO: 2422202 - RNA, 15 nt, Human
ucuauuuauguuugc

SEQ ID NO: 2422203 - RNA, 22 nt, Human
ucuauuuauuuacugagcuucu

SEQ ID NO: 2422204 - RNA, 15 nt, Human
ucuauuuauuuacug

SEQ ID NO: 2422205 - RNA, 13 nt, Human
ucuauuuauaugu

SEQ ID NO: 2422206 - RNA, 13 nt, Human
ucuauuuagcaug

SEQ ID NO: 2422207 - RNA, 18 nt, Human
ucuauuuauauguacaug

SEQ ID NO: 2422208 - RNA, 19 nt, Human
ucuauguauauacauuuau

SEQ ID NO: 2422209 - RNA, 18 nt, Human
ucuauuaagauuuccaag

SEQ ID NO: 2422210 - RNA, 17 nt, Human
ucuauuaagauuuccaa

SEQ ID NO: 2422211 - RNA, 16 nt, Human
ucuauuaagauuucca

SEQ ID NO: 2422212 - RNA, 15 nt, Human
ucuauuauacuguau

SEQ ID NO: 2422213 - RNA, 14 nt, Human
ucuauuauacugua

SEQ ID NO: 2422214 - RNA, 16 nt, Human
ucuauucagacaagca

SEQ ID NO: 2422215 - RNA, 22 nt, Human
ucuauuauacuguauuaagagu

SEQ ID NO: 2422216 - RNA, 19 nt, Human
ucuauuauacuguauuaag

SEQ ID NO: 2422217 - RNA, 12 nt, Human
ucuauucagcuu

SEQ ID NO: 2422218 - RNA, 20 nt, Human
ucuauugauguacagucugu

SEQ ID NO: 2422219 - RNA, 22 nt, Human
ucuauugacuucaaugauagua

SEQ ID NO: 2422220 - RNA, 23 nt, Human
ucuauugcaguuauagaaaaucu

SEQ ID NO: 2422221 - RNA, 13 nt, Human
ucuauugaaaaau

SEQ ID NO: 2422222 - RNA, 16 nt, Human
ucuauugauguacagu

SEQ ID NO: 2422223 - RNA, 16 nt, Human
ucuauucuccagcuga

SEQ ID NO: 2422224 - RNA, 13 nt, Human
ucuauucucucca

SEQ ID NO: 2422225 - RNA, 22 nt, Human
ucuauguuuacaaauggacaua

SEQ ID NO: 2422226 - RNA, 17 nt, Human
ucuaugugcuuguaaaa

SEQ ID NO: 2422227 - RNA, 19 nt, Human
ucuauguaaaugcaucugu

SEQ ID NO: 2422228 - RNA, 16 nt, Human
ucuauguauauacauu

SEQ ID NO: 2422229 - RNA, 23 nt, Human
ucuaugggacucaaugcacugac

SEQ ID NO: 2422230 - RNA, 17 nt, Human
ucuauagcaccagggcu

SEQ ID NO: 2422231 - RNA, 16 nt, Human
ucuauagacucuagga

SEQ ID NO: 2422232 - RNA, 20 nt, Human
ucuauaccugucuccuuucu

SEQ ID NO: 2422233 - RNA, 17 nt, Human
ucuauagaacugaauga

SEQ ID NO: 2422234 - RNA, 13 nt, Human
ucuauagacucua

SEQ ID NO: 2422235 - RNA, 15 nt, Human
ugacuguuuuuaccc

SEQ ID NO: 2422236 - RNA, 16 nt, Human
ugacucugaaaucuga

SEQ ID NO: 2422237 - RNA, 17 nt, Human
ugacuguuuuuacccau

SEQ ID NO: 2422238 - RNA, 16 nt, Human
ugacuguuuuuaccca

SEQ ID NO: 2422239 - RNA, 18 nt, Human
ugacuguuuuuacccaua

SEQ ID NO: 2422240 - RNA, 16 nt, Human
ugacuuaacugcauuu

SEQ ID NO: 2422241 - RNA, 17 nt, Human
ugacuguuuuuguagug

SEQ ID NO: 2422242 - RNA, 21 nt, Human
ugacuguuuucucuugagagg

SEQ ID NO: 2422243 - RNA, 15 nt, Human
ugacucugaaaucug

SEQ ID NO: 2422244 - RNA, 14 nt, Human
ugacucugaaaucu

SEQ ID NO: 2422245 - RNA, 11 nt, Human
ugacucugaaa

SEQ ID NO: 2422246 - RNA, 14 nt, Human
ugacucucaaaucu

SEQ ID NO: 2422247 - RNA, 13 nt, Human
ugacucucuguga

SEQ ID NO: 2422248 - RNA, 15 nt, Human
ugacucucugugacc

SEQ ID NO: 2422249 - RNA, 15 nt, Human
ugacucgugcugcau

SEQ ID NO: 2422250 - RNA, 20 nt, Human
ugacucgucugacugugugu

SEQ ID NO: 2422251 - RNA, 16 nt, Human
ugacucgucugacugu

SEQ ID NO: 2422252 - RNA, 13 nt, Human
ugacucucaaauc

SEQ ID NO: 2422253 - RNA, 15 nt, Human
ugacucgucugacug

SEQ ID NO: 2422254 - RNA, 18 nt, Human
ugacucggggguggggaa

SEQ ID NO: 2422255 - RNA, 18 nt, Human
ugacucgguuucuccaaa

SEQ ID NO: 2422256 - RNA, 21 nt, Human
ugacucguauaugucucaggu

SEQ ID NO: 2422257 - RNA, 16 nt, Human
ugacucgguuucucca

SEQ ID NO: 2422258 - RNA, 15 nt, Human
ugacucgguuucucc

SEQ ID NO: 2422259 - RNA, 14 nt, Human
ugacucgguuucuc

SEQ ID NO: 2422260 - RNA, 19 nt, Human
ugacuauuuuucagaaucu

SEQ ID NO: 2422261 - RNA, 13 nt, Human
ugaccuuucaaua

SEQ ID NO: 2422262 - RNA, 21 nt, Human
ugaccuuguaccucucuuuga

SEQ ID NO: 2422263 - RNA, 12 nt, Human
ugaccuuucaau

SEQ ID NO: 2422264 - RNA, 21 nt, Human
ugacuauauagagauguuuuu

SEQ ID NO: 2422265 - RNA, 19 nt, Human
ugacuauauagagauguuu

SEQ ID NO: 2422266 - RNA, 18 nt, Human
ugacuauauagagauguu

SEQ ID NO: 2422267 - RNA, 17 nt, Human
ugacuauauagagaugu

SEQ ID NO: 2422268 - RNA, 16 nt, Human
ugacuauauagagaug

SEQ ID NO: 2422269 - RNA, 14 nt, Human
ugacuauauagaga

SEQ ID NO: 2422270 - RNA, 16 nt, Human
ugacuaucaaacugaa

SEQ ID NO: 2422271 - RNA, 22 nt, Human
ugacuaucaaacugaagccaga

SEQ ID NO: 2422272 - RNA, 20 nt, Human
ugacuauugaaguugcagau

SEQ ID NO: 2422273 - RNA, 19 nt, Human
agaugucuucugccuguua

SEQ ID NO: 2422274 - RNA, 22 nt, Human
agauguauguacuucaugcugu

SEQ ID NO: 2422275 - RNA, 17 nt, Human
agaugugaacacaucag

SEQ ID NO: 2422276 - RNA, 13 nt, Human
agaugucuuuagg

SEQ ID NO: 2422277 - RNA, 23 nt, Human
agaugucuuuaggcagcagcuuu

SEQ ID NO: 2422278 - RNA, 15 nt, Human
agaugucuuuaggca

SEQ ID NO: 2422279 - RNA, 22 nt, Human
agaugugaacacaucagcuugc

SEQ ID NO: 2422280 - RNA, 17 nt, Human
agaugugauaaggauca

SEQ ID NO: 2422281 - RNA, 16 nt, Human
ugaccugccucccuuc

SEQ ID NO: 2422282 - RNA, 20 nt, Human
ugaccugccccgcccagcug

SEQ ID NO: 2422283 - RNA, 13 nt, Human
ugaccugccccgc

SEQ ID NO: 2422284 - RNA, 19 nt, Human
ugaccugccccgcccagcu

SEQ ID NO: 2422285 - RNA, 16 nt, Human
ugaccugccaggcaca

SEQ ID NO: 2422286 - RNA, 19 nt, Human
ugaccugccaggcacacug

SEQ ID NO: 2422287 - RNA, 21 nt, Human
ugaccugcuggguaaacugug

SEQ ID NO: 2422288 - RNA, 17 nt, Human
ugaccugccucccuuca

SEQ ID NO: 2422289 - RNA, 19 nt, Human
ugaccugccucccuucaug

SEQ ID NO: 2422290 - RNA, 23 nt, Human
ugaccugccucccuucaugcaug

SEQ ID NO: 2422291 - RNA, 21 nt, Human
ugaccugccucccuucaugca

SEQ ID NO: 2422292 - RNA, 22 nt, Human
ugaccuggauaacuuagguggc

SEQ ID NO: 2422293 - RNA, 19 nt, Human
ugaccugucaugccccccu

SEQ ID NO: 2422294 - RNA, 16 nt, Human
ugaccugucaugcccc

SEQ ID NO: 2422295 - RNA, 15 nt, Human
ugaccugucaugccc

SEQ ID NO: 2422296 - RNA, 12 nt, Human
ugaccugucacc

SEQ ID NO: 2422297 - RNA, 15 nt, Human
ugaccuuuaagagaa

SEQ ID NO: 2422298 - RNA, 16 nt, Human
ugaccuugcaacuuca

SEQ ID NO: 2422299 - RNA, 21 nt, Human
agauuucaucugcucuccuuc

SEQ ID NO: 2422300 - RNA, 20 nt, Human
agauuucaucugcucuccuu

SEQ ID NO: 2422301 - RNA, 19 nt, Human
agauuucaucugcucuccu

SEQ ID NO: 2422302 - RNA, 18 nt, Human
agauuucaucugcucucc

SEQ ID NO: 2422303 - RNA, 15 nt, Human
agauuucaucugcuc

SEQ ID NO: 2422304 - RNA, 13 nt, Human
agauuucaucugc

SEQ ID NO: 2422305 - RNA, 19 nt, Human
agauuucacucuccuuggu

SEQ ID NO: 2422306 - RNA, 17 nt, Human
agauuucacucuccuug

SEQ ID NO: 2422307 - RNA, 17 nt, Human
agauuuuaaaaagucuu

SEQ ID NO: 2422308 - RNA, 12 nt, Human
agauuuuaaaga

SEQ ID NO: 2422309 - RNA, 13 nt, Human
agauuuguguuau

SEQ ID NO: 2422310 - RNA, 23 nt, Human
agauuucaucugcucuccuuccu

SEQ ID NO: 2422311 - RNA, 21 nt, Human
agauuuuaauuuugaauaaau

SEQ ID NO: 2422312 - RNA, 17 nt, Human
agauuuuaauuuugaau

SEQ ID NO: 2422313 - RNA, 14 nt, Human
agauuuuaauuuug

SEQ ID NO: 2422314 - RNA, 19 nt, Human
agauuuuaaucaaguugaa

SEQ ID NO: 2422315 - RNA, 22 nt, Human
agauuuuaaauucacaauagaa

SEQ ID NO: 2422316 - RNA, 13 nt, Human
agauuuuaaauuc

SEQ ID NO: 2422317 - RNA, 19 nt, Human
agauuuuaaauucacaaua

SEQ ID NO: 2422318 - RNA, 22 nt, Human
agauuguuuuaucaugacaugu

SEQ ID NO: 2422319 - RNA, 23 nt, Human
agauuguuuuaucaugacauguu

SEQ ID NO: 2422320 - RNA, 23 nt, Human
agauuguuguuugccauacuuug

SEQ ID NO: 2422321 - RNA, 22 nt, Human
agauuguuguuugccauacuuu

SEQ ID NO: 2422322 - RNA, 16 nt, Human
agauuguuguuugcca

SEQ ID NO: 2422323 - RNA, 15 nt, Human
agauuguuguuugcc

SEQ ID NO: 2422324 - RNA, 16 nt, Human
agauucccagagcaaa

SEQ ID NO: 2422325 - RNA, 14 nt, Human
agauucccagagac

SEQ ID NO: 2422326 - RNA, 14 nt, Human
agauuguuaaaaua

SEQ ID NO: 2422327 - RNA, 15 nt, Human
agauuguuaaaauaa

SEQ ID NO: 2422328 - RNA, 21 nt, Human
agauuguguaacaauuuuaau

SEQ ID NO: 2422329 - RNA, 15 nt, Human
agauuguguaacaau

SEQ ID NO: 2422330 - RNA, 13 nt, Human
agauuguguaaca

SEQ ID NO: 2422331 - RNA, 19 nt, Human
agauucagguauguugccu

SEQ ID NO: 2422332 - RNA, 19 nt, Human
agauuccagagaguggcuc

SEQ ID NO: 2422333 - RNA, 22 nt, Human
agauuccagagaguggcuccuc

SEQ ID NO: 2422334 - RNA, 21 nt, Human
agauuccagagaguggcuccu

SEQ ID NO: 2422335 - RNA, 19 nt, Human
agauucauauuuacuucuu

SEQ ID NO: 2422336 - RNA, 13 nt, Human
agauucccagagc

SEQ ID NO: 2422337 - RNA, 12 nt, Human
agauucccagag

SEQ ID NO: 2422338 - RNA, 13 nt, Human
agauucccagaga

SEQ ID NO: 2422339 - RNA, 18 nt, Human
agauuauaacuugucuaa

SEQ ID NO: 2422340 - RNA, 14 nt, Human
agauuauaacuugu

SEQ ID NO: 2422341 - RNA, 13 nt, Human
agauuauaacuug

SEQ ID NO: 2422342 - RNA, 17 nt, Human
agauuauacagaauugu

SEQ ID NO: 2422343 - RNA, 14 nt, Human
agauuauacagaau

SEQ ID NO: 2422344 - RNA, 18 nt, Human
agauuagagggagguguu

SEQ ID NO: 2422345 - RNA, 21 nt, Human
agauuagaaugaaaauuguau

SEQ ID NO: 2422346 - RNA, 16 nt, Human
agauuagaucuuuuaa

SEQ ID NO: 2422347 - RNA, 17 nt, Human
agauuagcucuggacca

SEQ ID NO: 2422348 - RNA, 15 nt, Human
agauuagcucuggac

SEQ ID NO: 2422349 - RNA, 14 nt, Human
agauuagcucugga

SEQ ID NO: 2422350 - RNA, 15 nt, Human
agauuagaucuuuua

SEQ ID NO: 2422351 - RNA, 14 nt, Human
agauuagagggagg

SEQ ID NO: 2422352 - RNA, 15 nt, Human
agauuagaagcugaa

SEQ ID NO: 2422353 - RNA, 21 nt, Human
agauuacccccucauuguuua

SEQ ID NO: 2422354 - RNA, 20 nt, Human
agauucagguauguugccuu

SEQ ID NO: 2422355 - RNA, 18 nt, Human
agauucagguauguugcc

SEQ ID NO: 2422356 - RNA, 13 nt, Human
agauucauauuua

SEQ ID NO: 2422357 - RNA, 16 nt, Human
agauucauauuuacuu

SEQ ID NO: 2422358 - RNA, 12 nt, Human
ugacuuacugua

SEQ ID NO: 2422359 - RNA, 20 nt, Human
ugacuuacuguacaugaaaa

SEQ ID NO: 2422360 - RNA, 16 nt, Human
ugacuuagcagaugcu

SEQ ID NO: 2422361 - RNA, 16 nt, Human
agauuaagagccauau

SEQ ID NO: 2422362 - RNA, 16 nt, Human
agauuacuuagaggaa

SEQ ID NO: 2422363 - RNA, 14 nt, Human
agauuaccuccuga

SEQ ID NO: 2422364 - RNA, 23 nt, Human
ugaccaacauggagaaacccugu

SEQ ID NO: 2422365 - RNA, 18 nt, Human
ugaccaacuagacauucu

SEQ ID NO: 2422366 - RNA, 16 nt, Human
ugaccaacuagacauu

SEQ ID NO: 2422367 - RNA, 15 nt, Human
ugaccaacuagacau

SEQ ID NO: 2422368 - RNA, 22 nt, Human
ugaccaacuagacauucugucg

SEQ ID NO: 2422369 - RNA, 21 nt, Human
ugaccaacuagacauucuguc

SEQ ID NO: 2422370 - RNA, 20 nt, Human
ugaccaacuagacauucugu

SEQ ID NO: 2422371 - RNA, 15 nt, Human
ugaccaagagagaaa

SEQ ID NO: 2422372 - RNA, 14 nt, Human
ugaccaagcaggaa

SEQ ID NO: 2422373 - RNA, 16 nt, Human
ugaccaagagagaaag

SEQ ID NO: 2422374 - RNA, 17 nt, Human
ugaccaagagagaaaga

SEQ ID NO: 2422375 - RNA, 18 nt, Human
ugaccaagagagaaagaa

SEQ ID NO: 2422376 - RNA, 15 nt, Human
ugaccaagcaggaag

SEQ ID NO: 2422377 - RNA, 16 nt, Human
ugaccaagcaggaagc

SEQ ID NO: 2422378 - RNA, 17 nt, Human
ugaccaagcaggaagcu

SEQ ID NO: 2422379 - RNA, 18 nt, Human
ugaccaagcaggaagcuc

SEQ ID NO: 2422380 - RNA, 19 nt, Human
ugaccaagcaggaagcuca

SEQ ID NO: 2422381 - RNA, 21 nt, Human
ugaccaagcaggaagcucaga

SEQ ID NO: 2422382 - RNA, 13 nt, Human
ugaccaaguuaua

SEQ ID NO: 2422383 - RNA, 16 nt, Human
ugaccaaguuauaaau

SEQ ID NO: 2422384 - RNA, 20 nt, Human
ugaccaaguuauaaaucaau

SEQ ID NO: 2422385 - RNA, 22 nt, Human
agaucccagaaggaccuccuga

SEQ ID NO: 2422386 - RNA, 18 nt, Human
agauccccaagccuggca

SEQ ID NO: 2422387 - RNA, 14 nt, Human
agaucccccagacu

SEQ ID NO: 2422388 - RNA, 11 nt, Human
agauccccuca

SEQ ID NO: 2422389 - RNA, 13 nt, Human
agaucccagcuca

SEQ ID NO: 2422390 - RNA, 16 nt, Human
agauccuaaaacaaaa

SEQ ID NO: 2422391 - RNA, 22 nt, Human
agauccuaccccaauuccuugu

SEQ ID NO: 2422392 - RNA, 15 nt, Human
agauccccucaggac

SEQ ID NO: 2422393 - RNA, 15 nt, Human
agaucccgccucuuc

SEQ ID NO: 2422394 - RNA, 19 nt, Human
agaucccgccucuucuucu

SEQ ID NO: 2422395 - RNA, 22 nt, Human
agauccuaaaacaaaagcucau

SEQ ID NO: 2422396 - RNA, 13 nt, Human
agauccuaaaaca

SEQ ID NO: 2422397 - RNA, 22 nt, Human
agaucccgccucuucuucuuca

SEQ ID NO: 2422398 - RNA, 20 nt, Human
agaucuaagccuuuccauaa

SEQ ID NO: 2422399 - RNA, 17 nt, Human
agaucguuaguaucuaa

SEQ ID NO: 2422400 - RNA, 16 nt, Human
agaucguuaguaucua

SEQ ID NO: 2422401 - RNA, 22 nt, Human
agaucuaaggaugucacagggc

SEQ ID NO: 2422402 - RNA, 19 nt, Human
agaucuaggugaggauuga

SEQ ID NO: 2422403 - RNA, 18 nt, Human
agaucucuaacuucacca

SEQ ID NO: 2422404 - RNA, 18 nt, Human
agaucuccuggcaaaggc

SEQ ID NO: 2422405 - RNA, 20 nt, Human
agaugcaaagaggcaagagg

SEQ ID NO: 2422406 - RNA, 14 nt, Human
agaucuccuggcaa

SEQ ID NO: 2422407 - RNA, 15 nt, Human
agaugcaaggaccag

SEQ ID NO: 2422408 - RNA, 13 nt, Human
agauccuggaaau

SEQ ID NO: 2422409 - RNA, 12 nt, Human
agauccuccugc

SEQ ID NO: 2422410 - RNA, 17 nt, Human
agauccugcgggugggg

SEQ ID NO: 2422411 - RNA, 14 nt, Human
agauccuggaaauc

SEQ ID NO: 2422412 - RNA, 22 nt, Human
agaucgugccguuacucuccaa

SEQ ID NO: 2422413 - RNA, 18 nt, Human
agauccugcggguggggc

SEQ ID NO: 2422414 - RNA, 16 nt, Human
agaucguucucugccu

SEQ ID NO: 2422415 - RNA, 22 nt, Human
agaugcuggagaagagaggaga

SEQ ID NO: 2422416 - RNA, 21 nt, Human
agaugcuggagaagagaggag

SEQ ID NO: 2422417 - RNA, 20 nt, Human
agaugcuggagaagagagga

SEQ ID NO: 2422418 - RNA, 19 nt, Human
agaugcuggagaagagagg

SEQ ID NO: 2422419 - RNA, 18 nt, Human
agaugcuggagaagagag

SEQ ID NO: 2422420 - RNA, 17 nt, Human
agaugcuggagaagaga

SEQ ID NO: 2422421 - RNA, 16 nt, Human
agaugcuggagaagag

SEQ ID NO: 2422422 - RNA, 13 nt, Human
agaugcuggagaa

SEQ ID NO: 2422423 - RNA, 11 nt, Human
agaugcuggag

SEQ ID NO: 2422424 - RNA, 22 nt, Human
agaugcugauguucaguguaau

SEQ ID NO: 2422425 - RNA, 21 nt, Human
agaugcugauguucaguguaa

SEQ ID NO: 2422426 - RNA, 20 nt, Human
agaugcugauguucagugua

SEQ ID NO: 2422427 - RNA, 19 nt, Human
agaugcugauguucagugu

SEQ ID NO: 2422428 - RNA, 18 nt, Human
agaugcugauguucagug

SEQ ID NO: 2422429 - RNA, 17 nt, Human
agaugcugauguucagu

SEQ ID NO: 2422430 - RNA, 21 nt, Human
agaugcuagaacucccuuuca

SEQ ID NO: 2422431 - RNA, 16 nt, Human
agaugcugauguucag

SEQ ID NO: 2422432 - RNA, 14 nt, Human
agaugcuggcccag

SEQ ID NO: 2422433 - RNA, 15 nt, Human
agaugcuggcccagg

SEQ ID NO: 2422434 - RNA, 16 nt, Human
agaugcuggcccaggg

SEQ ID NO: 2422435 - RNA, 17 nt, Human
agaugcuggcccagggc

SEQ ID NO: 2422436 - RNA, 18 nt, Human
agaugcuggcccagggcc

SEQ ID NO: 2422437 - RNA, 21 nt, Human
agauguagccccucuccugga

SEQ ID NO: 2422438 - RNA, 22 nt, Human
agauguagccccucuccuggaa

SEQ ID NO: 2422439 - RNA, 21 nt, Human
agaugcuggaugucugccaau

SEQ ID NO: 2422440 - RNA, 21 nt, Human
agaugcaguucugaagaagau

SEQ ID NO: 2422441 - RNA, 22 nt, Human
agaugcauucuugguuggcugg

SEQ ID NO: 2422442 - RNA, 20 nt, Human
agaugcaccaccaagccaag

SEQ ID NO: 2422443 - RNA, 19 nt, Human
agaugcuagaacucccuuu

SEQ ID NO: 2422444 - RNA, 20 nt, Human
agaugcaguucugaagaaga

SEQ ID NO: 2422445 - RNA, 18 nt, Human
agaugcaccaccaagcca

SEQ ID NO: 2422446 - RNA, 19 nt, Human
agaugcaaugugcuacuga

SEQ ID NO: 2422447 - RNA, 13 nt, Human
agaugcaagauau

SEQ ID NO: 2422448 - RNA, 18 nt, Human
agaugcaaugugcuacug

SEQ ID NO: 2422449 - RNA, 20 nt, Human
agaugcaaggaccaggacuc

SEQ ID NO: 2422450 - RNA, 17 nt, Human
agaugcaaggaccagga

SEQ ID NO: 2422451 - RNA, 18 nt, Human
agaugcaaggaccaggac

SEQ ID NO: 2422452 - RNA, 20 nt, Human
agaugcaaugacucaggaca

SEQ ID NO: 2422453 - RNA, 21 nt, Human
ugacagcuuugcugcugaagg

SEQ ID NO: 2422454 - RNA, 20 nt, Human
ugacagcuuugcugcugaag

SEQ ID NO: 2422455 - RNA, 15 nt, Human
ugacagguaaacuau

SEQ ID NO: 2422456 - RNA, 15 nt, Human
ugacagguuugggac

SEQ ID NO: 2422457 - RNA, 22 nt, Human
ugacagggcacaccgggcacuc

SEQ ID NO: 2422458 - RNA, 15 nt, Human
ugacagcuuugcugc

SEQ ID NO: 2422459 - RNA, 16 nt, Human
ugacagcuuugcugcu

SEQ ID NO: 2422460 - RNA, 17 nt, Human
ugacagcuuugcugcug

SEQ ID NO: 2422461 - RNA, 18 nt, Human
ugacagcuuugcugcuga

SEQ ID NO: 2422462 - RNA, 21 nt, Human
ugacagggcacaccgggcacu

SEQ ID NO: 2422463 - RNA, 19 nt, Human
ugacaggcaaugcuggcug

SEQ ID NO: 2422464 - RNA, 17 nt, Human
ugacaggcaaugcuggc

SEQ ID NO: 2422465 - RNA, 14 nt, Human
ugacagcagguggg

SEQ ID NO: 2422466 - RNA, 13 nt, Human
ugacagcuuugcu

SEQ ID NO: 2422467 - RNA, 14 nt, Human
ugacagcuuugcug

SEQ ID NO: 2422468 - RNA, 11 nt, Human
ugacagccucc

SEQ ID NO: 2422469 - RNA, 12 nt, Human
ugacagccuccc

SEQ ID NO: 2422470 - RNA, 20 nt, Human
ugacauuuauauauugaauu

SEQ ID NO: 2422471 - RNA, 19 nt, Human
ugacauuuauauauugaau

SEQ ID NO: 2422472 - RNA, 18 nt, Human
ugacauuuauuuuucauu

SEQ ID NO: 2422473 - RNA, 21 nt, Human
ugacauuuauuuuucauuuag

SEQ ID NO: 2422474 - RNA, 21 nt, Human
ugacauuuggaguguuccccu

SEQ ID NO: 2422475 - RNA, 13 nt, Human
ugacauuucuuug

SEQ ID NO: 2422476 - RNA, 14 nt, Human
ugacauuucuuugu

SEQ ID NO: 2422477 - RNA, 22 nt, Human
ugacauuuauuuuucucaugaa

SEQ ID NO: 2422478 - RNA, 21 nt, Human
ugacauuuauuuuucucauga

SEQ ID NO: 2422479 - RNA, 12 nt, Human
ugacauuucuuu

SEQ ID NO: 2422480 - RNA, 24 nt, Human
ugacauuugggagacaugugacau

SEQ ID NO: 2422481 - RNA, 23 nt, Human
ugacauuugggagacaugugaca

SEQ ID NO: 2422482 - RNA, 22 nt, Human
ugacauuugggagacaugugac

SEQ ID NO: 2422483 - RNA, 21 nt, Human
ugacauuugggagacauguga

SEQ ID NO: 2422484 - RNA, 21 nt, Human
ugacauuccuaaacuaucuuu

SEQ ID NO: 2422485 - RNA, 20 nt, Human
ugacauuccuaaacuaucuu

SEQ ID NO: 2422486 - RNA, 15 nt, Human
ugacauucaugccug

SEQ ID NO: 2422487 - RNA, 15 nt, Human
ugacauucaaggcau

SEQ ID NO: 2422488 - RNA, 22 nt, Human
ugacauucucaggaagccccca

SEQ ID NO: 2422489 - RNA, 17 nt, Human
ugacauucaugccuggc

SEQ ID NO: 2422490 - RNA, 15 nt, Human
ugacauucaccugcc

SEQ ID NO: 2422491 - RNA, 18 nt, Human
ugacauucaccugcccca

SEQ ID NO: 2422492 - RNA, 12 nt, Human
ugacauucaccu

SEQ ID NO: 2422493 - RNA, 21 nt, Human
ugacauuaacaguuuuccaug

SEQ ID NO: 2422494 - RNA, 17 nt, Human
ugacauuaacaguuuuc

SEQ ID NO: 2422495 - RNA, 19 nt, Human
ugacauuaacaguuuucca

SEQ ID NO: 2422496 - RNA, 22 nt, Human
ugacauuaacaguuuuccauga

SEQ ID NO: 2422497 - RNA, 17 nt, Human
ugacagguaaauuaaga

SEQ ID NO: 2422498 - RNA, 13 nt, Human
ugacauuaacagu

SEQ ID NO: 2422499 - RNA, 13 nt, Human
ugacauguuuuau

SEQ ID NO: 2422500 - RNA, 15 nt, Human
ugaaugcugggacuc

SEQ ID NO: 2422501 - RNA, 14 nt, Human
ugaaugcugggacu

SEQ ID NO: 2422502 - RNA, 19 nt, Human
ugaaugcugggacucagcc

SEQ ID NO: 2422503 - RNA, 19 nt, Human
ugaaugcuuauagguggcc

SEQ ID NO: 2422504 - RNA, 15 nt, Human
ugacaccugcugaga

SEQ ID NO: 2422505 - RNA, 21 nt, Human
ugacaccgggguggugggaac

SEQ ID NO: 2422506 - RNA, 16 nt, Human
ugacacgaauauugcu

SEQ ID NO: 2422507 - RNA, 18 nt, Human
ugaaugcccccagcuggc

SEQ ID NO: 2422508 - RNA, 17 nt, Human
ugaaugcccccagcugg

SEQ ID NO: 2422509 - RNA, 20 nt, Human
ugaaucaauaauauauuuuc

SEQ ID NO: 2422510 - RNA, 19 nt, Human
ugaaucaauaauauauuuu

SEQ ID NO: 2422511 - RNA, 17 nt, Human
ugaaucaauaauauauu

SEQ ID NO: 2422512 - RNA, 16 nt, Human
ugaaucaauaauauau

SEQ ID NO: 2422513 - RNA, 15 nt, Human
ugaaucaauaauaua

SEQ ID NO: 2422514 - RNA, 13 nt, Human
ugaaucaauaaua

SEQ ID NO: 2422515 - RNA, 13 nt, Human
ugaaugcugggac

SEQ ID NO: 2422516 - RNA, 12 nt, Human
ugaaugcuggga

SEQ ID NO: 2422517 - RNA, 17 nt, Human
ugaaugccucaauguga

SEQ ID NO: 2422518 - RNA, 11 nt, Human
ugaaugcuggg

SEQ ID NO: 2422519 - RNA, 20 nt, Human
ugaaugcccccagcuggccc

SEQ ID NO: 2422520 - RNA, 19 nt, Human
ugaaugcccccagcuggcc

SEQ ID NO: 2422521 - RNA, 14 nt, Human
ugaaugccguggau

SEQ ID NO: 2422522 - RNA, 13 nt, Human
ugaaugcggccca

SEQ ID NO: 2422523 - RNA, 15 nt, Human
ugacacuuaaaaaug

SEQ ID NO: 2422524 - RNA, 22 nt, Human
ugacagagugagacucugucuc

SEQ ID NO: 2422525 - RNA, 19 nt, Human
ugacagaugucagccgagc

SEQ ID NO: 2422526 - RNA, 21 nt, Human
ugacagaucaagcugugagac

SEQ ID NO: 2422527 - RNA, 22 nt, Human
ugacagaugucagccgagccgg

SEQ ID NO: 2422528 - RNA, 19 nt, Human
ugacagauguugaaugccc

SEQ ID NO: 2422529 - RNA, 19 nt, Human
ugacagaucaagcugugag

SEQ ID NO: 2422530 - RNA, 18 nt, Human
ugacagaucaagcuguga

SEQ ID NO: 2422531 - RNA, 17 nt, Human
ugacagaucaagcugug

SEQ ID NO: 2422532 - RNA, 16 nt, Human
ugacagaucaagcugu

SEQ ID NO: 2422533 - RNA, 21 nt, Human
ugacacugguauuccugccuc

SEQ ID NO: 2422534 - RNA, 20 nt, Human
ugacacugguauuccugccu

SEQ ID NO: 2422535 - RNA, 15 nt, Human
ugacagaucaagcug

SEQ ID NO: 2422536 - RNA, 15 nt, Human
ugacagaguucacua

SEQ ID NO: 2422537 - RNA, 19 nt, Human
ugacacugguauuccugcc

SEQ ID NO: 2422538 - RNA, 23 nt, Human
ugacacugcggggcuuggcugag

SEQ ID NO: 2422539 - RNA, 19 nt, Human
ugacacgaauauugcugau

SEQ ID NO: 2422540 - RNA, 19 nt, Human
ugacaccuuugcaggcaug

SEQ ID NO: 2422541 - RNA, 18 nt, Human
ugacaccuuugcaggcau

SEQ ID NO: 2422542 - RNA, 20 nt, Human
ugacacugcggggcuuggcu

SEQ ID NO: 2422543 - RNA, 23 nt, Human
ugacaccuuucauaaucuuugcu

SEQ ID NO: 2422544 - RNA, 20 nt, Human
ugacaccuuucauaaucuuu

SEQ ID NO: 2422545 - RNA, 22 nt, Human
agcacaugccucucucaggcca

SEQ ID NO: 2422546 - RNA, 21 nt, Human
agcacaugccucucucaggcc

SEQ ID NO: 2422547 - RNA, 20 nt, Human
agcacaugccucucucaggc

SEQ ID NO: 2422548 - RNA, 19 nt, Human
agcacaugccucucucagg

SEQ ID NO: 2422549 - RNA, 16 nt, Human
agcacaugccucucuc

SEQ ID NO: 2422550 - RNA, 15 nt, Human
agcacaggugggcuu

SEQ ID NO: 2422551 - RNA, 18 nt, Human
agcacaugccucucucag

SEQ ID NO: 2422552 - RNA, 20 nt, Human
agcacagcuugaccugaggc

SEQ ID NO: 2422553 - RNA, 18 nt, Human
agcacagcuugaccugag

SEQ ID NO: 2422554 - RNA, 13 nt, Human
agcacaggcagcu

SEQ ID NO: 2422555 - RNA, 12 nt, Human
agcacaggcagc

SEQ ID NO: 2422556 - RNA, 15 nt, Human
agcacaggcagcugg

SEQ ID NO: 2422557 - RNA, 23 nt, Human
agcaauaauggucccauccaggc

SEQ ID NO: 2422558 - RNA, 21 nt, Human
agcaauaauggucccauccag

SEQ ID NO: 2422559 - RNA, 20 nt, Human
agcaauaauggucccaucca

SEQ ID NO: 2422560 - RNA, 19 nt, Human
agcaauaauggucccaucc

SEQ ID NO: 2422561 - RNA, 14 nt, Human
agcaagugaauuuu

SEQ ID NO: 2422562 - RNA, 13 nt, Human
agcaauaaaugaa

SEQ ID NO: 2422563 - RNA, 14 nt, Human
agcaauaaaugaau

SEQ ID NO: 2422564 - RNA, 15 nt, Human
agcaauaaaugaaug

SEQ ID NO: 2422565 - RNA, 17 nt, Human
agcaagugagagcuggg

SEQ ID NO: 2422566 - RNA, 15 nt, Human
agcaagucugcaggu

SEQ ID NO: 2422567 - RNA, 14 nt, Human
agcaagucugcagg

SEQ ID NO: 2422568 - RNA, 13 nt, Human
agcaagucugcag

SEQ ID NO: 2422569 - RNA, 16 nt, Human
agcaauaaagaagagu

SEQ ID NO: 2422570 - RNA, 21 nt, Human
agcaauaucaguuauuuuuug

SEQ ID NO: 2422571 - RNA, 15 nt, Human
agcaauaucaguuau

SEQ ID NO: 2422572 - RNA, 12 nt, Human
agcaauaugcau

SEQ ID NO: 2422573 - RNA, 15 nt, Human
agcaauauguaaaua

SEQ ID NO: 2422574 - RNA, 17 nt, Human
agcaauccauguuaguu

SEQ ID NO: 2422575 - RNA, 20 nt, Human
agcaauccauguuaguuuuu

SEQ ID NO: 2422576 - RNA, 21 nt, Human
agcacagcuucauuuccugug

SEQ ID NO: 2422577 - RNA, 14 nt, Human
agcacagcuugacc

SEQ ID NO: 2422578 - RNA, 19 nt, Human
agcaauccuagguaggguu

SEQ ID NO: 2422579 - RNA, 22 nt, Human
agcaauccauguuaguuuuuac

SEQ ID NO: 2422580 - RNA, 23 nt, Human
agcaauccauguuaguuuuuacu

SEQ ID NO: 2422581 - RNA, 23 nt, Human
agcacaugccucucucaggccaa

SEQ ID NO: 2422582 - RNA, 16 nt, Human
agcaccaucucuccuc

SEQ ID NO: 2422583 - RNA, 14 nt, Human
agcaccccaaggcu

SEQ ID NO: 2422584 - RNA, 20 nt, Human
agcaccauccgccagggccc

SEQ ID NO: 2422585 - RNA, 19 nt, Human
agcaccauccgccagggcc

SEQ ID NO: 2422586 - RNA, 20 nt, Human
agcacccagcaacuccaacu

SEQ ID NO: 2422587 - RNA, 15 nt, Human
agcaccguucugugc

SEQ ID NO: 2422588 - RNA, 16 nt, Human
agcaccguucugugca

SEQ ID NO: 2422589 - RNA, 17 nt, Human
agcaccguucugugcac

SEQ ID NO: 2422590 - RNA, 17 nt, Human
agcacccgggcucaggg

SEQ ID NO: 2422591 - RNA, 15 nt, Human
agcacccgggcucag

SEQ ID NO: 2422592 - RNA, 14 nt, Human
agcaccccuuccau

SEQ ID NO: 2422593 - RNA, 13 nt, Human
agcaccccuucca

SEQ ID NO: 2422594 - RNA, 12 nt, Human
agcaccccuucc

SEQ ID NO: 2422595 - RNA, 15 nt, Human
agcaccccugucucu

SEQ ID NO: 2422596 - RNA, 13 nt, Human
agcaccccugucu

SEQ ID NO: 2422597 - RNA, 19 nt, Human
agcaccccucucugcaucu

SEQ ID NO: 2422598 - RNA, 16 nt, Human
agcaccccucucugca

SEQ ID NO: 2422599 - RNA, 15 nt, Human
agcaccccucucugc

SEQ ID NO: 2422600 - RNA, 14 nt, Human
agcaccccucucug

SEQ ID NO: 2422601 - RNA, 19 nt, Human
agcaccccaugccaaagcu

SEQ ID NO: 2422602 - RNA, 16 nt, Human
agcaccuccugccucg

SEQ ID NO: 2422603 - RNA, 14 nt, Human
agcaccuccugccu

SEQ ID NO: 2422604 - RNA, 13 nt, Human
agcaccuccugcc

SEQ ID NO: 2422605 - RNA, 21 nt, Human
agcaccuacaguguacagucu

SEQ ID NO: 2422606 - RNA, 19 nt, Human
agcaccuacaguguacagu

SEQ ID NO: 2422607 - RNA, 15 nt, Human
agcaccuacagugua

SEQ ID NO: 2422608 - RNA, 14 nt, Human
agcaccuacagugu

SEQ ID NO: 2422609 - RNA, 18 nt, Human
agcaccuaguccagugac

SEQ ID NO: 2422610 - RNA, 17 nt, Human
agcaccuagccucgcuc

SEQ ID NO: 2422611 - RNA, 15 nt, Human
agcaccuacuuacau

SEQ ID NO: 2422612 - RNA, 18 nt, Human
agcaccguucugugcaca

SEQ ID NO: 2422613 - RNA, 22 nt, Human
agcaccuacaguguacagucuu

SEQ ID NO: 2422614 - RNA, 14 nt, Human
ugagcauuagauuu

SEQ ID NO: 2422615 - RNA, 16 nt, Human
ugagcauuagauuucu

SEQ ID NO: 2422616 - RNA, 21 nt, Human
ugagcauuguggcugucagca

SEQ ID NO: 2422617 - RNA, 13 nt, Human
ugagccacugcac

SEQ ID NO: 2422618 - RNA, 12 nt, Human
ugagccacugca

SEQ ID NO: 2422619 - RNA, 21 nt, Human
ugagauuucaucugcucuccu

SEQ ID NO: 2422620 - RNA, 19 nt, Human
ugagauuucaucugcucuc

SEQ ID NO: 2422621 - RNA, 18 nt, Human
ugagauuucaucugcucu

SEQ ID NO: 2422622 - RNA, 14 nt, Human
ugagauuucaucug

SEQ ID NO: 2422623 - RNA, 14 nt, Human
ugagauuuugguau

SEQ ID NO: 2422624 - RNA, 22 nt, Human
ugagauuucaucugcucuccuu

SEQ ID NO: 2422625 - RNA, 18 nt, Human
ugagcaaacuaacuugac

SEQ ID NO: 2422626 - RNA, 20 nt, Human
ugagcaaagggaacagugag

SEQ ID NO: 2422627 - RNA, 14 nt, Human
ugagcauggagcug

SEQ ID NO: 2422628 - RNA, 15 nt, Human
ugagcauggagcugg

SEQ ID NO: 2422629 - RNA, 18 nt, Human
ugagcauggagcuggccg

SEQ ID NO: 2422630 - RNA, 16 nt, Human
ugagcauggagcuggc

SEQ ID NO: 2422631 - RNA, 19 nt, Human
ugagccagauuucacucuc

SEQ ID NO: 2422632 - RNA, 18 nt, Human
ugagccagauuucacucu

SEQ ID NO: 2422633 - RNA, 14 nt, Human
ugagccacugcacc

SEQ ID NO: 2422634 - RNA, 22 nt, Human
ugagcauuguggcugucagcag

SEQ ID NO: 2422635 - RNA, 23 nt, Human
ugagcauuguggcugucagcagg

SEQ ID NO: 2422636 - RNA, 21 nt, Human
ugagccagauuucacucuccu

SEQ ID NO: 2422637 - RNA, 20 nt, Human
ugagccagauuucacucucc

SEQ ID NO: 2422638 - RNA, 15 nt, Human
agcaagcucccaagg

SEQ ID NO: 2422639 - RNA, 11 nt, Human
agcaagcuccc

SEQ ID NO: 2422640 - RNA, 20 nt, Human
agcaagcauuuauguuuauu

SEQ ID NO: 2422641 - RNA, 14 nt, Human
agcaagauuucaga

SEQ ID NO: 2422642 - RNA, 16 nt, Human
agcaagggugauggga

SEQ ID NO: 2422643 - RNA, 16 nt, Human
agcaaggcaccugcag

SEQ ID NO: 2422644 - RNA, 17 nt, Human
agcaaggaggcuggcug

SEQ ID NO: 2422645 - RNA, 16 nt, Human
agcaaggaggcuggcu

SEQ ID NO: 2422646 - RNA, 22 nt, Human
agcaaggaggcuggcuggggcc

SEQ ID NO: 2422647 - RNA, 13 nt, Human
agcaaggcaccug

SEQ ID NO: 2422648 - RNA, 17 nt, Human
agcaaggagauuuacaa

SEQ ID NO: 2422649 - RNA, 19 nt, Human
agcaaggagauuuacaacu

SEQ ID NO: 2422650 - RNA, 14 nt, Human
agcaaggagauuua

SEQ ID NO: 2422651 - RNA, 20 nt, Human
agcaagcucccaagggaugg

SEQ ID NO: 2422652 - RNA, 20 nt, Human
agcaagggugaugggaaagc

SEQ ID NO: 2422653 - RNA, 22 nt, Human
agcaagggugaugggaaagcau

SEQ ID NO: 2422654 - RNA, 15 nt, Human
agcaagucagaauag

SEQ ID NO: 2422655 - RNA, 23 nt, Human
agcaaggugcucacaccccauug

SEQ ID NO: 2422656 - RNA, 20 nt, Human
agcaaggguucccucaagag

SEQ ID NO: 2422657 - RNA, 16 nt, Human
agcaagugagagcugg

SEQ ID NO: 2422658 - RNA, 15 nt, Human
agcaagugagagcug

SEQ ID NO: 2422659 - RNA, 16 nt, Human
agcaagugagacccug

SEQ ID NO: 2422660 - RNA, 13 nt, Human
agcaagucucuuu

SEQ ID NO: 2422661 - RNA, 14 nt, Human
agcaagucaggguu

SEQ ID NO: 2422662 - RNA, 18 nt, Human
ugagaaucuauauuuaac

SEQ ID NO: 2422663 - RNA, 23 nt, Human
ugagaaucuauauuuaacaagau

SEQ ID NO: 2422664 - RNA, 12 nt, Human
ugagaaucuacc

SEQ ID NO: 2422665 - RNA, 21 nt, Human
ugagaaucuacccccagaucc

SEQ ID NO: 2422666 - RNA, 13 nt, Human
ugagaaucccaaa

SEQ ID NO: 2422667 - RNA, 20 nt, Human
ugagaaucccaaauuugauu

SEQ ID NO: 2422668 - RNA, 21 nt, Human
ugagaaucccaaauuugauug

SEQ ID NO: 2422669 - RNA, 22 nt, Human
ugagaaucccaaauuugauuga

SEQ ID NO: 2422670 - RNA, 15 nt, Human
ugagaauguaagaac

SEQ ID NO: 2422671 - RNA, 21 nt, Human
ugagacacggagcccagcccu

SEQ ID NO: 2422672 - RNA, 17 nt, Human
ugagacacggagcccag

SEQ ID NO: 2422673 - RNA, 22 nt, Human
ugagaaucuuuauugagaaaga

SEQ ID NO: 2422674 - RNA, 21 nt, Human
ugagaaucuuuauugagaaag

SEQ ID NO: 2422675 - RNA, 20 nt, Human
ugagaaucuuuauugagaaa

SEQ ID NO: 2422676 - RNA, 19 nt, Human
ugagaaucuuuauugagaa

SEQ ID NO: 2422677 - RNA, 13 nt, Human
ugagacagcccgg

SEQ ID NO: 2422678 - RNA, 21 nt, Human
ugagacagaguuuucacucuu

SEQ ID NO: 2422679 - RNA, 13 nt, Human
ugagacagaaucu

SEQ ID NO: 2422680 - RNA, 22 nt, Human
ugagacacggagcccagcccuc

SEQ ID NO: 2422681 - RNA, 20 nt, Human
ugagacagaaucucgcucug

SEQ ID NO: 2422682 - RNA, 11 nt, Human
ugagacagagu

SEQ ID NO: 2422683 - RNA, 13 nt, Human
ugagaaggcagcc

SEQ ID NO: 2422684 - RNA, 22 nt, Human
ugagaaggagucagaaacuguu

SEQ ID NO: 2422685 - RNA, 16 nt, Human
ugagaaggagagaaag

SEQ ID NO: 2422686 - RNA, 15 nt, Human
ugagaaggagagaaa

SEQ ID NO: 2422687 - RNA, 14 nt, Human
ugagaaggcagcca

SEQ ID NO: 2422688 - RNA, 20 nt, Human
ugagaagcuuugcccuccua

SEQ ID NO: 2422689 - RNA, 19 nt, Human
ugagaagcuuuugaauaaa

SEQ ID NO: 2422690 - RNA, 14 nt, Human
ugagaaggagagaa

SEQ ID NO: 2422691 - RNA, 13 nt, Human
ugagaaggagaga

SEQ ID NO: 2422692 - RNA, 12 nt, Human
ugagaaggagag

SEQ ID NO: 2422693 - RNA, 17 nt, Human
ugagaaggaauuugagu

SEQ ID NO: 2422694 - RNA, 19 nt, Human
agauuuuccuuuuuuauac

SEQ ID NO: 2422695 - RNA, 13 nt, Human
agauuuuccuucc

SEQ ID NO: 2422696 - RNA, 20 nt, Human
agauuuuccuuuuuuauaca

SEQ ID NO: 2422697 - RNA, 16 nt, Human
ugagaagccgugggug

SEQ ID NO: 2422698 - RNA, 17 nt, Human
ugagaagccgugggugg

SEQ ID NO: 2422699 - RNA, 14 nt, Human
agauuuuccugaaa

SEQ ID NO: 2422700 - RNA, 19 nt, Human
agauuuuaggaaaugaaug

SEQ ID NO: 2422701 - RNA, 15 nt, Human
agauuuuccugaaaa

SEQ ID NO: 2422702 - RNA, 16 nt, Human
agauuuuccugaaaac

SEQ ID NO: 2422703 - RNA, 20 nt, Human
agauuuuaggaaaugaaugu

SEQ ID NO: 2422704 - RNA, 11 nt, Human
agauuuuccuu

SEQ ID NO: 2422705 - RNA, 20 nt, Human
ugagacagcccgggcucugc

SEQ ID NO: 2422706 - RNA, 19 nt, Human
ugagacagcccgggcucug

SEQ ID NO: 2422707 - RNA, 18 nt, Human
ugagacagcccgggcucu

SEQ ID NO: 2422708 - RNA, 17 nt, Human
ugagacagcccgggcuc

SEQ ID NO: 2422709 - RNA, 12 nt, Human
ugagacagcucu

SEQ ID NO: 2422710 - RNA, 22 nt, Human
ugagacagcccgggcucugccu

SEQ ID NO: 2422711 - RNA, 20 nt, Human
ugagacucugucucagucca

SEQ ID NO: 2422712 - RNA, 20 nt, Human
ugagacucugucucaaaaaa

SEQ ID NO: 2422713 - RNA, 20 nt, Human
ugagagacacacugaagaag

SEQ ID NO: 2422714 - RNA, 19 nt, Human
ugagagacacacugaagaa

SEQ ID NO: 2422715 - RNA, 17 nt, Human
ugagagacacacugaag

SEQ ID NO: 2422716 - RNA, 16 nt, Human
ugagagacacacugaa

SEQ ID NO: 2422717 - RNA, 14 nt, Human
ugagacagaaucuc

SEQ ID NO: 2422718 - RNA, 22 nt, Human
ugagacugcgggaugguccugg

SEQ ID NO: 2422719 - RNA, 23 nt, Human
ugagacugcgggaugguccuggg

SEQ ID NO: 2422720 - RNA, 12 nt, Human
ugagacuuccaa

SEQ ID NO: 2422721 - RNA, 21 nt, Human
ugagacuggauacugcccggg

SEQ ID NO: 2422722 - RNA, 18 nt, Human
ugagacugggucucgcuu

SEQ ID NO: 2422723 - RNA, 14 nt, Human
ugagacuugcucuc

SEQ ID NO: 2422724 - RNA, 20 nt, Human
ugagacuugcucucuggccu

SEQ ID NO: 2422725 - RNA, 13 nt, Human
ugagagaaaauaa

SEQ ID NO: 2422726 - RNA, 22 nt, Human
ugagagaaauauggaacuuaca

SEQ ID NO: 2422727 - RNA, 18 nt, Human
ugagagaauaagucaugu

SEQ ID NO: 2422728 - RNA, 15 nt, Human
ugagagaagggacac

SEQ ID NO: 2422729 - RNA, 14 nt, Human
ugagagaauggaaa

SEQ ID NO: 2422730 - RNA, 19 nt, Human
ugagagaauggaaaacaga

SEQ ID NO: 2422731 - RNA, 23 nt, Human
ugagagagaugggagcuccucuc

SEQ ID NO: 2422732 - RNA, 22 nt, Human
ugagagagaugggagcuccucu

SEQ ID NO: 2422733 - RNA, 16 nt, Human
ugagagcccagaggua

SEQ ID NO: 2422734 - RNA, 15 nt, Human
ugagagcccagaggu

SEQ ID NO: 2422735 - RNA, 22 nt, Human
ugagagacacacugaagaagca

SEQ ID NO: 2422736 - RNA, 21 nt, Human
ugagagacacacugaagaagc

SEQ ID NO: 2422737 - RNA, 14 nt, Human
ugagagaccaggca

SEQ ID NO: 2422738 - RNA, 24 nt, Human
ugagagaccaggcaaagcaaguga

SEQ ID NO: 2422739 - RNA, 23 nt, Human
ugagagaauggaaaacagacuca

SEQ ID NO: 2422740 - RNA, 18 nt, Human
ugagagaauuguaucauu

SEQ ID NO: 2422741 - RNA, 19 nt, Human
ugagagaauuguaucauuu

SEQ ID NO: 2422742 - RNA, 21 nt, Human
ugagagacccaaggaggaaaa

SEQ ID NO: 2422743 - RNA, 12 nt, Human
ugagagacuuuu

SEQ ID NO: 2422744 - RNA, 20 nt, Human
ugagagacccaaggaggaaa

SEQ ID NO: 2422745 - RNA, 21 nt, Human
ugagagagaugggagcuccuc

SEQ ID NO: 2422746 - RNA, 17 nt, Human
ugagagagaugggagcu

SEQ ID NO: 2422747 - RNA, 16 nt, Human
ugagagagaugggagc

SEQ ID NO: 2422748 - RNA, 14 nt, Human
ugagaggaaaucac

SEQ ID NO: 2422749 - RNA, 13 nt, Human
ugagaggaaauca

SEQ ID NO: 2422750 - RNA, 12 nt, Human
ugagaggaaauc

SEQ ID NO: 2422751 - RNA, 11 nt, Human
ugagaggaaau

SEQ ID NO: 2422752 - RNA, 16 nt, Human
ugagagcugcucugga

SEQ ID NO: 2422753 - RNA, 22 nt, Human
ugagagccccagcugacaugga

SEQ ID NO: 2422754 - RNA, 23 nt, Human
ugagagcgugcuccagccuggcu

SEQ ID NO: 2422755 - RNA, 17 nt, Human
ugagagcugugcaucag

SEQ ID NO: 2422756 - RNA, 10 nt, Human
ugagaggaaa

SEQ ID NO: 2422757 - RNA, 14 nt, Human
ugagagcugggugu

SEQ ID NO: 2422758 - RNA, 15 nt, Human
ugagagccccagcug

SEQ ID NO: 2422759 - RNA, 12 nt, Human
ugagagccccag

SEQ ID NO: 2422760 - RNA, 20 nt, Human
ugagagcccagagguaacag

SEQ ID NO: 2422761 - RNA, 19 nt, Human
ugagagcccagagguaaca

SEQ ID NO: 2422762 - RNA, 19 nt, Human
ugagagccccagcugacau

SEQ ID NO: 2422763 - RNA, 16 nt, Human
ugagagccccagcuga

SEQ ID NO: 2422764 - RNA, 23 nt, Human
ugagaugcuggagaagagaggag

SEQ ID NO: 2422765 - RNA, 20 nt, Human
ugagaugcuggagaagagag

SEQ ID NO: 2422766 - RNA, 19 nt, Human
ugagaugcuggagaagaga

SEQ ID NO: 2422767 - RNA, 18 nt, Human
ugagaugcuggagaagag

SEQ ID NO: 2422768 - RNA, 17 nt, Human
ugagaugcuggagaaga

SEQ ID NO: 2422769 - RNA, 16 nt, Human
ugagaugcuggagaag

SEQ ID NO: 2422770 - RNA, 15 nt, Human
ugagaugcuggagaa

SEQ ID NO: 2422771 - RNA, 13 nt, Human
ugagaugcuggag

SEQ ID NO: 2422772 - RNA, 15 nt, Human
ugagaggaugaaugu

SEQ ID NO: 2422773 - RNA, 19 nt, Human
ugagagcugcucuggaaaa

SEQ ID NO: 2422774 - RNA, 23 nt, Human
ugagaggaugaauguaugugcac

SEQ ID NO: 2422775 - RNA, 22 nt, Human
ugagaggaugaauguaugugca

SEQ ID NO: 2422776 - RNA, 20 nt, Human
ugagaggcaaugauuguuaa

SEQ ID NO: 2422777 - RNA, 17 nt, Human
ugagaggaaaucaccga

SEQ ID NO: 2422778 - RNA, 23 nt, Human
ugagaggacuuuucuuuguggcu

SEQ ID NO: 2422779 - RNA, 13 nt, Human
ugagaugugaaca

SEQ ID NO: 2422780 - RNA, 23 nt, Human
ugagauguagccccucuccugga

SEQ ID NO: 2422781 - RNA, 18 nt, Human
ugagauggagucucacuc

SEQ ID NO: 2422782 - RNA, 16 nt, Human
ugagauggacacacug

SEQ ID NO: 2422783 - RNA, 21 nt, Human
ugagaugcugguaauggccau

SEQ ID NO: 2422784 - RNA, 13 nt, Human
ugagauggacaca

SEQ ID NO: 2422785 - RNA, 21 nt, Human
ugagauggaacccuuuuggcc

SEQ ID NO: 2422786 - RNA, 18 nt, Human
ugagaugugaacacauca

SEQ ID NO: 2422787 - RNA, 19 nt, Human
ugagaugugaacacaucag

SEQ ID NO: 2422788 - RNA, 24 nt, Human
ugagaugugaacacaucagcuugc

SEQ ID NO: 2422789 - RNA, 18 nt, Human
ugagauugcaccacugca

SEQ ID NO: 2422790 - RNA, 13 nt, Human
ugagauuucaucu

SEQ ID NO: 2422791 - RNA, 14 nt, Human
ugagauguguucac

SEQ ID NO: 2422792 - RNA, 19 nt, Human
ugagauuacagaggaaguu

SEQ ID NO: 2422793 - RNA, 17 nt, Human
ugagauuagagggaggu

SEQ ID NO: 2422794 - RNA, 15 nt, Human
ugagauuauuuuaau

SEQ ID NO: 2422795 - RNA, 15 nt, Human
ugagauuacagagga

SEQ ID NO: 2422796 - RNA, 17 nt, Human
agagacuggagcaucug

SEQ ID NO: 2422797 - RNA, 14 nt, Human
agagacuggagcau

SEQ ID NO: 2422798 - RNA, 13 nt, Human
agagacuggagca

SEQ ID NO: 2422799 - RNA, 22 nt, Human
agagacucuggccuccacaguu

SEQ ID NO: 2422800 - RNA, 22 nt, Human
agagacuccuugagagaccagg

SEQ ID NO: 2422801 - RNA, 21 nt, Human
agagacuccuugagagaccag

SEQ ID NO: 2422802 - RNA, 11 nt, Human
agagacuccug

SEQ ID NO: 2422803 - RNA, 14 nt, Human
agagagaaaaacaa

SEQ ID NO: 2422804 - RNA, 13 nt, Human
agagagaaaaaca

SEQ ID NO: 2422805 - RNA, 19 nt, Human
agagacuuuuaaucagaca

SEQ ID NO: 2422806 - RNA, 16 nt, Human
agagacuuuuaaucag

SEQ ID NO: 2422807 - RNA, 17 nt, Human
agagacuuuuaaucaga

SEQ ID NO: 2422808 - RNA, 20 nt, Human
agagacuugggacauugccu

SEQ ID NO: 2422809 - RNA, 23 nt, Human
agagacugggaagauaggcucug

SEQ ID NO: 2422810 - RNA, 21 nt, Human
agagacuggagcaucugacuc

SEQ ID NO: 2422811 - RNA, 13 nt, Human
agagacugggaag

SEQ ID NO: 2422812 - RNA, 14 nt, Human
agagacuccugcag

SEQ ID NO: 2422813 - RNA, 13 nt, Human
agagacuccugca

SEQ ID NO: 2422814 - RNA, 12 nt, Human
agagacuccugc

SEQ ID NO: 2422815 - RNA, 13 nt, Human
agagaccucauca

SEQ ID NO: 2422816 - RNA, 20 nt, Human
agagaccuaccucagguugc

SEQ ID NO: 2422817 - RNA, 18 nt, Human
agagaccuaccucagguu

SEQ ID NO: 2422818 - RNA, 17 nt, Human
agagaccuaccucaggu

SEQ ID NO: 2422819 - RNA, 16 nt, Human
agagaccuaccucagg

SEQ ID NO: 2422820 - RNA, 23 nt, Human
agagaccguccucaccccugucc

SEQ ID NO: 2422821 - RNA, 15 nt, Human
agagaccuaccucag

SEQ ID NO: 2422822 - RNA, 15 nt, Human
agagaguugaaccua

SEQ ID NO: 2422823 - RNA, 21 nt, Human
agagagaaaacuuauuugagu

SEQ ID NO: 2422824 - RNA, 19 nt, Human
agagagaaaacuuauuuga

SEQ ID NO: 2422825 - RNA, 11 nt, Human
agagagaaaau

SEQ ID NO: 2422826 - RNA, 17 nt, Human
agagaguggcuccuccc

SEQ ID NO: 2422827 - RNA, 18 nt, Human
agagauccaaaagaagcc

SEQ ID NO: 2422828 - RNA, 19 nt, Human
agagaugaagagugagagg

SEQ ID NO: 2422829 - RNA, 20 nt, Human
agagauaugcagaaggaagg

SEQ ID NO: 2422830 - RNA, 17 nt, Human
agagaugacugaguccu

SEQ ID NO: 2422831 - RNA, 14 nt, Human
agagaugccuccac

SEQ ID NO: 2422832 - RNA, 12 nt, Human
agagaugccucc

SEQ ID NO: 2422833 - RNA, 12 nt, Human
agagaugaauua

SEQ ID NO: 2422834 - RNA, 18 nt, Human
agagaugacugaguccuc

SEQ ID NO: 2422835 - RNA, 16 nt, Human
agagaugccuccaccg

SEQ ID NO: 2422836 - RNA, 17 nt, Human
agagaugccuccaccgc

SEQ ID NO: 2422837 - RNA, 21 nt, Human
agagaugccuccaccgcugcc

SEQ ID NO: 2422838 - RNA, 23 nt, Human
agagaugccuccaccgcugccua

SEQ ID NO: 2422839 - RNA, 23 nt, Human
agagaccaucccugaaggccccg

SEQ ID NO: 2422840 - RNA, 22 nt, Human
agagaccaucccugaaggcccc

SEQ ID NO: 2422841 - RNA, 23 nt, Human
agagacccucugccaccagagac

SEQ ID NO: 2422842 - RNA, 21 nt, Human
agagacccucugccaccagag

SEQ ID NO: 2422843 - RNA, 19 nt, Human
agagacccucugccaccag

SEQ ID NO: 2422844 - RNA, 15 nt, Human
agagaccguccucac

SEQ ID NO: 2422845 - RNA, 22 nt, Human
agagaccguccucaccccuguc

SEQ ID NO: 2422846 - RNA, 17 nt, Human
agagacccuuguuugau

SEQ ID NO: 2422847 - RNA, 16 nt, Human
ugaaagagaaccaguu

SEQ ID NO: 2422848 - RNA, 18 nt, Human
ugaaagagaaccaguuuc

SEQ ID NO: 2422849 - RNA, 12 nt, Human
agagacccaagg

SEQ ID NO: 2422850 - RNA, 13 nt, Human
agagacccaagga

SEQ ID NO: 2422851 - RNA, 14 nt, Human
agagacccaaggag

SEQ ID NO: 2422852 - RNA, 16 nt, Human
agagacccaaggagga

SEQ ID NO: 2422853 - RNA, 21 nt, Human
agagacccaaggaggaaaaac

SEQ ID NO: 2422854 - RNA, 21 nt, Human
agagacccccggaacaagccu

SEQ ID NO: 2422855 - RNA, 21 nt, Human
agagaccaucccugaaggccc

SEQ ID NO: 2422856 - RNA, 19 nt, Human
agagaccaucccugaaggc

SEQ ID NO: 2422857 - RNA, 18 nt, Human
ugaaagaggaaugaagua

SEQ ID NO: 2422858 - RNA, 18 nt, Human
agagaccaucccugaagg

SEQ ID NO: 2422859 - RNA, 13 nt, Human
ugaaagagaacca

SEQ ID NO: 2422860 - RNA, 18 nt, Human
ugaaagacuguacaaagu

SEQ ID NO: 2422861 - RNA, 19 nt, Human
ugaaagacuguacaaagua

SEQ ID NO: 2422862 - RNA, 17 nt, Human
ugaaagaggaaugaagu

SEQ ID NO: 2422863 - RNA, 22 nt, Human
ugaaagacuguacaaaguagaa

SEQ ID NO: 2422864 - RNA, 22 nt, Human
ugaaagaaaauaccaaggaaca

SEQ ID NO: 2422865 - RNA, 20 nt, Human
ugaaacugcuuguuuccuag

SEQ ID NO: 2422866 - RNA, 22 nt, Human
ugaaacugcuuguuuccuagca

SEQ ID NO: 2422867 - RNA, 14 nt, Human
ugaaagaaacaguu

SEQ ID NO: 2422868 - RNA, 20 nt, Human
ugaaagaaacaguuaacuuu

SEQ ID NO: 2422869 - RNA, 22 nt, Human
ugaaagaaacaguuaacuuuca

SEQ ID NO: 2422870 - RNA, 20 nt, Human
ugaaagaaaauaugcaucua

SEQ ID NO: 2422871 - RNA, 16 nt, Human
ugaaagacuguacaaa

SEQ ID NO: 2422872 - RNA, 15 nt, Human
ugaaaacacauuuuu

SEQ ID NO: 2422873 - RNA, 17 nt, Human
ugaaaacacauuuuucu

SEQ ID NO: 2422874 - RNA, 19 nt, Human
ugaaaacacauuuuucuua

SEQ ID NO: 2422875 - RNA, 22 nt, Human
ugaaaaguuacuaccugucaag

SEQ ID NO: 2422876 - RNA, 20 nt, Human
ugaaaauaaaaagaucacuu

SEQ ID NO: 2422877 - RNA, 20 nt, Human
ugaaaacacauuuuucuuag

SEQ ID NO: 2422878 - RNA, 21 nt, Human
ugaaaauaaaaagaucacuuu

SEQ ID NO: 2422879 - RNA, 16 nt, Human
ugaaaauaagaauaga

SEQ ID NO: 2422880 - RNA, 17 nt, Human
ugaaaauauuuguauca

SEQ ID NO: 2422881 - RNA, 12 nt, Human
ugaaaauacaac

SEQ ID NO: 2422882 - RNA, 19 nt, Human
ugaaaauacaacuuaaaua

SEQ ID NO: 2422883 - RNA, 16 nt, Human
ugaaaacaagugcugg

SEQ ID NO: 2422884 - RNA, 15 nt, Human
ugaaaacaagugcug

SEQ ID NO: 2422885 - RNA, 14 nt, Human
ugaaaacaagugcu

SEQ ID NO: 2422886 - RNA, 13 nt, Human
ugaaaacaagugc

SEQ ID NO: 2422887 - RNA, 21 nt, Human
ugaaaacaagugcuggcacca

SEQ ID NO: 2422888 - RNA, 18 nt, Human
ugaaaacaagugcuggca

SEQ ID NO: 2422889 - RNA, 14 nt, Human
ugaaaacacauuuu

SEQ ID NO: 2422890 - RNA, 12 nt, Human
ugaaaacacauu

SEQ ID NO: 2422891 - RNA, 13 nt, Human
ugaaaacacauuu

SEQ ID NO: 2422892 - RNA, 19 nt, Human
ucuuuuuuuuauuccacau

SEQ ID NO: 2422893 - RNA, 22 nt, Human
ucuuuuuuuuaaugugcugugu

SEQ ID NO: 2422894 - RNA, 20 nt, Human
ucuuuuuuuuaaugugcugu

SEQ ID NO: 2422895 - RNA, 19 nt, Human
ucuuuuuuuuaaugugcug

SEQ ID NO: 2422896 - RNA, 16 nt, Human
ucuuuuuuugugaugu

SEQ ID NO: 2422897 - RNA, 14 nt, Human
ucuuuuuuugugau

SEQ ID NO: 2422898 - RNA, 12 nt, Human
ugaaaacaagug

SEQ ID NO: 2422899 - RNA, 20 nt, Human
ugaaaaauuuaagcauuguu

SEQ ID NO: 2422900 - RNA, 22 nt, Human
ugaaaaaaaaaaugcugaacau

SEQ ID NO: 2422901 - RNA, 20 nt, Human
ugaaaaaaaaaaugcugaac

SEQ ID NO: 2422902 - RNA, 21 nt, Human
ugaaaaaaaaaaugcugaaca

SEQ ID NO: 2422903 - RNA, 18 nt, Human
ugaaaaaaaaaaugcuga

SEQ ID NO: 2422904 - RNA, 23 nt, Human
ucuuuuuuuuuuuuuaaagacag

SEQ ID NO: 2422905 - RNA, 21 nt, Human
ugaaaauauuuguaucacaaa

SEQ ID NO: 2422906 - RNA, 22 nt, Human
ugaaaauauuuguaucacaaau

SEQ ID NO: 2422907 - RNA, 23 nt, Human
ugaaaauauuuuuuauauauaca

SEQ ID NO: 2422908 - RNA, 21 nt, Human
ugaaaauauuuuuuauauaua

SEQ ID NO: 2422909 - RNA, 18 nt, Human
ugaaaauagguauacagu

SEQ ID NO: 2422910 - RNA, 18 nt, Human
ugaaaauacuuaggaagg

SEQ ID NO: 2422911 - RNA, 13 nt, Human
ugaaaauaauugu

SEQ ID NO: 2422912 - RNA, 23 nt, Human
ugaaaauacaacuuaaauaauaa

SEQ ID NO: 2422913 - RNA, 18 nt, Human
ugaaaauguaagcuguuu

SEQ ID NO: 2422914 - RNA, 21 nt, Human
ugaaaaugguauuuucccccu

SEQ ID NO: 2422915 - RNA, 16 nt, Human
ugaaaaugguauuuuc

SEQ ID NO: 2422916 - RNA, 15 nt, Human
ugaaaaugguauuuu

SEQ ID NO: 2422917 - RNA, 21 nt, Human
ugaaaauggguuggugcuucu

SEQ ID NO: 2422918 - RNA, 17 nt, Human
ugaaaaugugcuauacu

SEQ ID NO: 2422919 - RNA, 19 nt, Human
ugaaaaugugcuauacugc

SEQ ID NO: 2422920 - RNA, 16 nt, Human
ugaaaaugucuugugu

SEQ ID NO: 2422921 - RNA, 19 nt, Human
ugaaaauguaagcuguuua

SEQ ID NO: 2422922 - RNA, 12 nt, Human
ugaaaaucaaau

SEQ ID NO: 2422923 - RNA, 18 nt, Human
ugaaaaugcaacaacaug

SEQ ID NO: 2422924 - RNA, 21 nt, Human
ugaaaaugcaacaacauguau

SEQ ID NO: 2422925 - RNA, 20 nt, Human
ugaaaaugcaacaacaugua

SEQ ID NO: 2422926 - RNA, 23 nt, Human
ugaaaaugcaacaacauguauaa

SEQ ID NO: 2422927 - RNA, 17 nt, Human
ugaaacuggauuaaacu

SEQ ID NO: 2422928 - RNA, 18 nt, Human
ugaaacuggauuaaacuu

SEQ ID NO: 2422929 - RNA, 13 nt, Human
ugaaagaaaauaa

SEQ ID NO: 2422930 - RNA, 20 nt, Human
ugaaaaugugcuauacugca

SEQ ID NO: 2422931 - RNA, 21 nt, Human
ugaaaaugugcuauacugcau

SEQ ID NO: 2422932 - RNA, 22 nt, Human
ugaaaaugugcuauacugcaua

SEQ ID NO: 2422933 - RNA, 13 nt, Human
ugaaaaugugaau

SEQ ID NO: 2422934 - RNA, 16 nt, Human
ugaaaauuaacacugc

SEQ ID NO: 2422935 - RNA, 15 nt, Human
ugaaaauuaacacug

SEQ ID NO: 2422936 - RNA, 13 nt, Human
ugaaaauguuuuu

SEQ ID NO: 2422937 - RNA, 14 nt, Human
ugaaaauuaacacu

SEQ ID NO: 2422938 - RNA, 14 nt, Human
ugaaaauuaacaug

SEQ ID NO: 2422939 - RNA, 18 nt, Human
ugaaacugcuuguuuccu

SEQ ID NO: 2422940 - RNA, 19 nt, Human
ugaaacugcuuguuuccua

SEQ ID NO: 2422941 - RNA, 18 nt, Human
ugaaaauuaacacugcuu

SEQ ID NO: 2422942 - RNA, 19 nt, Human
agagacacaagccuucggc

SEQ ID NO: 2422943 - RNA, 16 nt, Human
agagacacaagccuuc

SEQ ID NO: 2422944 - RNA, 15 nt, Human
agagacacaagccuu

SEQ ID NO: 2422945 - RNA, 16 nt, Human
agacuguaaugaaucu

SEQ ID NO: 2422946 - RNA, 18 nt, Human
agacuuuuaaucagacaa

SEQ ID NO: 2422947 - RNA, 19 nt, Human
agacuuuggaaagaguagg

SEQ ID NO: 2422948 - RNA, 12 nt, Human
agacuuuuauga

SEQ ID NO: 2422949 - RNA, 15 nt, Human
agacuuuuccaaccc

SEQ ID NO: 2422950 - RNA, 15 nt, Human
agacuuuuaugauac

SEQ ID NO: 2422951 - RNA, 20 nt, Human
agacugggcugagggagccu

SEQ ID NO: 2422952 - RNA, 15 nt, Human
agacugggcugaggg

SEQ ID NO: 2422953 - RNA, 16 nt, Human
agacugggcugaggga

SEQ ID NO: 2422954 - RNA, 12 nt, Human
agacugggcuga

SEQ ID NO: 2422955 - RNA, 14 nt, Human
agacugggcugagg

SEQ ID NO: 2422956 - RNA, 20 nt, Human
agacugguuccauggccucu

SEQ ID NO: 2422957 - RNA, 15 nt, Human
agacuuuggaaagag

SEQ ID NO: 2422958 - RNA, 17 nt, Human
agacuuuggaaagacuu

SEQ ID NO: 2422959 - RNA, 15 nt, Human
agacuuuggaaagac

SEQ ID NO: 2422960 - RNA, 22 nt, Human
agacugguuuauccacccacaa

SEQ ID NO: 2422961 - RNA, 18 nt, Human
agacuggggggcuugaaa

SEQ ID NO: 2422962 - RNA, 18 nt, Human
agacuggugagcagacug

SEQ ID NO: 2422963 - RNA, 14 nt, Human
agacuguaaugaau

SEQ ID NO: 2422964 - RNA, 23 nt, Human
agacuggugagcagacugguggg

SEQ ID NO: 2422965 - RNA, 20 nt, Human
ucuuuguacagacaacaaac

SEQ ID NO: 2422966 - RNA, 15 nt, Human
ucuuuguacagacaa

SEQ ID NO: 2422967 - RNA, 14 nt, Human
ucuuuguacagaca

SEQ ID NO: 2422968 - RNA, 16 nt, Human
ucuuuguaaugaaaac

SEQ ID NO: 2422969 - RNA, 21 nt, Human
agagacaccugcaccuccccc

SEQ ID NO: 2422970 - RNA, 22 nt, Human
agagacaccugcaccucccccc

SEQ ID NO: 2422971 - RNA, 14 nt, Human
agagacagaaagca

SEQ ID NO: 2422972 - RNA, 15 nt, Human
agagacagaaagcag

SEQ ID NO: 2422973 - RNA, 16 nt, Human
agagacacacugaaga

SEQ ID NO: 2422974 - RNA, 13 nt, Human
agagacaccugca

SEQ ID NO: 2422975 - RNA, 14 nt, Human
agagacaccugcac

SEQ ID NO: 2422976 - RNA, 15 nt, Human
agagacaccugcacc

SEQ ID NO: 2422977 - RNA, 16 nt, Human
agagacaccugcaccu

SEQ ID NO: 2422978 - RNA, 18 nt, Human
agagacaccugcaccucc

SEQ ID NO: 2422979 - RNA, 19 nt, Human
agagacaccugcaccuccc

SEQ ID NO: 2422980 - RNA, 20 nt, Human
agagacaccugcaccucccc

SEQ ID NO: 2422981 - RNA, 13 nt, Human
ucuuugucuaaaa

SEQ ID NO: 2422982 - RNA, 23 nt, Human
ucuuuguaaugucaccaccuucc

SEQ ID NO: 2422983 - RNA, 15 nt, Human
ucuuugucuaaaaca

SEQ ID NO: 2422984 - RNA, 19 nt, Human
ucuuugucuaaaacaauaa

SEQ ID NO: 2422985 - RNA, 20 nt, Human
ucuuugucuaaaacaauaaa

SEQ ID NO: 2422986 - RNA, 14 nt, Human
ucuuuguggcuucc

SEQ ID NO: 2422987 - RNA, 13 nt, Human
ucuuuguggccaa

SEQ ID NO: 2422988 - RNA, 14 nt, Human
ucuuuguggccaag

SEQ ID NO: 2422989 - RNA, 22 nt, Human
ucuuuguggccaaggagcugcu

SEQ ID NO: 2422990 - RNA, 23 nt, Human
ucuuuguggccaaggagcugcua

SEQ ID NO: 2422991 - RNA, 16 nt, Human
ucuuugugcuuuggcu

SEQ ID NO: 2422992 - RNA, 22 nt, Human
ucuuuuuucuaaaguaaaaaca

SEQ ID NO: 2422993 - RNA, 21 nt, Human
ucuuuuuucuaaaguaaaaac

SEQ ID NO: 2422994 - RNA, 23 nt, Human
ucuuuuuucauggacacuuugaa

SEQ ID NO: 2422995 - RNA, 14 nt, Human
ucuuuuuucacaaa

SEQ ID NO: 2422996 - RNA, 12 nt, Human
ucuuuccuccuu

SEQ ID NO: 2422997 - RNA, 23 nt, Human
ucuuuccuaaggcugcaagguuu

SEQ ID NO: 2422998 - RNA, 19 nt, Human
ucuuuccuagauggcaguc

SEQ ID NO: 2422999 - RNA, 17 nt, Human
ucuuuccuaaggcugca

SEQ ID NO: 2423000 - RNA, 11 nt, Human
ucuuuccucuu

SEQ ID NO: 2423001 - RNA, 15 nt, Human
ucuuuccuccuucca

SEQ ID NO: 2423002 - RNA, 22 nt, Human
ucuuuccuagauggcagucacu

SEQ ID NO: 2423003 - RNA, 14 nt, Human
ucuuuccuccuucc

SEQ ID NO: 2423004 - RNA, 12 nt, Human
ucuuuccugagg

SEQ ID NO: 2423005 - RNA, 22 nt, Human
ucuuucuaguucagcugcccca

SEQ ID NO: 2423006 - RNA, 22 nt, Human
ucuuucuaguggucuuuguaag

SEQ ID NO: 2423007 - RNA, 21 nt, Human
ucuuucuaguggucuuuguaa

SEQ ID NO: 2423008 - RNA, 20 nt, Human
ucuuucuaguggucuuugua

SEQ ID NO: 2423009 - RNA, 17 nt, Human
ucuuucuaguggucuuu

SEQ ID NO: 2423010 - RNA, 16 nt, Human
ucuuucuaguggucuu

SEQ ID NO: 2423011 - RNA, 15 nt, Human
ucuuucuaguggucu

SEQ ID NO: 2423012 - RNA, 19 nt, Human
ucuuucuacucugaacuaa

SEQ ID NO: 2423013 - RNA, 16 nt, Human
ucuuucuacucugaac

SEQ ID NO: 2423014 - RNA, 14 nt, Human
ucuuucuacaguau

SEQ ID NO: 2423015 - RNA, 23 nt, Human
ucuuuccucuuccccuugcccuu

SEQ ID NO: 2423016 - RNA, 22 nt, Human
ucuuuccucuuccccuugcccu

SEQ ID NO: 2423017 - RNA, 20 nt, Human
ucuuuccucuuccccuugcc

SEQ ID NO: 2423018 - RNA, 19 nt, Human
ucuuucuaaugugugaauc

SEQ ID NO: 2423019 - RNA, 22 nt, Human
agacuccaaagaaauguaaggg

SEQ ID NO: 2423020 - RNA, 12 nt, Human
agacuccaccaa

SEQ ID NO: 2423021 - RNA, 16 nt, Human
agacuccaccaagccu

SEQ ID NO: 2423022 - RNA, 15 nt, Human
ucuuucuauuccaaa

SEQ ID NO: 2423023 - RNA, 19 nt, Human
ucuuucuaguucagcugcc

SEQ ID NO: 2423024 - RNA, 18 nt, Human
ucuuucuccuuagucuuc

SEQ ID NO: 2423025 - RNA, 21 nt, Human
ucuuucuccuuagucuucuca

SEQ ID NO: 2423026 - RNA, 16 nt, Human
ucuuucucuacuuuga

SEQ ID NO: 2423027 - RNA, 15 nt, Human
ucuuucucuccuuuc

SEQ ID NO: 2423028 - RNA, 24 nt, Human
ucuuucuccuuagucuucucauag

SEQ ID NO: 2423029 - RNA, 15 nt, Human
ucuuuaaugucacag

SEQ ID NO: 2423030 - RNA, 19 nt, Human
agacaggagggcaagggcc

SEQ ID NO: 2423031 - RNA, 14 nt, Human
agacaggagggcaa

SEQ ID NO: 2423032 - RNA, 22 nt, Human
agacaggcaagcaccuccugcc

SEQ ID NO: 2423033 - RNA, 18 nt, Human
agacaggaccugacuauu

SEQ ID NO: 2423034 - RNA, 16 nt, Human
agacaggaccuaggau

SEQ ID NO: 2423035 - RNA, 14 nt, Human
agacaggagaaaug

SEQ ID NO: 2423036 - RNA, 20 nt, Human
agacaggcaagcaccuccug

SEQ ID NO: 2423037 - RNA, 19 nt, Human
ucuuuaaugucacaggcag

SEQ ID NO: 2423038 - RNA, 18 nt, Human
ucuuuaaugucacaggca

SEQ ID NO: 2423039 - RNA, 13 nt, Human
ucuuuaaugcuuu

SEQ ID NO: 2423040 - RNA, 16 nt, Human
ucuuuaaugcuuuuau

SEQ ID NO: 2423041 - RNA, 11 nt, Human
ucuuuaaugcu

SEQ ID NO: 2423042 - RNA, 23 nt, Human
agacaggagggcaagggccaugc

SEQ ID NO: 2423043 - RNA, 20 nt, Human
ucuuucccugcuuaaugaaa

SEQ ID NO: 2423044 - RNA, 18 nt, Human
agacuggcuuuuauuaau

SEQ ID NO: 2423045 - RNA, 11 nt, Human
agacuggcuuu

SEQ ID NO: 2423046 - RNA, 14 nt, Human
agacuggcuggcug

SEQ ID NO: 2423047 - RNA, 20 nt, Human
agacuggcuggcugcaguga

SEQ ID NO: 2423048 - RNA, 23 nt, Human
agacuggcuuuuauuaaugcacu

SEQ ID NO: 2423049 - RNA, 22 nt, Human
agacuggcuuuuauuaaugcac

SEQ ID NO: 2423050 - RNA, 21 nt, Human
agacugggaagauaggcucug

SEQ ID NO: 2423051 - RNA, 22 nt, Human
agacugggaagauaggcucugc

SEQ ID NO: 2423052 - RNA, 23 nt, Human
agacugggaagauaggcucugca

SEQ ID NO: 2423053 - RNA, 23 nt, Human
agacuggcacaguuuucugagaa

SEQ ID NO: 2423054 - RNA, 20 nt, Human
agacuggcacaguuuucuga

SEQ ID NO: 2423055 - RNA, 21 nt, Human
agacuggcacaguuuucugag

SEQ ID NO: 2423056 - RNA, 14 nt, Human
agacucucuuagga

SEQ ID NO: 2423057 - RNA, 16 nt, Human
agacucugaaaucuca

SEQ ID NO: 2423058 - RNA, 14 nt, Human
agacucuggucuuc

SEQ ID NO: 2423059 - RNA, 20 nt, Human
agacucugaaaucucagaau

SEQ ID NO: 2423060 - RNA, 19 nt, Human
agacucuggucuucuuugg

SEQ ID NO: 2423061 - RNA, 12 nt, Human
ucuuucucuccu

SEQ ID NO: 2423062 - RNA, 21 nt, Human
agacuccagcuggguuggaaa

SEQ ID NO: 2423063 - RNA, 16 nt, Human
agacucccaagcugga

SEQ ID NO: 2423064 - RNA, 17 nt, Human
agacucccauuccugaa

SEQ ID NO: 2423065 - RNA, 19 nt, Human
agacucccauuccugaaga

SEQ ID NO: 2423066 - RNA, 23 nt, Human
agacucccauuccugaagaacca

SEQ ID NO: 2423067 - RNA, 11 nt, Human
agacuccuagg

SEQ ID NO: 2423068 - RNA, 18 nt, Human
agacuccgucucaaggaa

SEQ ID NO: 2423069 - RNA, 22 nt, Human
agacuccuaggcaggacaugcu

SEQ ID NO: 2423070 - RNA, 14 nt, Human
agacuccuaggcag

SEQ ID NO: 2423071 - RNA, 14 nt, Human
agacuccuccucca

SEQ ID NO: 2423072 - RNA, 21 nt, Human
agacucuaccagacuguguau

SEQ ID NO: 2423073 - RNA, 13 nt, Human
agacucuaccaga

SEQ ID NO: 2423074 - RNA, 19 nt, Human
agacucuacccauauuaca

SEQ ID NO: 2423075 - RNA, 21 nt, Human
agacucuaggacauaaauuag

SEQ ID NO: 2423076 - RNA, 13 nt, Human
agacuccugcagg

SEQ ID NO: 2423077 - RNA, 22 nt, Human
agacuccugaggacagcugucc

SEQ ID NO: 2423078 - RNA, 20 nt, Human
agacuccugaggacagcugu

SEQ ID NO: 2423079 - RNA, 15 nt, Human
agacuccugaggaca

SEQ ID NO: 2423080 - RNA, 23 nt, Human
agacuccuccuccaaaggccccc

SEQ ID NO: 2423081 - RNA, 20 nt, Human
agaguaauccaagcaaaugu

SEQ ID NO: 2423082 - RNA, 21 nt, Human
ugaagauucuuucccaauuca

SEQ ID NO: 2423083 - RNA, 18 nt, Human
agaguaauccaagcaaau

SEQ ID NO: 2423084 - RNA, 12 nt, Human
agagguuuuucu

SEQ ID NO: 2423085 - RNA, 22 nt, Human
agagguuuuucuuaaauaauaa

SEQ ID NO: 2423086 - RNA, 18 nt, Human
agaguaaaggaaaugauu

SEQ ID NO: 2423087 - RNA, 15 nt, Human
agaguaaaaacugaa

SEQ ID NO: 2423088 - RNA, 16 nt, Human
agagguucaaagauau

SEQ ID NO: 2423089 - RNA, 19 nt, Human
agagguucaaagauauuuu

SEQ ID NO: 2423090 - RNA, 20 nt, Human
agagguucaaagauauuuug

SEQ ID NO: 2423091 - RNA, 23 nt, Human
agagggauaagguaccuuucaca

SEQ ID NO: 2423092 - RNA, 14 nt, Human
agagggagguguuu

SEQ ID NO: 2423093 - RNA, 22 nt, Human
agagggaggucacuggaaaggg

SEQ ID NO: 2423094 - RNA, 20 nt, Human
agagggaggucacuggaaag

SEQ ID NO: 2423095 - RNA, 19 nt, Human
agagguuuuguuguuuuau

SEQ ID NO: 2423096 - RNA, 16 nt, Human
agagguuuuguuguuu

SEQ ID NO: 2423097 - RNA, 22 nt, Human
agagggaugaggugcugggagg

SEQ ID NO: 2423098 - RNA, 23 nt, Human
agagggaugaggugcugggaggg

SEQ ID NO: 2423099 - RNA, 15 nt, Human
agagggagugacaga

SEQ ID NO: 2423100 - RNA, 15 nt, Human
agagggagguaagga

SEQ ID NO: 2423101 - RNA, 16 nt, Human
agaggcuggaggcagg

SEQ ID NO: 2423102 - RNA, 13 nt, Human
agagguucaaaga

SEQ ID NO: 2423103 - RNA, 20 nt, Human
agagggagugacagaggcag

SEQ ID NO: 2423104 - RNA, 16 nt, Human
agaggcugaggcuggc

SEQ ID NO: 2423105 - RNA, 19 nt, Human
agaggcugaggcuggcaca

SEQ ID NO: 2423106 - RNA, 13 nt, Human
agaggcugcagaa

SEQ ID NO: 2423107 - RNA, 21 nt, Human
agaggcugaggcuggcacagg

SEQ ID NO: 2423108 - RNA, 22 nt, Human
agaggcugcagaaggccaagaa

SEQ ID NO: 2423109 - RNA, 21 nt, Human
agaggcugcagaaggccaaga

SEQ ID NO: 2423110 - RNA, 16 nt, Human
agaggcugcagccagg

SEQ ID NO: 2423111 - RNA, 22 nt, Human
agaggcugccucucccaucacu

SEQ ID NO: 2423112 - RNA, 18 nt, Human
agagcuguucacagccag

SEQ ID NO: 2423113 - RNA, 19 nt, Human
agagcuguucacagccaga

SEQ ID NO: 2423114 - RNA, 16 nt, Human
agagcuguggagaggg

SEQ ID NO: 2423115 - RNA, 17 nt, Human
agagcuguauuaagcca

SEQ ID NO: 2423116 - RNA, 19 nt, Human
agagcuguauuaagccacu

SEQ ID NO: 2423117 - RNA, 17 nt, Human
agagcuggugucugauu

SEQ ID NO: 2423118 - RNA, 16 nt, Human
agagcugguugggaag

SEQ ID NO: 2423119 - RNA, 22 nt, Human
agagcugguugggaagacaugg

SEQ ID NO: 2423120 - RNA, 11 nt, Human
agagcuggugu

SEQ ID NO: 2423121 - RNA, 15 nt, Human
agagcuggugucuga

SEQ ID NO: 2423122 - RNA, 23 nt, Human
agaggcagccccauucugccugc

SEQ ID NO: 2423123 - RNA, 21 nt, Human
agaggcagggucucacucugu

SEQ ID NO: 2423124 - RNA, 22 nt, Human
agaggcagccccauucugccug

SEQ ID NO: 2423125 - RNA, 21 nt, Human
agaggcagccccauucugccu

SEQ ID NO: 2423126 - RNA, 13 nt, Human
agaggccugcccg

SEQ ID NO: 2423127 - RNA, 22 nt, Human
agaggccugccuccagggcugg

SEQ ID NO: 2423128 - RNA, 21 nt, Human
agaggccugccuccagggcug

SEQ ID NO: 2423129 - RNA, 12 nt, Human
agaggccugccc

SEQ ID NO: 2423130 - RNA, 22 nt, Human
agaggccugaggaugagcugga

SEQ ID NO: 2423131 - RNA, 20 nt, Human
agaggccugccuccagggcu

SEQ ID NO: 2423132 - RNA, 13 nt, Human
agaggccugagga

SEQ ID NO: 2423133 - RNA, 24 nt, Human
agaggcccucuggaguggccacua

SEQ ID NO: 2423134 - RNA, 22 nt, Human
agaggcccucuggaguggccac

SEQ ID NO: 2423135 - RNA, 23 nt, Human
agaggcccucuggaguggccacu

SEQ ID NO: 2423136 - RNA, 14 nt, Human
agaggccagccugg

SEQ ID NO: 2423137 - RNA, 23 nt, Human
agaggccagccccacccaggagg

SEQ ID NO: 2423138 - RNA, 21 nt, Human
agaggcccucuggaguggcca

SEQ ID NO: 2423139 - RNA, 15 nt, Human
agaggccagccuggc

SEQ ID NO: 2423140 - RNA, 16 nt, Human
agaggccagccccacc

SEQ ID NO: 2423141 - RNA, 17 nt, Human
agaggccagccccaccc

SEQ ID NO: 2423142 - RNA, 18 nt, Human
agaggccagccccaccca

SEQ ID NO: 2423143 - RNA, 21 nt, Human
agaggccagccccacccagga

SEQ ID NO: 2423144 - RNA, 13 nt, Human
agaggccagaggc

SEQ ID NO: 2423145 - RNA, 13 nt, Human
agaggccaaugcc

SEQ ID NO: 2423146 - RNA, 16 nt, Human
ugaaguaauaugcaca

SEQ ID NO: 2423147 - RNA, 20 nt, Human
ugaaguaauaugcacacauu

SEQ ID NO: 2423148 - RNA, 21 nt, Human
ugaaguaauaugcacacauuu

SEQ ID NO: 2423149 - RNA, 22 nt, Human
ugaaguaauaugcacacauuuu

SEQ ID NO: 2423150 - RNA, 15 nt, Human
ugaaguaauaugcac

SEQ ID NO: 2423151 - RNA, 14 nt, Human
ugaaguaagcaaag

SEQ ID NO: 2423152 - RNA, 13 nt, Human
ugaaguaagcaaa

SEQ ID NO: 2423153 - RNA, 15 nt, Human
ugaagggcaggugcu

SEQ ID NO: 2423154 - RNA, 19 nt, Human
ugaagggcaggugcuucag

SEQ ID NO: 2423155 - RNA, 12 nt, Human
ugaagggccaga

SEQ ID NO: 2423156 - RNA, 14 nt, Human
ugaagggccagagc

SEQ ID NO: 2423157 - RNA, 16 nt, Human
ugaagggagagccagc

SEQ ID NO: 2423158 - RNA, 17 nt, Human
ugaagggagagccagcu

SEQ ID NO: 2423159 - RNA, 11 nt, Human
ugaagggaggu

SEQ ID NO: 2423160 - RNA, 19 nt, Human
ugaagggagagccagcucc

SEQ ID NO: 2423161 - RNA, 21 nt, Human
ugaagggagguggggaugaga

SEQ ID NO: 2423162 - RNA, 16 nt, Human
ugaagggaggugggga

SEQ ID NO: 2423163 - RNA, 24 nt, Human
ugaagggauuuuagucacacgugg

SEQ ID NO: 2423164 - RNA, 15 nt, Human
ugaagggccagagcc

SEQ ID NO: 2423165 - RNA, 16 nt, Human
ugaagggccagagcca

SEQ ID NO: 2423166 - RNA, 17 nt, Human
ugaagggccagagccag

SEQ ID NO: 2423167 - RNA, 18 nt, Human
ugaagguuucugaaaauu

SEQ ID NO: 2423168 - RNA, 16 nt, Human
ugaagguuucugaaaa

SEQ ID NO: 2423169 - RNA, 20 nt, Human
ugaagauuuaccacuugugu

SEQ ID NO: 2423170 - RNA, 17 nt, Human
ugaagauuuaccacuug

SEQ ID NO: 2423171 - RNA, 20 nt, Human
ugaagggaccuugaagggua

SEQ ID NO: 2423172 - RNA, 14 nt, Human
ugaagggagagcca

SEQ ID NO: 2423173 - RNA, 18 nt, Human
ugaagggaaaggauauuu

SEQ ID NO: 2423174 - RNA, 21 nt, Human
ugaagggaaaggauauuuucu

SEQ ID NO: 2423175 - RNA, 22 nt, Human
ugaagggaaaggauauuuucuu

SEQ ID NO: 2423176 - RNA, 14 nt, Human
ugaagcaaacacau

SEQ ID NO: 2423177 - RNA, 13 nt, Human
ugaagcaaacaca

SEQ ID NO: 2423178 - RNA, 23 nt, Human
ugaauaauguaagacaaauaugu

SEQ ID NO: 2423179 - RNA, 20 nt, Human
ugaauaaugguaccagauaa

SEQ ID NO: 2423180 - RNA, 14 nt, Human
ugaauaauuuccca

SEQ ID NO: 2423181 - RNA, 15 nt, Human
ugaauaauuucccaa

SEQ ID NO: 2423182 - RNA, 13 nt, Human
ugaauaauuucuu

SEQ ID NO: 2423183 - RNA, 22 nt, Human
ugaauaauuucccaauuaggaa

SEQ ID NO: 2423184 - RNA, 17 nt, Human
ugaauaagccauucuga

SEQ ID NO: 2423185 - RNA, 22 nt, Human
ugaauaagccauucugacucau

SEQ ID NO: 2423186 - RNA, 18 nt, Human
ugaauaaugguaccagau

SEQ ID NO: 2423187 - RNA, 13 nt, Human
ugaauaauacagu

SEQ ID NO: 2423188 - RNA, 15 nt, Human
ugaauacaaagugau

SEQ ID NO: 2423189 - RNA, 20 nt, Human
ugaauacaaacaauggaaac

SEQ ID NO: 2423190 - RNA, 17 nt, Human
ugaauacaaacaaugga

SEQ ID NO: 2423191 - RNA, 16 nt, Human
ugaauacaaacaaugg

SEQ ID NO: 2423192 - RNA, 15 nt, Human
ugaauacaaacaaug

SEQ ID NO: 2423193 - RNA, 23 nt, Human
ugaauacaaacaauggaaacuga

SEQ ID NO: 2423194 - RNA, 22 nt, Human
ugaauacaaacaauggaaacug

SEQ ID NO: 2423195 - RNA, 18 nt, Human
ugaauauuuaguguucau

SEQ ID NO: 2423196 - RNA, 21 nt, Human
ugaauauuuguuauguagaua

SEQ ID NO: 2423197 - RNA, 21 nt, Human
ugaauauuuccauauggauuu

SEQ ID NO: 2423198 - RNA, 19 nt, Human
ugaauauuuauauuucacu

SEQ ID NO: 2423199 - RNA, 19 nt, Human
ugaauacagggcaugcauu

SEQ ID NO: 2423200 - RNA, 20 nt, Human
ugaauauuuauauuucacua

SEQ ID NO: 2423201 - RNA, 13 nt, Human
ugaaucaaagaca

SEQ ID NO: 2423202 - RNA, 13 nt, Human
ugaagucacacag

SEQ ID NO: 2423203 - RNA, 20 nt, Human
ugaaguauuuugcuggaaua

SEQ ID NO: 2423204 - RNA, 15 nt, Human
ugaauaaaugucuug

SEQ ID NO: 2423205 - RNA, 19 nt, Human
ugaauaaauucuauaggaa

SEQ ID NO: 2423206 - RNA, 21 nt, Human
ugaauaaauucuauaggaaca

SEQ ID NO: 2423207 - RNA, 15 nt, Human
ugaauaaccacuuaa

SEQ ID NO: 2423208 - RNA, 12 nt, Human
ugaauaauacag

SEQ ID NO: 2423209 - RNA, 17 nt, Human
ugaaguacucauacaug

SEQ ID NO: 2423210 - RNA, 15 nt, Human
ugaaguaagcaaaga

SEQ ID NO: 2423211 - RNA, 14 nt, Human
ugaaguaaugaauu

SEQ ID NO: 2423212 - RNA, 20 nt, Human
ugaaguaaugaauuuuuaug

SEQ ID NO: 2423213 - RNA, 17 nt, Human
ugaaguauuucucacuc

SEQ ID NO: 2423214 - RNA, 16 nt, Human
ugaaguauauaauggu

SEQ ID NO: 2423215 - RNA, 22 nt, Human
ugaaguauauaaugguuucaaa

SEQ ID NO: 2423216 - RNA, 15 nt, Human
ugaaguaguuuguau

SEQ ID NO: 2423217 - RNA, 14 nt, Human
ugaaguaguuugua

SEQ ID NO: 2423218 - RNA, 15 nt, Human
ugaaguauacuguau

SEQ ID NO: 2423219 - RNA, 18 nt, Human
ugaaguacccguucacau

SEQ ID NO: 2423220 - RNA, 13 nt, Human
ugaaguacauauu

SEQ ID NO: 2423221 - RNA, 20 nt, Human
ugaaguacauauuaggaaaa

SEQ ID NO: 2423222 - RNA, 23 nt, Human
ugaaguacccguucacauuuuug

SEQ ID NO: 2423223 - RNA, 22 nt, Human
ugaagacaaugacuuacuguac

SEQ ID NO: 2423224 - RNA, 23 nt, Human
ugaagacaaugacuuacuguaca

SEQ ID NO: 2423225 - RNA, 13 nt, Human
ugaagacagagcu

SEQ ID NO: 2423226 - RNA, 16 nt, Human
agagcuggugcccgga

SEQ ID NO: 2423227 - RNA, 18 nt, Human
ugaagaacugcaggcccu

SEQ ID NO: 2423228 - RNA, 22 nt, Human
ugaagaagcuaaauccuuuacu

SEQ ID NO: 2423229 - RNA, 21 nt, Human
ugaagaaucuguuucccagca

SEQ ID NO: 2423230 - RNA, 21 nt, Human
ugaagacaaugacuuacugua

SEQ ID NO: 2423231 - RNA, 21 nt, Human
ugaacucagccaagcacagug

SEQ ID NO: 2423232 - RNA, 20 nt, Human
ugaacucagccaagcacagu

SEQ ID NO: 2423233 - RNA, 19 nt, Human
ugaacucagccaagcacag

SEQ ID NO: 2423234 - RNA, 18 nt, Human
ugaacucagccaagcaca

SEQ ID NO: 2423235 - RNA, 17 nt, Human
ugaacucagccaagcac

SEQ ID NO: 2423236 - RNA, 16 nt, Human
ugaacucagccaagca

SEQ ID NO: 2423237 - RNA, 15 nt, Human
ugaacucagccaagc

SEQ ID NO: 2423238 - RNA, 14 nt, Human
ugaacucagccaag

SEQ ID NO: 2423239 - RNA, 13 nt, Human
ugaacucagccaa

SEQ ID NO: 2423240 - RNA, 22 nt, Human
ugaacucagaucugucugauag

SEQ ID NO: 2423241 - RNA, 18 nt, Human
ugaacucagaucugucug

SEQ ID NO: 2423242 - RNA, 21 nt, Human
ugaacuacgcuugcucauuuu

SEQ ID NO: 2423243 - RNA, 20 nt, Human
ugaacuaccuugguuccccc

SEQ ID NO: 2423244 - RNA, 20 nt, Human
ugaacucacuuuccuccuga

SEQ ID NO: 2423245 - RNA, 15 nt, Human
ugaacuccugaccuc

SEQ ID NO: 2423246 - RNA, 23 nt, Human
ugaacucagccaagcacaguggu

SEQ ID NO: 2423247 - RNA, 22 nt, Human
ugaacucagccaagcacagugg

SEQ ID NO: 2423248 - RNA, 13 nt, Human
ugaagaacaguaa

SEQ ID NO: 2423249 - RNA, 11 nt, Human
ugaacuccugg

SEQ ID NO: 2423250 - RNA, 22 nt, Human
ugaagaagcaccaaucaugaau

SEQ ID NO: 2423251 - RNA, 17 nt, Human
ugaagaacugcaggccc

SEQ ID NO: 2423252 - RNA, 16 nt, Human
ugaagaacugcaggcc

SEQ ID NO: 2423253 - RNA, 15 nt, Human
ugaagaacugcaggc

SEQ ID NO: 2423254 - RNA, 14 nt, Human
ugaagaacugcagg

SEQ ID NO: 2423255 - RNA, 13 nt, Human
ugaagaacugagg

SEQ ID NO: 2423256 - RNA, 19 nt, Human
ugaagaacugaggaggaaa

SEQ ID NO: 2423257 - RNA, 19 nt, Human
ugaagaaccagucccccca

SEQ ID NO: 2423258 - RNA, 20 nt, Human
ugaagaaccaguccccccac

SEQ ID NO: 2423259 - RNA, 13 nt, Human
ugaagaacaugug

SEQ ID NO: 2423260 - RNA, 14 nt, Human
ugaagaacauguga

SEQ ID NO: 2423261 - RNA, 15 nt, Human
ugaagaacaguaacu

SEQ ID NO: 2423262 - RNA, 20 nt, Human
ugaagaacaguaacugccau

SEQ ID NO: 2423263 - RNA, 16 nt, Human
ugaacggggagaaaag

SEQ ID NO: 2423264 - RNA, 13 nt, Human
ugaacggggagaa

SEQ ID NO: 2423265 - RNA, 22 nt, Human
ugaaccgaggggcucaggaaaa

SEQ ID NO: 2423266 - RNA, 15 nt, Human
ugaacggggagaaaa

SEQ ID NO: 2423267 - RNA, 15 nt, Human
ugaacggugagcauu

SEQ ID NO: 2423268 - RNA, 17 nt, Human
ugaacuaaacuuucaca

SEQ ID NO: 2423269 - RNA, 19 nt, Human
ugaacuaaacuuucacacc

SEQ ID NO: 2423270 - RNA, 18 nt, Human
ugaacucacuuuccuccu

SEQ ID NO: 2423271 - RNA, 16 nt, Human
ugaacuaauaaaagca

SEQ ID NO: 2423272 - RNA, 22 nt, Human
ugaacccauauuuguacaccaa

SEQ ID NO: 2423273 - RNA, 18 nt, Human
ugaacccgggaggcagag

SEQ ID NO: 2423274 - RNA, 22 nt, Human
ugaacccgggacgcagggguug

SEQ ID NO: 2423275 - RNA, 14 nt, Human
ugaacccccaugau

SEQ ID NO: 2423276 - RNA, 13 nt, Human
ugaacccugugcu

SEQ ID NO: 2423277 - RNA, 13 nt, Human
ugaacccaggagg

SEQ ID NO: 2423278 - RNA, 14 nt, Human
ugaacccaggaggu

SEQ ID NO: 2423279 - RNA, 19 nt, Human
ugaacccauuuugagugac

SEQ ID NO: 2423280 - RNA, 19 nt, Human
ugaacccaggagguggagg

SEQ ID NO: 2423281 - RNA, 15 nt, Human
ugaacccugugcugg

SEQ ID NO: 2423282 - RNA, 14 nt, Human
ugaacccugugcug

SEQ ID NO: 2423283 - RNA, 13 nt, Human
ugaacccuugcuu

SEQ ID NO: 2423284 - RNA, 20 nt, Human
ugaaccgaggggcucaggaa

SEQ ID NO: 2423285 - RNA, 19 nt, Human
ugaacccugugcugguguc

SEQ ID NO: 2423286 - RNA, 15 nt, Human
ugaacccuugcuugc

SEQ ID NO: 2423287 - RNA, 16 nt, Human
ugaaccacuucccuca

SEQ ID NO: 2423288 - RNA, 15 nt, Human
ugaaccacuucccuc

SEQ ID NO: 2423289 - RNA, 14 nt, Human
ugaaccacuucccu

SEQ ID NO: 2423290 - RNA, 21 nt, Human
ugaacaaauugaacucuuuga

SEQ ID NO: 2423291 - RNA, 23 nt, Human
ugaaccacuucccucaucucucc

SEQ ID NO: 2423292 - RNA, 17 nt, Human
ugaaccauuaaagucga

SEQ ID NO: 2423293 - RNA, 21 nt, Human
ugaaccaucauuauaaacgug

SEQ ID NO: 2423294 - RNA, 20 nt, Human
ugaacccaggacgcuucuga

SEQ ID NO: 2423295 - RNA, 21 nt, Human
ugaacccaggacgcuucugaa

SEQ ID NO: 2423296 - RNA, 22 nt, Human
ugaacccaggacgcuucugaau

SEQ ID NO: 2423297 - RNA, 12 nt, Human
ugaacccaggag

SEQ ID NO: 2423298 - RNA, 22 nt, Human
ugaaccaccacacccagcccac

SEQ ID NO: 2423299 - RNA, 13 nt, Human
ugaacaaauuuac

SEQ ID NO: 2423300 - RNA, 21 nt, Human
ugaaccaccacacccagccca

SEQ ID NO: 2423301 - RNA, 22 nt, Human
agagauuggaaugggcagcuca

SEQ ID NO: 2423302 - RNA, 20 nt, Human
agagauuggaaugggcagcu

SEQ ID NO: 2423303 - RNA, 22 nt, Human
agagauguuuuuaaaaguuuca

SEQ ID NO: 2423304 - RNA, 21 nt, Human
agagauuggaaugggcagcuc

SEQ ID NO: 2423305 - RNA, 17 nt, Human
ugaaauaaaacuggcuu

SEQ ID NO: 2423306 - RNA, 19 nt, Human
ugaaauaaaacuggcuuug

SEQ ID NO: 2423307 - RNA, 22 nt, Human
ugaaauaaaacuggcuuuggcu

SEQ ID NO: 2423308 - RNA, 20 nt, Human
agagauuaccuccugagaaa

SEQ ID NO: 2423309 - RNA, 16 nt, Human
agagauugugguuuca

SEQ ID NO: 2423310 - RNA, 21 nt, Human
agagauguuuuuaaaaguuuc

SEQ ID NO: 2423311 - RNA, 20 nt, Human
agagauguuuuuaaaaguuu

SEQ ID NO: 2423312 - RNA, 12 nt, Human
agagauguuuuu

SEQ ID NO: 2423313 - RNA, 16 nt, Human
agagauuaccuccuga

SEQ ID NO: 2423314 - RNA, 19 nt, Human
agagauuaccuccugagaa

SEQ ID NO: 2423315 - RNA, 12 nt, Human
agagauggagga

SEQ ID NO: 2423316 - RNA, 13 nt, Human
agagauggaggag

SEQ ID NO: 2423317 - RNA, 14 nt, Human
agagauggaggagg

SEQ ID NO: 2423318 - RNA, 16 nt, Human
ugaaauaacauggccu

SEQ ID NO: 2423319 - RNA, 17 nt, Human
ugaaauaacauggccuu

SEQ ID NO: 2423320 - RNA, 14 nt, Human
ugaaauaagccaga

SEQ ID NO: 2423321 - RNA, 20 nt, Human
ugaaauaaagaaauugcaau

SEQ ID NO: 2423322 - RNA, 14 nt, Human
ugaaauaacuccuu

SEQ ID NO: 2423323 - RNA, 21 nt, Human
ugaaauaaagaaauugcaaua

SEQ ID NO: 2423324 - RNA, 14 nt, Human
ugaaauacuguuug

SEQ ID NO: 2423325 - RNA, 16 nt, Human
ugaaauacuguuugag

SEQ ID NO: 2423326 - RNA, 13 nt, Human
ugaaauacuacuu

SEQ ID NO: 2423327 - RNA, 22 nt, Human
ugaaauaccagugaaccaaaga

SEQ ID NO: 2423328 - RNA, 23 nt, Human
ugaaauaccagugaaccaaagag

SEQ ID NO: 2423329 - RNA, 14 nt, Human
ugaaauaccagugu

SEQ ID NO: 2423330 - RNA, 16 nt, Human
ugaaauaccagugugg

SEQ ID NO: 2423331 - RNA, 22 nt, Human
ugaaauuuauuaguuaauauau

SEQ ID NO: 2423332 - RNA, 21 nt, Human
ugaaauuuauuaguuaauaua

SEQ ID NO: 2423333 - RNA, 20 nt, Human
ugaaauuuauuaguuaauau

SEQ ID NO: 2423334 - RNA, 23 nt, Human
ugaaauuuauacaccaauugauu

SEQ ID NO: 2423335 - RNA, 16 nt, Human
ugaaauuuauacacca

SEQ ID NO: 2423336 - RNA, 12 nt, Human
ugaaauuguaaa

SEQ ID NO: 2423337 - RNA, 12 nt, Human
ugaaauuucaga

SEQ ID NO: 2423338 - RNA, 22 nt, Human
ugaaauuuaauauagcuauuuu

SEQ ID NO: 2423339 - RNA, 23 nt, Human
ugaaauagacccacaagaggcag

SEQ ID NO: 2423340 - RNA, 13 nt, Human
ugaaauagucugu

SEQ ID NO: 2423341 - RNA, 16 nt, Human
ugaaauagucugugug

SEQ ID NO: 2423342 - RNA, 17 nt, Human
ugaaauagucuguguga

SEQ ID NO: 2423343 - RNA, 18 nt, Human
ugaaauagucugugugaa

SEQ ID NO: 2423344 - RNA, 20 nt, Human
ugaaauuuuuauuaaauuau

SEQ ID NO: 2423345 - RNA, 22 nt, Human
ugaaauuucagauucccagagc

SEQ ID NO: 2423346 - RNA, 19 nt, Human
ugaaauuuuuauuaaauua

SEQ ID NO: 2423347 - RNA, 16 nt, Human
ugaacaaagcagccac

SEQ ID NO: 2423348 - RNA, 17 nt, Human
ugaacaaagcagccacg

SEQ ID NO: 2423349 - RNA, 18 nt, Human
ugaacaaauugaacucuu

SEQ ID NO: 2423350 - RNA, 14 nt, Human
ugaacaaagcagcc

SEQ ID NO: 2423351 - RNA, 15 nt, Human
ugaacaaagcagcca

SEQ ID NO: 2423352 - RNA, 18 nt, Human
ugaacaaaaaauaaaaau

SEQ ID NO: 2423353 - RNA, 20 nt, Human
agucacauuccaagccucau

SEQ ID NO: 2423354 - RNA, 13 nt, Human
agucacagccacc

SEQ ID NO: 2423355 - RNA, 14 nt, Human
agucacaucacagg

SEQ ID NO: 2423356 - RNA, 23 nt, Human
agucacauggccuaugcacauau

SEQ ID NO: 2423357 - RNA, 16 nt, Human
agucacaucucuuccu

SEQ ID NO: 2423358 - RNA, 14 nt, Human
agucacaucucuuc

SEQ ID NO: 2423359 - RNA, 15 nt, Human
agucacaucacagga

SEQ ID NO: 2423360 - RNA, 16 nt, Human
agucacugagacagcc

SEQ ID NO: 2423361 - RNA, 15 nt, Human
agucacugagacagc

SEQ ID NO: 2423362 - RNA, 17 nt, Human
agucacugagacagccc

SEQ ID NO: 2423363 - RNA, 15 nt, Human
ugucagcauagaagu

SEQ ID NO: 2423364 - RNA, 16 nt, Human
aguauuguccaggucu

SEQ ID NO: 2423365 - RNA, 15 nt, Human
aguauuguccagguc

SEQ ID NO: 2423366 - RNA, 17 nt, Human
aguauuuaauuagugcu

SEQ ID NO: 2423367 - RNA, 16 nt, Human
aguauuuaauuagugc

SEQ ID NO: 2423368 - RNA, 15 nt, Human
aguauuuaauuagug

SEQ ID NO: 2423369 - RNA, 14 nt, Human
aguauuuaauuagu

SEQ ID NO: 2423370 - RNA, 13 nt, Human
aguauuuaauuag

SEQ ID NO: 2423371 - RNA, 11 nt, Human
aguauuuaauu

SEQ ID NO: 2423372 - RNA, 21 nt, Human
aguauuuaauucauguugccu

SEQ ID NO: 2423373 - RNA, 21 nt, Human
aguauuuaauuagugcuaagu

SEQ ID NO: 2423374 - RNA, 19 nt, Human
aguauuuaauuagugcuaa

SEQ ID NO: 2423375 - RNA, 22 nt, Human
agucacagagauaauucuagcu

SEQ ID NO: 2423376 - RNA, 20 nt, Human
aguauugcaucuguauaagu

SEQ ID NO: 2423377 - RNA, 22 nt, Human
aguauugcaucuguauaaguaa

SEQ ID NO: 2423378 - RNA, 18 nt, Human
aguauuggggucugaccc

SEQ ID NO: 2423379 - RNA, 14 nt, Human
aguauuauaccuuu

SEQ ID NO: 2423380 - RNA, 20 nt, Human
aguauuauaaauuauguuua

SEQ ID NO: 2423381 - RNA, 19 nt, Human
aguauuauaaauuauguuu

SEQ ID NO: 2423382 - RNA, 18 nt, Human
aguauuauaaauuauguu

SEQ ID NO: 2423383 - RNA, 13 nt, Human
aguauuauaaauu

SEQ ID NO: 2423384 - RNA, 15 nt, Human
aguauuauaccuuuu

SEQ ID NO: 2423385 - RNA, 17 nt, Human
aguauugcaucuguaua

SEQ ID NO: 2423386 - RNA, 20 nt, Human
aguauuauaggccaaacugg

SEQ ID NO: 2423387 - RNA, 21 nt, Human
aguauguuagugcaaauuguc

SEQ ID NO: 2423388 - RNA, 18 nt, Human
aguauguuagugcaaauu

SEQ ID NO: 2423389 - RNA, 21 nt, Human
aguauuagaauaccacaggaa

SEQ ID NO: 2423390 - RNA, 18 nt, Human
aguauguguuugugugug

SEQ ID NO: 2423391 - RNA, 16 nt, Human
aguauguuaagcucuu

SEQ ID NO: 2423392 - RNA, 19 nt, Human
aguauguguuugugugugu

SEQ ID NO: 2423393 - RNA, 19 nt, Human
aguauguuaagcucuuuau

SEQ ID NO: 2423394 - RNA, 21 nt, Human
aguagcugggacuacaggcac

SEQ ID NO: 2423395 - RNA, 19 nt, Human
aguagcugggacuacaggc

SEQ ID NO: 2423396 - RNA, 22 nt, Human
aguagcugggacuacaggcacc

SEQ ID NO: 2423397 - RNA, 17 nt, Human
aguagcuggauuacagg

SEQ ID NO: 2423398 - RNA, 15 nt, Human
ugucaaaguggugag

SEQ ID NO: 2423399 - RNA, 14 nt, Human
ugucaaagugguga

SEQ ID NO: 2423400 - RNA, 16 nt, Human
ugucaaacuguagaaa

SEQ ID NO: 2423401 - RNA, 14 nt, Human
ugucaaagaagguu

SEQ ID NO: 2423402 - RNA, 12 nt, Human
ugucaaagaagg

SEQ ID NO: 2423403 - RNA, 18 nt, Human
ugucaaacuguagaaaug

SEQ ID NO: 2423404 - RNA, 11 nt, Human
uguauuaugug

SEQ ID NO: 2423405 - RNA, 23 nt, Human
uguauuacuagaagaugaauaca

SEQ ID NO: 2423406 - RNA, 18 nt, Human
uguauuagauguucucua

SEQ ID NO: 2423407 - RNA, 16 nt, Human
uguauuagauguucuc

SEQ ID NO: 2423408 - RNA, 14 nt, Human
uguauuagauguuc

SEQ ID NO: 2423409 - RNA, 13 nt, Human
uguauuagauguu

SEQ ID NO: 2423410 - RNA, 15 nt, Human
uguauuagucacaga

SEQ ID NO: 2423411 - RNA, 19 nt, Human
uguauuagauguucucuau

SEQ ID NO: 2423412 - RNA, 21 nt, Human
uguauuaggugucauuuccau

SEQ ID NO: 2423413 - RNA, 17 nt, Human
uguauuaagagugaaaa

SEQ ID NO: 2423414 - RNA, 16 nt, Human
uguauuaagagugaaa

SEQ ID NO: 2423415 - RNA, 12 nt, Human
uguauuaagagu

SEQ ID NO: 2423416 - RNA, 18 nt, Human
uguauuaagagugaaaau

SEQ ID NO: 2423417 - RNA, 14 nt, Human
uguauuaagccacu

SEQ ID NO: 2423418 - RNA, 19 nt, Human
uguauuacuagaagaugaa

SEQ ID NO: 2423419 - RNA, 16 nt, Human
uguauuacuagaagau

SEQ ID NO: 2423420 - RNA, 21 nt, Human
uguauuaaguuguuaauaaaa

SEQ ID NO: 2423421 - RNA, 14 nt, Human
ugucaacuucuggc

SEQ ID NO: 2423422 - RNA, 15 nt, Human
ugucaacuucaacau

SEQ ID NO: 2423423 - RNA, 15 nt, Human
ugucaacugaccuaa

SEQ ID NO: 2423424 - RNA, 18 nt, Human
ugucaacuucuggcuccu

SEQ ID NO: 2423425 - RNA, 15 nt, Human
ugucaacuucuggcu

SEQ ID NO: 2423426 - RNA, 20 nt, Human
ugucaacuucuggcuccuca

SEQ ID NO: 2423427 - RNA, 14 nt, Human
aguagcugggacua

SEQ ID NO: 2423428 - RNA, 13 nt, Human
aguagcugggacu

SEQ ID NO: 2423429 - RNA, 19 nt, Human
ugucaaaguggugagaggc

SEQ ID NO: 2423430 - RNA, 16 nt, Human
ugucaaaguggugaga

SEQ ID NO: 2423431 - RNA, 17 nt, Human
ugucaaauaaacacugu

SEQ ID NO: 2423432 - RNA, 15 nt, Human
ugucaaauaaacacu

SEQ ID NO: 2423433 - RNA, 12 nt, Human
ugucaaagcagg

SEQ ID NO: 2423434 - RNA, 17 nt, Human
ugucaaagagagggcuu

SEQ ID NO: 2423435 - RNA, 18 nt, Human
ugucaaauaaacacugug

SEQ ID NO: 2423436 - RNA, 15 nt, Human
ugucaacuaugauau

SEQ ID NO: 2423437 - RNA, 22 nt, Human
uguauuaaaaaaaacaaaaaga

SEQ ID NO: 2423438 - RNA, 21 nt, Human
uguauuaaaaaaaacaaaaag

SEQ ID NO: 2423439 - RNA, 20 nt, Human
uguauuaaaaaaaacaaaaa

SEQ ID NO: 2423440 - RNA, 19 nt, Human
uguauuaaaaaaaacaaaa

SEQ ID NO: 2423441 - RNA, 17 nt, Human
uguauuaaaaaaaacaa

SEQ ID NO: 2423442 - RNA, 17 nt, Human
uguauguuuuuuuucug

SEQ ID NO: 2423443 - RNA, 12 nt, Human
uguauuaagaau

SEQ ID NO: 2423444 - RNA, 16 nt, Human
uguauuaagaaugaaa

SEQ ID NO: 2423445 - RNA, 15 nt, Human
uguaucccaugagcc

SEQ ID NO: 2423446 - RNA, 21 nt, Human
uguaugugggggucugugugu

SEQ ID NO: 2423447 - RNA, 22 nt, Human
uguaugugggggucuguguguu

SEQ ID NO: 2423448 - RNA, 14 nt, Human
uguauguguaagua

SEQ ID NO: 2423449 - RNA, 15 nt, Human
uguagagccaggguc

SEQ ID NO: 2423450 - RNA, 12 nt, Human
uguagagccagg

SEQ ID NO: 2423451 - RNA, 21 nt, Human
agguuuggaugggagugagac

SEQ ID NO: 2423452 - RNA, 17 nt, Human
agguuugagaagcacug

SEQ ID NO: 2423453 - RNA, 14 nt, Human
agguuugaguagag

SEQ ID NO: 2423454 - RNA, 23 nt, Human
agguuucuggucucuaggcuggg

SEQ ID NO: 2423455 - RNA, 22 nt, Human
agguuucuggucucuaggcugg

SEQ ID NO: 2423456 - RNA, 22 nt, Human
uguauccauccauggggcugau

SEQ ID NO: 2423457 - RNA, 20 nt, Human
agguuuguauauugucagau

SEQ ID NO: 2423458 - RNA, 13 nt, Human
agguuuguauauu

SEQ ID NO: 2423459 - RNA, 16 nt, Human
uguauccaugggggca

SEQ ID NO: 2423460 - RNA, 22 nt, Human
uguauccauuaucauguguaau

SEQ ID NO: 2423461 - RNA, 20 nt, Human
uguauccauuaucaugugua

SEQ ID NO: 2423462 - RNA, 19 nt, Human
uguauccauuaucaugugu

SEQ ID NO: 2423463 - RNA, 18 nt, Human
uguauccauuaucaugug

SEQ ID NO: 2423464 - RNA, 17 nt, Human
uguauccauuaucaugu

SEQ ID NO: 2423465 - RNA, 14 nt, Human
uguauccauuauca

SEQ ID NO: 2423466 - RNA, 13 nt, Human
uguauccauuauc

SEQ ID NO: 2423467 - RNA, 19 nt, Human
uguauccaugggggcaggg

SEQ ID NO: 2423468 - RNA, 16 nt, Human
agguuugggaccccug

SEQ ID NO: 2423469 - RNA, 21 nt, Human
agguuugggaccccugguggu

SEQ ID NO: 2423470 - RNA, 22 nt, Human
agguuugguguguggagaugca

SEQ ID NO: 2423471 - RNA, 12 nt, Human
agguuuguauau

SEQ ID NO: 2423472 - RNA, 16 nt, Human
agguuuggugugugga

SEQ ID NO: 2423473 - RNA, 22 nt, Human
ugucccuaccgagucucuucuc

SEQ ID NO: 2423474 - RNA, 21 nt, Human
ugucccuaccgagucucuucu

SEQ ID NO: 2423475 - RNA, 20 nt, Human
ugucccuaccgagucucuuc

SEQ ID NO: 2423476 - RNA, 19 nt, Human
ugucccuacaccccucccc

SEQ ID NO: 2423477 - RNA, 21 nt, Human
uguccaggcacugcugcccag

SEQ ID NO: 2423478 - RNA, 20 nt, Human
uguccaggcacugcugccca

SEQ ID NO: 2423479 - RNA, 17 nt, Human
uguccagcugagcgcca

SEQ ID NO: 2423480 - RNA, 21 nt, Human
uguccagcugagcgccaggau

SEQ ID NO: 2423481 - RNA, 19 nt, Human
uguccaggcacugcugccc

SEQ ID NO: 2423482 - RNA, 15 nt, Human
uguccagaagaauau

SEQ ID NO: 2423483 - RNA, 13 nt, Human
uguccacugugua

SEQ ID NO: 2423484 - RNA, 19 nt, Human
uguccacgacugucuccau

SEQ ID NO: 2423485 - RNA, 20 nt, Human
uguccagaagaauauucagg

SEQ ID NO: 2423486 - RNA, 16 nt, Human
uguccagaagaauauu

SEQ ID NO: 2423487 - RNA, 11 nt, Human
uguccagcucc

SEQ ID NO: 2423488 - RNA, 12 nt, Human
uguccagcucca

SEQ ID NO: 2423489 - RNA, 16 nt, Human
uguccagcuccaaccu

SEQ ID NO: 2423490 - RNA, 20 nt, Human
uguccagcuccaaccugcaa

SEQ ID NO: 2423491 - RNA, 23 nt, Human
uguccagcuccaaccugcaaaga

SEQ ID NO: 2423492 - RNA, 17 nt, Human
uguccacgacugucucc

SEQ ID NO: 2423493 - RNA, 18 nt, Human
uguccacgacugucucca

SEQ ID NO: 2423494 - RNA, 16 nt, Human
uguccacgacugucuc

SEQ ID NO: 2423495 - RNA, 15 nt, Human
uguccaccuggcccc

SEQ ID NO: 2423496 - RNA, 11 nt, Human
uguccaccugg

SEQ ID NO: 2423497 - RNA, 12 nt, Human
uguccaccuggc

SEQ ID NO: 2423498 - RNA, 13 nt, Human
uguccaccuggcc

SEQ ID NO: 2423499 - RNA, 14 nt, Human
uguccaccuggccc

SEQ ID NO: 2423500 - RNA, 21 nt, Human
ugucagccgggcccugaguaa

SEQ ID NO: 2423501 - RNA, 17 nt, Human
ugucagccgggcccuga

SEQ ID NO: 2423502 - RNA, 16 nt, Human
ugucagccgggcccug

SEQ ID NO: 2423503 - RNA, 15 nt, Human
ugucagccgggcccu

SEQ ID NO: 2423504 - RNA, 23 nt, Human
ugucagccgagccgggccugggg

SEQ ID NO: 2423505 - RNA, 22 nt, Human
ugucagccgagccgggccuggg

SEQ ID NO: 2423506 - RNA, 21 nt, Human
ugucagccgagccgggccugg

SEQ ID NO: 2423507 - RNA, 20 nt, Human
ugucagccgagccgggccug

SEQ ID NO: 2423508 - RNA, 23 nt, Human
ugucagcgcagguuuaguuuacu

SEQ ID NO: 2423509 - RNA, 22 nt, Human
ugucagccgggcccugaguaau

SEQ ID NO: 2423510 - RNA, 18 nt, Human
ugucagcuacuaaugaug

SEQ ID NO: 2423511 - RNA, 19 nt, Human
ugucagcuacuaaugaugu

SEQ ID NO: 2423512 - RNA, 21 nt, Human
ugucagcuacuaaugauguuu

SEQ ID NO: 2423513 - RNA, 16 nt, Human
ugucagccauuccugu

SEQ ID NO: 2423514 - RNA, 20 nt, Human
ugucagcuccccucggagaa

SEQ ID NO: 2423515 - RNA, 21 nt, Human
ugucagcuccccucggagaag

SEQ ID NO: 2423516 - RNA, 23 nt, Human
ugucagcuccccucggagaagag

SEQ ID NO: 2423517 - RNA, 20 nt, Human
uguccacagaugccuccacc

SEQ ID NO: 2423518 - RNA, 21 nt, Human
uguccacccaccuaugugcca

SEQ ID NO: 2423519 - RNA, 23 nt, Human
ugucagcuacugcggaaaaggaa

SEQ ID NO: 2423520 - RNA, 14 nt, Human
uguccacagaugcc

SEQ ID NO: 2423521 - RNA, 18 nt, Human
uguccacagaugccucca

SEQ ID NO: 2423522 - RNA, 19 nt, Human
uguccacagaugccuccac

SEQ ID NO: 2423523 - RNA, 24 nt, Human
uguccuguaguugcguggacucug

SEQ ID NO: 2423524 - RNA, 16 nt, Human
uguccuguacauugug

SEQ ID NO: 2423525 - RNA, 20 nt, Human
uguccuguagagguuuuguu

SEQ ID NO: 2423526 - RNA, 22 nt, Human
uguccuucccugcauuucugag

SEQ ID NO: 2423527 - RNA, 16 nt, Human
uguccuucccugcauu

SEQ ID NO: 2423528 - RNA, 14 nt, Human
uguccuucccugca

SEQ ID NO: 2423529 - RNA, 11 nt, Human
uguccuuagca

SEQ ID NO: 2423530 - RNA, 12 nt, Human
uguccuuagaac

SEQ ID NO: 2423531 - RNA, 18 nt, Human
uguccuuagaacauuuua

SEQ ID NO: 2423532 - RNA, 20 nt, Human
uguccuuacccaucugcacc

SEQ ID NO: 2423533 - RNA, 15 nt, Human
uguccugguucccgu

SEQ ID NO: 2423534 - RNA, 13 nt, Human
uguccugguguca

SEQ ID NO: 2423535 - RNA, 21 nt, Human
uguccuggugucacuuacugu

SEQ ID NO: 2423536 - RNA, 16 nt, Human
uguccuggugucacuu

SEQ ID NO: 2423537 - RNA, 15 nt, Human
uguccuguaaagguu

SEQ ID NO: 2423538 - RNA, 22 nt, Human
uguccuguaaagguuacaagcc

SEQ ID NO: 2423539 - RNA, 12 nt, Human
ugucccuuuucc

SEQ ID NO: 2423540 - RNA, 18 nt, Human
ugucccuuucuuggccag

SEQ ID NO: 2423541 - RNA, 16 nt, Human
ugucccuuucuuggcc

SEQ ID NO: 2423542 - RNA, 17 nt, Human
ugucccuuucuuggcca

SEQ ID NO: 2423543 - RNA, 14 nt, Human
ugucccucugcccc

SEQ ID NO: 2423544 - RNA, 15 nt, Human
ugucccucugcccca

SEQ ID NO: 2423545 - RNA, 16 nt, Human
ugucccucugccccau

SEQ ID NO: 2423546 - RNA, 18 nt, Human
ugucccuucugucccuca

SEQ ID NO: 2423547 - RNA, 18 nt, Human
uguccacacccagcucag

SEQ ID NO: 2423548 - RNA, 18 nt, Human
ugucccuucacauaguuu

SEQ ID NO: 2423549 - RNA, 14 nt, Human
ugucccugcacuug

SEQ ID NO: 2423550 - RNA, 22 nt, Human
ugucccuugccucaaugccagu

SEQ ID NO: 2423551 - RNA, 20 nt, Human
ugucccuucugucccucaca

SEQ ID NO: 2423552 - RNA, 14 nt, Human
ugucccuuggagcu

SEQ ID NO: 2423553 - RNA, 20 nt, Human
ugucccuuucugugugaaga

SEQ ID NO: 2423554 - RNA, 18 nt, Human
ugucccucccaccucugu

SEQ ID NO: 2423555 - RNA, 17 nt, Human
ugucccucccaccucug

SEQ ID NO: 2423556 - RNA, 14 nt, Human
ugucccucccccuu

SEQ ID NO: 2423557 - RNA, 12 nt, Human
ugucccuccugg

SEQ ID NO: 2423558 - RNA, 12 nt, Human
ugucccuccggg

SEQ ID NO: 2423559 - RNA, 13 nt, Human
ugucccucuaaag

SEQ ID NO: 2423560 - RNA, 20 nt, Human
ugucccucccaccucuguga

SEQ ID NO: 2423561 - RNA, 11 nt, Human
ugucccucuca

SEQ ID NO: 2423562 - RNA, 14 nt, Human
ugucccucucaggc

SEQ ID NO: 2423563 - RNA, 21 nt, Human
ugucccucucggaaggcuggc

SEQ ID NO: 2423564 - RNA, 15 nt, Human
ugucccucucaggca

SEQ ID NO: 2423565 - RNA, 16 nt, Human
ugucccucccaccucu

SEQ ID NO: 2423566 - RNA, 15 nt, Human
ugucccucccaccuc

SEQ ID NO: 2423567 - RNA, 14 nt, Human
ugucccucccaccu

SEQ ID NO: 2423568 - RNA, 13 nt, Human
ugucccucccacc

SEQ ID NO: 2423569 - RNA, 12 nt, Human
ugucccucccac

SEQ ID NO: 2423570 - RNA, 19 nt, Human
ugucccucaaaugacccaa

SEQ ID NO: 2423571 - RNA, 21 nt, Human
ugucccucacuguugaauuuu

SEQ ID NO: 2423572 - RNA, 21 nt, Human
uguccagaagaauauucagga

SEQ ID NO: 2423573 - RNA, 14 nt, Human
ugucccuaggucag

SEQ ID NO: 2423574 - RNA, 17 nt, Human
ugucccuaugcauauca

SEQ ID NO: 2423575 - RNA, 21 nt, Human
ugucccuaguaaaaauacaaa

SEQ ID NO: 2423576 - RNA, 14 nt, Human
ugucuaagauagua

SEQ ID NO: 2423577 - RNA, 15 nt, Human
ugucuaagauaguaa

SEQ ID NO: 2423578 - RNA, 19 nt, Human
ugucuaaagagcuuuaguc

SEQ ID NO: 2423579 - RNA, 13 nt, Human
ugucuaaacugca

SEQ ID NO: 2423580 - RNA, 18 nt, Human
ugucuaaauuugaauguu

SEQ ID NO: 2423581 - RNA, 13 nt, Human
uguccuuucccuc

SEQ ID NO: 2423582 - RNA, 11 nt, Human
ugucuaaacug

SEQ ID NO: 2423583 - RNA, 15 nt, Human
uguccuuguguguuu

SEQ ID NO: 2423584 - RNA, 14 nt, Human
uguccuugugcaug

SEQ ID NO: 2423585 - RNA, 13 nt, Human
uguccuugcaccu

SEQ ID NO: 2423586 - RNA, 15 nt, Human
uguccuugcaccugc

SEQ ID NO: 2423587 - RNA, 18 nt, Human
uguccuuggaaguuucau

SEQ ID NO: 2423588 - RNA, 16 nt, Human
uguccuugcaccugca

SEQ ID NO: 2423589 - RNA, 19 nt, Human
uguccuucucucaccuccu

SEQ ID NO: 2423590 - RNA, 18 nt, Human
uguccuucucucaccucc

SEQ ID NO: 2423591 - RNA, 21 nt, Human
uguccuucucucaccuccuaa

SEQ ID NO: 2423592 - RNA, 19 nt, Human
agucagggguucccuuuuu

SEQ ID NO: 2423593 - RNA, 17 nt, Human
agucaguauuguuuugg

SEQ ID NO: 2423594 - RNA, 15 nt, Human
agucaguauuguuuu

SEQ ID NO: 2423595 - RNA, 14 nt, Human
agucaguauuguuu

SEQ ID NO: 2423596 - RNA, 13 nt, Human
agucaguauuguu

SEQ ID NO: 2423597 - RNA, 14 nt, Human
agucagguccaauu

SEQ ID NO: 2423598 - RNA, 14 nt, Human
agucagaugcccag

SEQ ID NO: 2423599 - RNA, 23 nt, Human
agucagaugcccagagggcccag

SEQ ID NO: 2423600 - RNA, 21 nt, Human
agucagucaugauggcaccac

SEQ ID NO: 2423601 - RNA, 16 nt, Human
agucagugccaggucc

SEQ ID NO: 2423602 - RNA, 23 nt, Human
agucagugcaaaugucagauaca

SEQ ID NO: 2423603 - RNA, 16 nt, Human
agucagugcaaauguc

SEQ ID NO: 2423604 - RNA, 14 nt, Human
agucaucucaacca

SEQ ID NO: 2423605 - RNA, 15 nt, Human
agucaucucaaccau

SEQ ID NO: 2423606 - RNA, 17 nt, Human
agucaucuccaucagcu

SEQ ID NO: 2423607 - RNA, 18 nt, Human
agucaucuccaucagcug

SEQ ID NO: 2423608 - RNA, 19 nt, Human
agucaucuccaucagcugu

SEQ ID NO: 2423609 - RNA, 20 nt, Human
agucaucuccaucagcugua

SEQ ID NO: 2423610 - RNA, 20 nt, Human
agucagugcccaacuguuau

SEQ ID NO: 2423611 - RNA, 13 nt, Human
agucauccaaucu

SEQ ID NO: 2423612 - RNA, 13 nt, Human
agucccaguggga

SEQ ID NO: 2423613 - RNA, 18 nt, Human
agucccacugccucaggu

SEQ ID NO: 2423614 - RNA, 12 nt, Human
aguccccacccc

SEQ ID NO: 2423615 - RNA, 11 nt, Human
aguccccaccc

SEQ ID NO: 2423616 - RNA, 15 nt, Human
agucccagugggagg

SEQ ID NO: 2423617 - RNA, 20 nt, Human
agucccaggcugagccucag

SEQ ID NO: 2423618 - RNA, 17 nt, Human
agucccacugccucagg

SEQ ID NO: 2423619 - RNA, 12 nt, Human
agucccacugcc

SEQ ID NO: 2423620 - RNA, 23 nt, Human
aguccauauuucaauuuccaaga

SEQ ID NO: 2423621 - RNA, 19 nt, Human
aguccccuguuuguuucug

SEQ ID NO: 2423622 - RNA, 14 nt, Human
aguccccuguuugu

SEQ ID NO: 2423623 - RNA, 17 nt, Human
aguccccaccccugccc

SEQ ID NO: 2423624 - RNA, 16 nt, Human
aguccccaccccugcc

SEQ ID NO: 2423625 - RNA, 15 nt, Human
aguccccaccccugc

SEQ ID NO: 2423626 - RNA, 13 nt, Human
aguccccaccccu

SEQ ID NO: 2423627 - RNA, 20 nt, Human
aguccccaccccugccccca

SEQ ID NO: 2423628 - RNA, 18 nt, Human
aguccccaccccugcccc

SEQ ID NO: 2423629 - RNA, 19 nt, Human
aguccccaggccccaggaa

SEQ ID NO: 2423630 - RNA, 16 nt, Human
aguccccaggccccag

SEQ ID NO: 2423631 - RNA, 17 nt, Human
aguccccaggccccagg

SEQ ID NO: 2423632 - RNA, 13 nt, Human
aguccccaggccc

SEQ ID NO: 2423633 - RNA, 20 nt, Human
agucccaccuuggcugcagg

SEQ ID NO: 2423634 - RNA, 23 nt, Human
agucccaccuuggcugcagggag

SEQ ID NO: 2423635 - RNA, 21 nt, Human
agucccaccuuggcugcaggg

SEQ ID NO: 2423636 - RNA, 20 nt, Human
agucaucuugaccaagcagg

SEQ ID NO: 2423637 - RNA, 13 nt, Human
agucaugaagccc

SEQ ID NO: 2423638 - RNA, 14 nt, Human
agucaugaagccca

SEQ ID NO: 2423639 - RNA, 21 nt, Human
agucaugaagcccaagugaaa

SEQ ID NO: 2423640 - RNA, 21 nt, Human
agucaucuugaccaagcagga

SEQ ID NO: 2423641 - RNA, 15 nt, Human
aguccagucucuucu

SEQ ID NO: 2423642 - RNA, 17 nt, Human
aguccagugaccugcug

SEQ ID NO: 2423643 - RNA, 21 nt, Human
aguccauauuucaauuuccaa

SEQ ID NO: 2423644 - RNA, 21 nt, Human
ugucuucccaggguagcccgc

SEQ ID NO: 2423645 - RNA, 16 nt, Human
ugucuucccaggguag

SEQ ID NO: 2423646 - RNA, 14 nt, Human
ugucuucccagggu

SEQ ID NO: 2423647 - RNA, 13 nt, Human
ugucuucccaggg

SEQ ID NO: 2423648 - RNA, 22 nt, Human
ugucuucccaggguagcccgcc

SEQ ID NO: 2423649 - RNA, 16 nt, Human
ugucuuccucccaagu

SEQ ID NO: 2423650 - RNA, 13 nt, Human
ugucuuccugcau

SEQ ID NO: 2423651 - RNA, 17 nt, Human
ugucuuccugcauucac

SEQ ID NO: 2423652 - RNA, 13 nt, Human
ugucuuccugugg

SEQ ID NO: 2423653 - RNA, 18 nt, Human
ugucuuccugcauucacc

SEQ ID NO: 2423654 - RNA, 17 nt, Human
ugucuucguacaguucu

SEQ ID NO: 2423655 - RNA, 16 nt, Human
ugucuucguacaguuc

SEQ ID NO: 2423656 - RNA, 21 nt, Human
ugucuucggaaaccuuggugu

SEQ ID NO: 2423657 - RNA, 20 nt, Human
ugucuucggaaaccuuggug

SEQ ID NO: 2423658 - RNA, 19 nt, Human
ugucuucggaaaccuuggu

SEQ ID NO: 2423659 - RNA, 16 nt, Human
ugucuucggaaaccuu

SEQ ID NO: 2423660 - RNA, 14 nt, Human
ugucuuccuuggag

SEQ ID NO: 2423661 - RNA, 14 nt, Human
ugucuuccuguggg

SEQ ID NO: 2423662 - RNA, 18 nt, Human
ugucuucguacaguucuu

SEQ ID NO: 2423663 - RNA, 16 nt, Human
ugucuucucaggcucu

SEQ ID NO: 2423664 - RNA, 21 nt, Human
ugucuucucaggcucugcccu

SEQ ID NO: 2423665 - RNA, 22 nt, Human
ugucuucucaggcucugcccug

SEQ ID NO: 2423666 - RNA, 14 nt, Human
ugucuucacaacag

SEQ ID NO: 2423667 - RNA, 22 nt, Human
ugucuucauaccuacauguauu

SEQ ID NO: 2423668 - RNA, 24 nt, Human
ugucuucaccugauucaacuaaaa

SEQ ID NO: 2423669 - RNA, 19 nt, Human
ugucuucacagcucugugu

SEQ ID NO: 2423670 - RNA, 19 nt, Human
ugucuucauuucauuguau

SEQ ID NO: 2423671 - RNA, 17 nt, Human
ugucuucauuucauugu

SEQ ID NO: 2423672 - RNA, 16 nt, Human
ugucuucauuucauug

SEQ ID NO: 2423673 - RNA, 13 nt, Human
ugucuucaccuga

SEQ ID NO: 2423674 - RNA, 15 nt, Human
ugucuucauagcaga

SEQ ID NO: 2423675 - RNA, 23 nt, Human
ugucuucauuucauuguaugaug

SEQ ID NO: 2423676 - RNA, 21 nt, Human
ugucuucauuucauuguauga

SEQ ID NO: 2423677 - RNA, 12 nt, Human
ugucuuccauaa

SEQ ID NO: 2423678 - RNA, 13 nt, Human
ugucuuccauaau

SEQ ID NO: 2423679 - RNA, 14 nt, Human
ugucuuccauaaug

SEQ ID NO: 2423680 - RNA, 17 nt, Human
ugucuuccauaauguau

SEQ ID NO: 2423681 - RNA, 21 nt, Human
ugucuugcaauggcagccuug

SEQ ID NO: 2423682 - RNA, 20 nt, Human
ugucuugcaauggcagccuu

SEQ ID NO: 2423683 - RNA, 18 nt, Human
ugucuugcaauggcagcc

SEQ ID NO: 2423684 - RNA, 17 nt, Human
ugucuugcaauggcagc

SEQ ID NO: 2423685 - RNA, 18 nt, Human
ugucuucugccuguuaua

SEQ ID NO: 2423686 - RNA, 17 nt, Human
ugucuucugccuguuau

SEQ ID NO: 2423687 - RNA, 15 nt, Human
ugucuucugccuguu

SEQ ID NO: 2423688 - RNA, 14 nt, Human
ugucuucugccugu

SEQ ID NO: 2423689 - RNA, 13 nt, Human
ugucuucugccug

SEQ ID NO: 2423690 - RNA, 12 nt, Human
ugucuucugccu

SEQ ID NO: 2423691 - RNA, 14 nt, Human
ugucuucuccccag

SEQ ID NO: 2423692 - RNA, 23 nt, Human
ugucuucucaggcucugcccugc

SEQ ID NO: 2423693 - RNA, 20 nt, Human
ugucuugaaugucuuuugaa

SEQ ID NO: 2423694 - RNA, 17 nt, Human
ugucuugaaugucuuuu

SEQ ID NO: 2423695 - RNA, 19 nt, Human
ugucuugaaagauucaggu

SEQ ID NO: 2423696 - RNA, 16 nt, Human
ugucuucuucugugcu

SEQ ID NO: 2423697 - RNA, 22 nt, Human
ugucuugaugcaugcacuguuc

SEQ ID NO: 2423698 - RNA, 15 nt, Human
ugucuugcaauggca

SEQ ID NO: 2423699 - RNA, 23 nt, Human
ugugaaccaccacacccagccca

SEQ ID NO: 2423700 - RNA, 22 nt, Human
ugugaaccaccacacccagccc

SEQ ID NO: 2423701 - RNA, 16 nt, Human
ugugaaccaccacacc

SEQ ID NO: 2423702 - RNA, 14 nt, Human
ugugaacuaaacuu

SEQ ID NO: 2423703 - RNA, 19 nt, Human
ugugaacuaaacuuucaca

SEQ ID NO: 2423704 - RNA, 20 nt, Human
ugugaacuaaacuuucacac

SEQ ID NO: 2423705 - RNA, 20 nt, Human
ugugaacucagccaagcaca

SEQ ID NO: 2423706 - RNA, 19 nt, Human
ugugaacucagccaagcac

SEQ ID NO: 2423707 - RNA, 18 nt, Human
ugugaacucagccaagca

SEQ ID NO: 2423708 - RNA, 16 nt, Human
ugugaacucagccaag

SEQ ID NO: 2423709 - RNA, 15 nt, Human
ugugaacucagccaa

SEQ ID NO: 2423710 - RNA, 14 nt, Human
ugugaacucagcca

SEQ ID NO: 2423711 - RNA, 12 nt, Human
ugugaacauuua

SEQ ID NO: 2423712 - RNA, 14 nt, Human
ugugaacauggacu

SEQ ID NO: 2423713 - RNA, 19 nt, Human
ugucuuucagauacauggu

SEQ ID NO: 2423714 - RNA, 20 nt, Human
ugucuuucagauacaugguu

SEQ ID NO: 2423715 - RNA, 17 nt, Human
ugugaaccgaggggcuc

SEQ ID NO: 2423716 - RNA, 21 nt, Human
ugugaacgauuuagaaagaag

SEQ ID NO: 2423717 - RNA, 15 nt, Human
ugugaaccaccacac

SEQ ID NO: 2423718 - RNA, 15 nt, Human
ugucuuucagauaca

SEQ ID NO: 2423719 - RNA, 16 nt, Human
ugucuuucagauacau

SEQ ID NO: 2423720 - RNA, 14 nt, Human
ugucuuuaaggaaa

SEQ ID NO: 2423721 - RNA, 15 nt, Human
ugucuuuaaggaaaa

SEQ ID NO: 2423722 - RNA, 19 nt, Human
ugucuuuaggcagcagcuu

SEQ ID NO: 2423723 - RNA, 21 nt, Human
ugucuuuaggcagcagcuuuu

SEQ ID NO: 2423724 - RNA, 15 nt, Human
ugucuuggacacugu

SEQ ID NO: 2423725 - RNA, 13 nt, Human
ugucuuggacacu

SEQ ID NO: 2423726 - RNA, 23 nt, Human
ugucuugcuauggggagaaaaga

SEQ ID NO: 2423727 - RNA, 13 nt, Human
ugucuuguucugu

SEQ ID NO: 2423728 - RNA, 18 nt, Human
ugucuuguguuucuuuag

SEQ ID NO: 2423729 - RNA, 22 nt, Human
ugucucuggauuauauuaugaa

SEQ ID NO: 2423730 - RNA, 13 nt, Human
ugucucugagagu

SEQ ID NO: 2423731 - RNA, 12 nt, Human
ugucucucauga

SEQ ID NO: 2423732 - RNA, 19 nt, Human
ugucucuagccacuuuggu

SEQ ID NO: 2423733 - RNA, 13 nt, Human
ugucucucagaau

SEQ ID NO: 2423734 - RNA, 20 nt, Human
ugucucgugguaggacugua

SEQ ID NO: 2423735 - RNA, 19 nt, Human
ugucucgugguaggacugu

SEQ ID NO: 2423736 - RNA, 18 nt, Human
ugucucgugguaggacug

SEQ ID NO: 2423737 - RNA, 17 nt, Human
ugucucuacuaaaaaua

SEQ ID NO: 2423738 - RNA, 16 nt, Human
ugucucuagccacuuu

SEQ ID NO: 2423739 - RNA, 15 nt, Human
ugucucuagccacuu

SEQ ID NO: 2423740 - RNA, 21 nt, Human
ugucucgugguaggacuguag

SEQ ID NO: 2423741 - RNA, 16 nt, Human
agucccugccaaugga

SEQ ID NO: 2423742 - RNA, 14 nt, Human
agucccugccaaug

SEQ ID NO: 2423743 - RNA, 13 nt, Human
agucccugccaau

SEQ ID NO: 2423744 - RNA, 23 nt, Human
aguccccuguuuguuucugaaag

SEQ ID NO: 2423745 - RNA, 21 nt, Human
ugucuccuuucaccccagggc

SEQ ID NO: 2423746 - RNA, 22 nt, Human
ugucuccuuucaccccagggcc

SEQ ID NO: 2423747 - RNA, 19 nt, Human
ugucuccuuugcaggcuca

SEQ ID NO: 2423748 - RNA, 12 nt, Human
ugucuccuaucc

SEQ ID NO: 2423749 - RNA, 18 nt, Human
ugucuccuuaacacugag

SEQ ID NO: 2423750 - RNA, 17 nt, Human
ugucuccuuaacacuga

SEQ ID NO: 2423751 - RNA, 21 nt, Human
ugucucuugguccugcugcag

SEQ ID NO: 2423752 - RNA, 20 nt, Human
ugucucuugguccugcugca

SEQ ID NO: 2423753 - RNA, 19 nt, Human
ugucucuugguccugcugc

SEQ ID NO: 2423754 - RNA, 18 nt, Human
ugucucuugguccugcug

SEQ ID NO: 2423755 - RNA, 13 nt, Human
ugucucuucugag

SEQ ID NO: 2423756 - RNA, 16 nt, Human
ugucucuucugagcua

SEQ ID NO: 2423757 - RNA, 13 nt, Human
ugucucuuccaua

SEQ ID NO: 2423758 - RNA, 21 nt, Human
ugucucuuccauaugaccuca

SEQ ID NO: 2423759 - RNA, 17 nt, Human
ugucucuugaguuuguc

SEQ ID NO: 2423760 - RNA, 14 nt, Human
ugucucuugaguuu

SEQ ID NO: 2423761 - RNA, 13 nt, Human
ugucucugugaga

SEQ ID NO: 2423762 - RNA, 23 nt, Human
ugucucugggcuuggggcuuccu

SEQ ID NO: 2423763 - RNA, 16 nt, Human
ugucucugucauggua

SEQ ID NO: 2423764 - RNA, 22 nt, Human
ugucucugccucccucacccug

SEQ ID NO: 2423765 - RNA, 13 nt, Human
ugucucugccucc

SEQ ID NO: 2423766 - RNA, 13 nt, Human
ugucucuggccug

SEQ ID NO: 2423767 - RNA, 17 nt, Human
ugucucugccucccuca

SEQ ID NO: 2423768 - RNA, 18 nt, Human
ugucucuggcgugugggu

SEQ ID NO: 2423769 - RNA, 19 nt, Human
ugucucuggcgugugggua

SEQ ID NO: 2423770 - RNA, 15 nt, Human
ugucuuaauuauuau

SEQ ID NO: 2423771 - RNA, 14 nt, Human
ugucuuaauuauua

SEQ ID NO: 2423772 - RNA, 12 nt, Human
ugucugaaaaau

SEQ ID NO: 2423773 - RNA, 22 nt, Human
ugucuuauauauauuucuuugu

SEQ ID NO: 2423774 - RNA, 13 nt, Human
ugucuuauauaua

SEQ ID NO: 2423775 - RNA, 17 nt, Human
ugucuucaacagcuccc

SEQ ID NO: 2423776 - RNA, 14 nt, Human
ugucuuaauuaaaa

SEQ ID NO: 2423777 - RNA, 22 nt, Human
ugucugaaaaauuccuuugugu

SEQ ID NO: 2423778 - RNA, 22 nt, Human
ugucucuugguccugcugcagu

SEQ ID NO: 2423779 - RNA, 21 nt, Human
ugucucuuuaaugucacaggc

SEQ ID NO: 2423780 - RNA, 22 nt, Human
ugucucuuuaaugucacaggca

SEQ ID NO: 2423781 - RNA, 18 nt, Human
ugucucuuuucucuuucu

SEQ ID NO: 2423782 - RNA, 14 nt, Human
ugucucuuuucucu

SEQ ID NO: 2423783 - RNA, 13 nt, Human
ugucucuuucaug

SEQ ID NO: 2423784 - RNA, 11 nt, Human
agugaaaaagg

SEQ ID NO: 2423785 - RNA, 17 nt, Human
agugaaaaaggaggaag

SEQ ID NO: 2423786 - RNA, 20 nt, Human
agugaaaaaggaggaagaga

SEQ ID NO: 2423787 - RNA, 23 nt, Human
agugaaaaaggaggaagagaaaa

SEQ ID NO: 2423788 - RNA, 20 nt, Human
agucuuuugcuuuuggcaaa

SEQ ID NO: 2423789 - RNA, 19 nt, Human
agucuuuugcuuuuggcaa

SEQ ID NO: 2423790 - RNA, 22 nt, Human
agucuuuuguucgcauggucac

SEQ ID NO: 2423791 - RNA, 18 nt, Human
agucuuuugcuuuuggca

SEQ ID NO: 2423792 - RNA, 14 nt, Human
agucuuuugcuuuu

SEQ ID NO: 2423793 - RNA, 20 nt, Human
agucuucucauagcauuaac

SEQ ID NO: 2423794 - RNA, 21 nt, Human
agucuucucauagcauuaacu

SEQ ID NO: 2423795 - RNA, 12 nt, Human
agucuucucaua

SEQ ID NO: 2423796 - RNA, 13 nt, Human
agucuucucauag

SEQ ID NO: 2423797 - RNA, 18 nt, Human
agucuucucauagcauua

SEQ ID NO: 2423798 - RNA, 13 nt, Human
agucuuuuccaug

SEQ ID NO: 2423799 - RNA, 15 nt, Human
agucuuuuccaugaa

SEQ ID NO: 2423800 - RNA, 15 nt, Human
agucuuccugacacu

SEQ ID NO: 2423801 - RNA, 16 nt, Human
agucuuccugacacuu

SEQ ID NO: 2423802 - RNA, 12 nt, Human
agucuuccugac

SEQ ID NO: 2423803 - RNA, 19 nt, Human
agucuuccauuugcaaggg

SEQ ID NO: 2423804 - RNA, 17 nt, Human
agucuuccugacacuuu

SEQ ID NO: 2423805 - RNA, 18 nt, Human
agucuuccugacacuuua

SEQ ID NO: 2423806 - RNA, 19 nt, Human
agucuuccugacacuuuaa

SEQ ID NO: 2423807 - RNA, 15 nt, Human
agucuuccauuugca

SEQ ID NO: 2423808 - RNA, 22 nt, Human
agucuuaauauauauauccaga

SEQ ID NO: 2423809 - RNA, 16 nt, Human
agucuuccauuugcaa

SEQ ID NO: 2423810 - RNA, 17 nt, Human
agucuuccauuugcaag

SEQ ID NO: 2423811 - RNA, 13 nt, Human
agucuucccugau

SEQ ID NO: 2423812 - RNA, 13 nt, Human
agucuguuuuaug

SEQ ID NO: 2423813 - RNA, 14 nt, Human
agucuguuuuauga

SEQ ID NO: 2423814 - RNA, 17 nt, Human
agucuguuuuaugacuu

SEQ ID NO: 2423815 - RNA, 18 nt, Human
agucuguuuuaugacuuc

SEQ ID NO: 2423816 - RNA, 21 nt, Human
agucucugagggcuuccuuug

SEQ ID NO: 2423817 - RNA, 16 nt, Human
agucucugcuggccca

SEQ ID NO: 2423818 - RNA, 17 nt, Human
agucucugcuggcccag

SEQ ID NO: 2423819 - RNA, 16 nt, Human
agucuuacgaauacuu

SEQ ID NO: 2423820 - RNA, 24 nt, Human
agucuuagacuugaaauacuacuu

SEQ ID NO: 2423821 - RNA, 13 nt, Human
agucuuaagaacu

SEQ ID NO: 2423822 - RNA, 23 nt, Human
agucuuaaaauaacuuauaucau

SEQ ID NO: 2423823 - RNA, 17 nt, Human
agucuuaaaauaacuua

SEQ ID NO: 2423824 - RNA, 13 nt, Human
agucuuaaaauaa

SEQ ID NO: 2423825 - RNA, 11 nt, Human
agucucugagc

SEQ ID NO: 2423826 - RNA, 13 nt, Human
agucucugagcag

SEQ ID NO: 2423827 - RNA, 19 nt, Human
agucucugagggcuuccuu

SEQ ID NO: 2423828 - RNA, 15 nt, Human
agucucugagggcuu

SEQ ID NO: 2423829 - RNA, 16 nt, Human
agucucugagcaguga

SEQ ID NO: 2423830 - RNA, 23 nt, Human
agucucccucacagcacagagaa

SEQ ID NO: 2423831 - RNA, 18 nt, Human
agucucugaagugaaacu

SEQ ID NO: 2423832 - RNA, 19 nt, Human
agucucugaagugaaacug

SEQ ID NO: 2423833 - RNA, 14 nt, Human
agucucccucccuu

SEQ ID NO: 2423834 - RNA, 18 nt, Human
agucucccucccuugggg

SEQ ID NO: 2423835 - RNA, 14 nt, Human
ugugagcccagcug

SEQ ID NO: 2423836 - RNA, 15 nt, Human
ugugagcccagcugg

SEQ ID NO: 2423837 - RNA, 18 nt, Human
ugugagcaucacaguuuu

SEQ ID NO: 2423838 - RNA, 14 nt, Human
ugugagcagugagu

SEQ ID NO: 2423839 - RNA, 19 nt, Human
agucuccaaagucucugga

SEQ ID NO: 2423840 - RNA, 14 nt, Human
agucucccaaggcu

SEQ ID NO: 2423841 - RNA, 13 nt, Human
agucucccaaggc

SEQ ID NO: 2423842 - RNA, 22 nt, Human
agucuccagugguugcuguuga

SEQ ID NO: 2423843 - RNA, 16 nt, Human
agucuccaccaggaac

SEQ ID NO: 2423844 - RNA, 20 nt, Human
agucucccucacagcacaga

SEQ ID NO: 2423845 - RNA, 15 nt, Human
agucucccucacagc

SEQ ID NO: 2423846 - RNA, 14 nt, Human
agucuccaccagga

SEQ ID NO: 2423847 - RNA, 15 nt, Human
agucuccaccaggaa

SEQ ID NO: 2423848 - RNA, 19 nt, Human
agucuccagugguugcugu

SEQ ID NO: 2423849 - RNA, 17 nt, Human
agucucauuacuuuuga

SEQ ID NO: 2423850 - RNA, 18 nt, Human
agucucauuacuuuugaa

SEQ ID NO: 2423851 - RNA, 21 nt, Human
ugugaacucagccaagcacag

SEQ ID NO: 2423852 - RNA, 18 nt, Human
ugugaacuggacccuguu

SEQ ID NO: 2423853 - RNA, 14 nt, Human
ugugaacugaacuc

SEQ ID NO: 2423854 - RNA, 23 nt, Human
ugugaacugaacucugacaacag

SEQ ID NO: 2423855 - RNA, 14 nt, Human
ugugaagcaaaauu

SEQ ID NO: 2423856 - RNA, 22 nt, Human
ugugaagaugauauacuauuuu

SEQ ID NO: 2423857 - RNA, 15 nt, Human
ugugaacugacaggc

SEQ ID NO: 2423858 - RNA, 18 nt, Human
ugugaagagggagaagca

SEQ ID NO: 2423859 - RNA, 22 nt, Human
ugugaagaucacguuccuuccc

SEQ ID NO: 2423860 - RNA, 12 nt, Human
ugugaagcauuc

SEQ ID NO: 2423861 - RNA, 10 nt, Human
ugugaagcca

SEQ ID NO: 2423862 - RNA, 20 nt, Human
ugugaagccaauucagacag

SEQ ID NO: 2423863 - RNA, 21 nt, Human
ugugaagccaauucagacagg

SEQ ID NO: 2423864 - RNA, 22 nt, Human
ugugagaugcuagaacucccuu

SEQ ID NO: 2423865 - RNA, 19 nt, Human
ugugagcacaaagguagcu

SEQ ID NO: 2423866 - RNA, 14 nt, Human
ugugagcaagaagu

SEQ ID NO: 2423867 - RNA, 19 nt, Human
ugugagcaagcauuuaugu

SEQ ID NO: 2423868 - RNA, 14 nt, Human
ugugagauguaauu

SEQ ID NO: 2423869 - RNA, 22 nt, Human
agugaaagaggcagcuugaaac

SEQ ID NO: 2423870 - RNA, 14 nt, Human
agugagacagcucu

SEQ ID NO: 2423871 - RNA, 16 nt, Human
agugaaagaggcagcu

SEQ ID NO: 2423872 - RNA, 17 nt, Human
agugaaagaaaauaaca

SEQ ID NO: 2423873 - RNA, 20 nt, Human
agugaaacucguuaauuugu

SEQ ID NO: 2423874 - RNA, 21 nt, Human
agugaaaccuuuagggcagcu

SEQ ID NO: 2423875 - RNA, 20 nt, Human
agugaaaccuuuagggcagc

SEQ ID NO: 2423876 - RNA, 19 nt, Human
agugaaaccuuuagggcag

SEQ ID NO: 2423877 - RNA, 15 nt, Human
agugaaaauugucuu

SEQ ID NO: 2423878 - RNA, 17 nt, Human
agucuuuuguucgcaug

SEQ ID NO: 2423879 - RNA, 14 nt, Human
agugaaaaaugaga

SEQ ID NO: 2423880 - RNA, 19 nt, Human
agugaaaacaagugcuggc

SEQ ID NO: 2423881 - RNA, 12 nt, Human
agugaaaacaag

SEQ ID NO: 2423882 - RNA, 20 nt, Human
agugaaaacaagugcuggca

SEQ ID NO: 2423883 - RNA, 14 nt, Human
agugaaaauaggua

SEQ ID NO: 2423884 - RNA, 17 nt, Human
agugagacucugucuca

SEQ ID NO: 2423885 - RNA, 16 nt, Human
agugagacucugucuc

SEQ ID NO: 2423886 - RNA, 22 nt, Human
agugagacucugucucaaaaaa

SEQ ID NO: 2423887 - RNA, 21 nt, Human
agugagacccagcccucaucc

SEQ ID NO: 2423888 - RNA, 16 nt, Human
agugagacccugucuc

SEQ ID NO: 2423889 - RNA, 17 nt, Human
agugagacccugucucu

SEQ ID NO: 2423890 - RNA, 13 nt, Human
agugagacucugu

SEQ ID NO: 2423891 - RNA, 21 nt, Human
agugagacccugucucaaaaa

SEQ ID NO: 2423892 - RNA, 17 nt, Human
agugagacccugucuca

SEQ ID NO: 2423893 - RNA, 21 nt, Human
agugagacaguccagccugga

SEQ ID NO: 2423894 - RNA, 13 nt, Human
agugagacagaag

SEQ ID NO: 2423895 - RNA, 17 nt, Human
agugaaagacaagcugc

SEQ ID NO: 2423896 - RNA, 22 nt, Human
agugaaaccuuuagggcagcuu

SEQ ID NO: 2423897 - RNA, 14 nt, Human
agugaaagcaucac

SEQ ID NO: 2423898 - RNA, 18 nt, Human
ugugauuauuucacuuua

SEQ ID NO: 2423899 - RNA, 14 nt, Human
ugugauuuuaacuc

SEQ ID NO: 2423900 - RNA, 16 nt, Human
ugugauuuuaacucug

SEQ ID NO: 2423901 - RNA, 17 nt, Human
ugugauuuuaacucugu

SEQ ID NO: 2423902 - RNA, 20 nt, Human
ugugauuuuaacucugucuu

SEQ ID NO: 2423903 - RNA, 18 nt, Human
ugugauuuuaacucuguc

SEQ ID NO: 2423904 - RNA, 19 nt, Human
ugugauuuuaacucugucu

SEQ ID NO: 2423905 - RNA, 11 nt, Human
ugugauuuuuu

SEQ ID NO: 2423906 - RNA, 17 nt, Human
ugugauuauuucacuuu

SEQ ID NO: 2423907 - RNA, 15 nt, Human
ugugauuauuucacu

SEQ ID NO: 2423908 - RNA, 22 nt, Human
ugugauuuggaagggaaacuuu

SEQ ID NO: 2423909 - RNA, 14 nt, Human
ugugauucaaucug

SEQ ID NO: 2423910 - RNA, 15 nt, Human
ugugaugugaagcca

SEQ ID NO: 2423911 - RNA, 11 nt, Human
ugugauguguc

SEQ ID NO: 2423912 - RNA, 17 nt, Human
ugugauggggcccugcc

SEQ ID NO: 2423913 - RNA, 21 nt, Human
agugagcagucaggaaagaga

SEQ ID NO: 2423914 - RNA, 23 nt, Human
agugagagcgugcuccagccugg

SEQ ID NO: 2423915 - RNA, 16 nt, Human
agugagcacucccaag

SEQ ID NO: 2423916 - RNA, 15 nt, Human
agugagcacucccaa

SEQ ID NO: 2423917 - RNA, 22 nt, Human
agugagagagaugggagcuccu

SEQ ID NO: 2423918 - RNA, 14 nt, Human
agugagagcugggu

SEQ ID NO: 2423919 - RNA, 16 nt, Human
ugugauggggcccugc

SEQ ID NO: 2423920 - RNA, 15 nt, Human
ugugauggggcccug

SEQ ID NO: 2423921 - RNA, 16 nt, Human
agugagccgagauugu

SEQ ID NO: 2423922 - RNA, 17 nt, Human
ugugaugcuuugaagua

SEQ ID NO: 2423923 - RNA, 13 nt, Human
uggucccacccca

SEQ ID NO: 2423924 - RNA, 15 nt, Human
uggucucgaacuccu

SEQ ID NO: 2423925 - RNA, 19 nt, Human
uggucucgaacuccugacc

SEQ ID NO: 2423926 - RNA, 19 nt, Human
uggucucuaggcuggggaa

SEQ ID NO: 2423927 - RNA, 18 nt, Human
uggucucuaggcugggga

SEQ ID NO: 2423928 - RNA, 17 nt, Human
uggucucuaggcugggg

SEQ ID NO: 2423929 - RNA, 16 nt, Human
uggucucuaggcuggg

SEQ ID NO: 2423930 - RNA, 14 nt, Human
uggucucuaggcug

SEQ ID NO: 2423931 - RNA, 20 nt, Human
uggucucgaacuccugaccu

SEQ ID NO: 2423932 - RNA, 21 nt, Human
uggucucgaacuccugaccuu

SEQ ID NO: 2423933 - RNA, 19 nt, Human
ugguccauagagagcaaga

SEQ ID NO: 2423934 - RNA, 21 nt, Human
uggucccaacaggaggacaau

SEQ ID NO: 2423935 - RNA, 20 nt, Human
ugguccauggaaugcuugaa

SEQ ID NO: 2423936 - RNA, 17 nt, Human
ugguccauggaaugcuu

SEQ ID NO: 2423937 - RNA, 22 nt, Human
ugguccaugggccauaugaaaa

SEQ ID NO: 2423938 - RNA, 22 nt, Human
uggucugugagaugcuagaacu

SEQ ID NO: 2423939 - RNA, 12 nt, Human
uggucuguguga

SEQ ID NO: 2423940 - RNA, 16 nt, Human
uggucuuauuuguaaa

SEQ ID NO: 2423941 - RNA, 18 nt, Human
uggucuguuggcaggcug

SEQ ID NO: 2423942 - RNA, 14 nt, Human
uggucuguuggcag

SEQ ID NO: 2423943 - RNA, 21 nt, Human
uggucugggacuuccuugcuc

SEQ ID NO: 2423944 - RNA, 18 nt, Human
uggucugacccacugcuu

SEQ ID NO: 2423945 - RNA, 22 nt, Human
uggucucugcugaagguuguaa

SEQ ID NO: 2423946 - RNA, 12 nt, Human
uggucugaaugu

SEQ ID NO: 2423947 - RNA, 22 nt, Human
uggucugaggggcaacugaguc

SEQ ID NO: 2423948 - RNA, 16 nt, Human
uggucugauuucagga

SEQ ID NO: 2423949 - RNA, 19 nt, Human
uggucugggacuuccuugc

SEQ ID NO: 2423950 - RNA, 17 nt, Human
uggucugggacuuccuu

SEQ ID NO: 2423951 - RNA, 16 nt, Human
uggucugggacuuccu

SEQ ID NO: 2423952 - RNA, 16 nt, Human
uggucugggacucucu

SEQ ID NO: 2423953 - RNA, 17 nt, Human
uggucugcucgggccca

SEQ ID NO: 2423954 - RNA, 15 nt, Human
uggucugcaggcagg

SEQ ID NO: 2423955 - RNA, 21 nt, Human
uggucugcucgggcccaggcc

SEQ ID NO: 2423956 - RNA, 19 nt, Human
uggucugcucgggcccagg

SEQ ID NO: 2423957 - RNA, 18 nt, Human
uggucugcucgggcccag

SEQ ID NO: 2423958 - RNA, 14 nt, Human
uggucugcaggcag

SEQ ID NO: 2423959 - RNA, 19 nt, Human
aggguggugaccucugccu

SEQ ID NO: 2423960 - RNA, 18 nt, Human
aggguggugaccucugcc

SEQ ID NO: 2423961 - RNA, 17 nt, Human
aggguggugaccucugc

SEQ ID NO: 2423962 - RNA, 15 nt, Human
uggugaaaauguacu

SEQ ID NO: 2423963 - RNA, 23 nt, Human
uggucuuuguaagaguguagaag

SEQ ID NO: 2423964 - RNA, 19 nt, Human
uggugaacagaacaaaagg

SEQ ID NO: 2423965 - RNA, 15 nt, Human
aggguugggcuggug

SEQ ID NO: 2423966 - RNA, 13 nt, Human
aggguugggcugg

SEQ ID NO: 2423967 - RNA, 14 nt, Human
aggguuggccccug

SEQ ID NO: 2423968 - RNA, 13 nt, Human
aggguuggccccu

SEQ ID NO: 2423969 - RNA, 14 nt, Human
aggguucuggcugc

SEQ ID NO: 2423970 - RNA, 23 nt, Human
aggguuccuguagaccuagggag

SEQ ID NO: 2423971 - RNA, 17 nt, Human
aggguucuccucucccc

SEQ ID NO: 2423972 - RNA, 21 nt, Human
aggguuccuguagaccuaggg

SEQ ID NO: 2423973 - RNA, 19 nt, Human
aggguucccccagcccugu

SEQ ID NO: 2423974 - RNA, 16 nt, Human
aggguugaccccagag

SEQ ID NO: 2423975 - RNA, 17 nt, Human
aggguugaccccagagg

SEQ ID NO: 2423976 - RNA, 18 nt, Human
aggguugaccccagagga

SEQ ID NO: 2423977 - RNA, 20 nt, Human
aggguucuccucuccccucu

SEQ ID NO: 2423978 - RNA, 21 nt, Human
aggguugaguuacuuccuauc

SEQ ID NO: 2423979 - RNA, 16 nt, Human
aggguucagagacuca

SEQ ID NO: 2423980 - RNA, 18 nt, Human
aggguucagagacucagg

SEQ ID NO: 2423981 - RNA, 22 nt, Human
aggguucaaaaugucuguagcu

SEQ ID NO: 2423982 - RNA, 15 nt, Human
aggguucccccagcc

SEQ ID NO: 2423983 - RNA, 17 nt, Human
aggguucccccagcccu

SEQ ID NO: 2423984 - RNA, 18 nt, Human
aggguucccccagcccug

SEQ ID NO: 2423985 - RNA, 19 nt, Human
uggugaaauuuauuaguua

SEQ ID NO: 2423986 - RNA, 18 nt, Human
aggguuauugcauuugga

SEQ ID NO: 2423987 - RNA, 14 nt, Human
aggguucaaaaugu

SEQ ID NO: 2423988 - RNA, 18 nt, Human
aggguucaaaaugucugu

SEQ ID NO: 2423989 - RNA, 13 nt, Human
uggugaauauugu

SEQ ID NO: 2423990 - RNA, 18 nt, Human
uggugaaauuuauuaguu

SEQ ID NO: 2423991 - RNA, 21 nt, Human
aggguuuggcugugucuaaac

SEQ ID NO: 2423992 - RNA, 20 nt, Human
aggguuuggcugugucuaaa

SEQ ID NO: 2423993 - RNA, 18 nt, Human
aggguuucugagcugcuc

SEQ ID NO: 2423994 - RNA, 19 nt, Human
aggguuucgagaagcugcu

SEQ ID NO: 2423995 - RNA, 17 nt, Human
aggguuucugagcugcu

SEQ ID NO: 2423996 - RNA, 22 nt, Human
aggguuuaauccccaguaaaau

SEQ ID NO: 2423997 - RNA, 17 nt, Human
aggguuucagagagccu

SEQ ID NO: 2423998 - RNA, 17 nt, Human
aggguuucgagaagcug

SEQ ID NO: 2423999 - RNA, 23 nt, Human
agguagaguuugaaggaggugag

SEQ ID NO: 2424000 - RNA, 21 nt, Human
agguagaguuugaaggaggug

SEQ ID NO: 2424001 - RNA, 20 nt, Human
agguagaguuugaaggaggu

SEQ ID NO: 2424002 - RNA, 17 nt, Human
agguagaguuugaagga

SEQ ID NO: 2424003 - RNA, 20 nt, Human
agguagauguucagauugcu

SEQ ID NO: 2424004 - RNA, 16 nt, Human
agguagcccuggccag

SEQ ID NO: 2424005 - RNA, 23 nt, Human
aggguuuggcugugucuaaacug

SEQ ID NO: 2424006 - RNA, 22 nt, Human
aggguuuggcugugucuaaacu

SEQ ID NO: 2424007 - RNA, 20 nt, Human
aggguuuauguuuaggaugu

SEQ ID NO: 2424008 - RNA, 20 nt, Human
aggguugguccucuugccuc

SEQ ID NO: 2424009 - RNA, 21 nt, Human
aggguuuaauccccaguaaaa

SEQ ID NO: 2424010 - RNA, 21 nt, Human
aggguuguuaauggugcaaau

SEQ ID NO: 2424011 - RNA, 17 nt, Human
aggguugggcugguguc

SEQ ID NO: 2424012 - RNA, 23 nt, Human
aggguuggguucaucugagcaag

SEQ ID NO: 2424013 - RNA, 14 nt, Human
aggguugaucacac

SEQ ID NO: 2424014 - RNA, 14 nt, Human
aggguuggagcagu

SEQ ID NO: 2424015 - RNA, 22 nt, Human
agguaucaguugcaauaauacu

SEQ ID NO: 2424016 - RNA, 17 nt, Human
agguaucaguugcaaua

SEQ ID NO: 2424017 - RNA, 19 nt, Human
agguagcugccccuggcuc

SEQ ID NO: 2424018 - RNA, 21 nt, Human
agguagcccuggccagaggcu

SEQ ID NO: 2424019 - RNA, 19 nt, Human
agguagcccuggccagagg

SEQ ID NO: 2424020 - RNA, 20 nt, Human
agguagcccuggccagaggc

SEQ ID NO: 2424021 - RNA, 23 nt, Human
agguagcuuugagguggaagagg

SEQ ID NO: 2424022 - RNA, 14 nt, Human
agguagcugccccu

SEQ ID NO: 2424023 - RNA, 19 nt, Human
agguaggagaauugcuuga

SEQ ID NO: 2424024 - RNA, 14 nt, Human
agguauuuaucuuu

SEQ ID NO: 2424025 - RNA, 16 nt, Human
agguaugaggucuagg

SEQ ID NO: 2424026 - RNA, 14 nt, Human
aggucaacagagaa

SEQ ID NO: 2424027 - RNA, 14 nt, Human
agguauuucaaaac

SEQ ID NO: 2424028 - RNA, 23 nt, Human
agguaugaccuucuaggaagcuc

SEQ ID NO: 2424029 - RNA, 22 nt, Human
agguaugaccuucuaggaagcu

SEQ ID NO: 2424030 - RNA, 17 nt, Human
agguaugcaaucaaauc

SEQ ID NO: 2424031 - RNA, 14 nt, Human
agguaucuccagga

SEQ ID NO: 2424032 - RNA, 13 nt, Human
agguaucuccagg

SEQ ID NO: 2424033 - RNA, 21 nt, Human
agguaucauuuucugcauuua

SEQ ID NO: 2424034 - RNA, 15 nt, Human
agguaucuccaggau

SEQ ID NO: 2424035 - RNA, 13 nt, Human
agguaugaauaag

SEQ ID NO: 2424036 - RNA, 20 nt, Human
agguaugaccuucuaggaag

SEQ ID NO: 2424037 - RNA, 17 nt, Human
agguccacaacacacag

SEQ ID NO: 2424038 - RNA, 14 nt, Human
agguccaagauacc

SEQ ID NO: 2424039 - RNA, 17 nt, Human
aggucauagcugagauu

SEQ ID NO: 2424040 - RNA, 21 nt, Human
aggucuugaacuccuggccuc

SEQ ID NO: 2424041 - RNA, 20 nt, Human
aggucuugaacuccuggccu

SEQ ID NO: 2424042 - RNA, 14 nt, Human
aggugaaagggagc

SEQ ID NO: 2424043 - RNA, 16 nt, Human
aggugaaagggagcua

SEQ ID NO: 2424044 - RNA, 19 nt, Human
aggugaaaguuaauccacu

SEQ ID NO: 2424045 - RNA, 21 nt, Human
aggugaaagggagcuaucagg

SEQ ID NO: 2424046 - RNA, 22 nt, Human
aggucuugaacuccuggccuca

SEQ ID NO: 2424047 - RNA, 16 nt, Human
agguccaauuuguaaa

SEQ ID NO: 2424048 - RNA, 21 nt, Human
aggucuuuugacauguggaaa

SEQ ID NO: 2424049 - RNA, 18 nt, Human
aggucuugaacuccuggc

SEQ ID NO: 2424050 - RNA, 15 nt, Human
aggucagugcaaaua

SEQ ID NO: 2424051 - RNA, 21 nt, Human
aggucaaggcugcagugagcc

SEQ ID NO: 2424052 - RNA, 17 nt, Human
aggucaacagagaaggc

SEQ ID NO: 2424053 - RNA, 19 nt, Human
aggucaacagagaaggcag

SEQ ID NO: 2424054 - RNA, 21 nt, Human
aggucaacagagaaggcagga

SEQ ID NO: 2424055 - RNA, 19 nt, Human
aggucaagaagaagaugga

SEQ ID NO: 2424056 - RNA, 16 nt, Human
aggucaagcccaggag

SEQ ID NO: 2424057 - RNA, 18 nt, Human
aggucaagcccaggagga

SEQ ID NO: 2424058 - RNA, 17 nt, Human
aggucaaguaagaagac

SEQ ID NO: 2424059 - RNA, 22 nt, Human
aggucauuuuuuuuaagaaaaa

SEQ ID NO: 2424060 - RNA, 23 nt, Human
aggucauuuuuuuuaagaaaaag

SEQ ID NO: 2424061 - RNA, 20 nt, Human
aggucauacaauccauucuu

SEQ ID NO: 2424062 - RNA, 21 nt, Human
aggucauacaauccauucuua

SEQ ID NO: 2424063 - RNA, 22 nt, Human
aggucauacuaucuacucuccu

SEQ ID NO: 2424064 - RNA, 18 nt, Human
aggucaaguaagaagaca

SEQ ID NO: 2424065 - RNA, 20 nt, Human
aggucaggaguuccuaacca

SEQ ID NO: 2424066 - RNA, 15 nt, Human
aggucaggaguucga

SEQ ID NO: 2424067 - RNA, 21 nt, Human
agggugaugggaaagcauugu

SEQ ID NO: 2424068 - RNA, 22 nt, Human
agggugaugggaaagcauugua

SEQ ID NO: 2424069 - RNA, 14 nt, Human
agggugaugccagg

SEQ ID NO: 2424070 - RNA, 14 nt, Human
agggugagagcugc

SEQ ID NO: 2424071 - RNA, 13 nt, Human
agggugaggaugg

SEQ ID NO: 2424072 - RNA, 21 nt, Human
agggucuuuucaucugggaaa

SEQ ID NO: 2424073 - RNA, 18 nt, Human
agggucuuuucaucuggg

SEQ ID NO: 2424074 - RNA, 13 nt, Human
agggucuuuucau

SEQ ID NO: 2424075 - RNA, 22 nt, Human
aggguggacuuagaaagcaggg

SEQ ID NO: 2424076 - RNA, 21 nt, Human
aggguggacuuagaaagcagg

SEQ ID NO: 2424077 - RNA, 20 nt, Human
aggguggacuuagaaagcag

SEQ ID NO: 2424078 - RNA, 16 nt, Human
aggguggacuuagaaa

SEQ ID NO: 2424079 - RNA, 13 nt, Human
ugggucugugugu

SEQ ID NO: 2424080 - RNA, 19 nt, Human
ugggucuguuuuccuuucu

SEQ ID NO: 2424081 - RNA, 15 nt, Human
ugggucuguuuuccu

SEQ ID NO: 2424082 - RNA, 14 nt, Human
ugggucuguuuucc

SEQ ID NO: 2424083 - RNA, 23 nt, Human
aggguggacuuagaaagcagggg

SEQ ID NO: 2424084 - RNA, 15 nt, Human
ugggucugugugugu

SEQ ID NO: 2424085 - RNA, 19 nt, Human
agggugaugccagguucua

SEQ ID NO: 2424086 - RNA, 15 nt, Human
agggugaugccaggu

SEQ ID NO: 2424087 - RNA, 20 nt, Human
agggugcaguaucaugcccu

SEQ ID NO: 2424088 - RNA, 22 nt, Human
agggugcuacguacaugugagg

SEQ ID NO: 2424089 - RNA, 17 nt, Human
agggugcugcuucccuc

SEQ ID NO: 2424090 - RNA, 23 nt, Human
agggugcuacguacaugugaggc

SEQ ID NO: 2424091 - RNA, 21 nt, Human
agggugcugcuucccucugcc

SEQ ID NO: 2424092 - RNA, 19 nt, Human
uggguuuuguauucucuga

SEQ ID NO: 2424093 - RNA, 21 nt, Human
uggguuuuguauucucugagc

SEQ ID NO: 2424094 - RNA, 14 nt, Human
uggguuuuucccug

SEQ ID NO: 2424095 - RNA, 15 nt, Human
uggguuuuuguuacc

SEQ ID NO: 2424096 - RNA, 22 nt, Human
uggguuuuuguuaccuuuaugg

SEQ ID NO: 2424097 - RNA, 23 nt, Human
uggguggaugccugguggcagcu

SEQ ID NO: 2424098 - RNA, 20 nt, Human
uggguggauauaaauauaua

SEQ ID NO: 2424099 - RNA, 23 nt, Human
uggguggagaagccauugucuuc

SEQ ID NO: 2424100 - RNA, 22 nt, Human
uggguggagaagccauugucuu

SEQ ID NO: 2424101 - RNA, 21 nt, Human
uggguggagaagccauugucu

SEQ ID NO: 2424102 - RNA, 19 nt, Human
uggguuuucuuaaccaucu

SEQ ID NO: 2424103 - RNA, 14 nt, Human
uggguuuucuuccc

SEQ ID NO: 2424104 - RNA, 24 nt, Human
uggguuuucuucccaucacuggag

SEQ ID NO: 2424105 - RNA, 14 nt, Human
uggguggaugccug

SEQ ID NO: 2424106 - RNA, 17 nt, Human
uggguggagaagccauu

SEQ ID NO: 2424107 - RNA, 16 nt, Human
uggguggagaagccau

SEQ ID NO: 2424108 - RNA, 15 nt, Human
uggguggagaagcca

SEQ ID NO: 2424109 - RNA, 14 nt, Human
uggguggagaagcc

SEQ ID NO: 2424110 - RNA, 16 nt, Human
uggguggacaggggcc

SEQ ID NO: 2424111 - RNA, 19 nt, Human
uggguggaaccaggaaccu

SEQ ID NO: 2424112 - RNA, 22 nt, Human
ugggucuuguuuuuuuuuucca

SEQ ID NO: 2424113 - RNA, 22 nt, Human
ugggucuguuuuccuuucucac

SEQ ID NO: 2424114 - RNA, 21 nt, Human
ugggucuguuuuccuuucuca

SEQ ID NO: 2424115 - RNA, 22 nt, Human
ugggucuucagggggccaggug

SEQ ID NO: 2424116 - RNA, 15 nt, Human
ugggugaagacagag

SEQ ID NO: 2424117 - RNA, 16 nt, Human
uggucaccaugaaacu

SEQ ID NO: 2424118 - RNA, 14 nt, Human
uggucaccaugaaa

SEQ ID NO: 2424119 - RNA, 15 nt, Human
uggucaccagcuccu

SEQ ID NO: 2424120 - RNA, 14 nt, Human
uggucaccagcucc

SEQ ID NO: 2424121 - RNA, 23 nt, Human
uggucaccaaaucagcugcuacu

SEQ ID NO: 2424122 - RNA, 21 nt, Human
uggucaccaaaucagcugcua

SEQ ID NO: 2424123 - RNA, 16 nt, Human
ugguacauggccagug

SEQ ID NO: 2424124 - RNA, 15 nt, Human
ugguacauggccagu

SEQ ID NO: 2424125 - RNA, 22 nt, Human
ugguaauuuguaucugaaggag

SEQ ID NO: 2424126 - RNA, 13 nt, Human
ugguaauuguugc

SEQ ID NO: 2424127 - RNA, 21 nt, Human
ugguaauuuguaucugaagga

SEQ ID NO: 2424128 - RNA, 19 nt, Human
ugguaauuuguaucugaag

SEQ ID NO: 2424129 - RNA, 21 nt, Human
ugguaaacuauuugucuuuca

SEQ ID NO: 2424130 - RNA, 13 nt, Human
ugguaaacuauuu

SEQ ID NO: 2424131 - RNA, 16 nt, Human
ugguaaagacuggcuu

SEQ ID NO: 2424132 - RNA, 19 nt, Human
ugguaaacgcugucccuag

SEQ ID NO: 2424133 - RNA, 22 nt, Human
ugguaauuuaagauuccagaga

SEQ ID NO: 2424134 - RNA, 17 nt, Human
ugguaaagacuggcuuu

SEQ ID NO: 2424135 - RNA, 16 nt, Human
ugguccauagagagca

SEQ ID NO: 2424136 - RNA, 15 nt, Human
ugguccauagagagc

SEQ ID NO: 2424137 - RNA, 13 nt, Human
ugguccagggcua

SEQ ID NO: 2424138 - RNA, 19 nt, Human
ugguccagggaagcuggcc

SEQ ID NO: 2424139 - RNA, 21 nt, Human
ugguccagggcuagugacuug

SEQ ID NO: 2424140 - RNA, 14 nt, Human
ugguccaggguuga

SEQ ID NO: 2424141 - RNA, 22 nt, Human
ugguccagcuugcucuucagug

SEQ ID NO: 2424142 - RNA, 16 nt, Human
ugguccaggagaaggc

SEQ ID NO: 2424143 - RNA, 17 nt, Human
ugguccagggaagcugg

SEQ ID NO: 2424144 - RNA, 12 nt, Human
ugguccaggaga

SEQ ID NO: 2424145 - RNA, 15 nt, Human
ugguccagcuugcuc

SEQ ID NO: 2424146 - RNA, 18 nt, Human
uggucauuuuauguuaag

SEQ ID NO: 2424147 - RNA, 21 nt, Human
ugguccaaaagauugcugaaa

SEQ ID NO: 2424148 - RNA, 23 nt, Human
ugguccaaaagauugcugaaauu

SEQ ID NO: 2424149 - RNA, 16 nt, Human
uggucaucuuuuucuc

SEQ ID NO: 2424150 - RNA, 12 nt, Human
aggguagggugg

SEQ ID NO: 2424151 - RNA, 16 nt, Human
aggguaucaggugcug

SEQ ID NO: 2424152 - RNA, 22 nt, Human
agggucuugguuccagccugcc

SEQ ID NO: 2424153 - RNA, 18 nt, Human
aggguaucaaauaaaauu

SEQ ID NO: 2424154 - RNA, 21 nt, Human
agggucuugguuccagccugc

SEQ ID NO: 2424155 - RNA, 17 nt, Human
aggguagucugguuucu

SEQ ID NO: 2424156 - RNA, 22 nt, Human
aggguaauaaacuuagaauaaa

SEQ ID NO: 2424157 - RNA, 23 nt, Human
aggguaccuugaacacuggggga

SEQ ID NO: 2424158 - RNA, 19 nt, Human
aggguaccuugaacacugg

SEQ ID NO: 2424159 - RNA, 19 nt, Human
aggguacuaaggaaucuuu

SEQ ID NO: 2424160 - RNA, 23 nt, Human
aggguagcccgccugccaguccu

SEQ ID NO: 2424161 - RNA, 16 nt, Human
aggguagcccgccugc

SEQ ID NO: 2424162 - RNA, 21 nt, Human
aggguaggagguuuggauggg

SEQ ID NO: 2424163 - RNA, 14 nt, Human
aggguagcccgccu

SEQ ID NO: 2424164 - RNA, 15 nt, Human
aggguagcagguacc

SEQ ID NO: 2424165 - RNA, 19 nt, Human
agggggcuugaagccaaag

SEQ ID NO: 2424166 - RNA, 18 nt, Human
agggggcuugaagccaaa

SEQ ID NO: 2424167 - RNA, 16 nt, Human
agggggcuugaagcca

SEQ ID NO: 2424168 - RNA, 14 nt, Human
aggggggagcuggg

SEQ ID NO: 2424169 - RNA, 13 nt, Human
aggggggagcugg

SEQ ID NO: 2424170 - RNA, 14 nt, Human
aggggggaagauca

SEQ ID NO: 2424171 - RNA, 17 nt, Human
aggggggaagaucaggu

SEQ ID NO: 2424172 - RNA, 23 nt, Human
aggggggcacaugcugagucucc

SEQ ID NO: 2424173 - RNA, 17 nt, Human
aggggggcugccuggcc

SEQ ID NO: 2424174 - RNA, 24 nt, Human
agggggucccagugggaggggcag

SEQ ID NO: 2424175 - RNA, 20 nt, Human
agggggucccagugggaggg

SEQ ID NO: 2424176 - RNA, 19 nt, Human
agggggucccagugggagg

SEQ ID NO: 2424177 - RNA, 16 nt, Human
agggggucccaguggg

SEQ ID NO: 2424178 - RNA, 16 nt, Human
aggggguccacccagc

SEQ ID NO: 2424179 - RNA, 21 nt, Human
agggggguugugaggccuggc

SEQ ID NO: 2424180 - RNA, 16 nt, Human
aggggucaggcuccau

SEQ ID NO: 2424181 - RNA, 14 nt, Human
aggggucagggacc

SEQ ID NO: 2424182 - RNA, 20 nt, Human
aggggucagggaccaaggac

SEQ ID NO: 2424183 - RNA, 24 nt, Human
aggggucagggaccaaggaccccu

SEQ ID NO: 2424184 - RNA, 15 nt, Human
aggggucaggcucca

SEQ ID NO: 2424185 - RNA, 17 nt, Human
aggggucucccuggagu

SEQ ID NO: 2424186 - RNA, 15 nt, Human
aggguaaggugccuu

SEQ ID NO: 2424187 - RNA, 14 nt, Human
aggguaaggugccu

SEQ ID NO: 2424188 - RNA, 19 nt, Human
aggggucucccuggagugc

SEQ ID NO: 2424189 - RNA, 16 nt, Human
aggggucucccuggag

SEQ ID NO: 2424190 - RNA, 15 nt, Human
aggggucucccugga

SEQ ID NO: 2424191 - RNA, 16 nt, Human
agggguccuuggugug

SEQ ID NO: 2424192 - RNA, 18 nt, Human
aggggucuccaggaggag

SEQ ID NO: 2424193 - RNA, 13 nt, Human
aggggucucccug

SEQ ID NO: 2424194 - RNA, 19 nt, Human
aggggucuccaggaggaga

SEQ ID NO: 2424195 - RNA, 19 nt, Human
aggggucccagccaccccg

SEQ ID NO: 2424196 - RNA, 15 nt, Human
aggggucccagccac

SEQ ID NO: 2424197 - RNA, 18 nt, Human
aggggucccagccacccc

SEQ ID NO: 2424198 - RNA, 21 nt, Human
aggggucggcugaccaugcuc

SEQ ID NO: 2424199 - RNA, 15 nt, Human
aggggucggcugacc

SEQ ID NO: 2424200 - RNA, 14 nt, Human
aggggcuuucugga

SEQ ID NO: 2424201 - RNA, 16 nt, Human
aggggcuuucuggaga

SEQ ID NO: 2424202 - RNA, 13 nt, Human
agggggcugggac

SEQ ID NO: 2424203 - RNA, 17 nt, Human
aggggcuuucuggagag

SEQ ID NO: 2424204 - RNA, 20 nt, Human
aggggcuuucuggagaggag

SEQ ID NO: 2424205 - RNA, 16 nt, Human
aggggauagagagaga

SEQ ID NO: 2424206 - RNA, 16 nt, Human
aggggaguugugucug

SEQ ID NO: 2424207 - RNA, 19 nt, Human
aggggcuggccuuccugcc

SEQ ID NO: 2424208 - RNA, 19 nt, Human
aggggcuggcuucaggagg

SEQ ID NO: 2424209 - RNA, 17 nt, Human
aggggcuggcuucagga

SEQ ID NO: 2424210 - RNA, 16 nt, Human
aggggcuggcuucagg

SEQ ID NO: 2424211 - RNA, 23 nt, Human
aggggcuggccuuccugcccuac

SEQ ID NO: 2424212 - RNA, 19 nt, Human
aggggaggguggcagguga

SEQ ID NO: 2424213 - RNA, 16 nt, Human
aggggaggguggcagg

SEQ ID NO: 2424214 - RNA, 16 nt, Human
aggggaggggggcaca

SEQ ID NO: 2424215 - RNA, 18 nt, Human
aggggagggggauccgac

SEQ ID NO: 2424216 - RNA, 13 nt, Human
aggggaggcagcc

SEQ ID NO: 2424217 - RNA, 21 nt, Human
aggggaggcagccggcaccca

SEQ ID NO: 2424218 - RNA, 14 nt, Human
aggggaggagggcg

SEQ ID NO: 2424219 - RNA, 19 nt, Human
aggggaggaucacuggagc

SEQ ID NO: 2424220 - RNA, 14 nt, Human
aggggacgcuggua

SEQ ID NO: 2424221 - RNA, 13 nt, Human
aggggaggagggc

SEQ ID NO: 2424222 - RNA, 22 nt, Human
aggggacccccgcccccugccc

SEQ ID NO: 2424223 - RNA, 14 nt, Human
aggggacccccgcc

SEQ ID NO: 2424224 - RNA, 19 nt, Human
aggggacccccgcccccug

SEQ ID NO: 2424225 - RNA, 18 nt, Human
aggggacccccgcccccu

SEQ ID NO: 2424226 - RNA, 15 nt, Human
aggggacccccgccc

SEQ ID NO: 2424227 - RNA, 20 nt, Human
ugggaauauuugaaucuugu

SEQ ID NO: 2424228 - RNA, 19 nt, Human
ugggaauauuugaaucuug

SEQ ID NO: 2424229 - RNA, 23 nt, Human
aggggacacuucccucuguuucu

SEQ ID NO: 2424230 - RNA, 22 nt, Human
ugggaauauuugaaucuugucu

SEQ ID NO: 2424231 - RNA, 18 nt, Human
ugggaauauuugaaucuu

SEQ ID NO: 2424232 - RNA, 16 nt, Human
ugggaauauuugaauc

SEQ ID NO: 2424233 - RNA, 15 nt, Human
ugggaauauuugaau

SEQ ID NO: 2424234 - RNA, 14 nt, Human
ugggaauauuugaa

SEQ ID NO: 2424235 - RNA, 23 nt, Human
ugggaauaagugccaggauggaa

SEQ ID NO: 2424236 - RNA, 13 nt, Human
ugggaauauuuga

SEQ ID NO: 2424237 - RNA, 23 nt, Human
ugguggcagcucaccucucccuu

SEQ ID NO: 2424238 - RNA, 20 nt, Human
ugguggcagcucaccucucc

SEQ ID NO: 2424239 - RNA, 19 nt, Human
ugguggcagcucaccucuc

SEQ ID NO: 2424240 - RNA, 16 nt, Human
ugguggcagcucaccu

SEQ ID NO: 2424241 - RNA, 12 nt, Human
ugguggcagcuc

SEQ ID NO: 2424242 - RNA, 15 nt, Human
ugguggcagagugga

SEQ ID NO: 2424243 - RNA, 16 nt, Human
aggugaaggaauauau

SEQ ID NO: 2424244 - RNA, 14 nt, Human
aggugaaggaauau

SEQ ID NO: 2424245 - RNA, 23 nt, Human
aggugaaggaauauauggcagag

SEQ ID NO: 2424246 - RNA, 17 nt, Human
aggugaaggaauauaug

SEQ ID NO: 2424247 - RNA, 19 nt, Human
ugguggcacugagcccccc

SEQ ID NO: 2424248 - RNA, 17 nt, Human
ugguggcacugagcccc

SEQ ID NO: 2424249 - RNA, 12 nt, Human
ugguggcagcug

SEQ ID NO: 2424250 - RNA, 18 nt, Human
uggugugaucgucugacu

SEQ ID NO: 2424251 - RNA, 17 nt, Human
uggugugaccugagggc

SEQ ID NO: 2424252 - RNA, 18 nt, Human
uggugugacccucugaau

SEQ ID NO: 2424253 - RNA, 16 nt, Human
ugguggcacugagccc

SEQ ID NO: 2424254 - RNA, 16 nt, Human
uggugugaccugaggg

SEQ ID NO: 2424255 - RNA, 16 nt, Human
uggugugaucgucuga

SEQ ID NO: 2424256 - RNA, 16 nt, Human
ugguguggcaaagccu

SEQ ID NO: 2424257 - RNA, 19 nt, Human
uggugugucccccucuguc

SEQ ID NO: 2424258 - RNA, 15 nt, Human
ugguguguguaugcg

SEQ ID NO: 2424259 - RNA, 21 nt, Human
ugguguucaaaaaacuuguaa

SEQ ID NO: 2424260 - RNA, 22 nt, Human
ugguguucaaaaaacuuguaaa

SEQ ID NO: 2424261 - RNA, 13 nt, Human
ugguguugcagaa

SEQ ID NO: 2424262 - RNA, 20 nt, Human
ugguucacucuuggagccug

SEQ ID NO: 2424263 - RNA, 21 nt, Human
ugguucacucuuggagccugc

SEQ ID NO: 2424264 - RNA, 22 nt, Human
ugguucacucuuggagccugca

SEQ ID NO: 2424265 - RNA, 13 nt, Human
ugguuauuucucu

SEQ ID NO: 2424266 - RNA, 22 nt, Human
ugguucaggguuggccccugcc

SEQ ID NO: 2424267 - RNA, 20 nt, Human
ugguucaggguuggccccug

SEQ ID NO: 2424268 - RNA, 23 nt, Human
ugguucaggguuggccccugccc

SEQ ID NO: 2424269 - RNA, 16 nt, Human
ugguucagcuaagcua

SEQ ID NO: 2424270 - RNA, 17 nt, Human
ugguuuacacuuuaugc

SEQ ID NO: 2424271 - RNA, 17 nt, Human
ugguguuuccuggcacu

SEQ ID NO: 2424272 - RNA, 15 nt, Human
ugguguuuccuggca

SEQ ID NO: 2424273 - RNA, 20 nt, Human
ugguguuuuggggaugagag

SEQ ID NO: 2424274 - RNA, 16 nt, Human
ugguguuucucccucu

SEQ ID NO: 2424275 - RNA, 20 nt, Human
ugguguuuucuuaugcagga

SEQ ID NO: 2424276 - RNA, 21 nt, Human
ugguguuucuagcacuggccu

SEQ ID NO: 2424277 - RNA, 18 nt, Human
ugguguuucuagcacugg

SEQ ID NO: 2424278 - RNA, 16 nt, Human
ugguguuguaugccuu

SEQ ID NO: 2424279 - RNA, 17 nt, Human
ugguguugcagaagguu

SEQ ID NO: 2424280 - RNA, 17 nt, Human
ugguucacucuuggagc

SEQ ID NO: 2424281 - RNA, 15 nt, Human
ugguuauuucucuga

SEQ ID NO: 2424282 - RNA, 22 nt, Human
ugguuauuuagggaacugcuug

SEQ ID NO: 2424283 - RNA, 15 nt, Human
ugguuaagucuguuu

SEQ ID NO: 2424284 - RNA, 18 nt, Human
ugguuaagucuguuuuau

SEQ ID NO: 2424285 - RNA, 17 nt, Human
ugguuaaucuuuccuga

SEQ ID NO: 2424286 - RNA, 18 nt, Human
uguaaagccaacacccug

SEQ ID NO: 2424287 - RNA, 18 nt, Human
uguaaagcauuccaacaa

SEQ ID NO: 2424288 - RNA, 13 nt, Human
ugguuuucuguuc

SEQ ID NO: 2424289 - RNA, 15 nt, Human
ugguuuucuguucuu

SEQ ID NO: 2424290 - RNA, 21 nt, Human
uguaaagagaccuaccucagg

SEQ ID NO: 2424291 - RNA, 23 nt, Human
uguaaagaaagagagaaaauaaa

SEQ ID NO: 2424292 - RNA, 23 nt, Human
uguaaagagaccuaccucagguu

SEQ ID NO: 2424293 - RNA, 22 nt, Human
uguaaagagaccuaccucaggu

SEQ ID NO: 2424294 - RNA, 18 nt, Human
uguaaagauauuuuuauc

SEQ ID NO: 2424295 - RNA, 17 nt, Human
uguaaagcauuccaaca

SEQ ID NO: 2424296 - RNA, 12 nt, Human
uguaaagcauuc

SEQ ID NO: 2424297 - RNA, 23 nt, Human
aggugauccacccaccucagccu

SEQ ID NO: 2424298 - RNA, 21 nt, Human
aggugauccacccaccucagc

SEQ ID NO: 2424299 - RNA, 13 nt, Human
uguaaauauuuau

SEQ ID NO: 2424300 - RNA, 20 nt, Human
uguaaauauucuauaugaau

SEQ ID NO: 2424301 - RNA, 12 nt, Human
uguaaauauuua

SEQ ID NO: 2424302 - RNA, 16 nt, Human
uguaaauauucuauau

SEQ ID NO: 2424303 - RNA, 15 nt, Human
uguaaauauucuaua

SEQ ID NO: 2424304 - RNA, 14 nt, Human
uguaaauauucuau

SEQ ID NO: 2424305 - RNA, 22 nt, Human
uguaaauauguuuuuuagauca

SEQ ID NO: 2424306 - RNA, 21 nt, Human
uguaaauauauaaauauauau

SEQ ID NO: 2424307 - RNA, 19 nt, Human
uguaaauauauaaauauau

SEQ ID NO: 2424308 - RNA, 18 nt, Human
uguaaauauauaaauaua

SEQ ID NO: 2424309 - RNA, 17 nt, Human
uguaaauauauaaauau

SEQ ID NO: 2424310 - RNA, 16 nt, Human
uguaaauauauaaaua

SEQ ID NO: 2424311 - RNA, 15 nt, Human
uguaaauauauaaau

SEQ ID NO: 2424312 - RNA, 14 nt, Human
uguaaauauauaaa

SEQ ID NO: 2424313 - RNA, 13 nt, Human
uguaaauauauaa

SEQ ID NO: 2424314 - RNA, 12 nt, Human
uguaaauauaua

SEQ ID NO: 2424315 - RNA, 12 nt, Human
uguaaauacaua

SEQ ID NO: 2424316 - RNA, 13 nt, Human
uguaaauacauaa

SEQ ID NO: 2424317 - RNA, 12 nt, Human
uguaaauacacc

SEQ ID NO: 2424318 - RNA, 21 nt, Human
uguaaauacacauagcaugua

SEQ ID NO: 2424319 - RNA, 14 nt, Human
ugguuucagaaaug

SEQ ID NO: 2424320 - RNA, 15 nt, Human
ugguuucagaaaugu

SEQ ID NO: 2424321 - RNA, 11 nt, Human
ugguuuauguc

SEQ ID NO: 2424322 - RNA, 21 nt, Human
ugguuuauagagggccaagac

SEQ ID NO: 2424323 - RNA, 12 nt, Human
ugguuuauguca

SEQ ID NO: 2424324 - RNA, 16 nt, Human
ugguuucaaagauuca

SEQ ID NO: 2424325 - RNA, 16 nt, Human
ugguuucacuggccca

SEQ ID NO: 2424326 - RNA, 18 nt, Human
ugguuuaacuucugccug

SEQ ID NO: 2424327 - RNA, 11 nt, Human
ugguuuauaga

SEQ ID NO: 2424328 - RNA, 16 nt, Human
ugguuucuagacuugu

SEQ ID NO: 2424329 - RNA, 12 nt, Human
ugguuucuccag

SEQ ID NO: 2424330 - RNA, 15 nt, Human
ugguuucgaacuccu

SEQ ID NO: 2424331 - RNA, 20 nt, Human
ugguuuccacgaugaaaaac

SEQ ID NO: 2424332 - RNA, 13 nt, Human
ugguuuccuuccu

SEQ ID NO: 2424333 - RNA, 18 nt, Human
ugguuucacuggcccaag

SEQ ID NO: 2424334 - RNA, 21 nt, Human
ugguuucacggugccagguuu

SEQ ID NO: 2424335 - RNA, 21 nt, Human
ugguuuccacgaugaaaaacu

SEQ ID NO: 2424336 - RNA, 21 nt, Human
ugguuuguaaauuaacuuuua

SEQ ID NO: 2424337 - RNA, 23 nt, Human
ugguuucuucaacaggagaauuu

SEQ ID NO: 2424338 - RNA, 21 nt, Human
ugguuugagacacugguuuac

SEQ ID NO: 2424339 - RNA, 23 nt, Human
ugguuugagcuuagugaaauuac

SEQ ID NO: 2424340 - RNA, 17 nt, Human
ugguuugagcuuaguga

SEQ ID NO: 2424341 - RNA, 15 nt, Human
ugguuugcagagcuu

SEQ ID NO: 2424342 - RNA, 17 nt, Human
ugguuugcaaggaagcc

SEQ ID NO: 2424343 - RNA, 15 nt, Human
ugguuugcaaggaag

SEQ ID NO: 2424344 - RNA, 12 nt, Human
ugguuuuaacaa

SEQ ID NO: 2424345 - RNA, 18 nt, Human
ugguuuuaacaauuuccu

SEQ ID NO: 2424346 - RNA, 18 nt, Human
ugguuuuaguugcaacuu

SEQ ID NO: 2424347 - RNA, 23 nt, Human
ugguuuuauacugaaggaaaaac

SEQ ID NO: 2424348 - RNA, 16 nt, Human
ugguuuuauacugaag

SEQ ID NO: 2424349 - RNA, 12 nt, Human
ugguuuucuguu

SEQ ID NO: 2424350 - RNA, 22 nt, Human
ugguuuuccccucccuggguuc

SEQ ID NO: 2424351 - RNA, 16 nt, Human
ugguuuuccuaaaugc

SEQ ID NO: 2424352 - RNA, 22 nt, Human
ugguuuuccuaaaugcagugaa

SEQ ID NO: 2424353 - RNA, 20 nt, Human
aggugugagucaccaagccc

SEQ ID NO: 2424354 - RNA, 14 nt, Human
aggugugagucacc

SEQ ID NO: 2424355 - RNA, 20 nt, Human
aggugugacugaauuucuuu

SEQ ID NO: 2424356 - RNA, 20 nt, Human
aggugugagccaccacgccc

SEQ ID NO: 2424357 - RNA, 15 nt, Human
agguggucugaaugu

SEQ ID NO: 2424358 - RNA, 16 nt, Human
agguggucugaauguu

SEQ ID NO: 2424359 - RNA, 17 nt, Human
agguggucugaauguuc

SEQ ID NO: 2424360 - RNA, 22 nt, Human
aggugugaaccaccacacccag

SEQ ID NO: 2424361 - RNA, 19 nt, Human
agguggguuuucuucccau

SEQ ID NO: 2424362 - RNA, 21 nt, Human
agguggguuuucuucccauca

SEQ ID NO: 2424363 - RNA, 22 nt, Human
agguggguuuucuucccaucac

SEQ ID NO: 2424364 - RNA, 15 nt, Human
aggugguaugugugu

SEQ ID NO: 2424365 - RNA, 18 nt, Human
aggugguaugugugugua

SEQ ID NO: 2424366 - RNA, 19 nt, Human
aggugguccugagaccuga

SEQ ID NO: 2424367 - RNA, 14 nt, Human
agguggucugaaug

SEQ ID NO: 2424368 - RNA, 18 nt, Human
aggugugacugaauuucu

SEQ ID NO: 2424369 - RNA, 23 nt, Human
aggugugaaccaccacacccagc

SEQ ID NO: 2424370 - RNA, 22 nt, Human
aggugauccacucgccuucauc

SEQ ID NO: 2424371 - RNA, 13 nt, Human
agguggggcagcu

SEQ ID NO: 2424372 - RNA, 19 nt, Human
agguggggagacugggcug

SEQ ID NO: 2424373 - RNA, 21 nt, Human
agguggggagacugggcugag

SEQ ID NO: 2424374 - RNA, 11 nt, Human
agguggggagg

SEQ ID NO: 2424375 - RNA, 22 nt, Human
agguggggaggggguuuggggg

SEQ ID NO: 2424376 - RNA, 23 nt, Human
agguggggaggggguuugggggc

SEQ ID NO: 2424377 - RNA, 13 nt, Human
agguggggaguca

SEQ ID NO: 2424378 - RNA, 23 nt, Human
agguggggucacucuggcagcuc

SEQ ID NO: 2424379 - RNA, 14 nt, Human
agguggggcagcuu

SEQ ID NO: 2424380 - RNA, 23 nt, Human
agguggguuuucaucaagacugg

SEQ ID NO: 2424381 - RNA, 23 nt, Human
agguggguuuucuucccaucacu

SEQ ID NO: 2424382 - RNA, 22 nt, Human
agguggggucuuugugagagug

SEQ ID NO: 2424383 - RNA, 22 nt, Human
aggugggguugggauugggggc

SEQ ID NO: 2424384 - RNA, 21 nt, Human
agguggggucuuugugagagu

SEQ ID NO: 2424385 - RNA, 17 nt, Human
agguuuaaacuucucug

SEQ ID NO: 2424386 - RNA, 16 nt, Human
agguuguuccuaaaau

SEQ ID NO: 2424387 - RNA, 17 nt, Human
agguuguaguaaagaaa

SEQ ID NO: 2424388 - RNA, 20 nt, Human
agguugucugaagucacugc

SEQ ID NO: 2424389 - RNA, 20 nt, Human
agguguuuaaagagagguua

SEQ ID NO: 2424390 - RNA, 18 nt, Human
agguguuuaaagagaggu

SEQ ID NO: 2424391 - RNA, 17 nt, Human
agguguuuaaagagagg

SEQ ID NO: 2424392 - RNA, 13 nt, Human
agguguuuaaaga

SEQ ID NO: 2424393 - RNA, 16 nt, Human
agguugucugaaguca

SEQ ID NO: 2424394 - RNA, 15 nt, Human
agguguuacuguaau

SEQ ID NO: 2424395 - RNA, 16 nt, Human
agguguuacuguaauu

SEQ ID NO: 2424396 - RNA, 22 nt, Human
agguguucaagaccagccugac

SEQ ID NO: 2424397 - RNA, 17 nt, Human
agguguucuacacucau

SEQ ID NO: 2424398 - RNA, 23 nt, Human
agguguugccaaauauguccugg

SEQ ID NO: 2424399 - RNA, 22 nt, Human
agguguugccaaauauguccug

SEQ ID NO: 2424400 - RNA, 15 nt, Human
agguguugucccuuc

SEQ ID NO: 2424401 - RNA, 16 nt, Human
agguguugucccuucu

SEQ ID NO: 2424402 - RNA, 21 nt, Human
agguguugccaaauauguccu

SEQ ID NO: 2424403 - RNA, 12 nt, Human
agguguugccaa

SEQ ID NO: 2424404 - RNA, 21 nt, Human
agguguugauuuucuguugua

SEQ ID NO: 2424405 - RNA, 18 nt, Human
agguguugauuuucuguu

SEQ ID NO: 2424406 - RNA, 20 nt, Human
agguguucuacacucaucuu

SEQ ID NO: 2424407 - RNA, 15 nt, Human
uguaaggaaugauua

SEQ ID NO: 2424408 - RNA, 14 nt, Human
uguaaggaaugauu

SEQ ID NO: 2424409 - RNA, 13 nt, Human
uguaaggaaugau

SEQ ID NO: 2424410 - RNA, 16 nt, Human
uguaagcugaaaauau

SEQ ID NO: 2424411 - RNA, 14 nt, Human
uguaagcugaaaau

SEQ ID NO: 2424412 - RNA, 12 nt, Human
uguaagaaauac

SEQ ID NO: 2424413 - RNA, 18 nt, Human
uguaagaaauacuguaca

SEQ ID NO: 2424414 - RNA, 22 nt, Human
uguaagcucuacugaggugcua

SEQ ID NO: 2424415 - RNA, 18 nt, Human
uguaagaaaauaucacuu

SEQ ID NO: 2424416 - RNA, 17 nt, Human
uguaagaaaauaucacu

SEQ ID NO: 2424417 - RNA, 13 nt, Human
agguuuaacucag

SEQ ID NO: 2424418 - RNA, 17 nt, Human
uguaagaaacacacuga

SEQ ID NO: 2424419 - RNA, 22 nt, Human
uguaagaaacacacugaggcag

SEQ ID NO: 2424420 - RNA, 16 nt, Human
uguaauuugugauaca

SEQ ID NO: 2424421 - RNA, 15 nt, Human
uguaaggcaaucaug

SEQ ID NO: 2424422 - RNA, 18 nt, Human
uguaaggaaugauuaauu

SEQ ID NO: 2424423 - RNA, 22 nt, Human
uguaagcuguuuauuuuauauu

SEQ ID NO: 2424424 - RNA, 16 nt, Human
uguaagcuguuuauuu

SEQ ID NO: 2424425 - RNA, 15 nt, Human
uguaagcuguuuauu

SEQ ID NO: 2424426 - RNA, 14 nt, Human
uguaagcuguuuau

SEQ ID NO: 2424427 - RNA, 13 nt, Human
uguaagcugaagu

SEQ ID NO: 2424428 - RNA, 17 nt, Human
uguaauuugugauacaa

SEQ ID NO: 2424429 - RNA, 21 nt, Human
uguaauuugugauacaaugcu

SEQ ID NO: 2424430 - RNA, 14 nt, Human
uguaaggcaugaag

SEQ ID NO: 2424431 - RNA, 15 nt, Human
uguaaggcaugaagg

SEQ ID NO: 2424432 - RNA, 16 nt, Human
uguaauuuuauaugaa

SEQ ID NO: 2424433 - RNA, 22 nt, Human
uguacaaaauaaacaaauaaca

SEQ ID NO: 2424434 - RNA, 21 nt, Human
uguaauuuuaaauaaaaguga

SEQ ID NO: 2424435 - RNA, 14 nt, Human
uguacauauaagug

SEQ ID NO: 2424436 - RNA, 21 nt, Human
uguacaaaaucgauuggcuuu

SEQ ID NO: 2424437 - RNA, 19 nt, Human
uguacaaaguagaagucuu

SEQ ID NO: 2424438 - RNA, 23 nt, Human
uguacaaaguagaagucuuagau

SEQ ID NO: 2424439 - RNA, 21 nt, Human
uguacaucccauguaacagaa

SEQ ID NO: 2424440 - RNA, 20 nt, Human
uguacaucccauguaacaga

SEQ ID NO: 2424441 - RNA, 18 nt, Human
uguacaucccauguaaca

SEQ ID NO: 2424442 - RNA, 17 nt, Human
uguacaucccauguaac

SEQ ID NO: 2424443 - RNA, 23 nt, Human
uguacaucccauguaacagaaag

SEQ ID NO: 2424444 - RNA, 22 nt, Human
uguacaucccauguaacagaaa

SEQ ID NO: 2424445 - RNA, 14 nt, Human
uguacaucuauuuu

SEQ ID NO: 2424446 - RNA, 20 nt, Human
uguacauaugugcuggaauu

SEQ ID NO: 2424447 - RNA, 19 nt, Human
uguacauauuuguggaaua

SEQ ID NO: 2424448 - RNA, 18 nt, Human
uguacauauuuguggaau

SEQ ID NO: 2424449 - RNA, 20 nt, Human
uguacauauuugagacuagu

SEQ ID NO: 2424450 - RNA, 17 nt, Human
uguacauaugugcugga

SEQ ID NO: 2424451 - RNA, 15 nt, Human
uguacauaugugcug

SEQ ID NO: 2424452 - RNA, 19 nt, Human
uguacauauguaaaauaaa

SEQ ID NO: 2424453 - RNA, 21 nt, Human
uguacauauguaaaauaaaau

SEQ ID NO: 2424454 - RNA, 13 nt, Human
uguacauauguaa

SEQ ID NO: 2424455 - RNA, 15 nt, Human
uguacauauguaaaa

SEQ ID NO: 2424456 - RNA, 16 nt, Human
uguacauauguaaaau

SEQ ID NO: 2424457 - RNA, 18 nt, Human
uguacauauguaaaauaa

SEQ ID NO: 2424458 - RNA, 17 nt, Human
uguacaugaaaacacau

SEQ ID NO: 2424459 - RNA, 18 nt, Human
uguacaugaaaacacauu

SEQ ID NO: 2424460 - RNA, 19 nt, Human
uguacaugaaaacacauuu

SEQ ID NO: 2424461 - RNA, 20 nt, Human
uguacauguguagccugugc

SEQ ID NO: 2424462 - RNA, 17 nt, Human
uguacauguguagccug

SEQ ID NO: 2424463 - RNA, 20 nt, Human
uguacaugaaaacacauuuu

SEQ ID NO: 2424464 - RNA, 21 nt, Human
uguacauuuccaaauucacaa

SEQ ID NO: 2424465 - RNA, 22 nt, Human
uguacauuuccaaauucacaag

SEQ ID NO: 2424466 - RNA, 15 nt, Human
uguacuuaacuauuc

SEQ ID NO: 2424467 - RNA, 13 nt, Human
uguacauuucuga

SEQ ID NO: 2424468 - RNA, 22 nt, Human
uguacauuagucauucaauaaa

SEQ ID NO: 2424469 - RNA, 14 nt, Human
uguacauuaauuac

SEQ ID NO: 2424470 - RNA, 21 nt, Human
uguacauguguagccugugca

SEQ ID NO: 2424471 - RNA, 21 nt, Human
uguacauuuaugauuuaauaa

SEQ ID NO: 2424472 - RNA, 20 nt, Human
uguacauuuaugauuuaaua

SEQ ID NO: 2424473 - RNA, 15 nt, Human
uguacauucuaaaau

SEQ ID NO: 2424474 - RNA, 10 nt, Human
uguacauuuc

SEQ ID NO: 2424475 - RNA, 18 nt, Human
uguacauuuccaaauuca

SEQ ID NO: 2424476 - RNA, 15 nt, Human
uguacuugcucuuga

SEQ ID NO: 2424477 - RNA, 16 nt, Human
uguacauuucugaaau

SEQ ID NO: 2424478 - RNA, 16 nt, Human
uguacuuaauaaauuc

SEQ ID NO: 2424479 - RNA, 20 nt, Human
uguacuuaauaaauucagau

SEQ ID NO: 2424480 - RNA, 21 nt, Human
uguacuuaauaaauucagaua

SEQ ID NO: 2424481 - RNA, 14 nt, Human
uguacuucacuguc

SEQ ID NO: 2424482 - RNA, 13 nt, Human
uguacuucacugu

SEQ ID NO: 2424483 - RNA, 22 nt, Human
uguacuuaauaaauucagauau

SEQ ID NO: 2424484 - RNA, 14 nt, Human
uguacuucaaguua

SEQ ID NO: 2424485 - RNA, 21 nt, Human
uguacuucgucuucuaauuuc

SEQ ID NO: 2424486 - RNA, 21 nt, Human
uguacuucacugucaggaaga

SEQ ID NO: 2424487 - RNA, 16 nt, Human
uguacuugaugacaga

SEQ ID NO: 2424488 - RNA, 17 nt, Human
uguagaaugauuucaug

SEQ ID NO: 2424489 - RNA, 18 nt, Human
uguagaaugauuucaugc

SEQ ID NO: 2424490 - RNA, 19 nt, Human
uguagaauguauuguaccu

SEQ ID NO: 2424491 - RNA, 17 nt, Human
uguagaauguauuguac

SEQ ID NO: 2424492 - RNA, 18 nt, Human
uguagaauguauuguacc

SEQ ID NO: 2424493 - RNA, 21 nt, Human
uguagaccuagggaggaccuu

SEQ ID NO: 2424494 - RNA, 16 nt, Human
uguagaaugauuucau

SEQ ID NO: 2424495 - RNA, 22 nt, Human
uguagaaguaggaagugaaaau

SEQ ID NO: 2424496 - RNA, 22 nt, Human
uguagaagcauuccuucuuuga

SEQ ID NO: 2424497 - RNA, 17 nt, Human
uguagaagcauuccuuc

SEQ ID NO: 2424498 - RNA, 17 nt, Human
uguagaaggagacagag

SEQ ID NO: 2424499 - RNA, 21 nt, Human
uguagaaggagacagagcugg

SEQ ID NO: 2424500 - RNA, 16 nt, Human
uguagaagcauuccuu

SEQ ID NO: 2424501 - RNA, 15 nt, Human
uguagaagcauuccu

SEQ ID NO: 2424502 - RNA, 13 nt, Human
uguagaagcauuc

SEQ ID NO: 2424503 - RNA, 14 nt, Human
auaaccagcuguaa

SEQ ID NO: 2424504 - RNA, 22 nt, Human
auaacucuguggcauuauugca

SEQ ID NO: 2424505 - RNA, 13 nt, Human
auaacugaaaaug

SEQ ID NO: 2424506 - RNA, 19 nt, Human
auaaccagcuguaacacag

SEQ ID NO: 2424507 - RNA, 15 nt, Human
auaacugaaaaugug

SEQ ID NO: 2424508 - RNA, 14 nt, Human
auaacugaaggaga

SEQ ID NO: 2424509 - RNA, 20 nt, Human
auaaccaguguuguggauuu

SEQ ID NO: 2424510 - RNA, 22 nt, Human
auaaccacuuaaaaaaugucca

SEQ ID NO: 2424511 - RNA, 13 nt, Human
auaaccacuuaaa

SEQ ID NO: 2424512 - RNA, 20 nt, Human
auaaccaaagcccaaagugg

SEQ ID NO: 2424513 - RNA, 23 nt, Human
auaaccacaaagcacaguuugaa

SEQ ID NO: 2424514 - RNA, 12 nt, Human
auaacuggaaac

SEQ ID NO: 2424515 - RNA, 18 nt, Human
auaacugccuuaaaacuu

SEQ ID NO: 2424516 - RNA, 18 nt, Human
auaacugaaggagaaggu

SEQ ID NO: 2424517 - RNA, 12 nt, Human
auaacugagaau

SEQ ID NO: 2424518 - RNA, 16 nt, Human
auaacugaaggagaag

SEQ ID NO: 2424519 - RNA, 19 nt, Human
auaaauaaaguuuguugaa

SEQ ID NO: 2424520 - RNA, 13 nt, Human
auaaauaaaguuu

SEQ ID NO: 2424521 - RNA, 12 nt, Human
auaaauaaaugu

SEQ ID NO: 2424522 - RNA, 15 nt, Human
auaaauaaauauaua

SEQ ID NO: 2424523 - RNA, 16 nt, Human
auaaauaaaugcaaua

SEQ ID NO: 2424524 - RNA, 14 nt, Human
auaaauaaauauau

SEQ ID NO: 2424525 - RNA, 13 nt, Human
auaaauaaauaua

SEQ ID NO: 2424526 - RNA, 14 nt, Human
auaaauaaaaugac

SEQ ID NO: 2424527 - RNA, 12 nt, Human
auaaauaaauau

SEQ ID NO: 2424528 - RNA, 20 nt, Human
auaaaugucuuuuuuuuaau

SEQ ID NO: 2424529 - RNA, 12 nt, Human
auaaaugucuuu

SEQ ID NO: 2424530 - RNA, 15 nt, Human
auaaaugucuguuga

SEQ ID NO: 2424531 - RNA, 12 nt, Human
auaaaugucugu

SEQ ID NO: 2424532 - RNA, 21 nt, Human
auaaaugucauuaaaauaaau

SEQ ID NO: 2424533 - RNA, 20 nt, Human
auaacauuaccuuacugugg

SEQ ID NO: 2424534 - RNA, 19 nt, Human
auaacauuaccuuacugug

SEQ ID NO: 2424535 - RNA, 14 nt, Human
auaacauuaccuua

SEQ ID NO: 2424536 - RNA, 21 nt, Human
auaaauuauuaguuuacauca

SEQ ID NO: 2424537 - RNA, 15 nt, Human
auaaauuauguuuau

SEQ ID NO: 2424538 - RNA, 14 nt, Human
auaaauuauguuua

SEQ ID NO: 2424539 - RNA, 13 nt, Human
auaaauuauguuu

SEQ ID NO: 2424540 - RNA, 13 nt, Human
auaaauuauaagu

SEQ ID NO: 2424541 - RNA, 19 nt, Human
auaaaugugccuucauuuu

SEQ ID NO: 2424542 - RNA, 23 nt, Human
auaaaugucuuuuuuuuaaugug

SEQ ID NO: 2424543 - RNA, 22 nt, Human
auaaaugucuuuuuuuuaaugu

SEQ ID NO: 2424544 - RNA, 22 nt, Human
uuacaggaaguacuggagaaaa

SEQ ID NO: 2424545 - RNA, 18 nt, Human
uuacaggaaguacuggag

SEQ ID NO: 2424546 - RNA, 16 nt, Human
uuacaugauucauuuu

SEQ ID NO: 2424547 - RNA, 17 nt, Human
uuacaugauucauuuua

SEQ ID NO: 2424548 - RNA, 17 nt, Human
uuacaugaauugcauuu

SEQ ID NO: 2424549 - RNA, 14 nt, Human
uuacaugacacagc

SEQ ID NO: 2424550 - RNA, 18 nt, Human
uuacaucuguuuuaaauu

SEQ ID NO: 2424551 - RNA, 21 nt, Human
uuacaucuguuuuaaauuuau

SEQ ID NO: 2424552 - RNA, 15 nt, Human
uuacaucuuucacau

SEQ ID NO: 2424553 - RNA, 16 nt, Human
uuacaggaaguacugg

SEQ ID NO: 2424554 - RNA, 15 nt, Human
uuacaggaaguacug

SEQ ID NO: 2424555 - RNA, 12 nt, Human
auaacugugaag

SEQ ID NO: 2424556 - RNA, 18 nt, Human
uuacaugcauacuucaaa

SEQ ID NO: 2424557 - RNA, 15 nt, Human
uuacaugcauacuuc

SEQ ID NO: 2424558 - RNA, 14 nt, Human
uuacaugcauacuu

SEQ ID NO: 2424559 - RNA, 12 nt, Human
uuacaugcauac

SEQ ID NO: 2424560 - RNA, 22 nt, Human
uuacaugcaauuuauuaaaaug

SEQ ID NO: 2424561 - RNA, 23 nt, Human
uuacaugcaauuuauuaaaauga

SEQ ID NO: 2424562 - RNA, 21 nt, Human
uuacaugcauacuucaaaagu

SEQ ID NO: 2424563 - RNA, 19 nt, Human
uuacaugcauacuucaaaa

SEQ ID NO: 2424564 - RNA, 22 nt, Human
uuacaugcauuacugcaugcac

SEQ ID NO: 2424565 - RNA, 22 nt, Human
uuacaugcauacuucaaaagua

SEQ ID NO: 2424566 - RNA, 13 nt, Human
uuacaugcauuug

SEQ ID NO: 2424567 - RNA, 16 nt, Human
uuaccaugugccugau

SEQ ID NO: 2424568 - RNA, 23 nt, Human
uuaccauuuugggguacccacug

SEQ ID NO: 2424569 - RNA, 22 nt, Human
uuacccugcgauuuugccugug

SEQ ID NO: 2424570 - RNA, 13 nt, Human
uuacccuuuagac

SEQ ID NO: 2424571 - RNA, 16 nt, Human
uuacccuuuagacugu

SEQ ID NO: 2424572 - RNA, 24 nt, Human
uuacccaaaaacuaaaucucuaau

SEQ ID NO: 2424573 - RNA, 13 nt, Human
uuacccaagcaaa

SEQ ID NO: 2424574 - RNA, 12 nt, Human
uuacccaagcaa

SEQ ID NO: 2424575 - RNA, 20 nt, Human
uuacccaagcaaaaucaugg

SEQ ID NO: 2424576 - RNA, 16 nt, Human
uuacccacacacagau

SEQ ID NO: 2424577 - RNA, 12 nt, Human
aguuuucugaga

SEQ ID NO: 2424578 - RNA, 13 nt, Human
aguuuucugagaa

SEQ ID NO: 2424579 - RNA, 22 nt, Human
aguuuuccuaagugauuguaug

SEQ ID NO: 2424580 - RNA, 12 nt, Human
aguuuuccuucu

SEQ ID NO: 2424581 - RNA, 14 nt, Human
aguuuuccuucuca

SEQ ID NO: 2424582 - RNA, 18 nt, Human
aguuuuccuucucaucug

SEQ ID NO: 2424583 - RNA, 22 nt, Human
aguuuuccuucucaucugugau

SEQ ID NO: 2424584 - RNA, 14 nt, Human
aguuuucugagaaa

SEQ ID NO: 2424585 - RNA, 17 nt, Human
aguuuucugagaaagac

SEQ ID NO: 2424586 - RNA, 23 nt, Human
auaaacacucuugaaaaaugcau

SEQ ID NO: 2424587 - RNA, 17 nt, Human
aguuuucuccucccagg

SEQ ID NO: 2424588 - RNA, 23 nt, Human
aguuuuccuucucaucugugauu

SEQ ID NO: 2424589 - RNA, 22 nt, Human
auaaaccucuaauuuauuuugu

SEQ ID NO: 2424590 - RNA, 20 nt, Human
auaaaccucuaauuuauuuu

SEQ ID NO: 2424591 - RNA, 19 nt, Human
auaaaccucuaauuuauuu

SEQ ID NO: 2424592 - RNA, 18 nt, Human
auaaaccucuaauuuauu

SEQ ID NO: 2424593 - RNA, 22 nt, Human
auaaaccuaaaaaagauauauu

SEQ ID NO: 2424594 - RNA, 20 nt, Human
auaaaccuaaaaaagauaua

SEQ ID NO: 2424595 - RNA, 19 nt, Human
auaaaccuaaaaaagauau

SEQ ID NO: 2424596 - RNA, 20 nt, Human
auaaacgauuuaauucucuu

SEQ ID NO: 2424597 - RNA, 19 nt, Human
auaaacgauuuaauucucu

SEQ ID NO: 2424598 - RNA, 18 nt, Human
auaaacgauuuaauucuc

SEQ ID NO: 2424599 - RNA, 16 nt, Human
auaaaccuuaaguaag

SEQ ID NO: 2424600 - RNA, 15 nt, Human
auaaacgauuuaauu

SEQ ID NO: 2424601 - RNA, 16 nt, Human
auaaaccucaaaaugu

SEQ ID NO: 2424602 - RNA, 18 nt, Human
auaaaccuaaaaaagaua

SEQ ID NO: 2424603 - RNA, 17 nt, Human
auaaaccuaaaaaagau

SEQ ID NO: 2424604 - RNA, 21 nt, Human
auaaaccagguuuagacagua

SEQ ID NO: 2424605 - RNA, 21 nt, Human
auaaacccaguugccaucugc

SEQ ID NO: 2424606 - RNA, 18 nt, Human
auaaacacucuugaaaaa

SEQ ID NO: 2424607 - RNA, 12 nt, Human
auaaacacugug

SEQ ID NO: 2424608 - RNA, 11 nt, Human
aguuuuccuga

SEQ ID NO: 2424609 - RNA, 14 nt, Human
auaaacacugugua

SEQ ID NO: 2424610 - RNA, 16 nt, Human
auaaacaucacacaca

SEQ ID NO: 2424611 - RNA, 22 nt, Human
auaaacaguggaauauaaggaa

SEQ ID NO: 2424612 - RNA, 17 nt, Human
auaaacaucacacacac

SEQ ID NO: 2424613 - RNA, 21 nt, Human
auaaacauccuucaagaacuc

SEQ ID NO: 2424614 - RNA, 23 nt, Human
auaaacauuaagauugaggccug

SEQ ID NO: 2424615 - RNA, 13 nt, Human
auaaacauuguau

SEQ ID NO: 2424616 - RNA, 22 nt, Human
auaaacauuuguagcauccucu

SEQ ID NO: 2424617 - RNA, 17 nt, Human
auaaacuagauuacauu

SEQ ID NO: 2424618 - RNA, 19 nt, Human
auaaacuagauuacauuca

SEQ ID NO: 2424619 - RNA, 20 nt, Human
auaaacgugaugaucagcug

SEQ ID NO: 2424620 - RNA, 20 nt, Human
auaaacgcgggaaaaaagau

SEQ ID NO: 2424621 - RNA, 13 nt, Human
auaaacugacuuu

SEQ ID NO: 2424622 - RNA, 12 nt, Human
auaaacugacuu

SEQ ID NO: 2424623 - RNA, 15 nt, Human
auaaacucuaaacau

SEQ ID NO: 2424624 - RNA, 14 nt, Human
auaaacuaucaguu

SEQ ID NO: 2424625 - RNA, 18 nt, Human
auaaacuggcagcucagc

SEQ ID NO: 2424626 - RNA, 18 nt, Human
auaaacugacuuuauccu

SEQ ID NO: 2424627 - RNA, 15 nt, Human
auaaacugacuuuau

SEQ ID NO: 2424628 - RNA, 12 nt, Human
auaaacugugug

SEQ ID NO: 2424629 - RNA, 22 nt, Human
auaaacuuuaauauaaaguagu

SEQ ID NO: 2424630 - RNA, 20 nt, Human
auaaacuuuaauauaaagua

SEQ ID NO: 2424631 - RNA, 15 nt, Human
auaaacuuagaauaa

SEQ ID NO: 2424632 - RNA, 14 nt, Human
auaaacuuagaaua

SEQ ID NO: 2424633 - RNA, 16 nt, Human
auaaacuuuaauauaa

SEQ ID NO: 2424634 - RNA, 20 nt, Human
auaaacugacuuuauccuca

SEQ ID NO: 2424635 - RNA, 14 nt, Human
auaaacugugugca

SEQ ID NO: 2424636 - RNA, 16 nt, Human
auaaacuguguuuacu

SEQ ID NO: 2424637 - RNA, 23 nt, Human
auaaacuuagugcggacaaguuu

SEQ ID NO: 2424638 - RNA, 13 nt, Human
auaaacuuuaccu

SEQ ID NO: 2424639 - RNA, 15 nt, Human
auaaacuuuaccuuu

SEQ ID NO: 2424640 - RNA, 17 nt, Human
auaaaguaguccuguga

SEQ ID NO: 2424641 - RNA, 18 nt, Human
auaaaguaucaugcauuc

SEQ ID NO: 2424642 - RNA, 17 nt, Human
auaaaguaucaugcauu

SEQ ID NO: 2424643 - RNA, 15 nt, Human
auaaaguaucaugca

SEQ ID NO: 2424644 - RNA, 18 nt, Human
auaaaguaguaaaaauua

SEQ ID NO: 2424645 - RNA, 16 nt, Human
auaaaguaguccugug

SEQ ID NO: 2424646 - RNA, 21 nt, Human
auaaacuuagaauaaaauugu

SEQ ID NO: 2424647 - RNA, 21 nt, Human
auaaaguauuuaauuagugcu

SEQ ID NO: 2424648 - RNA, 19 nt, Human
auaaaguauuuaauuagug

SEQ ID NO: 2424649 - RNA, 17 nt, Human
auaaaguauuuaauuag

SEQ ID NO: 2424650 - RNA, 15 nt, Human
auaaaguauuuaauu

SEQ ID NO: 2424651 - RNA, 14 nt, Human
auaaaguauuuaau

SEQ ID NO: 2424652 - RNA, 12 nt, Human
auaaaguauuua

SEQ ID NO: 2424653 - RNA, 19 nt, Human
auaaaguaugguauugaaa

SEQ ID NO: 2424654 - RNA, 14 nt, Human
auaaaguaucuaca

SEQ ID NO: 2424655 - RNA, 15 nt, Human
auaaauaaaaaugga

SEQ ID NO: 2424656 - RNA, 17 nt, Human
auaaauaaaaauggaua

SEQ ID NO: 2424657 - RNA, 13 nt, Human
auaaauaaaacau

SEQ ID NO: 2424658 - RNA, 23 nt, Human
auaauacaccacuacauucuguu

SEQ ID NO: 2424659 - RNA, 21 nt, Human
auaauacaccacuacauucug

SEQ ID NO: 2424660 - RNA, 18 nt, Human
auaaguuugcaauuuggg

SEQ ID NO: 2424661 - RNA, 17 nt, Human
auaaguuugcaauuugg

SEQ ID NO: 2424662 - RNA, 21 nt, Human
auaaguuugaaggaaacaguu

SEQ ID NO: 2424663 - RNA, 20 nt, Human
auaaguuugaaggaaacagu

SEQ ID NO: 2424664 - RNA, 13 nt, Human
auaaguuuuaugu

SEQ ID NO: 2424665 - RNA, 23 nt, Human
auaauaaauucccuggccuuuca

SEQ ID NO: 2424666 - RNA, 13 nt, Human
auaauaagcuaaa

SEQ ID NO: 2424667 - RNA, 15 nt, Human
auaauaagcuaaaga

SEQ ID NO: 2424668 - RNA, 22 nt, Human
auaaguuuauuucuuaaaucua

SEQ ID NO: 2424669 - RNA, 18 nt, Human
auaaguuuauuucuuaaa

SEQ ID NO: 2424670 - RNA, 14 nt, Human
auaaguuuauuucu

SEQ ID NO: 2424671 - RNA, 12 nt, Human
auaaguuuauuu

SEQ ID NO: 2424672 - RNA, 19 nt, Human
auaaguuugaaggaaacag

SEQ ID NO: 2424673 - RNA, 15 nt, Human
auaaguuugaaggaa

SEQ ID NO: 2424674 - RNA, 13 nt, Human
auaaguuugaagg

SEQ ID NO: 2424675 - RNA, 18 nt, Human
auaaguuucuuugcuuca

SEQ ID NO: 2424676 - RNA, 21 nt, Human
auaaguuucugggaccucagu

SEQ ID NO: 2424677 - RNA, 20 nt, Human
auaaguuucacugacuuaga

SEQ ID NO: 2424678 - RNA, 20 nt, Human
auaaguucuuaugccauguu

SEQ ID NO: 2424679 - RNA, 23 nt, Human
auaaguucuaguugcuuguaaaa

SEQ ID NO: 2424680 - RNA, 20 nt, Human
auaaguucaaauucuucuga

SEQ ID NO: 2424681 - RNA, 21 nt, Human
auaaguucaaauucuucugaa

SEQ ID NO: 2424682 - RNA, 24 nt, Human
auaaguucaaauucuucugaacuc

SEQ ID NO: 2424683 - RNA, 24 nt, Human
auaaguuauugcaguuuaucauuc

SEQ ID NO: 2424684 - RNA, 21 nt, Human
auaaguuauugcaguuuauca

SEQ ID NO: 2424685 - RNA, 18 nt, Human
auaaguucaaauucuucu

SEQ ID NO: 2424686 - RNA, 20 nt, Human
auaaguuauugcaguuuauc

SEQ ID NO: 2424687 - RNA, 16 nt, Human
auaaguuauugcaguu

SEQ ID NO: 2424688 - RNA, 14 nt, Human
auaaguuauugcag

SEQ ID NO: 2424689 - RNA, 13 nt, Human
auaaguuauugca

SEQ ID NO: 2424690 - RNA, 22 nt, Human
auaaguuaacuuccaauuuaca

SEQ ID NO: 2424691 - RNA, 23 nt, Human
uuaccugaucaaugacagagccu

SEQ ID NO: 2424692 - RNA, 20 nt, Human
uuaccugaucaaugacagag

SEQ ID NO: 2424693 - RNA, 22 nt, Human
auaagaaagugcgaguccucca

SEQ ID NO: 2424694 - RNA, 22 nt, Human
auaagaaccuuuugagugccuu

SEQ ID NO: 2424695 - RNA, 18 nt, Human
uuaccugaaaacacugug

SEQ ID NO: 2424696 - RNA, 20 nt, Human
uuaccugaaaacacugugca

SEQ ID NO: 2424697 - RNA, 22 nt, Human
uuaccugaaaacacugugcaca

SEQ ID NO: 2424698 - RNA, 19 nt, Human
uuaccugaucaaugacaga

SEQ ID NO: 2424699 - RNA, 18 nt, Human
uuaccugaucaaugacag

SEQ ID NO: 2424700 - RNA, 17 nt, Human
uuaccugaucaaugaca

SEQ ID NO: 2424701 - RNA, 16 nt, Human
uuaccuaaacagauau

SEQ ID NO: 2424702 - RNA, 16 nt, Human
uuaccguuucuucccu

SEQ ID NO: 2424703 - RNA, 14 nt, Human
uuaccguuucuucc

SEQ ID NO: 2424704 - RNA, 21 nt, Human
uuaccgcguuguaaaauauag

SEQ ID NO: 2424705 - RNA, 18 nt, Human
uuaccgcguuguaaaaua

SEQ ID NO: 2424706 - RNA, 16 nt, Human
uuaccgcguuguaaaa

SEQ ID NO: 2424707 - RNA, 15 nt, Human
uuaccgcguuguaaa

SEQ ID NO: 2424708 - RNA, 20 nt, Human
uuaccuaaacagauauaaau

SEQ ID NO: 2424709 - RNA, 19 nt, Human
uuaccuaaacagauauaaa

SEQ ID NO: 2424710 - RNA, 18 nt, Human
uuaccuaaacagauauaa

SEQ ID NO: 2424711 - RNA, 17 nt, Human
uuaccuaaacagauaua

SEQ ID NO: 2424712 - RNA, 21 nt, Human
uuaccuaaacagauauaaaug

SEQ ID NO: 2424713 - RNA, 12 nt, Human
uuaccucuuuaa

SEQ ID NO: 2424714 - RNA, 20 nt, Human
uuaccucuuaacaauuucug

SEQ ID NO: 2424715 - RNA, 15 nt, Human
uuaccucuuaacaau

SEQ ID NO: 2424716 - RNA, 21 nt, Human
uuaccucugauaccucaaccc

SEQ ID NO: 2424717 - RNA, 11 nt, Human
uuaccucugau

SEQ ID NO: 2424718 - RNA, 19 nt, Human
uuaccuccugcccaggaga

SEQ ID NO: 2424719 - RNA, 13 nt, Human
uuaccuaauuaga

SEQ ID NO: 2424720 - RNA, 15 nt, Human
auaagaaaguuucac

SEQ ID NO: 2424721 - RNA, 23 nt, Human
auaagaaccuuuugagugccuua

SEQ ID NO: 2424722 - RNA, 15 nt, Human
auaagaauaaaaugu

SEQ ID NO: 2424723 - RNA, 21 nt, Human
auaagaagggauggauuccaa

SEQ ID NO: 2424724 - RNA, 18 nt, Human
auaagaauaaaauguuga

SEQ ID NO: 2424725 - RNA, 20 nt, Human
auaagaagggauggauucca

SEQ ID NO: 2424726 - RNA, 23 nt, Human
auaagcaaagggagcacuggguu

SEQ ID NO: 2424727 - RNA, 12 nt, Human
auaagcaagaga

SEQ ID NO: 2424728 - RNA, 14 nt, Human
auaagcaagagaga

SEQ ID NO: 2424729 - RNA, 15 nt, Human
auaagcaagagagau

SEQ ID NO: 2424730 - RNA, 17 nt, Human
auaagcaagagagaugu

SEQ ID NO: 2424731 - RNA, 17 nt, Human
auaaguuaacuuccaau

SEQ ID NO: 2424732 - RNA, 17 nt, Human
auaagcacugugcuaau

SEQ ID NO: 2424733 - RNA, 14 nt, Human
auaagcacugugcu

SEQ ID NO: 2424734 - RNA, 16 nt, Human
auaagcaagagagaug

SEQ ID NO: 2424735 - RNA, 18 nt, Human
auaagcacugugcuaaua

SEQ ID NO: 2424736 - RNA, 16 nt, Human
auaagcagauuuaaca

SEQ ID NO: 2424737 - RNA, 22 nt, Human
auaaguuaacuauuuuauuuuc

SEQ ID NO: 2424738 - RNA, 23 nt, Human
uuagauugaaaacuuuucucaga

SEQ ID NO: 2424739 - RNA, 17 nt, Human
uuagauuagcucuggac

SEQ ID NO: 2424740 - RNA, 16 nt, Human
uuagauuagcucugga

SEQ ID NO: 2424741 - RNA, 21 nt, Human
auaauuguaucguauagcugu

SEQ ID NO: 2424742 - RNA, 20 nt, Human
auaauuguaucguauagcug

SEQ ID NO: 2424743 - RNA, 22 nt, Human
auaauuguaucguauagcugua

SEQ ID NO: 2424744 - RNA, 16 nt, Human
uuagauggauucucca

SEQ ID NO: 2424745 - RNA, 17 nt, Human
uuagauggauucuccac

SEQ ID NO: 2424746 - RNA, 14 nt, Human
uuagauuagcucug

SEQ ID NO: 2424747 - RNA, 23 nt, Human
uuagauggauucuccacucaguu

SEQ ID NO: 2424748 - RNA, 12 nt, Human
uuagcaccaggg

SEQ ID NO: 2424749 - RNA, 15 nt, Human
uuagcagcuuccaga

SEQ ID NO: 2424750 - RNA, 20 nt, Human
uuagcaggagaggagagcca

SEQ ID NO: 2424751 - RNA, 12 nt, Human
uuagcagacagg

SEQ ID NO: 2424752 - RNA, 21 nt, Human
uuagcagcagccuuuaaugca

SEQ ID NO: 2424753 - RNA, 12 nt, Human
auaauucuaaag

SEQ ID NO: 2424754 - RNA, 20 nt, Human
auaauucccuaucuuuuagu

SEQ ID NO: 2424755 - RNA, 14 nt, Human
auaauugcauucau

SEQ ID NO: 2424756 - RNA, 13 nt, Human
auaauugcauuca

SEQ ID NO: 2424757 - RNA, 14 nt, Human
auaauugaucaaau

SEQ ID NO: 2424758 - RNA, 15 nt, Human
auaauugaucaaauu

SEQ ID NO: 2424759 - RNA, 19 nt, Human
auaauugaguuuucagugg

SEQ ID NO: 2424760 - RNA, 22 nt, Human
uuagaugcaguucugaagaaga

SEQ ID NO: 2424761 - RNA, 23 nt, Human
uuagaugcaguucugaagaagau

SEQ ID NO: 2424762 - RNA, 13 nt, Human
auaauuguaucgu

SEQ ID NO: 2424763 - RNA, 23 nt, Human
auaauuguaucagaggccuauaa

SEQ ID NO: 2424764 - RNA, 17 nt, Human
auaauuguaucagaggc

SEQ ID NO: 2424765 - RNA, 12 nt, Human
auaauuguauca

SEQ ID NO: 2424766 - RNA, 14 nt, Human
auaaugaauacuuu

SEQ ID NO: 2424767 - RNA, 14 nt, Human
auaaugaagcuuua

SEQ ID NO: 2424768 - RNA, 14 nt, Human
auaauucuacuuug

SEQ ID NO: 2424769 - RNA, 16 nt, Human
auaauuaugacaguua

SEQ ID NO: 2424770 - RNA, 20 nt, Human
auaauucaggaagcagcuuu

SEQ ID NO: 2424771 - RNA, 14 nt, Human
auaauuaugacagu

SEQ ID NO: 2424772 - RNA, 12 nt, Human
auaauucccuau

SEQ ID NO: 2424773 - RNA, 17 nt, Human
auaauucccuaucuuuu

SEQ ID NO: 2424774 - RNA, 19 nt, Human
auaauucccuaucuuuuag

SEQ ID NO: 2424775 - RNA, 17 nt, Human
auaauuauccagaguuu

SEQ ID NO: 2424776 - RNA, 16 nt, Human
auaauuaucggaagca

SEQ ID NO: 2424777 - RNA, 19 nt, Human
auaauuaucggaagcagug

SEQ ID NO: 2424778 - RNA, 20 nt, Human
auaauuaucggaagcagugc

SEQ ID NO: 2424779 - RNA, 21 nt, Human
auaauuaucggaagcagugcc

SEQ ID NO: 2424780 - RNA, 22 nt, Human
auaauuaucggaagcagugccu

SEQ ID NO: 2424781 - RNA, 19 nt, Human
auaaucacuuuuuuccaca

SEQ ID NO: 2424782 - RNA, 21 nt, Human
auaaucagcaagaauuugauc

SEQ ID NO: 2424783 - RNA, 13 nt, Human
auaaucagccucu

SEQ ID NO: 2424784 - RNA, 16 nt, Human
auaaucacgcuuuccu

SEQ ID NO: 2424785 - RNA, 18 nt, Human
auaaucacgcuuuccuga

SEQ ID NO: 2424786 - RNA, 21 nt, Human
auaauacacuaauuccuuucu

SEQ ID NO: 2424787 - RNA, 17 nt, Human
auaauacagccaaagau

SEQ ID NO: 2424788 - RNA, 21 nt, Human
auaauacagccaaagauaauc

SEQ ID NO: 2424789 - RNA, 22 nt, Human
auaauacacuaauuccuuucua

SEQ ID NO: 2424790 - RNA, 12 nt, Human
auaauaauauau

SEQ ID NO: 2424791 - RNA, 19 nt, Human
auaauacaguaucucaggg

SEQ ID NO: 2424792 - RNA, 21 nt, Human
auaaucuuucacaggggacag

SEQ ID NO: 2424793 - RNA, 15 nt, Human
auaaucccagcacuu

SEQ ID NO: 2424794 - RNA, 17 nt, Human
auaauccagucuucacu

SEQ ID NO: 2424795 - RNA, 13 nt, Human
auaaucuuugggu

SEQ ID NO: 2424796 - RNA, 14 nt, Human
auaaucagccucuu

SEQ ID NO: 2424797 - RNA, 15 nt, Human
auaaucagccucuua

SEQ ID NO: 2424798 - RNA, 16 nt, Human
auaaucagccucuuaa

SEQ ID NO: 2424799 - RNA, 17 nt, Human
auaaucagccucuuaaa

SEQ ID NO: 2424800 - RNA, 20 nt, Human
auaaucagugugucuaaauu

SEQ ID NO: 2424801 - RNA, 22 nt, Human
auaccacaggaaccacaagacu

SEQ ID NO: 2424802 - RNA, 19 nt, Human
auaccaaugaaaaaaugua

SEQ ID NO: 2424803 - RNA, 17 nt, Human
auaccagccaguaaaug

SEQ ID NO: 2424804 - RNA, 20 nt, Human
auaccaaugcuuuuaucaaa

SEQ ID NO: 2424805 - RNA, 17 nt, Human
auaccaaguauuuauua

SEQ ID NO: 2424806 - RNA, 21 nt, Human
auaccaaugaaaaaauguaua

SEQ ID NO: 2424807 - RNA, 19 nt, Human
auaccagccaguaaauggg

SEQ ID NO: 2424808 - RNA, 21 nt, Human
auacuaaccagcagaaaugcc

SEQ ID NO: 2424809 - RNA, 20 nt, Human
auaccagugaaccaaagaga

SEQ ID NO: 2424810 - RNA, 14 nt, Human
auacuaagaaaaga

SEQ ID NO: 2424811 - RNA, 16 nt, Human
auaccagcgaggaggc

SEQ ID NO: 2424812 - RNA, 22 nt, Human
auaccagcgaggaggcuccaga

SEQ ID NO: 2424813 - RNA, 18 nt, Human
auaccagcuuagauuuua

SEQ ID NO: 2424814 - RNA, 22 nt, Human
auaccagccccuguauggcacu

SEQ ID NO: 2424815 - RNA, 17 nt, Human
auaccaggccgccccag

SEQ ID NO: 2424816 - RNA, 19 nt, Human
auaccagugaaccaaagag

SEQ ID NO: 2424817 - RNA, 17 nt, Human
auaccagugaaccaaag

SEQ ID NO: 2424818 - RNA, 14 nt, Human
auaccagguugaaa

SEQ ID NO: 2424819 - RNA, 16 nt, Human
auaccagguugaaaga

SEQ ID NO: 2424820 - RNA, 12 nt, Human
auaccagugugg

SEQ ID NO: 2424821 - RNA, 19 nt, Human
auaccauggugaauuaauc

SEQ ID NO: 2424822 - RNA, 13 nt, Human
auacuacaguuug

SEQ ID NO: 2424823 - RNA, 15 nt, Human
auacuacaguuuguu

SEQ ID NO: 2424824 - RNA, 16 nt, Human
auacuacaguuuguua

SEQ ID NO: 2424825 - RNA, 20 nt, Human
auacuacaguuuguuaguau

SEQ ID NO: 2424826 - RNA, 14 nt, Human
auacuaccuugaaa

SEQ ID NO: 2424827 - RNA, 15 nt, Human
auacuaccuugaaaa

SEQ ID NO: 2424828 - RNA, 17 nt, Human
auacuaccuugaaaaua

SEQ ID NO: 2424829 - RNA, 13 nt, Human
auacuacuccugu

SEQ ID NO: 2424830 - RNA, 22 nt, Human
auacuauuuaaagccuccucau

SEQ ID NO: 2424831 - RNA, 21 nt, Human
auacuauuuaaagccuccuca

SEQ ID NO: 2424832 - RNA, 20 nt, Human
auacuauuuaguuuuuguaa

SEQ ID NO: 2424833 - RNA, 19 nt, Human
auacuauuuuuacugccac

SEQ ID NO: 2424834 - RNA, 18 nt, Human
auacuauuuuuacugcca

SEQ ID NO: 2424835 - RNA, 20 nt, Human
auacuauuuuuacugccacu

SEQ ID NO: 2424836 - RNA, 15 nt, Human
auacuauuuuuacug

SEQ ID NO: 2424837 - RNA, 23 nt, Human
auacuauuuaguuuuuguaauuu

SEQ ID NO: 2424838 - RNA, 17 nt, Human
uuaucaugugaaaucau

SEQ ID NO: 2424839 - RNA, 20 nt, Human
uuaucauccacauuguuuua

SEQ ID NO: 2424840 - RNA, 19 nt, Human
uuaucaugacauguuauau

SEQ ID NO: 2424841 - RNA, 18 nt, Human
uuaucauccacauuguuu

SEQ ID NO: 2424842 - RNA, 11 nt, Human
uuaucaugcaa

SEQ ID NO: 2424843 - RNA, 21 nt, Human
uuaucagucauaacuaaauaa

SEQ ID NO: 2424844 - RNA, 23 nt, Human
uuaucagucaauauuuuuagaua

SEQ ID NO: 2424845 - RNA, 14 nt, Human
uuaucagucaauau

SEQ ID NO: 2424846 - RNA, 15 nt, Human
uuaucagucaauauu

SEQ ID NO: 2424847 - RNA, 23 nt, Human
uuaucagucauaacuaaauaaag

SEQ ID NO: 2424848 - RNA, 21 nt, Human
uuaucaguaagaaaaagaaga

SEQ ID NO: 2424849 - RNA, 16 nt, Human
uuaucagugacagagu

SEQ ID NO: 2424850 - RNA, 16 nt, Human
uuaucauccacauugu

SEQ ID NO: 2424851 - RNA, 17 nt, Human
uuaucagugacagaguu

SEQ ID NO: 2424852 - RNA, 20 nt, Human
uuaucaugugaaaucauuca

SEQ ID NO: 2424853 - RNA, 18 nt, Human
uuaucaugugaaaucauu

SEQ ID NO: 2424854 - RNA, 22 nt, Human
uuaucaugugaaaucauucauu

SEQ ID NO: 2424855 - RNA, 14 nt, Human
uuaucauguguaau

SEQ ID NO: 2424856 - RNA, 13 nt, Human
uuaucauguguaa

SEQ ID NO: 2424857 - RNA, 12 nt, Human
uuaucaugugua

SEQ ID NO: 2424858 - RNA, 19 nt, Human
uuaucauggucucagucau

SEQ ID NO: 2424859 - RNA, 16 nt, Human
uuaucaugcaaaugcu

SEQ ID NO: 2424860 - RNA, 13 nt, Human
uuaucaugcuguc

SEQ ID NO: 2424861 - RNA, 16 nt, Human
uuaucaugcugucuuu

SEQ ID NO: 2424862 - RNA, 16 nt, Human
uuaucaaaacuuucuu

SEQ ID NO: 2424863 - RNA, 15 nt, Human
uuaucaaaacuuucu

SEQ ID NO: 2424864 - RNA, 13 nt, Human
uuaucaaaucagu

SEQ ID NO: 2424865 - RNA, 15 nt, Human
uuaucaacaauagug

SEQ ID NO: 2424866 - RNA, 17 nt, Human
auacucauaaugugaag

SEQ ID NO: 2424867 - RNA, 16 nt, Human
auacucauaaugugaa

SEQ ID NO: 2424868 - RNA, 15 nt, Human
auacucauaauguga

SEQ ID NO: 2424869 - RNA, 15 nt, Human
auacucauccuugua

SEQ ID NO: 2424870 - RNA, 20 nt, Human
auacucauaaugugaagugu

SEQ ID NO: 2424871 - RNA, 19 nt, Human
auacucauaaugugaagug

SEQ ID NO: 2424872 - RNA, 18 nt, Human
auacucauaaugugaagu

SEQ ID NO: 2424873 - RNA, 11 nt, Human
auacucaugug

SEQ ID NO: 2424874 - RNA, 18 nt, Human
auacucauccuuguauaa

SEQ ID NO: 2424875 - RNA, 12 nt, Human
auacucaugugu

SEQ ID NO: 2424876 - RNA, 20 nt, Human
uuaucaguaagaaaaagaag

SEQ ID NO: 2424877 - RNA, 18 nt, Human
uuaucacugacacaaaaa

SEQ ID NO: 2424878 - RNA, 14 nt, Human
uuaucaagugucuu

SEQ ID NO: 2424879 - RNA, 11 nt, Human
uuaucaagugu

SEQ ID NO: 2424880 - RNA, 21 nt, Human
uuaucaccgugggcucccuga

SEQ ID NO: 2424881 - RNA, 14 nt, Human
uuaucaacauuugu

SEQ ID NO: 2424882 - RNA, 20 nt, Human
uuaucaaaucagucagugca

SEQ ID NO: 2424883 - RNA, 19 nt, Human
auacauugaauuagaaaca

SEQ ID NO: 2424884 - RNA, 17 nt, Human
auacauugaauuagaaa

SEQ ID NO: 2424885 - RNA, 15 nt, Human
auacauugaauuaga

SEQ ID NO: 2424886 - RNA, 21 nt, Human
auacauugucucuaaauugug

SEQ ID NO: 2424887 - RNA, 16 nt, Human
auacauugucucuaaa

SEQ ID NO: 2424888 - RNA, 15 nt, Human
auacauuuauaaugu

SEQ ID NO: 2424889 - RNA, 20 nt, Human
auacauuuauaauguuugcu

SEQ ID NO: 2424890 - RNA, 21 nt, Human
auacauuuauaauguuugcua

SEQ ID NO: 2424891 - RNA, 21 nt, Human
auacauuucuccuuugauaaa

SEQ ID NO: 2424892 - RNA, 20 nt, Human
auacauuucuccuuugauaa

SEQ ID NO: 2424893 - RNA, 17 nt, Human
auacauuuaugaauuaa

SEQ ID NO: 2424894 - RNA, 23 nt, Human
auacauuuauaauguuugcuauu

SEQ ID NO: 2424895 - RNA, 16 nt, Human
auacauuugauaaagu

SEQ ID NO: 2424896 - RNA, 19 nt, Human
auacauuugaggggaaaac

SEQ ID NO: 2424897 - RNA, 22 nt, Human
auacauuucuccuuugauaaaa

SEQ ID NO: 2424898 - RNA, 14 nt, Human
auaccaaguauuua

SEQ ID NO: 2424899 - RNA, 18 nt, Human
auaccaaaauuauuucag

SEQ ID NO: 2424900 - RNA, 20 nt, Human
auaccaaaauuauuucagaa

SEQ ID NO: 2424901 - RNA, 19 nt, Human
auaccaaaauuauuucaga

SEQ ID NO: 2424902 - RNA, 16 nt, Human
auacaguuguuggccu

SEQ ID NO: 2424903 - RNA, 22 nt, Human
auacagucccuaaagaaaaaaa

SEQ ID NO: 2424904 - RNA, 20 nt, Human
auacagucccuaaagaaaaa

SEQ ID NO: 2424905 - RNA, 18 nt, Human
auacagucccuaaagaaa

SEQ ID NO: 2424906 - RNA, 17 nt, Human
auacagucccuaaagaa

SEQ ID NO: 2424907 - RNA, 20 nt, Human
auacaguaacuuuaugugua

SEQ ID NO: 2424908 - RNA, 19 nt, Human
auacaguaacuuuaugugu

SEQ ID NO: 2424909 - RNA, 19 nt, Human
auacaguaagcugcucuau

SEQ ID NO: 2424910 - RNA, 15 nt, Human
auacaguacaggcag

SEQ ID NO: 2424911 - RNA, 16 nt, Human
auacaguacaggcagc

SEQ ID NO: 2424912 - RNA, 19 nt, Human
auacaguacaggcagcaca

SEQ ID NO: 2424913 - RNA, 22 nt, Human
auacauaugaguguggaagccg

SEQ ID NO: 2424914 - RNA, 21 nt, Human
auacauaucuuuauuaaucac

SEQ ID NO: 2424915 - RNA, 22 nt, Human
auacaguuugucacaugaaaca

SEQ ID NO: 2424916 - RNA, 20 nt, Human
auacaguuguuggccuccgg

SEQ ID NO: 2424917 - RNA, 14 nt, Human
auacauauuuccaa

SEQ ID NO: 2424918 - RNA, 20 nt, Human
auacaucccuuaccugggaa

SEQ ID NO: 2424919 - RNA, 21 nt, Human
auacauauuuuauagaacuuc

SEQ ID NO: 2424920 - RNA, 16 nt, Human
auacaugacucagcau

SEQ ID NO: 2424921 - RNA, 21 nt, Human
auacaguucggugagcuacaa

SEQ ID NO: 2424922 - RNA, 21 nt, Human
auacagggcaugcauuuugca

SEQ ID NO: 2424923 - RNA, 18 nt, Human
auacaguaacuuuaugug

SEQ ID NO: 2424924 - RNA, 17 nt, Human
auacaguaacuuuaugu

SEQ ID NO: 2424925 - RNA, 20 nt, Human
auacaggaaaagcugcugac

SEQ ID NO: 2424926 - RNA, 19 nt, Human
auacaggaaaagcugcuga

SEQ ID NO: 2424927 - RNA, 14 nt, Human
auacaggaaaagcu

SEQ ID NO: 2424928 - RNA, 15 nt, Human
auacaaauuagaaaa

SEQ ID NO: 2424929 - RNA, 17 nt, Human
auacaaauuagaaaaug

SEQ ID NO: 2424930 - RNA, 14 nt, Human
auacaaauuagaaa

SEQ ID NO: 2424931 - RNA, 23 nt, Human
auaauuuuuuuauuacugauuuu

SEQ ID NO: 2424932 - RNA, 18 nt, Human
auacaaacaauggaaacu

SEQ ID NO: 2424933 - RNA, 16 nt, Human
auacaaacaauggaaa

SEQ ID NO: 2424934 - RNA, 22 nt, Human
auacaaacaauggaaacugaau

SEQ ID NO: 2424935 - RNA, 19 nt, Human
auacaaacauauuuguuaa

SEQ ID NO: 2424936 - RNA, 11 nt, Human
auacagcucua

SEQ ID NO: 2424937 - RNA, 13 nt, Human
auacagcucagaa

SEQ ID NO: 2424938 - RNA, 20 nt, Human
auacagcauuacaaauugcu

SEQ ID NO: 2424939 - RNA, 20 nt, Human
auacagcccucccccagcag

SEQ ID NO: 2424940 - RNA, 18 nt, Human
auacagccaaagauaauc

SEQ ID NO: 2424941 - RNA, 16 nt, Human
auacagcaacaauuua

SEQ ID NO: 2424942 - RNA, 22 nt, Human
auacagauuuugauagcaaagc

SEQ ID NO: 2424943 - RNA, 19 nt, Human
auacagauuuugauagcaa

SEQ ID NO: 2424944 - RNA, 18 nt, Human
auacagauuuugauagca

SEQ ID NO: 2424945 - RNA, 17 nt, Human
auacagauuuugauagc

SEQ ID NO: 2424946 - RNA, 16 nt, Human
auacagauuuugauag

SEQ ID NO: 2424947 - RNA, 14 nt, Human
auacagauuuugau

SEQ ID NO: 2424948 - RNA, 18 nt, Human
auacaaauuagaaaaugu

SEQ ID NO: 2424949 - RNA, 15 nt, Human
uuauaguuguaacua

SEQ ID NO: 2424950 - RNA, 20 nt, Human
uuauaguugugggugggaga

SEQ ID NO: 2424951 - RNA, 18 nt, Human
uuauauaagcuuguauuc

SEQ ID NO: 2424952 - RNA, 12 nt, Human
uuauaguuugua

SEQ ID NO: 2424953 - RNA, 16 nt, Human
uuauaguuuguacaug

SEQ ID NO: 2424954 - RNA, 15 nt, Human
uuauaguuuguacau

SEQ ID NO: 2424955 - RNA, 14 nt, Human
uuauauaaaugcuu

SEQ ID NO: 2424956 - RNA, 13 nt, Human
uuauauaaaugcu

SEQ ID NO: 2424957 - RNA, 22 nt, Human
uuauauagauuauaacuugucu

SEQ ID NO: 2424958 - RNA, 21 nt, Human
auaauuuuaagaaaucaaaga

SEQ ID NO: 2424959 - RNA, 15 nt, Human
auaauuuuaagaaau

SEQ ID NO: 2424960 - RNA, 14 nt, Human
auaauuuuaagaaa

SEQ ID NO: 2424961 - RNA, 12 nt, Human
uuauauauguga

SEQ ID NO: 2424962 - RNA, 17 nt, Human
uuauauauguauuuaua

SEQ ID NO: 2424963 - RNA, 13 nt, Human
auaauuuucuuca

SEQ ID NO: 2424964 - RNA, 17 nt, Human
auaauuuucuucaugca

SEQ ID NO: 2424965 - RNA, 22 nt, Human
auaauuuucuucaugcaaugac

SEQ ID NO: 2424966 - RNA, 23 nt, Human
auaauuuucuucaugcaaugaca

SEQ ID NO: 2424967 - RNA, 19 nt, Human
auaauuuuaugaaugucuu

SEQ ID NO: 2424968 - RNA, 15 nt, Human
auaauuuuaugaaug

SEQ ID NO: 2424969 - RNA, 19 nt, Human
uuauauauauauauauuuc

SEQ ID NO: 2424970 - RNA, 14 nt, Human
uuauauauguauuu

SEQ ID NO: 2424971 - RNA, 19 nt, Human
uuauauagauuauaacuug

SEQ ID NO: 2424972 - RNA, 18 nt, Human
uuauauagguugugcaaa

SEQ ID NO: 2424973 - RNA, 21 nt, Human
uuauauagggaucaaccagcu

SEQ ID NO: 2424974 - RNA, 15 nt, Human
uuauauauacaguaa

SEQ ID NO: 2424975 - RNA, 23 nt, Human
uuauauagguuuuguuugcuauc

SEQ ID NO: 2424976 - RNA, 21 nt, Human
uuauauagguuuuguuugcua

SEQ ID NO: 2424977 - RNA, 18 nt, Human
uuauauaguuuacuauuu

SEQ ID NO: 2424978 - RNA, 20 nt, Human
auaauuuugugaagcaaaau

SEQ ID NO: 2424979 - RNA, 15 nt, Human
auaauuuugugaagc

SEQ ID NO: 2424980 - RNA, 14 nt, Human
auaauuuugugaag

SEQ ID NO: 2424981 - RNA, 13 nt, Human
auaauuuugugaa

SEQ ID NO: 2424982 - RNA, 19 nt, Human
auaauuuuuauauuugaaa

SEQ ID NO: 2424983 - RNA, 16 nt, Human
auaauuuuuauauuug

SEQ ID NO: 2424984 - RNA, 14 nt, Human
auaauuuuuauauu

SEQ ID NO: 2424985 - RNA, 15 nt, Human
auaauuuuuaaagua

SEQ ID NO: 2424986 - RNA, 22 nt, Human
auacaaaaaaaaaaaaaaauua

SEQ ID NO: 2424987 - RNA, 12 nt, Human
auacaaaagcau

SEQ ID NO: 2424988 - RNA, 13 nt, Human
auacaaaagcaug

SEQ ID NO: 2424989 - RNA, 15 nt, Human
auacaaaagcaugug

SEQ ID NO: 2424990 - RNA, 22 nt, Human
auaauuuuuauauuugaaauau

SEQ ID NO: 2424991 - RNA, 21 nt, Human
auaauuuuuauauuugaaaua

SEQ ID NO: 2424992 - RNA, 22 nt, Human
auaauuuuuuucaauauuuauu

SEQ ID NO: 2424993 - RNA, 21 nt, Human
auaauuuuuuucaauauuuau

SEQ ID NO: 2424994 - RNA, 17 nt, Human
auaauuuuuuauucaag

SEQ ID NO: 2424995 - RNA, 20 nt, Human
auaauuuuuuucaauauuua

SEQ ID NO: 2424996 - RNA, 16 nt, Human
auaauuuuuuauucaa

SEQ ID NO: 2424997 - RNA, 15 nt, Human
auaauuuuuuauuca

SEQ ID NO: 2424998 - RNA, 18 nt, Human
auaauuuuuaaaguauau

SEQ ID NO: 2424999 - RNA, 19 nt, Human
auaauuuuuaaaguauaua

SEQ ID NO: 2425000 - RNA, 21 nt, Human
auaauuuuuaaaguauauauu

SEQ ID NO: 2425001 - RNA, 23 nt, Human
auaauuuuuaaaguauauauuua

SEQ ID NO: 2425002 - RNA, 19 nt, Human
uuauagguggccucuccuu

SEQ ID NO: 2425003 - RNA, 17 nt, Human
uuauaggucacuccugg

SEQ ID NO: 2425004 - RNA, 18 nt, Human
uuauaggucacuccuggg

SEQ ID NO: 2425005 - RNA, 18 nt, Human
uuauaguauaucuggaca

SEQ ID NO: 2425006 - RNA, 15 nt, Human
uuauaguauaucugg

SEQ ID NO: 2425007 - RNA, 21 nt, Human
uuauagugauguaaucuugaa

SEQ ID NO: 2425008 - RNA, 16 nt, Human
uuauaggaucauuugu

SEQ ID NO: 2425009 - RNA, 22 nt, Human
uuauagccacaucccuuugaaa

SEQ ID NO: 2425010 - RNA, 17 nt, Human
uuauagcuauuacuguc

SEQ ID NO: 2425011 - RNA, 16 nt, Human
uuauagcucaguuuau

SEQ ID NO: 2425012 - RNA, 21 nt, Human
uuauagaugggaaugaagcuu

SEQ ID NO: 2425013 - RNA, 21 nt, Human
uuauagaucccccagacuuua

SEQ ID NO: 2425014 - RNA, 15 nt, Human
uuauagaugucuagg

SEQ ID NO: 2425015 - RNA, 15 nt, Human
uuauagauuugaccu

SEQ ID NO: 2425016 - RNA, 17 nt, Human
uuauagcaaacuuggaa

SEQ ID NO: 2425017 - RNA, 16 nt, Human
uuauagccgaaaugau

SEQ ID NO: 2425018 - RNA, 17 nt, Human
uuauacguguagcuaua

SEQ ID NO: 2425019 - RNA, 15 nt, Human
uuauacguguagcua

SEQ ID NO: 2425020 - RNA, 21 nt, Human
uuauacguguagcuauaucua

SEQ ID NO: 2425021 - RNA, 18 nt, Human
uuauacguguagcuauau

SEQ ID NO: 2425022 - RNA, 12 nt, Human
uuauacuaagaa

SEQ ID NO: 2425023 - RNA, 16 nt, Human
uuauacucuuucugua

SEQ ID NO: 2425024 - RNA, 16 nt, Human
uuauacuaagaaaaga

SEQ ID NO: 2425025 - RNA, 22 nt, Human
uuauacuguacuuaauaaauuc

SEQ ID NO: 2425026 - RNA, 23 nt, Human
uuauagaguguacuuaacuauuc

SEQ ID NO: 2425027 - RNA, 19 nt, Human
uuauagagggccaagacuu

SEQ ID NO: 2425028 - RNA, 21 nt, Human
uuauagaggcuagcuucugcu

SEQ ID NO: 2425029 - RNA, 15 nt, Human
uuauagacaaauaau

SEQ ID NO: 2425030 - RNA, 23 nt, Human
uuauagaauauuuauuaccucug

SEQ ID NO: 2425031 - RNA, 15 nt, Human
uuauagaauauuuau

SEQ ID NO: 2425032 - RNA, 14 nt, Human
uuauagaaaguuca

SEQ ID NO: 2425033 - RNA, 14 nt, Human
uuauacuguauuaa

SEQ ID NO: 2425034 - RNA, 18 nt, Human
uuauacuuuguaaagaca

SEQ ID NO: 2425035 - RNA, 16 nt, Human
uuauaacucaucauaa

SEQ ID NO: 2425036 - RNA, 17 nt, Human
uuauaacucaucauaaa

SEQ ID NO: 2425037 - RNA, 18 nt, Human
uuauaacucaucauaaaa

SEQ ID NO: 2425038 - RNA, 16 nt, Human
uuauaacucugcacua

SEQ ID NO: 2425039 - RNA, 22 nt, Human
uuauaacuacuccggagacagg

SEQ ID NO: 2425040 - RNA, 19 nt, Human
uuauaacucugcacuacuc

SEQ ID NO: 2425041 - RNA, 18 nt, Human
uuauaacugaaggagaag

SEQ ID NO: 2425042 - RNA, 19 nt, Human
uuauaacucaucauaaaau

SEQ ID NO: 2425043 - RNA, 20 nt, Human
uuauaacucaucauaaaaua

SEQ ID NO: 2425044 - RNA, 21 nt, Human
uuauaacucaucauaaaauaa

SEQ ID NO: 2425045 - RNA, 22 nt, Human
uuauaacucaucauaaaauaaa

SEQ ID NO: 2425046 - RNA, 18 nt, Human
uuauacccccugcaaagc

SEQ ID NO: 2425047 - RNA, 13 nt, Human
uuauaacuuaaaa

SEQ ID NO: 2425048 - RNA, 15 nt, Human
uuauaacuuaaaaaa

SEQ ID NO: 2425049 - RNA, 17 nt, Human
uuauaacuuaaaauauu

SEQ ID NO: 2425050 - RNA, 14 nt, Human
uuauaaaugcuauu

SEQ ID NO: 2425051 - RNA, 17 nt, Human
uuauaaaucgcuuuuga

SEQ ID NO: 2425052 - RNA, 18 nt, Human
uuauaaaucgcuuuugau

SEQ ID NO: 2425053 - RNA, 21 nt, Human
uuauaaauuauguuuauauaa

SEQ ID NO: 2425054 - RNA, 17 nt, Human
uuauaaauuauguuuau

SEQ ID NO: 2425055 - RNA, 16 nt, Human
uuauaaauuauguuua

SEQ ID NO: 2425056 - RNA, 15 nt, Human
uuauaaauuauguuu

SEQ ID NO: 2425057 - RNA, 14 nt, Human
uuauaaauuauguu

SEQ ID NO: 2425058 - RNA, 13 nt, Human
uuauaaauuaugu

SEQ ID NO: 2425059 - RNA, 11 nt, Human
uuauaaauuau

SEQ ID NO: 2425060 - RNA, 17 nt, Human
uuagccugaguagaaag

SEQ ID NO: 2425061 - RNA, 15 nt, Human
uuagccucccugaaa

SEQ ID NO: 2425062 - RNA, 21 nt, Human
uuauaaauaugaagcucaccu

SEQ ID NO: 2425063 - RNA, 14 nt, Human
uuauaaaucgcuuu

SEQ ID NO: 2425064 - RNA, 12 nt, Human
uuauaaauauga

SEQ ID NO: 2425065 - RNA, 13 nt, Human
uuagcccccaccc

SEQ ID NO: 2425066 - RNA, 12 nt, Human
uuagcccccacc

SEQ ID NO: 2425067 - RNA, 17 nt, Human
uuagcccccacccacuu

SEQ ID NO: 2425068 - RNA, 13 nt, Human
uuagccgggcgug

SEQ ID NO: 2425069 - RNA, 14 nt, Human
uuagccccauaauu

SEQ ID NO: 2425070 - RNA, 16 nt, Human
uuagcaguuugcuuug

SEQ ID NO: 2425071 - RNA, 23 nt, Human
uuagcaggagaggagagccagag

SEQ ID NO: 2425072 - RNA, 22 nt, Human
uuagcaggagaggagagccaga

SEQ ID NO: 2425073 - RNA, 13 nt, Human
uguucugggacac

SEQ ID NO: 2425074 - RNA, 14 nt, Human
uguuccccucacug

SEQ ID NO: 2425075 - RNA, 21 nt, Human
uguucccccgccgcuuuucuc

SEQ ID NO: 2425076 - RNA, 16 nt, Human
uguucccccugugcag

SEQ ID NO: 2425077 - RNA, 12 nt, Human
uguucugggaca

SEQ ID NO: 2425078 - RNA, 16 nt, Human
uguucccccgccgcuu

SEQ ID NO: 2425079 - RNA, 18 nt, Human
uguuccccauggccacuu

SEQ ID NO: 2425080 - RNA, 15 nt, Human
uguucccccugugca

SEQ ID NO: 2425081 - RNA, 13 nt, Human
uguuccccaucug

SEQ ID NO: 2425082 - RNA, 14 nt, Human
uguuccccagagaa

SEQ ID NO: 2425083 - RNA, 13 nt, Human
uguuccccagaga

SEQ ID NO: 2425084 - RNA, 22 nt, Human
uguuccccacugacagccuccc

SEQ ID NO: 2425085 - RNA, 14 nt, Human
uguucuuaauucuu

SEQ ID NO: 2425086 - RNA, 16 nt, Human
uguucuuaauucuuag

SEQ ID NO: 2425087 - RNA, 15 nt, Human
uguucugggacacag

SEQ ID NO: 2425088 - RNA, 14 nt, Human
uguucugggacaca

SEQ ID NO: 2425089 - RNA, 19 nt, Human
uguucuugguuuguaaauu

SEQ ID NO: 2425090 - RNA, 13 nt, Human
uguucuuuccaaa

SEQ ID NO: 2425091 - RNA, 14 nt, Human
uguucuuuccaaag

SEQ ID NO: 2425092 - RNA, 17 nt, Human
uguucuugguuuguaaa

SEQ ID NO: 2425093 - RNA, 18 nt, Human
uguucuugguuuguaaau

SEQ ID NO: 2425094 - RNA, 18 nt, Human
uguucuuaauugcacucu

SEQ ID NO: 2425095 - RNA, 17 nt, Human
uguucuuaccuguaugu

SEQ ID NO: 2425096 - RNA, 22 nt, Human
uguucuuaccuguaugucucca

SEQ ID NO: 2425097 - RNA, 17 nt, Human
uguucuuaauugcacuc

SEQ ID NO: 2425098 - RNA, 16 nt, Human
uguucuuaauugcacu

SEQ ID NO: 2425099 - RNA, 15 nt, Human
uguuccccucacugg

SEQ ID NO: 2425100 - RNA, 16 nt, Human
uguucuuaagacguga

SEQ ID NO: 2425101 - RNA, 23 nt, Human
aguguaggcagacacagggacuu

SEQ ID NO: 2425102 - RNA, 22 nt, Human
aguguaggcagacacagggacu

SEQ ID NO: 2425103 - RNA, 20 nt, Human
aguguaggcagacacaggga

SEQ ID NO: 2425104 - RNA, 18 nt, Human
aguguaggcagacacagg

SEQ ID NO: 2425105 - RNA, 16 nt, Human
aguguaggcagacaca

SEQ ID NO: 2425106 - RNA, 15 nt, Human
aguguaggcagacac

SEQ ID NO: 2425107 - RNA, 14 nt, Human
aguguaggcagaca

SEQ ID NO: 2425108 - RNA, 13 nt, Human
aguguaggcagac

SEQ ID NO: 2425109 - RNA, 23 nt, Human
aguguagcccacacuugagagga

SEQ ID NO: 2425110 - RNA, 21 nt, Human
aguguagcccacacuugagag

SEQ ID NO: 2425111 - RNA, 15 nt, Human
aguguagccuugccc

SEQ ID NO: 2425112 - RNA, 17 nt, Human
aguguagccuugcccgg

SEQ ID NO: 2425113 - RNA, 18 nt, Human
aguguagccuugcccgga

SEQ ID NO: 2425114 - RNA, 23 nt, Human
aguguacauggaauaacauguaa

SEQ ID NO: 2425115 - RNA, 13 nt, Human
aguguaccauaau

SEQ ID NO: 2425116 - RNA, 20 nt, Human
aguguaauuucuuugccugu

SEQ ID NO: 2425117 - RNA, 17 nt, Human
aguguacagucuuguau

SEQ ID NO: 2425118 - RNA, 22 nt, Human
aguguagaagcauuccuucuuu

SEQ ID NO: 2425119 - RNA, 15 nt, Human
aguguagaucagagc

SEQ ID NO: 2425120 - RNA, 23 nt, Human
aguguagaucagagcagcaguga

SEQ ID NO: 2425121 - RNA, 13 nt, Human
aguguagccuugc

SEQ ID NO: 2425122 - RNA, 18 nt, Human
aguguagcccacacuuga

SEQ ID NO: 2425123 - RNA, 23 nt, Human
uguuauuaaacguaugcauguga

SEQ ID NO: 2425124 - RNA, 18 nt, Human
uguuauuucuuacaggca

SEQ ID NO: 2425125 - RNA, 22 nt, Human
uguuauuaaacguaugcaugug

SEQ ID NO: 2425126 - RNA, 21 nt, Human
uguuauuaaacguaugcaugu

SEQ ID NO: 2425127 - RNA, 20 nt, Human
uguuauuaaacguaugcaug

SEQ ID NO: 2425128 - RNA, 18 nt, Human
uguuauuuucaguauuuu

SEQ ID NO: 2425129 - RNA, 14 nt, Human
uguuauuuucagua

SEQ ID NO: 2425130 - RNA, 16 nt, Human
uguuauuuguacaguu

SEQ ID NO: 2425131 - RNA, 17 nt, Human
uguuauuuguacaguuc

SEQ ID NO: 2425132 - RNA, 22 nt, Human
uguuauguaaaaggccaaaccu

SEQ ID NO: 2425133 - RNA, 15 nt, Human
uguuaugcugugaca

SEQ ID NO: 2425134 - RNA, 14 nt, Human
uguuauggaaacug

SEQ ID NO: 2425135 - RNA, 17 nt, Human
uguuauguagauaacaa

SEQ ID NO: 2425136 - RNA, 18 nt, Human
uguuauggcuuaaugaca

SEQ ID NO: 2425137 - RNA, 16 nt, Human
uguucccauuucagcu

SEQ ID NO: 2425138 - RNA, 17 nt, Human
uguucccauuucagcug

SEQ ID NO: 2425139 - RNA, 16 nt, Human
uguucccauucuugca

SEQ ID NO: 2425140 - RNA, 21 nt, Human
uguucaaagccagcguccucc

SEQ ID NO: 2425141 - RNA, 22 nt, Human
uguucaaagccagcguccuccu

SEQ ID NO: 2425142 - RNA, 20 nt, Human
uguucccauguagcccccug

SEQ ID NO: 2425143 - RNA, 22 nt, Human
uguuauuuuuauaucagccuga

SEQ ID NO: 2425144 - RNA, 19 nt, Human
uguuauuuucuuugaaauu

SEQ ID NO: 2425145 - RNA, 14 nt, Human
uguuauuuugcaac

SEQ ID NO: 2425146 - RNA, 18 nt, Human
uguuauuuucuguugaag

SEQ ID NO: 2425147 - RNA, 18 nt, Human
uguuauuuuuuaauuauu

SEQ ID NO: 2425148 - RNA, 16 nt, Human
uguuauuuuuguuucu

SEQ ID NO: 2425149 - RNA, 21 nt, Human
uguuauuuuuguuucuuccaa

SEQ ID NO: 2425150 - RNA, 19 nt, Human
uguucaaaaaaacacuagu

SEQ ID NO: 2425151 - RNA, 21 nt, Human
agugguuccuaauccucuagg

SEQ ID NO: 2425152 - RNA, 24 nt, Human
aguggucuuuguaagaguguagaa

SEQ ID NO: 2425153 - RNA, 22 nt, Human
aguggucuuuguaagaguguag

SEQ ID NO: 2425154 - RNA, 21 nt, Human
aguggucuuuguaagagugua

SEQ ID NO: 2425155 - RNA, 20 nt, Human
aguggucuuuguaagagugu

SEQ ID NO: 2425156 - RNA, 16 nt, Human
aguggugcgaucuggg

SEQ ID NO: 2425157 - RNA, 22 nt, Human
aguggucgcuuacuuugaguga

SEQ ID NO: 2425158 - RNA, 20 nt, Human
aguggucuuuccuaucaugg

SEQ ID NO: 2425159 - RNA, 13 nt, Human
aguggucuuucug

SEQ ID NO: 2425160 - RNA, 15 nt, Human
aguggucuuucugga

SEQ ID NO: 2425161 - RNA, 16 nt, Human
aguggucuuucuggag

SEQ ID NO: 2425162 - RNA, 18 nt, Human
aguggucuuucuggagag

SEQ ID NO: 2425163 - RNA, 19 nt, Human
aguggucuuuguaagagug

SEQ ID NO: 2425164 - RNA, 18 nt, Human
aguggucuuuguaagagu

SEQ ID NO: 2425165 - RNA, 17 nt, Human
aguggucuuuguaagag

SEQ ID NO: 2425166 - RNA, 16 nt, Human
aguggucuuuguaaga

SEQ ID NO: 2425167 - RNA, 15 nt, Human
aguggucuuuguaag

SEQ ID NO: 2425168 - RNA, 14 nt, Human
aguggucuuuguaa

SEQ ID NO: 2425169 - RNA, 13 nt, Human
aguggucuuugua

SEQ ID NO: 2425170 - RNA, 20 nt, Human
aguggucuuucuggagaggu

SEQ ID NO: 2425171 - RNA, 22 nt, Human
agugggucccacuuccccuccu

SEQ ID NO: 2425172 - RNA, 21 nt, Human
agugggucccacuuccccucc

SEQ ID NO: 2425173 - RNA, 17 nt, Human
agugggucccacuuccc

SEQ ID NO: 2425174 - RNA, 16 nt, Human
agugggucccacuucc

SEQ ID NO: 2425175 - RNA, 14 nt, Human
agugggucccagau

SEQ ID NO: 2425176 - RNA, 19 nt, Human
agugggugaauaauacagu

SEQ ID NO: 2425177 - RNA, 19 nt, Human
agugggugagaugcuggag

SEQ ID NO: 2425178 - RNA, 18 nt, Human
agugggugagaugcugga

SEQ ID NO: 2425179 - RNA, 22 nt, Human
agugggugagaugcuggagaag

SEQ ID NO: 2425180 - RNA, 16 nt, Human
aguggguuauucugga

SEQ ID NO: 2425181 - RNA, 15 nt, Human
aguggguuauucugg

SEQ ID NO: 2425182 - RNA, 18 nt, Human
agugggugguggaucugu

SEQ ID NO: 2425183 - RNA, 21 nt, Human
aguggguuucacaagugaaaa

SEQ ID NO: 2425184 - RNA, 19 nt, Human
aguggguuauucuggaguu

SEQ ID NO: 2425185 - RNA, 18 nt, Human
aguggguuauucuggagu

SEQ ID NO: 2425186 - RNA, 15 nt, Human
aguggguuucacaag

SEQ ID NO: 2425187 - RNA, 11 nt, Human
aguggugccua

SEQ ID NO: 2425188 - RNA, 18 nt, Human
agugguuuuauacugaag

SEQ ID NO: 2425189 - RNA, 17 nt, Human
agugguuuuauacugaa

SEQ ID NO: 2425190 - RNA, 19 nt, Human
agugguuguuaguuauaga

SEQ ID NO: 2425191 - RNA, 13 nt, Human
aguguaaguguga

SEQ ID NO: 2425192 - RNA, 13 nt, Human
aguguaaaauaag

SEQ ID NO: 2425193 - RNA, 23 nt, Human
agugguuuuauacugaaggaaaa

SEQ ID NO: 2425194 - RNA, 21 nt, Human
agugguuuuauacugaaggaa

SEQ ID NO: 2425195 - RNA, 20 nt, Human
agugguuuuauacugaagga

SEQ ID NO: 2425196 - RNA, 11 nt, Human
aguguaaaaua

SEQ ID NO: 2425197 - RNA, 21 nt, Human
aguguacauggaauaacaugu

SEQ ID NO: 2425198 - RNA, 22 nt, Human
aguguacauggaauaacaugua

SEQ ID NO: 2425199 - RNA, 16 nt, Human
aguguacagucuugua

SEQ ID NO: 2425200 - RNA, 15 nt, Human
aguguacagucuugu

SEQ ID NO: 2425201 - RNA, 21 nt, Human
aguguaauuucuuugccuguu

SEQ ID NO: 2425202 - RNA, 16 nt, Human
aguguaauuucuuugc

SEQ ID NO: 2425203 - RNA, 13 nt, Human
aguguacagucuu

SEQ ID NO: 2425204 - RNA, 14 nt, Human
agugggucccacuu

SEQ ID NO: 2425205 - RNA, 22 nt, Human
agugggguugcaaccacugcaa

SEQ ID NO: 2425206 - RNA, 19 nt, Human
agugggguugcaaccacug

SEQ ID NO: 2425207 - RNA, 20 nt, Human
agugggguuaucucuguguu

SEQ ID NO: 2425208 - RNA, 23 nt, Human
agugggggagagcaggcuggcag

SEQ ID NO: 2425209 - RNA, 21 nt, Human
agugggggagagcaggcuggc

SEQ ID NO: 2425210 - RNA, 21 nt, Human
agugggguuaucucuguguua

SEQ ID NO: 2425211 - RNA, 18 nt, Human
agugggggaucacagccu

SEQ ID NO: 2425212 - RNA, 13 nt, Human
agugggugaauaa

SEQ ID NO: 2425213 - RNA, 18 nt, Human
agugggugaauaauacag

SEQ ID NO: 2425214 - RNA, 20 nt, Human
agugggggaguggccacaga

SEQ ID NO: 2425215 - RNA, 19 nt, Human
agugggggaguggccacag

SEQ ID NO: 2425216 - RNA, 18 nt, Human
aguggcaggggacaggag

SEQ ID NO: 2425217 - RNA, 18 nt, Human
aguggggcucgccaugcc

SEQ ID NO: 2425218 - RNA, 19 nt, Human
agugggggagagcaggcug

SEQ ID NO: 2425219 - RNA, 16 nt, Human
agugggggagagcagg

SEQ ID NO: 2425220 - RNA, 11 nt, Human
aguggcagggg

SEQ ID NO: 2425221 - RNA, 15 nt, Human
aguggggcucgccau

SEQ ID NO: 2425222 - RNA, 11 nt, Human
aguggcagcug

SEQ ID NO: 2425223 - RNA, 20 nt, Human
ugugcaacaggguauggacu

SEQ ID NO: 2425224 - RNA, 18 nt, Human
ugugcaacaggguaugga

SEQ ID NO: 2425225 - RNA, 15 nt, Human
ugugcaaauuaacag

SEQ ID NO: 2425226 - RNA, 12 nt, Human
ugugcaaauccu

SEQ ID NO: 2425227 - RNA, 13 nt, Human
aguggcagcugcu

SEQ ID NO: 2425228 - RNA, 12 nt, Human
aguggcagcugc

SEQ ID NO: 2425229 - RNA, 20 nt, Human
aguggcagcugcuuuugucu

SEQ ID NO: 2425230 - RNA, 14 nt, Human
aguggcagcugcuu

SEQ ID NO: 2425231 - RNA, 18 nt, Human
aguggcagggcucaggau

SEQ ID NO: 2425232 - RNA, 17 nt, Human
aguggcagggcucagga

SEQ ID NO: 2425233 - RNA, 14 nt, Human
aguggcagggcuca

SEQ ID NO: 2425234 - RNA, 13 nt, Human
aguggcagggcuc

SEQ ID NO: 2425235 - RNA, 13 nt, Human
aguuauuguacag

SEQ ID NO: 2425236 - RNA, 12 nt, Human
aguuauuguaca

SEQ ID NO: 2425237 - RNA, 22 nt, Human
aguuauugcaguuuaucauuca

SEQ ID NO: 2425238 - RNA, 19 nt, Human
aguuauugcaguuuaucau

SEQ ID NO: 2425239 - RNA, 18 nt, Human
aguuauugcaguuuauca

SEQ ID NO: 2425240 - RNA, 16 nt, Human
aguuauugcaguuuau

SEQ ID NO: 2425241 - RNA, 13 nt, Human
aguuauugcaguu

SEQ ID NO: 2425242 - RNA, 17 nt, Human
aguuauugacaaacucu

SEQ ID NO: 2425243 - RNA, 18 nt, Human
aguuauugacaaacucuc

SEQ ID NO: 2425244 - RNA, 20 nt, Human
aguuauuauauuuacaaaug

SEQ ID NO: 2425245 - RNA, 15 nt, Human
aguuaugugaaugau

SEQ ID NO: 2425246 - RNA, 13 nt, Human
aguuaugugaaug

SEQ ID NO: 2425247 - RNA, 14 nt, Human
aguuaugugaauga

SEQ ID NO: 2425248 - RNA, 21 nt, Human
aguuauggccuauacacuauu

SEQ ID NO: 2425249 - RNA, 18 nt, Human
aguuauggccuauacacu

SEQ ID NO: 2425250 - RNA, 19 nt, Human
aguuauggcuauaggugcu

SEQ ID NO: 2425251 - RNA, 20 nt, Human
aguuaugauuuuuuuuucau

SEQ ID NO: 2425252 - RNA, 19 nt, Human
aguuaugccgcuagauaca

SEQ ID NO: 2425253 - RNA, 17 nt, Human
aguuaucuaaaagaaau

SEQ ID NO: 2425254 - RNA, 19 nt, Human
aguuauagaugucuaggua

SEQ ID NO: 2425255 - RNA, 17 nt, Human
aguuauagaugucuagg

SEQ ID NO: 2425256 - RNA, 15 nt, Human
aguuauagaugucua

SEQ ID NO: 2425257 - RNA, 21 nt, Human
aguuauaaguagcaggccaag

SEQ ID NO: 2425258 - RNA, 12 nt, Human
aguuauaaauca

SEQ ID NO: 2425259 - RNA, 23 nt, Human
aguuagucuacucuuaagccauc

SEQ ID NO: 2425260 - RNA, 17 nt, Human
aguuaguggauuacugc

SEQ ID NO: 2425261 - RNA, 20 nt, Human
aguuaguggauuacugccau

SEQ ID NO: 2425262 - RNA, 22 nt, Human
aguuagucuacucuuaagccau

SEQ ID NO: 2425263 - RNA, 15 nt, Human
aguuaguagcauguu

SEQ ID NO: 2425264 - RNA, 14 nt, Human
aguuaguagcaugu

SEQ ID NO: 2425265 - RNA, 17 nt, Human
aguuagucuacucuuaa

SEQ ID NO: 2425266 - RNA, 16 nt, Human
aguuaguagcauguug

SEQ ID NO: 2425267 - RNA, 17 nt, Human
aguuaguagcauguuga

SEQ ID NO: 2425268 - RNA, 16 nt, Human
aguuaguuucuuuggg

SEQ ID NO: 2425269 - RNA, 23 nt, Human
aguuaguucucucguaacugguu

SEQ ID NO: 2425270 - RNA, 17 nt, Human
aguuaguuucuuuggga

SEQ ID NO: 2425271 - RNA, 23 nt, Human
aguuacuaagaagaaaauugcug

SEQ ID NO: 2425272 - RNA, 18 nt, Human
aguuacuaagaagaaaau

SEQ ID NO: 2425273 - RNA, 17 nt, Human
aguuaggaaauaaaacc

SEQ ID NO: 2425274 - RNA, 18 nt, Human
aguuaggaaauaaaaccu

SEQ ID NO: 2425275 - RNA, 20 nt, Human
aguuaggaaauaaaaccuuu

SEQ ID NO: 2425276 - RNA, 21 nt, Human
aguuaggaaauaaaaccuuuc

SEQ ID NO: 2425277 - RNA, 22 nt, Human
aguuaggaaauaaaaccuuuca

SEQ ID NO: 2425278 - RNA, 18 nt, Human
aguuaggauagcauuuuu

SEQ ID NO: 2425279 - RNA, 16 nt, Human
aguuaggauagcauuu

SEQ ID NO: 2425280 - RNA, 15 nt, Human
aguuaggaaauaaaa

SEQ ID NO: 2425281 - RNA, 18 nt, Human
aguuaggcuauucacaac

SEQ ID NO: 2425282 - RNA, 17 nt, Human
aguuagggaauggcaca

SEQ ID NO: 2425283 - RNA, 12 nt, Human
aguguuucuguu

SEQ ID NO: 2425284 - RNA, 17 nt, Human
aguguuucugugcaugg

SEQ ID NO: 2425285 - RNA, 15 nt, Human
aguguuucugugcau

SEQ ID NO: 2425286 - RNA, 14 nt, Human
aguguuucugugca

SEQ ID NO: 2425287 - RNA, 14 nt, Human
aguguuucuguuau

SEQ ID NO: 2425288 - RNA, 13 nt, Human
aguguuucuguua

SEQ ID NO: 2425289 - RNA, 16 nt, Human
aguuacauuaauguua

SEQ ID NO: 2425290 - RNA, 13 nt, Human
aguguuucugugc

SEQ ID NO: 2425291 - RNA, 16 nt, Human
aguguuuccuuuuugg

SEQ ID NO: 2425292 - RNA, 13 nt, Human
aguguuuccuuuu

SEQ ID NO: 2425293 - RNA, 16 nt, Human
aguguuucccauaauu

SEQ ID NO: 2425294 - RNA, 19 nt, Human
aguguuucgacagcugauu

SEQ ID NO: 2425295 - RNA, 18 nt, Human
uguucuuuccaaaguaca

SEQ ID NO: 2425296 - RNA, 21 nt, Human
aguguuuauuuuucauauugu

SEQ ID NO: 2425297 - RNA, 19 nt, Human
aguguuuauuuuucauauu

SEQ ID NO: 2425298 - RNA, 17 nt, Human
aguguuuauuuuucaua

SEQ ID NO: 2425299 - RNA, 15 nt, Human
aguguuuauuuuuca

SEQ ID NO: 2425300 - RNA, 22 nt, Human
aguguuuauuuuucauauugug

SEQ ID NO: 2425301 - RNA, 15 nt, Human
aguguuucccauaau

SEQ ID NO: 2425302 - RNA, 18 nt, Human
aguucaaauucuucugaa

SEQ ID NO: 2425303 - RNA, 22 nt, Human
aguuauuguacagcuguuuaag

SEQ ID NO: 2425304 - RNA, 21 nt, Human
aguuauuguacagcuguuuaa

SEQ ID NO: 2425305 - RNA, 19 nt, Human
aguuauuguacagcuguuu

SEQ ID NO: 2425306 - RNA, 18 nt, Human
aguuauuguacagcuguu

SEQ ID NO: 2425307 - RNA, 22 nt, Human
aguuauuuaugccucuguauuu

SEQ ID NO: 2425308 - RNA, 23 nt, Human
aguuauuuucuacagugguuuua

SEQ ID NO: 2425309 - RNA, 14 nt, Human
aguuauuuucuaca

SEQ ID NO: 2425310 - RNA, 21 nt, Human
aguuauuuauuuauuggagau

SEQ ID NO: 2425311 - RNA, 19 nt, Human
aguuauuuuaauuaucuuu

SEQ ID NO: 2425312 - RNA, 13 nt, Human
aguucaaacaaga

SEQ ID NO: 2425313 - RNA, 21 nt, Human
aguuauuuuuauuuauuuaaa

SEQ ID NO: 2425314 - RNA, 17 nt, Human
aguucccuacuuccugu

SEQ ID NO: 2425315 - RNA, 14 nt, Human
aguucccugaaaac

SEQ ID NO: 2425316 - RNA, 15 nt, Human
aguucccuacuuccu

SEQ ID NO: 2425317 - RNA, 19 nt, Human
aguucccugaaaacccaga

SEQ ID NO: 2425318 - RNA, 20 nt, Human
aguucccugaaaacccagag

SEQ ID NO: 2425319 - RNA, 24 nt, Human
aguucccugaaaacccagagagga

SEQ ID NO: 2425320 - RNA, 21 nt, Human
aguucccugaaaacccagaga

SEQ ID NO: 2425321 - RNA, 13 nt, Human
aguucccuuggcc

SEQ ID NO: 2425322 - RNA, 16 nt, Human
aguuccgauuucccag

SEQ ID NO: 2425323 - RNA, 17 nt, Human
aguuccuagccaccgcc

SEQ ID NO: 2425324 - RNA, 20 nt, Human
aguuccugucccuucucuua

SEQ ID NO: 2425325 - RNA, 15 nt, Human
aguucccuuggccuc

SEQ ID NO: 2425326 - RNA, 16 nt, Human
aguucccuuggccuca

SEQ ID NO: 2425327 - RNA, 17 nt, Human
aguucccuuggccucag

SEQ ID NO: 2425328 - RNA, 18 nt, Human
aguucccuuggccucaga

SEQ ID NO: 2425329 - RNA, 20 nt, Human
aguuccuugaucuguauaua

SEQ ID NO: 2425330 - RNA, 14 nt, Human
aguuccuuauguau

SEQ ID NO: 2425331 - RNA, 20 nt, Human
aguuccuucagcuuccauuu

SEQ ID NO: 2425332 - RNA, 21 nt, Human
aguuccugucccuucucuuaa

SEQ ID NO: 2425333 - RNA, 23 nt, Human
aguuccugucccuucucuuaauu

SEQ ID NO: 2425334 - RNA, 18 nt, Human
aguucgagaccaaccuga

SEQ ID NO: 2425335 - RNA, 14 nt, Human
aguucgagaccagc

SEQ ID NO: 2425336 - RNA, 17 nt, Human
aguucgagaccagccug

SEQ ID NO: 2425337 - RNA, 18 nt, Human
uguugggauuccugaccc

SEQ ID NO: 2425338 - RNA, 17 nt, Human
uguugggauuccugacc

SEQ ID NO: 2425339 - RNA, 15 nt, Human
uguugggauuccuga

SEQ ID NO: 2425340 - RNA, 16 nt, Human
uguugggccaggagcc

SEQ ID NO: 2425341 - RNA, 18 nt, Human
uguugggauacugcaggg

SEQ ID NO: 2425342 - RNA, 18 nt, Human
uguugggagugaggaugu

SEQ ID NO: 2425343 - RNA, 13 nt, Human
uguugggccagga

SEQ ID NO: 2425344 - RNA, 15 nt, Human
aguucuaaauuuugu

SEQ ID NO: 2425345 - RNA, 21 nt, Human
aguucgagaccagccuggcca

SEQ ID NO: 2425346 - RNA, 18 nt, Human
aguucgagaccagccugg

SEQ ID NO: 2425347 - RNA, 19 nt, Human
aguucgagaccagccuggc

SEQ ID NO: 2425348 - RNA, 22 nt, Human
uguuguacauuuaugauuuaau

SEQ ID NO: 2425349 - RNA, 20 nt, Human
uguuguacauuuaugauuua

SEQ ID NO: 2425350 - RNA, 18 nt, Human
uguuguacauuuaugauu

SEQ ID NO: 2425351 - RNA, 17 nt, Human
uguuguacauuuaugau

SEQ ID NO: 2425352 - RNA, 16 nt, Human
uguuguacauuuauga

SEQ ID NO: 2425353 - RNA, 15 nt, Human
uguuguacauuuaug

SEQ ID NO: 2425354 - RNA, 14 nt, Human
uguuguacauuuau

SEQ ID NO: 2425355 - RNA, 13 nt, Human
uguuguacauuua

SEQ ID NO: 2425356 - RNA, 23 nt, Human
uguuguacauuuaugauuuaaua

SEQ ID NO: 2425357 - RNA, 14 nt, Human
uguuguaaauauuu

SEQ ID NO: 2425358 - RNA, 21 nt, Human
uguuguaaauauuuauguaaa

SEQ ID NO: 2425359 - RNA, 13 nt, Human
uguuguauuuuaa

SEQ ID NO: 2425360 - RNA, 15 nt, Human
uguuguaugccuuua

SEQ ID NO: 2425361 - RNA, 14 nt, Human
uguuguauaaauuu

SEQ ID NO: 2425362 - RNA, 11 nt, Human
uguuguauaaa

SEQ ID NO: 2425363 - RNA, 13 nt, Human
uguuguauaaauu

SEQ ID NO: 2425364 - RNA, 13 nt, Human
uguugucagcuga

SEQ ID NO: 2425365 - RNA, 18 nt, Human
uuaaaaaagaaacauuug

SEQ ID NO: 2425366 - RNA, 15 nt, Human
uuaaaaaagaaacau

SEQ ID NO: 2425367 - RNA, 16 nt, Human
uuaaaaaaauuuaagu

SEQ ID NO: 2425368 - RNA, 21 nt, Human
uuaaaaaaauugguuggagaa

SEQ ID NO: 2425369 - RNA, 20 nt, Human
uuaaaaaaauugguuggaga

SEQ ID NO: 2425370 - RNA, 20 nt, Human
aguugccagucaccccggcc

SEQ ID NO: 2425371 - RNA, 21 nt, Human
aguugcauggcaucaccucca

SEQ ID NO: 2425372 - RNA, 20 nt, Human
aguugcauggcaucaccucc

SEQ ID NO: 2425373 - RNA, 22 nt, Human
aguugcauagguuuaauaauuu

SEQ ID NO: 2425374 - RNA, 16 nt, Human
aguugcacagcuauga

SEQ ID NO: 2425375 - RNA, 20 nt, Human
aguugcaauugaauuaaauu

SEQ ID NO: 2425376 - RNA, 18 nt, Human
aguugcaauugaauuaaa

SEQ ID NO: 2425377 - RNA, 19 nt, Human
aguugcaauugaauuaaau

SEQ ID NO: 2425378 - RNA, 20 nt, Human
uuaaaaaugguuuaaauggu

SEQ ID NO: 2425379 - RNA, 16 nt, Human
uuaaaaauauaaaacu

SEQ ID NO: 2425380 - RNA, 15 nt, Human
uuaaaaauauaaaac

SEQ ID NO: 2425381 - RNA, 23 nt, Human
uuaaaaauauggaacuucuaaua

SEQ ID NO: 2425382 - RNA, 22 nt, Human
uuaaaaauauggaacuucuaau

SEQ ID NO: 2425383 - RNA, 20 nt, Human
uuaaaaauauggaacuucua

SEQ ID NO: 2425384 - RNA, 17 nt, Human
uuaaaaauguaaauauu

SEQ ID NO: 2425385 - RNA, 16 nt, Human
uuaaaaauguaaauau

SEQ ID NO: 2425386 - RNA, 14 nt, Human
uuaaaaauguaaau

SEQ ID NO: 2425387 - RNA, 13 nt, Human
uuaaaaauguaaa

SEQ ID NO: 2425388 - RNA, 21 nt, Human
uuaaaaauguuaaaauguauu

SEQ ID NO: 2425389 - RNA, 19 nt, Human
uuaaaaauguaaauauucu

SEQ ID NO: 2425390 - RNA, 17 nt, Human
uuaaaacaacacucaca

SEQ ID NO: 2425391 - RNA, 13 nt, Human
uuaaaaauauaaa

SEQ ID NO: 2425392 - RNA, 14 nt, Human
uuaaaaagucuuca

SEQ ID NO: 2425393 - RNA, 18 nt, Human
uuaaaaaguggaaaaaua

SEQ ID NO: 2425394 - RNA, 11 nt, Human
uuaaaaaacaa

SEQ ID NO: 2425395 - RNA, 13 nt, Human
uuaaaaaacuugu

SEQ ID NO: 2425396 - RNA, 20 nt, Human
uuaaauaaugugaaacugga

SEQ ID NO: 2425397 - RNA, 21 nt, Human
uuaaauaaugugaaacuggau

SEQ ID NO: 2425398 - RNA, 22 nt, Human
uuaaauaaugugaaacuggauu

SEQ ID NO: 2425399 - RNA, 19 nt, Human
uuaaauaaugugaaacugg

SEQ ID NO: 2425400 - RNA, 13 nt, Human
uuaaauaaaucau

SEQ ID NO: 2425401 - RNA, 15 nt, Human
uuaaauaaaucauaa

SEQ ID NO: 2425402 - RNA, 21 nt, Human
uuaaacggauuauuuuuucag

SEQ ID NO: 2425403 - RNA, 16 nt, Human
uuaaacggauuauuuu

SEQ ID NO: 2425404 - RNA, 13 nt, Human
uuaaauaaaagug

SEQ ID NO: 2425405 - RNA, 14 nt, Human
uuaaauaaaaguga

SEQ ID NO: 2425406 - RNA, 20 nt, Human
uuaaauaaaagugaucaaua

SEQ ID NO: 2425407 - RNA, 19 nt, Human
uuaaauaaaguaucaugca

SEQ ID NO: 2425408 - RNA, 17 nt, Human
uuaaauaaaguaucaug

SEQ ID NO: 2425409 - RNA, 19 nt, Human
uuaaaauaucuuuugaccu

SEQ ID NO: 2425410 - RNA, 13 nt, Human
uuaaaauaucuuu

SEQ ID NO: 2425411 - RNA, 12 nt, Human
uuaaaauauauu

SEQ ID NO: 2425412 - RNA, 17 nt, Human
uuaaaauauuuauuuau

SEQ ID NO: 2425413 - RNA, 14 nt, Human
uuaaaauauggcua

SEQ ID NO: 2425414 - RNA, 12 nt, Human
uuaaaauauuuu

SEQ ID NO: 2425415 - RNA, 14 nt, Human
uuaaaauauuuuau

SEQ ID NO: 2425416 - RNA, 19 nt, Human
uuaaaauauuccugcauuu

SEQ ID NO: 2425417 - RNA, 16 nt, Human
uuaaaauauuccugca

SEQ ID NO: 2425418 - RNA, 17 nt, Human
uuaaaccgccaaggcug

SEQ ID NO: 2425419 - RNA, 16 nt, Human
uuaaacccauuuuagu

SEQ ID NO: 2425420 - RNA, 13 nt, Human
uuaaacccauuuu

SEQ ID NO: 2425421 - RNA, 20 nt, Human
uuaaacccuggaucaguccu

SEQ ID NO: 2425422 - RNA, 15 nt, Human
uuaaacggauuauuu

SEQ ID NO: 2425423 - RNA, 14 nt, Human
uuaaacggauuauu

SEQ ID NO: 2425424 - RNA, 13 nt, Human
uuaaacggauuau

SEQ ID NO: 2425425 - RNA, 18 nt, Human
uuaaaccucucuucuacc

SEQ ID NO: 2425426 - RNA, 21 nt, Human
aguuugucgcucaugugugca

SEQ ID NO: 2425427 - RNA, 19 nt, Human
aguuugucgcucaugugug

SEQ ID NO: 2425428 - RNA, 17 nt, Human
aguuugucgcucaugug

SEQ ID NO: 2425429 - RNA, 20 nt, Human
aguuuuaucauuuucaaaau

SEQ ID NO: 2425430 - RNA, 14 nt, Human
aguuuuaucauuuu

SEQ ID NO: 2425431 - RNA, 18 nt, Human
aguuuguacaugcauuca

SEQ ID NO: 2425432 - RNA, 17 nt, Human
aguuuguauaacuucuu

SEQ ID NO: 2425433 - RNA, 15 nt, Human
aguuuguacaugcau

SEQ ID NO: 2425434 - RNA, 23 nt, Human
aguuuguacagacguaugcuuau

SEQ ID NO: 2425435 - RNA, 13 nt, Human
aguuuguauauac

SEQ ID NO: 2425436 - RNA, 14 nt, Human
aguuuguauaacuu

SEQ ID NO: 2425437 - RNA, 22 nt, Human
aguuuguaugccaagugagaag

SEQ ID NO: 2425438 - RNA, 16 nt, Human
aguuuguccuguagag

SEQ ID NO: 2425439 - RNA, 18 nt, Human
aguuugucacaugaaaca

SEQ ID NO: 2425440 - RNA, 14 nt, Human
aguuugucagacuu

SEQ ID NO: 2425441 - RNA, 20 nt, Human
aguuugguucacuuacagau

SEQ ID NO: 2425442 - RNA, 22 nt, Human
aguuuguacagacguaugcuua

SEQ ID NO: 2425443 - RNA, 22 nt, Human
aguuuggccgggugcgguggcu

SEQ ID NO: 2425444 - RNA, 21 nt, Human
aguuucucagcucccauuucu

SEQ ID NO: 2425445 - RNA, 20 nt, Human
aguuuggggguuuugcuguu

SEQ ID NO: 2425446 - RNA, 17 nt, Human
aguuuucaguuuguaua

SEQ ID NO: 2425447 - RNA, 15 nt, Human
aguuuucaguuugua

SEQ ID NO: 2425448 - RNA, 11 nt, Human
aguuuucaguu

SEQ ID NO: 2425449 - RNA, 12 nt, Human
aguuuucagugg

SEQ ID NO: 2425450 - RNA, 22 nt, Human
aguuuucagaaccucuucccca

SEQ ID NO: 2425451 - RNA, 17 nt, Human
aguuuucagaaccucuu

SEQ ID NO: 2425452 - RNA, 18 nt, Human
aguuuucagaaccucuuc

SEQ ID NO: 2425453 - RNA, 20 nt, Human
aguuuucagaaccucuuccc

SEQ ID NO: 2425454 - RNA, 21 nt, Human
aguuuucagaaccucuucccc

SEQ ID NO: 2425455 - RNA, 12 nt, Human
aguuuuccauga

SEQ ID NO: 2425456 - RNA, 13 nt, Human
aguuuuccaugaa

SEQ ID NO: 2425457 - RNA, 16 nt, Human
aguuuuccaugaaaac

SEQ ID NO: 2425458 - RNA, 21 nt, Human
aguuuuccaugaaaacguuuu

SEQ ID NO: 2425459 - RNA, 18 nt, Human
aguuuucccuugaggaaa

SEQ ID NO: 2425460 - RNA, 20 nt, Human
aguuuucccuugaggaaaca

SEQ ID NO: 2425461 - RNA, 23 nt, Human
aguuuuauuaauaaacauucuau

SEQ ID NO: 2425462 - RNA, 15 nt, Human
aguuuuaucauuuuc

SEQ ID NO: 2425463 - RNA, 21 nt, Human
aguuuuauugagaauuuuaaa

SEQ ID NO: 2425464 - RNA, 16 nt, Human
aguuuuauugagaauu

SEQ ID NO: 2425465 - RNA, 22 nt, Human
aguuuucacucuuauugcccac

SEQ ID NO: 2425466 - RNA, 21 nt, Human
aguuuucaagucaaauuaaua

SEQ ID NO: 2425467 - RNA, 16 nt, Human
aguuuucagaaccucu

SEQ ID NO: 2425468 - RNA, 22 nt, Human
aguuuucaagucaaauuaauaa

SEQ ID NO: 2425469 - RNA, 23 nt, Human
uuaaauucuccaguuuuuuguua

SEQ ID NO: 2425470 - RNA, 16 nt, Human
uuaaauucuugcaaag

SEQ ID NO: 2425471 - RNA, 13 nt, Human
uuaaauucuugca

SEQ ID NO: 2425472 - RNA, 21 nt, Human
uuaaauaaaguaucaugcauu

SEQ ID NO: 2425473 - RNA, 12 nt, Human
uuaaauaaaugu

SEQ ID NO: 2425474 - RNA, 21 nt, Human
uuaaauucaguccuaagaaag

SEQ ID NO: 2425475 - RNA, 21 nt, Human
uuaaauuauaacuuaaaauau

SEQ ID NO: 2425476 - RNA, 15 nt, Human
aguuucaaugugauu

SEQ ID NO: 2425477 - RNA, 14 nt, Human
aguuucaaugugau

SEQ ID NO: 2425478 - RNA, 12 nt, Human
aguuucaaugug

SEQ ID NO: 2425479 - RNA, 22 nt, Human
aguuucaaugugauucuaaugu

SEQ ID NO: 2425480 - RNA, 16 nt, Human
aguuucaaugugauuc

SEQ ID NO: 2425481 - RNA, 18 nt, Human
aguuuccucaggcugcug

SEQ ID NO: 2425482 - RNA, 15 nt, Human
aguuucaaaaacugu

SEQ ID NO: 2425483 - RNA, 15 nt, Human
aguuuauuuuaagac

SEQ ID NO: 2425484 - RNA, 15 nt, Human
aguuucuccaagcag

SEQ ID NO: 2425485 - RNA, 13 nt, Human
aguuucuccaagc

SEQ ID NO: 2425486 - RNA, 21 nt, Human
aguuucuccaagcaggacaug

SEQ ID NO: 2425487 - RNA, 16 nt, Human
aguuucucagcuccca

SEQ ID NO: 2425488 - RNA, 16 nt, Human
aguuucguuuucaaaa

SEQ ID NO: 2425489 - RNA, 19 nt, Human
aguuuccuuggcuggugca

SEQ ID NO: 2425490 - RNA, 15 nt, Human
aguuucucagcuccc

SEQ ID NO: 2425491 - RNA, 15 nt, Human
aguuucguuuucaaa

SEQ ID NO: 2425492 - RNA, 12 nt, Human
aguuuccugaaa

SEQ ID NO: 2425493 - RNA, 20 nt, Human
aguuuccucaggcugcugga

SEQ ID NO: 2425494 - RNA, 23 nt, Human
aguuuccucaggcugcuggagga

SEQ ID NO: 2425495 - RNA, 18 nt, Human
aguuuccuuggcuggugc

SEQ ID NO: 2425496 - RNA, 17 nt, Human
aguuuccuuggcuggug

SEQ ID NO: 2425497 - RNA, 15 nt, Human
aguuuccuuggcugg

SEQ ID NO: 2425498 - RNA, 21 nt, Human
aguugauagcacagacccugc

SEQ ID NO: 2425499 - RNA, 20 nt, Human
aguugauagcacagacccug

SEQ ID NO: 2425500 - RNA, 19 nt, Human
aguugauagcacagacccu

SEQ ID NO: 2425501 - RNA, 15 nt, Human
aguugauagcacaga

SEQ ID NO: 2425502 - RNA, 13 nt, Human
aguucuucuccaa

SEQ ID NO: 2425503 - RNA, 22 nt, Human
aguucuucgggaagagaggagu

SEQ ID NO: 2425504 - RNA, 20 nt, Human
aguucuucgggaagagagga

SEQ ID NO: 2425505 - RNA, 19 nt, Human
aguucuucgggaagagagg

SEQ ID NO: 2425506 - RNA, 18 nt, Human
aguucuucgggaagagag

SEQ ID NO: 2425507 - RNA, 14 nt, Human
aguucuugugccau

SEQ ID NO: 2425508 - RNA, 13 nt, Human
aguucuugugcca

SEQ ID NO: 2425509 - RNA, 22 nt, Human
aguucuugucugauuggcucac

SEQ ID NO: 2425510 - RNA, 12 nt, Human
aguucuugugcc

SEQ ID NO: 2425511 - RNA, 15 nt, Human
aguucuuugggccag

SEQ ID NO: 2425512 - RNA, 16 nt, Human
aguucuuugggccaga

SEQ ID NO: 2425513 - RNA, 17 nt, Human
aguucuuugggccagac

SEQ ID NO: 2425514 - RNA, 14 nt, Human
aguugauagcacag

SEQ ID NO: 2425515 - RNA, 14 nt, Human
aguucugaagaaga

SEQ ID NO: 2425516 - RNA, 13 nt, Human
aguucugaagaag

SEQ ID NO: 2425517 - RNA, 15 nt, Human
aguucugaagaagau

SEQ ID NO: 2425518 - RNA, 16 nt, Human
aguucugaagaagaug

SEQ ID NO: 2425519 - RNA, 15 nt, Human
aguucuguagaaaug

SEQ ID NO: 2425520 - RNA, 13 nt, Human
aguucuguagaaa

SEQ ID NO: 2425521 - RNA, 17 nt, Human
aguucuguagaaauggu

SEQ ID NO: 2425522 - RNA, 16 nt, Human
aguucuguagaaaugg

SEQ ID NO: 2425523 - RNA, 18 nt, Human
aguucuguagaaaugguu

SEQ ID NO: 2425524 - RNA, 17 nt, Human
aguucuucgggaagaga

SEQ ID NO: 2425525 - RNA, 21 nt, Human
aguugauaugccuuuucccaa

SEQ ID NO: 2425526 - RNA, 19 nt, Human
aguugauauagaacagugc

SEQ ID NO: 2425527 - RNA, 17 nt, Human
aguugauauagaacagu

SEQ ID NO: 2425528 - RNA, 21 nt, Human
aguugaucgccuuucccaggu

SEQ ID NO: 2425529 - RNA, 18 nt, Human
aguucuuugggccagaca

SEQ ID NO: 2425530 - RNA, 15 nt, Human
aguugauauagaaca

SEQ ID NO: 2425531 - RNA, 23 nt, Human
aguugauagcacagacccugccc

SEQ ID NO: 2425532 - RNA, 22 nt, Human
aguugauagcacagacccugcc

SEQ ID NO: 2425533 - RNA, 18 nt, Human
aguugaucuggaacccag

SEQ ID NO: 2425534 - RNA, 19 nt, Human
aguugaucuggaacccaga

SEQ ID NO: 2425535 - RNA, 20 nt, Human
aguugaucuggaacccagac

SEQ ID NO: 2425536 - RNA, 21 nt, Human
aguugaucuggaacccagacu

SEQ ID NO: 2425537 - RNA, 15 nt, Human
aguugaucuggaacc

SEQ ID NO: 2425538 - RNA, 17 nt, Human
aguugaucuggaaccca

SEQ ID NO: 2425539 - RNA, 13 nt, Human
aguugaucuggaa

SEQ ID NO: 2425540 - RNA, 13 nt, Human
aguugauucagcu

SEQ ID NO: 2425541 - RNA, 23 nt, Human
aguugaucuggaacccagacuca

SEQ ID NO: 2425542 - RNA, 15 nt, Human
aguugauguugcauu

SEQ ID NO: 2425543 - RNA, 16 nt, Human
aguugauguugcauuu

SEQ ID NO: 2425544 - RNA, 19 nt, Human
aguugcaacuuuguauaaa

SEQ ID NO: 2425545 - RNA, 23 nt, Human
aguugauucagcucugcaagaau

SEQ ID NO: 2425546 - RNA, 19 nt, Human
aguugcaaucguaauguac

SEQ ID NO: 2425547 - RNA, 17 nt, Human
aguugcaauagaacaga

SEQ ID NO: 2425548 - RNA, 15 nt, Human
aguugcaauagaaca

SEQ ID NO: 2425549 - RNA, 22 nt, Human
aguugcaauaauacuucucaaa

SEQ ID NO: 2425550 - RNA, 17 nt, Human
aguugcaauaauacuuc

SEQ ID NO: 2425551 - RNA, 14 nt, Human
aguugcaauaauac

SEQ ID NO: 2425552 - RNA, 13 nt, Human
aguugcaauaaua

SEQ ID NO: 2425553 - RNA, 18 nt, Human
aguugauuuaguguuuuu

SEQ ID NO: 2425554 - RNA, 21 nt, Human
aguugauuuuacaauugaaau

SEQ ID NO: 2425555 - RNA, 23 nt, Human
aguugauuuuacaauugaaauga

SEQ ID NO: 2425556 - RNA, 14 nt, Human
aguugauucagcuc

SEQ ID NO: 2425557 - RNA, 15 nt, Human
aguugauucagcucu

SEQ ID NO: 2425558 - RNA, 17 nt, Human
aguugauucagcucugc

SEQ ID NO: 2425559 - RNA, 18 nt, Human
aguugauucagcucugca

SEQ ID NO: 2425560 - RNA, 17 nt, Human
uguuuuaguuaaauuuc

SEQ ID NO: 2425561 - RNA, 16 nt, Human
uguuuuaguuaaauuu

SEQ ID NO: 2425562 - RNA, 23 nt, Human
uguuuuagguuaaaaaaaggcau

SEQ ID NO: 2425563 - RNA, 19 nt, Human
uguuuuagaguuaacaaug

SEQ ID NO: 2425564 - RNA, 18 nt, Human
uguuuuauuuuuuauugu

SEQ ID NO: 2425565 - RNA, 23 nt, Human
uguuuuauuuuuuauuguuuuca

SEQ ID NO: 2425566 - RNA, 15 nt, Human
uguuuucagacucag

SEQ ID NO: 2425567 - RNA, 15 nt, Human
uguuuucaguguaca

SEQ ID NO: 2425568 - RNA, 20 nt, Human
uguuuuauaauuuugugaag

SEQ ID NO: 2425569 - RNA, 13 nt, Human
uguuuuauaauuu

SEQ ID NO: 2425570 - RNA, 24 nt, Human
uguuuuagacaaauacucaugugu

SEQ ID NO: 2425571 - RNA, 23 nt, Human
uguuuuagacaaauacucaugug

SEQ ID NO: 2425572 - RNA, 22 nt, Human
uguuuuagacaaauacucaugu

SEQ ID NO: 2425573 - RNA, 21 nt, Human
uguuuuagacaaauacucaug

SEQ ID NO: 2425574 - RNA, 21 nt, Human
uguuuuacuaaagaaagauua

SEQ ID NO: 2425575 - RNA, 16 nt, Human
uguuuuacuaaagaaa

SEQ ID NO: 2425576 - RNA, 15 nt, Human
uguuuuacugugaaa

SEQ ID NO: 2425577 - RNA, 20 nt, Human
uguuuuagacaaauacucau

SEQ ID NO: 2425578 - RNA, 18 nt, Human
uguuuuacugugaaacug

SEQ ID NO: 2425579 - RNA, 19 nt, Human
uguuuuagacaaauacuca

SEQ ID NO: 2425580 - RNA, 12 nt, Human
aguucucuccuu

SEQ ID NO: 2425581 - RNA, 13 nt, Human
aguucucuccuuc

SEQ ID NO: 2425582 - RNA, 17 nt, Human
aguucucucguaacugg

SEQ ID NO: 2425583 - RNA, 16 nt, Human
aguucucucguaacug

SEQ ID NO: 2425584 - RNA, 21 nt, Human
uguuuucucuggaguauucua

SEQ ID NO: 2425585 - RNA, 20 nt, Human
aguucucuucacucaaggau

SEQ ID NO: 2425586 - RNA, 16 nt, Human
aguucucuccuucuuc

SEQ ID NO: 2425587 - RNA, 16 nt, Human
uguuuuccgugaaaac

SEQ ID NO: 2425588 - RNA, 19 nt, Human
uguuuuccgugaaaacgga

SEQ ID NO: 2425589 - RNA, 14 nt, Human
uguuuuccucccuu

SEQ ID NO: 2425590 - RNA, 16 nt, Human
uguuuucccugaccuc

SEQ ID NO: 2425591 - RNA, 21 nt, Human
uguuuuccucccuucugcuac

SEQ ID NO: 2425592 - RNA, 22 nt, Human
uguuuuccucccuucugcuacu

SEQ ID NO: 2425593 - RNA, 17 nt, Human
uguuuucaguguacaug

SEQ ID NO: 2425594 - RNA, 15 nt, Human
uguuuuccuuucuca

SEQ ID NO: 2425595 - RNA, 23 nt, Human
uguuuuccucccuucugcuacug

SEQ ID NO: 2425596 - RNA, 15 nt, Human
uguuuucucuugaga

SEQ ID NO: 2425597 - RNA, 15 nt, Human
uguugucauugcugu

SEQ ID NO: 2425598 - RNA, 12 nt, Human
uguugucccuuc

SEQ ID NO: 2425599 - RNA, 13 nt, Human
uguugucccuucu

SEQ ID NO: 2425600 - RNA, 14 nt, Human
uguugucagcugaa

SEQ ID NO: 2425601 - RNA, 14 nt, Human
uguugucauugcug

SEQ ID NO: 2425602 - RNA, 11 nt, Human
uguugucauug

SEQ ID NO: 2425603 - RNA, 13 nt, Human
uguugucaaagag

SEQ ID NO: 2425604 - RNA, 15 nt, Human
uguuugcuaagcauu

SEQ ID NO: 2425605 - RNA, 16 nt, Human
uguuugccucugccuc

SEQ ID NO: 2425606 - RNA, 15 nt, Human
uguuugcaucugaaa

SEQ ID NO: 2425607 - RNA, 14 nt, Human
uguuugccucugcc

SEQ ID NO: 2425608 - RNA, 19 nt, Human
uguuugcuaagcauuccaa

SEQ ID NO: 2425609 - RNA, 15 nt, Human
uguuugccauacuuu

SEQ ID NO: 2425610 - RNA, 22 nt, Human
uguuugcaugugaaaaucaaau

SEQ ID NO: 2425611 - RNA, 17 nt, Human
uguuugcuaucuuaauu

SEQ ID NO: 2425612 - RNA, 22 nt, Human
uguuugccauacuuugucugaa

SEQ ID NO: 2425613 - RNA, 20 nt, Human
uguuugccuucuacuuuuaa

SEQ ID NO: 2425614 - RNA, 15 nt, Human
uguuuggagacauuc

SEQ ID NO: 2425615 - RNA, 14 nt, Human
uguuugcucucccg

SEQ ID NO: 2425616 - RNA, 15 nt, Human
uguuuggaggagcaa

SEQ ID NO: 2425617 - RNA, 12 nt, Human
uguuuggagagc

SEQ ID NO: 2425618 - RNA, 19 nt, Human
uguuuggagacauuccugg

SEQ ID NO: 2425619 - RNA, 15 nt, Human
uguuuggggaugaga

SEQ ID NO: 2425620 - RNA, 19 nt, Human
uguuuggggaugagaaagg

SEQ ID NO: 2425621 - RNA, 19 nt, Human
uguuuuacgucugggagaa

SEQ ID NO: 2425622 - RNA, 16 nt, Human
uguuugggcagaaggg

SEQ ID NO: 2425623 - RNA, 22 nt, Human
uguuugggcagaagggagaagg

SEQ ID NO: 2425624 - RNA, 14 nt, Human
agcccaggaaaggc

SEQ ID NO: 2425625 - RNA, 23 nt, Human
agcccagcuugaaaccuucacuu

SEQ ID NO: 2425626 - RNA, 21 nt, Human
agcccagcugggucaggcagg

SEQ ID NO: 2425627 - RNA, 13 nt, Human
agcccagcuggug

SEQ ID NO: 2425628 - RNA, 16 nt, Human
agcccagcugguggga

SEQ ID NO: 2425629 - RNA, 19 nt, Human
agcccagcugggucaggca

SEQ ID NO: 2425630 - RNA, 20 nt, Human
agcccagcugggucaggcag

SEQ ID NO: 2425631 - RNA, 17 nt, Human
agcccagcugggucagg

SEQ ID NO: 2425632 - RNA, 13 nt, Human
agcccagccacgu

SEQ ID NO: 2425633 - RNA, 21 nt, Human
agcccagcacugcuugaggaa

SEQ ID NO: 2425634 - RNA, 15 nt, Human
agcccagcagggccu

SEQ ID NO: 2425635 - RNA, 20 nt, Human
agcccagcagggccucaaag

SEQ ID NO: 2425636 - RNA, 16 nt, Human
ugauucauaaugacuu

SEQ ID NO: 2425637 - RNA, 15 nt, Human
ugauucauaaugacu

SEQ ID NO: 2425638 - RNA, 21 nt, Human
ugauucauaaugacuuaagca

SEQ ID NO: 2425639 - RNA, 16 nt, Human
ugauucauaguaacuu

SEQ ID NO: 2425640 - RNA, 18 nt, Human
ugauucauaguaacuucu

SEQ ID NO: 2425641 - RNA, 20 nt, Human
agcccagcuggugggaagcg

SEQ ID NO: 2425642 - RNA, 23 nt, Human
ugauucccaagcucugcuccucu

SEQ ID NO: 2425643 - RNA, 22 nt, Human
ugauucccaagcucugcuccuc

SEQ ID NO: 2425644 - RNA, 14 nt, Human
ugauuccuuccugu

SEQ ID NO: 2425645 - RNA, 20 nt, Human
ugauucucagggucucugcu

SEQ ID NO: 2425646 - RNA, 18 nt, Human
ugauucccuccugcuacu

SEQ ID NO: 2425647 - RNA, 19 nt, Human
ugauucaugccaauuagca

SEQ ID NO: 2425648 - RNA, 19 nt, Human
ugauucauaguaacuucuu

SEQ ID NO: 2425649 - RNA, 17 nt, Human
ugauucccuccugcuac

SEQ ID NO: 2425650 - RNA, 23 nt, Human
ugauucucagggucucugcugcc

SEQ ID NO: 2425651 - RNA, 22 nt, Human
ugauucucagggucucugcugc

SEQ ID NO: 2425652 - RNA, 21 nt, Human
ugauucucagggucucugcug

SEQ ID NO: 2425653 - RNA, 12 nt, Human
ugauuccuuccu

SEQ ID NO: 2425654 - RNA, 13 nt, Human
ugauucucaugcc

SEQ ID NO: 2425655 - RNA, 14 nt, Human
ugauucucaugccu

SEQ ID NO: 2425656 - RNA, 15 nt, Human
ugauucucaugccuc

SEQ ID NO: 2425657 - RNA, 17 nt, Human
ugauuuacaguuucaaa

SEQ ID NO: 2425658 - RNA, 15 nt, Human
ugauuuacaguuuca

SEQ ID NO: 2425659 - RNA, 13 nt, Human
ugauuuacaguuu

SEQ ID NO: 2425660 - RNA, 16 nt, Human
ugauucucaugccuca

SEQ ID NO: 2425661 - RNA, 13 nt, Human
ugauucuccugcc

SEQ ID NO: 2425662 - RNA, 20 nt, Human
ugauuucuauucaagguggc

SEQ ID NO: 2425663 - RNA, 14 nt, Human
ugauuucuauucaa

SEQ ID NO: 2425664 - RNA, 13 nt, Human
ugauuucuauuca

SEQ ID NO: 2425665 - RNA, 17 nt, Human
ugauuucuagaaagccu

SEQ ID NO: 2425666 - RNA, 13 nt, Human
ugauuuccuugaa

SEQ ID NO: 2425667 - RNA, 14 nt, Human
ugauuuccuugaau

SEQ ID NO: 2425668 - RNA, 15 nt, Human
ugauuuccuugaaug

SEQ ID NO: 2425669 - RNA, 16 nt, Human
ugauuuccuugaaugu

SEQ ID NO: 2425670 - RNA, 17 nt, Human
ugauuuccuugaaugug

SEQ ID NO: 2425671 - RNA, 19 nt, Human
ugauuuccuugaauguggc

SEQ ID NO: 2425672 - RNA, 23 nt, Human
ugauuuccuugaauguggcuuga

SEQ ID NO: 2425673 - RNA, 13 nt, Human
ugauuuggugacc

SEQ ID NO: 2425674 - RNA, 19 nt, Human
ugauuuggugaccaacugu

SEQ ID NO: 2425675 - RNA, 20 nt, Human
ugauuuggugaccaacuguc

SEQ ID NO: 2425676 - RNA, 17 nt, Human
ugauuugaagaacaugu

SEQ ID NO: 2425677 - RNA, 17 nt, Human
ugauuuggggauauuuu

SEQ ID NO: 2425678 - RNA, 16 nt, Human
ugauuucuuuccagag

SEQ ID NO: 2425679 - RNA, 15 nt, Human
ugauuucuuuccaga

SEQ ID NO: 2425680 - RNA, 19 nt, Human
ugauuucuucuguuuucug

SEQ ID NO: 2425681 - RNA, 17 nt, Human
ugauuucugccuuccuu

SEQ ID NO: 2425682 - RNA, 22 nt, Human
ugauuuccguuaaaauaccagc

SEQ ID NO: 2425683 - RNA, 15 nt, Human
ugauuucauuaauac

SEQ ID NO: 2425684 - RNA, 18 nt, Human
ugauuuccguuaaaauac

SEQ ID NO: 2425685 - RNA, 19 nt, Human
ugauuucaggauacucugu

SEQ ID NO: 2425686 - RNA, 11 nt, Human
ugauuucagga

SEQ ID NO: 2425687 - RNA, 18 nt, Human
ugauuucaggauacucug

SEQ ID NO: 2425688 - RNA, 23 nt, Human
ugauuucaggauacucugucaga

SEQ ID NO: 2425689 - RNA, 16 nt, Human
ugauuuaggagaagcc

SEQ ID NO: 2425690 - RNA, 20 nt, Human
ugauuuaggagaagccagga

SEQ ID NO: 2425691 - RNA, 16 nt, Human
ugauuuacgcucauug

SEQ ID NO: 2425692 - RNA, 21 nt, Human
ugauuuagaacuguaugucag

SEQ ID NO: 2425693 - RNA, 21 nt, Human
ugauuuaggagaagccaggaa

SEQ ID NO: 2425694 - RNA, 22 nt, Human
ugauuuaggagaagccaggaau

SEQ ID NO: 2425695 - RNA, 22 nt, Human
ugauuuaguguuuuuaccucug

SEQ ID NO: 2425696 - RNA, 20 nt, Human
ugauuucagcaccuacagug

SEQ ID NO: 2425697 - RNA, 17 nt, Human
ugauuucagcucacugc

SEQ ID NO: 2425698 - RNA, 21 nt, Human
ugauuucagcaccuacagugu

SEQ ID NO: 2425699 - RNA, 15 nt, Human
agcccacuucugcca

SEQ ID NO: 2425700 - RNA, 14 nt, Human
agcccacuucugcc

SEQ ID NO: 2425701 - RNA, 15 nt, Human
agcccacuguccugg

SEQ ID NO: 2425702 - RNA, 17 nt, Human
agcccacuguccugggc

SEQ ID NO: 2425703 - RNA, 18 nt, Human
agcccacuguccugggcc

SEQ ID NO: 2425704 - RNA, 19 nt, Human
agcccacuguccugggccu

SEQ ID NO: 2425705 - RNA, 13 nt, Human
agcccacuucugc

SEQ ID NO: 2425706 - RNA, 22 nt, Human
agcccagauguuuuacgucugg

SEQ ID NO: 2425707 - RNA, 18 nt, Human
agcccagaucagcuccua

SEQ ID NO: 2425708 - RNA, 17 nt, Human
agcccagaucagcuccu

SEQ ID NO: 2425709 - RNA, 16 nt, Human
agcccagaucagcucc

SEQ ID NO: 2425710 - RNA, 15 nt, Human
agcccagcacugcuu

SEQ ID NO: 2425711 - RNA, 18 nt, Human
agcccagagguaacagaa

SEQ ID NO: 2425712 - RNA, 17 nt, Human
agcccagagguaacaga

SEQ ID NO: 2425713 - RNA, 16 nt, Human
agcccagagguaacag

SEQ ID NO: 2425714 - RNA, 15 nt, Human
agcccagagguaaca

SEQ ID NO: 2425715 - RNA, 21 nt, Human
agcccagagguaacagaacag

SEQ ID NO: 2425716 - RNA, 20 nt, Human
agcccagagguaacagaaca

SEQ ID NO: 2425717 - RNA, 16 nt, Human
agcccagaggagggca

SEQ ID NO: 2425718 - RNA, 20 nt, Human
agcccacuguccugggccug

SEQ ID NO: 2425719 - RNA, 22 nt, Human
agcccacuguccugggccugca

SEQ ID NO: 2425720 - RNA, 13 nt, Human
agcccagagguaa

SEQ ID NO: 2425721 - RNA, 23 nt, Human
agcccacuguccugggccugcag

SEQ ID NO: 2425722 - RNA, 16 nt, Human
agccaugggaccaaac

SEQ ID NO: 2425723 - RNA, 15 nt, Human
agccaugggaccaaa

SEQ ID NO: 2425724 - RNA, 13 nt, Human
agccaugggacca

SEQ ID NO: 2425725 - RNA, 20 nt, Human
agcccacugcccacccccuc

SEQ ID NO: 2425726 - RNA, 19 nt, Human
agcccacugcccacccccu

SEQ ID NO: 2425727 - RNA, 14 nt, Human
agcccacuguccug

SEQ ID NO: 2425728 - RNA, 16 nt, Human
agcccacuguacuugc

SEQ ID NO: 2425729 - RNA, 14 nt, Human
agcccacuguacuu

SEQ ID NO: 2425730 - RNA, 19 nt, Human
agccaugcugggaagacgc

SEQ ID NO: 2425731 - RNA, 15 nt, Human
agccaugcugggaag

SEQ ID NO: 2425732 - RNA, 12 nt, Human
agccaugggacc

SEQ ID NO: 2425733 - RNA, 18 nt, Human
agccauggacucuacacu

SEQ ID NO: 2425734 - RNA, 23 nt, Human
agccaugcgcccccuccgcccug

SEQ ID NO: 2425735 - RNA, 16 nt, Human
agccaugcgcccccuc

SEQ ID NO: 2425736 - RNA, 23 nt, Human
agccaugauguggaguggggcag

SEQ ID NO: 2425737 - RNA, 18 nt, Human
agccaugauaacugcaau

SEQ ID NO: 2425738 - RNA, 18 nt, Human
agccaugaggaguugcug

SEQ ID NO: 2425739 - RNA, 19 nt, Human
agccaugaggaguugcugu

SEQ ID NO: 2425740 - RNA, 20 nt, Human
agccaugaggaguugcuguu

SEQ ID NO: 2425741 - RNA, 21 nt, Human
agccaugagaugauacaucca

SEQ ID NO: 2425742 - RNA, 18 nt, Human
agccaugaccuuacauuu

SEQ ID NO: 2425743 - RNA, 20 nt, Human
agccaugacuugagaaacaa

SEQ ID NO: 2425744 - RNA, 17 nt, Human
agccaugaccuuacauu

SEQ ID NO: 2425745 - RNA, 19 nt, Human
agccaucuugguaaauuuc

SEQ ID NO: 2425746 - RNA, 17 nt, Human
agccaucuugguaaauu

SEQ ID NO: 2425747 - RNA, 15 nt, Human
agccaucuugguaaa

SEQ ID NO: 2425748 - RNA, 19 nt, Human
agccaucugcccaggggug

SEQ ID NO: 2425749 - RNA, 18 nt, Human
agccaucugcccaggggu

SEQ ID NO: 2425750 - RNA, 16 nt, Human
agccaucugcccaggg

SEQ ID NO: 2425751 - RNA, 15 nt, Human
agccaucugcccagg

SEQ ID NO: 2425752 - RNA, 22 nt, Human
agccaucuccaucuugaaggaa

SEQ ID NO: 2425753 - RNA, 22 nt, Human
agccaucggugaaacuaacaga

SEQ ID NO: 2425754 - RNA, 14 nt, Human
agccaucugcccag

SEQ ID NO: 2425755 - RNA, 19 nt, Human
agccaucccaugaacacac

SEQ ID NO: 2425756 - RNA, 22 nt, Human
agccaucucucuacuccuaccu

SEQ ID NO: 2425757 - RNA, 21 nt, Human
agccaggcucugugcugaccc

SEQ ID NO: 2425758 - RNA, 21 nt, Human
agccaggcugccaaggccaga

SEQ ID NO: 2425759 - RNA, 11 nt, Human
agccagggcca

SEQ ID NO: 2425760 - RNA, 22 nt, Human
agccagcucccucuauuuaugu

SEQ ID NO: 2425761 - RNA, 13 nt, Human
agccagcucucag

SEQ ID NO: 2425762 - RNA, 14 nt, Human
agccagcucucagc

SEQ ID NO: 2425763 - RNA, 15 nt, Human
agccagcucucagcc

SEQ ID NO: 2425764 - RNA, 16 nt, Human
agccagcucucagcca

SEQ ID NO: 2425765 - RNA, 14 nt, Human
agccaggcucugug

SEQ ID NO: 2425766 - RNA, 17 nt, Human
agccaggcucugugcug

SEQ ID NO: 2425767 - RNA, 16 nt, Human
agccaggcucugugcu

SEQ ID NO: 2425768 - RNA, 20 nt, Human
agccaggcugccaaggccag

SEQ ID NO: 2425769 - RNA, 15 nt, Human
agccagcucauuuca

SEQ ID NO: 2425770 - RNA, 23 nt, Human
agccagccuucuuccaucccagg

SEQ ID NO: 2425771 - RNA, 23 nt, Human
agccagcguccuccucugugacc

SEQ ID NO: 2425772 - RNA, 14 nt, Human
agccagcucccucu

SEQ ID NO: 2425773 - RNA, 15 nt, Human
agccagcucccucua

SEQ ID NO: 2425774 - RNA, 17 nt, Human
agccagcucccucuauu

SEQ ID NO: 2425775 - RNA, 19 nt, Human
agccagcucccucuauuua

SEQ ID NO: 2425776 - RNA, 17 nt, Human
agccagcguccuccucu

SEQ ID NO: 2425777 - RNA, 18 nt, Human
agccagcguccuccucug

SEQ ID NO: 2425778 - RNA, 19 nt, Human
agccagcguccuccucugu

SEQ ID NO: 2425779 - RNA, 21 nt, Human
agccagcguccuccucuguga

SEQ ID NO: 2425780 - RNA, 16 nt, Human
agccagcguccuccuc

SEQ ID NO: 2425781 - RNA, 22 nt, Human
agccagcgggaauggcagcugc

SEQ ID NO: 2425782 - RNA, 18 nt, Human
agccaucaacaagaguug

SEQ ID NO: 2425783 - RNA, 18 nt, Human
agccaguaaacagaggag

SEQ ID NO: 2425784 - RNA, 18 nt, Human
agccaucaaaaugcuuuu

SEQ ID NO: 2425785 - RNA, 21 nt, Human
agccaguaaaugggggugcau

SEQ ID NO: 2425786 - RNA, 18 nt, Human
agccaucauaggaaggga

SEQ ID NO: 2425787 - RNA, 13 nt, Human
agccaucauggau

SEQ ID NO: 2425788 - RNA, 19 nt, Human
agccaucccagccuuggca

SEQ ID NO: 2425789 - RNA, 18 nt, Human
agccaucccagccuuggc

SEQ ID NO: 2425790 - RNA, 17 nt, Human
agccaucccagccuugg

SEQ ID NO: 2425791 - RNA, 14 nt, Human
agccaucccagccu

SEQ ID NO: 2425792 - RNA, 13 nt, Human
agccaguaaaugg

SEQ ID NO: 2425793 - RNA, 17 nt, Human
agccaggugccuuggag

SEQ ID NO: 2425794 - RNA, 16 nt, Human
agccaggugccuugga

SEQ ID NO: 2425795 - RNA, 14 nt, Human
agccaggugccuug

SEQ ID NO: 2425796 - RNA, 16 nt, Human
agccaguaaacagagg

SEQ ID NO: 2425797 - RNA, 18 nt, Human
agccaggugccuuggagg

SEQ ID NO: 2425798 - RNA, 21 nt, Human
agccagggcugcuagacggag

SEQ ID NO: 2425799 - RNA, 14 nt, Human
agccagggcugcua

SEQ ID NO: 2425800 - RNA, 13 nt, Human
agccaggugccuu

SEQ ID NO: 2425801 - RNA, 12 nt, Human
agccagggcugc

SEQ ID NO: 2425802 - RNA, 23 nt, Human
agccagggcuaugggagcagcuu

SEQ ID NO: 2425803 - RNA, 11 nt, Human
agccagggcug

SEQ ID NO: 2425804 - RNA, 17 nt, Human
agccagggccagggguc

SEQ ID NO: 2425805 - RNA, 14 nt, Human
agccagggccaggg

SEQ ID NO: 2425806 - RNA, 13 nt, Human
agccagggccagg

SEQ ID NO: 2425807 - RNA, 12 nt, Human
agccagggccag

SEQ ID NO: 2425808 - RNA, 22 nt, Human
agccagggcuaugggagcagcu

SEQ ID NO: 2425809 - RNA, 19 nt, Human
ugaugggagaguagauggu

SEQ ID NO: 2425810 - RNA, 21 nt, Human
ugauggagguuucauacucua

SEQ ID NO: 2425811 - RNA, 18 nt, Human
ugauggagguuucauacu

SEQ ID NO: 2425812 - RNA, 15 nt, Human
ugauggagcagagca

SEQ ID NO: 2425813 - RNA, 19 nt, Human
ugaugggaaagcauuguaa

SEQ ID NO: 2425814 - RNA, 14 nt, Human
ugaugggauuuggu

SEQ ID NO: 2425815 - RNA, 19 nt, Human
ugauggggcccugccuccu

SEQ ID NO: 2425816 - RNA, 16 nt, Human
ugauggggcccugccu

SEQ ID NO: 2425817 - RNA, 15 nt, Human
ugauggggcccugcc

SEQ ID NO: 2425818 - RNA, 14 nt, Human
ugauggggcccugc

SEQ ID NO: 2425819 - RNA, 16 nt, Human
ugaugagaggaaauca

SEQ ID NO: 2425820 - RNA, 15 nt, Human
ugaugagaggaaauc

SEQ ID NO: 2425821 - RNA, 14 nt, Human
ugaugagaggaaau

SEQ ID NO: 2425822 - RNA, 13 nt, Human
ugaugagaggaaa

SEQ ID NO: 2425823 - RNA, 14 nt, Human
ugaugggaaagcau

SEQ ID NO: 2425824 - RNA, 20 nt, Human
ugauggacccaaugcacaca

SEQ ID NO: 2425825 - RNA, 18 nt, Human
ugauggaaauauuuauuu

SEQ ID NO: 2425826 - RNA, 23 nt, Human
ugaugcuucuucagagacuccug

SEQ ID NO: 2425827 - RNA, 18 nt, Human
ugaugcuuucagauuaaa

SEQ ID NO: 2425828 - RNA, 21 nt, Human
ugauccucccaccucagccuc

SEQ ID NO: 2425829 - RNA, 16 nt, Human
ugauccucccaccuca

SEQ ID NO: 2425830 - RNA, 22 nt, Human
ugauccucccaccucagccucc

SEQ ID NO: 2425831 - RNA, 14 nt, Human
ugauccuggaggcc

SEQ ID NO: 2425832 - RNA, 15 nt, Human
ugauccuggaggccc

SEQ ID NO: 2425833 - RNA, 17 nt, Human
ugauccuccaacuucau

SEQ ID NO: 2425834 - RNA, 21 nt, Human
agcaccugccgaccucguccu

SEQ ID NO: 2425835 - RNA, 22 nt, Human
ugauccuaaugaaugcauaaaa

SEQ ID NO: 2425836 - RNA, 18 nt, Human
ugauccucauauggccca

SEQ ID NO: 2425837 - RNA, 22 nt, Human
agcaccugccgaccucguccuc

SEQ ID NO: 2425838 - RNA, 15 nt, Human
ugauccucccaccuc

SEQ ID NO: 2425839 - RNA, 16 nt, Human
ugauccuaguuccacc

SEQ ID NO: 2425840 - RNA, 15 nt, Human
agcaccugccgaccu

SEQ ID NO: 2425841 - RNA, 16 nt, Human
agcaccugccgaccuc

SEQ ID NO: 2425842 - RNA, 19 nt, Human
agcaccugccgaccucguc

SEQ ID NO: 2425843 - RNA, 20 nt, Human
agcaccugccgaccucgucc

SEQ ID NO: 2425844 - RNA, 11 nt, Human
agcaccugccg

SEQ ID NO: 2425845 - RNA, 12 nt, Human
ugaugaagaagu

SEQ ID NO: 2425846 - RNA, 11 nt, Human
ugaugaagaag

SEQ ID NO: 2425847 - RNA, 16 nt, Human
ugauccuggaggccca

SEQ ID NO: 2425848 - RNA, 17 nt, Human
ugauccuggaggcccag

SEQ ID NO: 2425849 - RNA, 18 nt, Human
ugauccuggaggcccagu

SEQ ID NO: 2425850 - RNA, 18 nt, Human
ugaugaaauguaaauacu

SEQ ID NO: 2425851 - RNA, 13 nt, Human
ugaugaacuuucu

SEQ ID NO: 2425852 - RNA, 17 nt, Human
ugaugaacuuauucugu

SEQ ID NO: 2425853 - RNA, 18 nt, Human
ugaugaacucuuaaucaa

SEQ ID NO: 2425854 - RNA, 15 nt, Human
ugaugaacuuucucu

SEQ ID NO: 2425855 - RNA, 14 nt, Human
ugaugaacuuucuc

SEQ ID NO: 2425856 - RNA, 23 nt, Human
ugaugaacuuucucuucauacuu

SEQ ID NO: 2425857 - RNA, 18 nt, Human
ugaugaagaaaagugggc

SEQ ID NO: 2425858 - RNA, 14 nt, Human
ugaugaccaaaguc

SEQ ID NO: 2425859 - RNA, 15 nt, Human
ugaugacagagcgag

SEQ ID NO: 2425860 - RNA, 17 nt, Human
ugaugacaguaguacca

SEQ ID NO: 2425861 - RNA, 20 nt, Human
ugaugaagaaaagugggcca

SEQ ID NO: 2425862 - RNA, 14 nt, Human
ugaugacagacacu

SEQ ID NO: 2425863 - RNA, 14 nt, Human
agccacuaacuaga

SEQ ID NO: 2425864 - RNA, 15 nt, Human
agccacucaggaggc

SEQ ID NO: 2425865 - RNA, 22 nt, Human
agccacucaggaggcugaggca

SEQ ID NO: 2425866 - RNA, 13 nt, Human
agccacuaacuag

SEQ ID NO: 2425867 - RNA, 22 nt, Human
agccacguuccuuacugcagaa

SEQ ID NO: 2425868 - RNA, 23 nt, Human
agccacguuccuuacugcagaau

SEQ ID NO: 2425869 - RNA, 12 nt, Human
agccacuccucu

SEQ ID NO: 2425870 - RNA, 16 nt, Human
agccacugcaccgggc

SEQ ID NO: 2425871 - RNA, 15 nt, Human
agccacgguguucug

SEQ ID NO: 2425872 - RNA, 17 nt, Human
ugauuaauggaaauguu

SEQ ID NO: 2425873 - RNA, 17 nt, Human
agccacguuccuuacug

SEQ ID NO: 2425874 - RNA, 18 nt, Human
agccacguuccuuacugc

SEQ ID NO: 2425875 - RNA, 20 nt, Human
agccacguuccuuacugcag

SEQ ID NO: 2425876 - RNA, 21 nt, Human
agccacguuccuuacugcaga

SEQ ID NO: 2425877 - RNA, 23 nt, Human
ugauuaaguaaugauaacuggaa

SEQ ID NO: 2425878 - RNA, 16 nt, Human
ugauuaauccagaaua

SEQ ID NO: 2425879 - RNA, 13 nt, Human
ugauuaauccaga

SEQ ID NO: 2425880 - RNA, 17 nt, Human
ugauuaauccagaauaa

SEQ ID NO: 2425881 - RNA, 15 nt, Human
ugauggugcaaugac

SEQ ID NO: 2425882 - RNA, 19 nt, Human
ugauuaaauucuugcaaag

SEQ ID NO: 2425883 - RNA, 13 nt, Human
ugauggugcaaug

SEQ ID NO: 2425884 - RNA, 16 nt, Human
ugauggugaugaaaug

SEQ ID NO: 2425885 - RNA, 15 nt, Human
ugauggugaugaaau

SEQ ID NO: 2425886 - RNA, 20 nt, Human
ugauuaaauucuugcaaagu

SEQ ID NO: 2425887 - RNA, 17 nt, Human
ugauggugaugaaaugu

SEQ ID NO: 2425888 - RNA, 16 nt, Human
ugauggucuucagccu

SEQ ID NO: 2425889 - RNA, 18 nt, Human
ugauuaaguaaugauaac

SEQ ID NO: 2425890 - RNA, 19 nt, Human
ugauuaaccacuucagcug

SEQ ID NO: 2425891 - RNA, 19 nt, Human
agccacugcaccgggccac

SEQ ID NO: 2425892 - RNA, 18 nt, Human
agccacugcaccgggcca

SEQ ID NO: 2425893 - RNA, 19 nt, Human
agccagagaagugacaggg

SEQ ID NO: 2425894 - RNA, 18 nt, Human
agccagagaagugacagg

SEQ ID NO: 2425895 - RNA, 17 nt, Human
agccagagaagugacag

SEQ ID NO: 2425896 - RNA, 16 nt, Human
agccagagaagugaca

SEQ ID NO: 2425897 - RNA, 15 nt, Human
agccagagaagugac

SEQ ID NO: 2425898 - RNA, 14 nt, Human
agccagagaaguga

SEQ ID NO: 2425899 - RNA, 11 nt, Human
agccagagaag

SEQ ID NO: 2425900 - RNA, 11 nt, Human
agccagaggag

SEQ ID NO: 2425901 - RNA, 10 nt, Human
agccagagga

SEQ ID NO: 2425902 - RNA, 21 nt, Human
agccagccuucuuccauccca

SEQ ID NO: 2425903 - RNA, 18 nt, Human
agccagccuucuuccauc

SEQ ID NO: 2425904 - RNA, 12 nt, Human
agccagcccucc

SEQ ID NO: 2425905 - RNA, 13 nt, Human
agccagcccuccc

SEQ ID NO: 2425906 - RNA, 15 nt, Human
agccagcccucccug

SEQ ID NO: 2425907 - RNA, 16 nt, Human
agccagcccucccugu

SEQ ID NO: 2425908 - RNA, 18 nt, Human
agccagcccucccugucc

SEQ ID NO: 2425909 - RNA, 20 nt, Human
agccagcccucccuguccuc

SEQ ID NO: 2425910 - RNA, 22 nt, Human
agccagcccucccuguccuccu

SEQ ID NO: 2425911 - RNA, 23 nt, Human
agccagcccucccuguccuccuc

SEQ ID NO: 2425912 - RNA, 21 nt, Human
agccagagaagugacagggaa

SEQ ID NO: 2425913 - RNA, 12 nt, Human
agccagcccagc

SEQ ID NO: 2425914 - RNA, 14 nt, Human
agccagcccagccc

SEQ ID NO: 2425915 - RNA, 15 nt, Human
agccagcccagccca

SEQ ID NO: 2425916 - RNA, 16 nt, Human
agccagcccagcccag

SEQ ID NO: 2425917 - RNA, 17 nt, Human
agccagcccagcccagc

SEQ ID NO: 2425918 - RNA, 18 nt, Human
agccagcccagcccagcu

SEQ ID NO: 2425919 - RNA, 14 nt, Human
ugcaagucauggcu

SEQ ID NO: 2425920 - RNA, 21 nt, Human
ugcaagucagaggauggccag

SEQ ID NO: 2425921 - RNA, 23 nt, Human
ugcaagucaguccaggaugcuaa

SEQ ID NO: 2425922 - RNA, 16 nt, Human
ugcaagucagaggaug

SEQ ID NO: 2425923 - RNA, 15 nt, Human
ugcaagucagaggau

SEQ ID NO: 2425924 - RNA, 14 nt, Human
ugcaagucagagga

SEQ ID NO: 2425925 - RNA, 22 nt, Human
ugcaaguauguuuuagcaugug

SEQ ID NO: 2425926 - RNA, 13 nt, Human
ugcaagucagagg

SEQ ID NO: 2425927 - RNA, 18 nt, Human
ugcaaguaugugagugug

SEQ ID NO: 2425928 - RNA, 22 nt, Human
ugcaaguaugugagugugucca

SEQ ID NO: 2425929 - RNA, 19 nt, Human
ugcaaguauguuuuagcau

SEQ ID NO: 2425930 - RNA, 21 nt, Human
ugcaaguauguuuuagcaugu

SEQ ID NO: 2425931 - RNA, 17 nt, Human
ugcaaacgcugccugcc

SEQ ID NO: 2425932 - RNA, 19 nt, Human
ugcaaacgcugccugccca

SEQ ID NO: 2425933 - RNA, 21 nt, Human
ugcaaacgcugccugcccgua

SEQ ID NO: 2425934 - RNA, 21 nt, Human
ugcaaacgcugccugccggua

SEQ ID NO: 2425935 - RNA, 16 nt, Human
ugcaaacucacugcuc

SEQ ID NO: 2425936 - RNA, 15 nt, Human
ugcaaguaugugagu

SEQ ID NO: 2425937 - RNA, 23 nt, Human
ugcaaaccugaccccugcucagu

SEQ ID NO: 2425938 - RNA, 14 nt, Human
ugcaaacgcugccu

SEQ ID NO: 2425939 - RNA, 15 nt, Human
ugcaaacgcugccug

SEQ ID NO: 2425940 - RNA, 16 nt, Human
ugcaaacgcugccugc

SEQ ID NO: 2425941 - RNA, 22 nt, Human
ugcaaaccugaccccugcucag

SEQ ID NO: 2425942 - RNA, 21 nt, Human
ugcaaaccaucauugaaaucu

SEQ ID NO: 2425943 - RNA, 15 nt, Human
ugauuuguacugaaa

SEQ ID NO: 2425944 - RNA, 18 nt, Human
ugauuuguacugaaaaau

SEQ ID NO: 2425945 - RNA, 19 nt, Human
ugauuuguuuuccucuuaa

SEQ ID NO: 2425946 - RNA, 22 nt, Human
agcccaggagagagaaagccag

SEQ ID NO: 2425947 - RNA, 17 nt, Human
agcccaggaggacugcc

SEQ ID NO: 2425948 - RNA, 12 nt, Human
agcccaggagga

SEQ ID NO: 2425949 - RNA, 19 nt, Human
agcccaggagagagaaagc

SEQ ID NO: 2425950 - RNA, 18 nt, Human
agcccaggagagagaaag

SEQ ID NO: 2425951 - RNA, 20 nt, Human
ugcaauauaucuaaauugaa

SEQ ID NO: 2425952 - RNA, 19 nt, Human
ugcaauauaucuaaauuga

SEQ ID NO: 2425953 - RNA, 18 nt, Human
ugcaauauaucuaaauug

SEQ ID NO: 2425954 - RNA, 20 nt, Human
ugcaauagaacagagaaaga

SEQ ID NO: 2425955 - RNA, 14 nt, Human
ugcaauaauacuuc

SEQ ID NO: 2425956 - RNA, 21 nt, Human
ugcaauaagaauuuagggaga

SEQ ID NO: 2425957 - RNA, 21 nt, Human
ugcaauaaaucugacccagug

SEQ ID NO: 2425958 - RNA, 23 nt, Human
ugcaauaaaucugacccagugcc

SEQ ID NO: 2425959 - RNA, 20 nt, Human
ugcaauaaaucugacccagu

SEQ ID NO: 2425960 - RNA, 19 nt, Human
ugcaauaaaucugacccag

SEQ ID NO: 2425961 - RNA, 21 nt, Human
ugcaagugguagcaagaagug

SEQ ID NO: 2425962 - RNA, 21 nt, Human
ugcaaguguaugcacgugugc

SEQ ID NO: 2425963 - RNA, 16 nt, Human
ugcaagugucugugug

SEQ ID NO: 2425964 - RNA, 17 nt, Human
ugcaagugucugugugc

SEQ ID NO: 2425965 - RNA, 16 nt, Human
ugcaagucauggcugu

SEQ ID NO: 2425966 - RNA, 18 nt, Human
ugcaagugaagguuuaca

SEQ ID NO: 2425967 - RNA, 13 nt, Human
ugcaagugaaggu

SEQ ID NO: 2425968 - RNA, 16 nt, Human
ugcaagugacaucucu

SEQ ID NO: 2425969 - RNA, 22 nt, Human
agccccauucugccugcccagg

SEQ ID NO: 2425970 - RNA, 21 nt, Human
agccccauucugccugcccag

SEQ ID NO: 2425971 - RNA, 18 nt, Human
agccccaaaacucuccuc

SEQ ID NO: 2425972 - RNA, 20 nt, Human
agccccauucugccugccca

SEQ ID NO: 2425973 - RNA, 17 nt, Human
agccccaaaacucuccu

SEQ ID NO: 2425974 - RNA, 16 nt, Human
agccccaaaacucucc

SEQ ID NO: 2425975 - RNA, 13 nt, Human
agcccauuucaau

SEQ ID NO: 2425976 - RNA, 22 nt, Human
agcccauucucucuccugucca

SEQ ID NO: 2425977 - RNA, 20 nt, Human
agcccauucucucuccuguc

SEQ ID NO: 2425978 - RNA, 21 nt, Human
agcccauucucucuccugucc

SEQ ID NO: 2425979 - RNA, 16 nt, Human
agcccauucucucucc

SEQ ID NO: 2425980 - RNA, 17 nt, Human
agcccauucucucuccu

SEQ ID NO: 2425981 - RNA, 18 nt, Human
agcccauucucucuccug

SEQ ID NO: 2425982 - RNA, 19 nt, Human
agcccauucucucuccugu

SEQ ID NO: 2425983 - RNA, 17 nt, Human
agcccauucauuccauu

SEQ ID NO: 2425984 - RNA, 22 nt, Human
agcccauucauuccauucugga

SEQ ID NO: 2425985 - RNA, 23 nt, Human
agcccauucauuccauucuggaa

SEQ ID NO: 2425986 - RNA, 15 nt, Human
agcccauucucucuc

SEQ ID NO: 2425987 - RNA, 14 nt, Human
agcccauucauucc

SEQ ID NO: 2425988 - RNA, 19 nt, Human
agcccauggcccucccagu

SEQ ID NO: 2425989 - RNA, 16 nt, Human
agcccagggcuccugc

SEQ ID NO: 2425990 - RNA, 15 nt, Human
agcccagggcuccug

SEQ ID NO: 2425991 - RNA, 14 nt, Human
agcccagggcuccu

SEQ ID NO: 2425992 - RNA, 23 nt, Human
agcccagggcuccugcacuuacu

SEQ ID NO: 2425993 - RNA, 17 nt, Human
agcccagggcuccugca

SEQ ID NO: 2425994 - RNA, 10 nt, Human
agcccagggu

SEQ ID NO: 2425995 - RNA, 11 nt, Human
agcccaggagu

SEQ ID NO: 2425996 - RNA, 19 nt, Human
agcccaggaguuugaggcu

SEQ ID NO: 2425997 - RNA, 21 nt, Human
agcccaggcgggagcgguggc

SEQ ID NO: 2425998 - RNA, 21 nt, Human
agcccaggccuccuacagcuu

SEQ ID NO: 2425999 - RNA, 18 nt, Human
agcccagggagcggaaag

SEQ ID NO: 2426000 - RNA, 19 nt, Human
agcccagggagcggaaagc

SEQ ID NO: 2426001 - RNA, 20 nt, Human
agcccagggagcggaaagca

SEQ ID NO: 2426002 - RNA, 21 nt, Human
agcccagggagcggaaagcag

SEQ ID NO: 2426003 - RNA, 22 nt, Human
agcccagggagcggaaagcagc

SEQ ID NO: 2426004 - RNA, 23 nt, Human
agcccagggagcggaaagcagcu

SEQ ID NO: 2426005 - RNA, 15 nt, Human
agcccggcugguuuu

SEQ ID NO: 2426006 - RNA, 15 nt, Human
agcccggcucccacc

SEQ ID NO: 2426007 - RNA, 13 nt, Human
agcccggcugguu

SEQ ID NO: 2426008 - RNA, 16 nt, Human
agcccugcuggccgcc

SEQ ID NO: 2426009 - RNA, 13 nt, Human
agcccugcuggcc

SEQ ID NO: 2426010 - RNA, 12 nt, Human
agcccugcuggc

SEQ ID NO: 2426011 - RNA, 17 nt, Human
agcccugcuuugggcug

SEQ ID NO: 2426012 - RNA, 19 nt, Human
agcccuggagucaugccaa

SEQ ID NO: 2426013 - RNA, 19 nt, Human
agcccugcuuugggcugcc

SEQ ID NO: 2426014 - RNA, 21 nt, Human
agcccugcuggccgccucacc

SEQ ID NO: 2426015 - RNA, 17 nt, Human
agcccugcuggccgccu

SEQ ID NO: 2426016 - RNA, 12 nt, Human
agcccuggcagg

SEQ ID NO: 2426017 - RNA, 13 nt, Human
agcccuggcagga

SEQ ID NO: 2426018 - RNA, 17 nt, Human
agcccuggcaggaugac

SEQ ID NO: 2426019 - RNA, 13 nt, Human
agcccuggccaga

SEQ ID NO: 2426020 - RNA, 21 nt, Human
agcccuggcaggaugacccug

SEQ ID NO: 2426021 - RNA, 23 nt, Human
agcccuggauuucagaaagagca

SEQ ID NO: 2426022 - RNA, 14 nt, Human
agcccuggccagag

SEQ ID NO: 2426023 - RNA, 15 nt, Human
agcccuggccagagg

SEQ ID NO: 2426024 - RNA, 16 nt, Human
agcccuggccagaggc

SEQ ID NO: 2426025 - RNA, 15 nt, Human
agcccuggcugaagg

SEQ ID NO: 2426026 - RNA, 13 nt, Human
agcccuggcugaa

SEQ ID NO: 2426027 - RNA, 12 nt, Human
agcccuggcuga

SEQ ID NO: 2426028 - RNA, 15 nt, Human
agcccuggcucugca

SEQ ID NO: 2426029 - RNA, 14 nt, Human
agcccuggcucugc

SEQ ID NO: 2426030 - RNA, 17 nt, Human
agcccuggccagaggcu

SEQ ID NO: 2426031 - RNA, 16 nt, Human
agcccugguggcagug

SEQ ID NO: 2426032 - RNA, 15 nt, Human
agcccugguggcagu

SEQ ID NO: 2426033 - RNA, 21 nt, Human
agcccuggcugaaggacugug

SEQ ID NO: 2426034 - RNA, 20 nt, Human
agcccuggcugaaggacugu

SEQ ID NO: 2426035 - RNA, 18 nt, Human
agcccuggcugaaggacu

SEQ ID NO: 2426036 - RNA, 16 nt, Human
agcccuggcugaagga

SEQ ID NO: 2426037 - RNA, 14 nt, Human
agcccugguggcag

SEQ ID NO: 2426038 - RNA, 18 nt, Human
ugcacacaccagagccca

SEQ ID NO: 2426039 - RNA, 17 nt, Human
ugcacacaccagagccc

SEQ ID NO: 2426040 - RNA, 16 nt, Human
agcccuggucucagca

SEQ ID NO: 2426041 - RNA, 14 nt, Human
agcccuggucucag

SEQ ID NO: 2426042 - RNA, 21 nt, Human
ugcacacaccagagcccaccu

SEQ ID NO: 2426043 - RNA, 19 nt, Human
agcccgcacccccacccuu

SEQ ID NO: 2426044 - RNA, 21 nt, Human
agcccgcacccccacccuuug

SEQ ID NO: 2426045 - RNA, 19 nt, Human
agcccgccaagguagccau

SEQ ID NO: 2426046 - RNA, 16 nt, Human
agcccgcacccccacc

SEQ ID NO: 2426047 - RNA, 17 nt, Human
agcccgcacccccaccc

SEQ ID NO: 2426048 - RNA, 18 nt, Human
agcccgcacccccacccu

SEQ ID NO: 2426049 - RNA, 15 nt, Human
agcccgaauacaaac

SEQ ID NO: 2426050 - RNA, 15 nt, Human
agcccgcacccccac

SEQ ID NO: 2426051 - RNA, 23 nt, Human
agccccugccccagcccaagucc

SEQ ID NO: 2426052 - RNA, 21 nt, Human
agccccugccccagcccaagu

SEQ ID NO: 2426053 - RNA, 18 nt, Human
agccccugccccagccca

SEQ ID NO: 2426054 - RNA, 17 nt, Human
agccccugccccagccc

SEQ ID NO: 2426055 - RNA, 16 nt, Human
agccccugccccagcc

SEQ ID NO: 2426056 - RNA, 15 nt, Human
agccccugccccagc

SEQ ID NO: 2426057 - RNA, 13 nt, Human
agccccugcccca

SEQ ID NO: 2426058 - RNA, 14 nt, Human
agcccgaauacaaa

SEQ ID NO: 2426059 - RNA, 23 nt, Human
agccccuuuuucauauguugcuc

SEQ ID NO: 2426060 - RNA, 22 nt, Human
agccccuuuuucauauguugcu

SEQ ID NO: 2426061 - RNA, 22 nt, Human
agcccggcgccccugccaccuc

SEQ ID NO: 2426062 - RNA, 21 nt, Human
agcccggcgccccugccaccu

SEQ ID NO: 2426063 - RNA, 18 nt, Human
agcccggcgccccugcca

SEQ ID NO: 2426064 - RNA, 16 nt, Human
agcccggcgccccugc

SEQ ID NO: 2426065 - RNA, 21 nt, Human
agcccggcgccaccauccugc

SEQ ID NO: 2426066 - RNA, 20 nt, Human
agcccggcgccaccauccug

SEQ ID NO: 2426067 - RNA, 22 nt, Human
agcccggccugcucccagcagc

SEQ ID NO: 2426068 - RNA, 21 nt, Human
agcccggccugcucccagcag

SEQ ID NO: 2426069 - RNA, 20 nt, Human
agcccggccugcucccagca

SEQ ID NO: 2426070 - RNA, 19 nt, Human
agcccggccugcucccagc

SEQ ID NO: 2426071 - RNA, 11 nt, Human
agcccggccug

SEQ ID NO: 2426072 - RNA, 20 nt, Human
agcccggaccuuggcagccc

SEQ ID NO: 2426073 - RNA, 19 nt, Human
agcccgcugaguggacugg

SEQ ID NO: 2426074 - RNA, 14 nt, Human
agcccggaugcuuc

SEQ ID NO: 2426075 - RNA, 21 nt, Human
agcccgccugccaguccuagc

SEQ ID NO: 2426076 - RNA, 19 nt, Human
agcccgccugccaguccua

SEQ ID NO: 2426077 - RNA, 18 nt, Human
agcccgccugccaguccu

SEQ ID NO: 2426078 - RNA, 16 nt, Human
agcccgccugccaguc

SEQ ID NO: 2426079 - RNA, 15 nt, Human
agcccgccugccagu

SEQ ID NO: 2426080 - RNA, 14 nt, Human
agcccgccugccag

SEQ ID NO: 2426081 - RNA, 13 nt, Human
agcccgccugcca

SEQ ID NO: 2426082 - RNA, 12 nt, Human
agcccgccugcc

SEQ ID NO: 2426083 - RNA, 20 nt, Human
agcccgcggggacauuggga

SEQ ID NO: 2426084 - RNA, 23 nt, Human
agcccgccugccaguccuagcug

SEQ ID NO: 2426085 - RNA, 22 nt, Human
agcccgccugccaguccuagcu

SEQ ID NO: 2426086 - RNA, 15 nt, Human
agcccgcggggacau

SEQ ID NO: 2426087 - RNA, 14 nt, Human
agcccccuggccuc

SEQ ID NO: 2426088 - RNA, 21 nt, Human
agccccucuggucgcuccugc

SEQ ID NO: 2426089 - RNA, 20 nt, Human
agccccucuggucgcuccug

SEQ ID NO: 2426090 - RNA, 22 nt, Human
agccccucuggucgcuccugcc

SEQ ID NO: 2426091 - RNA, 10 nt, Human
agccccucuu

SEQ ID NO: 2426092 - RNA, 12 nt, Human
agccccugcccc

SEQ ID NO: 2426093 - RNA, 20 nt, Human
agccccugauccugugaagu

SEQ ID NO: 2426094 - RNA, 16 nt, Human
agccccucuugccccc

SEQ ID NO: 2426095 - RNA, 17 nt, Human
agccccucuugcccccc

SEQ ID NO: 2426096 - RNA, 20 nt, Human
agccccucuugccccccacc

SEQ ID NO: 2426097 - RNA, 23 nt, Human
agccccucuugccccccacccca

SEQ ID NO: 2426098 - RNA, 21 nt, Human
agccccucuugccccccaccc

SEQ ID NO: 2426099 - RNA, 22 nt, Human
agccccucuugccccccacccc

SEQ ID NO: 2426100 - RNA, 23 nt, Human
agccccauucugccugcccaggc

SEQ ID NO: 2426101 - RNA, 22 nt, Human
agcccccccaacacugugcccu

SEQ ID NO: 2426102 - RNA, 21 nt, Human
agcccccccaacacugugccc

SEQ ID NO: 2426103 - RNA, 20 nt, Human
agcccccccaacacugugcc

SEQ ID NO: 2426104 - RNA, 19 nt, Human
agcccccccaacacugugc

SEQ ID NO: 2426105 - RNA, 17 nt, Human
agcccccaggcugcugg

SEQ ID NO: 2426106 - RNA, 18 nt, Human
agcccccccaacacugug

SEQ ID NO: 2426107 - RNA, 18 nt, Human
agcccccaggcugcugga

SEQ ID NO: 2426108 - RNA, 16 nt, Human
agcccccuccuugucu

SEQ ID NO: 2426109 - RNA, 23 nt, Human
agcccccgccccgccccacauuc

SEQ ID NO: 2426110 - RNA, 23 nt, Human
agcccccccaacacugugcccug

SEQ ID NO: 2426111 - RNA, 22 nt, Human
agcccccgccccgccccacauu

SEQ ID NO: 2426112 - RNA, 15 nt, Human
agcccccccuuccac

SEQ ID NO: 2426113 - RNA, 13 nt, Human
agcccccccuucc

SEQ ID NO: 2426114 - RNA, 20 nt, Human
agccucauauuuaaagacag

SEQ ID NO: 2426115 - RNA, 21 nt, Human
agccuccaagcuccaucucca

SEQ ID NO: 2426116 - RNA, 17 nt, Human
agccucauccgaggcag

SEQ ID NO: 2426117 - RNA, 14 nt, Human
agccuccagccucu

SEQ ID NO: 2426118 - RNA, 13 nt, Human
agccuccagccuc

SEQ ID NO: 2426119 - RNA, 12 nt, Human
agccuccagccu

SEQ ID NO: 2426120 - RNA, 17 nt, Human
agccuccagcugccccg

SEQ ID NO: 2426121 - RNA, 18 nt, Human
agccuccagccucuguuc

SEQ ID NO: 2426122 - RNA, 16 nt, Human
agccuccagccucugu

SEQ ID NO: 2426123 - RNA, 15 nt, Human
agccuccagccucug

SEQ ID NO: 2426124 - RNA, 17 nt, Human
agccuccaugcugccuc

SEQ ID NO: 2426125 - RNA, 23 nt, Human
agccucugaaaaccaauguucuc

SEQ ID NO: 2426126 - RNA, 22 nt, Human
agccuccaguccaaggaaacca

SEQ ID NO: 2426127 - RNA, 16 nt, Human
agccuccaguccaagg

SEQ ID NO: 2426128 - RNA, 15 nt, Human
agccucucucccagu

SEQ ID NO: 2426129 - RNA, 14 nt, Human
agccucucucccag

SEQ ID NO: 2426130 - RNA, 17 nt, Human
agccucucucccagucu

SEQ ID NO: 2426131 - RNA, 16 nt, Human
agccucucucccaguc

SEQ ID NO: 2426132 - RNA, 18 nt, Human
agccucucucccagucua

SEQ ID NO: 2426133 - RNA, 13 nt, Human
agccucugcuccc

SEQ ID NO: 2426134 - RNA, 21 nt, Human
agccucugacuuaagcugccu

SEQ ID NO: 2426135 - RNA, 22 nt, Human
agccucugaccccuccucacug

SEQ ID NO: 2426136 - RNA, 18 nt, Human
agccucugagccccuggg

SEQ ID NO: 2426137 - RNA, 21 nt, Human
agccucugaccccuccucacu

SEQ ID NO: 2426138 - RNA, 20 nt, Human
agccucugaccccuccucac

SEQ ID NO: 2426139 - RNA, 19 nt, Human
agccucugaccccuccuca

SEQ ID NO: 2426140 - RNA, 18 nt, Human
agccucugaccccuccuc

SEQ ID NO: 2426141 - RNA, 17 nt, Human
agccucugaccccuccu

SEQ ID NO: 2426142 - RNA, 15 nt, Human
agccucugaccccuc

SEQ ID NO: 2426143 - RNA, 12 nt, Human
agccucugaccc

SEQ ID NO: 2426144 - RNA, 22 nt, Human
ugcagcucaaggaaaggccuga

SEQ ID NO: 2426145 - RNA, 16 nt, Human
ugcagcucacuacccu

SEQ ID NO: 2426146 - RNA, 21 nt, Human
ugcagcucaaggaaaggccug

SEQ ID NO: 2426147 - RNA, 22 nt, Human
ugcagccucaaccuccugggcu

SEQ ID NO: 2426148 - RNA, 21 nt, Human
ugcagccucaaccuccugggc

SEQ ID NO: 2426149 - RNA, 20 nt, Human
ugcagccucaaccuccuggg

SEQ ID NO: 2426150 - RNA, 13 nt, Human
agccucuggguca

SEQ ID NO: 2426151 - RNA, 20 nt, Human
agccucuggcuagaggccag

SEQ ID NO: 2426152 - RNA, 12 nt, Human
agccucuggcua

SEQ ID NO: 2426153 - RNA, 13 nt, Human
agccucuggcuag

SEQ ID NO: 2426154 - RNA, 14 nt, Human
agccucuggcuaga

SEQ ID NO: 2426155 - RNA, 15 nt, Human
agccucuggcuagag

SEQ ID NO: 2426156 - RNA, 15 nt, Human
agccucugcucccca

SEQ ID NO: 2426157 - RNA, 16 nt, Human
agccucugcuccccag

SEQ ID NO: 2426158 - RNA, 12 nt, Human
agccucugcugc

SEQ ID NO: 2426159 - RNA, 13 nt, Human
agccucugcugcc

SEQ ID NO: 2426160 - RNA, 23 nt, Human
agccucuggcauuagaauuauuu

SEQ ID NO: 2426161 - RNA, 22 nt, Human
agccucuggcauuagaauuauu

SEQ ID NO: 2426162 - RNA, 14 nt, Human
agccucugcugcca

SEQ ID NO: 2426163 - RNA, 18 nt, Human
agccucugcugccauggc

SEQ ID NO: 2426164 - RNA, 13 nt, Human
agccucagucucc

SEQ ID NO: 2426165 - RNA, 16 nt, Human
agccucagucucccuc

SEQ ID NO: 2426166 - RNA, 19 nt, Human
agccucagucucccucccu

SEQ ID NO: 2426167 - RNA, 20 nt, Human
agccucagucucccucccuu

SEQ ID NO: 2426168 - RNA, 19 nt, Human
agccucaguccuccccuca

SEQ ID NO: 2426169 - RNA, 18 nt, Human
agccucaguccuccccuc

SEQ ID NO: 2426170 - RNA, 20 nt, Human
agccucaguccuccccucac

SEQ ID NO: 2426171 - RNA, 22 nt, Human
agccucagucucccucccuugg

SEQ ID NO: 2426172 - RNA, 16 nt, Human
agccucauauuuaaag

SEQ ID NO: 2426173 - RNA, 15 nt, Human
agccucauauuuaaa

SEQ ID NO: 2426174 - RNA, 14 nt, Human
agccucauauuuaa

SEQ ID NO: 2426175 - RNA, 19 nt, Human
agccucauauuuaaagaca

SEQ ID NO: 2426176 - RNA, 17 nt, Human
agccucauauuuaaaga

SEQ ID NO: 2426177 - RNA, 14 nt, Human
agccucauccgagg

SEQ ID NO: 2426178 - RNA, 17 nt, Human
agccucaguccuccccu

SEQ ID NO: 2426179 - RNA, 16 nt, Human
agccucaguccucccc

SEQ ID NO: 2426180 - RNA, 15 nt, Human
agccucaguccuccc

SEQ ID NO: 2426181 - RNA, 11 nt, Human
agccucagucc

SEQ ID NO: 2426182 - RNA, 12 nt, Human
agccucagccau

SEQ ID NO: 2426183 - RNA, 15 nt, Human
agccucagccauuca

SEQ ID NO: 2426184 - RNA, 22 nt, Human
agccucacuugaaugugucacu

SEQ ID NO: 2426185 - RNA, 18 nt, Human
agccgagaucacgccacu

SEQ ID NO: 2426186 - RNA, 19 nt, Human
agccucaaccuccugggcu

SEQ ID NO: 2426187 - RNA, 20 nt, Human
agccucaaccuccugggcua

SEQ ID NO: 2426188 - RNA, 21 nt, Human
agccucaagucuuauuuccuc

SEQ ID NO: 2426189 - RNA, 21 nt, Human
agcccuuugggaggcugaggc

SEQ ID NO: 2426190 - RNA, 22 nt, Human
agcccuuugggaggcugaggcg

SEQ ID NO: 2426191 - RNA, 17 nt, Human
agccucacaguccuuac

SEQ ID NO: 2426192 - RNA, 20 nt, Human
agccucaauaagccuugucg

SEQ ID NO: 2426193 - RNA, 19 nt, Human
agccucaauaagccuuguc

SEQ ID NO: 2426194 - RNA, 18 nt, Human
agccucaauaagccuugu

SEQ ID NO: 2426195 - RNA, 15 nt, Human
agccucacagaagaa

SEQ ID NO: 2426196 - RNA, 18 nt, Human
agccucacaguccuuacc

SEQ ID NO: 2426197 - RNA, 16 nt, Human
agccucacuugaaugu

SEQ ID NO: 2426198 - RNA, 17 nt, Human
agccucacuugaaugug

SEQ ID NO: 2426199 - RNA, 18 nt, Human
agcccuguggaugagccc

SEQ ID NO: 2426200 - RNA, 19 nt, Human
agcccuguggaugagcccu

SEQ ID NO: 2426201 - RNA, 22 nt, Human
agcccuguggaugagcccucag

SEQ ID NO: 2426202 - RNA, 23 nt, Human
agcccuguggaugagcccucaga

SEQ ID NO: 2426203 - RNA, 16 nt, Human
agcccuuagcagggaa

SEQ ID NO: 2426204 - RNA, 23 nt, Human
agcccugucgagacacuugccuu

SEQ ID NO: 2426205 - RNA, 21 nt, Human
agcccugucgagacacuugcc

SEQ ID NO: 2426206 - RNA, 12 nt, Human
agcccuguggaa

SEQ ID NO: 2426207 - RNA, 18 nt, Human
agcccugucgagacacuu

SEQ ID NO: 2426208 - RNA, 17 nt, Human
agcccugucgagacacu

SEQ ID NO: 2426209 - RNA, 17 nt, Human
ugcagacucuacagagg

SEQ ID NO: 2426210 - RNA, 16 nt, Human
ugcagacucuacagag

SEQ ID NO: 2426211 - RNA, 16 nt, Human
agcccugucagugcag

SEQ ID NO: 2426212 - RNA, 14 nt, Human
ugcagacucacugu

SEQ ID NO: 2426213 - RNA, 14 nt, Human
ugcagacucaguuu

SEQ ID NO: 2426214 - RNA, 15 nt, Human
ugcagacucaguuug

SEQ ID NO: 2426215 - RNA, 20 nt, Human
agcccugucagugcagcccg

SEQ ID NO: 2426216 - RNA, 19 nt, Human
ugcagacucaguuugucag

SEQ ID NO: 2426217 - RNA, 20 nt, Human
ugcagacucaguuugucaga

SEQ ID NO: 2426218 - RNA, 17 nt, Human
agcccugucagugcagc

SEQ ID NO: 2426219 - RNA, 19 nt, Human
agcccugucagugcagccc

SEQ ID NO: 2426220 - RNA, 18 nt, Human
agcccuuucugugugcac

SEQ ID NO: 2426221 - RNA, 17 nt, Human
agcccuuucugugugca

SEQ ID NO: 2426222 - RNA, 16 nt, Human
agcccuuucugugugc

SEQ ID NO: 2426223 - RNA, 13 nt, Human
agcccuuucugug

SEQ ID NO: 2426224 - RNA, 12 nt, Human
agcccuuucugu

SEQ ID NO: 2426225 - RNA, 21 nt, Human
agcccuuuacuugaccuccua

SEQ ID NO: 2426226 - RNA, 20 nt, Human
agccgagauagccaaggcca

SEQ ID NO: 2426227 - RNA, 21 nt, Human
agccgagauagccaaggccaa

SEQ ID NO: 2426228 - RNA, 17 nt, Human
agccgagaucacgccac

SEQ ID NO: 2426229 - RNA, 15 nt, Human
agcccuuaucugugc

SEQ ID NO: 2426230 - RNA, 23 nt, Human
agcccuguugacacaggucuuuc

SEQ ID NO: 2426231 - RNA, 17 nt, Human
agcccuguugacacagg

SEQ ID NO: 2426232 - RNA, 18 nt, Human
agcccuguugacacaggu

SEQ ID NO: 2426233 - RNA, 20 nt, Human
agcccuguugacacaggucu

SEQ ID NO: 2426234 - RNA, 21 nt, Human
agcccuguugacacaggucuu

SEQ ID NO: 2426235 - RNA, 21 nt, Human
agcccuuagcagggaaacagc

SEQ ID NO: 2426236 - RNA, 11 nt, Human
agcccuuggcc

SEQ ID NO: 2426237 - RNA, 23 nt, Human
agcccuugccuccccauuuccca

SEQ ID NO: 2426238 - RNA, 12 nt, Human
agcccuuggcca

SEQ ID NO: 2426239 - RNA, 12 nt, Human
agcccuuggguu

SEQ ID NO: 2426240 - RNA, 16 nt, Human
agcccuugccucccca

SEQ ID NO: 2426241 - RNA, 14 nt, Human
agcccuugccuccc

SEQ ID NO: 2426242 - RNA, 13 nt, Human
agcccuugccucc

SEQ ID NO: 2426243 - RNA, 12 nt, Human
agcccuugccuc

SEQ ID NO: 2426244 - RNA, 17 nt, Human
agcccuugcauugcaga

SEQ ID NO: 2426245 - RNA, 11 nt, Human
ugcacacauuu

SEQ ID NO: 2426246 - RNA, 12 nt, Human
ugcacacauuuu

SEQ ID NO: 2426247 - RNA, 13 nt, Human
ugcacacauuuuu

SEQ ID NO: 2426248 - RNA, 15 nt, Human
ugcacacauuuuuua

SEQ ID NO: 2426249 - RNA, 17 nt, Human
ugcacuccccugcuggg

SEQ ID NO: 2426250 - RNA, 16 nt, Human
ugcacuccccugcugg

SEQ ID NO: 2426251 - RNA, 18 nt, Human
ugcacucuaaaagguuca

SEQ ID NO: 2426252 - RNA, 17 nt, Human
agcccuggucucagcag

SEQ ID NO: 2426253 - RNA, 19 nt, Human
ugcacuccccugcugggug

SEQ ID NO: 2426254 - RNA, 15 nt, Human
ugcagaagacaguau

SEQ ID NO: 2426255 - RNA, 22 nt, Human
ugcagacaggcaagcaccuccu

SEQ ID NO: 2426256 - RNA, 14 nt, Human
ugcagaagacagua

SEQ ID NO: 2426257 - RNA, 22 nt, Human
ugcacucuaacccuaggcauca

SEQ ID NO: 2426258 - RNA, 21 nt, Human
ugcacucuaaaagguucaggg

SEQ ID NO: 2426259 - RNA, 14 nt, Human
ugcagaacuaaacu

SEQ ID NO: 2426260 - RNA, 23 nt, Human
ugcagaccacgcccguccugccu

SEQ ID NO: 2426261 - RNA, 15 nt, Human
ugcagacaugagugc

SEQ ID NO: 2426262 - RNA, 23 nt, Human
ugcagaccuguccuccugguggg

SEQ ID NO: 2426263 - RNA, 21 nt, Human
ugcagaccuguccuccuggug

SEQ ID NO: 2426264 - RNA, 20 nt, Human
ugcagaccuguccuccuggu

SEQ ID NO: 2426265 - RNA, 19 nt, Human
ugcagaccuguccuccugg

SEQ ID NO: 2426266 - RNA, 18 nt, Human
ugcagaccuguccuccug

SEQ ID NO: 2426267 - RNA, 15 nt, Human
ugcagaccuguccuc

SEQ ID NO: 2426268 - RNA, 14 nt, Human
ugcagaccuguccu

SEQ ID NO: 2426269 - RNA, 23 nt, Human
ugcagacuagaauucuagugcug

SEQ ID NO: 2426270 - RNA, 22 nt, Human
ugcagacuagaauucuagugcu

SEQ ID NO: 2426271 - RNA, 16 nt, Human
ugcagacucaauaaaa

SEQ ID NO: 2426272 - RNA, 19 nt, Human
ugcagacucaauaaaauca

SEQ ID NO: 2426273 - RNA, 19 nt, Human
ugcagacuagaauucuagu

SEQ ID NO: 2426274 - RNA, 17 nt, Human
ugcagacuagaauucua

SEQ ID NO: 2426275 - RNA, 14 nt, Human
ugcagacuagaauu

SEQ ID NO: 2426276 - RNA, 10 nt, Human
ugccugcuga

SEQ ID NO: 2426277 - RNA, 23 nt, Human
ugccugcugaaugauuuccaaag

SEQ ID NO: 2426278 - RNA, 21 nt, Human
ugccugcuuuucacugcugca

SEQ ID NO: 2426279 - RNA, 19 nt, Human
ugccugcuuuucacugcug

SEQ ID NO: 2426280 - RNA, 10 nt, Human
agcugccugu

SEQ ID NO: 2426281 - RNA, 22 nt, Human
agcugcuuuugucuaugggacu

SEQ ID NO: 2426282 - RNA, 13 nt, Human
agcugccuguuca

SEQ ID NO: 2426283 - RNA, 14 nt, Human
agcugccuguaguu

SEQ ID NO: 2426284 - RNA, 15 nt, Human
agcugccuguaguua

SEQ ID NO: 2426285 - RNA, 18 nt, Human
agcugccuguaguuagga

SEQ ID NO: 2426286 - RNA, 19 nt, Human
agcugccuguaguuaggaa

SEQ ID NO: 2426287 - RNA, 20 nt, Human
agcugccuguaguuaggaaa

SEQ ID NO: 2426288 - RNA, 22 nt, Human
agcugccuguaguuaggaaaua

SEQ ID NO: 2426289 - RNA, 23 nt, Human
agcugccuguaguuaggaaauaa

SEQ ID NO: 2426290 - RNA, 14 nt, Human
agcugccugugccu

SEQ ID NO: 2426291 - RNA, 24 nt, Human
agcugcuuuugucuaugggacuca

SEQ ID NO: 2426292 - RNA, 23 nt, Human
agcugcuuuugucuaugggacuc

SEQ ID NO: 2426293 - RNA, 13 nt, Human
agcuggaggacua

SEQ ID NO: 2426294 - RNA, 19 nt, Human
agcuggagccuggugcccu

SEQ ID NO: 2426295 - RNA, 17 nt, Human
agcuggagccuggugcc

SEQ ID NO: 2426296 - RNA, 15 nt, Human
agcuggagccuggug

SEQ ID NO: 2426297 - RNA, 14 nt, Human
agcuggagccuggu

SEQ ID NO: 2426298 - RNA, 22 nt, Human
agcuggaggacuagaaccugga

SEQ ID NO: 2426299 - RNA, 20 nt, Human
agcuggaggacuagaaccug

SEQ ID NO: 2426300 - RNA, 15 nt, Human
agcugggacuacagg

SEQ ID NO: 2426301 - RNA, 13 nt, Human
ugccucucuguuu

SEQ ID NO: 2426302 - RNA, 12 nt, Human
ugccucucuguu

SEQ ID NO: 2426303 - RNA, 21 nt, Human
ugccucucugcaggucccuaa

SEQ ID NO: 2426304 - RNA, 22 nt, Human
ugccucugccaaaggaugugau

SEQ ID NO: 2426305 - RNA, 21 nt, Human
ugccucugccaaaggauguga

SEQ ID NO: 2426306 - RNA, 11 nt, Human
ugccucugccu

SEQ ID NO: 2426307 - RNA, 23 nt, Human
ugccucucugcaggucccuaaua

SEQ ID NO: 2426308 - RNA, 15 nt, Human
ugccucucugcaggu

SEQ ID NO: 2426309 - RNA, 16 nt, Human
ugccucugacacacag

SEQ ID NO: 2426310 - RNA, 14 nt, Human
ugccucugacacac

SEQ ID NO: 2426311 - RNA, 19 nt, Human
ugccugcccaggccccugc

SEQ ID NO: 2426312 - RNA, 18 nt, Human
ugccugcccaggccccug

SEQ ID NO: 2426313 - RNA, 17 nt, Human
ugccugcccaggccccu

SEQ ID NO: 2426314 - RNA, 12 nt, Human
ugccucugccuc

SEQ ID NO: 2426315 - RNA, 20 nt, Human
ugccugccugucugucucuc

SEQ ID NO: 2426316 - RNA, 21 nt, Human
ugccugccugucugucucucc

SEQ ID NO: 2426317 - RNA, 14 nt, Human
ugccugcgcccacc

SEQ ID NO: 2426318 - RNA, 21 nt, Human
ugccugcgcccaccccgcucu

SEQ ID NO: 2426319 - RNA, 20 nt, Human
ugccugcgcccaccccgcuc

SEQ ID NO: 2426320 - RNA, 19 nt, Human
ugccugcggaguugugcac

SEQ ID NO: 2426321 - RNA, 16 nt, Human
ugcccuuccucaguuu

SEQ ID NO: 2426322 - RNA, 20 nt, Human
ugcccuucccugucccucua

SEQ ID NO: 2426323 - RNA, 18 nt, Human
ugcccuuccucaguuuaa

SEQ ID NO: 2426324 - RNA, 20 nt, Human
ugccgcagcccugcagaggg

SEQ ID NO: 2426325 - RNA, 19 nt, Human
ugcccuuaccugccaggaa

SEQ ID NO: 2426326 - RNA, 14 nt, Human
ugcccuucacccca

SEQ ID NO: 2426327 - RNA, 17 nt, Human
ugcccuucacaguguuu

SEQ ID NO: 2426328 - RNA, 18 nt, Human
ugcccuucccugucccuc

SEQ ID NO: 2426329 - RNA, 17 nt, Human
ugcccuucccugucccu

SEQ ID NO: 2426330 - RNA, 16 nt, Human
ugcccuucccuguccc

SEQ ID NO: 2426331 - RNA, 15 nt, Human
ugcccuucccugucc

SEQ ID NO: 2426332 - RNA, 20 nt, Human
ugcccuucaccccaguggcc

SEQ ID NO: 2426333 - RNA, 15 nt, Human
ugcccuucaccccag

SEQ ID NO: 2426334 - RNA, 13 nt, Human
ugcccuucccugu

SEQ ID NO: 2426335 - RNA, 16 nt, Human
ugccgccccacccaga

SEQ ID NO: 2426336 - RNA, 15 nt, Human
ugccgccccacccag

SEQ ID NO: 2426337 - RNA, 14 nt, Human
ugccgccccaccca

SEQ ID NO: 2426338 - RNA, 20 nt, Human
ugccgccgccucgcccaccg

SEQ ID NO: 2426339 - RNA, 18 nt, Human
ugccgccgccucgcccac

SEQ ID NO: 2426340 - RNA, 21 nt, Human
ugccgccgccucgcccaccgc

SEQ ID NO: 2426341 - RNA, 17 nt, Human
ugccgccgccucgccca

SEQ ID NO: 2426342 - RNA, 16 nt, Human
ugccgccgccucgccc

SEQ ID NO: 2426343 - RNA, 15 nt, Human
ugccgccgccucgcc

SEQ ID NO: 2426344 - RNA, 15 nt, Human
ugccucaccccuugc

SEQ ID NO: 2426345 - RNA, 16 nt, Human
ugccgccucaaugugg

SEQ ID NO: 2426346 - RNA, 13 nt, Human
ugccgccucccag

SEQ ID NO: 2426347 - RNA, 14 nt, Human
ugccgccucccagc

SEQ ID NO: 2426348 - RNA, 19 nt, Human
ugcccuguuaaaagaugaa

SEQ ID NO: 2426349 - RNA, 12 nt, Human
ugcccugugcaa

SEQ ID NO: 2426350 - RNA, 22 nt, Human
ugcccuuaccugccaggaagcc

SEQ ID NO: 2426351 - RNA, 18 nt, Human
ugcccugugggcccccaa

SEQ ID NO: 2426352 - RNA, 15 nt, Human
ugcccugugggcccc

SEQ ID NO: 2426353 - RNA, 23 nt, Human
ugcccugugaguacuacaguccu

SEQ ID NO: 2426354 - RNA, 16 nt, Human
agcucuucuccaggcu

SEQ ID NO: 2426355 - RNA, 15 nt, Human
agcucuguuucgguu

SEQ ID NO: 2426356 - RNA, 15 nt, Human
agcucuucuccaggc

SEQ ID NO: 2426357 - RNA, 17 nt, Human
ugccucucucaggccaa

SEQ ID NO: 2426358 - RNA, 16 nt, Human
ugccucucucaggcca

SEQ ID NO: 2426359 - RNA, 12 nt, Human
ugccucucugca

SEQ ID NO: 2426360 - RNA, 11 nt, Human
ugccucucugc

SEQ ID NO: 2426361 - RNA, 23 nt, Human
ugccuccccauuucccaucugca

SEQ ID NO: 2426362 - RNA, 22 nt, Human
ugccuccccauuucccaucugc

SEQ ID NO: 2426363 - RNA, 18 nt, Human
ugccuccccggcucgagc

SEQ ID NO: 2426364 - RNA, 19 nt, Human
ugccuccccaacccugccc

SEQ ID NO: 2426365 - RNA, 20 nt, Human
ugccuccccaacccugcccc

SEQ ID NO: 2426366 - RNA, 21 nt, Human
ugccuccccaacccugccccu

SEQ ID NO: 2426367 - RNA, 22 nt, Human
ugccuccccaacccugccccug

SEQ ID NO: 2426368 - RNA, 21 nt, Human
ugccuccccauuucccaucug

SEQ ID NO: 2426369 - RNA, 20 nt, Human
ugccuccccauuucccaucu

SEQ ID NO: 2426370 - RNA, 17 nt, Human
ugccuccccauuuccca

SEQ ID NO: 2426371 - RNA, 23 nt, Human
ugccuccccaacccugccccugc

SEQ ID NO: 2426372 - RNA, 12 nt, Human
ugccucagcccg

SEQ ID NO: 2426373 - RNA, 18 nt, Human
ugccucagaaaacaagga

SEQ ID NO: 2426374 - RNA, 15 nt, Human
ugccucagccucccg

SEQ ID NO: 2426375 - RNA, 18 nt, Human
ugccucagccucccgagu

SEQ ID NO: 2426376 - RNA, 15 nt, Human
ugccucagccuccug

SEQ ID NO: 2426377 - RNA, 17 nt, Human
ugccucagccuccugag

SEQ ID NO: 2426378 - RNA, 22 nt, Human
ugccucccaucacccgcuaaga

SEQ ID NO: 2426379 - RNA, 16 nt, Human
ugccucagguuccuau

SEQ ID NO: 2426380 - RNA, 14 nt, Human
ugccucagguuccu

SEQ ID NO: 2426381 - RNA, 17 nt, Human
ugccucccauucugacc

SEQ ID NO: 2426382 - RNA, 15 nt, Human
ugccuccccaacccu

SEQ ID NO: 2426383 - RNA, 16 nt, Human
ugccuccccaacccug

SEQ ID NO: 2426384 - RNA, 18 nt, Human
ugccuccccaacccugcc

SEQ ID NO: 2426385 - RNA, 18 nt, Human
ugccucaggaggcaggac

SEQ ID NO: 2426386 - RNA, 14 nt, Human
ugccucagccuccg

SEQ ID NO: 2426387 - RNA, 21 nt, Human
ugccucaggaggcaggaccuu

SEQ ID NO: 2426388 - RNA, 12 nt, Human
ugccucagguuc

SEQ ID NO: 2426389 - RNA, 18 nt, Human
agcuccccagaguccucu

SEQ ID NO: 2426390 - RNA, 23 nt, Human
agcucccauuucuacucucccau

SEQ ID NO: 2426391 - RNA, 18 nt, Human
agcucccauuucuacucu

SEQ ID NO: 2426392 - RNA, 22 nt, Human
agcuccccaaaaaccucacccg

SEQ ID NO: 2426393 - RNA, 14 nt, Human
agcuccccaccacc

SEQ ID NO: 2426394 - RNA, 17 nt, Human
agcuccccaccacccca

SEQ ID NO: 2426395 - RNA, 20 nt, Human
agcuccccaccaccccagcu

SEQ ID NO: 2426396 - RNA, 13 nt, Human
agcuccccagagu

SEQ ID NO: 2426397 - RNA, 21 nt, Human
agcuccccaccaccccagcug

SEQ ID NO: 2426398 - RNA, 15 nt, Human
agcucccccuguccc

SEQ ID NO: 2426399 - RNA, 14 nt, Human
agcucccccugucc

SEQ ID NO: 2426400 - RNA, 13 nt, Human
agcucccccuguc

SEQ ID NO: 2426401 - RNA, 23 nt, Human
agcucccccucccccacugccau

SEQ ID NO: 2426402 - RNA, 23 nt, Human
agcucccccgggaggggcccgcu

SEQ ID NO: 2426403 - RNA, 19 nt, Human
agcucccccgggaggggcc

SEQ ID NO: 2426404 - RNA, 21 nt, Human
agcucccccuguccccucagc

SEQ ID NO: 2426405 - RNA, 19 nt, Human
agcucccccuguccccuca

SEQ ID NO: 2426406 - RNA, 17 nt, Human
agcucccccuguccccu

SEQ ID NO: 2426407 - RNA, 16 nt, Human
agcucccccugucccc

SEQ ID NO: 2426408 - RNA, 20 nt, Human
agcuccccgcuucugccugc

SEQ ID NO: 2426409 - RNA, 23 nt, Human
agcucccccuguccccucagcuc

SEQ ID NO: 2426410 - RNA, 23 nt, Human
agcuccuucuguccuacucugug

SEQ ID NO: 2426411 - RNA, 22 nt, Human
agcuccuucuguccuacucugu

SEQ ID NO: 2426412 - RNA, 20 nt, Human
agcuccuugggaggaagcag

SEQ ID NO: 2426413 - RNA, 19 nt, Human
agcuccuugggaggaagca

SEQ ID NO: 2426414 - RNA, 18 nt, Human
agcuccuugggaggaagc

SEQ ID NO: 2426415 - RNA, 17 nt, Human
agcuccuugggaggaag

SEQ ID NO: 2426416 - RNA, 12 nt, Human
agcuccuuggga

SEQ ID NO: 2426417 - RNA, 22 nt, Human
agcuccuugggaggaagcagaa

SEQ ID NO: 2426418 - RNA, 21 nt, Human
agcuccuugggaggaagcaga

SEQ ID NO: 2426419 - RNA, 23 nt, Human
agcuccuugggaggaagcagaau

SEQ ID NO: 2426420 - RNA, 15 nt, Human
agcuccuugggaggc

SEQ ID NO: 2426421 - RNA, 19 nt, Human
agcucguguauccuggggc

SEQ ID NO: 2426422 - RNA, 18 nt, Human
agcucguguauccugggg

SEQ ID NO: 2426423 - RNA, 19 nt, Human
agcuccuugggaggcccca

SEQ ID NO: 2426424 - RNA, 17 nt, Human
agcucguguauccuggg

SEQ ID NO: 2426425 - RNA, 23 nt, Human
agcucccaccccacccccuucag

SEQ ID NO: 2426426 - RNA, 13 nt, Human
agcucccacccca

SEQ ID NO: 2426427 - RNA, 15 nt, Human
agcucccaccccacc

SEQ ID NO: 2426428 - RNA, 17 nt, Human
agcucccaccccacccc

SEQ ID NO: 2426429 - RNA, 23 nt, Human
agcucccaagggauggugcccug

SEQ ID NO: 2426430 - RNA, 22 nt, Human
agcucccaagggauggugcccu

SEQ ID NO: 2426431 - RNA, 20 nt, Human
agcucccaagggauggugcc

SEQ ID NO: 2426432 - RNA, 18 nt, Human
agcucccaagggauggug

SEQ ID NO: 2426433 - RNA, 21 nt, Human
agcuccaucuccacuccagau

SEQ ID NO: 2426434 - RNA, 19 nt, Human
agcuccagcucaccagccc

SEQ ID NO: 2426435 - RNA, 18 nt, Human
agcuccagcucaccagcc

SEQ ID NO: 2426436 - RNA, 21 nt, Human
agcuccagcucaccagcccca

SEQ ID NO: 2426437 - RNA, 19 nt, Human
agcuccagacccccagcaa

SEQ ID NO: 2426438 - RNA, 17 nt, Human
agcucuggacagcccca

SEQ ID NO: 2426439 - RNA, 18 nt, Human
agcucuggacagccccac

SEQ ID NO: 2426440 - RNA, 12 nt, Human
agcucuggacca

SEQ ID NO: 2426441 - RNA, 13 nt, Human
agcucugcauuau

SEQ ID NO: 2426442 - RNA, 21 nt, Human
agcucuggacagccccacccu

SEQ ID NO: 2426443 - RNA, 23 nt, Human
agcucugcccauccugccccuga

SEQ ID NO: 2426444 - RNA, 16 nt, Human
agcucugcagcccagg

SEQ ID NO: 2426445 - RNA, 14 nt, Human
agcucugcagccca

SEQ ID NO: 2426446 - RNA, 12 nt, Human
agcucugcauua

SEQ ID NO: 2426447 - RNA, 21 nt, Human
agcucugcagagcaggaaaca

SEQ ID NO: 2426448 - RNA, 20 nt, Human
agcucguguauccuggggcu

SEQ ID NO: 2426449 - RNA, 13 nt, Human
agcucuacccagg

SEQ ID NO: 2426450 - RNA, 15 nt, Human
agcucuacccagggc

SEQ ID NO: 2426451 - RNA, 17 nt, Human
agcucuacccagggccu

SEQ ID NO: 2426452 - RNA, 19 nt, Human
agcucuacccagggccugc

SEQ ID NO: 2426453 - RNA, 20 nt, Human
agcucuacccagggccugca

SEQ ID NO: 2426454 - RNA, 21 nt, Human
agcucuacccagggccugcag

SEQ ID NO: 2426455 - RNA, 17 nt, Human
agcucccauuucuacuc

SEQ ID NO: 2426456 - RNA, 16 nt, Human
agcucuagacaacccu

SEQ ID NO: 2426457 - RNA, 17 nt, Human
agcucuagacaacccug

SEQ ID NO: 2426458 - RNA, 19 nt, Human
agcucuagacaacccugca

SEQ ID NO: 2426459 - RNA, 20 nt, Human
agcucuagacaacccugcaa

SEQ ID NO: 2426460 - RNA, 13 nt, Human
agcucuucaggcc

SEQ ID NO: 2426461 - RNA, 15 nt, Human
agcucuucaggccuc

SEQ ID NO: 2426462 - RNA, 16 nt, Human
agcucuucaggccucc

SEQ ID NO: 2426463 - RNA, 17 nt, Human
agcucuucaggccuccc

SEQ ID NO: 2426464 - RNA, 13 nt, Human
agcucuucauguu

SEQ ID NO: 2426465 - RNA, 16 nt, Human
agcucuucauguuuca

SEQ ID NO: 2426466 - RNA, 18 nt, Human
agcucuucaggccucccu

SEQ ID NO: 2426467 - RNA, 20 nt, Human
agcucuuaauuguucauuuu

SEQ ID NO: 2426468 - RNA, 18 nt, Human
agcucuguguugccaugu

SEQ ID NO: 2426469 - RNA, 23 nt, Human
agcucuguguugccaugugugcu

SEQ ID NO: 2426470 - RNA, 20 nt, Human
agcucuggaggggaggggga

SEQ ID NO: 2426471 - RNA, 19 nt, Human
agcucuggaggggaggggg

SEQ ID NO: 2426472 - RNA, 18 nt, Human
agcucuggaggggagggg

SEQ ID NO: 2426473 - RNA, 17 nt, Human
agcucuggaggggaggg

SEQ ID NO: 2426474 - RNA, 16 nt, Human
agcucuggaggggagg

SEQ ID NO: 2426475 - RNA, 12 nt, Human
agcucuggaggg

SEQ ID NO: 2426476 - RNA, 17 nt, Human
agcucuggaccagccug

SEQ ID NO: 2426477 - RNA, 15 nt, Human
agcucuggaccagcc

SEQ ID NO: 2426478 - RNA, 21 nt, Human
agcucuggcugaacccugugc

SEQ ID NO: 2426479 - RNA, 20 nt, Human
agcucuggcugaacccugug

SEQ ID NO: 2426480 - RNA, 19 nt, Human
agcucuggcugaacccugu

SEQ ID NO: 2426481 - RNA, 18 nt, Human
agcucuggcugaacccug

SEQ ID NO: 2426482 - RNA, 17 nt, Human
agcucuggcugaacccu

SEQ ID NO: 2426483 - RNA, 16 nt, Human
agcucuggcugaaccc

SEQ ID NO: 2426484 - RNA, 12 nt, Human
agcucuggcuga

SEQ ID NO: 2426485 - RNA, 22 nt, Human
agcucuggcugaacccugugcu

SEQ ID NO: 2426486 - RNA, 15 nt, Human
agcucuguguugcca

SEQ ID NO: 2426487 - RNA, 16 nt, Human
agcucuguguugccau

SEQ ID NO: 2426488 - RNA, 24 nt, Human
agcuccacucugcuucucugacuu

SEQ ID NO: 2426489 - RNA, 23 nt, Human
agcuccacucugcuucucugacu

SEQ ID NO: 2426490 - RNA, 23 nt, Human
agcuccacugucacccuccaccu

SEQ ID NO: 2426491 - RNA, 21 nt, Human
agcuccacugucacccuccac

SEQ ID NO: 2426492 - RNA, 18 nt, Human
agcuccacugucacccuc

SEQ ID NO: 2426493 - RNA, 14 nt, Human
agcuccagaccccc

SEQ ID NO: 2426494 - RNA, 16 nt, Human
agcuccagacccccag

SEQ ID NO: 2426495 - RNA, 17 nt, Human
agcuccagacccccagc

SEQ ID NO: 2426496 - RNA, 18 nt, Human
agcuccagacccccagca

SEQ ID NO: 2426497 - RNA, 23 nt, Human
agcuccagacccccagcaacccu

SEQ ID NO: 2426498 - RNA, 17 nt, Human
agcuccagcucaccagc

SEQ ID NO: 2426499 - RNA, 13 nt, Human
agcuccagcucac

SEQ ID NO: 2426500 - RNA, 22 nt, Human
agcuccacucugcuucucugac

SEQ ID NO: 2426501 - RNA, 19 nt, Human
agcuccacucugcuucucu

SEQ ID NO: 2426502 - RNA, 18 nt, Human
agcuccacucugcuucuc

SEQ ID NO: 2426503 - RNA, 17 nt, Human
agcuccacucugcuucu

SEQ ID NO: 2426504 - RNA, 16 nt, Human
agcuccacucugcuuc

SEQ ID NO: 2426505 - RNA, 14 nt, Human
agcuccacucugcu

SEQ ID NO: 2426506 - RNA, 13 nt, Human
agcuccacucugc

SEQ ID NO: 2426507 - RNA, 12 nt, Human
agcuccacucug

SEQ ID NO: 2426508 - RNA, 11 nt, Human
agcuccacucu

SEQ ID NO: 2426509 - RNA, 17 nt, Human
agcuccacccuggccga

SEQ ID NO: 2426510 - RNA, 15 nt, Human
agcuccacccuggcc

SEQ ID NO: 2426511 - RNA, 22 nt, Human
agcuccacacccucucccagga

SEQ ID NO: 2426512 - RNA, 23 nt, Human
agcuccacacccucucccaggac

SEQ ID NO: 2426513 - RNA, 23 nt, Human
ugcccugaguggaucuccaagga

SEQ ID NO: 2426514 - RNA, 21 nt, Human
agcuccacacccucucccagg

SEQ ID NO: 2426515 - RNA, 19 nt, Human
agcuccaagcucccaggca

SEQ ID NO: 2426516 - RNA, 18 nt, Human
agcuccaagcucccaggc

SEQ ID NO: 2426517 - RNA, 17 nt, Human
agcuccaagcucccagg

SEQ ID NO: 2426518 - RNA, 22 nt, Human
ugcccugaccucccagcccuau

SEQ ID NO: 2426519 - RNA, 22 nt, Human
ugcccugaguggaucuccaagg

SEQ ID NO: 2426520 - RNA, 22 nt, Human
ugcccugcacgucaugggaggg

SEQ ID NO: 2426521 - RNA, 21 nt, Human
ugcccugaccucccagcccua

SEQ ID NO: 2426522 - RNA, 20 nt, Human
ugcccugaccucccagcccu

SEQ ID NO: 2426523 - RNA, 18 nt, Human
ugcccugaccucccagcc

SEQ ID NO: 2426524 - RNA, 17 nt, Human
ugcccugaccucccagc

SEQ ID NO: 2426525 - RNA, 16 nt, Human
ugcccugaccucccag

SEQ ID NO: 2426526 - RNA, 15 nt, Human
ugcccugaccuccca

SEQ ID NO: 2426527 - RNA, 14 nt, Human
ugcccugaccuccc

SEQ ID NO: 2426528 - RNA, 13 nt, Human
ugcccugaccucc

SEQ ID NO: 2426529 - RNA, 12 nt, Human
ugcccugaccuc

SEQ ID NO: 2426530 - RNA, 12 nt, Human
ugcccucuucau

SEQ ID NO: 2426531 - RNA, 18 nt, Human
ugcccucguggccagccc

SEQ ID NO: 2426532 - RNA, 17 nt, Human
ugcccucguggccagcc

SEQ ID NO: 2426533 - RNA, 16 nt, Human
ugcccucguggccagc

SEQ ID NO: 2426534 - RNA, 15 nt, Human
ugcccucguggccag

SEQ ID NO: 2426535 - RNA, 20 nt, Human
ugcccucguggccagcccgg

SEQ ID NO: 2426536 - RNA, 19 nt, Human
ugcccucguggccagcccg

SEQ ID NO: 2426537 - RNA, 21 nt, Human
ugcccucguggccagcccggc

SEQ ID NO: 2426538 - RNA, 22 nt, Human
ugcccuccuuguccacccaccu

SEQ ID NO: 2426539 - RNA, 19 nt, Human
ugcccuccuuguccaccca

SEQ ID NO: 2426540 - RNA, 16 nt, Human
ugcccuccucucccau

SEQ ID NO: 2426541 - RNA, 17 nt, Human
ugcccucgcugcuucug

SEQ ID NO: 2426542 - RNA, 15 nt, Human
ugcccucgcugcuuc

SEQ ID NO: 2426543 - RNA, 14 nt, Human
ugcccucgcugcuu

SEQ ID NO: 2426544 - RNA, 13 nt, Human
ugcccucgcugcu

SEQ ID NO: 2426545 - RNA, 19 nt, Human
ugcccucgggcgagucacu

SEQ ID NO: 2426546 - RNA, 20 nt, Human
ugcccucgggcgagucacug

SEQ ID NO: 2426547 - RNA, 22 nt, Human
ugcccucgggcgagucacugcc

SEQ ID NO: 2426548 - RNA, 23 nt, Human
ugcccucgggcgagucacugccu

SEQ ID NO: 2426549 - RNA, 12 nt, Human
ugcccuccucuc

SEQ ID NO: 2426550 - RNA, 14 nt, Human
ugcccuccucuccc

SEQ ID NO: 2426551 - RNA, 15 nt, Human
ugcccuccucuccca

SEQ ID NO: 2426552 - RNA, 21 nt, Human
ugcccuccccucucugcaccg

SEQ ID NO: 2426553 - RNA, 20 nt, Human
ugcccuccccagagcacugg

SEQ ID NO: 2426554 - RNA, 19 nt, Human
ugcccuccccagagcacug

SEQ ID NO: 2426555 - RNA, 17 nt, Human
ugcccuccccagagcac

SEQ ID NO: 2426556 - RNA, 16 nt, Human
ugcccuccccagagca

SEQ ID NO: 2426557 - RNA, 17 nt, Human
ugcccuccccucucugc

SEQ ID NO: 2426558 - RNA, 14 nt, Human
ugcccuccccucuc

SEQ ID NO: 2426559 - RNA, 22 nt, Human
ugcccuaaccucugagucacca

SEQ ID NO: 2426560 - RNA, 19 nt, Human
ugccccggggaggggcgcu

SEQ ID NO: 2426561 - RNA, 19 nt, Human
ugccccauccuccagcagg

SEQ ID NO: 2426562 - RNA, 20 nt, Human
ugcccuaaugcgcaggcugg

SEQ ID NO: 2426563 - RNA, 21 nt, Human
ugcccuccagcucuuuccucc

SEQ ID NO: 2426564 - RNA, 13 nt, Human
ugcccuccauccc

SEQ ID NO: 2426565 - RNA, 14 nt, Human
ugcccuccaucccg

SEQ ID NO: 2426566 - RNA, 17 nt, Human
ugcccuccaucccgaca

SEQ ID NO: 2426567 - RNA, 15 nt, Human
ugcccuccccagagc

SEQ ID NO: 2426568 - RNA, 15 nt, Human
ugcccucccaucccg

SEQ ID NO: 2426569 - RNA, 12 nt, Human
ugcccucccauc

SEQ ID NO: 2426570 - RNA, 20 nt, Human
ugcccuccaucccgacaugg

SEQ ID NO: 2426571 - RNA, 23 nt, Human
ugcccuaaugcgcaggcuggccc

SEQ ID NO: 2426572 - RNA, 18 nt, Human
ugcccuacagaggucucu

SEQ ID NO: 2426573 - RNA, 22 nt, Human
agcuccaagaccuguugguucc

SEQ ID NO: 2426574 - RNA, 20 nt, Human
agcuccaagaccuguugguu

SEQ ID NO: 2426575 - RNA, 15 nt, Human
agcuccaagccccau

SEQ ID NO: 2426576 - RNA, 15 nt, Human
agcuccaagcuccca

SEQ ID NO: 2426577 - RNA, 16 nt, Human
agcucaggugggcgug

SEQ ID NO: 2426578 - RNA, 10 nt, Human
agcucaggug

SEQ ID NO: 2426579 - RNA, 22 nt, Human
agcuccaaccugcaaagaucug

SEQ ID NO: 2426580 - RNA, 17 nt, Human
agcucaggugucccugc

SEQ ID NO: 2426581 - RNA, 22 nt, Human
ugccauuuaaagcuuauuaaaa

SEQ ID NO: 2426582 - RNA, 16 nt, Human
agcuccaagcucccag

SEQ ID NO: 2426583 - RNA, 22 nt, Human
ugccauuugcacccuccgccuu

SEQ ID NO: 2426584 - RNA, 19 nt, Human
ugccauuugcacccuccgc

SEQ ID NO: 2426585 - RNA, 21 nt, Human
ugccauuugcacccuccgccu

SEQ ID NO: 2426586 - RNA, 23 nt, Human
agcuccaagaccuguugguucca

SEQ ID NO: 2426587 - RNA, 16 nt, Human
ugccauuugcacccuc

SEQ ID NO: 2426588 - RNA, 17 nt, Human
ugccauuugcacccucc

SEQ ID NO: 2426589 - RNA, 15 nt, Human
agcucagggcuucau

SEQ ID NO: 2426590 - RNA, 14 nt, Human
agcucagggcuuca

SEQ ID NO: 2426591 - RNA, 18 nt, Human
agcucagggccuggcuca

SEQ ID NO: 2426592 - RNA, 20 nt, Human
agcucagggccuggcucagg

SEQ ID NO: 2426593 - RNA, 19 nt, Human
agcucagggccuggcucag

SEQ ID NO: 2426594 - RNA, 14 nt, Human
agcucagggccugg

SEQ ID NO: 2426595 - RNA, 13 nt, Human
agcucaggaucuc

SEQ ID NO: 2426596 - RNA, 17 nt, Human
agcucaggaggcuugga

SEQ ID NO: 2426597 - RNA, 13 nt, Human
agcucagggccug

SEQ ID NO: 2426598 - RNA, 12 nt, Human
agcucagggccu

SEQ ID NO: 2426599 - RNA, 19 nt, Human
agcuauucaguaauaacuc

SEQ ID NO: 2426600 - RNA, 18 nt, Human
agcucaggaccaggcaau

SEQ ID NO: 2426601 - RNA, 18 nt, Human
agcucaggaccugggacc

SEQ ID NO: 2426602 - RNA, 22 nt, Human
agcuauuagccaggaucauggu

SEQ ID NO: 2426603 - RNA, 20 nt, Human
agcuauuagccaggaucaug

SEQ ID NO: 2426604 - RNA, 14 nt, Human
agcucaggaccagg

SEQ ID NO: 2426605 - RNA, 19 nt, Human
agcuaguggcuucaaaaua

SEQ ID NO: 2426606 - RNA, 17 nt, Human
agcuaguucguagcuuu

SEQ ID NO: 2426607 - RNA, 18 nt, Human
agcuaguucguagcuuuc

SEQ ID NO: 2426608 - RNA, 17 nt, Human
agcuauauccauguacu

SEQ ID NO: 2426609 - RNA, 20 nt, Human
agcuaucagaagaccacaaa

SEQ ID NO: 2426610 - RNA, 15 nt, Human
agcuauccuggcucu

SEQ ID NO: 2426611 - RNA, 23 nt, Human
agcuaucaagugugcuuuagcuu

SEQ ID NO: 2426612 - RNA, 22 nt, Human
agcuaucaagugugcuuuagcu

SEQ ID NO: 2426613 - RNA, 14 nt, Human
agcuaucaggaaca

SEQ ID NO: 2426614 - RNA, 17 nt, Human
agcuauaucuauauaua

SEQ ID NO: 2426615 - RNA, 15 nt, Human
agcuauaucuauaua

SEQ ID NO: 2426616 - RNA, 20 nt, Human
agcuauauccauguacugua

SEQ ID NO: 2426617 - RNA, 22 nt, Human
agcuauauccauguacuguagu

SEQ ID NO: 2426618 - RNA, 17 nt, Human
agcuaucaagugugcuu

SEQ ID NO: 2426619 - RNA, 19 nt, Human
agcuauaucuauauauaau

SEQ ID NO: 2426620 - RNA, 18 nt, Human
agcuauguuauauugaaa

SEQ ID NO: 2426621 - RNA, 22 nt, Human
agcuauguuauauugaaaaaau

SEQ ID NO: 2426622 - RNA, 18 nt, Human
agcuauuagccaggauca

SEQ ID NO: 2426623 - RNA, 14 nt, Human
agcuauuagccagg

SEQ ID NO: 2426624 - RNA, 21 nt, Human
agcuauuacugucugguuuua

SEQ ID NO: 2426625 - RNA, 20 nt, Human
agcuauuacugucugguuuu

SEQ ID NO: 2426626 - RNA, 15 nt, Human
agcuauuacugucug

SEQ ID NO: 2426627 - RNA, 20 nt, Human
agcuauguuauauugaaaaa

SEQ ID NO: 2426628 - RNA, 17 nt, Human
agcuaucguaaaauuaa

SEQ ID NO: 2426629 - RNA, 22 nt, Human
agcuaucuggucaaccuccugg

SEQ ID NO: 2426630 - RNA, 16 nt, Human
agcuauccuggcucuu

SEQ ID NO: 2426631 - RNA, 17 nt, Human
agcuaucucucagugaa

SEQ ID NO: 2426632 - RNA, 19 nt, Human
agcguccuccucugugacc

SEQ ID NO: 2426633 - RNA, 22 nt, Human
agcgugaaggccgagaagcaag

SEQ ID NO: 2426634 - RNA, 22 nt, Human
agcgugagacgccaccauuccu

SEQ ID NO: 2426635 - RNA, 23 nt, Human
agcgugaaggccgagaagcaaga

SEQ ID NO: 2426636 - RNA, 18 nt, Human
agcuacagguuacaacag

SEQ ID NO: 2426637 - RNA, 14 nt, Human
agcuacagguuaca

SEQ ID NO: 2426638 - RNA, 13 nt, Human
agcuacagguuac

SEQ ID NO: 2426639 - RNA, 12 nt, Human
agcuacagguua

SEQ ID NO: 2426640 - RNA, 14 nt, Human
agcuacaggaagca

SEQ ID NO: 2426641 - RNA, 22 nt, Human
agcuacaggaagcaccccaugc

SEQ ID NO: 2426642 - RNA, 21 nt, Human
agcuacagguuacaacagauu

SEQ ID NO: 2426643 - RNA, 21 nt, Human
agcuaggccuggccagaugca

SEQ ID NO: 2426644 - RNA, 22 nt, Human
agcuacagguuacaacagauuu

SEQ ID NO: 2426645 - RNA, 20 nt, Human
agcuacagguuacaacagau

SEQ ID NO: 2426646 - RNA, 19 nt, Human
agcuacagguuacaacaga

SEQ ID NO: 2426647 - RNA, 17 nt, Human
agcuacccgcagaguuc

SEQ ID NO: 2426648 - RNA, 18 nt, Human
ugcccaggccccugccac

SEQ ID NO: 2426649 - RNA, 17 nt, Human
ugcccaggccccugcca

SEQ ID NO: 2426650 - RNA, 15 nt, Human
ugcccaggccccugc

SEQ ID NO: 2426651 - RNA, 16 nt, Human
ugcccaggagagccag

SEQ ID NO: 2426652 - RNA, 17 nt, Human
ugcccaggagagccagc

SEQ ID NO: 2426653 - RNA, 18 nt, Human
ugcccaggagagccagcc

SEQ ID NO: 2426654 - RNA, 22 nt, Human
ugcccaggacggggccggccag

SEQ ID NO: 2426655 - RNA, 21 nt, Human
ugcccaggacggggccggcca

SEQ ID NO: 2426656 - RNA, 23 nt, Human
ugcccagcuugggcccagcuggg

SEQ ID NO: 2426657 - RNA, 21 nt, Human
ugcccagcuugggcccagcug

SEQ ID NO: 2426658 - RNA, 20 nt, Human
ugcccagcuugggcccagcu

SEQ ID NO: 2426659 - RNA, 18 nt, Human
ugcccagcuugggcccag

SEQ ID NO: 2426660 - RNA, 16 nt, Human
ugcccagcuugggccc

SEQ ID NO: 2426661 - RNA, 14 nt, Human
ugcccagcuugggc

SEQ ID NO: 2426662 - RNA, 13 nt, Human
ugcccagcuuggg

SEQ ID NO: 2426663 - RNA, 21 nt, Human
ugcccagcuagcugcagagcc

SEQ ID NO: 2426664 - RNA, 13 nt, Human
ugcccagcucucg

SEQ ID NO: 2426665 - RNA, 20 nt, Human
ugcccagcuagcugcagagc

SEQ ID NO: 2426666 - RNA, 23 nt, Human
ugcccaacaccagccccugcccc

SEQ ID NO: 2426667 - RNA, 18 nt, Human
ugcccagcuauaccugug

SEQ ID NO: 2426668 - RNA, 14 nt, Human
ugcccagcuagcug

SEQ ID NO: 2426669 - RNA, 20 nt, Human
ugcccagcuauaccugugcc

SEQ ID NO: 2426670 - RNA, 21 nt, Human
ugcccagcuauaccugugccu

SEQ ID NO: 2426671 - RNA, 22 nt, Human
ugcccagcuauaccugugccuc

SEQ ID NO: 2426672 - RNA, 17 nt, Human
ugcccagcucagagggu

SEQ ID NO: 2426673 - RNA, 17 nt, Human
ugcccagccccuucuga

SEQ ID NO: 2426674 - RNA, 16 nt, Human
ugcccagccccuucug

SEQ ID NO: 2426675 - RNA, 22 nt, Human
ugcccaacaccagccccugccc

SEQ ID NO: 2426676 - RNA, 21 nt, Human
ugcccaacaccagccccugcc

SEQ ID NO: 2426677 - RNA, 19 nt, Human
ugcccaacaccagccccug

SEQ ID NO: 2426678 - RNA, 18 nt, Human
ugcccaacaccagccccu

SEQ ID NO: 2426679 - RNA, 12 nt, Human
ugcccagccccu

SEQ ID NO: 2426680 - RNA, 13 nt, Human
ugcccagccccuu

SEQ ID NO: 2426681 - RNA, 20 nt, Human
ugcccaaagaugcagccggu

SEQ ID NO: 2426682 - RNA, 17 nt, Human
ugcccaaagaugcagcc

SEQ ID NO: 2426683 - RNA, 19 nt, Human
ugcccaaaaauaugguuga

SEQ ID NO: 2426684 - RNA, 18 nt, Human
ugcccaaagucuguguga

SEQ ID NO: 2426685 - RNA, 18 nt, Human
agcucaggacagaugcca

SEQ ID NO: 2426686 - RNA, 21 nt, Human
ugcccaaagugcuuccaaggc

SEQ ID NO: 2426687 - RNA, 14 nt, Human
ugcccaacaccagc

SEQ ID NO: 2426688 - RNA, 17 nt, Human
ugcccaacaccagcccc

SEQ ID NO: 2426689 - RNA, 16 nt, Human
ugcccaacaccagccc

SEQ ID NO: 2426690 - RNA, 15 nt, Human
ugcccaacaccagcc

SEQ ID NO: 2426691 - RNA, 14 nt, Human
ugcccccucugccc

SEQ ID NO: 2426692 - RNA, 15 nt, Human
ugcccccucugcccu

SEQ ID NO: 2426693 - RNA, 16 nt, Human
ugcccccucugcccug

SEQ ID NO: 2426694 - RNA, 17 nt, Human
ugcccccucugcccugc

SEQ ID NO: 2426695 - RNA, 22 nt, Human
ugcccccuuucagaugucuucu

SEQ ID NO: 2426696 - RNA, 21 nt, Human
ugcccccuuucagaugucuuc

SEQ ID NO: 2426697 - RNA, 18 nt, Human
ugcccccuuucagauguc

SEQ ID NO: 2426698 - RNA, 16 nt, Human
ugcccccuuucagaug

SEQ ID NO: 2426699 - RNA, 18 nt, Human
ugcccccugaaacuuauu

SEQ ID NO: 2426700 - RNA, 18 nt, Human
ugcccccucgugccaguc

SEQ ID NO: 2426701 - RNA, 17 nt, Human
ugcccccucgugccagu

SEQ ID NO: 2426702 - RNA, 16 nt, Human
ugcccccucgugccag

SEQ ID NO: 2426703 - RNA, 18 nt, Human
ugcccccucugcccugcg

SEQ ID NO: 2426704 - RNA, 23 nt, Human
ugccccggccccggccccagcca

SEQ ID NO: 2426705 - RNA, 22 nt, Human
ugccccggccccggccccagcc

SEQ ID NO: 2426706 - RNA, 21 nt, Human
ugccccggccccggccccagc

SEQ ID NO: 2426707 - RNA, 23 nt, Human
ugccccggccaccucugcggacc

SEQ ID NO: 2426708 - RNA, 18 nt, Human
ugccccggccaccucugc

SEQ ID NO: 2426709 - RNA, 17 nt, Human
ugccccggccaccucug

SEQ ID NO: 2426710 - RNA, 16 nt, Human
ugccccggccaccucu

SEQ ID NO: 2426711 - RNA, 15 nt, Human
ugccccggccaccuc

SEQ ID NO: 2426712 - RNA, 20 nt, Human
ugcccuaaaguguauuuuuu

SEQ ID NO: 2426713 - RNA, 23 nt, Human
ugccccgaacauguuuuucuucu

SEQ ID NO: 2426714 - RNA, 22 nt, Human
ugccccgcccccaguccccacc

SEQ ID NO: 2426715 - RNA, 23 nt, Human
ugcccccuuucagaugucuucug

SEQ ID NO: 2426716 - RNA, 13 nt, Human
ugccccgcccagc

SEQ ID NO: 2426717 - RNA, 14 nt, Human
ugccccggccaccu

SEQ ID NO: 2426718 - RNA, 13 nt, Human
ugccccggccacc

SEQ ID NO: 2426719 - RNA, 15 nt, Human
ugccccgccuccccg

SEQ ID NO: 2426720 - RNA, 21 nt, Human
ugccccccauccuggcccauc

SEQ ID NO: 2426721 - RNA, 20 nt, Human
ugccccccauccuggcccau

SEQ ID NO: 2426722 - RNA, 19 nt, Human
ugccccccauccuggccca

SEQ ID NO: 2426723 - RNA, 18 nt, Human
ugccccccauccuggccc

SEQ ID NO: 2426724 - RNA, 22 nt, Human
ugccccccucaaaccuccucuu

SEQ ID NO: 2426725 - RNA, 20 nt, Human
ugccccccucaaaccuccuc

SEQ ID NO: 2426726 - RNA, 23 nt, Human
ugccccccauccuggcccaucag

SEQ ID NO: 2426727 - RNA, 18 nt, Human
ugccccccuugccagaca

SEQ ID NO: 2426728 - RNA, 23 nt, Human
ugccccccucaaaccuccucuuc

SEQ ID NO: 2426729 - RNA, 14 nt, Human
ugcccccggccccc

SEQ ID NO: 2426730 - RNA, 15 nt, Human
ugcccccucgugcca

SEQ ID NO: 2426731 - RNA, 13 nt, Human
ugcccccucgugc

SEQ ID NO: 2426732 - RNA, 21 nt, Human
ugcccccuccucucccauccc

SEQ ID NO: 2426733 - RNA, 20 nt, Human
ugcccccuccucucccaucc

SEQ ID NO: 2426734 - RNA, 17 nt, Human
ugcccccuccucuccca

SEQ ID NO: 2426735 - RNA, 16 nt, Human
ugcccccuccucuccc

SEQ ID NO: 2426736 - RNA, 14 nt, Human
ugcccccuccucuc

SEQ ID NO: 2426737 - RNA, 12 nt, Human
ugcccccuccuc

SEQ ID NO: 2426738 - RNA, 21 nt, Human
ugcccccggcccccuggucuc

SEQ ID NO: 2426739 - RNA, 11 nt, Human
ugcccccuccu

SEQ ID NO: 2426740 - RNA, 18 nt, Human
ugcccccggcccccuggu

SEQ ID NO: 2426741 - RNA, 17 nt, Human
ugcccccggcccccugg

SEQ ID NO: 2426742 - RNA, 15 nt, Human
ugcccccggcccccu

SEQ ID NO: 2426743 - RNA, 16 nt, Human
ugccccauucaacauc

SEQ ID NO: 2426744 - RNA, 20 nt, Human
ugccccauccuccagcaggg

SEQ ID NO: 2426745 - RNA, 21 nt, Human
ugccccauccuccagcaggga

SEQ ID NO: 2426746 - RNA, 19 nt, Human
ugcccaggagagccagccc

SEQ ID NO: 2426747 - RNA, 20 nt, Human
ugcccaggagagccagcccu

SEQ ID NO: 2426748 - RNA, 12 nt, Human
ugccccaugccu

SEQ ID NO: 2426749 - RNA, 16 nt, Human
ugccccauuuauccac

SEQ ID NO: 2426750 - RNA, 17 nt, Human
ugccccccauccuggcc

SEQ ID NO: 2426751 - RNA, 21 nt, Human
ugcccccaccacggccacugg

SEQ ID NO: 2426752 - RNA, 15 nt, Human
ugccccaugccuguc

SEQ ID NO: 2426753 - RNA, 23 nt, Human
ugccccaugccuguccagccugg

SEQ ID NO: 2426754 - RNA, 18 nt, Human
ugccccauucuuuuguaa

SEQ ID NO: 2426755 - RNA, 12 nt, Human
ugccccauucuu

SEQ ID NO: 2426756 - RNA, 19 nt, Human
ugccacugccucuuccucc

SEQ ID NO: 2426757 - RNA, 18 nt, Human
ugccacugccucuuccuc

SEQ ID NO: 2426758 - RNA, 20 nt, Human
ugccacugccucuuccuccc

SEQ ID NO: 2426759 - RNA, 14 nt, Human
ugccagagauccaa

SEQ ID NO: 2426760 - RNA, 22 nt, Human
ugccacugcccgagcuggugca

SEQ ID NO: 2426761 - RNA, 15 nt, Human
ugccagagauggagg

SEQ ID NO: 2426762 - RNA, 21 nt, Human
ugccagagauggagguucucu

SEQ ID NO: 2426763 - RNA, 20 nt, Human
ugcauuugaggucuguucuu

SEQ ID NO: 2426764 - RNA, 21 nt, Human
ugcauuugaggucuguucuuu

SEQ ID NO: 2426765 - RNA, 20 nt, Human
ugcauuuaugagcucuucau

SEQ ID NO: 2426766 - RNA, 20 nt, Human
ugccacugcccgagcuggug

SEQ ID NO: 2426767 - RNA, 21 nt, Human
ugccacugcccgagcuggugc

SEQ ID NO: 2426768 - RNA, 19 nt, Human
ugccacugcccgagcuggu

SEQ ID NO: 2426769 - RNA, 17 nt, Human
ugccacugccucuuccu

SEQ ID NO: 2426770 - RNA, 13 nt, Human
ugccacugccucu

SEQ ID NO: 2426771 - RNA, 22 nt, Human
ugccagcaaugacaucucaggg

SEQ ID NO: 2426772 - RNA, 18 nt, Human
ugccagcaacugaauaaa

SEQ ID NO: 2426773 - RNA, 17 nt, Human
ugccagcaacugaauaa

SEQ ID NO: 2426774 - RNA, 16 nt, Human
ugccagcaacugaaua

SEQ ID NO: 2426775 - RNA, 15 nt, Human
ugccagcaacugaau

SEQ ID NO: 2426776 - RNA, 14 nt, Human
ugccagcaacugaa

SEQ ID NO: 2426777 - RNA, 13 nt, Human
ugccagcaacuga

SEQ ID NO: 2426778 - RNA, 12 nt, Human
ugccagcaacug

SEQ ID NO: 2426779 - RNA, 11 nt, Human
ugccagcaacu

SEQ ID NO: 2426780 - RNA, 24 nt, Human
ugccagcaaagccccaugcuggag

SEQ ID NO: 2426781 - RNA, 16 nt, Human
ugccagcaaagcccca

SEQ ID NO: 2426782 - RNA, 15 nt, Human
ugccagcaaagcccc

SEQ ID NO: 2426783 - RNA, 14 nt, Human
ugccagcaaagccc

SEQ ID NO: 2426784 - RNA, 13 nt, Human
ugccagcaaagcc

SEQ ID NO: 2426785 - RNA, 22 nt, Human
ugccagaugcugauguucagug

SEQ ID NO: 2426786 - RNA, 20 nt, Human
ugccagaggugggcaggugg

SEQ ID NO: 2426787 - RNA, 19 nt, Human
ugccagaggugggcaggug

SEQ ID NO: 2426788 - RNA, 18 nt, Human
ugccagaggugggcaggu

SEQ ID NO: 2426789 - RNA, 17 nt, Human
ugccagaggugggcagg

SEQ ID NO: 2426790 - RNA, 16 nt, Human
ugccagaggugggcag

SEQ ID NO: 2426791 - RNA, 15 nt, Human
ugccagaggugggca

SEQ ID NO: 2426792 - RNA, 21 nt, Human
ugccagaugcugauguucagu

SEQ ID NO: 2426793 - RNA, 17 nt, Human
ugccagaugcugauguu

SEQ ID NO: 2426794 - RNA, 16 nt, Human
ugccagaugcugaugu

SEQ ID NO: 2426795 - RNA, 14 nt, Human
ugccagaugcugau

SEQ ID NO: 2426796 - RNA, 12 nt, Human
ugccagaugcug

SEQ ID NO: 2426797 - RNA, 11 nt, Human
ugccagaugcu

SEQ ID NO: 2426798 - RNA, 21 nt, Human
ugccagaggugggcagguggu

SEQ ID NO: 2426799 - RNA, 21 nt, Human
ugccagaugccuuuauggcug

SEQ ID NO: 2426800 - RNA, 11 nt, Human
ugccagccaca

SEQ ID NO: 2426801 - RNA, 11 nt, Human
ugccagccagc

SEQ ID NO: 2426802 - RNA, 12 nt, Human
ugccagccagca

SEQ ID NO: 2426803 - RNA, 23 nt, Human
ugccagcaaugacaucucagggg

SEQ ID NO: 2426804 - RNA, 15 nt, Human
ugccagcugcacuga

SEQ ID NO: 2426805 - RNA, 23 nt, Human
ugccagcucuguaucaggaccca

SEQ ID NO: 2426806 - RNA, 22 nt, Human
ugccagcucuguaucaggaccc

SEQ ID NO: 2426807 - RNA, 22 nt, Human
ugccagugacagacaggcucuu

SEQ ID NO: 2426808 - RNA, 20 nt, Human
ugccagugacagacaggcuc

SEQ ID NO: 2426809 - RNA, 19 nt, Human
ugccagugacagacaggcu

SEQ ID NO: 2426810 - RNA, 17 nt, Human
ugccagugacagacagg

SEQ ID NO: 2426811 - RNA, 22 nt, Human
ugccagucgcgcugccugugug

SEQ ID NO: 2426812 - RNA, 21 nt, Human
ugccagucgcgcugccugugu

SEQ ID NO: 2426813 - RNA, 20 nt, Human
ugccagucgcgcugccugug

SEQ ID NO: 2426814 - RNA, 19 nt, Human
ugccagucgcgcugccugu

SEQ ID NO: 2426815 - RNA, 23 nt, Human
ugccagucucacugugggaaggc

SEQ ID NO: 2426816 - RNA, 23 nt, Human
ugccagucgcgcugccugugugg

SEQ ID NO: 2426817 - RNA, 16 nt, Human
ugccagugacagacag

SEQ ID NO: 2426818 - RNA, 13 nt, Human
agcggcuggcagc

SEQ ID NO: 2426819 - RNA, 16 nt, Human
ugccagugacacuucc

SEQ ID NO: 2426820 - RNA, 11 nt, Human
ugccagugccu

SEQ ID NO: 2426821 - RNA, 13 nt, Human
ugccagugccuua

SEQ ID NO: 2426822 - RNA, 18 nt, Human
ugccagucgcgcugccug

SEQ ID NO: 2426823 - RNA, 17 nt, Human
ugccagucgcgcugccu

SEQ ID NO: 2426824 - RNA, 16 nt, Human
ugccagucgcgcugcc

SEQ ID NO: 2426825 - RNA, 12 nt, Human
ugccagucgcgc

SEQ ID NO: 2426826 - RNA, 17 nt, Human
ugccaguccuagcugca

SEQ ID NO: 2426827 - RNA, 19 nt, Human
ugccagcuuuuccucccuu

SEQ ID NO: 2426828 - RNA, 16 nt, Human
ugccaguccuagcugc

SEQ ID NO: 2426829 - RNA, 20 nt, Human
ugccagucccccugccccag

SEQ ID NO: 2426830 - RNA, 20 nt, Human
ugccagcuuuuccucccuug

SEQ ID NO: 2426831 - RNA, 18 nt, Human
ugccagcuuaucucaggg

SEQ ID NO: 2426832 - RNA, 19 nt, Human
agcgucccagucucuggca

SEQ ID NO: 2426833 - RNA, 15 nt, Human
agcguccuccucugu

SEQ ID NO: 2426834 - RNA, 16 nt, Human
agcguccuccucugug

SEQ ID NO: 2426835 - RNA, 17 nt, Human
agcguccuccucuguga

SEQ ID NO: 2426836 - RNA, 18 nt, Human
agcgucccagucucuggc

SEQ ID NO: 2426837 - RNA, 16 nt, Human
agcgucccagucucug

SEQ ID NO: 2426838 - RNA, 13 nt, Human
agcgucccagucu

SEQ ID NO: 2426839 - RNA, 22 nt, Human
agcggggacagcuccuucuguc

SEQ ID NO: 2426840 - RNA, 16 nt, Human
agcgggaccuguggcu

SEQ ID NO: 2426841 - RNA, 15 nt, Human
agcgggaccuguggc

SEQ ID NO: 2426842 - RNA, 14 nt, Human
agcgggaccugugg

SEQ ID NO: 2426843 - RNA, 21 nt, Human
agcggggccccagggcuaccc

SEQ ID NO: 2426844 - RNA, 19 nt, Human
agcggggcgaagcccaggc

SEQ ID NO: 2426845 - RNA, 20 nt, Human
agcggggacagcuccuucug

SEQ ID NO: 2426846 - RNA, 19 nt, Human
agcggggacagcuccuucu

SEQ ID NO: 2426847 - RNA, 23 nt, Human
agcggcuggcagcccaccccuca

SEQ ID NO: 2426848 - RNA, 21 nt, Human
agcggcuggacuuggagguag

SEQ ID NO: 2426849 - RNA, 20 nt, Human
agcgggaauggcagcugcca

SEQ ID NO: 2426850 - RNA, 18 nt, Human
agccuuccagggguggga

SEQ ID NO: 2426851 - RNA, 20 nt, Human
ugcagcugaccucuguuguc

SEQ ID NO: 2426852 - RNA, 15 nt, Human
ugcagcugaccucug

SEQ ID NO: 2426853 - RNA, 22 nt, Human
agccuuccucugcagcugaccu

SEQ ID NO: 2426854 - RNA, 21 nt, Human
agccuuccucugcagcugacc

SEQ ID NO: 2426855 - RNA, 19 nt, Human
agccuuccucugcagcuga

SEQ ID NO: 2426856 - RNA, 18 nt, Human
agccuuccucugcagcug

SEQ ID NO: 2426857 - RNA, 23 nt, Human
agccuuccucugcagcugaccuc

SEQ ID NO: 2426858 - RNA, 12 nt, Human
agccuucucugu

SEQ ID NO: 2426859 - RNA, 15 nt, Human
agccuugaacuuuga

SEQ ID NO: 2426860 - RNA, 19 nt, Human
agccuucccccucccaggg

SEQ ID NO: 2426861 - RNA, 20 nt, Human
agccuuccccuugcccaggg

SEQ ID NO: 2426862 - RNA, 17 nt, Human
agccuuccucugcagcu

SEQ ID NO: 2426863 - RNA, 14 nt, Human
agccuuccucugca

SEQ ID NO: 2426864 - RNA, 23 nt, Human
agccuuccuccacauccuuucua

SEQ ID NO: 2426865 - RNA, 21 nt, Human
agccuuccuccacauccuuuc

SEQ ID NO: 2426866 - RNA, 19 nt, Human
agccuuccuccacauccuu

SEQ ID NO: 2426867 - RNA, 12 nt, Human
agccuuccucca

SEQ ID NO: 2426868 - RNA, 22 nt, Human
agccuuccccuugcccagggcu

SEQ ID NO: 2426869 - RNA, 22 nt, Human
agccuugaccauucuccaccug

SEQ ID NO: 2426870 - RNA, 16 nt, Human
agccuugaacuuugac

SEQ ID NO: 2426871 - RNA, 22 nt, Human
agccuugaacuuugaccucugc

SEQ ID NO: 2426872 - RNA, 13 nt, Human
agccuugccagag

SEQ ID NO: 2426873 - RNA, 14 nt, Human
agccuugccagaga

SEQ ID NO: 2426874 - RNA, 23 nt, Human
agccuugaccauucuccaccugc

SEQ ID NO: 2426875 - RNA, 22 nt, Human
agcgauucuucugcuucagccu

SEQ ID NO: 2426876 - RNA, 15 nt, Human
agccuugccagagau

SEQ ID NO: 2426877 - RNA, 17 nt, Human
agccuugccagagaucc

SEQ ID NO: 2426878 - RNA, 19 nt, Human
agccuugccagagauccaa

SEQ ID NO: 2426879 - RNA, 21 nt, Human
agccuugcccggauucuggga

SEQ ID NO: 2426880 - RNA, 12 nt, Human
agcgcaccugcc

SEQ ID NO: 2426881 - RNA, 14 nt, Human
agcgcaccugcccc

SEQ ID NO: 2426882 - RNA, 17 nt, Human
agcgcaccugcccccug

SEQ ID NO: 2426883 - RNA, 21 nt, Human
agcgcaccugcccccuggugg

SEQ ID NO: 2426884 - RNA, 18 nt, Human
agcgcaccugcccccugg

SEQ ID NO: 2426885 - RNA, 19 nt, Human
agcgcaccugcccccuggu

SEQ ID NO: 2426886 - RNA, 21 nt, Human
agcgccaagcaaccugggucc

SEQ ID NO: 2426887 - RNA, 16 nt, Human
agcgccaagcaaccug

SEQ ID NO: 2426888 - RNA, 19 nt, Human
agcgcagguuuaguuuacu

SEQ ID NO: 2426889 - RNA, 16 nt, Human
agcgcuggccgggacc

SEQ ID NO: 2426890 - RNA, 18 nt, Human
agcgccaagcaaccuggg

SEQ ID NO: 2426891 - RNA, 19 nt, Human
agcgcugccgcaccccaga

SEQ ID NO: 2426892 - RNA, 20 nt, Human
agcgcugccgcaccccagag

SEQ ID NO: 2426893 - RNA, 21 nt, Human
agcgcugccgcaccccagagu

SEQ ID NO: 2426894 - RNA, 16 nt, Human
agcgcuuucuggaaaa

SEQ ID NO: 2426895 - RNA, 22 nt, Human
agcgcuggccgggaccccgagc

SEQ ID NO: 2426896 - RNA, 21 nt, Human
agcgcuuucuggaaaagagga

SEQ ID NO: 2426897 - RNA, 17 nt, Human
agcgcuuucuggaaaag

SEQ ID NO: 2426898 - RNA, 22 nt, Human
agcggaaaagguuuuauuuugu

SEQ ID NO: 2426899 - RNA, 13 nt, Human
agcggaaagcagc

SEQ ID NO: 2426900 - RNA, 14 nt, Human
agcggaaagcagcu

SEQ ID NO: 2426901 - RNA, 17 nt, Human
agcggaaagcagcucaa

SEQ ID NO: 2426902 - RNA, 23 nt, Human
agcggaaagcagcucaaaggcac

SEQ ID NO: 2426903 - RNA, 19 nt, Human
agcggacaucagcugguca

SEQ ID NO: 2426904 - RNA, 22 nt, Human
agcggaacaaggagucagacau

SEQ ID NO: 2426905 - RNA, 17 nt, Human
agcggaacaaggaguca

SEQ ID NO: 2426906 - RNA, 19 nt, Human
ugcauuugaggucuguucu

SEQ ID NO: 2426907 - RNA, 18 nt, Human
ugcauuugaggucuguuc

SEQ ID NO: 2426908 - RNA, 19 nt, Human
ugcauuuaugagcucuuca

SEQ ID NO: 2426909 - RNA, 16 nt, Human
ugcauuuaaauacagu

SEQ ID NO: 2426910 - RNA, 22 nt, Human
ugcauuuaaauacagucuucca

SEQ ID NO: 2426911 - RNA, 24 nt, Human
ugcauuuaaauacagucuuccauu

SEQ ID NO: 2426912 - RNA, 12 nt, Human
ugcauucuagua

SEQ ID NO: 2426913 - RNA, 23 nt, Human
ugcauuccugauaugauuuaaaa

SEQ ID NO: 2426914 - RNA, 14 nt, Human
ugcauucccagugg

SEQ ID NO: 2426915 - RNA, 16 nt, Human
ugcauucacccagaca

SEQ ID NO: 2426916 - RNA, 12 nt, Human
ugcauucaaauu

SEQ ID NO: 2426917 - RNA, 14 nt, Human
ugcauucaaauuaa

SEQ ID NO: 2426918 - RNA, 14 nt, Human
ugcauucacccaga

SEQ ID NO: 2426919 - RNA, 20 nt, Human
ugcauucacccagacagcuc

SEQ ID NO: 2426920 - RNA, 20 nt, Human
ugcauuuaaaagauacaguu

SEQ ID NO: 2426921 - RNA, 21 nt, Human
ugcauucugccgugugcccuc

SEQ ID NO: 2426922 - RNA, 17 nt, Human
uggccucugcacucccc

SEQ ID NO: 2426923 - RNA, 15 nt, Human
uggccucugcacucc

SEQ ID NO: 2426924 - RNA, 14 nt, Human
uggccucugcacuc

SEQ ID NO: 2426925 - RNA, 14 nt, Human
uggccuggaucucc

SEQ ID NO: 2426926 - RNA, 12 nt, Human
uggccuggaucu

SEQ ID NO: 2426927 - RNA, 22 nt, Human
uggccuggaggugggguuggga

SEQ ID NO: 2426928 - RNA, 18 nt, Human
uggccuggaggugggguu

SEQ ID NO: 2426929 - RNA, 16 nt, Human
uggccuggaggugggg

SEQ ID NO: 2426930 - RNA, 19 nt, Human
uggccggcaaccccaguuc

SEQ ID NO: 2426931 - RNA, 16 nt, Human
uggccuggcacacauc

SEQ ID NO: 2426932 - RNA, 12 nt, Human
uggccuggcaca

SEQ ID NO: 2426933 - RNA, 18 nt, Human
uggccuggcacacaucag

SEQ ID NO: 2426934 - RNA, 12 nt, Human
uggccuggccag

SEQ ID NO: 2426935 - RNA, 21 nt, Human
uggccuggaucuccccacucu

SEQ ID NO: 2426936 - RNA, 18 nt, Human
uggccuggccaggagcuc

SEQ ID NO: 2426937 - RNA, 21 nt, Human
uggccuggccaggagcucuuc

SEQ ID NO: 2426938 - RNA, 13 nt, Human
uggccuggccagg

SEQ ID NO: 2426939 - RNA, 15 nt, Human
uggccuggccaggag

SEQ ID NO: 2426940 - RNA, 16 nt, Human
uggccuggccaggagc

SEQ ID NO: 2426941 - RNA, 17 nt, Human
uggccuggccaggagcu

SEQ ID NO: 2426942 - RNA, 21 nt, Human
aggccuggccagaugcaccag

SEQ ID NO: 2426943 - RNA, 17 nt, Human
aggccuggccagaugca

SEQ ID NO: 2426944 - RNA, 16 nt, Human
aggccuggccagaugc

SEQ ID NO: 2426945 - RNA, 15 nt, Human
aggccuggccagaug

SEQ ID NO: 2426946 - RNA, 23 nt, Human
aggccugggggcugggcagagga

SEQ ID NO: 2426947 - RNA, 15 nt, Human
aggccuggccaggca

SEQ ID NO: 2426948 - RNA, 14 nt, Human
aggccuggccaggc

SEQ ID NO: 2426949 - RNA, 13 nt, Human
aggccuggccagg

SEQ ID NO: 2426950 - RNA, 23 nt, Human
aggccuggccagaugcaccagcc

SEQ ID NO: 2426951 - RNA, 22 nt, Human
aggccuggccagaugcaccagc

SEQ ID NO: 2426952 - RNA, 17 nt, Human
uggccgcccccugcccc

SEQ ID NO: 2426953 - RNA, 15 nt, Human
uggccgcccccugcc

SEQ ID NO: 2426954 - RNA, 13 nt, Human
uggccgcccccug

SEQ ID NO: 2426955 - RNA, 22 nt, Human
uggcccucaaggccucccacag

SEQ ID NO: 2426956 - RNA, 21 nt, Human
uggcccucaaggccucccaca

SEQ ID NO: 2426957 - RNA, 20 nt, Human
uggcccucaaggccucccac

SEQ ID NO: 2426958 - RNA, 19 nt, Human
uggcccucaaggccuccca

SEQ ID NO: 2426959 - RNA, 17 nt, Human
uggccgaguccaagcug

SEQ ID NO: 2426960 - RNA, 19 nt, Human
uggccgaguccaagcuggg

SEQ ID NO: 2426961 - RNA, 23 nt, Human
uggccgcccccugccccccagcc

SEQ ID NO: 2426962 - RNA, 21 nt, Human
uggccgcccccugccccccag

SEQ ID NO: 2426963 - RNA, 18 nt, Human
uggccgccucacccccuc

SEQ ID NO: 2426964 - RNA, 16 nt, Human
uggccgccucaccccc

SEQ ID NO: 2426965 - RNA, 12 nt, Human
uggccgccucac

SEQ ID NO: 2426966 - RNA, 23 nt, Human
uggccgcgccaaauaaugucucu

SEQ ID NO: 2426967 - RNA, 22 nt, Human
uggccgcgccaaauaaugucuc

SEQ ID NO: 2426968 - RNA, 21 nt, Human
uggccgcgccaaauaaugucu

SEQ ID NO: 2426969 - RNA, 24 nt, Human
uggccggcaaccccaguucugcuc

SEQ ID NO: 2426970 - RNA, 19 nt, Human
uggccgcugaguggcaggg

SEQ ID NO: 2426971 - RNA, 17 nt, Human
uggccgcugaguggcag

SEQ ID NO: 2426972 - RNA, 15 nt, Human
uggccgggaccccga

SEQ ID NO: 2426973 - RNA, 17 nt, Human
uggccgggaccccgagc

SEQ ID NO: 2426974 - RNA, 23 nt, Human
uggccgggaccccgagccuggcu

SEQ ID NO: 2426975 - RNA, 15 nt, Human
uggccgggagccuga

SEQ ID NO: 2426976 - RNA, 22 nt, Human
uggccggagcaaacucugcugu

SEQ ID NO: 2426977 - RNA, 17 nt, Human
uggcccgacagccuggc

SEQ ID NO: 2426978 - RNA, 16 nt, Human
uggcccgacagccugg

SEQ ID NO: 2426979 - RNA, 15 nt, Human
uggcccgacagccug

SEQ ID NO: 2426980 - RNA, 14 nt, Human
uggcccgacagccu

SEQ ID NO: 2426981 - RNA, 19 nt, Human
uggcccgacagccuggcac

SEQ ID NO: 2426982 - RNA, 18 nt, Human
uggcccgacagccuggca

SEQ ID NO: 2426983 - RNA, 23 nt, Human
uggcccgugacagacuccugagg

SEQ ID NO: 2426984 - RNA, 20 nt, Human
uggcccgugacagacuccug

SEQ ID NO: 2426985 - RNA, 18 nt, Human
uggcccucaaggccuccc

SEQ ID NO: 2426986 - RNA, 18 nt, Human
uggcccgugacagacucc

SEQ ID NO: 2426987 - RNA, 15 nt, Human
uggcccgugacagac

SEQ ID NO: 2426988 - RNA, 16 nt, Human
uggccccuucacuucu

SEQ ID NO: 2426989 - RNA, 14 nt, Human
uggccaguggcugg

SEQ ID NO: 2426990 - RNA, 15 nt, Human
uggccaguggcugga

SEQ ID NO: 2426991 - RNA, 16 nt, Human
uggccaguggcuggau

SEQ ID NO: 2426992 - RNA, 23 nt, Human
uggccaguggcuggaucugugag

SEQ ID NO: 2426993 - RNA, 21 nt, Human
uggccccugcccggcugcgga

SEQ ID NO: 2426994 - RNA, 12 nt, Human
uggccccugggu

SEQ ID NO: 2426995 - RNA, 11 nt, Human
uggccccuuca

SEQ ID NO: 2426996 - RNA, 13 nt, Human
uggccccuucacu

SEQ ID NO: 2426997 - RNA, 21 nt, Human
uggccccuucacuucugacca

SEQ ID NO: 2426998 - RNA, 23 nt, Human
uggccaagcagggaggaagaagc

SEQ ID NO: 2426999 - RNA, 15 nt, Human
uggccaaggagcugc

SEQ ID NO: 2427000 - RNA, 16 nt, Human
uggccaaggagcugcu

SEQ ID NO: 2427001 - RNA, 17 nt, Human
uggccaaggagcugcua

SEQ ID NO: 2427002 - RNA, 18 nt, Human
uggccaaggagcugcuau

SEQ ID NO: 2427003 - RNA, 19 nt, Human
uggccaaggagcugcuaua

SEQ ID NO: 2427004 - RNA, 17 nt, Human
uggccaggcuggucuca

SEQ ID NO: 2427005 - RNA, 15 nt, Human
uggccaggcuggucu

SEQ ID NO: 2427006 - RNA, 18 nt, Human
uggccagggugagagcug

SEQ ID NO: 2427007 - RNA, 17 nt, Human
uggccagggugagagcu

SEQ ID NO: 2427008 - RNA, 16 nt, Human
uggccaguccaggcug

SEQ ID NO: 2427009 - RNA, 21 nt, Human
uggccaguccaggcugccgug

SEQ ID NO: 2427010 - RNA, 17 nt, Human
uggccaguccaggcugc

SEQ ID NO: 2427011 - RNA, 19 nt, Human
uggccagggugagagcugc

SEQ ID NO: 2427012 - RNA, 23 nt, Human
uggccaguccaggcugccguggg

SEQ ID NO: 2427013 - RNA, 13 nt, Human
uggccagggugag

SEQ ID NO: 2427014 - RNA, 12 nt, Human
uggccaggguga

SEQ ID NO: 2427015 - RNA, 23 nt, Human
uggccagggccuggaagacagag

SEQ ID NO: 2427016 - RNA, 20 nt, Human
uggccaggcuggucucgaac

SEQ ID NO: 2427017 - RNA, 16 nt, Human
uggccaaguucuuagu

SEQ ID NO: 2427018 - RNA, 15 nt, Human
uggcaugggaaugaa

SEQ ID NO: 2427019 - RNA, 12 nt, Human
uggcaugggaau

SEQ ID NO: 2427020 - RNA, 14 nt, Human
uggccaaaguguua

SEQ ID NO: 2427021 - RNA, 15 nt, Human
uggcauggcuccagu

SEQ ID NO: 2427022 - RNA, 16 nt, Human
uggcauggcuccaguc

SEQ ID NO: 2427023 - RNA, 14 nt, Human
uggcauggccacca

SEQ ID NO: 2427024 - RNA, 22 nt, Human
uggccaacaucgugaaacccug

SEQ ID NO: 2427025 - RNA, 20 nt, Human
uggccaaauuauuuguguaa

SEQ ID NO: 2427026 - RNA, 18 nt, Human
uggccaaauuauuugugu

SEQ ID NO: 2427027 - RNA, 16 nt, Human
uggccaaauuauuugu

SEQ ID NO: 2427028 - RNA, 17 nt, Human
uggcauggcuccagucu

SEQ ID NO: 2427029 - RNA, 20 nt, Human
aggccugccuccagggcugg

SEQ ID NO: 2427030 - RNA, 19 nt, Human
aggccugccuccagggcug

SEQ ID NO: 2427031 - RNA, 13 nt, Human
aggccugccuguu

SEQ ID NO: 2427032 - RNA, 22 nt, Human
aggccugcccucagggaucuug

SEQ ID NO: 2427033 - RNA, 17 nt, Human
aggccugcccucaggga

SEQ ID NO: 2427034 - RNA, 17 nt, Human
aggccugccuccagggc

SEQ ID NO: 2427035 - RNA, 16 nt, Human
aggccugcccucaggg

SEQ ID NO: 2427036 - RNA, 23 nt, Human
aggccugccagacggcacccacc

SEQ ID NO: 2427037 - RNA, 21 nt, Human
aggccugccuccagggcugga

SEQ ID NO: 2427038 - RNA, 18 nt, Human
aggccugcucagggacug

SEQ ID NO: 2427039 - RNA, 15 nt, Human
aggccugcucaggga

SEQ ID NO: 2427040 - RNA, 19 nt, Human
uggcaugccuuccagcacc

SEQ ID NO: 2427041 - RNA, 15 nt, Human
uggcaugccuuccag

SEQ ID NO: 2427042 - RNA, 15 nt, Human
aggccucccuagcca

SEQ ID NO: 2427043 - RNA, 15 nt, Human
aggccucccucucuc

SEQ ID NO: 2427044 - RNA, 22 nt, Human
aggccucccucucucuucugcu

SEQ ID NO: 2427045 - RNA, 15 nt, Human
aggccucccacagug

SEQ ID NO: 2427046 - RNA, 14 nt, Human
aggccucccacagu

SEQ ID NO: 2427047 - RNA, 13 nt, Human
aggccucccacag

SEQ ID NO: 2427048 - RNA, 12 nt, Human
aggccucccaca

SEQ ID NO: 2427049 - RNA, 18 nt, Human
aggccucccacagugacu

SEQ ID NO: 2427050 - RNA, 16 nt, Human
aggccucccacaguga

SEQ ID NO: 2427051 - RNA, 13 nt, Human
aggccucccucaa

SEQ ID NO: 2427052 - RNA, 16 nt, Human
aggccucagccagaga

SEQ ID NO: 2427053 - RNA, 14 nt, Human
aggccucagccaga

SEQ ID NO: 2427054 - RNA, 15 nt, Human
aggccucagccagag

SEQ ID NO: 2427055 - RNA, 13 nt, Human
aggccucagugga

SEQ ID NO: 2427056 - RNA, 14 nt, Human
aggccucccaaguu

SEQ ID NO: 2427057 - RNA, 23 nt, Human
aggccucaguggacuuuccaccc

SEQ ID NO: 2427058 - RNA, 15 nt, Human
aggccucaguggacu

SEQ ID NO: 2427059 - RNA, 16 nt, Human
aggccucaguggacuu

SEQ ID NO: 2427060 - RNA, 17 nt, Human
aggccuccaucucaugu

SEQ ID NO: 2427061 - RNA, 23 nt, Human
aggccugaggaugagcuggaagg

SEQ ID NO: 2427062 - RNA, 20 nt, Human
aggccugaggaugagcugga

SEQ ID NO: 2427063 - RNA, 19 nt, Human
aggccugaggaugagcugg

SEQ ID NO: 2427064 - RNA, 18 nt, Human
aggccugaggaugagcug

SEQ ID NO: 2427065 - RNA, 17 nt, Human
aggccugaggaugagcu

SEQ ID NO: 2427066 - RNA, 19 nt, Human
aggccaccugcccccuucu

SEQ ID NO: 2427067 - RNA, 16 nt, Human
aggccugaggaugagc

SEQ ID NO: 2427068 - RNA, 13 nt, Human
aggccucuguguc

SEQ ID NO: 2427069 - RNA, 21 nt, Human
aggccucucauuccagaggaa

SEQ ID NO: 2427070 - RNA, 20 nt, Human
aggccucgaaaaccaucaca

SEQ ID NO: 2427071 - RNA, 14 nt, Human
aggccucccuguuu

SEQ ID NO: 2427072 - RNA, 13 nt, Human
aggccucccuguu

SEQ ID NO: 2427073 - RNA, 12 nt, Human
aggccucccugu

SEQ ID NO: 2427074 - RNA, 14 nt, Human
aggcccucugccca

SEQ ID NO: 2427075 - RNA, 13 nt, Human
aggcccucugccc

SEQ ID NO: 2427076 - RNA, 22 nt, Human
aggccuauaaugaagcuuuaua

SEQ ID NO: 2427077 - RNA, 16 nt, Human
aggccuauaaugaagc

SEQ ID NO: 2427078 - RNA, 20 nt, Human
aggcccucgggcccagcccc

SEQ ID NO: 2427079 - RNA, 19 nt, Human
aggcccucgggcccagccc

SEQ ID NO: 2427080 - RNA, 13 nt, Human
aggccucagccag

SEQ ID NO: 2427081 - RNA, 18 nt, Human
aggcccucgggcccagcc

SEQ ID NO: 2427082 - RNA, 17 nt, Human
aggcccucgggcccagc

SEQ ID NO: 2427083 - RNA, 16 nt, Human
aggcccucgggcccag

SEQ ID NO: 2427084 - RNA, 15 nt, Human
aggcccucgggccca

SEQ ID NO: 2427085 - RNA, 15 nt, Human
aggcccucugcccac

SEQ ID NO: 2427086 - RNA, 12 nt, Human
aggcccaaagcc

SEQ ID NO: 2427087 - RNA, 13 nt, Human
aggcccaaagccu

SEQ ID NO: 2427088 - RNA, 15 nt, Human
aggcccaaagccucg

SEQ ID NO: 2427089 - RNA, 17 nt, Human
aggcccucgcugccagc

SEQ ID NO: 2427090 - RNA, 22 nt, Human
aggcccucgcugccagcucugu

SEQ ID NO: 2427091 - RNA, 15 nt, Human
aggcccucgcugcca

SEQ ID NO: 2427092 - RNA, 15 nt, Human
aggccaaaggaagca

SEQ ID NO: 2427093 - RNA, 14 nt, Human
aggccaaaggaagc

SEQ ID NO: 2427094 - RNA, 20 nt, Human
aggccaaacucaccugcccc

SEQ ID NO: 2427095 - RNA, 16 nt, Human
aggccaaaccucuguu

SEQ ID NO: 2427096 - RNA, 17 nt, Human
aggccaaaccucuguuc

SEQ ID NO: 2427097 - RNA, 18 nt, Human
aggccaaaccucuguuca

SEQ ID NO: 2427098 - RNA, 22 nt, Human
aggccaaaccucuguucagugu

SEQ ID NO: 2427099 - RNA, 21 nt, Human
aggccaaacuggcaaacuuca

SEQ ID NO: 2427100 - RNA, 20 nt, Human
aggccaaaggaagcacaugc

SEQ ID NO: 2427101 - RNA, 23 nt, Human
aggccaaaggaagcacaugccuc

SEQ ID NO: 2427102 - RNA, 18 nt, Human
aggccaaggugggaggau

SEQ ID NO: 2427103 - RNA, 14 nt, Human
aggccaagaaacgu

SEQ ID NO: 2427104 - RNA, 17 nt, Human
aggccaagaaacgucuu

SEQ ID NO: 2427105 - RNA, 22 nt, Human
aggccaacccaaaauaagcagg

SEQ ID NO: 2427106 - RNA, 18 nt, Human
uggacgagaaaacaauaa

SEQ ID NO: 2427107 - RNA, 22 nt, Human
uggaccuuuccugaggaagagg

SEQ ID NO: 2427108 - RNA, 13 nt, Human
uggacggcaggcu

SEQ ID NO: 2427109 - RNA, 16 nt, Human
uggaccucugcucuga

SEQ ID NO: 2427110 - RNA, 15 nt, Human
uggaccucugcucug

SEQ ID NO: 2427111 - RNA, 13 nt, Human
uggaccucugcuc

SEQ ID NO: 2427112 - RNA, 17 nt, Human
uggaccucugcucugag

SEQ ID NO: 2427113 - RNA, 16 nt, Human
uggaccuugagaccac

SEQ ID NO: 2427114 - RNA, 18 nt, Human
aggcauuuguuugaacug

SEQ ID NO: 2427115 - RNA, 20 nt, Human
uggacggcaggcucacugcc

SEQ ID NO: 2427116 - RNA, 18 nt, Human
uggacggcaggcucacug

SEQ ID NO: 2427117 - RNA, 15 nt, Human
uggacggcaggcuca

SEQ ID NO: 2427118 - RNA, 18 nt, Human
aggcauuuggcauuuauu

SEQ ID NO: 2427119 - RNA, 16 nt, Human
aggccaaacucaccug

SEQ ID NO: 2427120 - RNA, 14 nt, Human
aggccaaaccucug

SEQ ID NO: 2427121 - RNA, 15 nt, Human
aggccaaaccucugu

SEQ ID NO: 2427122 - RNA, 23 nt, Human
aggccaaaauuaccaaaaaucuu

SEQ ID NO: 2427123 - RNA, 13 nt, Human
aggccaaaaaaau

SEQ ID NO: 2427124 - RNA, 19 nt, Human
uggaugccugguggcagcu

SEQ ID NO: 2427125 - RNA, 18 nt, Human
uggaugccugguggcagc

SEQ ID NO: 2427126 - RNA, 22 nt, Human
uggaugggggaacucagaucca

SEQ ID NO: 2427127 - RNA, 16 nt, Human
uggaguuccugaaccu

SEQ ID NO: 2427128 - RNA, 23 nt, Human
uggaugggggaacucagauccag

SEQ ID NO: 2427129 - RNA, 20 nt, Human
uggaugccugguggcagcug

SEQ ID NO: 2427130 - RNA, 17 nt, Human
uggaguucaucuugaau

SEQ ID NO: 2427131 - RNA, 16 nt, Human
uggaguucaucuugaa

SEQ ID NO: 2427132 - RNA, 20 nt, Human
uggaguucaucuugaauugu

SEQ ID NO: 2427133 - RNA, 15 nt, Human
uggaugccugguggc

SEQ ID NO: 2427134 - RNA, 15 nt, Human
aggccacaagacccu

SEQ ID NO: 2427135 - RNA, 23 nt, Human
aggccaaguuuguaucaggugcc

SEQ ID NO: 2427136 - RNA, 22 nt, Human
aggccaagugugauaaauaaac

SEQ ID NO: 2427137 - RNA, 21 nt, Human
aggccaagaaacgucuucuaa

SEQ ID NO: 2427138 - RNA, 18 nt, Human
aggccaagucaggcccuu

SEQ ID NO: 2427139 - RNA, 14 nt, Human
aggccaagugcagg

SEQ ID NO: 2427140 - RNA, 15 nt, Human
aggccaagugcaggc

SEQ ID NO: 2427141 - RNA, 21 nt, Human
aggccaagugcaggcuggcac

SEQ ID NO: 2427142 - RNA, 17 nt, Human
uggagucuccagugguu

SEQ ID NO: 2427143 - RNA, 13 nt, Human
uggagucuccagu

SEQ ID NO: 2427144 - RNA, 14 nt, Human
uggagucggaaggg

SEQ ID NO: 2427145 - RNA, 21 nt, Human
uggaguccccucaccuccucu

SEQ ID NO: 2427146 - RNA, 20 nt, Human
uggaguccccucaccuccuc

SEQ ID NO: 2427147 - RNA, 19 nt, Human
uggaguccccucaccuccu

SEQ ID NO: 2427148 - RNA, 15 nt, Human
uggaguccccucacc

SEQ ID NO: 2427149 - RNA, 14 nt, Human
uggaguccccucac

SEQ ID NO: 2427150 - RNA, 19 nt, Human
uggagucagacagaugugg

SEQ ID NO: 2427151 - RNA, 15 nt, Human
uggagucaugccaag

SEQ ID NO: 2427152 - RNA, 14 nt, Human
uggaguccagucuc

SEQ ID NO: 2427153 - RNA, 15 nt, Human
uggaguccagucucu

SEQ ID NO: 2427154 - RNA, 22 nt, Human
uggagucaugguccgguguccu

SEQ ID NO: 2427155 - RNA, 20 nt, Human
aggccacaagacccuugugg

SEQ ID NO: 2427156 - RNA, 15 nt, Human
uggcagccucuucaa

SEQ ID NO: 2427157 - RNA, 16 nt, Human
uggcagccucuucaaa

SEQ ID NO: 2427158 - RNA, 19 nt, Human
uggcagccucccauccagg

SEQ ID NO: 2427159 - RNA, 20 nt, Human
uggcagccucccauccaggg

SEQ ID NO: 2427160 - RNA, 21 nt, Human
uggcagccucccauccagggc

SEQ ID NO: 2427161 - RNA, 22 nt, Human
uggcagccucccauccagggcc

SEQ ID NO: 2427162 - RNA, 23 nt, Human
uggcagccgugccuucagcucua

SEQ ID NO: 2427163 - RNA, 22 nt, Human
uggcagccgugccuucagcucu

SEQ ID NO: 2427164 - RNA, 14 nt, Human
uggcagccgagcuc

SEQ ID NO: 2427165 - RNA, 12 nt, Human
uggcagccccug

SEQ ID NO: 2427166 - RNA, 11 nt, Human
uggcagcccug

SEQ ID NO: 2427167 - RNA, 12 nt, Human
uggcagcccugu

SEQ ID NO: 2427168 - RNA, 16 nt, Human
uggcagccgugccuuc

SEQ ID NO: 2427169 - RNA, 14 nt, Human
uggcagcccuguag

SEQ ID NO: 2427170 - RNA, 17 nt, Human
uggcagcccuguaggga

SEQ ID NO: 2427171 - RNA, 21 nt, Human
aggccacaugucaccguggac

SEQ ID NO: 2427172 - RNA, 15 nt, Human
aggccacaugucacc

SEQ ID NO: 2427173 - RNA, 23 nt, Human
aggccacauggggcugggcagcu

SEQ ID NO: 2427174 - RNA, 22 nt, Human
aggccacauggggcugggcagc

SEQ ID NO: 2427175 - RNA, 19 nt, Human
aggccacauggggcugggc

SEQ ID NO: 2427176 - RNA, 18 nt, Human
aggccacaugagucccag

SEQ ID NO: 2427177 - RNA, 19 nt, Human
aggccacaugagucccagu

SEQ ID NO: 2427178 - RNA, 13 nt, Human
aggccaccaggau

SEQ ID NO: 2427179 - RNA, 12 nt, Human
aggccaccagga

SEQ ID NO: 2427180 - RNA, 22 nt, Human
aggccaccauauucagugcugu

SEQ ID NO: 2427181 - RNA, 17 nt, Human
aggccacacucagcaca

SEQ ID NO: 2427182 - RNA, 18 nt, Human
aggccacacucagcacaa

SEQ ID NO: 2427183 - RNA, 16 nt, Human
aggccacaugaguccc

SEQ ID NO: 2427184 - RNA, 21 nt, Human
aggccacaccaucuccuuuca

SEQ ID NO: 2427185 - RNA, 22 nt, Human
aggccacaccaucuccuuucag

SEQ ID NO: 2427186 - RNA, 19 nt, Human
aggccacuccuccaaagga

SEQ ID NO: 2427187 - RNA, 23 nt, Human
aggccacgugauguggagggcac

SEQ ID NO: 2427188 - RNA, 19 nt, Human
aggccacgugauguggagg

SEQ ID NO: 2427189 - RNA, 13 nt, Human
aggccacuccucc

SEQ ID NO: 2427190 - RNA, 14 nt, Human
aggccacuccucca

SEQ ID NO: 2427191 - RNA, 21 nt, Human
aggccaccugcccccuucucc

SEQ ID NO: 2427192 - RNA, 22 nt, Human
aggccaccugcccccuucuccc

SEQ ID NO: 2427193 - RNA, 13 nt, Human
aggccacggcagc

SEQ ID NO: 2427194 - RNA, 12 nt, Human
aggccagagaca

SEQ ID NO: 2427195 - RNA, 20 nt, Human
uggcacaguuuucugagaaa

SEQ ID NO: 2427196 - RNA, 22 nt, Human
uggauuaaacuuaaucuaaaug

SEQ ID NO: 2427197 - RNA, 12 nt, Human
uggauguucuga

SEQ ID NO: 2427198 - RNA, 20 nt, Human
uggaugucugccaauuuuug

SEQ ID NO: 2427199 - RNA, 17 nt, Human
uggaugucugccaauuu

SEQ ID NO: 2427200 - RNA, 15 nt, Human
uggcacaucagaaag

SEQ ID NO: 2427201 - RNA, 14 nt, Human
uggcacaucagaaa

SEQ ID NO: 2427202 - RNA, 20 nt, Human
uggauguuuuaauuccauga

SEQ ID NO: 2427203 - RNA, 18 nt, Human
uggauguuuuaauuccau

SEQ ID NO: 2427204 - RNA, 13 nt, Human
uggauguuuuaau

SEQ ID NO: 2427205 - RNA, 23 nt, Human
uggaugugggguccccaucaucc

SEQ ID NO: 2427206 - RNA, 15 nt, Human
uggaugucuuccuug

SEQ ID NO: 2427207 - RNA, 14 nt, Human
uggaugucuuccuu

SEQ ID NO: 2427208 - RNA, 22 nt, Human
uggcacaguuuucugagaaaga

SEQ ID NO: 2427209 - RNA, 20 nt, Human
uggcacaucagcacgauuuc

SEQ ID NO: 2427210 - RNA, 18 nt, Human
uggcaccagcagccugga

SEQ ID NO: 2427211 - RNA, 20 nt, Human
uggcagauaaucagccucuu

SEQ ID NO: 2427212 - RNA, 21 nt, Human
uggcagauaaucagccucuua

SEQ ID NO: 2427213 - RNA, 20 nt, Human
uggcagcauaaaggccuuuu

SEQ ID NO: 2427214 - RNA, 17 nt, Human
uggcagaguuugugugu

SEQ ID NO: 2427215 - RNA, 23 nt, Human
uggcagaguuguaaauauauaaa

SEQ ID NO: 2427216 - RNA, 20 nt, Human
uggcagaguuguaaauauau

SEQ ID NO: 2427217 - RNA, 19 nt, Human
uggcagaguuguaaauaua

SEQ ID NO: 2427218 - RNA, 22 nt, Human
uggcagaguuuguguguugucu

SEQ ID NO: 2427219 - RNA, 18 nt, Human
uggcagaguuuguguguu

SEQ ID NO: 2427220 - RNA, 19 nt, Human
uggcagauaaucagccucu

SEQ ID NO: 2427221 - RNA, 22 nt, Human
uggcagaguugaagacagagcu

SEQ ID NO: 2427222 - RNA, 17 nt, Human
uggcagaguuguaaaua

SEQ ID NO: 2427223 - RNA, 16 nt, Human
uggcagaguuguaaau

SEQ ID NO: 2427224 - RNA, 15 nt, Human
uggcagaguuguaaa

SEQ ID NO: 2427225 - RNA, 22 nt, Human
uggcacccaccguggaggagga

SEQ ID NO: 2427226 - RNA, 21 nt, Human
uggcacccaccguggaggagg

SEQ ID NO: 2427227 - RNA, 18 nt, Human
uggcaccagcgaagggag

SEQ ID NO: 2427228 - RNA, 20 nt, Human
uggcacccaccguggaggag

SEQ ID NO: 2427229 - RNA, 21 nt, Human
uggcagaguugaagacagagc

SEQ ID NO: 2427230 - RNA, 16 nt, Human
uggcacccggccccug

SEQ ID NO: 2427231 - RNA, 15 nt, Human
uggcacccggccccu

SEQ ID NO: 2427232 - RNA, 21 nt, Human
uggcacaucagcacgauuucu

SEQ ID NO: 2427233 - RNA, 13 nt, Human
uggcaccagcgaa

SEQ ID NO: 2427234 - RNA, 18 nt, Human
uggcacaucagaaaggaa

SEQ ID NO: 2427235 - RNA, 20 nt, Human
aggcuggcgugcaguggugc

SEQ ID NO: 2427236 - RNA, 18 nt, Human
aggcuggcgugcaguggu

SEQ ID NO: 2427237 - RNA, 19 nt, Human
aggcuggcuccagaugcag

SEQ ID NO: 2427238 - RNA, 22 nt, Human
aggcuggcgcagccaaggccga

SEQ ID NO: 2427239 - RNA, 13 nt, Human
aggcuggcuggcc

SEQ ID NO: 2427240 - RNA, 15 nt, Human
aggcuggcuggggcc

SEQ ID NO: 2427241 - RNA, 13 nt, Human
aggcuggcugggg

SEQ ID NO: 2427242 - RNA, 12 nt, Human
aggcuggcuggg

SEQ ID NO: 2427243 - RNA, 22 nt, Human
aggcuggcuggcccgucauguu

SEQ ID NO: 2427244 - RNA, 17 nt, Human
aggcugggaccacguga

SEQ ID NO: 2427245 - RNA, 17 nt, Human
aggcuggcuggggccua

SEQ ID NO: 2427246 - RNA, 14 nt, Human
aggcuggcuugucc

SEQ ID NO: 2427247 - RNA, 22 nt, Human
aggcuggcuuguccccuccuca

SEQ ID NO: 2427248 - RNA, 14 nt, Human
aggcugggagagcc

SEQ ID NO: 2427249 - RNA, 22 nt, Human
uggcuagagguucaaagauauu

SEQ ID NO: 2427250 - RNA, 20 nt, Human
aggcuggcuuguccccuccu

SEQ ID NO: 2427251 - RNA, 15 nt, Human
uggcuagaguccuca

SEQ ID NO: 2427252 - RNA, 16 nt, Human
uggcuagaguccucac

SEQ ID NO: 2427253 - RNA, 17 nt, Human
uggcuaggggagcaggg

SEQ ID NO: 2427254 - RNA, 15 nt, Human
uggcuagucaagcuc

SEQ ID NO: 2427255 - RNA, 18 nt, Human
uggcuagaguccucacuc

SEQ ID NO: 2427256 - RNA, 21 nt, Human
uggcuagaguccucacuccca

SEQ ID NO: 2427257 - RNA, 22 nt, Human
uggcuauuagagaucaaccccu

SEQ ID NO: 2427258 - RNA, 15 nt, Human
uggcuauuuaaaacu

SEQ ID NO: 2427259 - RNA, 16 nt, Human
uggcuauuuaaagaca

SEQ ID NO: 2427260 - RNA, 19 nt, Human
uggcuaugcauuugaaaau

SEQ ID NO: 2427261 - RNA, 16 nt, Human
uggcuaugagggccuu

SEQ ID NO: 2427262 - RNA, 14 nt, Human
uggcuauggccacc

SEQ ID NO: 2427263 - RNA, 13 nt, Human
uggcuauaaauau

SEQ ID NO: 2427264 - RNA, 16 nt, Human
uggcuagucagagaga

SEQ ID NO: 2427265 - RNA, 15 nt, Human
uggcuaugcauuuga

SEQ ID NO: 2427266 - RNA, 17 nt, Human
uggcuaugcauuugaaa

SEQ ID NO: 2427267 - RNA, 14 nt, Human
uggcuaugcauuug

SEQ ID NO: 2427268 - RNA, 17 nt, Human
uggcuagucaagcuccu

SEQ ID NO: 2427269 - RNA, 18 nt, Human
uggcuagucaagcuccuc

SEQ ID NO: 2427270 - RNA, 20 nt, Human
uggcuagucaagcuccuccu

SEQ ID NO: 2427271 - RNA, 21 nt, Human
uggcuagucaagcuccuccuc

SEQ ID NO: 2427272 - RNA, 22 nt, Human
uggcuagucaagcuccuccucc

SEQ ID NO: 2427273 - RNA, 23 nt, Human
uggcuagucaagcuccuccuccc

SEQ ID NO: 2427274 - RNA, 17 nt, Human
uggcuagugucuaucag

SEQ ID NO: 2427275 - RNA, 21 nt, Human
uggcucuuccaggcugggaga

SEQ ID NO: 2427276 - RNA, 20 nt, Human
uggcucuuccaggcugggag

SEQ ID NO: 2427277 - RNA, 19 nt, Human
uggcucuuccaggcuggga

SEQ ID NO: 2427278 - RNA, 18 nt, Human
uggcucaaguccucuuuu

SEQ ID NO: 2427279 - RNA, 22 nt, Human
uggcugagguuccucugccugc

SEQ ID NO: 2427280 - RNA, 21 nt, Human
uggcugagguuccucugccug

SEQ ID NO: 2427281 - RNA, 20 nt, Human
uggcugagguuccucugccu

SEQ ID NO: 2427282 - RNA, 18 nt, Human
uggcugagguuccucugc

SEQ ID NO: 2427283 - RNA, 17 nt, Human
uggcugagguuccucug

SEQ ID NO: 2427284 - RNA, 12 nt, Human
uggcugcaaagg

SEQ ID NO: 2427285 - RNA, 16 nt, Human
uggcucuugaacugag

SEQ ID NO: 2427286 - RNA, 22 nt, Human
uggcucuugaacugagcuugga

SEQ ID NO: 2427287 - RNA, 15 nt, Human
uggcucuucugccca

SEQ ID NO: 2427288 - RNA, 17 nt, Human
uggcugaggaggccucc

SEQ ID NO: 2427289 - RNA, 23 nt, Human
uggcugaggaggccuccaucuca

SEQ ID NO: 2427290 - RNA, 20 nt, Human
uggcugaggauuucaagccu

SEQ ID NO: 2427291 - RNA, 14 nt, Human
uggcugcagggagu

SEQ ID NO: 2427292 - RNA, 13 nt, Human
uggcugcagggag

SEQ ID NO: 2427293 - RNA, 19 nt, Human
uggcugcauaaauguggua

SEQ ID NO: 2427294 - RNA, 24 nt, Human
uggcugagguuccucugccugccc

SEQ ID NO: 2427295 - RNA, 23 nt, Human
uggcugagguuccucugccugcc

SEQ ID NO: 2427296 - RNA, 15 nt, Human
uggcugcagggaguc

SEQ ID NO: 2427297 - RNA, 20 nt, Human
uggcugccaaugggagcuca

SEQ ID NO: 2427298 - RNA, 18 nt, Human
uggcugccaaugggagcu

SEQ ID NO: 2427299 - RNA, 22 nt, Human
uggcugccagcuauuuuuacua

SEQ ID NO: 2427300 - RNA, 20 nt, Human
uggcugcccagaccccucug

SEQ ID NO: 2427301 - RNA, 23 nt, Human
uggcugcccagaccccucuggcc

SEQ ID NO: 2427302 - RNA, 22 nt, Human
uggcugccccauuuauccaccu

SEQ ID NO: 2427303 - RNA, 20 nt, Human
uggcugccccaaccugcuga

SEQ ID NO: 2427304 - RNA, 17 nt, Human
uggcugccccaaccugc

SEQ ID NO: 2427305 - RNA, 21 nt, Human
uggcugcccagaccccucugg

SEQ ID NO: 2427306 - RNA, 14 nt, Human
uggcugccagcuau

SEQ ID NO: 2427307 - RNA, 13 nt, Human
uggcugcccacac

SEQ ID NO: 2427308 - RNA, 12 nt, Human
uggcugcaugcg

SEQ ID NO: 2427309 - RNA, 20 nt, Human
uggcugcaucccccccaccu

SEQ ID NO: 2427310 - RNA, 17 nt, Human
uggcuuaaaacaacacu

SEQ ID NO: 2427311 - RNA, 15 nt, Human
uggcuguuggcuggg

SEQ ID NO: 2427312 - RNA, 14 nt, Human
uggcugugucuccc

SEQ ID NO: 2427313 - RNA, 13 nt, Human
uggcuguuggcug

SEQ ID NO: 2427314 - RNA, 16 nt, Human
uggcugcccuggcccu

SEQ ID NO: 2427315 - RNA, 15 nt, Human
uggcugcccuggccc

SEQ ID NO: 2427316 - RNA, 14 nt, Human
uggcugcccuggcc

SEQ ID NO: 2427317 - RNA, 13 nt, Human
uggcugcccuggc

SEQ ID NO: 2427318 - RNA, 16 nt, Human
uggcugccuccacucc

SEQ ID NO: 2427319 - RNA, 14 nt, Human
uggcugccuccacu

SEQ ID NO: 2427320 - RNA, 17 nt, Human
uggcugcccuggcccug

SEQ ID NO: 2427321 - RNA, 17 nt, Human
uggcugccucauuuaga

SEQ ID NO: 2427322 - RNA, 22 nt, Human
uggcugccuugugaaggaauua

SEQ ID NO: 2427323 - RNA, 18 nt, Human
uggcugccuccacuccca

SEQ ID NO: 2427324 - RNA, 17 nt, Human
uggcugccuccacuccc

SEQ ID NO: 2427325 - RNA, 20 nt, Human
uggcugccuccacucccacu

SEQ ID NO: 2427326 - RNA, 19 nt, Human
uggcugugucuaaacugca

SEQ ID NO: 2427327 - RNA, 20 nt, Human
uggcugugucuaaacugcau

SEQ ID NO: 2427328 - RNA, 15 nt, Human
uggcugcuagcacuu

SEQ ID NO: 2427329 - RNA, 13 nt, Human
uggcugcuagcac

SEQ ID NO: 2427330 - RNA, 14 nt, Human
uggcugcuagcacu

SEQ ID NO: 2427331 - RNA, 17 nt, Human
uggcugcggcacccuug

SEQ ID NO: 2427332 - RNA, 16 nt, Human
uggcugcggcacccuu

SEQ ID NO: 2427333 - RNA, 14 nt, Human
uggcuuaauguuua

SEQ ID NO: 2427334 - RNA, 20 nt, Human
uggcuuaaugcuucuuucau

SEQ ID NO: 2427335 - RNA, 15 nt, Human
uggcuuaauguuuau

SEQ ID NO: 2427336 - RNA, 18 nt, Human
uggcuguuggcagugagu

SEQ ID NO: 2427337 - RNA, 14 nt, Human
uggcuguucuggaa

SEQ ID NO: 2427338 - RNA, 22 nt, Human
uggcuguguucuggugaggccu

SEQ ID NO: 2427339 - RNA, 16 nt, Human
uggcuuaaugcuucuu

SEQ ID NO: 2427340 - RNA, 15 nt, Human
uggcuuaaugcuucu

SEQ ID NO: 2427341 - RNA, 22 nt, Human
uggcuucacggaagagccuugc

SEQ ID NO: 2427342 - RNA, 15 nt, Human
uggcuuauccagcug

SEQ ID NO: 2427343 - RNA, 23 nt, Human
uggcuuacuacaugugggagcuu

SEQ ID NO: 2427344 - RNA, 20 nt, Human
uggcuuacuacaugugggag

SEQ ID NO: 2427345 - RNA, 22 nt, Human
uggcuuccagguaucuccagga

SEQ ID NO: 2427346 - RNA, 21 nt, Human
uggcuuccagguaucuccagg

SEQ ID NO: 2427347 - RNA, 20 nt, Human
uggcuuccagguaucuccag

SEQ ID NO: 2427348 - RNA, 15 nt, Human
uggcuuccagguauc

SEQ ID NO: 2427349 - RNA, 14 nt, Human
uggcuuccagguau

SEQ ID NO: 2427350 - RNA, 20 nt, Human
uggcuucauuagagcaggcg

SEQ ID NO: 2427351 - RNA, 23 nt, Human
uggcuuccagaaaaccccagcau

SEQ ID NO: 2427352 - RNA, 18 nt, Human
uggcuucauuagagcagg

SEQ ID NO: 2427353 - RNA, 16 nt, Human
uggcuucaucugucaa

SEQ ID NO: 2427354 - RNA, 22 nt, Human
uggcuuccagaaaaccccagca

SEQ ID NO: 2427355 - RNA, 13 nt, Human
uggcuucaggagg

SEQ ID NO: 2427356 - RNA, 12 nt, Human
uggcuucaggag

SEQ ID NO: 2427357 - RNA, 23 nt, Human
uggcuucacggaagagccuugcg

SEQ ID NO: 2427358 - RNA, 16 nt, Human
uggcuuccaugauggu

SEQ ID NO: 2427359 - RNA, 23 nt, Human
uggcuuccagguaucuccaggau

SEQ ID NO: 2427360 - RNA, 16 nt, Human
uggcuucccgcucagc

SEQ ID NO: 2427361 - RNA, 15 nt, Human
uggcuucccgcucag

SEQ ID NO: 2427362 - RNA, 16 nt, Human
ugggaaagccaccucu

SEQ ID NO: 2427363 - RNA, 15 nt, Human
ugggaaagccaccuc

SEQ ID NO: 2427364 - RNA, 17 nt, Human
uggcuucccgcucagcc

SEQ ID NO: 2427365 - RNA, 16 nt, Human
ugggaaaggggaaguu

SEQ ID NO: 2427366 - RNA, 21 nt, Human
ugggaaagccaccucucccuc

SEQ ID NO: 2427367 - RNA, 20 nt, Human
ugggaaagccaccucucccu

SEQ ID NO: 2427368 - RNA, 22 nt, Human
ugggaaagccaccucucccuca

SEQ ID NO: 2427369 - RNA, 16 nt, Human
ugggaaaggaguagaa

SEQ ID NO: 2427370 - RNA, 16 nt, Human
ugggaaaguauucugu

SEQ ID NO: 2427371 - RNA, 17 nt, Human
ugggaaauaagagagaa

SEQ ID NO: 2427372 - RNA, 17 nt, Human
ugggaaaggaguagaaa

SEQ ID NO: 2427373 - RNA, 16 nt, Human
ugggaacgagagggga

SEQ ID NO: 2427374 - RNA, 15 nt, Human
ugggaacgagagggg

SEQ ID NO: 2427375 - RNA, 21 nt, Human
ugggaacgcagaugauccaug

SEQ ID NO: 2427376 - RNA, 22 nt, Human
ugggaagauaggcucugcacag

SEQ ID NO: 2427377 - RNA, 17 nt, Human
ugggaagauaggcucug

SEQ ID NO: 2427378 - RNA, 20 nt, Human
ugggaagauaggcucugcac

SEQ ID NO: 2427379 - RNA, 12 nt, Human
ugggaaggaggg

SEQ ID NO: 2427380 - RNA, 16 nt, Human
ugggaaggccagcugc

SEQ ID NO: 2427381 - RNA, 15 nt, Human
ugggaaggccagcug

SEQ ID NO: 2427382 - RNA, 13 nt, Human
ugggaagggagag

SEQ ID NO: 2427383 - RNA, 19 nt, Human
ugggaaggggacccccgcc

SEQ ID NO: 2427384 - RNA, 15 nt, Human
ugggaauaaauaugc

SEQ ID NO: 2427385 - RNA, 14 nt, Human
ugggaauaaauaug

SEQ ID NO: 2427386 - RNA, 13 nt, Human
ugggaauaaauau

SEQ ID NO: 2427387 - RNA, 20 nt, Human
ugggaagugacuuagcagau

SEQ ID NO: 2427388 - RNA, 14 nt, Human
ugggaagugacuua

SEQ ID NO: 2427389 - RNA, 15 nt, Human
ugggaagugaagacu

SEQ ID NO: 2427390 - RNA, 21 nt, Human
ugggaagggagagcggggcag

SEQ ID NO: 2427391 - RNA, 22 nt, Human
ugggaaggggacccccgccccc

SEQ ID NO: 2427392 - RNA, 13 nt, Human
ugggaacuagacu

SEQ ID NO: 2427393 - RNA, 24 nt, Human
ugggaacgcagaugauccaugagu

SEQ ID NO: 2427394 - RNA, 20 nt, Human
ugggaacgagaggggaagag

SEQ ID NO: 2427395 - RNA, 16 nt, Human
ugggaacgugacugcc

SEQ ID NO: 2427396 - RNA, 18 nt, Human
ugggaacucaccuggggc

SEQ ID NO: 2427397 - RNA, 17 nt, Human
ugggaacucaccugggg

SEQ ID NO: 2427398 - RNA, 15 nt, Human
ugggaacucaccugg

SEQ ID NO: 2427399 - RNA, 18 nt, Human
ugggaacgugacugcccc

SEQ ID NO: 2427400 - RNA, 17 nt, Human
ugggaacugcagaccug

SEQ ID NO: 2427401 - RNA, 16 nt, Human
ugggaacugcagaccu

SEQ ID NO: 2427402 - RNA, 19 nt, Human
ugggaagacgccugagcuc

SEQ ID NO: 2427403 - RNA, 18 nt, Human
ugggaagacgccugagcu

SEQ ID NO: 2427404 - RNA, 21 nt, Human
ugggaagacgccugagcucac

SEQ ID NO: 2427405 - RNA, 18 nt, Human
ugggaagacgaggcccuc

SEQ ID NO: 2427406 - RNA, 17 nt, Human
ugggaagacgaggcccu

SEQ ID NO: 2427407 - RNA, 23 nt, Human
ugggaagaccagcuuugcaguga

SEQ ID NO: 2427408 - RNA, 21 nt, Human
ugggaagacauggggaggaag

SEQ ID NO: 2427409 - RNA, 13 nt, Human
ugggaagacauga

SEQ ID NO: 2427410 - RNA, 18 nt, Human
ugggaacugcagaccugu

SEQ ID NO: 2427411 - RNA, 20 nt, Human
aggcucucaggccagcugcu

SEQ ID NO: 2427412 - RNA, 19 nt, Human
aggcucucaggccagcugc

SEQ ID NO: 2427413 - RNA, 18 nt, Human
aggcucucaggccagcug

SEQ ID NO: 2427414 - RNA, 16 nt, Human
aggcucucaggccagc

SEQ ID NO: 2427415 - RNA, 15 nt, Human
aggcucucaggccag

SEQ ID NO: 2427416 - RNA, 14 nt, Human
aggcucucaggcca

SEQ ID NO: 2427417 - RNA, 12 nt, Human
aggcucucaggc

SEQ ID NO: 2427418 - RNA, 11 nt, Human
aggcucucagg

SEQ ID NO: 2427419 - RNA, 21 nt, Human
aggcucucaggccagcugcuu

SEQ ID NO: 2427420 - RNA, 19 nt, Human
aggcucugacccagugaga

SEQ ID NO: 2427421 - RNA, 18 nt, Human
aggcucugaaagccagcu

SEQ ID NO: 2427422 - RNA, 11 nt, Human
aggcucugccc

SEQ ID NO: 2427423 - RNA, 12 nt, Human
aggcucugcccu

SEQ ID NO: 2427424 - RNA, 15 nt, Human
aggcucugcccuugg

SEQ ID NO: 2427425 - RNA, 14 nt, Human
aggcucugcccuug

SEQ ID NO: 2427426 - RNA, 13 nt, Human
aggcucugcccuu

SEQ ID NO: 2427427 - RNA, 13 nt, Human
aggcucugcacag

SEQ ID NO: 2427428 - RNA, 15 nt, Human
aggcucugcacagau

SEQ ID NO: 2427429 - RNA, 17 nt, Human
aggcucugcacagaugg

SEQ ID NO: 2427430 - RNA, 13 nt, Human
aggcucugcccug

SEQ ID NO: 2427431 - RNA, 14 nt, Human
aggcuccugccacc

SEQ ID NO: 2427432 - RNA, 17 nt, Human
aggccugggugcuggcu

SEQ ID NO: 2427433 - RNA, 23 nt, Human
aggccugggugcuggcugcccag

SEQ ID NO: 2427434 - RNA, 22 nt, Human
aggccuguccugaccugucuca

SEQ ID NO: 2427435 - RNA, 16 nt, Human
aggccuggccaggcac

SEQ ID NO: 2427436 - RNA, 16 nt, Human
aggccugggucugugu

SEQ ID NO: 2427437 - RNA, 17 nt, Human
aggccugggucuguguc

SEQ ID NO: 2427438 - RNA, 19 nt, Human
aggccugggucugugucuc

SEQ ID NO: 2427439 - RNA, 21 nt, Human
aggccugggucugugucucuu

SEQ ID NO: 2427440 - RNA, 12 nt, Human
aggccugggugc

SEQ ID NO: 2427441 - RNA, 16 nt, Human
aggccugggugcuggc

SEQ ID NO: 2427442 - RNA, 20 nt, Human
aggcuccugccaccacgccc

SEQ ID NO: 2427443 - RNA, 13 nt, Human
aggcuccugccac

SEQ ID NO: 2427444 - RNA, 21 nt, Human
aggcuccugccaguguggaac

SEQ ID NO: 2427445 - RNA, 19 nt, Human
aggcuccugugcuacuuug

SEQ ID NO: 2427446 - RNA, 13 nt, Human
aggcuccugugcu

SEQ ID NO: 2427447 - RNA, 12 nt, Human
aggcucgagcau

SEQ ID NO: 2427448 - RNA, 19 nt, Human
aggcuccuuuagcgcccag

SEQ ID NO: 2427449 - RNA, 19 nt, Human
aggcucgagcaugccugga

SEQ ID NO: 2427450 - RNA, 18 nt, Human
aggcucgagcaugccugg

SEQ ID NO: 2427451 - RNA, 17 nt, Human
aggcucgagcaugccug

SEQ ID NO: 2427452 - RNA, 15 nt, Human
aggcucgagcaugcc

SEQ ID NO: 2427453 - RNA, 21 nt, Human
aggcucgagcaugccuggaug

SEQ ID NO: 2427454 - RNA, 13 nt, Human
aggcuccuuccug

SEQ ID NO: 2427455 - RNA, 15 nt, Human
aggcuccuuccuguc

SEQ ID NO: 2427456 - RNA, 16 nt, Human
aggcuccuuccugucu

SEQ ID NO: 2427457 - RNA, 16 nt, Human
aggcucgauuuuguau

SEQ ID NO: 2427458 - RNA, 15 nt, Human
aggcucgauuuugua

SEQ ID NO: 2427459 - RNA, 14 nt, Human
aggcucgauuuugu

SEQ ID NO: 2427460 - RNA, 23 nt, Human
aggcuccuuccugucuuccugca

SEQ ID NO: 2427461 - RNA, 23 nt, Human
aggcucgauuuuguaucugcagg

SEQ ID NO: 2427462 - RNA, 19 nt, Human
aggcucgauuuuguaucug

SEQ ID NO: 2427463 - RNA, 17 nt, Human
aggcucgauuuuguauc

SEQ ID NO: 2427464 - RNA, 22 nt, Human
aggcucgauuuuguaucugcag

SEQ ID NO: 2427465 - RNA, 20 nt, Human
aggcucucaacaggggagag

SEQ ID NO: 2427466 - RNA, 16 nt, Human
aggcucugcccuuggu

SEQ ID NO: 2427467 - RNA, 13 nt, Human
aggcucuggagcc

SEQ ID NO: 2427468 - RNA, 15 nt, Human
aggcucuggagccca

SEQ ID NO: 2427469 - RNA, 14 nt, Human
aggcucuggagccc

SEQ ID NO: 2427470 - RNA, 19 nt, Human
aggcucuggagcccacugu

SEQ ID NO: 2427471 - RNA, 18 nt, Human
aggcucuggagcccacug

SEQ ID NO: 2427472 - RNA, 17 nt, Human
aggcugcucagggcugg

SEQ ID NO: 2427473 - RNA, 16 nt, Human
aggcugcucagggcug

SEQ ID NO: 2427474 - RNA, 16 nt, Human
aggcugcgucuggagg

SEQ ID NO: 2427475 - RNA, 15 nt, Human
aggcugcucagggcu

SEQ ID NO: 2427476 - RNA, 18 nt, Human
aggcucugcgccugcccc

SEQ ID NO: 2427477 - RNA, 23 nt, Human
aggcucugcccugcccuagcucc

SEQ ID NO: 2427478 - RNA, 14 nt, Human
aggcucugcccugc

SEQ ID NO: 2427479 - RNA, 17 nt, Human
aggcucugcccugcccu

SEQ ID NO: 2427480 - RNA, 20 nt, Human
aggcugcuggcgccucugca

SEQ ID NO: 2427481 - RNA, 19 nt, Human
aggcugcuggcgccucugc

SEQ ID NO: 2427482 - RNA, 18 nt, Human
aggcugcuggcgccucug

SEQ ID NO: 2427483 - RNA, 15 nt, Human
aggcugcuggcgccu

SEQ ID NO: 2427484 - RNA, 21 nt, Human
aggcugcuggcgccucugcaa

SEQ ID NO: 2427485 - RNA, 14 nt, Human
aggcugcuuagaau

SEQ ID NO: 2427486 - RNA, 13 nt, Human
aggcugcuuucca

SEQ ID NO: 2427487 - RNA, 14 nt, Human
aggcugcuuuccaa

SEQ ID NO: 2427488 - RNA, 17 nt, Human
aggcugcgucuggaggg

SEQ ID NO: 2427489 - RNA, 23 nt, Human
aggcugcucuugaacuccugacc

SEQ ID NO: 2427490 - RNA, 13 nt, Human
aggcugcuggagg

SEQ ID NO: 2427491 - RNA, 14 nt, Human
aggcugcuggagga

SEQ ID NO: 2427492 - RNA, 14 nt, Human
aggcugcuggcgcc

SEQ ID NO: 2427493 - RNA, 12 nt, Human
aggcugcuggcg

SEQ ID NO: 2427494 - RNA, 15 nt, Human
aggcugcuggaggaa

SEQ ID NO: 2427495 - RNA, 16 nt, Human
aggcugcuggaggaaa

SEQ ID NO: 2427496 - RNA, 15 nt, Human
aggcugcuuuccaaa

SEQ ID NO: 2427497 - RNA, 17 nt, Human
aggcugcuuuccaaagc

SEQ ID NO: 2427498 - RNA, 18 nt, Human
aggcugcuuuccaaagcc

SEQ ID NO: 2427499 - RNA, 19 nt, Human
aggcugcuuuccaaagcca

SEQ ID NO: 2427500 - RNA, 21 nt, Human
aggcugcuuuccaaagccaau

SEQ ID NO: 2427501 - RNA, 22 nt, Human
aggcugcuuagaauccaaacuu

SEQ ID NO: 2427502 - RNA, 13 nt, Human
aggcugcuuggga

SEQ ID NO: 2427503 - RNA, 12 nt, Human
aggcuggagaag

SEQ ID NO: 2427504 - RNA, 15 nt, Human
aggcuggcccugccc

SEQ ID NO: 2427505 - RNA, 16 nt, Human
aggcuggcccugcccu

SEQ ID NO: 2427506 - RNA, 17 nt, Human
aggcuggcccugcccug

SEQ ID NO: 2427507 - RNA, 18 nt, Human
aggcuggcccugcccugg

SEQ ID NO: 2427508 - RNA, 21 nt, Human
aggcuggccaguccaggcugc

SEQ ID NO: 2427509 - RNA, 19 nt, Human
aggcuggccaguccaggcu

SEQ ID NO: 2427510 - RNA, 18 nt, Human
aggcuggccaguccaggc

SEQ ID NO: 2427511 - RNA, 17 nt, Human
aggcuggccaguccagg

SEQ ID NO: 2427512 - RNA, 12 nt, Human
aggcuggcccug

SEQ ID NO: 2427513 - RNA, 14 nt, Human
aggcuggcccugcc

SEQ ID NO: 2427514 - RNA, 20 nt, Human
aggcuggcgcagccaaggcc

SEQ ID NO: 2427515 - RNA, 19 nt, Human
aggcuggcgcagccaaggc

SEQ ID NO: 2427516 - RNA, 17 nt, Human
aggcuggcgcagccaag

SEQ ID NO: 2427517 - RNA, 15 nt, Human
aggcuggcgcagcca

SEQ ID NO: 2427518 - RNA, 14 nt, Human
aggcuggcgcagcc

SEQ ID NO: 2427519 - RNA, 19 nt, Human
aggcuggcccugcccuggu

SEQ ID NO: 2427520 - RNA, 17 nt, Human
aggcuggcgugcagugg

SEQ ID NO: 2427521 - RNA, 13 nt, Human
aggcuggcgugca

SEQ ID NO: 2427522 - RNA, 20 nt, Human
aggcuggaguggaguggcgu

SEQ ID NO: 2427523 - RNA, 14 nt, Human
aggcuggcacagga

SEQ ID NO: 2427524 - RNA, 22 nt, Human
aggcuggauccuagccuuaucc

SEQ ID NO: 2427525 - RNA, 22 nt, Human
aggcuggauuuugaauuuucuu

SEQ ID NO: 2427526 - RNA, 16 nt, Human
aggcuggaggcagggc

SEQ ID NO: 2427527 - RNA, 17 nt, Human
aggcuggaggcagggcc

SEQ ID NO: 2427528 - RNA, 18 nt, Human
aggcuggaggcagggccu

SEQ ID NO: 2427529 - RNA, 19 nt, Human
aggcuggaggcagggccuu

SEQ ID NO: 2427530 - RNA, 20 nt, Human
aggcuggagugcaguggcgu

SEQ ID NO: 2427531 - RNA, 20 nt, Human
aggcuggagugcaguggcau

SEQ ID NO: 2427532 - RNA, 23 nt, Human
aggcuggaggcagggccuugccc

SEQ ID NO: 2427533 - RNA, 14 nt, Human
aggcuggagaagcu

SEQ ID NO: 2427534 - RNA, 13 nt, Human
aggcuggagaagc

SEQ ID NO: 2427535 - RNA, 20 nt, Human
aggcuggagaagcucaccca

SEQ ID NO: 2427536 - RNA, 13 nt, Human
aggcuggagccca

SEQ ID NO: 2427537 - RNA, 15 nt, Human
aggcuggagcccagg

SEQ ID NO: 2427538 - RNA, 18 nt, Human
aggcuggagcccagggag

SEQ ID NO: 2427539 - RNA, 12 nt, Human
aggcuggagcug

SEQ ID NO: 2427540 - RNA, 14 nt, Human
aggcuggagcuggc

SEQ ID NO: 2427541 - RNA, 17 nt, Human
aggcuggagcuggcguc

SEQ ID NO: 2427542 - RNA, 18 nt, Human
aggcuggagcuggcgucu

SEQ ID NO: 2427543 - RNA, 13 nt, Human
aggcuggaggcag

SEQ ID NO: 2427544 - RNA, 14 nt, Human
aggcuggaggcagg

SEQ ID NO: 2427545 - RNA, 15 nt, Human
aggcuggaggcaggg

SEQ ID NO: 2427546 - RNA, 16 nt, Human
aggcuggcacaggaca

SEQ ID NO: 2427547 - RNA, 17 nt, Human
aggcuggcacaggacau

SEQ ID NO: 2427548 - RNA, 18 nt, Human
aggcuggcacaggacaug

SEQ ID NO: 2427549 - RNA, 19 nt, Human
aggcuggcaccgccuucuc

SEQ ID NO: 2427550 - RNA, 20 nt, Human
aggcuggcaccgccuucucu

SEQ ID NO: 2427551 - RNA, 18 nt, Human
aggcuggcagcucuccag

SEQ ID NO: 2427552 - RNA, 17 nt, Human
aggcuggcagcucucca

SEQ ID NO: 2427553 - RNA, 16 nt, Human
aggcuggcagcucucc

SEQ ID NO: 2427554 - RNA, 15 nt, Human
aggcuggcagcucuc

SEQ ID NO: 2427555 - RNA, 20 nt, Human
aggcuggcagcucuccaguc

SEQ ID NO: 2427556 - RNA, 19 nt, Human
aggcuggcagcucuccagu

SEQ ID NO: 2427557 - RNA, 15 nt, Human
aggcuggcagguaug

SEQ ID NO: 2427558 - RNA, 21 nt, Human
aggcuggccagccccacagcc

SEQ ID NO: 2427559 - RNA, 20 nt, Human
aggcuggccagccccacagc

SEQ ID NO: 2427560 - RNA, 19 nt, Human
aggcuggccagccccacag

SEQ ID NO: 2427561 - RNA, 18 nt, Human
aggcuggccagccccaca

SEQ ID NO: 2427562 - RNA, 22 nt, Human
aggcuggccagccccacagccc

SEQ ID NO: 2427563 - RNA, 15 nt, Human
aggcuggccagucca

SEQ ID NO: 2427564 - RNA, 17 nt, Human
aggcuggccagccccac

SEQ ID NO: 2427565 - RNA, 16 nt, Human
aggcuggccagcccca

SEQ ID NO: 2427566 - RNA, 15 nt, Human
aggcuggccagcccc

SEQ ID NO: 2427567 - RNA, 14 nt, Human
aggcuggccagccc

SEQ ID NO: 2427568 - RNA, 13 nt, Human
aggcuggccagcc

SEQ ID NO: 2427569 - RNA, 21 nt, Human
aggcuggcagcucuccaguca

SEQ ID NO: 2427570 - RNA, 16 nt, Human
ugcuggaggugggagc

SEQ ID NO: 2427571 - RNA, 15 nt, Human
ugcuggaggugggag

SEQ ID NO: 2427572 - RNA, 14 nt, Human
ugcuggagguggga

SEQ ID NO: 2427573 - RNA, 13 nt, Human
ugcuggaggacug

SEQ ID NO: 2427574 - RNA, 23 nt, Human
ugcuggagccuguguaacagcuc

SEQ ID NO: 2427575 - RNA, 21 nt, Human
ugcuggaggugacaucucuua

SEQ ID NO: 2427576 - RNA, 12 nt, Human
ugcuggcccagg

SEQ ID NO: 2427577 - RNA, 13 nt, Human
ugcuggcccaggg

SEQ ID NO: 2427578 - RNA, 14 nt, Human
ugcuggcccagggc

SEQ ID NO: 2427579 - RNA, 16 nt, Human
ugcuggcccagggccc

SEQ ID NO: 2427580 - RNA, 17 nt, Human
ugcuggcccagggccca

SEQ ID NO: 2427581 - RNA, 18 nt, Human
ugcuggcccagggcccag

SEQ ID NO: 2427582 - RNA, 19 nt, Human
ugcuggcccagggcccaga

SEQ ID NO: 2427583 - RNA, 20 nt, Human
ugcuggcccagggcccagag

SEQ ID NO: 2427584 - RNA, 21 nt, Human
ugcuggcccagggcccagagc

SEQ ID NO: 2427585 - RNA, 22 nt, Human
ugcuggcccagggcccagagcc

SEQ ID NO: 2427586 - RNA, 23 nt, Human
ugcuggcccagggcccagagccc

SEQ ID NO: 2427587 - RNA, 21 nt, Human
ugcuggcugccuuagaaccuu

SEQ ID NO: 2427588 - RNA, 12 nt, Human
ugcuggccccuc

SEQ ID NO: 2427589 - RNA, 13 nt, Human
ugcuggccccuca

SEQ ID NO: 2427590 - RNA, 16 nt, Human
ugcuggcuggaaggga

SEQ ID NO: 2427591 - RNA, 15 nt, Human
ugcuggccccucacc

SEQ ID NO: 2427592 - RNA, 14 nt, Human
ugcuggcugccuua

SEQ ID NO: 2427593 - RNA, 15 nt, Human
ugcuggcugccuuag

SEQ ID NO: 2427594 - RNA, 16 nt, Human
ugcuggcugguuagag

SEQ ID NO: 2427595 - RNA, 18 nt, Human
ugcuggcuguuggcuggg

SEQ ID NO: 2427596 - RNA, 14 nt, Human
ugcugcccugugag

SEQ ID NO: 2427597 - RNA, 13 nt, Human
ugcugcccuguga

SEQ ID NO: 2427598 - RNA, 12 nt, Human
ugcugcccugug

SEQ ID NO: 2427599 - RNA, 13 nt, Human
ugcuggagcucug

SEQ ID NO: 2427600 - RNA, 14 nt, Human
ugcuggagcucugc

SEQ ID NO: 2427601 - RNA, 15 nt, Human
ugcugcccugugagu

SEQ ID NO: 2427602 - RNA, 22 nt, Human
ugcuggagccuguguaacagcu

SEQ ID NO: 2427603 - RNA, 21 nt, Human
ugcuggagccuguguaacagc

SEQ ID NO: 2427604 - RNA, 19 nt, Human
ugcugccgccccacccaga

SEQ ID NO: 2427605 - RNA, 20 nt, Human
ugcugggaggagggagaggg

SEQ ID NO: 2427606 - RNA, 18 nt, Human
ugcuguaacuuucugaaa

SEQ ID NO: 2427607 - RNA, 15 nt, Human
ugcuguacaucuauu

SEQ ID NO: 2427608 - RNA, 16 nt, Human
ugcuguacaucuauuu

SEQ ID NO: 2427609 - RNA, 17 nt, Human
ugcuguacaucuauuuu

SEQ ID NO: 2427610 - RNA, 21 nt, Human
ugcuguacaucuauuuuggau

SEQ ID NO: 2427611 - RNA, 18 nt, Human
ugcugggaggagggagag

SEQ ID NO: 2427612 - RNA, 17 nt, Human
ugcugggaggagggaga

SEQ ID NO: 2427613 - RNA, 21 nt, Human
ugcugggagcugaaaaaucac

SEQ ID NO: 2427614 - RNA, 18 nt, Human
ugcugggagcugaaaaau

SEQ ID NO: 2427615 - RNA, 14 nt, Human
ugcugggagcugaa

SEQ ID NO: 2427616 - RNA, 23 nt, Human
ugcugggagcuccacucugcuuc

SEQ ID NO: 2427617 - RNA, 22 nt, Human
ugcugggagcuccacucugcuu

SEQ ID NO: 2427618 - RNA, 21 nt, Human
ugcugggagcuccacucugcu

SEQ ID NO: 2427619 - RNA, 20 nt, Human
ugcugggagcuccacucugc

SEQ ID NO: 2427620 - RNA, 18 nt, Human
ugcugggagcuccacucu

SEQ ID NO: 2427621 - RNA, 17 nt, Human
ugcugggagcuccacuc

SEQ ID NO: 2427622 - RNA, 16 nt, Human
ugcugggagcuccacu

SEQ ID NO: 2427623 - RNA, 15 nt, Human
ugcugggagcuccac

SEQ ID NO: 2427624 - RNA, 20 nt, Human
ugcugggacugagccagucc

SEQ ID NO: 2427625 - RNA, 17 nt, Human
ugcugggacugagccag

SEQ ID NO: 2427626 - RNA, 16 nt, Human
ugcugggacugagcca

SEQ ID NO: 2427627 - RNA, 21 nt, Human
ugcuggcuggaagggaggagc

SEQ ID NO: 2427628 - RNA, 15 nt, Human
ugcugggacugagcc

SEQ ID NO: 2427629 - RNA, 15 nt, Human
ugcugggacuggcca

SEQ ID NO: 2427630 - RNA, 17 nt, Human
ugcugggacuggccagg

SEQ ID NO: 2427631 - RNA, 17 nt, Human
ugcugucccucccccuu

SEQ ID NO: 2427632 - RNA, 16 nt, Human
ugcugucccucccccu

SEQ ID NO: 2427633 - RNA, 13 nt, Human
ugcugucccuccc

SEQ ID NO: 2427634 - RNA, 12 nt, Human
ugcugucccucc

SEQ ID NO: 2427635 - RNA, 20 nt, Human
ugcuguccccucuugcccca

SEQ ID NO: 2427636 - RNA, 17 nt, Human
ugcuguccccucuugcc

SEQ ID NO: 2427637 - RNA, 15 nt, Human
ugcuguccccucuug

SEQ ID NO: 2427638 - RNA, 13 nt, Human
ugcuguccccucu

SEQ ID NO: 2427639 - RNA, 21 nt, Human
ugcuguccagacagccuguau

SEQ ID NO: 2427640 - RNA, 19 nt, Human
ugcuguccagacagccugu

SEQ ID NO: 2427641 - RNA, 10 nt, Human
ugcugucccc

SEQ ID NO: 2427642 - RNA, 15 nt, Human
ugcuguccagacagc

SEQ ID NO: 2427643 - RNA, 21 nt, Human
ugcuguacuagagaucugguu

SEQ ID NO: 2427644 - RNA, 19 nt, Human
ugcuguacuagagaucugg

SEQ ID NO: 2427645 - RNA, 14 nt, Human
ugcuguacuagaga

SEQ ID NO: 2427646 - RNA, 20 nt, Human
ugcugucaaguuccuuuggg

SEQ ID NO: 2427647 - RNA, 14 nt, Human
ugcuguccuaggcc

SEQ ID NO: 2427648 - RNA, 21 nt, Human
ugcuguccccucuugccccaa

SEQ ID NO: 2427649 - RNA, 16 nt, Human
ugcuguccuaggccac

SEQ ID NO: 2427650 - RNA, 23 nt, Human
ugcuguccuaggccacaccaucu

SEQ ID NO: 2427651 - RNA, 12 nt, Human
ugcuguccucag

SEQ ID NO: 2427652 - RNA, 18 nt, Human
ugcuguccucagguggcc

SEQ ID NO: 2427653 - RNA, 14 nt, Human
ugcuguccucaggu

SEQ ID NO: 2427654 - RNA, 19 nt, Human
ugcugucugaucugugcuu

SEQ ID NO: 2427655 - RNA, 14 nt, Human
ugcugucuaugugg

SEQ ID NO: 2427656 - RNA, 18 nt, Human
ugcugucuaaccugugac

SEQ ID NO: 2427657 - RNA, 17 nt, Human
ugcugucuaaccuguga

SEQ ID NO: 2427658 - RNA, 19 nt, Human
ugcuguccucagguggcca

SEQ ID NO: 2427659 - RNA, 21 nt, Human
ugcuguccucagguggccaug

SEQ ID NO: 2427660 - RNA, 19 nt, Human
aggacacuaaccacgcugg

SEQ ID NO: 2427661 - RNA, 23 nt, Human
aggacacuaaccacgcuggaccu

SEQ ID NO: 2427662 - RNA, 14 nt, Human
aggacacugauaug

SEQ ID NO: 2427663 - RNA, 20 nt, Human
ugcuucauaaaugaagcagc

SEQ ID NO: 2427664 - RNA, 18 nt, Human
ugcuucauaaaugaagca

SEQ ID NO: 2427665 - RNA, 11 nt, Human
ugcuucauaca

SEQ ID NO: 2427666 - RNA, 14 nt, Human
ugcuucauacaggg

SEQ ID NO: 2427667 - RNA, 15 nt, Human
ugcuucauacaggga

SEQ ID NO: 2427668 - RNA, 16 nt, Human
ugcuucauacagggau

SEQ ID NO: 2427669 - RNA, 12 nt, Human
ugcuucagccug

SEQ ID NO: 2427670 - RNA, 14 nt, Human
ugcuucagccugag

SEQ ID NO: 2427671 - RNA, 15 nt, Human
ugcuucagccugagg

SEQ ID NO: 2427672 - RNA, 17 nt, Human
ugcuucagccugaggcu

SEQ ID NO: 2427673 - RNA, 22 nt, Human
ugcuucagccugaggcugagac

SEQ ID NO: 2427674 - RNA, 23 nt, Human
ugcuucagccugaggcugagacu

SEQ ID NO: 2427675 - RNA, 18 nt, Human
ugcuucaguggagaauua

SEQ ID NO: 2427676 - RNA, 16 nt, Human
ugcuucaguggagaau

SEQ ID NO: 2427677 - RNA, 15 nt, Human
aggacagcuguccuc

SEQ ID NO: 2427678 - RNA, 13 nt, Human
aggacagcugucc

SEQ ID NO: 2427679 - RNA, 22 nt, Human
aggacagccuguggcggugccu

SEQ ID NO: 2427680 - RNA, 12 nt, Human
aggacagcuguc

SEQ ID NO: 2427681 - RNA, 23 nt, Human
aggacagccuguggcggugccug

SEQ ID NO: 2427682 - RNA, 18 nt, Human
aggacaggaccagauuuu

SEQ ID NO: 2427683 - RNA, 12 nt, Human
aggacaggcccg

SEQ ID NO: 2427684 - RNA, 22 nt, Human
aggacagggaggugaccccagg

SEQ ID NO: 2427685 - RNA, 20 nt, Human
aggacaugcgguagccagca

SEQ ID NO: 2427686 - RNA, 22 nt, Human
aggacaugcgguagccagcaca

SEQ ID NO: 2427687 - RNA, 17 nt, Human
aggacaugcugaagcca

SEQ ID NO: 2427688 - RNA, 18 nt, Human
aggacaugaaacuccacc

SEQ ID NO: 2427689 - RNA, 13 nt, Human
aggacaugaaacu

SEQ ID NO: 2427690 - RNA, 20 nt, Human
aggacauaaugggguccugg

SEQ ID NO: 2427691 - RNA, 21 nt, Human
aggacaugauggagcgcaccu

SEQ ID NO: 2427692 - RNA, 24 nt, Human
aggacauaaugggguccuggccau

SEQ ID NO: 2427693 - RNA, 20 nt, Human
aggacauccccccgccaaaa

SEQ ID NO: 2427694 - RNA, 19 nt, Human
ugcuucaaggauccugagc

SEQ ID NO: 2427695 - RNA, 18 nt, Human
ugcuucaaggauccugag

SEQ ID NO: 2427696 - RNA, 16 nt, Human
ugcuucaaggauccug

SEQ ID NO: 2427697 - RNA, 22 nt, Human
ugcuuaugcaguuuuucagagu

SEQ ID NO: 2427698 - RNA, 12 nt, Human
ugcuucaaggau

SEQ ID NO: 2427699 - RNA, 16 nt, Human
ugcuucacuucuccca

SEQ ID NO: 2427700 - RNA, 14 nt, Human
ugcuucagccuccc

SEQ ID NO: 2427701 - RNA, 13 nt, Human
ugcuucagccucc

SEQ ID NO: 2427702 - RNA, 17 nt, Human
ugcuuauagguggccuc

SEQ ID NO: 2427703 - RNA, 20 nt, Human
ugcuuaguccaauuccuugc

SEQ ID NO: 2427704 - RNA, 21 nt, Human
ugcuuaugacaucacuuguac

SEQ ID NO: 2427705 - RNA, 18 nt, Human
ugcuuauagguggccucu

SEQ ID NO: 2427706 - RNA, 13 nt, Human
ugcuuauacacuu

SEQ ID NO: 2427707 - RNA, 19 nt, Human
ugcugugaggcuguccugu

SEQ ID NO: 2427708 - RNA, 18 nt, Human
ugcugugaggcuguccug

SEQ ID NO: 2427709 - RNA, 17 nt, Human
ugcugugaggcuguccu

SEQ ID NO: 2427710 - RNA, 16 nt, Human
ugcugugaggcugucc

SEQ ID NO: 2427711 - RNA, 23 nt, Human
ugcuuagucacuuauuucauaaa

SEQ ID NO: 2427712 - RNA, 21 nt, Human
ugcuuagucacuuauuucaua

SEQ ID NO: 2427713 - RNA, 20 nt, Human
ugcuuaguguacuuggagua

SEQ ID NO: 2427714 - RNA, 19 nt, Human
ugcuuagucacugccugca

SEQ ID NO: 2427715 - RNA, 18 nt, Human
ugcuuagucacugccugc

SEQ ID NO: 2427716 - RNA, 12 nt, Human
ugcugugaaaaa

SEQ ID NO: 2427717 - RNA, 13 nt, Human
ugcugugaaaaaa

SEQ ID NO: 2427718 - RNA, 14 nt, Human
ugcugugaggcugu

SEQ ID NO: 2427719 - RNA, 13 nt, Human
ugcugugaggcug

SEQ ID NO: 2427720 - RNA, 21 nt, Human
ugcugugaauuuguguaagga

SEQ ID NO: 2427721 - RNA, 19 nt, Human
ugcugugaauuagcucacu

SEQ ID NO: 2427722 - RNA, 18 nt, Human
ugcugugaauuagcucac

SEQ ID NO: 2427723 - RNA, 14 nt, Human
ugcugugaaaaaaa

SEQ ID NO: 2427724 - RNA, 22 nt, Human
ugcugugaaaaaaaaaaugcug

SEQ ID NO: 2427725 - RNA, 23 nt, Human
aggaauugacccacaagaaauga

SEQ ID NO: 2427726 - RNA, 11 nt, Human
aggaauuuaaa

SEQ ID NO: 2427727 - RNA, 22 nt, Human
aggaauuucaccuguaaaccug

SEQ ID NO: 2427728 - RNA, 15 nt, Human
aggaauuucccagga

SEQ ID NO: 2427729 - RNA, 17 nt, Human
aggaauuucccaggacc

SEQ ID NO: 2427730 - RNA, 18 nt, Human
aggaauuucccaggaccc

SEQ ID NO: 2427731 - RNA, 19 nt, Human
aggaauuucccaggacccu

SEQ ID NO: 2427732 - RNA, 20 nt, Human
aggaauuucccaggacccug

SEQ ID NO: 2427733 - RNA, 21 nt, Human
aggaauuucccaggacccuga

SEQ ID NO: 2427734 - RNA, 23 nt, Human
aggaauuguguuuauaauuuuaa

SEQ ID NO: 2427735 - RNA, 18 nt, Human
aggaauuucaccuguaaa

SEQ ID NO: 2427736 - RNA, 12 nt, Human
aggaauugacuu

SEQ ID NO: 2427737 - RNA, 19 nt, Human
aggaaggaaacccagcucu

SEQ ID NO: 2427738 - RNA, 23 nt, Human
aggaaggagacucaccucugccu

SEQ ID NO: 2427739 - RNA, 15 nt, Human
aggaaggagagccug

SEQ ID NO: 2427740 - RNA, 17 nt, Human
aggaaggagagccugcu

SEQ ID NO: 2427741 - RNA, 15 nt, Human
aggaaggagaggaga

SEQ ID NO: 2427742 - RNA, 21 nt, Human
aggaaggagagaaggggagga

SEQ ID NO: 2427743 - RNA, 18 nt, Human
aggaaggagagccugcug

SEQ ID NO: 2427744 - RNA, 20 nt, Human
aggaagcagaauaaagcaau

SEQ ID NO: 2427745 - RNA, 17 nt, Human
aggaagcugcuccgugc

SEQ ID NO: 2427746 - RNA, 17 nt, Human
aggaagccagcaggcuc

SEQ ID NO: 2427747 - RNA, 18 nt, Human
aggaaggaaacccagcuc

SEQ ID NO: 2427748 - RNA, 19 nt, Human
aggaagacuucaucccucu

SEQ ID NO: 2427749 - RNA, 13 nt, Human
aggaagacuucau

SEQ ID NO: 2427750 - RNA, 23 nt, Human
ugcugagucugaaggcuggguuc

SEQ ID NO: 2427751 - RNA, 22 nt, Human
ugcugagucugaaggcuggguu

SEQ ID NO: 2427752 - RNA, 21 nt, Human
ugcugagucugaaggcugggu

SEQ ID NO: 2427753 - RNA, 18 nt, Human
ugcugagucugaaggcug

SEQ ID NO: 2427754 - RNA, 17 nt, Human
ugcugagucugaaggcu

SEQ ID NO: 2427755 - RNA, 16 nt, Human
ugcugagucugaaggc

SEQ ID NO: 2427756 - RNA, 24 nt, Human
aggaagcacaugccucucucaggc

SEQ ID NO: 2427757 - RNA, 23 nt, Human
aggaagcacaugccucucucagg

SEQ ID NO: 2427758 - RNA, 14 nt, Human
aggaagacuuugga

SEQ ID NO: 2427759 - RNA, 13 nt, Human
aggaagacuuugg

SEQ ID NO: 2427760 - RNA, 15 nt, Human
aggaagccagcaggc

SEQ ID NO: 2427761 - RNA, 14 nt, Human
aggaagccagcagg

SEQ ID NO: 2427762 - RNA, 19 nt, Human
aggaagcagaauaaagcaa

SEQ ID NO: 2427763 - RNA, 18 nt, Human
aggaagcagaauaaagca

SEQ ID NO: 2427764 - RNA, 17 nt, Human
aggaagcagaauaaagc

SEQ ID NO: 2427765 - RNA, 16 nt, Human
aggaagcagaauaaag

SEQ ID NO: 2427766 - RNA, 15 nt, Human
aggaagcagaauaaa

SEQ ID NO: 2427767 - RNA, 14 nt, Human
aggaagcagaauaa

SEQ ID NO: 2427768 - RNA, 13 nt, Human
aggaagcagaaua

SEQ ID NO: 2427769 - RNA, 12 nt, Human
aggaagcagaau

SEQ ID NO: 2427770 - RNA, 11 nt, Human
aggaagcagaa

SEQ ID NO: 2427771 - RNA, 18 nt, Human
aggaagcaccccaugcca

SEQ ID NO: 2427772 - RNA, 18 nt, Human
agcugggacuacaggcac

SEQ ID NO: 2427773 - RNA, 16 nt, Human
agcugggacuacaggc

SEQ ID NO: 2427774 - RNA, 19 nt, Human
agcugggacuacaggcacc

SEQ ID NO: 2427775 - RNA, 18 nt, Human
ugcuauuguagagccaga

SEQ ID NO: 2427776 - RNA, 22 nt, Human
ugcuauuguagagccagagguc

SEQ ID NO: 2427777 - RNA, 15 nt, Human
ugcuccaccacaucc

SEQ ID NO: 2427778 - RNA, 14 nt, Human
ugcuccaccacauc

SEQ ID NO: 2427779 - RNA, 16 nt, Human
ugcuccagccuggcuc

SEQ ID NO: 2427780 - RNA, 15 nt, Human
ugcuccagccuggcu

SEQ ID NO: 2427781 - RNA, 17 nt, Human
ugcuccagccuggcucc

SEQ ID NO: 2427782 - RNA, 15 nt, Human
ugcucccagcagccc

SEQ ID NO: 2427783 - RNA, 14 nt, Human
ugcucccagcagcc

SEQ ID NO: 2427784 - RNA, 13 nt, Human
ugcucccagcagc

SEQ ID NO: 2427785 - RNA, 16 nt, Human
ugcuccagcuguucag

SEQ ID NO: 2427786 - RNA, 19 nt, Human
ugcuccagcuguucagcug

SEQ ID NO: 2427787 - RNA, 12 nt, Human
ugcuccagaccu

SEQ ID NO: 2427788 - RNA, 14 nt, Human
ugcuccagaccuga

SEQ ID NO: 2427789 - RNA, 21 nt, Human
ugcuccagaccugauccugga

SEQ ID NO: 2427790 - RNA, 15 nt, Human
ugcuccagccaaccc

SEQ ID NO: 2427791 - RNA, 17 nt, Human
ugcuccagccaaccccu

SEQ ID NO: 2427792 - RNA, 18 nt, Human
ugcuccagccaaccccug

SEQ ID NO: 2427793 - RNA, 20 nt, Human
ugcuccagccaaccccugug

SEQ ID NO: 2427794 - RNA, 23 nt, Human
ugcuccagccaaccccuguggag

SEQ ID NO: 2427795 - RNA, 14 nt, Human
ugcuccagccuggc

SEQ ID NO: 2427796 - RNA, 22 nt, Human
ugcuccagccaaccccugugga

SEQ ID NO: 2427797 - RNA, 22 nt, Human
ugcuccacccuuggccugucuc

SEQ ID NO: 2427798 - RNA, 23 nt, Human
ugcuccacccuuggccugucuca

SEQ ID NO: 2427799 - RNA, 16 nt, Human
ugcuccacccuuggcc

SEQ ID NO: 2427800 - RNA, 17 nt, Human
ugcuccacccuuggccu

SEQ ID NO: 2427801 - RNA, 18 nt, Human
ugcuccacccuuggccug

SEQ ID NO: 2427802 - RNA, 19 nt, Human
ugcuccacccuuggccugu

SEQ ID NO: 2427803 - RNA, 23 nt, Human
ugcuccccagcccuggcucugca

SEQ ID NO: 2427804 - RNA, 22 nt, Human
ugcuccccagcccuggcucugc

SEQ ID NO: 2427805 - RNA, 18 nt, Human
ugcuccccagcccuggcu

SEQ ID NO: 2427806 - RNA, 17 nt, Human
ugcuccccagcccuggc

SEQ ID NO: 2427807 - RNA, 16 nt, Human
ugcuccccagcccugg

SEQ ID NO: 2427808 - RNA, 21 nt, Human
ugcucccagcagcccuaagga

SEQ ID NO: 2427809 - RNA, 20 nt, Human
ugcucccagcagcccuaagg

SEQ ID NO: 2427810 - RNA, 17 nt, Human
ugcucccagcagcccua

SEQ ID NO: 2427811 - RNA, 17 nt, Human
ugcucccugaagccagc

SEQ ID NO: 2427812 - RNA, 15 nt, Human
ugcucccugaagcca

SEQ ID NO: 2427813 - RNA, 14 nt, Human
ugcucccugaagcc

SEQ ID NO: 2427814 - RNA, 13 nt, Human
ugcucccugaagc

SEQ ID NO: 2427815 - RNA, 13 nt, Human
ugcucccccaucc

SEQ ID NO: 2427816 - RNA, 20 nt, Human
ugcucccuccccugcccugg

SEQ ID NO: 2427817 - RNA, 14 nt, Human
ugcucccccacccc

SEQ ID NO: 2427818 - RNA, 16 nt, Human
ugcucccccacccccu

SEQ ID NO: 2427819 - RNA, 21 nt, Human
ugcucccccacccccucccca

SEQ ID NO: 2427820 - RNA, 23 nt, Human
ugcucccccacccccuccccagg

SEQ ID NO: 2427821 - RNA, 15 nt, Human
ugcucccccauccuc

SEQ ID NO: 2427822 - RNA, 19 nt, Human
ugcucccuccccugcccug

SEQ ID NO: 2427823 - RNA, 21 nt, Human
ugcucccugaagccagccuuc

SEQ ID NO: 2427824 - RNA, 20 nt, Human
ugcucccugaagccagccuu

SEQ ID NO: 2427825 - RNA, 19 nt, Human
ugcucccugaagccagccu

SEQ ID NO: 2427826 - RNA, 18 nt, Human
ugcucccugaagccagcc

SEQ ID NO: 2427827 - RNA, 22 nt, Human
ugcucccugaagccagccuucu

SEQ ID NO: 2427828 - RNA, 18 nt, Human
ugcucccugguucugaug

SEQ ID NO: 2427829 - RNA, 18 nt, Human
ugcuccgccucugcuggc

SEQ ID NO: 2427830 - RNA, 22 nt, Human
ugcucugcugacagacacaggc

SEQ ID NO: 2427831 - RNA, 21 nt, Human
ugcucugcugacagacacagg

SEQ ID NO: 2427832 - RNA, 22 nt, Human
ugcugacggccagggagaagcu

SEQ ID NO: 2427833 - RNA, 14 nt, Human
ugcugacggccagg

SEQ ID NO: 2427834 - RNA, 15 nt, Human
ugcugacggccaggg

SEQ ID NO: 2427835 - RNA, 17 nt, Human
ugcugacggccagggag

SEQ ID NO: 2427836 - RNA, 20 nt, Human
ugcugacggccagggagaag

SEQ ID NO: 2427837 - RNA, 14 nt, Human
ugcugagucugaag

SEQ ID NO: 2427838 - RNA, 15 nt, Human
ugcugagucugaagg

SEQ ID NO: 2427839 - RNA, 23 nt, Human
ugcucuggaaaaugugacccaga

SEQ ID NO: 2427840 - RNA, 19 nt, Human
ugcucuggaaaaugugacc

SEQ ID NO: 2427841 - RNA, 15 nt, Human
ugcugacccuccugu

SEQ ID NO: 2427842 - RNA, 15 nt, Human
ugcugaccuccacag

SEQ ID NO: 2427843 - RNA, 16 nt, Human
ugcugaccuccacagc

SEQ ID NO: 2427844 - RNA, 16 nt, Human
ugcucugcugacagac

SEQ ID NO: 2427845 - RNA, 13 nt, Human
ugcuccgugccuc

SEQ ID NO: 2427846 - RNA, 18 nt, Human
ugcugacauucaccugcc

SEQ ID NO: 2427847 - RNA, 16 nt, Human
ugcucugcuugacaac

SEQ ID NO: 2427848 - RNA, 21 nt, Human
ugcucugcuugacaacaucug

SEQ ID NO: 2427849 - RNA, 13 nt, Human
aggagggagaggg

SEQ ID NO: 2427850 - RNA, 12 nt, Human
aggagggagagg

SEQ ID NO: 2427851 - RNA, 23 nt, Human
aggagggagacacuggccccuca

SEQ ID NO: 2427852 - RNA, 16 nt, Human
aggagggagacacugg

SEQ ID NO: 2427853 - RNA, 13 nt, Human
aggaggccaccuc

SEQ ID NO: 2427854 - RNA, 13 nt, Human
aggaggcuggcuu

SEQ ID NO: 2427855 - RNA, 12 nt, Human
aggaggccaccu

SEQ ID NO: 2427856 - RNA, 20 nt, Human
aggaggcuuggaaagcauca

SEQ ID NO: 2427857 - RNA, 14 nt, Human
aggaggcaggaccu

SEQ ID NO: 2427858 - RNA, 20 nt, Human
aggaggcagcuguugcagug

SEQ ID NO: 2427859 - RNA, 13 nt, Human
aggagcugcuaua

SEQ ID NO: 2427860 - RNA, 19 nt, Human
aggagcugcuauagccugg

SEQ ID NO: 2427861 - RNA, 20 nt, Human
aggagcugcuauagccuggg

SEQ ID NO: 2427862 - RNA, 21 nt, Human
aggagcugcuauagccugggg

SEQ ID NO: 2427863 - RNA, 12 nt, Human
aggagcugcugg

SEQ ID NO: 2427864 - RNA, 13 nt, Human
aggagcugcuggc

SEQ ID NO: 2427865 - RNA, 12 nt, Human
aggaggaggagg

SEQ ID NO: 2427866 - RNA, 14 nt, Human
aggagcugcuggcu

SEQ ID NO: 2427867 - RNA, 16 nt, Human
aggagcugcuggcuug

SEQ ID NO: 2427868 - RNA, 22 nt, Human
aggaggaugggcucgcccacca

SEQ ID NO: 2427869 - RNA, 15 nt, Human
aggaggaugggcucg

SEQ ID NO: 2427870 - RNA, 14 nt, Human
aggaggaugggcuc

SEQ ID NO: 2427871 - RNA, 18 nt, Human
aggaggaggugccaacag

SEQ ID NO: 2427872 - RNA, 23 nt, Human
aggaggaggcaauugggauggcg

SEQ ID NO: 2427873 - RNA, 21 nt, Human
aggaggagguuuaggucaaga

SEQ ID NO: 2427874 - RNA, 20 nt, Human
aggaggauugcuugagccca

SEQ ID NO: 2427875 - RNA, 21 nt, Human
aggaggauugcuugagcccag

SEQ ID NO: 2427876 - RNA, 23 nt, Human
aggaggauugcuugagcccagga

SEQ ID NO: 2427877 - RNA, 17 nt, Human
uggaaauucccuucauc

SEQ ID NO: 2427878 - RNA, 22 nt, Human
uggaaauucccuucaucuggaa

SEQ ID NO: 2427879 - RNA, 21 nt, Human
aggagcugcccagaguugcug

SEQ ID NO: 2427880 - RNA, 14 nt, Human
aggagcugcccaga

SEQ ID NO: 2427881 - RNA, 16 nt, Human
uggaaauugacgaggg

SEQ ID NO: 2427882 - RNA, 18 nt, Human
uggaaauucccuucaucu

SEQ ID NO: 2427883 - RNA, 18 nt, Human
aggagcugccuuggcuca

SEQ ID NO: 2427884 - RNA, 19 nt, Human
aggagcugccuuggcucag

SEQ ID NO: 2427885 - RNA, 11 nt, Human
aggagcugcua

SEQ ID NO: 2427886 - RNA, 23 nt, Human
aggagcugccuuggcucagacau

SEQ ID NO: 2427887 - RNA, 21 nt, Human
aggagcugccuuggcucagac

SEQ ID NO: 2427888 - RNA, 22 nt, Human
aggagcugccuuggcucagaca

SEQ ID NO: 2427889 - RNA, 20 nt, Human
uggaaauauuaagaaagacu

SEQ ID NO: 2427890 - RNA, 22 nt, Human
uggaaauaucaguuacucagcc

SEQ ID NO: 2427891 - RNA, 23 nt, Human
uggaaauauucaugcuucuuccu

SEQ ID NO: 2427892 - RNA, 23 nt, Human
uggaaaugggcagagcagagacc

SEQ ID NO: 2427893 - RNA, 18 nt, Human
uggaaauuaagaagaaac

SEQ ID NO: 2427894 - RNA, 20 nt, Human
uggaaauuaagaagaaacua

SEQ ID NO: 2427895 - RNA, 17 nt, Human
aggaugaucuaggaaga

SEQ ID NO: 2427896 - RNA, 16 nt, Human
aggaugaucuaggaag

SEQ ID NO: 2427897 - RNA, 20 nt, Human
aggaugagcucuacccaggg

SEQ ID NO: 2427898 - RNA, 18 nt, Human
aggaucuuuguggccaag

SEQ ID NO: 2427899 - RNA, 20 nt, Human
aggaucuuuguggccaagga

SEQ ID NO: 2427900 - RNA, 16 nt, Human
aggaugagcuggaagg

SEQ ID NO: 2427901 - RNA, 15 nt, Human
aggaugagcuggaag

SEQ ID NO: 2427902 - RNA, 13 nt, Human
aggaugagcugga

SEQ ID NO: 2427903 - RNA, 13 nt, Human
aggaucuuugugg

SEQ ID NO: 2427904 - RNA, 15 nt, Human
aggaucuuuguggcc

SEQ ID NO: 2427905 - RNA, 16 nt, Human
aggaucuuuguggcca

SEQ ID NO: 2427906 - RNA, 17 nt, Human
aggaucuuuguggccaa

SEQ ID NO: 2427907 - RNA, 14 nt, Human
aggaucuggagaac

SEQ ID NO: 2427908 - RNA, 20 nt, Human
aggaucuguuuuuaaaaauc

SEQ ID NO: 2427909 - RNA, 23 nt, Human
aggaucuguuuuuaaaaaucaua

SEQ ID NO: 2427910 - RNA, 18 nt, Human
aggauccugagccagauu

SEQ ID NO: 2427911 - RNA, 17 nt, Human
aggauccugagccagau

SEQ ID NO: 2427912 - RNA, 21 nt, Human
aggaucucuugagccugggag

SEQ ID NO: 2427913 - RNA, 22 nt, Human
aggaucucuugagccugggagg

SEQ ID NO: 2427914 - RNA, 14 nt, Human
aggagggaggggga

SEQ ID NO: 2427915 - RNA, 15 nt, Human
aggagggagagggag

SEQ ID NO: 2427916 - RNA, 14 nt, Human
aggagggagaggga

SEQ ID NO: 2427917 - RNA, 21 nt, Human
aggagggagcaucagugcccu

SEQ ID NO: 2427918 - RNA, 16 nt, Human
aggauccugagccaga

SEQ ID NO: 2427919 - RNA, 15 nt, Human
aggauccugagccag

SEQ ID NO: 2427920 - RNA, 21 nt, Human
aggauacaaaagcaugugaga

SEQ ID NO: 2427921 - RNA, 12 nt, Human
aggauaaaauaa

SEQ ID NO: 2427922 - RNA, 17 nt, Human
aggauuuuaugcuuuaa

SEQ ID NO: 2427923 - RNA, 17 nt, Human
aggaugcuaaaccuuag

SEQ ID NO: 2427924 - RNA, 19 nt, Human
aggaugcuaacaucuaaaa

SEQ ID NO: 2427925 - RNA, 15 nt, Human
aggauuuuuaucuuu

SEQ ID NO: 2427926 - RNA, 20 nt, Human
aggauuuuaugcuuuaaaca

SEQ ID NO: 2427927 - RNA, 17 nt, Human
aggauuuuuuucugagc

SEQ ID NO: 2427928 - RNA, 16 nt, Human
aggauuuuuuucugag

SEQ ID NO: 2427929 - RNA, 15 nt, Human
aggcaaaaauguaaa

SEQ ID NO: 2427930 - RNA, 17 nt, Human
aggaugcuaacaucuaa

SEQ ID NO: 2427931 - RNA, 16 nt, Human
aggaugcuaacaucua

SEQ ID NO: 2427932 - RNA, 17 nt, Human
aggaugccccguccccc

SEQ ID NO: 2427933 - RNA, 19 nt, Human
aggauuuugauccaagcug

SEQ ID NO: 2427934 - RNA, 14 nt, Human
aggaugcccaaaga

SEQ ID NO: 2427935 - RNA, 20 nt, Human
aggaugaucuaggaagacuu

SEQ ID NO: 2427936 - RNA, 19 nt, Human
aggaugcccaaagaugcag

SEQ ID NO: 2427937 - RNA, 23 nt, Human
aggaugaggccgcuagaggccug

SEQ ID NO: 2427938 - RNA, 21 nt, Human
aggaugaggccgcuagaggcc

SEQ ID NO: 2427939 - RNA, 19 nt, Human
aggaugcagagucagcaga

SEQ ID NO: 2427940 - RNA, 13 nt, Human
aggaugcccaggg

SEQ ID NO: 2427941 - RNA, 14 nt, Human
aggaugcccagggc

SEQ ID NO: 2427942 - RNA, 22 nt, Human
aggaugcccagggccacucugc

SEQ ID NO: 2427943 - RNA, 17 nt, Human
aggcaaaauccuugcuu

SEQ ID NO: 2427944 - RNA, 19 nt, Human
aggcaaaauccuugcuuau

SEQ ID NO: 2427945 - RNA, 13 nt, Human
aggcaaaauugca

SEQ ID NO: 2427946 - RNA, 14 nt, Human
aggcaaauguguac

SEQ ID NO: 2427947 - RNA, 17 nt, Human
aggcaaauguguacaug

SEQ ID NO: 2427948 - RNA, 16 nt, Human
aggcaacauccaaaau

SEQ ID NO: 2427949 - RNA, 17 nt, Human
aggcaacucaucuuagg

SEQ ID NO: 2427950 - RNA, 14 nt, Human
aggcaacugaggca

SEQ ID NO: 2427951 - RNA, 15 nt, Human
aggcaacugaggcag

SEQ ID NO: 2427952 - RNA, 16 nt, Human
aggcaacugaggcaga

SEQ ID NO: 2427953 - RNA, 22 nt, Human
uggaauuucucccagucauuua

SEQ ID NO: 2427954 - RNA, 22 nt, Human
uggaauuggguggggggcuuca

SEQ ID NO: 2427955 - RNA, 17 nt, Human
uggaauugggagcuugg

SEQ ID NO: 2427956 - RNA, 18 nt, Human
uggaauuggagcucgugg

SEQ ID NO: 2427957 - RNA, 23 nt, Human
uggaauugauuugcauugaacac

SEQ ID NO: 2427958 - RNA, 17 nt, Human
aggcaacugaggcagac

SEQ ID NO: 2427959 - RNA, 19 nt, Human
aggcaacugaggcagacag

SEQ ID NO: 2427960 - RNA, 13 nt, Human
uggacccugaggc

SEQ ID NO: 2427961 - RNA, 12 nt, Human
uggacccugagg

SEQ ID NO: 2427962 - RNA, 14 nt, Human
uggacccugaggcc

SEQ ID NO: 2427963 - RNA, 16 nt, Human
uggacccuguugcuaa

SEQ ID NO: 2427964 - RNA, 21 nt, Human
uggaccuaaauggccucaugu

SEQ ID NO: 2427965 - RNA, 18 nt, Human
uggaccuaaauggccuca

SEQ ID NO: 2427966 - RNA, 17 nt, Human
uggaccuaaauggccuc

SEQ ID NO: 2427967 - RNA, 13 nt, Human
uggacccuuccau

SEQ ID NO: 2427968 - RNA, 22 nt, Human
uggaccuauguccuaaggacac

SEQ ID NO: 2427969 - RNA, 14 nt, Human
uggaccuaauccaa

SEQ ID NO: 2427970 - RNA, 22 nt, Human
uggaccuaauccaagcaucccu

SEQ ID NO: 2427971 - RNA, 19 nt, Human
uggaccuauguccuaagga

SEQ ID NO: 2427972 - RNA, 18 nt, Human
uggacacagcucuucucc

SEQ ID NO: 2427973 - RNA, 17 nt, Human
uggaauuuauauacaac

SEQ ID NO: 2427974 - RNA, 16 nt, Human
uggacacagcucuucu

SEQ ID NO: 2427975 - RNA, 15 nt, Human
uggacacagcucuuc

SEQ ID NO: 2427976 - RNA, 13 nt, Human
uggaccagugguc

SEQ ID NO: 2427977 - RNA, 18 nt, Human
uggaccaguggucucaca

SEQ ID NO: 2427978 - RNA, 13 nt, Human
uggaccaggacag

SEQ ID NO: 2427979 - RNA, 14 nt, Human
uggaccaggacagg

SEQ ID NO: 2427980 - RNA, 18 nt, Human
uggaccaggacaggacca

SEQ ID NO: 2427981 - RNA, 19 nt, Human
uggaccaggacaggaccag

SEQ ID NO: 2427982 - RNA, 20 nt, Human
uggacccagggaugacaugu

SEQ ID NO: 2427983 - RNA, 16 nt, Human
ugcuugggcuucaucc

SEQ ID NO: 2427984 - RNA, 12 nt, Human
ugcuugggcuuc

SEQ ID NO: 2427985 - RNA, 19 nt, Human
ugcuugcugccuucuggau

SEQ ID NO: 2427986 - RNA, 15 nt, Human
ugcuugggaaggggc

SEQ ID NO: 2427987 - RNA, 19 nt, Human
ugcuuggcugcuuggccuu

SEQ ID NO: 2427988 - RNA, 19 nt, Human
ugcuuggccuugggcuuca

SEQ ID NO: 2427989 - RNA, 15 nt, Human
ugcuugccucucugu

SEQ ID NO: 2427990 - RNA, 15 nt, Human
ugcuugccugauaua

SEQ ID NO: 2427991 - RNA, 21 nt, Human
ugcuuggaggaaggaaaccca

SEQ ID NO: 2427992 - RNA, 19 nt, Human
ugcuugccuagggccuggu

SEQ ID NO: 2427993 - RNA, 11 nt, Human
ugcuugccucu

SEQ ID NO: 2427994 - RNA, 22 nt, Human
ugcuugccuagggccuggucca

SEQ ID NO: 2427995 - RNA, 19 nt, Human
ugcuugccugcguuuugga

SEQ ID NO: 2427996 - RNA, 22 nt, Human
aggagccugcuggucacagccu

SEQ ID NO: 2427997 - RNA, 11 nt, Human
aggagccuggc

SEQ ID NO: 2427998 - RNA, 19 nt, Human
aggagcccugggaggcucu

SEQ ID NO: 2427999 - RNA, 14 nt, Human
aggagccugcuggu

SEQ ID NO: 2428000 - RNA, 18 nt, Human
aggagcgggaccuguggc

SEQ ID NO: 2428001 - RNA, 16 nt, Human
aggagcgggaccugug

SEQ ID NO: 2428002 - RNA, 17 nt, Human
ugcuugccacagagcgg

SEQ ID NO: 2428003 - RNA, 18 nt, Human
ugcuugcccccaugcugg

SEQ ID NO: 2428004 - RNA, 14 nt, Human
ugcuugccuagggc

SEQ ID NO: 2428005 - RNA, 17 nt, Human
ugcuuuucacugcugca

SEQ ID NO: 2428006 - RNA, 16 nt, Human
ugcuuuucacugcugc

SEQ ID NO: 2428007 - RNA, 22 nt, Human
ugcuuuucacugcugcaaggcc

SEQ ID NO: 2428008 - RNA, 18 nt, Human
ugcuuuucacugcugcaa

SEQ ID NO: 2428009 - RNA, 17 nt, Human
ugcuuuuaccaugcccc

SEQ ID NO: 2428010 - RNA, 13 nt, Human
ugcuuuuaccaug

SEQ ID NO: 2428011 - RNA, 19 nt, Human
ugcuuuguaggugucucau

SEQ ID NO: 2428012 - RNA, 19 nt, Human
ugcuuggguggagaagcca

SEQ ID NO: 2428013 - RNA, 21 nt, Human
ugcuuugggcugcccuggugc

SEQ ID NO: 2428014 - RNA, 20 nt, Human
ugcuuugggcugcccuggug

SEQ ID NO: 2428015 - RNA, 19 nt, Human
ugcuuugggcugcccuggu

SEQ ID NO: 2428016 - RNA, 18 nt, Human
ugcuuugggcugcccugg

SEQ ID NO: 2428017 - RNA, 19 nt, Human
ugcuugggcuucauccucc

SEQ ID NO: 2428018 - RNA, 16 nt, Human
ugcuuggguggagaag

SEQ ID NO: 2428019 - RNA, 15 nt, Human
ugcuuggguggagaa

SEQ ID NO: 2428020 - RNA, 18 nt, Human
ugcuuggguggagaagcc

SEQ ID NO: 2428021 - RNA, 17 nt, Human
ugcuuggguggagaagc

SEQ ID NO: 2428022 - RNA, 17 nt, Human
ugcuuugggcugcccug

SEQ ID NO: 2428023 - RNA, 22 nt, Human
ugcuuuuccuuggggcaggcag

SEQ ID NO: 2428024 - RNA, 23 nt, Human
ugcuuuucuccaauaucagugcu

SEQ ID NO: 2428025 - RNA, 20 nt, Human
ugcuuuucuccaauaucagu

SEQ ID NO: 2428026 - RNA, 12 nt, Human
ugcuuuucucca

SEQ ID NO: 2428027 - RNA, 15 nt, Human
ugcuuuucugcccug

SEQ ID NO: 2428028 - RNA, 12 nt, Human
uggaaagccucu

SEQ ID NO: 2428029 - RNA, 14 nt, Human
uggaaagccucugc

SEQ ID NO: 2428030 - RNA, 20 nt, Human
uggaaagcuccuagcagaga

SEQ ID NO: 2428031 - RNA, 15 nt, Human
uggaaagccucugcu

SEQ ID NO: 2428032 - RNA, 16 nt, Human
uggaaagccucugcug

SEQ ID NO: 2428033 - RNA, 18 nt, Human
uggaaagccucugcugcc

SEQ ID NO: 2428034 - RNA, 21 nt, Human
uggaaauagaaauuuccagag

SEQ ID NO: 2428035 - RNA, 22 nt, Human
uggaaauacaguuguuggccuc

SEQ ID NO: 2428036 - RNA, 18 nt, Human
uggaaauacaguuguugg

SEQ ID NO: 2428037 - RNA, 15 nt, Human
uggaaauauuaagaa

SEQ ID NO: 2428038 - RNA, 13 nt, Human
uggaaaggcagcu

SEQ ID NO: 2428039 - RNA, 17 nt, Human
uggaaaggagaggaaag

SEQ ID NO: 2428040 - RNA, 16 nt, Human
uggaaaggagaggaaa

SEQ ID NO: 2428041 - RNA, 15 nt, Human
uggaaaggagaggaa

SEQ ID NO: 2428042 - RNA, 14 nt, Human
uggaaaggagagga

SEQ ID NO: 2428043 - RNA, 23 nt, Human
uggaaaggagaggaaagaacuca

SEQ ID NO: 2428044 - RNA, 19 nt, Human
uggaaaggagaggaaagaa

SEQ ID NO: 2428045 - RNA, 11 nt, Human
aggagaaacug

SEQ ID NO: 2428046 - RNA, 11 nt, Human
aggacuuugca

SEQ ID NO: 2428047 - RNA, 17 nt, Human
aggacuuucugaagccu

SEQ ID NO: 2428048 - RNA, 23 nt, Human
aggacuuggucugauuucaggau

SEQ ID NO: 2428049 - RNA, 13 nt, Human
aggagaaaaacaa

SEQ ID NO: 2428050 - RNA, 12 nt, Human
aggagaaacaca

SEQ ID NO: 2428051 - RNA, 23 nt, Human
aggacuuuucuuuguggcuuccu

SEQ ID NO: 2428052 - RNA, 21 nt, Human
aggacuuuccuaaauguuuaa

SEQ ID NO: 2428053 - RNA, 14 nt, Human
aggagauuuuccuu

SEQ ID NO: 2428054 - RNA, 22 nt, Human
aggagauugagaaggagagaaa

SEQ ID NO: 2428055 - RNA, 21 nt, Human
aggagauugagaaggagagaa

SEQ ID NO: 2428056 - RNA, 19 nt, Human
aggagauugagaaggagag

SEQ ID NO: 2428057 - RNA, 17 nt, Human
aggagauugagaaggag

SEQ ID NO: 2428058 - RNA, 16 nt, Human
aggagauugagaagga

SEQ ID NO: 2428059 - RNA, 15 nt, Human
aggagauugagaagg

SEQ ID NO: 2428060 - RNA, 17 nt, Human
aggagauuggaaggaac

SEQ ID NO: 2428061 - RNA, 14 nt, Human
aggagaugggccuu

SEQ ID NO: 2428062 - RNA, 14 nt, Human
aggagaaacacauc

SEQ ID NO: 2428063 - RNA, 13 nt, Human
aggagaaacacau

SEQ ID NO: 2428064 - RNA, 14 nt, Human
aggagaaacagaga

SEQ ID NO: 2428065 - RNA, 13 nt, Human
aggagauugagaa

SEQ ID NO: 2428066 - RNA, 16 nt, Human
aggagaaacagagaca

SEQ ID NO: 2428067 - RNA, 18 nt, Human
aggagaaacagagacagg

SEQ ID NO: 2428068 - RNA, 16 nt, Human
aggagcaaaggcugag

SEQ ID NO: 2428069 - RNA, 15 nt, Human
aggagcaaaggcuga

SEQ ID NO: 2428070 - RNA, 18 nt, Human
aggagauuuuccuuccua

SEQ ID NO: 2428071 - RNA, 15 nt, Human
aggagauuuuccuuc

SEQ ID NO: 2428072 - RNA, 14 nt, Human
aggagcagccacau

SEQ ID NO: 2428073 - RNA, 16 nt, Human
aggagcagugcaggca

SEQ ID NO: 2428074 - RNA, 14 nt, Human
aggagcagugcagg

SEQ ID NO: 2428075 - RNA, 19 nt, Human
aggagcaguaucaugaagc

SEQ ID NO: 2428076 - RNA, 20 nt, Human
aggagcauccaccuccuucu

SEQ ID NO: 2428077 - RNA, 16 nt, Human
aggagcauccaccucc

SEQ ID NO: 2428078 - RNA, 19 nt, Human
aggagcagugcaggcacag

SEQ ID NO: 2428079 - RNA, 16 nt, Human
aggagcagcuucaguu

SEQ ID NO: 2428080 - RNA, 19 nt, Human
aggagcagccucagaacaa

SEQ ID NO: 2428081 - RNA, 16 nt, Human
aggagcagccucagaa

SEQ ID NO: 2428082 - RNA, 20 nt, Human
aggagcaggggcguggaggg

SEQ ID NO: 2428083 - RNA, 20 nt, Human
aggagcagcuucaguuguuu

SEQ ID NO: 2428084 - RNA, 19 nt, Human
aggagcaggagccugagcc

SEQ ID NO: 2428085 - RNA, 18 nt, Human
aggagcccugggaggcuc

SEQ ID NO: 2428086 - RNA, 22 nt, Human
aggagccccgaggccuucucug

SEQ ID NO: 2428087 - RNA, 21 nt, Human
aggagcauuuggagagaaggc

SEQ ID NO: 2428088 - RNA, 18 nt, Human
aggacauugcggacagcc

SEQ ID NO: 2428089 - RNA, 17 nt, Human
aggacauugcggacagc

SEQ ID NO: 2428090 - RNA, 15 nt, Human
aggacauugcggaca

SEQ ID NO: 2428091 - RNA, 16 nt, Human
aggacauuccaagaca

SEQ ID NO: 2428092 - RNA, 14 nt, Human
aggacauuccaaga

SEQ ID NO: 2428093 - RNA, 23 nt, Human
aggacauguuuuuguuuucuuug

SEQ ID NO: 2428094 - RNA, 21 nt, Human
aggacauguuuuuguuuucuu

SEQ ID NO: 2428095 - RNA, 16 nt, Human
aggacauguuuuuguu

SEQ ID NO: 2428096 - RNA, 15 nt, Human
aggacauguuuuugu

SEQ ID NO: 2428097 - RNA, 23 nt, Human
aggacauugcggacagccacggc

SEQ ID NO: 2428098 - RNA, 19 nt, Human
aggacauugcggacagcca

SEQ ID NO: 2428099 - RNA, 18 nt, Human
aggacauuccaagacagu

SEQ ID NO: 2428100 - RNA, 17 nt, Human
aggacauuccaagacag

SEQ ID NO: 2428101 - RNA, 15 nt, Human
aggacauuucccagg

SEQ ID NO: 2428102 - RNA, 19 nt, Human
aggacucugccuccucuuc

SEQ ID NO: 2428103 - RNA, 20 nt, Human
aggacuuccuguccagcucc

SEQ ID NO: 2428104 - RNA, 21 nt, Human
aggacuuaacggcuccaggau

SEQ ID NO: 2428105 - RNA, 19 nt, Human
aggacuuauuuaaacucug

SEQ ID NO: 2428106 - RNA, 21 nt, Human
aggacuguuuuuuccugagcu

SEQ ID NO: 2428107 - RNA, 18 nt, Human
aggacuguuuuuuccuga

SEQ ID NO: 2428108 - RNA, 20 nt, Human
aggacuuaacggcuccagga

SEQ ID NO: 2428109 - RNA, 18 nt, Human
aggacuuaacggcuccag

SEQ ID NO: 2428110 - RNA, 17 nt, Human
aggacuuaacggcucca

SEQ ID NO: 2428111 - RNA, 22 nt, Human
aggacuguuuuuuccugagcuu

SEQ ID NO: 2428112 - RNA, 13 nt, Human
aggacuugugucu

SEQ ID NO: 2428113 - RNA, 16 nt, Human
aggacuugugucucug

SEQ ID NO: 2428114 - RNA, 20 nt, Human
aggacuuggucugauuucag

SEQ ID NO: 2428115 - RNA, 16 nt, Human
aggacuuggucugauu

SEQ ID NO: 2428116 - RNA, 18 nt, Human
aggacugagggacucuga

SEQ ID NO: 2428117 - RNA, 12 nt, Human
aggacugaggga

SEQ ID NO: 2428118 - RNA, 24 nt, Human
aggacugagccccgcagaccuccc

SEQ ID NO: 2428119 - RNA, 16 nt, Human
aggacugagccccgca

SEQ ID NO: 2428120 - RNA, 13 nt, Human
aggacugagcccc

SEQ ID NO: 2428121 - RNA, 20 nt, Human
aggacugaauuguccccagu

SEQ ID NO: 2428122 - RNA, 17 nt, Human
aggacugaauugucccc

SEQ ID NO: 2428123 - RNA, 19 nt, Human
aggacugaauuguccccag

SEQ ID NO: 2428124 - RNA, 20 nt, Human
aggacugugacaggcagcag

SEQ ID NO: 2428125 - RNA, 19 nt, Human
aggacugugacaggcagca

SEQ ID NO: 2428126 - RNA, 18 nt, Human
aggacugugacaggcagc

SEQ ID NO: 2428127 - RNA, 17 nt, Human
aggacugugacaggcag

SEQ ID NO: 2428128 - RNA, 22 nt, Human
aggacuguauuugugacuaauu

SEQ ID NO: 2428129 - RNA, 18 nt, Human
aggacuguauuugugacu

SEQ ID NO: 2428130 - RNA, 16 nt, Human
aggacugugacaggca

SEQ ID NO: 2428131 - RNA, 22 nt, Human
aggacugugacaggcagcagag

SEQ ID NO: 2428132 - RNA, 21 nt, Human
aggacugugacaggcagcaga

SEQ ID NO: 2428133 - RNA, 18 nt, Human
aucccaugagccucagca

SEQ ID NO: 2428134 - RNA, 17 nt, Human
aucccaugagccucagc

SEQ ID NO: 2428135 - RNA, 17 nt, Human
aucccugaaggccccgc

SEQ ID NO: 2428136 - RNA, 22 nt, Human
aucccugaaggccccgcccagg

SEQ ID NO: 2428137 - RNA, 22 nt, Human
aucccugaaucccccuugccac

SEQ ID NO: 2428138 - RNA, 20 nt, Human
aucccugaaucccccuugcc

SEQ ID NO: 2428139 - RNA, 15 nt, Human
aucccucugggcacu

SEQ ID NO: 2428140 - RNA, 21 nt, Human
aucccagcacuuugggaggcc

SEQ ID NO: 2428141 - RNA, 16 nt, Human
aucccaugagccucag

SEQ ID NO: 2428142 - RNA, 13 nt, Human
aucccaugagccu

SEQ ID NO: 2428143 - RNA, 11 nt, Human
aucccagcccc

SEQ ID NO: 2428144 - RNA, 20 nt, Human
aucccagcacuuugggaggc

SEQ ID NO: 2428145 - RNA, 17 nt, Human
aucccagcacuuuggga

SEQ ID NO: 2428146 - RNA, 22 nt, Human
aucccagcacuuugggaggcug

SEQ ID NO: 2428147 - RNA, 14 nt, Human
aucccagcacuuug

SEQ ID NO: 2428148 - RNA, 17 nt, Human
aucccagaaauuagaaa

SEQ ID NO: 2428149 - RNA, 19 nt, Human
aucccagcacuuugggagg

SEQ ID NO: 2428150 - RNA, 20 nt, Human
auccauggggcugauuguau

SEQ ID NO: 2428151 - RNA, 21 nt, Human
auccaugaccuaguuuuccau

SEQ ID NO: 2428152 - RNA, 22 nt, Human
auccaugaccuaguuuuccaug

SEQ ID NO: 2428153 - RNA, 19 nt, Human
auccaugaguuugcccugg

SEQ ID NO: 2428154 - RNA, 13 nt, Human
aucccagaaauua

SEQ ID NO: 2428155 - RNA, 20 nt, Human
aucccagagggugggcuuca

SEQ ID NO: 2428156 - RNA, 22 nt, Human
aucccacuuucuauagcagauu

SEQ ID NO: 2428157 - RNA, 16 nt, Human
auccaugggggcaggg

SEQ ID NO: 2428158 - RNA, 19 nt, Human
auccaugggggcagggcau

SEQ ID NO: 2428159 - RNA, 16 nt, Human
aucccacuugccccug

SEQ ID NO: 2428160 - RNA, 20 nt, Human
auccaauggguuuuucccug

SEQ ID NO: 2428161 - RNA, 14 nt, Human
auccaacuccagga

SEQ ID NO: 2428162 - RNA, 19 nt, Human
auccaagauauuuuaaaau

SEQ ID NO: 2428163 - RNA, 16 nt, Human
auccaacuaaugccuu

SEQ ID NO: 2428164 - RNA, 18 nt, Human
auccaacuaaugccuuac

SEQ ID NO: 2428165 - RNA, 20 nt, Human
auccaacuaaugccuuacuc

SEQ ID NO: 2428166 - RNA, 16 nt, Human
auccaagcaaauguga

SEQ ID NO: 2428167 - RNA, 16 nt, Human
uucugccugcccaggc

SEQ ID NO: 2428168 - RNA, 15 nt, Human
uucugccugcccagg

SEQ ID NO: 2428169 - RNA, 18 nt, Human
uucugccugccagcugca

SEQ ID NO: 2428170 - RNA, 19 nt, Human
uucugccugccagcugcac

SEQ ID NO: 2428171 - RNA, 15 nt, Human
auccaaagcagacag

SEQ ID NO: 2428172 - RNA, 22 nt, Human
uucugccugccagcugcacuga

SEQ ID NO: 2428173 - RNA, 18 nt, Human
auccaaccccccaccugc

SEQ ID NO: 2428174 - RNA, 20 nt, Human
auccaaccccccaccugcca

SEQ ID NO: 2428175 - RNA, 16 nt, Human
auccaguaggauccag

SEQ ID NO: 2428176 - RNA, 14 nt, Human
auccaguaucuuga

SEQ ID NO: 2428177 - RNA, 14 nt, Human
auccauccagaggc

SEQ ID NO: 2428178 - RNA, 14 nt, Human
auccaucaucaugu

SEQ ID NO: 2428179 - RNA, 21 nt, Human
auccaucuaaauaccugcccu

SEQ ID NO: 2428180 - RNA, 18 nt, Human
auccaugaccuaguuuuc

SEQ ID NO: 2428181 - RNA, 20 nt, Human
auccaugaccuaguuuucca

SEQ ID NO: 2428182 - RNA, 15 nt, Human
auccaguaucuugaa

SEQ ID NO: 2428183 - RNA, 18 nt, Human
auccaucaucaugugugu

SEQ ID NO: 2428184 - RNA, 21 nt, Human
auccacagagagucccacugc

SEQ ID NO: 2428185 - RNA, 20 nt, Human
auccacagagagucccacug

SEQ ID NO: 2428186 - RNA, 17 nt, Human
auccacauuguuuuaaa

SEQ ID NO: 2428187 - RNA, 15 nt, Human
auccacauuguuuua

SEQ ID NO: 2428188 - RNA, 13 nt, Human
auccacauuguuu

SEQ ID NO: 2428189 - RNA, 17 nt, Human
auccagguucagcuugu

SEQ ID NO: 2428190 - RNA, 19 nt, Human
auccacagagagucccacu

SEQ ID NO: 2428191 - RNA, 17 nt, Human
auccacagagaguccca

SEQ ID NO: 2428192 - RNA, 13 nt, Human
auccacagagagu

SEQ ID NO: 2428193 - RNA, 16 nt, Human
auccacacacagagga

SEQ ID NO: 2428194 - RNA, 20 nt, Human
auccacacacagaggaagag

SEQ ID NO: 2428195 - RNA, 19 nt, Human
auccacacacgcaggaacu

SEQ ID NO: 2428196 - RNA, 23 nt, Human
auccacacacagaggaagagcag

SEQ ID NO: 2428197 - RNA, 15 nt, Human
auccacacacagagg

SEQ ID NO: 2428198 - RNA, 22 nt, Human
auccaauggacugcauaaauaa

SEQ ID NO: 2428199 - RNA, 22 nt, Human
auccaagacagaauaaugaaug

SEQ ID NO: 2428200 - RNA, 14 nt, Human
uucuuacauguuuu

SEQ ID NO: 2428201 - RNA, 14 nt, Human
uucuuacaugcauu

SEQ ID NO: 2428202 - RNA, 16 nt, Human
uucuuacaugcauuug

SEQ ID NO: 2428203 - RNA, 13 nt, Human
uucuuacauguuu

SEQ ID NO: 2428204 - RNA, 15 nt, Human
uucuuaccuguaugu

SEQ ID NO: 2428205 - RNA, 22 nt, Human
uucuuagaaauuuauuuccuag

SEQ ID NO: 2428206 - RNA, 13 nt, Human
uucuuagaaauuu

SEQ ID NO: 2428207 - RNA, 21 nt, Human
uucuuagacuacauuuagaga

SEQ ID NO: 2428208 - RNA, 18 nt, Human
uucuuacuaaacauuuug

SEQ ID NO: 2428209 - RNA, 15 nt, Human
uucuuacuaaacauu

SEQ ID NO: 2428210 - RNA, 12 nt, Human
uucuuagaaauu

SEQ ID NO: 2428211 - RNA, 15 nt, Human
uucuuaaauaauaaa

SEQ ID NO: 2428212 - RNA, 19 nt, Human
uucuuaaauaauaaagauc

SEQ ID NO: 2428213 - RNA, 15 nt, Human
uucuguuuucuguuu

SEQ ID NO: 2428214 - RNA, 22 nt, Human
uucuuaaccagaucauugugaa

SEQ ID NO: 2428215 - RNA, 21 nt, Human
uucuuaaaugggcuacuuugu

SEQ ID NO: 2428216 - RNA, 17 nt, Human
uucuguuuuauaauuuu

SEQ ID NO: 2428217 - RNA, 16 nt, Human
uucuguuuggaggagc

SEQ ID NO: 2428218 - RNA, 11 nt, Human
uucuguuucuu

SEQ ID NO: 2428219 - RNA, 16 nt, Human
uucuguuuuauaauuu

SEQ ID NO: 2428220 - RNA, 19 nt, Human
uucuguuuacaucaguuuu

SEQ ID NO: 2428221 - RNA, 15 nt, Human
uucuguuuccuuuuu

SEQ ID NO: 2428222 - RNA, 13 nt, Human
uucuguuuagaua

SEQ ID NO: 2428223 - RNA, 18 nt, Human
uucuguuuagauaauaca

SEQ ID NO: 2428224 - RNA, 21 nt, Human
uucuguuggccagugugacaa

SEQ ID NO: 2428225 - RNA, 14 nt, Human
aucccugccagcuc

SEQ ID NO: 2428226 - RNA, 15 nt, Human
aucccugccagcucu

SEQ ID NO: 2428227 - RNA, 20 nt, Human
uucuguugucauugcuguug

SEQ ID NO: 2428228 - RNA, 14 nt, Human
aucccugccugguc

SEQ ID NO: 2428229 - RNA, 22 nt, Human
uucuuugauaauguuaaauuug

SEQ ID NO: 2428230 - RNA, 20 nt, Human
uucuuugauguuaacacauu

SEQ ID NO: 2428231 - RNA, 18 nt, Human
uucuuugauguuaacaca

SEQ ID NO: 2428232 - RNA, 13 nt, Human
uucuuugauguua

SEQ ID NO: 2428233 - RNA, 22 nt, Human
uucuuugauguuaacacauuuu

SEQ ID NO: 2428234 - RNA, 21 nt, Human
uucuuugauguuaacacauuu

SEQ ID NO: 2428235 - RNA, 11 nt, Human
uucuuugaaug

SEQ ID NO: 2428236 - RNA, 18 nt, Human
uucuuugauaauguuaaa

SEQ ID NO: 2428237 - RNA, 17 nt, Human
uucuuugauaauguuaa

SEQ ID NO: 2428238 - RNA, 16 nt, Human
uucuuugauaauguua

SEQ ID NO: 2428239 - RNA, 17 nt, Human
uucuuugagacuggguc

SEQ ID NO: 2428240 - RNA, 17 nt, Human
uucuuucuggcuaugca

SEQ ID NO: 2428241 - RNA, 20 nt, Human
uucuuucuggcuaugcauuu

SEQ ID NO: 2428242 - RNA, 12 nt, Human
uucuuucuggcu

SEQ ID NO: 2428243 - RNA, 19 nt, Human
uucuuucuaguucagcugc

SEQ ID NO: 2428244 - RNA, 22 nt, Human
uucuuucuaguggucuuuguaa

SEQ ID NO: 2428245 - RNA, 21 nt, Human
uucuuucuaguggucuuugua

SEQ ID NO: 2428246 - RNA, 18 nt, Human
uucuuucuaguggucuuu

SEQ ID NO: 2428247 - RNA, 21 nt, Human
uucuugccuacuaugccagau

SEQ ID NO: 2428248 - RNA, 18 nt, Human
uucuucuagguucuaaaa

SEQ ID NO: 2428249 - RNA, 21 nt, Human
uucuucuagguucuaaaaauu

SEQ ID NO: 2428250 - RNA, 15 nt, Human
uucuucgggaagaga

SEQ ID NO: 2428251 - RNA, 23 nt, Human
uucuucgagguggaucacagagg

SEQ ID NO: 2428252 - RNA, 17 nt, Human
uucuucgggaagagagg

SEQ ID NO: 2428253 - RNA, 20 nt, Human
uucuucggggaacuccugga

SEQ ID NO: 2428254 - RNA, 22 nt, Human
uucuucuccacuuucuagccag

SEQ ID NO: 2428255 - RNA, 11 nt, Human
uucuucucccu

SEQ ID NO: 2428256 - RNA, 12 nt, Human
uucuugccuuca

SEQ ID NO: 2428257 - RNA, 22 nt, Human
uucuugccucugugcugugugu

SEQ ID NO: 2428258 - RNA, 17 nt, Human
uucuugccucugugcug

SEQ ID NO: 2428259 - RNA, 16 nt, Human
uucuugccucugugcu

SEQ ID NO: 2428260 - RNA, 15 nt, Human
uucuugccucugugc

SEQ ID NO: 2428261 - RNA, 20 nt, Human
uucuugccucuguccccuuc

SEQ ID NO: 2428262 - RNA, 18 nt, Human
uucuugccucuguccccu

SEQ ID NO: 2428263 - RNA, 16 nt, Human
uucuugccaaugaggu

SEQ ID NO: 2428264 - RNA, 23 nt, Human
uucuucucaggcaugaacaugua

SEQ ID NO: 2428265 - RNA, 16 nt, Human
uucugcaucagcugcu

SEQ ID NO: 2428266 - RNA, 21 nt, Human
uucugcaguagucucugugcu

SEQ ID NO: 2428267 - RNA, 12 nt, Human
uucugccugcca

SEQ ID NO: 2428268 - RNA, 16 nt, Human
uucugccugccagcug

SEQ ID NO: 2428269 - RNA, 17 nt, Human
uucugccugccagcugc

SEQ ID NO: 2428270 - RNA, 17 nt, Human
uucugcauauguugaau

SEQ ID NO: 2428271 - RNA, 21 nt, Human
uucugcauauguugaauacuu

SEQ ID NO: 2428272 - RNA, 22 nt, Human
uucugcauauguugaauacuuu

SEQ ID NO: 2428273 - RNA, 23 nt, Human
uucugcauauguugaauacuuuu

SEQ ID NO: 2428274 - RNA, 16 nt, Human
uucugcagcuguuuua

SEQ ID NO: 2428275 - RNA, 15 nt, Human
uucugcagcuguuuu

SEQ ID NO: 2428276 - RNA, 12 nt, Human
uucugcagcugu

SEQ ID NO: 2428277 - RNA, 11 nt, Human
uucugaaugua

SEQ ID NO: 2428278 - RNA, 18 nt, Human
uucugaaugcugcuacuu

SEQ ID NO: 2428279 - RNA, 15 nt, Human
uucugcaguaaaucu

SEQ ID NO: 2428280 - RNA, 18 nt, Human
uucugcaguaaaucuuuu

SEQ ID NO: 2428281 - RNA, 20 nt, Human
uucugcaguagucucugugc

SEQ ID NO: 2428282 - RNA, 19 nt, Human
uucugcaguagucucugug

SEQ ID NO: 2428283 - RNA, 22 nt, Human
uucugcaguaaaucuuuuacaa

SEQ ID NO: 2428284 - RNA, 19 nt, Human
uucugcagccacuauuguu

SEQ ID NO: 2428285 - RNA, 11 nt, Human
uucugaauaug

SEQ ID NO: 2428286 - RNA, 19 nt, Human
uucugaauacaaagugaug

SEQ ID NO: 2428287 - RNA, 17 nt, Human
uucugaauaauuucuua

SEQ ID NO: 2428288 - RNA, 16 nt, Human
uucugaauaauuucuu

SEQ ID NO: 2428289 - RNA, 16 nt, Human
uucugaaugcugcuac

SEQ ID NO: 2428290 - RNA, 14 nt, Human
uucugaaugcugcu

SEQ ID NO: 2428291 - RNA, 15 nt, Human
uucugaauaugcugc

SEQ ID NO: 2428292 - RNA, 17 nt, Human
uucugaauaacauuugu

SEQ ID NO: 2428293 - RNA, 18 nt, Human
uucugaagucuacuuugu

SEQ ID NO: 2428294 - RNA, 21 nt, Human
uucucuaguuugauuaaauuc

SEQ ID NO: 2428295 - RNA, 13 nt, Human
uucucuaucauuu

SEQ ID NO: 2428296 - RNA, 20 nt, Human
uucucuaaaauagccacuua

SEQ ID NO: 2428297 - RNA, 13 nt, Human
uucucucaccucc

SEQ ID NO: 2428298 - RNA, 16 nt, Human
uucucuaucauuuaau

SEQ ID NO: 2428299 - RNA, 12 nt, Human
uucucucaucuc

SEQ ID NO: 2428300 - RNA, 17 nt, Human
uucucucaucucuuagc

SEQ ID NO: 2428301 - RNA, 13 nt, Human
uucucucaucucu

SEQ ID NO: 2428302 - RNA, 23 nt, Human
uucucucaucucuuagcuccccu

SEQ ID NO: 2428303 - RNA, 20 nt, Human
uucucucaucucuuagcucc

SEQ ID NO: 2428304 - RNA, 12 nt, Human
uucucgggcuga

SEQ ID NO: 2428305 - RNA, 18 nt, Human
uucuccuuuuccucucuc

SEQ ID NO: 2428306 - RNA, 13 nt, Human
uucuccuuuuccu

SEQ ID NO: 2428307 - RNA, 16 nt, Human
uucuccuuuugaaaag

SEQ ID NO: 2428308 - RNA, 20 nt, Human
uucuccuuugauaaaauaaa

SEQ ID NO: 2428309 - RNA, 17 nt, Human
uucucgauuuuaucuuu

SEQ ID NO: 2428310 - RNA, 22 nt, Human
uucuccuuucacaaccuucugu

SEQ ID NO: 2428311 - RNA, 18 nt, Human
uucuccuuucacaaccuu

SEQ ID NO: 2428312 - RNA, 17 nt, Human
uucuccuuuguacuuug

SEQ ID NO: 2428313 - RNA, 14 nt, Human
uucuccuuuguacu

SEQ ID NO: 2428314 - RNA, 23 nt, Human
uucuccuccaugggagaaaauag

SEQ ID NO: 2428315 - RNA, 12 nt, Human
uucuccuuugua

SEQ ID NO: 2428316 - RNA, 13 nt, Human
aucauugaaaucu

SEQ ID NO: 2428317 - RNA, 23 nt, Human
aucauucuuauuucaugaaaauu

SEQ ID NO: 2428318 - RNA, 15 nt, Human
aucauuguacaguuu

SEQ ID NO: 2428319 - RNA, 18 nt, Human
aucauuguauauaugugu

SEQ ID NO: 2428320 - RNA, 22 nt, Human
aucauuguacaguuuguuuaca

SEQ ID NO: 2428321 - RNA, 18 nt, Human
aucauuguacaguuuguu

SEQ ID NO: 2428322 - RNA, 16 nt, Human
aucauuguacaguuug

SEQ ID NO: 2428323 - RNA, 14 nt, Human
aucauuguauggau

SEQ ID NO: 2428324 - RNA, 20 nt, Human
aucauucuuauuucaugaaa

SEQ ID NO: 2428325 - RNA, 19 nt, Human
aucauucuuauuucaugaa

SEQ ID NO: 2428326 - RNA, 24 nt, Human
aucauucucugucucauccaucau

SEQ ID NO: 2428327 - RNA, 12 nt, Human
aucauugaaauc

SEQ ID NO: 2428328 - RNA, 15 nt, Human
aucauugugaaauua

SEQ ID NO: 2428329 - RNA, 13 nt, Human
aucauugugaaau

SEQ ID NO: 2428330 - RNA, 19 nt, Human
aucauugugaaauuauuca

SEQ ID NO: 2428331 - RNA, 21 nt, Human
uucuccgccagccuccucugg

SEQ ID NO: 2428332 - RNA, 20 nt, Human
uucuccgccagccuccucug

SEQ ID NO: 2428333 - RNA, 19 nt, Human
uucuccgccagccuccucu

SEQ ID NO: 2428334 - RNA, 17 nt, Human
uucuccguuagcuccug

SEQ ID NO: 2428335 - RNA, 16 nt, Human
uucuccguuagcuccu

SEQ ID NO: 2428336 - RNA, 18 nt, Human
uucuccgccagccuccuc

SEQ ID NO: 2428337 - RNA, 17 nt, Human
uucuccgccagccuccu

SEQ ID NO: 2428338 - RNA, 16 nt, Human
uucuccgccagccucc

SEQ ID NO: 2428339 - RNA, 15 nt, Human
uucuccgccagccuc

SEQ ID NO: 2428340 - RNA, 14 nt, Human
uucuccgccagccu

SEQ ID NO: 2428341 - RNA, 13 nt, Human
uucuccgccagcc

SEQ ID NO: 2428342 - RNA, 23 nt, Human
uucuccgacugcuagggaguggu

SEQ ID NO: 2428343 - RNA, 22 nt, Human
uucuccguuagcuccuguggcc

SEQ ID NO: 2428344 - RNA, 20 nt, Human
uucuccguuagcuccugugg

SEQ ID NO: 2428345 - RNA, 19 nt, Human
uucuccguuagcuccugug

SEQ ID NO: 2428346 - RNA, 18 nt, Human
uucuccguuagcuccugu

SEQ ID NO: 2428347 - RNA, 15 nt, Human
uucuccuauguguaa

SEQ ID NO: 2428348 - RNA, 17 nt, Human
uucuccuuucacaaccu

SEQ ID NO: 2428349 - RNA, 23 nt, Human
uucuccccugcccccaggacugg

SEQ ID NO: 2428350 - RNA, 22 nt, Human
uucuccccugcccccaggacug

SEQ ID NO: 2428351 - RNA, 21 nt, Human
uucuccccugcccccaggacu

SEQ ID NO: 2428352 - RNA, 19 nt, Human
uucuccccugcccccagga

SEQ ID NO: 2428353 - RNA, 18 nt, Human
uucuccccugcccccagg

SEQ ID NO: 2428354 - RNA, 17 nt, Human
uucuccccugcccccag

SEQ ID NO: 2428355 - RNA, 16 nt, Human
uucuccccugccccca

SEQ ID NO: 2428356 - RNA, 15 nt, Human
uucuccccugccccc

SEQ ID NO: 2428357 - RNA, 20 nt, Human
uucucccucauuucaggagc

SEQ ID NO: 2428358 - RNA, 21 nt, Human
uucucccguucacguugccua

SEQ ID NO: 2428359 - RNA, 13 nt, Human
uucucccucugga

SEQ ID NO: 2428360 - RNA, 17 nt, Human
uucucccucucacuguc

SEQ ID NO: 2428361 - RNA, 16 nt, Human
aucauaaacugugugc

SEQ ID NO: 2428362 - RNA, 19 nt, Human
aucaucaguauugaagcau

SEQ ID NO: 2428363 - RNA, 19 nt, Human
aucauaugauucugcuuuu

SEQ ID NO: 2428364 - RNA, 18 nt, Human
aucauaugauucugcuuu

SEQ ID NO: 2428365 - RNA, 16 nt, Human
aucauaugauucugcu

SEQ ID NO: 2428366 - RNA, 18 nt, Human
aucaucaguggagccaug

SEQ ID NO: 2428367 - RNA, 16 nt, Human
aucauauaauaaaugu

SEQ ID NO: 2428368 - RNA, 20 nt, Human
aucauauaauaaauguacau

SEQ ID NO: 2428369 - RNA, 13 nt, Human
aucauaugauucu

SEQ ID NO: 2428370 - RNA, 15 nt, Human
aucauaaaacuugau

SEQ ID NO: 2428371 - RNA, 21 nt, Human
aucaguugcaauaauacuucu

SEQ ID NO: 2428372 - RNA, 18 nt, Human
aucaguugcaauaauacu

SEQ ID NO: 2428373 - RNA, 23 nt, Human
aucauaguggcuuaaaacaacac

SEQ ID NO: 2428374 - RNA, 14 nt, Human
aucauaaacugugu

SEQ ID NO: 2428375 - RNA, 13 nt, Human
aucauaaaauaaa

SEQ ID NO: 2428376 - RNA, 22 nt, Human
aucaguuugcuagcagaaaucu

SEQ ID NO: 2428377 - RNA, 17 nt, Human
aucaguuuuauccacag

SEQ ID NO: 2428378 - RNA, 12 nt, Human
aucauaaaauaa

SEQ ID NO: 2428379 - RNA, 23 nt, Human
aucauccacugugccaugugcca

SEQ ID NO: 2428380 - RNA, 12 nt, Human
aucauuaaaguu

SEQ ID NO: 2428381 - RNA, 11 nt, Human
aucauuaaagu

SEQ ID NO: 2428382 - RNA, 16 nt, Human
aucauccacauuguuu

SEQ ID NO: 2428383 - RNA, 11 nt, Human
aucauuaauac

SEQ ID NO: 2428384 - RNA, 18 nt, Human
aucaucauguguguccac

SEQ ID NO: 2428385 - RNA, 21 nt, Human
aucauccacugugccaugugc

SEQ ID NO: 2428386 - RNA, 16 nt, Human
aucauuaggugugacu

SEQ ID NO: 2428387 - RNA, 14 nt, Human
aucauuaaaguucu

SEQ ID NO: 2428388 - RNA, 13 nt, Human
aucauuaaaguuc

SEQ ID NO: 2428389 - RNA, 11 nt, Human
aucauuagaac

SEQ ID NO: 2428390 - RNA, 15 nt, Human
aucauuaaaguucua

SEQ ID NO: 2428391 - RNA, 19 nt, Human
aucauuagggggaacucua

SEQ ID NO: 2428392 - RNA, 16 nt, Human
aucauuauaaacguga

SEQ ID NO: 2428393 - RNA, 23 nt, Human
aucauuauaaacgugaugaucag

SEQ ID NO: 2428394 - RNA, 12 nt, Human
aucauucucugu

SEQ ID NO: 2428395 - RNA, 14 nt, Human
aucauucucugucu

SEQ ID NO: 2428396 - RNA, 16 nt, Human
aucauucucugucuca

SEQ ID NO: 2428397 - RNA, 21 nt, Human
aucauucucugucucauccau

SEQ ID NO: 2428398 - RNA, 20 nt, Human
aucauuaucagccugugcca

SEQ ID NO: 2428399 - RNA, 20 nt, Human
aucauuauaacugaaggaga

SEQ ID NO: 2428400 - RNA, 22 nt, Human
aucauuauaacugaaggagaag

SEQ ID NO: 2428401 - RNA, 23 nt, Human
aucacuugaacccgggaggcaga

SEQ ID NO: 2428402 - RNA, 15 nt, Human
aucaggugcugccau

SEQ ID NO: 2428403 - RNA, 19 nt, Human
aucaggugcugccauccag

SEQ ID NO: 2428404 - RNA, 17 nt, Human
aucaggugcugccaucc

SEQ ID NO: 2428405 - RNA, 18 nt, Human
aucacuucugagaacuca

SEQ ID NO: 2428406 - RNA, 20 nt, Human
aucacuuaggaaauggcuuu

SEQ ID NO: 2428407 - RNA, 14 nt, Human
aucacugaacuuug

SEQ ID NO: 2428408 - RNA, 17 nt, Human
aucacucuuguggaugu

SEQ ID NO: 2428409 - RNA, 14 nt, Human
aucacucuugugga

SEQ ID NO: 2428410 - RNA, 16 nt, Human
aucacucuuguggaug

SEQ ID NO: 2428411 - RNA, 20 nt, Human
aucagugcucgagacacagu

SEQ ID NO: 2428412 - RNA, 15 nt, Human
aucagugcucccuca

SEQ ID NO: 2428413 - RNA, 17 nt, Human
aucagugcccuccagga

SEQ ID NO: 2428414 - RNA, 13 nt, Human
aucagugcccucc

SEQ ID NO: 2428415 - RNA, 15 nt, Human
aucagugcccuccag

SEQ ID NO: 2428416 - RNA, 19 nt, Human
aucagucugauucccaagc

SEQ ID NO: 2428417 - RNA, 18 nt, Human
aucagucucugagggcuu

SEQ ID NO: 2428418 - RNA, 20 nt, Human
aucagucuauccacagagag

SEQ ID NO: 2428419 - RNA, 13 nt, Human
aucagucucugag

SEQ ID NO: 2428420 - RNA, 14 nt, Human
aucaggugcugcca

SEQ ID NO: 2428421 - RNA, 18 nt, Human
aucaguuacuaagaagaa

SEQ ID NO: 2428422 - RNA, 15 nt, Human
aucaguuacucagcc

SEQ ID NO: 2428423 - RNA, 16 nt, Human
aucaguuacucagccc

SEQ ID NO: 2428424 - RNA, 17 nt, Human
aucaguuacucagcccu

SEQ ID NO: 2428425 - RNA, 18 nt, Human
aucaguuacucagcccug

SEQ ID NO: 2428426 - RNA, 15 nt, Human
aucaguuagagcuga

SEQ ID NO: 2428427 - RNA, 19 nt, Human
aucaguuacucagcccugg

SEQ ID NO: 2428428 - RNA, 21 nt, Human
aucaguuacucagcccugggc

SEQ ID NO: 2428429 - RNA, 18 nt, Human
aucaguuacucugaaggg

SEQ ID NO: 2428430 - RNA, 23 nt, Human
aucagugugucuaaauuugaaug

SEQ ID NO: 2428431 - RNA, 15 nt, Human
aucgggaacaguguu

SEQ ID NO: 2428432 - RNA, 16 nt, Human
aucgggaacaguguuu

SEQ ID NO: 2428433 - RNA, 17 nt, Human
aucgggaacaguguuuc

SEQ ID NO: 2428434 - RNA, 21 nt, Human
aucgggaacaguguuucccau

SEQ ID NO: 2428435 - RNA, 23 nt, Human
aucggcccacagcucccacccca

SEQ ID NO: 2428436 - RNA, 16 nt, Human
aucgggagcagugucu

SEQ ID NO: 2428437 - RNA, 17 nt, Human
aucgggagcagugucuu

SEQ ID NO: 2428438 - RNA, 18 nt, Human
aucgggagcagugucuuc

SEQ ID NO: 2428439 - RNA, 21 nt, Human
aucgggagcagugucuuccau

SEQ ID NO: 2428440 - RNA, 12 nt, Human
aucguaaaauua

SEQ ID NO: 2428441 - RNA, 17 nt, Human
aucggggcacugcaggg

SEQ ID NO: 2428442 - RNA, 19 nt, Human
aucggucuugcccagagga

SEQ ID NO: 2428443 - RNA, 14 nt, Human
aucguaaaauuaag

SEQ ID NO: 2428444 - RNA, 13 nt, Human
aucguaaaauuaa

SEQ ID NO: 2428445 - RNA, 17 nt, Human
aucguaaaauuaagaaa

SEQ ID NO: 2428446 - RNA, 15 nt, Human
aucguaaccagccag

SEQ ID NO: 2428447 - RNA, 18 nt, Human
aucggugaaacuaacaga

SEQ ID NO: 2428448 - RNA, 19 nt, Human
aucggugaaacuaacagau

SEQ ID NO: 2428449 - RNA, 21 nt, Human
aucggugaaacuaacagauaa

SEQ ID NO: 2428450 - RNA, 14 nt, Human
auccuguguuucua

SEQ ID NO: 2428451 - RNA, 18 nt, Human
auccuguguuucuaggga

SEQ ID NO: 2428452 - RNA, 18 nt, Human
auccugugacauguaaca

SEQ ID NO: 2428453 - RNA, 16 nt, Human
auccugugacauguaa

SEQ ID NO: 2428454 - RNA, 15 nt, Human
auccugugacaugua

SEQ ID NO: 2428455 - RNA, 16 nt, Human
auccugugaaguaagg

SEQ ID NO: 2428456 - RNA, 12 nt, Human
auccugugaagu

SEQ ID NO: 2428457 - RNA, 13 nt, Human
auccuguggguga

SEQ ID NO: 2428458 - RNA, 23 nt, Human
auccugucuuucugagcacacuu

SEQ ID NO: 2428459 - RNA, 18 nt, Human
auccugucuuucugagca

SEQ ID NO: 2428460 - RNA, 15 nt, Human
auccugucuuucuga

SEQ ID NO: 2428461 - RNA, 21 nt, Human
auccugucuuuaaggaaaaaa

SEQ ID NO: 2428462 - RNA, 23 nt, Human
auccugucuuuaaggaaaaaaag

SEQ ID NO: 2428463 - RNA, 19 nt, Human
auccugucuuuaaggaaaa

SEQ ID NO: 2428464 - RNA, 18 nt, Human
auccuguccucagcuucu

SEQ ID NO: 2428465 - RNA, 17 nt, Human
auccuguccucagcuuc

SEQ ID NO: 2428466 - RNA, 14 nt, Human
auccuguccucagc

SEQ ID NO: 2428467 - RNA, 16 nt, Human
auccuggggcucccuu

SEQ ID NO: 2428468 - RNA, 15 nt, Human
auccuggggcucccu

SEQ ID NO: 2428469 - RNA, 21 nt, Human
auccugggggacccaauguag

SEQ ID NO: 2428470 - RNA, 20 nt, Human
auccuggggcauuaaaaaaa

SEQ ID NO: 2428471 - RNA, 20 nt, Human
auccuggggcucccuucauc

SEQ ID NO: 2428472 - RNA, 22 nt, Human
auccuggguggucugcaggcag

SEQ ID NO: 2428473 - RNA, 23 nt, Human
auccuggguggucugcaggcagg

SEQ ID NO: 2428474 - RNA, 22 nt, Human
auccugguugguguugcagaag

SEQ ID NO: 2428475 - RNA, 18 nt, Human
auccugggcauccuucuu

SEQ ID NO: 2428476 - RNA, 24 nt, Human
auccuggcucuuuggagaucaagg

SEQ ID NO: 2428477 - RNA, 13 nt, Human
auccuggcccauc

SEQ ID NO: 2428478 - RNA, 12 nt, Human
auccuggcccau

SEQ ID NO: 2428479 - RNA, 16 nt, Human
auccuggcccaucagu

SEQ ID NO: 2428480 - RNA, 14 nt, Human
auccuggcccauca

SEQ ID NO: 2428481 - RNA, 14 nt, Human
auccuggcccucug

SEQ ID NO: 2428482 - RNA, 17 nt, Human
auccuggccaacauggu

SEQ ID NO: 2428483 - RNA, 19 nt, Human
auccuggaggcccaguuca

SEQ ID NO: 2428484 - RNA, 20 nt, Human
auccuggaggcccaguucac

SEQ ID NO: 2428485 - RNA, 23 nt, Human
auccuggcacccggccccugcug

SEQ ID NO: 2428486 - RNA, 22 nt, Human
auccuggcacccggccccugcu

SEQ ID NO: 2428487 - RNA, 21 nt, Human
auccuggcacccggccccugc

SEQ ID NO: 2428488 - RNA, 20 nt, Human
auccuggcacccggccccug

SEQ ID NO: 2428489 - RNA, 19 nt, Human
auccuggcacccggccccu

SEQ ID NO: 2428490 - RNA, 17 nt, Human
auccuggcacccggccc

SEQ ID NO: 2428491 - RNA, 14 nt, Human
auccuggaggccca

SEQ ID NO: 2428492 - RNA, 15 nt, Human
auccuggaggcccag

SEQ ID NO: 2428493 - RNA, 16 nt, Human
auccuggaggcccagu

SEQ ID NO: 2428494 - RNA, 17 nt, Human
auccuggaggcccaguu

SEQ ID NO: 2428495 - RNA, 15 nt, Human
auccuggaguucugg

SEQ ID NO: 2428496 - RNA, 14 nt, Human
auccugcuucagug

SEQ ID NO: 2428497 - RNA, 22 nt, Human
auccuggacaugaagauucuuu

SEQ ID NO: 2428498 - RNA, 21 nt, Human
auccugcuucugauaugcagu

SEQ ID NO: 2428499 - RNA, 19 nt, Human
auccugcuucugauaugca

SEQ ID NO: 2428500 - RNA, 11 nt, Human
auccugaggcu

SEQ ID NO: 2428501 - RNA, 13 nt, Human
auccugaggcucc

SEQ ID NO: 2428502 - RNA, 16 nt, Human
auccugaggcuccacu

SEQ ID NO: 2428503 - RNA, 18 nt, Human
auccugaggcuccacuug

SEQ ID NO: 2428504 - RNA, 21 nt, Human
auccugagccagauuucacuc

SEQ ID NO: 2428505 - RNA, 17 nt, Human
auccugagccagauuuc

SEQ ID NO: 2428506 - RNA, 15 nt, Human
auccugagccagauu

SEQ ID NO: 2428507 - RNA, 14 nt, Human
auccugagccagau

SEQ ID NO: 2428508 - RNA, 13 nt, Human
auccugccccuga

SEQ ID NO: 2428509 - RNA, 20 nt, Human
auccugcagccuccuccuga

SEQ ID NO: 2428510 - RNA, 17 nt, Human
auccugcagccuccucc

SEQ ID NO: 2428511 - RNA, 16 nt, Human
auccugcagccuccuc

SEQ ID NO: 2428512 - RNA, 22 nt, Human
auccugccuuagagccaggcac

SEQ ID NO: 2428513 - RNA, 21 nt, Human
auccugccuuagagccaggca

SEQ ID NO: 2428514 - RNA, 19 nt, Human
auccugccuuagagccagg

SEQ ID NO: 2428515 - RNA, 23 nt, Human
auccugcccccugaaacuuauuu

SEQ ID NO: 2428516 - RNA, 22 nt, Human
auccugcccccugaaacuuauu

SEQ ID NO: 2428517 - RNA, 20 nt, Human
auccugcccccugaaacuua

SEQ ID NO: 2428518 - RNA, 23 nt, Human
auccugccuuagagccaggcaca

SEQ ID NO: 2428519 - RNA, 16 nt, Human
auccugcggguggggc

SEQ ID NO: 2428520 - RNA, 14 nt, Human
auccugcugcugug

SEQ ID NO: 2428521 - RNA, 22 nt, Human
auccugaggcuccacuuggucu

SEQ ID NO: 2428522 - RNA, 13 nt, Human
auccugaggcuga

SEQ ID NO: 2428523 - RNA, 19 nt, Human
auccugacucugcccccug

SEQ ID NO: 2428524 - RNA, 24 nt, Human
auccugagccaucggugaaacuaa

SEQ ID NO: 2428525 - RNA, 16 nt, Human
auccugcaauuccacu

SEQ ID NO: 2428526 - RNA, 19 nt, Human
auccugaugagguuucuac

SEQ ID NO: 2428527 - RNA, 12 nt, Human
auccugagccau

SEQ ID NO: 2428528 - RNA, 13 nt, Human
auccugagccaga

SEQ ID NO: 2428529 - RNA, 12 nt, Human
auccugagccag

SEQ ID NO: 2428530 - RNA, 11 nt, Human
auccugagcca

SEQ ID NO: 2428531 - RNA, 18 nt, Human
auccugacucugcccccu

SEQ ID NO: 2428532 - RNA, 17 nt, Human
auccugacucugccccc

SEQ ID NO: 2428533 - RNA, 15 nt, Human
auccugacucugccc

SEQ ID NO: 2428534 - RNA, 14 nt, Human
auccugacucugcc

SEQ ID NO: 2428535 - RNA, 21 nt, Human
auccugaaauagaggcuaaau

SEQ ID NO: 2428536 - RNA, 21 nt, Human
auccucuuuagaguuagacug

SEQ ID NO: 2428537 - RNA, 20 nt, Human
auccucuuuagaguuagacu

SEQ ID NO: 2428538 - RNA, 19 nt, Human
auccucuuuagaguuagac

SEQ ID NO: 2428539 - RNA, 16 nt, Human
auccucuuuagaguua

SEQ ID NO: 2428540 - RNA, 17 nt, Human
auccucuuugagugaag

SEQ ID NO: 2428541 - RNA, 14 nt, Human
auccugaaauuuca

SEQ ID NO: 2428542 - RNA, 16 nt, Human
auccugaaauuucaga

SEQ ID NO: 2428543 - RNA, 17 nt, Human
auccugaaauuucagau

SEQ ID NO: 2428544 - RNA, 23 nt, Human
auccucuuuagaguuagacuguu

SEQ ID NO: 2428545 - RNA, 22 nt, Human
auccucuuuagaguuagacugu

SEQ ID NO: 2428546 - RNA, 18 nt, Human
auccugaaauagaggcua

SEQ ID NO: 2428547 - RNA, 21 nt, Human
uucuuuucuggaauguaauca

SEQ ID NO: 2428548 - RNA, 23 nt, Human
uucuuuucgccguggcugcggca

SEQ ID NO: 2428549 - RNA, 23 nt, Human
uucuuuugagcaacuuucuuaca

SEQ ID NO: 2428550 - RNA, 21 nt, Human
uucuuuugcccuucacagugu

SEQ ID NO: 2428551 - RNA, 22 nt, Human
uucuuuugcccuucacaguguu

SEQ ID NO: 2428552 - RNA, 23 nt, Human
uucuuuugcccuucacaguguuu

SEQ ID NO: 2428553 - RNA, 20 nt, Human
uucuuuugccguuauuaaaa

SEQ ID NO: 2428554 - RNA, 22 nt, Human
uucuuuugguaaagacuggcuu

SEQ ID NO: 2428555 - RNA, 13 nt, Human
uucuuuugguaaa

SEQ ID NO: 2428556 - RNA, 23 nt, Human
uucuuuugguaaagacuggcuuu

SEQ ID NO: 2428557 - RNA, 12 nt, Human
uucuuuuguaaa

SEQ ID NO: 2428558 - RNA, 20 nt, Human
auccucuguacagagcccac

SEQ ID NO: 2428559 - RNA, 18 nt, Human
auccucuguacagagccc

SEQ ID NO: 2428560 - RNA, 17 nt, Human
auccucuuccucugagg

SEQ ID NO: 2428561 - RNA, 16 nt, Human
auccucuuccucugag

SEQ ID NO: 2428562 - RNA, 15 nt, Human
auccucuuccucuga

SEQ ID NO: 2428563 - RNA, 14 nt, Human
auccucuuccucug

SEQ ID NO: 2428564 - RNA, 14 nt, Human
uucuuuuggcuucc

SEQ ID NO: 2428565 - RNA, 13 nt, Human
auccucuuccucu

SEQ ID NO: 2428566 - RNA, 15 nt, Human
auccucuuuagaguu

SEQ ID NO: 2428567 - RNA, 13 nt, Human
auccucuuuagag

SEQ ID NO: 2428568 - RNA, 22 nt, Human
auccucuucugcuuaggagaga

SEQ ID NO: 2428569 - RNA, 19 nt, Human
auccucuuccucugaggcu

SEQ ID NO: 2428570 - RNA, 17 nt, Human
uugaaggaaaaugauac

SEQ ID NO: 2428571 - RNA, 22 nt, Human
aucuaacccucccauggcaccu

SEQ ID NO: 2428572 - RNA, 18 nt, Human
aucuaaccucaucuucuu

SEQ ID NO: 2428573 - RNA, 15 nt, Human
aucuaacccucccau

SEQ ID NO: 2428574 - RNA, 14 nt, Human
aucuaaccacauca

SEQ ID NO: 2428575 - RNA, 13 nt, Human
aucuaaccucauc

SEQ ID NO: 2428576 - RNA, 14 nt, Human
aucuaaccucaucu

SEQ ID NO: 2428577 - RNA, 15 nt, Human
aucuaaccucaucuu

SEQ ID NO: 2428578 - RNA, 15 nt, Human
aucuaaauguugaaa

SEQ ID NO: 2428579 - RNA, 16 nt, Human
aucuaaauugaauaau

SEQ ID NO: 2428580 - RNA, 15 nt, Human
aucuaaauugaauaa

SEQ ID NO: 2428581 - RNA, 17 nt, Human
aucuaaauuuagaaauc

SEQ ID NO: 2428582 - RNA, 21 nt, Human
aucuaaauugaauaaugguac

SEQ ID NO: 2428583 - RNA, 23 nt, Human
aucuaaaguguguuguugcuuua

SEQ ID NO: 2428584 - RNA, 20 nt, Human
aucuaaaguguguuguugcu

SEQ ID NO: 2428585 - RNA, 17 nt, Human
aucuaaaguguguuguu

SEQ ID NO: 2428586 - RNA, 18 nt, Human
aucuaaauaccugcccug

SEQ ID NO: 2428587 - RNA, 22 nt, Human
aucuaaauauugauuucugccu

SEQ ID NO: 2428588 - RNA, 19 nt, Human
aucuaaauggaaccacucu

SEQ ID NO: 2428589 - RNA, 19 nt, Human
aucuaaaagaaaugucuau

SEQ ID NO: 2428590 - RNA, 15 nt, Human
aucuaaacugccccc

SEQ ID NO: 2428591 - RNA, 22 nt, Human
aucuaaacuggauucacagcuc

SEQ ID NO: 2428592 - RNA, 15 nt, Human
aucuaaaguguguug

SEQ ID NO: 2428593 - RNA, 15 nt, Human
aucgugacaacacuu

SEQ ID NO: 2428594 - RNA, 14 nt, Human
aucgugacaacacu

SEQ ID NO: 2428595 - RNA, 22 nt, Human
aucgugacgcugaauaaauguc

SEQ ID NO: 2428596 - RNA, 21 nt, Human
aucgugacgcugaauaaaugu

SEQ ID NO: 2428597 - RNA, 20 nt, Human
aucgugacgcugaauaaaug

SEQ ID NO: 2428598 - RNA, 18 nt, Human
aucgugacgcugaauaaa

SEQ ID NO: 2428599 - RNA, 23 nt, Human
aucuaaaaauagacuuaaaucuc

SEQ ID NO: 2428600 - RNA, 18 nt, Human
aucgugccguuacucucc

SEQ ID NO: 2428601 - RNA, 19 nt, Human
aucuaaaaauagacuuaaa

SEQ ID NO: 2428602 - RNA, 17 nt, Human
aucgugacgcugaauaa

SEQ ID NO: 2428603 - RNA, 12 nt, Human
aucgugaaaccc

SEQ ID NO: 2428604 - RNA, 20 nt, Human
aucgugaaacccugucucua

SEQ ID NO: 2428605 - RNA, 23 nt, Human
aucgucucucccucccuuugaaa

SEQ ID NO: 2428606 - RNA, 23 nt, Human
aucguccagggagcauuuuccuc

SEQ ID NO: 2428607 - RNA, 22 nt, Human
aucguauagcuguauugaauca

SEQ ID NO: 2428608 - RNA, 18 nt, Human
aucguauagcuguauuga

SEQ ID NO: 2428609 - RNA, 16 nt, Human
aucguauagcuguauu

SEQ ID NO: 2428610 - RNA, 15 nt, Human
aucguauagcuguau

SEQ ID NO: 2428611 - RNA, 14 nt, Human
aucguauagcugua

SEQ ID NO: 2428612 - RNA, 18 nt, Human
aucguaauguacagaugg

SEQ ID NO: 2428613 - RNA, 16 nt, Human
aucguaauguacagau

SEQ ID NO: 2428614 - RNA, 16 nt, Human
aucguaaccagccaga

SEQ ID NO: 2428615 - RNA, 14 nt, Human
aucgucacugcuua

SEQ ID NO: 2428616 - RNA, 18 nt, Human
aucgucacugcuuaacuu

SEQ ID NO: 2428617 - RNA, 19 nt, Human
aucguccagcgaccuuccu

SEQ ID NO: 2428618 - RNA, 23 nt, Human
aucguauagcuguauugaaucau

SEQ ID NO: 2428619 - RNA, 13 nt, Human
aucguccagggag

SEQ ID NO: 2428620 - RNA, 12 nt, Human
aucguccaggga

SEQ ID NO: 2428621 - RNA, 18 nt, Human
uugaaguauuuugcugga

SEQ ID NO: 2428622 - RNA, 18 nt, Human
uugaaguaaucccgccac

SEQ ID NO: 2428623 - RNA, 12 nt, Human
uugaaguaauga

SEQ ID NO: 2428624 - RNA, 16 nt, Human
uugaaguaaugaauuu

SEQ ID NO: 2428625 - RNA, 17 nt, Human
uugaaguaaugaauuuu

SEQ ID NO: 2428626 - RNA, 19 nt, Human
uugaaggguaaagaaguuu

SEQ ID NO: 2428627 - RNA, 18 nt, Human
uugaaggguaaagaaguu

SEQ ID NO: 2428628 - RNA, 23 nt, Human
uugaaggugcugacggccaggga

SEQ ID NO: 2428629 - RNA, 14 nt, Human
uugaaggaaacagu

SEQ ID NO: 2428630 - RNA, 13 nt, Human
uugaaggaaacag

SEQ ID NO: 2428631 - RNA, 11 nt, Human
uugaaggaaac

SEQ ID NO: 2428632 - RNA, 18 nt, Human
uugaaggaggugagggau

SEQ ID NO: 2428633 - RNA, 15 nt, Human
uugaagggccagagc

SEQ ID NO: 2428634 - RNA, 17 nt, Human
uugaagggccagagcca

SEQ ID NO: 2428635 - RNA, 19 nt, Human
uugaagggccagagccagg

SEQ ID NO: 2428636 - RNA, 20 nt, Human
uugaagggccagagccaggg

SEQ ID NO: 2428637 - RNA, 15 nt, Human
uugaaggaucuguuu

SEQ ID NO: 2428638 - RNA, 21 nt, Human
uugaaguuguuacuaacuaaa

SEQ ID NO: 2428639 - RNA, 20 nt, Human
uugaaguguaggcagacaca

SEQ ID NO: 2428640 - RNA, 22 nt, Human
uugaaguguaggcagacacagg

SEQ ID NO: 2428641 - RNA, 19 nt, Human
uugaaguguaggcagacac

SEQ ID NO: 2428642 - RNA, 18 nt, Human
uugaaguguaggcagaca

SEQ ID NO: 2428643 - RNA, 17 nt, Human
uugaaguguaggcagac

SEQ ID NO: 2428644 - RNA, 18 nt, Human
uugaaguggccagaugag

SEQ ID NO: 2428645 - RNA, 12 nt, Human
uugaauacuuuu

SEQ ID NO: 2428646 - RNA, 13 nt, Human
uugaauacuuuuu

SEQ ID NO: 2428647 - RNA, 19 nt, Human
uugaaguuguuacuaacua

SEQ ID NO: 2428648 - RNA, 18 nt, Human
uugaauauaaacacuaua

SEQ ID NO: 2428649 - RNA, 16 nt, Human
uugaauauaaacacua

SEQ ID NO: 2428650 - RNA, 15 nt, Human
uugaauauaaacacu

SEQ ID NO: 2428651 - RNA, 17 nt, Human
uugacacuuaaaaaugg

SEQ ID NO: 2428652 - RNA, 17 nt, Human
uugaauauccccuccca

SEQ ID NO: 2428653 - RNA, 16 nt, Human
uugaauauccccuccc

SEQ ID NO: 2428654 - RNA, 13 nt, Human
uugaauauauuau

SEQ ID NO: 2428655 - RNA, 19 nt, Human
uugaauauauuauaaucuu

SEQ ID NO: 2428656 - RNA, 21 nt, Human
uugaauauaauauauuugugu

SEQ ID NO: 2428657 - RNA, 20 nt, Human
uugaauauaauauauuugug

SEQ ID NO: 2428658 - RNA, 22 nt, Human
uugaauauaauauauuugugua

SEQ ID NO: 2428659 - RNA, 22 nt, Human
uugauaagagggcacacacugu

SEQ ID NO: 2428660 - RNA, 16 nt, Human
uugauaagagggcaca

SEQ ID NO: 2428661 - RNA, 14 nt, Human
uugauaacuuugcu

SEQ ID NO: 2428662 - RNA, 13 nt, Human
uugauaacuuugc

SEQ ID NO: 2428663 - RNA, 19 nt, Human
uugauaacagcacugacua

SEQ ID NO: 2428664 - RNA, 18 nt, Human
uugauaaauuccacugga

SEQ ID NO: 2428665 - RNA, 15 nt, Human
uugauaacagcacug

SEQ ID NO: 2428666 - RNA, 14 nt, Human
uugauaacagcacu

SEQ ID NO: 2428667 - RNA, 19 nt, Human
uugauaaauuccacuggac

SEQ ID NO: 2428668 - RNA, 21 nt, Human
uugauaaauuccacuggacuu

SEQ ID NO: 2428669 - RNA, 19 nt, Human
uugauaaucaacugggcug

SEQ ID NO: 2428670 - RNA, 21 nt, Human
aucuaagcagcauuucugaag

SEQ ID NO: 2428671 - RNA, 18 nt, Human
aucuaagcagcauuucug

SEQ ID NO: 2428672 - RNA, 13 nt, Human
aucuaagccugaa

SEQ ID NO: 2428673 - RNA, 16 nt, Human
aucuaagccuuuccau

SEQ ID NO: 2428674 - RNA, 15 nt, Human
aucuaagugauauaa

SEQ ID NO: 2428675 - RNA, 14 nt, Human
aucuaagugauaua

SEQ ID NO: 2428676 - RNA, 17 nt, Human
aucuaagugauauaaau

SEQ ID NO: 2428677 - RNA, 20 nt, Human
aucuaaggaugucacagggc

SEQ ID NO: 2428678 - RNA, 13 nt, Human
aucuaagugauau

SEQ ID NO: 2428679 - RNA, 18 nt, Human
aucuaagccuuuccauaa

SEQ ID NO: 2428680 - RNA, 18 nt, Human
aucuaaggaugucacagg

SEQ ID NO: 2428681 - RNA, 17 nt, Human
aucuaagccuuuccaua

SEQ ID NO: 2428682 - RNA, 15 nt, Human
uugaggucuguucuu

SEQ ID NO: 2428683 - RNA, 18 nt, Human
uugagaguuuugucuuga

SEQ ID NO: 2428684 - RNA, 17 nt, Human
uugagauagaagaacug

SEQ ID NO: 2428685 - RNA, 18 nt, Human
uugagauagaagaacugc

SEQ ID NO: 2428686 - RNA, 16 nt, Human
uugaggucuguucuuu

SEQ ID NO: 2428687 - RNA, 17 nt, Human
uugaggucuuuugacau

SEQ ID NO: 2428688 - RNA, 18 nt, Human
uugaggucuuuugacaug

SEQ ID NO: 2428689 - RNA, 19 nt, Human
uugaggucuuuugacaugu

SEQ ID NO: 2428690 - RNA, 22 nt, Human
uugaggucuuuugacaugugga

SEQ ID NO: 2428691 - RNA, 23 nt, Human
uugaggucuuuugacauguggaa

SEQ ID NO: 2428692 - RNA, 19 nt, Human
uugagguggaagcccuccu

SEQ ID NO: 2428693 - RNA, 22 nt, Human
uugagguggaagcccuccuucc

SEQ ID NO: 2428694 - RNA, 17 nt, Human
uugauaaaguuucucag

SEQ ID NO: 2428695 - RNA, 14 nt, Human
uugauaaaguuucu

SEQ ID NO: 2428696 - RNA, 13 nt, Human
uugauaaaguuuc

SEQ ID NO: 2428697 - RNA, 12 nt, Human
uugauaaaguuu

SEQ ID NO: 2428698 - RNA, 20 nt, Human
uugauaaaguaguaaaaauu

SEQ ID NO: 2428699 - RNA, 12 nt, Human
uugauaaaguaa

SEQ ID NO: 2428700 - RNA, 21 nt, Human
uugaguuuuguuuuaaaauua

SEQ ID NO: 2428701 - RNA, 12 nt, Human
uugaguuuuguu

SEQ ID NO: 2428702 - RNA, 22 nt, Human
uugagguggcacuuuuucauuu

SEQ ID NO: 2428703 - RNA, 21 nt, Human
uugagguggucugaauguucu

SEQ ID NO: 2428704 - RNA, 19 nt, Human
uugaccauucuccaccugc

SEQ ID NO: 2428705 - RNA, 18 nt, Human
uugaccauucuccaccug

SEQ ID NO: 2428706 - RNA, 20 nt, Human
uugacauaacacuauaaagg

SEQ ID NO: 2428707 - RNA, 19 nt, Human
uugacacuuaaaaaugguu

SEQ ID NO: 2428708 - RNA, 19 nt, Human
uugacagggcacaccgggc

SEQ ID NO: 2428709 - RNA, 17 nt, Human
uugacaguucugaagaa

SEQ ID NO: 2428710 - RNA, 15 nt, Human
uugacaguucugaag

SEQ ID NO: 2428711 - RNA, 18 nt, Human
uugacaguucugaagaau

SEQ ID NO: 2428712 - RNA, 19 nt, Human
uugacaguguugaaaaugu

SEQ ID NO: 2428713 - RNA, 14 nt, Human
uugagaguucuaaa

SEQ ID NO: 2428714 - RNA, 19 nt, Human
uugagaggcccugggguuc

SEQ ID NO: 2428715 - RNA, 17 nt, Human
uugagaaggagagaaag

SEQ ID NO: 2428716 - RNA, 23 nt, Human
uugagagaaauaugaagaacuga

SEQ ID NO: 2428717 - RNA, 16 nt, Human
uugagaaggagagaaa

SEQ ID NO: 2428718 - RNA, 17 nt, Human
uugagagaagagacaaa

SEQ ID NO: 2428719 - RNA, 16 nt, Human
uugagagaccaggcaa

SEQ ID NO: 2428720 - RNA, 17 nt, Human
uugagagaccaggcaaa

SEQ ID NO: 2428721 - RNA, 14 nt, Human
uugagaaggagaga

SEQ ID NO: 2428722 - RNA, 24 nt, Human
uugaccauucuccaccugccaggg

SEQ ID NO: 2428723 - RNA, 21 nt, Human
uugagaaauauggacacuuaa

SEQ ID NO: 2428724 - RNA, 15 nt, Human
uugagaaaugaauaa

SEQ ID NO: 2428725 - RNA, 19 nt, Human
uugagaaaugcauauugua

SEQ ID NO: 2428726 - RNA, 16 nt, Human
uugagaaaugcauauu

SEQ ID NO: 2428727 - RNA, 16 nt, Human
uugagaaaugaauaau

SEQ ID NO: 2428728 - RNA, 22 nt, Human
uugagaaaugaauaauuuccca

SEQ ID NO: 2428729 - RNA, 19 nt, Human
uugagaacugcauauguuu

SEQ ID NO: 2428730 - RNA, 21 nt, Human
uugagaacugcauauguuucg

SEQ ID NO: 2428731 - RNA, 22 nt, Human
uugagaagaccucaccuagaaa

SEQ ID NO: 2428732 - RNA, 15 nt, Human
uugagaagaaaacau

SEQ ID NO: 2428733 - RNA, 18 nt, Human
uugagaagaaaacaucua

SEQ ID NO: 2428734 - RNA, 23 nt, Human
auauuuaaugauaaguaaaugcu

SEQ ID NO: 2428735 - RNA, 13 nt, Human
auauuuaaugaua

SEQ ID NO: 2428736 - RNA, 12 nt, Human
auauuuaaugau

SEQ ID NO: 2428737 - RNA, 13 nt, Human
auauuuacaaaug

SEQ ID NO: 2428738 - RNA, 13 nt, Human
auauuguuuucag

SEQ ID NO: 2428739 - RNA, 17 nt, Human
auauuguuuucagugua

SEQ ID NO: 2428740 - RNA, 14 nt, Human
auauuguuugcuaa

SEQ ID NO: 2428741 - RNA, 21 nt, Human
auauugugccaauauguauug

SEQ ID NO: 2428742 - RNA, 20 nt, Human
auauugugccaauauguauu

SEQ ID NO: 2428743 - RNA, 12 nt, Human
auauuguuucua

SEQ ID NO: 2428744 - RNA, 22 nt, Human
auauugucagaguucugcucua

SEQ ID NO: 2428745 - RNA, 18 nt, Human
auauuguauuacuagaag

SEQ ID NO: 2428746 - RNA, 16 nt, Human
auauuguauuacuaga

SEQ ID NO: 2428747 - RNA, 15 nt, Human
auauuguacacuuuu

SEQ ID NO: 2428748 - RNA, 12 nt, Human
auauugucagau

SEQ ID NO: 2428749 - RNA, 15 nt, Human
auauugucagauauu

SEQ ID NO: 2428750 - RNA, 17 nt, Human
auauugucagauauuuu

SEQ ID NO: 2428751 - RNA, 14 nt, Human
auauuguacaguuu

SEQ ID NO: 2428752 - RNA, 13 nt, Human
auauuguacaguu

SEQ ID NO: 2428753 - RNA, 17 nt, Human
auauugugauucugccu

SEQ ID NO: 2428754 - RNA, 19 nt, Human
auauugugauucugccuuu

SEQ ID NO: 2428755 - RNA, 19 nt, Human
auauugugccaauauguau

SEQ ID NO: 2428756 - RNA, 18 nt, Human
auauugugccaauaugua

SEQ ID NO: 2428757 - RNA, 12 nt, Human
auauugugccaa

SEQ ID NO: 2428758 - RNA, 13 nt, Human
auauugugaagua

SEQ ID NO: 2428759 - RNA, 18 nt, Human
auauugucauuccuguau

SEQ ID NO: 2428760 - RNA, 15 nt, Human
auauugucauuccug

SEQ ID NO: 2428761 - RNA, 16 nt, Human
auauugucagauauuu

SEQ ID NO: 2428762 - RNA, 14 nt, Human
auauugugauucug

SEQ ID NO: 2428763 - RNA, 16 nt, Human
auauugacuuguauau

SEQ ID NO: 2428764 - RNA, 15 nt, Human
auauugacuuguaua

SEQ ID NO: 2428765 - RNA, 14 nt, Human
auauugacuuguau

SEQ ID NO: 2428766 - RNA, 18 nt, Human
auauugaauguuuccaac

SEQ ID NO: 2428767 - RNA, 15 nt, Human
auauugauaugcuua

SEQ ID NO: 2428768 - RNA, 20 nt, Human
auauucuauaugaauuuaaa

SEQ ID NO: 2428769 - RNA, 23 nt, Human
auauucuauuuucauuuucugca

SEQ ID NO: 2428770 - RNA, 18 nt, Human
auauucuauaugaauuua

SEQ ID NO: 2428771 - RNA, 20 nt, Human
auauuccuuucuaucauuuu

SEQ ID NO: 2428772 - RNA, 19 nt, Human
auauuccuuucuaucauuu

SEQ ID NO: 2428773 - RNA, 16 nt, Human
auauuccuuucuauca

SEQ ID NO: 2428774 - RNA, 21 nt, Human
auauuccugcauuugugaaau

SEQ ID NO: 2428775 - RNA, 13 nt, Human
auauuguaagaaa

SEQ ID NO: 2428776 - RNA, 14 nt, Human
auauuguaagaaau

SEQ ID NO: 2428777 - RNA, 15 nt, Human
auauuguaagaaaua

SEQ ID NO: 2428778 - RNA, 16 nt, Human
auauuguaagaaauac

SEQ ID NO: 2428779 - RNA, 14 nt, Human
auauuguacacuuu

SEQ ID NO: 2428780 - RNA, 13 nt, Human
auauuguacacuu

SEQ ID NO: 2428781 - RNA, 12 nt, Human
auauuguacacu

SEQ ID NO: 2428782 - RNA, 12 nt, Human
auauuguacagu

SEQ ID NO: 2428783 - RNA, 13 nt, Human
auauugguauuca

SEQ ID NO: 2428784 - RNA, 12 nt, Human
auauuguaagaa

SEQ ID NO: 2428785 - RNA, 21 nt, Human
auauugcugcugguaauuugu

SEQ ID NO: 2428786 - RNA, 17 nt, Human
auauugagucaaauggu

SEQ ID NO: 2428787 - RNA, 22 nt, Human
auauugcugauggugcaaugac

SEQ ID NO: 2428788 - RNA, 16 nt, Human
auauugcuuuuucuaa

SEQ ID NO: 2428789 - RNA, 15 nt, Human
auauugcuuuuucua

SEQ ID NO: 2428790 - RNA, 13 nt, Human
auauugcuuuuuc

SEQ ID NO: 2428791 - RNA, 17 nt, Human
auauugcuucuucuccu

SEQ ID NO: 2428792 - RNA, 21 nt, Human
auauugcuuuuucuaaugugg

SEQ ID NO: 2428793 - RNA, 18 nt, Human
auauugcuuuuucuaaug

SEQ ID NO: 2428794 - RNA, 22 nt, Human
auauugcuuuuucuaauguggu

SEQ ID NO: 2428795 - RNA, 15 nt, Human
auauugguauucacu

SEQ ID NO: 2428796 - RNA, 21 nt, Human
auauguuuuuuagaucaaaua

SEQ ID NO: 2428797 - RNA, 24 nt, Human
auauguuuaccuuuuaauuaauga

SEQ ID NO: 2428798 - RNA, 16 nt, Human
auauuaaaaauauaaa

SEQ ID NO: 2428799 - RNA, 15 nt, Human
auauuaaaaauauaa

SEQ ID NO: 2428800 - RNA, 14 nt, Human
auauuaaaaauaua

SEQ ID NO: 2428801 - RNA, 13 nt, Human
auauuaaaaauau

SEQ ID NO: 2428802 - RNA, 21 nt, Human
auauuaaaauaagcacugugc

SEQ ID NO: 2428803 - RNA, 14 nt, Human
auauuaaaauaagc

SEQ ID NO: 2428804 - RNA, 17 nt, Human
auauuaaaauauggcua

SEQ ID NO: 2428805 - RNA, 23 nt, Human
auauuaaaaauauggaacuucua

SEQ ID NO: 2428806 - RNA, 21 nt, Human
auauuaaaaauauaaaacugc

SEQ ID NO: 2428807 - RNA, 18 nt, Human
auauuaaaaauauaaaac

SEQ ID NO: 2428808 - RNA, 17 nt, Human
auauuaaaaauauaaaa

SEQ ID NO: 2428809 - RNA, 22 nt, Human
auauguuuaccuuuuaauuaau

SEQ ID NO: 2428810 - RNA, 20 nt, Human
auauguuuaccuuuuaauua

SEQ ID NO: 2428811 - RNA, 17 nt, Human
auauguuuaccuuuuaa

SEQ ID NO: 2428812 - RNA, 15 nt, Human
auauguugaauacuu

SEQ ID NO: 2428813 - RNA, 16 nt, Human
auauguugaauacuuu

SEQ ID NO: 2428814 - RNA, 17 nt, Human
auauguugaauacuuuu

SEQ ID NO: 2428815 - RNA, 18 nt, Human
auauguugaauacuuuuu

SEQ ID NO: 2428816 - RNA, 13 nt, Human
auauguugcucag

SEQ ID NO: 2428817 - RNA, 14 nt, Human
auauguugaugaaa

SEQ ID NO: 2428818 - RNA, 22 nt, Human
auauguugaugaaaaauagcaa

SEQ ID NO: 2428819 - RNA, 16 nt, Human
auauuaagaaagacua

SEQ ID NO: 2428820 - RNA, 15 nt, Human
auauuaagaaagacu

SEQ ID NO: 2428821 - RNA, 17 nt, Human
auauuaagaaagacuau

SEQ ID NO: 2428822 - RNA, 22 nt, Human
auauuaagaaagacuaucuaaa

SEQ ID NO: 2428823 - RNA, 17 nt, Human
auauuaccacagacaua

SEQ ID NO: 2428824 - RNA, 17 nt, Human
auauuaaugccuuuaaa

SEQ ID NO: 2428825 - RNA, 23 nt, Human
auauuaaugccuuuaaaguauga

SEQ ID NO: 2428826 - RNA, 16 nt, Human
uuccagugaggcucug

SEQ ID NO: 2428827 - RNA, 15 nt, Human
uuccagugaggcucu

SEQ ID NO: 2428828 - RNA, 11 nt, Human
uuccagucucc

SEQ ID NO: 2428829 - RNA, 20 nt, Human
uuccagucuccaccaggaac

SEQ ID NO: 2428830 - RNA, 15 nt, Human
uuccagucaggauga

SEQ ID NO: 2428831 - RNA, 15 nt, Human
uuccaguccaaucuc

SEQ ID NO: 2428832 - RNA, 17 nt, Human
uuccagucuuccugaca

SEQ ID NO: 2428833 - RNA, 18 nt, Human
uuccagucucugcaugua

SEQ ID NO: 2428834 - RNA, 22 nt, Human
uuccagucuccaccaggaaccu

SEQ ID NO: 2428835 - RNA, 22 nt, Human
uuccagugaaaucaguuacucu

SEQ ID NO: 2428836 - RNA, 21 nt, Human
uuccagugagcuuaucaugcu

SEQ ID NO: 2428837 - RNA, 16 nt, Human
uucccagcucucccuc

SEQ ID NO: 2428838 - RNA, 17 nt, Human
uucccagcucucccucu

SEQ ID NO: 2428839 - RNA, 18 nt, Human
uucccagcucucccucug

SEQ ID NO: 2428840 - RNA, 19 nt, Human
uucccagcucucccucugg

SEQ ID NO: 2428841 - RNA, 20 nt, Human
uucccagcucucccucuggc

SEQ ID NO: 2428842 - RNA, 20 nt, Human
uuccagucuuccugacacuu

SEQ ID NO: 2428843 - RNA, 22 nt, Human
uucccagcaguggacucaaaac

SEQ ID NO: 2428844 - RNA, 14 nt, Human
uucccagcucuccc

SEQ ID NO: 2428845 - RNA, 21 nt, Human
uucccagcuacaccuuucucc

SEQ ID NO: 2428846 - RNA, 12 nt, Human
uucccaggaccc

SEQ ID NO: 2428847 - RNA, 13 nt, Human
uucccaggacccu

SEQ ID NO: 2428848 - RNA, 11 nt, Human
uucccaggacc

SEQ ID NO: 2428849 - RNA, 23 nt, Human
uucccagcucucccucuggcccu

SEQ ID NO: 2428850 - RNA, 19 nt, Human
uucccaggacccugaaggg

SEQ ID NO: 2428851 - RNA, 20 nt, Human
uucccaggacccugaagggg

SEQ ID NO: 2428852 - RNA, 20 nt, Human
uucccaggaugagcauccca

SEQ ID NO: 2428853 - RNA, 16 nt, Human
auauguucugacauaa

SEQ ID NO: 2428854 - RNA, 21 nt, Human
auauguucacaccuagcguca

SEQ ID NO: 2428855 - RNA, 16 nt, Human
auauguucaacuggag

SEQ ID NO: 2428856 - RNA, 14 nt, Human
auauguugaauacu

SEQ ID NO: 2428857 - RNA, 14 nt, Human
auauguucacuguc

SEQ ID NO: 2428858 - RNA, 18 nt, Human
auauguucuuuaaaaaua

SEQ ID NO: 2428859 - RNA, 20 nt, Human
auauguguguuuaaauaaag

SEQ ID NO: 2428860 - RNA, 19 nt, Human
auauguguguuuaaauaaa

SEQ ID NO: 2428861 - RNA, 17 nt, Human
auauguguuuuucacau

SEQ ID NO: 2428862 - RNA, 19 nt, Human
auauguguuuuucacauuu

SEQ ID NO: 2428863 - RNA, 22 nt, Human
auauguguuuuucacauuugcg

SEQ ID NO: 2428864 - RNA, 20 nt, Human
auauguuaaccucaguguca

SEQ ID NO: 2428865 - RNA, 12 nt, Human
auauguucaacu

SEQ ID NO: 2428866 - RNA, 15 nt, Human
auauguucaacugga

SEQ ID NO: 2428867 - RNA, 19 nt, Human
uucccaguggcugcugccc

SEQ ID NO: 2428868 - RNA, 18 nt, Human
uucccaguggcugcugcc

SEQ ID NO: 2428869 - RNA, 17 nt, Human
uucccaguggcugcugc

SEQ ID NO: 2428870 - RNA, 16 nt, Human
uucccaguggcugcug

SEQ ID NO: 2428871 - RNA, 21 nt, Human
uucccaguggcugcugcccag

SEQ ID NO: 2428872 - RNA, 20 nt, Human
uucccaguggcugcugccca

SEQ ID NO: 2428873 - RNA, 17 nt, Human
uucccagugaauucuug

SEQ ID NO: 2428874 - RNA, 15 nt, Human
uucccaguggcugcu

SEQ ID NO: 2428875 - RNA, 14 nt, Human
uucccaguggcugc

SEQ ID NO: 2428876 - RNA, 23 nt, Human
uucccagugacacuucagagagc

SEQ ID NO: 2428877 - RNA, 20 nt, Human
uucccaggguagcccgccug

SEQ ID NO: 2428878 - RNA, 19 nt, Human
uucccaggguagcccgccu

SEQ ID NO: 2428879 - RNA, 23 nt, Human
uucccaggguagcccgccugcca

SEQ ID NO: 2428880 - RNA, 12 nt, Human
uucccaggugcu

SEQ ID NO: 2428881 - RNA, 16 nt, Human
uucccaggugcuacac

SEQ ID NO: 2428882 - RNA, 10 nt, Human
uucccagggu

SEQ ID NO: 2428883 - RNA, 22 nt, Human
uucccagggaagugcucugaua

SEQ ID NO: 2428884 - RNA, 14 nt, Human
uucccagggaagug

SEQ ID NO: 2428885 - RNA, 13 nt, Human
uucccagggaagu

SEQ ID NO: 2428886 - RNA, 19 nt, Human
aucaauguuucuucuaggu

SEQ ID NO: 2428887 - RNA, 18 nt, Human
aucaauguucauuguaau

SEQ ID NO: 2428888 - RNA, 13 nt, Human
aucaauuaaaugu

SEQ ID NO: 2428889 - RNA, 14 nt, Human
aucaauguucauug

SEQ ID NO: 2428890 - RNA, 15 nt, Human
aucaauguucauugu

SEQ ID NO: 2428891 - RNA, 16 nt, Human
aucaauguucauugua

SEQ ID NO: 2428892 - RNA, 17 nt, Human
aucaauguucauuguaa

SEQ ID NO: 2428893 - RNA, 22 nt, Human
aucaauuaauuuuuuuauuguu

SEQ ID NO: 2428894 - RNA, 15 nt, Human
aucaauuaauuuuuu

SEQ ID NO: 2428895 - RNA, 15 nt, Human
aucaauuaaauguag

SEQ ID NO: 2428896 - RNA, 14 nt, Human
aucaauuaauuuuu

SEQ ID NO: 2428897 - RNA, 14 nt, Human
aucaauuaaaugua

SEQ ID NO: 2428898 - RNA, 13 nt, Human
aucaauuuaaaaa

SEQ ID NO: 2428899 - RNA, 15 nt, Human
aucaauuuaaaccca

SEQ ID NO: 2428900 - RNA, 16 nt, Human
aucaauucauaucuau

SEQ ID NO: 2428901 - RNA, 21 nt, Human
aucaaggguacacugccuucu

SEQ ID NO: 2428902 - RNA, 13 nt, Human
aucaacucuaaua

SEQ ID NO: 2428903 - RNA, 14 nt, Human
aucaaugggaaaua

SEQ ID NO: 2428904 - RNA, 23 nt, Human
aucaauggcgcagugccucuggu

SEQ ID NO: 2428905 - RNA, 22 nt, Human
aucaauggcgcagugccucugg

SEQ ID NO: 2428906 - RNA, 13 nt, Human
aucaauguucauu

SEQ ID NO: 2428907 - RNA, 14 nt, Human
aucaauuuuucuua

SEQ ID NO: 2428908 - RNA, 21 nt, Human
aucaauuuaaacccauuuuag

SEQ ID NO: 2428909 - RNA, 17 nt, Human
aucaauuuaaacccauu

SEQ ID NO: 2428910 - RNA, 16 nt, Human
aucaauuuaaacccau

SEQ ID NO: 2428911 - RNA, 19 nt, Human
aucaauuuuucuuauuuca

SEQ ID NO: 2428912 - RNA, 17 nt, Human
aucacgccacugcacua

SEQ ID NO: 2428913 - RNA, 15 nt, Human
aucacgccacugcac

SEQ ID NO: 2428914 - RNA, 15 nt, Human
aucacgcuccccgcc

SEQ ID NO: 2428915 - RNA, 13 nt, Human
aucacgcuccccg

SEQ ID NO: 2428916 - RNA, 12 nt, Human
aucacgcucccc

SEQ ID NO: 2428917 - RNA, 20 nt, Human
aucaauuuguaauugcuuac

SEQ ID NO: 2428918 - RNA, 13 nt, Human
aucacgcuuuccu

SEQ ID NO: 2428919 - RNA, 14 nt, Human
aucacgccacugca

SEQ ID NO: 2428920 - RNA, 23 nt, Human
aucacgccacugcacuccagccu

SEQ ID NO: 2428921 - RNA, 13 nt, Human
aucacuccccucc

SEQ ID NO: 2428922 - RNA, 12 nt, Human
aucacuccccuc

SEQ ID NO: 2428923 - RNA, 14 nt, Human
aucacuccccucca

SEQ ID NO: 2428924 - RNA, 23 nt, Human
aucacgcuccccgccuguucccc

SEQ ID NO: 2428925 - RNA, 13 nt, Human
aucacucuguccu

SEQ ID NO: 2428926 - RNA, 21 nt, Human
aucacucugcugcuuagacau

SEQ ID NO: 2428927 - RNA, 14 nt, Human
aucacucugcugcu

SEQ ID NO: 2428928 - RNA, 16 nt, Human
aucaaggguacacugc

SEQ ID NO: 2428929 - RNA, 19 nt, Human
aucaacugggcugaacacu

SEQ ID NO: 2428930 - RNA, 21 nt, Human
aucaacugcaucaagauguga

SEQ ID NO: 2428931 - RNA, 13 nt, Human
aucaacugaauga

SEQ ID NO: 2428932 - RNA, 14 nt, Human
aucaacugaaugag

SEQ ID NO: 2428933 - RNA, 11 nt, Human
aucaacugaau

SEQ ID NO: 2428934 - RNA, 16 nt, Human
aucaaauaugcaaagc

SEQ ID NO: 2428935 - RNA, 17 nt, Human
aucaaauaugcaaagca

SEQ ID NO: 2428936 - RNA, 18 nt, Human
aucaaauaugcaaagcac

SEQ ID NO: 2428937 - RNA, 19 nt, Human
uuccuguuuuucacauuuu

SEQ ID NO: 2428938 - RNA, 23 nt, Human
uuccuguuuuucacauuuuccuu

SEQ ID NO: 2428939 - RNA, 13 nt, Human
uuccuuaaacugu

SEQ ID NO: 2428940 - RNA, 15 nt, Human
uuccuuaaacugugu

SEQ ID NO: 2428941 - RNA, 16 nt, Human
uuccuuaaacugugug

SEQ ID NO: 2428942 - RNA, 17 nt, Human
uuccuuaaacugugugg

SEQ ID NO: 2428943 - RNA, 13 nt, Human
uuccuuaccuuuu

SEQ ID NO: 2428944 - RNA, 21 nt, Human
auauuuuucaugauuuugaaa

SEQ ID NO: 2428945 - RNA, 16 nt, Human
uuccuuacugcagaau

SEQ ID NO: 2428946 - RNA, 15 nt, Human
aucaaauaugcaaag

SEQ ID NO: 2428947 - RNA, 21 nt, Human
auauuuuugguugucaauauu

SEQ ID NO: 2428948 - RNA, 18 nt, Human
auauuuuugguugucaau

SEQ ID NO: 2428949 - RNA, 18 nt, Human
uuccucucuuuguucuca

SEQ ID NO: 2428950 - RNA, 15 nt, Human
uuccucucuccagau

SEQ ID NO: 2428951 - RNA, 14 nt, Human
uuccucucuccaga

SEQ ID NO: 2428952 - RNA, 22 nt, Human
uuccucucuuuguucucagcuc

SEQ ID NO: 2428953 - RNA, 21 nt, Human
uuccucucuuuguucucagcu

SEQ ID NO: 2428954 - RNA, 15 nt, Human
uuccucuuugcuuug

SEQ ID NO: 2428955 - RNA, 16 nt, Human
uuccucuuugcuuugc

SEQ ID NO: 2428956 - RNA, 13 nt, Human
uuccucugagccu

SEQ ID NO: 2428957 - RNA, 18 nt, Human
uuccucuccacugccuuc

SEQ ID NO: 2428958 - RNA, 16 nt, Human
uuccucuccacugccu

SEQ ID NO: 2428959 - RNA, 17 nt, Human
uuccuaaguauaaaugg

SEQ ID NO: 2428960 - RNA, 19 nt, Human
uuccucuccacugccuucg

SEQ ID NO: 2428961 - RNA, 16 nt, Human
uuccuaaaugcaguga

SEQ ID NO: 2428962 - RNA, 14 nt, Human
uuccuaacacagca

SEQ ID NO: 2428963 - RNA, 18 nt, Human
uuccuaacacagcaugug

SEQ ID NO: 2428964 - RNA, 19 nt, Human
uuccuaacacagcaugugu

SEQ ID NO: 2428965 - RNA, 14 nt, Human
uuccuaaggcugca

SEQ ID NO: 2428966 - RNA, 19 nt, Human
uuccuaacaggauuagaca

SEQ ID NO: 2428967 - RNA, 21 nt, Human
uuccuaaauauauuuuaagac

SEQ ID NO: 2428968 - RNA, 14 nt, Human
uuccuaaaugcagu

SEQ ID NO: 2428969 - RNA, 13 nt, Human
uuccuaaaugcag

SEQ ID NO: 2428970 - RNA, 20 nt, Human
uuccuaaauauauuuuaaga

SEQ ID NO: 2428971 - RNA, 21 nt, Human
uuccggaauccuguccucagc

SEQ ID NO: 2428972 - RNA, 22 nt, Human
uuccuggcacugcuuccaguga

SEQ ID NO: 2428973 - RNA, 20 nt, Human
uuccuggcacugcuuccagu

SEQ ID NO: 2428974 - RNA, 22 nt, Human
uuccuguuguuauggaaacugu

SEQ ID NO: 2428975 - RNA, 14 nt, Human
uuccucuuugcuuu

SEQ ID NO: 2428976 - RNA, 21 nt, Human
uuccugggaaauauucccuag

SEQ ID NO: 2428977 - RNA, 17 nt, Human
uuccugggaaauauucc

SEQ ID NO: 2428978 - RNA, 14 nt, Human
uuccuggcuucuua

SEQ ID NO: 2428979 - RNA, 19 nt, Human
uuccuggcacugcuuccag

SEQ ID NO: 2428980 - RNA, 15 nt, Human
uuccugaaaugcagu

SEQ ID NO: 2428981 - RNA, 17 nt, Human
uuccugaaagaaacagu

SEQ ID NO: 2428982 - RNA, 18 nt, Human
uuccugaaagaaacaguu

SEQ ID NO: 2428983 - RNA, 22 nt, Human
uuccucuuuuuauuuaguuccu

SEQ ID NO: 2428984 - RNA, 22 nt, Human
uuccucuuugcuuugcuuucug

SEQ ID NO: 2428985 - RNA, 12 nt, Human
uuccugaaagaa

SEQ ID NO: 2428986 - RNA, 18 nt, Human
uuccugaaacaacuugga

SEQ ID NO: 2428987 - RNA, 13 nt, Human
uuccgcuuggagc

SEQ ID NO: 2428988 - RNA, 19 nt, Human
uuccgcuuggagcagaggg

SEQ ID NO: 2428989 - RNA, 20 nt, Human
uuccgacaaccgaugcucca

SEQ ID NO: 2428990 - RNA, 22 nt, Human
uuccgacaaccgaugcuccagc

SEQ ID NO: 2428991 - RNA, 23 nt, Human
uuccgacaaccgaugcuccagcc

SEQ ID NO: 2428992 - RNA, 15 nt, Human
uucccuuuuuuuaag

SEQ ID NO: 2428993 - RNA, 23 nt, Human
uuccgaaaaauccucuuccucug

SEQ ID NO: 2428994 - RNA, 21 nt, Human
uuccgaaaaauccucuuccuc

SEQ ID NO: 2428995 - RNA, 20 nt, Human
uuccgaaaccaaagaagaaa

SEQ ID NO: 2428996 - RNA, 20 nt, Human
uuccgaaaaauccucuuccu

SEQ ID NO: 2428997 - RNA, 15 nt, Human
uucccuaccucaggc

SEQ ID NO: 2428998 - RNA, 13 nt, Human
uucccuaccucag

SEQ ID NO: 2428999 - RNA, 14 nt, Human
uucccuaccucagg

SEQ ID NO: 2429000 - RNA, 16 nt, Human
uucccuaaucuauggu

SEQ ID NO: 2429001 - RNA, 19 nt, Human
uucccuaagccaagggccu

SEQ ID NO: 2429002 - RNA, 17 nt, Human
uucccguggccccagcc

SEQ ID NO: 2429003 - RNA, 16 nt, Human
uucccguggccccagc

SEQ ID NO: 2429004 - RNA, 15 nt, Human
uucccguggccccag

SEQ ID NO: 2429005 - RNA, 13 nt, Human
uucccguggcccc

SEQ ID NO: 2429006 - RNA, 15 nt, Human
uucccguuucuccac

SEQ ID NO: 2429007 - RNA, 14 nt, Human
uucccguuucucca

SEQ ID NO: 2429008 - RNA, 17 nt, Human
uucccguuucuccaccu

SEQ ID NO: 2429009 - RNA, 19 nt, Human
uucccguggccccagccug

SEQ ID NO: 2429010 - RNA, 15 nt, Human
uucccuaagccaagg

SEQ ID NO: 2429011 - RNA, 21 nt, Human
auauuugaauguaugcuucau

SEQ ID NO: 2429012 - RNA, 19 nt, Human
auauuugaaucuugucuca

SEQ ID NO: 2429013 - RNA, 18 nt, Human
auauuugaaucuugucuc

SEQ ID NO: 2429014 - RNA, 17 nt, Human
auauuugaaucuugucu

SEQ ID NO: 2429015 - RNA, 23 nt, Human
auauuuacagugaaaauguaagc

SEQ ID NO: 2429016 - RNA, 16 nt, Human
auauuugaaucuuguc

SEQ ID NO: 2429017 - RNA, 21 nt, Human
auauuugaaucuugucucaau

SEQ ID NO: 2429018 - RNA, 13 nt, Human
auauuugcuuuuu

SEQ ID NO: 2429019 - RNA, 23 nt, Human
uucccgagcaaagucuaaaguuu

SEQ ID NO: 2429020 - RNA, 22 nt, Human
uucccgagcaaagucuaaaguu

SEQ ID NO: 2429021 - RNA, 12 nt, Human
uucccgcucagc

SEQ ID NO: 2429022 - RNA, 15 nt, Human
uucccgcucagcccu

SEQ ID NO: 2429023 - RNA, 14 nt, Human
uucccgcucagccc

SEQ ID NO: 2429024 - RNA, 21 nt, Human
uuccccuugcccuugcccuga

SEQ ID NO: 2429025 - RNA, 20 nt, Human
uuccccuugcccuugcccug

SEQ ID NO: 2429026 - RNA, 14 nt, Human
uuccccuugcccuu

SEQ ID NO: 2429027 - RNA, 13 nt, Human
uuccccuugcccu

SEQ ID NO: 2429028 - RNA, 23 nt, Human
uuccccuugcccuugcccugacc

SEQ ID NO: 2429029 - RNA, 22 nt, Human
uuccccuugcccuugcccugac

SEQ ID NO: 2429030 - RNA, 14 nt, Human
uuccccuuucccca

SEQ ID NO: 2429031 - RNA, 17 nt, Human
uuccccuuuccccacuc

SEQ ID NO: 2429032 - RNA, 21 nt, Human
uucccgagcaaagucuaaagu

SEQ ID NO: 2429033 - RNA, 23 nt, Human
uucccgaaccccaaggagggaga

SEQ ID NO: 2429034 - RNA, 23 nt, Human
uucauaugacauucaugccuggc

SEQ ID NO: 2429035 - RNA, 16 nt, Human
uucaucaaauggaaga

SEQ ID NO: 2429036 - RNA, 19 nt, Human
uucaucaaauggaagacac

SEQ ID NO: 2429037 - RNA, 18 nt, Human
uucauauaugaggacuug

SEQ ID NO: 2429038 - RNA, 21 nt, Human
uucauauaugaggacuugugu

SEQ ID NO: 2429039 - RNA, 20 nt, Human
uucauaugacauucaugccu

SEQ ID NO: 2429040 - RNA, 20 nt, Human
uucauaucuauuuauuaaau

SEQ ID NO: 2429041 - RNA, 17 nt, Human
uucauaguaacuucuua

SEQ ID NO: 2429042 - RNA, 19 nt, Human
uucauaggucacuggcucu

SEQ ID NO: 2429043 - RNA, 14 nt, Human
uucauaggucacug

SEQ ID NO: 2429044 - RNA, 16 nt, Human
uucagugauuacuguc

SEQ ID NO: 2429045 - RNA, 19 nt, Human
uucauagggucucuucagg

SEQ ID NO: 2429046 - RNA, 20 nt, Human
uucagugagggucuucuuac

SEQ ID NO: 2429047 - RNA, 16 nt, Human
uucagugaaagcauca

SEQ ID NO: 2429048 - RNA, 16 nt, Human
uucagguauguugccu

SEQ ID NO: 2429049 - RNA, 19 nt, Human
uucagguagcugccccugg

SEQ ID NO: 2429050 - RNA, 14 nt, Human
uucagguacuaaau

SEQ ID NO: 2429051 - RNA, 17 nt, Human
uucagguaacaggcaga

SEQ ID NO: 2429052 - RNA, 19 nt, Human
uucaggugacaugugaaac

SEQ ID NO: 2429053 - RNA, 18 nt, Human
uucaggugacaugugaaa

SEQ ID NO: 2429054 - RNA, 17 nt, Human
uucaggugacaugugaa

SEQ ID NO: 2429055 - RNA, 16 nt, Human
uucaggugacauguga

SEQ ID NO: 2429056 - RNA, 14 nt, Human
uucaggugacaugu

SEQ ID NO: 2429057 - RNA, 13 nt, Human
uucaggugacaug

SEQ ID NO: 2429058 - RNA, 23 nt, Human
uucaggugacaugugaaaccuuu

SEQ ID NO: 2429059 - RNA, 22 nt, Human
uucaggugacaugugaaaccuu

SEQ ID NO: 2429060 - RNA, 21 nt, Human
uucaggugacaugugaaaccu

SEQ ID NO: 2429061 - RNA, 21 nt, Human
uucagguuaucgaaauaacaa

SEQ ID NO: 2429062 - RNA, 20 nt, Human
uucagguuaucgaaauaaca

SEQ ID NO: 2429063 - RNA, 19 nt, Human
uucagguuaucgaaauaac

SEQ ID NO: 2429064 - RNA, 20 nt, Human
uucagguguuuaguugcaga

SEQ ID NO: 2429065 - RNA, 14 nt, Human
uucaguaagccgug

SEQ ID NO: 2429066 - RNA, 16 nt, Human
uucagguuuuaguuuu

SEQ ID NO: 2429067 - RNA, 22 nt, Human
uucagguuaucgaaauaacaau

SEQ ID NO: 2429068 - RNA, 24 nt, Human
uucagguuaucgaaauaacaaugu

SEQ ID NO: 2429069 - RNA, 15 nt, Human
uucagguuuuguaaa

SEQ ID NO: 2429070 - RNA, 19 nt, Human
uucagguuuuguaaagaug

SEQ ID NO: 2429071 - RNA, 21 nt, Human
uucagucauauaaaagcuaug

SEQ ID NO: 2429072 - RNA, 21 nt, Human
uucaguauuuuggagaaauua

SEQ ID NO: 2429073 - RNA, 20 nt, Human
uucaguauuuuggagaaauu

SEQ ID NO: 2429074 - RNA, 19 nt, Human
uucaguauuuuggagaaau

SEQ ID NO: 2429075 - RNA, 18 nt, Human
uucaguauuuuggagaaa

SEQ ID NO: 2429076 - RNA, 15 nt, Human
uucaguaaaaaacaa

SEQ ID NO: 2429077 - RNA, 20 nt, Human
auauauggcagaguuguaaa

SEQ ID NO: 2429078 - RNA, 19 nt, Human
auauauggcagaguuguaa

SEQ ID NO: 2429079 - RNA, 17 nt, Human
auauauggcagaguugu

SEQ ID NO: 2429080 - RNA, 14 nt, Human
auauauggcagagu

SEQ ID NO: 2429081 - RNA, 13 nt, Human
auauauggcagag

SEQ ID NO: 2429082 - RNA, 14 nt, Human
auauauggauaaug

SEQ ID NO: 2429083 - RNA, 19 nt, Human
uucaucauauuauacagac

SEQ ID NO: 2429084 - RNA, 22 nt, Human
auauauggcagaguuguaaaua

SEQ ID NO: 2429085 - RNA, 21 nt, Human
auauauggcagaguuguaaau

SEQ ID NO: 2429086 - RNA, 13 nt, Human
auauauguguuuu

SEQ ID NO: 2429087 - RNA, 15 nt, Human
auauauguguuuuuc

SEQ ID NO: 2429088 - RNA, 21 nt, Human
auauauguguuuuucacauuu

SEQ ID NO: 2429089 - RNA, 23 nt, Human
auauauguguuuuucacauuugc

SEQ ID NO: 2429090 - RNA, 13 nt, Human
auauaugcuaagu

SEQ ID NO: 2429091 - RNA, 15 nt, Human
uucaucaaugaauga

SEQ ID NO: 2429092 - RNA, 22 nt, Human
uucaucaaucauuguacaguuu

SEQ ID NO: 2429093 - RNA, 16 nt, Human
uucaucaaucauugua

SEQ ID NO: 2429094 - RNA, 13 nt, Human
uucaucaaucauu

SEQ ID NO: 2429095 - RNA, 14 nt, Human
uucaucaagacugg

SEQ ID NO: 2429096 - RNA, 10 nt, Human
auauauuuau

SEQ ID NO: 2429097 - RNA, 12 nt, Human
auauauuuauaa

SEQ ID NO: 2429098 - RNA, 13 nt, Human
auauauuuauaac

SEQ ID NO: 2429099 - RNA, 16 nt, Human
auauauuuaaugauaa

SEQ ID NO: 2429100 - RNA, 17 nt, Human
auauauguuuaccuuuu

SEQ ID NO: 2429101 - RNA, 23 nt, Human
auauauguguguuuaaauaaagu

SEQ ID NO: 2429102 - RNA, 14 nt, Human
auauauguuuaccu

SEQ ID NO: 2429103 - RNA, 22 nt, Human
auauauguuuuaagaggcaggg

SEQ ID NO: 2429104 - RNA, 21 nt, Human
auauauguuuuaagaggcagg

SEQ ID NO: 2429105 - RNA, 9 nt, Human
auauauuuc

SEQ ID NO: 2429106 - RNA, 14 nt, Human
auauauuuauaacu

SEQ ID NO: 2429107 - RNA, 15 nt, Human
auauauuuauaacuc

SEQ ID NO: 2429108 - RNA, 16 nt, Human
auauauuuauaacuca

SEQ ID NO: 2429109 - RNA, 21 nt, Human
auauauuuauaacucaucaua

SEQ ID NO: 2429110 - RNA, 22 nt, Human
auauauuucacguguucccucu

SEQ ID NO: 2429111 - RNA, 20 nt, Human
auauauguuuaccuuuuaau

SEQ ID NO: 2429112 - RNA, 23 nt, Human
auauauuuauaacucaucauaaa

SEQ ID NO: 2429113 - RNA, 14 nt, Human
auauauuucagaua

SEQ ID NO: 2429114 - RNA, 15 nt, Human
auauauuuuaagacg

SEQ ID NO: 2429115 - RNA, 16 nt, Human
auauauuuuacaauuu

SEQ ID NO: 2429116 - RNA, 13 nt, Human
auauauuuuaauu

SEQ ID NO: 2429117 - RNA, 21 nt, Human
uucagcacugucccuugccuc

SEQ ID NO: 2429118 - RNA, 16 nt, Human
uucagcacugucccuu

SEQ ID NO: 2429119 - RNA, 15 nt, Human
uucagcacugucccu

SEQ ID NO: 2429120 - RNA, 14 nt, Human
uucagcacuguccc

SEQ ID NO: 2429121 - RNA, 20 nt, Human
uucagauuuuaaaaagucuu

SEQ ID NO: 2429122 - RNA, 20 nt, Human
uucagcacugucccuugccu

SEQ ID NO: 2429123 - RNA, 16 nt, Human
uucagcauauuuauag

SEQ ID NO: 2429124 - RNA, 17 nt, Human
uucagcgguuuauauaa

SEQ ID NO: 2429125 - RNA, 20 nt, Human
uucagcuaagcuaggaauga

SEQ ID NO: 2429126 - RNA, 14 nt, Human
uucagcuaagcuag

SEQ ID NO: 2429127 - RNA, 24 nt, Human
uucagcgauguaugcagcuaucug

SEQ ID NO: 2429128 - RNA, 10 nt, Human
uucagccaag

SEQ ID NO: 2429129 - RNA, 16 nt, Human
uucagcgauguaugca

SEQ ID NO: 2429130 - RNA, 16 nt, Human
uucagguaacaggcag

SEQ ID NO: 2429131 - RNA, 15 nt, Human
uucagguaacaggca

SEQ ID NO: 2429132 - RNA, 22 nt, Human
uucaggguuggccccugcccgg

SEQ ID NO: 2429133 - RNA, 19 nt, Human
uucaggguuggccccugcc

SEQ ID NO: 2429134 - RNA, 17 nt, Human
uucaggguuggccccug

SEQ ID NO: 2429135 - RNA, 16 nt, Human
uucaggguuggccccu

SEQ ID NO: 2429136 - RNA, 16 nt, Human
uucagggugaugccag

SEQ ID NO: 2429137 - RNA, 18 nt, Human
uucagcucacacaugaga

SEQ ID NO: 2429138 - RNA, 14 nt, Human
uucaggguuggccc

SEQ ID NO: 2429139 - RNA, 16 nt, Human
uucacuucaucuucuc

SEQ ID NO: 2429140 - RNA, 15 nt, Human
uucacuucaucuucu

SEQ ID NO: 2429141 - RNA, 19 nt, Human
uucacuucauaauccagua

SEQ ID NO: 2429142 - RNA, 18 nt, Human
uuaucauucaaguguaaa

SEQ ID NO: 2429143 - RNA, 19 nt, Human
uuaucauucauucuuagcu

SEQ ID NO: 2429144 - RNA, 18 nt, Human
uuaucauguguaaucaau

SEQ ID NO: 2429145 - RNA, 15 nt, Human
uuaucauguguaauc

SEQ ID NO: 2429146 - RNA, 21 nt, Human
uuaucauguguaaucaauaaa

SEQ ID NO: 2429147 - RNA, 14 nt, Human
uucacuucucccaa

SEQ ID NO: 2429148 - RNA, 18 nt, Human
uucacuucaucuucucag

SEQ ID NO: 2429149 - RNA, 18 nt, Human
uucacuucucccaagacu

SEQ ID NO: 2429150 - RNA, 16 nt, Human
uucacuuuagaugcug

SEQ ID NO: 2429151 - RNA, 13 nt, Human
uucacuuuaauuc

SEQ ID NO: 2429152 - RNA, 17 nt, Human
uucacuuucaaaaacau

SEQ ID NO: 2429153 - RNA, 17 nt, Human
uucacuuuagaugcuga

SEQ ID NO: 2429154 - RNA, 19 nt, Human
uucacuuucacauagaugu

SEQ ID NO: 2429155 - RNA, 21 nt, Human
uucagaaauuggaacagaaug

SEQ ID NO: 2429156 - RNA, 13 nt, Human
uucagaaauugga

SEQ ID NO: 2429157 - RNA, 20 nt, Human
uucacuuuuagggagaguca

SEQ ID NO: 2429158 - RNA, 20 nt, Human
uucagaaauuggaacagaau

SEQ ID NO: 2429159 - RNA, 16 nt, Human
uucagaaccauccaua

SEQ ID NO: 2429160 - RNA, 12 nt, Human
uucagaaccucu

SEQ ID NO: 2429161 - RNA, 15 nt, Human
uucagaaccucuucc

SEQ ID NO: 2429162 - RNA, 16 nt, Human
uucagaaauguguuau

SEQ ID NO: 2429163 - RNA, 17 nt, Human
uucacuuuugacaaagg

SEQ ID NO: 2429164 - RNA, 20 nt, Human
uucacuuuugacaaaggcaa

SEQ ID NO: 2429165 - RNA, 23 nt, Human
uucagaaaacccuuuucuacagu

SEQ ID NO: 2429166 - RNA, 16 nt, Human
uucagauuugccuuau

SEQ ID NO: 2429167 - RNA, 21 nt, Human
uucagauucccagagcaaaau

SEQ ID NO: 2429168 - RNA, 22 nt, Human
uucagauucccagagcaaaaua

SEQ ID NO: 2429169 - RNA, 14 nt, Human
uucagauugcuuug

SEQ ID NO: 2429170 - RNA, 14 nt, Human
uucagauucccaga

SEQ ID NO: 2429171 - RNA, 16 nt, Human
uucagauauauuuuuc

SEQ ID NO: 2429172 - RNA, 15 nt, Human
uucagauauauauca

SEQ ID NO: 2429173 - RNA, 19 nt, Human
uucagauauaaaagacuga

SEQ ID NO: 2429174 - RNA, 16 nt, Human
uucagaagacacugca

SEQ ID NO: 2429175 - RNA, 16 nt, Human
uucagaaccucuuccc

SEQ ID NO: 2429176 - RNA, 17 nt, Human
uucagaaccucuucccc

SEQ ID NO: 2429177 - RNA, 18 nt, Human
uucagaaccucuucccca

SEQ ID NO: 2429178 - RNA, 19 nt, Human
uucagaaccucuuccccag

SEQ ID NO: 2429179 - RNA, 22 nt, Human
uucagauauaaaagacugacca

SEQ ID NO: 2429180 - RNA, 21 nt, Human
uucauugccuuaacuggagcc

SEQ ID NO: 2429181 - RNA, 19 nt, Human
uucauugcacuuugauuag

SEQ ID NO: 2429182 - RNA, 20 nt, Human
uucauugcccccagggcacu

SEQ ID NO: 2429183 - RNA, 12 nt, Human
uucauuguaaaa

SEQ ID NO: 2429184 - RNA, 22 nt, Human
uuccaacuguauauauucccaa

SEQ ID NO: 2429185 - RNA, 16 nt, Human
uuccaagacaugucug

SEQ ID NO: 2429186 - RNA, 21 nt, Human
uuccaagacaugucuguucua

SEQ ID NO: 2429187 - RNA, 22 nt, Human
uuccaagacaguauacaguccu

SEQ ID NO: 2429188 - RNA, 12 nt, Human
uuccaagacauu

SEQ ID NO: 2429189 - RNA, 13 nt, Human
uuccaagacauug

SEQ ID NO: 2429190 - RNA, 14 nt, Human
uuccaagacauugu

SEQ ID NO: 2429191 - RNA, 14 nt, Human
uuccaagacaguau

SEQ ID NO: 2429192 - RNA, 12 nt, Human
uuccaagacagu

SEQ ID NO: 2429193 - RNA, 21 nt, Human
uuccaauuuucuggaauacau

SEQ ID NO: 2429194 - RNA, 11 nt, Human
uuccacaaaau

SEQ ID NO: 2429195 - RNA, 18 nt, Human
uuccacaaaaucugucca

SEQ ID NO: 2429196 - RNA, 22 nt, Human
uuccaauuuacauacucugcuu

SEQ ID NO: 2429197 - RNA, 16 nt, Human
uuccaagacauuguca

SEQ ID NO: 2429198 - RNA, 17 nt, Human
uuccaagacauugucaa

SEQ ID NO: 2429199 - RNA, 19 nt, Human
uuccaagacauugucaaua

SEQ ID NO: 2429200 - RNA, 20 nt, Human
uuccaagacauugucaauaa

SEQ ID NO: 2429201 - RNA, 21 nt, Human
uucauuaccuuuuuugauaaa

SEQ ID NO: 2429202 - RNA, 13 nt, Human
uucauuaccuuuu

SEQ ID NO: 2429203 - RNA, 18 nt, Human
uucauuacagcuuaauca

SEQ ID NO: 2429204 - RNA, 13 nt, Human
uucauuacagcuu

SEQ ID NO: 2429205 - RNA, 16 nt, Human
uucauuaauucuauaa

SEQ ID NO: 2429206 - RNA, 13 nt, Human
uucauuagagcag

SEQ ID NO: 2429207 - RNA, 14 nt, Human
uucauuaucucaaa

SEQ ID NO: 2429208 - RNA, 22 nt, Human
uucauuauuaguacugcucuug

SEQ ID NO: 2429209 - RNA, 17 nt, Human
uucauuauguaaaaugu

SEQ ID NO: 2429210 - RNA, 14 nt, Human
uucauuauguaaaa

SEQ ID NO: 2429211 - RNA, 16 nt, Human
uucauugacuaucaaa

SEQ ID NO: 2429212 - RNA, 19 nt, Human
uucauucuugaaagcugug

SEQ ID NO: 2429213 - RNA, 13 nt, Human
uucauucuugaaa

SEQ ID NO: 2429214 - RNA, 22 nt, Human
uucauugagaguuuugucuuga

SEQ ID NO: 2429215 - RNA, 19 nt, Human
uucauugagaguuuugucu

SEQ ID NO: 2429216 - RNA, 17 nt, Human
uucauugagaguuuugu

SEQ ID NO: 2429217 - RNA, 18 nt, Human
uucauucuucucuagcug

SEQ ID NO: 2429218 - RNA, 18 nt, Human
uucauugauaugaaaaau

SEQ ID NO: 2429219 - RNA, 16 nt, Human
uucauucuucucuagc

SEQ ID NO: 2429220 - RNA, 13 nt, Human
uucauucuuagcu

SEQ ID NO: 2429221 - RNA, 20 nt, Human
uucauuauuggaauuaaccu

SEQ ID NO: 2429222 - RNA, 13 nt, Human
uucauuauuggaa

SEQ ID NO: 2429223 - RNA, 17 nt, Human
uucauuauuggaauuaa

SEQ ID NO: 2429224 - RNA, 18 nt, Human
uucauuauuggaauuaac

SEQ ID NO: 2429225 - RNA, 21 nt, Human
uuccacaagagcccaggccuc

SEQ ID NO: 2429226 - RNA, 21 nt, Human
uuccacagccugcaagucagu

SEQ ID NO: 2429227 - RNA, 16 nt, Human
uuccacauauaaagcu

SEQ ID NO: 2429228 - RNA, 21 nt, Human
uuccaccacagccagcaccug

SEQ ID NO: 2429229 - RNA, 16 nt, Human
uuccaccacagccagc

SEQ ID NO: 2429230 - RNA, 15 nt, Human
uuccaccacagccag

SEQ ID NO: 2429231 - RNA, 22 nt, Human
uuccacaucuacguuuuuggug

SEQ ID NO: 2429232 - RNA, 14 nt, Human
uuccacgaugaaaa

SEQ ID NO: 2429233 - RNA, 19 nt, Human
uuccacgaugaaaaacuuc

SEQ ID NO: 2429234 - RNA, 15 nt, Human
uuccacgcugucucc

SEQ ID NO: 2429235 - RNA, 15 nt, Human
uuccaccuucccaug

SEQ ID NO: 2429236 - RNA, 21 nt, Human
uuccacggagccacuccucug

SEQ ID NO: 2429237 - RNA, 22 nt, Human
uuccacggagccacuccucuga

SEQ ID NO: 2429238 - RNA, 15 nt, Human
uuccacggagccacu

SEQ ID NO: 2429239 - RNA, 18 nt, Human
uuccacgcugucuccaga

SEQ ID NO: 2429240 - RNA, 19 nt, Human
uuccacgcugucuccagac

SEQ ID NO: 2429241 - RNA, 15 nt, Human
uuccaccucccuccc

SEQ ID NO: 2429242 - RNA, 14 nt, Human
uuccaccucccucc

SEQ ID NO: 2429243 - RNA, 12 nt, Human
uuccaccagccu

SEQ ID NO: 2429244 - RNA, 13 nt, Human
uuccaccucccuc

SEQ ID NO: 2429245 - RNA, 22 nt, Human
uuccaccacagccagcaccugg

SEQ ID NO: 2429246 - RNA, 11 nt, Human
uuccaccagcc

SEQ ID NO: 2429247 - RNA, 19 nt, Human
uuccacguguuuuauuccu

SEQ ID NO: 2429248 - RNA, 17 nt, Human
uuccaggcugggagagc

SEQ ID NO: 2429249 - RNA, 15 nt, Human
uuccaggcugggaga

SEQ ID NO: 2429250 - RNA, 13 nt, Human
uuccaggcuggga

SEQ ID NO: 2429251 - RNA, 24 nt, Human
uuccacggagccacuccucugacu

SEQ ID NO: 2429252 - RNA, 19 nt, Human
uuccacgucccccuggggc

SEQ ID NO: 2429253 - RNA, 18 nt, Human
uuccagguuuaagcuguu

SEQ ID NO: 2429254 - RNA, 17 nt, Human
uuccagguuuaagcugu

SEQ ID NO: 2429255 - RNA, 19 nt, Human
uuccaguaccuuugucaca

SEQ ID NO: 2429256 - RNA, 17 nt, Human
uuccaguaccuuuguca

SEQ ID NO: 2429257 - RNA, 18 nt, Human
uuccaguaccuuugucac

SEQ ID NO: 2429258 - RNA, 15 nt, Human
auauauuuucuguuu

SEQ ID NO: 2429259 - RNA, 18 nt, Human
auauauuuuacaauuuuu

SEQ ID NO: 2429260 - RNA, 14 nt, Human
auauauuuuuauau

SEQ ID NO: 2429261 - RNA, 23 nt, Human
auauauuuuuaagauaauaauau

SEQ ID NO: 2429262 - RNA, 16 nt, Human
auauauuuuuaagaua

SEQ ID NO: 2429263 - RNA, 14 nt, Human
auauauuuuuaaga

SEQ ID NO: 2429264 - RNA, 14 nt, Human
auaugaaauuuaau

SEQ ID NO: 2429265 - RNA, 16 nt, Human
auaugaagacauaaac

SEQ ID NO: 2429266 - RNA, 15 nt, Human
auaugaagacauaaa

SEQ ID NO: 2429267 - RNA, 14 nt, Human
auaugaagacauaa

SEQ ID NO: 2429268 - RNA, 19 nt, Human
auaugaacauauuguugaa

SEQ ID NO: 2429269 - RNA, 20 nt, Human
auaugaacauauuguugaaa

SEQ ID NO: 2429270 - RNA, 15 nt, Human
auaugaacauauugu

SEQ ID NO: 2429271 - RNA, 21 nt, Human
auaugaauuuaaauauaauuc

SEQ ID NO: 2429272 - RNA, 14 nt, Human
auaugacagcuguc

SEQ ID NO: 2429273 - RNA, 15 nt, Human
auaugacagcugucc

SEQ ID NO: 2429274 - RNA, 21 nt, Human
auaugacagcugucccuguca

SEQ ID NO: 2429275 - RNA, 21 nt, Human
auaugaagcucaccuguugcu

SEQ ID NO: 2429276 - RNA, 17 nt, Human
auaugaagcucaccugu

SEQ ID NO: 2429277 - RNA, 17 nt, Human
auaugaauuuaaauaua

SEQ ID NO: 2429278 - RNA, 22 nt, Human
auaugaauacagggcaugcauu

SEQ ID NO: 2429279 - RNA, 19 nt, Human
auaugacauucaugccugg

SEQ ID NO: 2429280 - RNA, 13 nt, Human
auaugaccucaug

SEQ ID NO: 2429281 - RNA, 16 nt, Human
auaugacggaagaaca

SEQ ID NO: 2429282 - RNA, 13 nt, Human
auaugacucacau

SEQ ID NO: 2429283 - RNA, 18 nt, Human
auaugacggaagaacaua

SEQ ID NO: 2429284 - RNA, 20 nt, Human
auaugacggaagaacauaga

SEQ ID NO: 2429285 - RNA, 21 nt, Human
auaugagcuuccuucugugaa

SEQ ID NO: 2429286 - RNA, 20 nt, Human
auaugacucacaugaugcau

SEQ ID NO: 2429287 - RNA, 23 nt, Human
auaugacggaagaacauagaacu

SEQ ID NO: 2429288 - RNA, 22 nt, Human
auaugauuuuauuugacaaaau

SEQ ID NO: 2429289 - RNA, 19 nt, Human
auaugauuuuauuugacaa

SEQ ID NO: 2429290 - RNA, 16 nt, Human
auaugauuuuauuuga

SEQ ID NO: 2429291 - RNA, 14 nt, Human
auaugauuuauagu

SEQ ID NO: 2429292 - RNA, 13 nt, Human
auaugauuuauag

SEQ ID NO: 2429293 - RNA, 12 nt, Human
auaugauuuaua

SEQ ID NO: 2429294 - RNA, 22 nt, Human
auaugagcuuccuucugugaaa

SEQ ID NO: 2429295 - RNA, 23 nt, Human
auaugagaaggugccucaagaau

SEQ ID NO: 2429296 - RNA, 13 nt, Human
auaugcaaagcac

SEQ ID NO: 2429297 - RNA, 14 nt, Human
auaugcaaagcacu

SEQ ID NO: 2429298 - RNA, 22 nt, Human
auauggcucuucauaauucuaa

SEQ ID NO: 2429299 - RNA, 15 nt, Human
auauggcuauaaaua

SEQ ID NO: 2429300 - RNA, 15 nt, Human
auaugggacauuuuu

SEQ ID NO: 2429301 - RNA, 16 nt, Human
auauggccucaagauc

SEQ ID NO: 2429302 - RNA, 15 nt, Human
auauggccucaagau

SEQ ID NO: 2429303 - RNA, 15 nt, Human
auaugcaaagcacug

SEQ ID NO: 2429304 - RNA, 23 nt, Human
auauggccacaguagucuugaug

SEQ ID NO: 2429305 - RNA, 17 nt, Human
auauguaggugucugca

SEQ ID NO: 2429306 - RNA, 16 nt, Human
auauguguauguacgu

SEQ ID NO: 2429307 - RNA, 14 nt, Human
auauguguauguac

SEQ ID NO: 2429308 - RNA, 12 nt, Human
auauguguaugu

SEQ ID NO: 2429309 - RNA, 16 nt, Human
auauguguguguaugu

SEQ ID NO: 2429310 - RNA, 22 nt, Human
auauguguauguacguuuguau

SEQ ID NO: 2429311 - RNA, 20 nt, Human
auauguguguguauguuugc

SEQ ID NO: 2429312 - RNA, 15 nt, Human
uucauggacacuuug

SEQ ID NO: 2429313 - RNA, 14 nt, Human
uucauggacacuuu

SEQ ID NO: 2429314 - RNA, 20 nt, Human
uucauggacacuuugaaaug

SEQ ID NO: 2429315 - RNA, 16 nt, Human
uucauggacacuuuga

SEQ ID NO: 2429316 - RNA, 13 nt, Human
uucauuaaagcau

SEQ ID NO: 2429317 - RNA, 15 nt, Human
uucauuaauaauaaa

SEQ ID NO: 2429318 - RNA, 18 nt, Human
uucauuaauaauaaauuc

SEQ ID NO: 2429319 - RNA, 21 nt, Human
uucauuaauaauaaauucccu

SEQ ID NO: 2429320 - RNA, 19 nt, Human
uucauuaagcccucuucca

SEQ ID NO: 2429321 - RNA, 23 nt, Human
uucauuaaaggcuucucucucac

SEQ ID NO: 2429322 - RNA, 15 nt, Human
uucauuaaagcauuu

SEQ ID NO: 2429323 - RNA, 23 nt, Human
auauguaccuaacgaaguauccu

SEQ ID NO: 2429324 - RNA, 17 nt, Human
auauguacuugucaaag

SEQ ID NO: 2429325 - RNA, 17 nt, Human
auauggguucuuuuuug

SEQ ID NO: 2429326 - RNA, 23 nt, Human
auauggggggccaacaccaggga

SEQ ID NO: 2429327 - RNA, 18 nt, Human
auauggggggccaacacc

SEQ ID NO: 2429328 - RNA, 17 nt, Human
auaugggacauuuuuga

SEQ ID NO: 2429329 - RNA, 14 nt, Human
auaugggagaaaua

SEQ ID NO: 2429330 - RNA, 17 nt, Human
auaugggcauuguaguu

SEQ ID NO: 2429331 - RNA, 15 nt, Human
auaugggagaaauag

SEQ ID NO: 2429332 - RNA, 20 nt, Human
auaugggggccuggauucau

SEQ ID NO: 2429333 - RNA, 17 nt, Human
auauggggggccaacac

SEQ ID NO: 2429334 - RNA, 20 nt, Human
auauggggaugcagcauuau

SEQ ID NO: 2429335 - RNA, 16 nt, Human
auauggggaugcagca

SEQ ID NO: 2429336 - RNA, 21 nt, Human
auauguggaguucaucuugaa

SEQ ID NO: 2429337 - RNA, 20 nt, Human
auauguggaguucaucuuga

SEQ ID NO: 2429338 - RNA, 21 nt, Human
auauguacuugucaaagaagg

SEQ ID NO: 2429339 - RNA, 20 nt, Human
auauguacuugucaaagaag

SEQ ID NO: 2429340 - RNA, 19 nt, Human
auauguacuugucaaagaa

SEQ ID NO: 2429341 - RNA, 18 nt, Human
auauguaguauaaagaaa

SEQ ID NO: 2429342 - RNA, 19 nt, Human
auauguaguauaaagaaaa

SEQ ID NO: 2429343 - RNA, 17 nt, Human
uuucaccagauuugcua

SEQ ID NO: 2429344 - RNA, 22 nt, Human
uuucaccauuugauuauguagc

SEQ ID NO: 2429345 - RNA, 14 nt, Human
uuucacauuuuccu

SEQ ID NO: 2429346 - RNA, 15 nt, Human
uuucaccacauucgu

SEQ ID NO: 2429347 - RNA, 13 nt, Human
uuucaaaaacauu

SEQ ID NO: 2429348 - RNA, 13 nt, Human
uuucacauuuucc

SEQ ID NO: 2429349 - RNA, 15 nt, Human
uuucaaaaacacagu

SEQ ID NO: 2429350 - RNA, 15 nt, Human
uuucaaaaaaauaaa

SEQ ID NO: 2429351 - RNA, 17 nt, Human
uuuauuuuuuucugaau

SEQ ID NO: 2429352 - RNA, 16 nt, Human
uuuauuuuuugggaaa

SEQ ID NO: 2429353 - RNA, 14 nt, Human
uuuauuuuuuucua

SEQ ID NO: 2429354 - RNA, 14 nt, Human
uuucacucuccuug

SEQ ID NO: 2429355 - RNA, 23 nt, Human
uuucacuccggagugagaagcuu

SEQ ID NO: 2429356 - RNA, 22 nt, Human
uuucaccccucccuuucucccc

SEQ ID NO: 2429357 - RNA, 20 nt, Human
uuucaccccucccuuucucc

SEQ ID NO: 2429358 - RNA, 18 nt, Human
uuucaccccucccuuucu

SEQ ID NO: 2429359 - RNA, 17 nt, Human
uuucaccccucccuuuc

SEQ ID NO: 2429360 - RNA, 15 nt, Human
uuucaccccucccuu

SEQ ID NO: 2429361 - RNA, 14 nt, Human
uuucaccccucccu

SEQ ID NO: 2429362 - RNA, 13 nt, Human
uuucaccccuccc

SEQ ID NO: 2429363 - RNA, 22 nt, Human
uuucaccccacccuuccccucc

SEQ ID NO: 2429364 - RNA, 19 nt, Human
uuucacuggaguuacauua

SEQ ID NO: 2429365 - RNA, 18 nt, Human
uuucacuggaguuacauu

SEQ ID NO: 2429366 - RNA, 17 nt, Human
uuucacuggaguuacau

SEQ ID NO: 2429367 - RNA, 24 nt, Human
uuucacuguagaaugauuucaugc

SEQ ID NO: 2429368 - RNA, 23 nt, Human
uuucacuggccacaguuguuuga

SEQ ID NO: 2429369 - RNA, 17 nt, Human
uuucacucccuccauca

SEQ ID NO: 2429370 - RNA, 24 nt, Human
uuucacugcuggcugccuuagaac

SEQ ID NO: 2429371 - RNA, 15 nt, Human
uuucacucuccuugg

SEQ ID NO: 2429372 - RNA, 24 nt, Human
uuucacucuuauugcccacgcugg

SEQ ID NO: 2429373 - RNA, 22 nt, Human
uuucagaaaauauuauguguuu

SEQ ID NO: 2429374 - RNA, 17 nt, Human
uuucacuuuagaugcug

SEQ ID NO: 2429375 - RNA, 12 nt, Human
uuucacuuuaga

SEQ ID NO: 2429376 - RNA, 17 nt, Human
uuucacuuugugauuau

SEQ ID NO: 2429377 - RNA, 21 nt, Human
uuucacuuucacauagauguc

SEQ ID NO: 2429378 - RNA, 19 nt, Human
uuucacuauuuuuauuuau

SEQ ID NO: 2429379 - RNA, 12 nt, Human
uuucauaaagca

SEQ ID NO: 2429380 - RNA, 21 nt, Human
uuucaguugaucacuggcaau

SEQ ID NO: 2429381 - RNA, 15 nt, Human
uuucaguuuucagga

SEQ ID NO: 2429382 - RNA, 23 nt, Human
uuucccacaccguguaaaccaaa

SEQ ID NO: 2429383 - RNA, 20 nt, Human
uuucccacaccguguaaacc

SEQ ID NO: 2429384 - RNA, 15 nt, Human
uuucccaauucacau

SEQ ID NO: 2429385 - RNA, 12 nt, Human
uuuccauauguu

SEQ ID NO: 2429386 - RNA, 22 nt, Human
uuuccauauggauuuucuauug

SEQ ID NO: 2429387 - RNA, 18 nt, Human
uuuccauauggauuuucu

SEQ ID NO: 2429388 - RNA, 15 nt, Human
uuuccauaaggaaug

SEQ ID NO: 2429389 - RNA, 15 nt, Human
uuuccaguaccuuug

SEQ ID NO: 2429390 - RNA, 15 nt, Human
uuuccagucuccacc

SEQ ID NO: 2429391 - RNA, 20 nt, Human
uuuccagucuccaccaggaa

SEQ ID NO: 2429392 - RNA, 21 nt, Human
uuuccagucuccaccaggaac

SEQ ID NO: 2429393 - RNA, 19 nt, Human
uuuccagugagcuuaucau

SEQ ID NO: 2429394 - RNA, 12 nt, Human
uuuccagugcaa

SEQ ID NO: 2429395 - RNA, 19 nt, Human
uuuccauaaagaagauguu

SEQ ID NO: 2429396 - RNA, 23 nt, Human
auggaauuggagcucgugggaca

SEQ ID NO: 2429397 - RNA, 13 nt, Human
uuucccaucugca

SEQ ID NO: 2429398 - RNA, 12 nt, Human
uuucccaucugc

SEQ ID NO: 2429399 - RNA, 17 nt, Human
auggaauugauuugcau

SEQ ID NO: 2429400 - RNA, 22 nt, Human
uuucccacugcacccccuccug

SEQ ID NO: 2429401 - RNA, 12 nt, Human
uuucccauaauu

SEQ ID NO: 2429402 - RNA, 14 nt, Human
uuucccauaauuuu

SEQ ID NO: 2429403 - RNA, 11 nt, Human
uuucccaggac

SEQ ID NO: 2429404 - RNA, 14 nt, Human
uuucccaggacccu

SEQ ID NO: 2429405 - RNA, 16 nt, Human
uuucccaggacccuga

SEQ ID NO: 2429406 - RNA, 18 nt, Human
uuucccaggacccugaag

SEQ ID NO: 2429407 - RNA, 18 nt, Human
uuucccacugcacccccu

SEQ ID NO: 2429408 - RNA, 15 nt, Human
uuucccacugcaccc

SEQ ID NO: 2429409 - RNA, 12 nt, Human
uuucccacugca

SEQ ID NO: 2429410 - RNA, 21 nt, Human
uuucccacuguuuaaggaguu

SEQ ID NO: 2429411 - RNA, 20 nt, Human
uuucccagcuacaccuuucu

SEQ ID NO: 2429412 - RNA, 14 nt, Human
uuucauaaguauuu

SEQ ID NO: 2429413 - RNA, 17 nt, Human
uuucauaaguauuucaa

SEQ ID NO: 2429414 - RNA, 14 nt, Human
uuucauacacuuau

SEQ ID NO: 2429415 - RNA, 21 nt, Human
uuucauacagcauuacaaauu

SEQ ID NO: 2429416 - RNA, 18 nt, Human
uuucauacucuagauuuu

SEQ ID NO: 2429417 - RNA, 17 nt, Human
uuucauacucuagauuu

SEQ ID NO: 2429418 - RNA, 16 nt, Human
uuucauacucuagauu

SEQ ID NO: 2429419 - RNA, 18 nt, Human
uuucauaaguauuucaaa

SEQ ID NO: 2429420 - RNA, 19 nt, Human
uuucauaaguauuucaaau

SEQ ID NO: 2429421 - RNA, 14 nt, Human
uuucauaaucuuug

SEQ ID NO: 2429422 - RNA, 12 nt, Human
uuucauaaucuu

SEQ ID NO: 2429423 - RNA, 15 nt, Human
uuucauaugcuguau

SEQ ID NO: 2429424 - RNA, 19 nt, Human
uuuccagguuuaagcuguu

SEQ ID NO: 2429425 - RNA, 22 nt, Human
uuucauacucuagauuuuguuu

SEQ ID NO: 2429426 - RNA, 19 nt, Human
uuucauacucuagauuuug

SEQ ID NO: 2429427 - RNA, 20 nt, Human
uuucauagcuaagaaauaaa

SEQ ID NO: 2429428 - RNA, 20 nt, Human
uuucauagauugagaaguuu

SEQ ID NO: 2429429 - RNA, 19 nt, Human
uuuauuacuguaagaaaau

SEQ ID NO: 2429430 - RNA, 12 nt, Human
uuuauuaagaug

SEQ ID NO: 2429431 - RNA, 22 nt, Human
augcuggcuguuggcugggggc

SEQ ID NO: 2429432 - RNA, 15 nt, Human
augcugggacucagc

SEQ ID NO: 2429433 - RNA, 10 nt, Human
augcugggac

SEQ ID NO: 2429434 - RNA, 23 nt, Human
augcugggaagacgccugagcuc

SEQ ID NO: 2429435 - RNA, 9 nt, Human
augcuggga

SEQ ID NO: 2429436 - RNA, 14 nt, Human
augcugggcugggu

SEQ ID NO: 2429437 - RNA, 21 nt, Human
augcugggcuggcucccucuu

SEQ ID NO: 2429438 - RNA, 14 nt, Human
augcugggcuggcu

SEQ ID NO: 2429439 - RNA, 12 nt, Human
augcugggcugg

SEQ ID NO: 2429440 - RNA, 16 nt, Human
augcugggacucagcc

SEQ ID NO: 2429441 - RNA, 16 nt, Human
augcugggcugacggu

SEQ ID NO: 2429442 - RNA, 19 nt, Human
augcuguauauccuuucua

SEQ ID NO: 2429443 - RNA, 23 nt, Human
augcuguacaucuauuuuggauu

SEQ ID NO: 2429444 - RNA, 23 nt, Human
augcuggguuggugcacagugau

SEQ ID NO: 2429445 - RNA, 19 nt, Human
augcuggguuggugcacag

SEQ ID NO: 2429446 - RNA, 11 nt, Human
augcuggguug

SEQ ID NO: 2429447 - RNA, 16 nt, Human
augcugggcugggugc

SEQ ID NO: 2429448 - RNA, 15 nt, Human
augcugggcugggug

SEQ ID NO: 2429449 - RNA, 22 nt, Human
augcuggggcaagucccugacu

SEQ ID NO: 2429450 - RNA, 23 nt, Human
augcugucuacacuaagagagaa

SEQ ID NO: 2429451 - RNA, 19 nt, Human
augcuguauucuucuuugg

SEQ ID NO: 2429452 - RNA, 14 nt, Human
augcuguauuuuaa

SEQ ID NO: 2429453 - RNA, 14 nt, Human
augcuguauauguu

SEQ ID NO: 2429454 - RNA, 13 nt, Human
augcuuacugaua

SEQ ID NO: 2429455 - RNA, 22 nt, Human
augcuuacugauauauuuuaca

SEQ ID NO: 2429456 - RNA, 23 nt, Human
augcuuacugauauauuuuacaa

SEQ ID NO: 2429457 - RNA, 17 nt, Human
augcuuagauguuccag

SEQ ID NO: 2429458 - RNA, 19 nt, Human
augcugugcccuaaagugu

SEQ ID NO: 2429459 - RNA, 23 nt, Human
augcugugacacauggccccucc

SEQ ID NO: 2429460 - RNA, 18 nt, Human
uuuauuuuguaauuauug

SEQ ID NO: 2429461 - RNA, 14 nt, Human
uuuauuuuuuaagu

SEQ ID NO: 2429462 - RNA, 15 nt, Human
uuuauuuuugcaugg

SEQ ID NO: 2429463 - RNA, 13 nt, Human
uuuauuuuuuggg

SEQ ID NO: 2429464 - RNA, 15 nt, Human
uuuauuuuuuacauu

SEQ ID NO: 2429465 - RNA, 17 nt, Human
uuuauuuuuuaaguauu

SEQ ID NO: 2429466 - RNA, 21 nt, Human
uuuauuuucuuuuguaaaugu

SEQ ID NO: 2429467 - RNA, 16 nt, Human
uuuauuuuccucccca

SEQ ID NO: 2429468 - RNA, 22 nt, Human
uuuauuuucugguagauagaaa

SEQ ID NO: 2429469 - RNA, 14 nt, Human
auggaauaacaugu

SEQ ID NO: 2429470 - RNA, 15 nt, Human
auggaauaacaugua

SEQ ID NO: 2429471 - RNA, 16 nt, Human
uuuauuuuaauaaugu

SEQ ID NO: 2429472 - RNA, 16 nt, Human
auggaaccgcaggaag

SEQ ID NO: 2429473 - RNA, 17 nt, Human
auggaagguuuguauau

SEQ ID NO: 2429474 - RNA, 22 nt, Human
auggaagguuuguauauuguca

SEQ ID NO: 2429475 - RNA, 17 nt, Human
auggaacacucugagac

SEQ ID NO: 2429476 - RNA, 18 nt, Human
auggaacacucugagacu

SEQ ID NO: 2429477 - RNA, 15 nt, Human
augcuuagucacugc

SEQ ID NO: 2429478 - RNA, 15 nt, Human
augcuuaguaaugcu

SEQ ID NO: 2429479 - RNA, 14 nt, Human
augcuuaguaaugc

SEQ ID NO: 2429480 - RNA, 15 nt, Human
augcuuacaaaaaag

SEQ ID NO: 2429481 - RNA, 15 nt, Human
augcuuagucccuca

SEQ ID NO: 2429482 - RNA, 21 nt, Human
augcuuagucccucaugcaaa

SEQ ID NO: 2429483 - RNA, 23 nt, Human
augcuuagucacugccugcagag

SEQ ID NO: 2429484 - RNA, 23 nt, Human
augcuuagucccucaugcaaauc

SEQ ID NO: 2429485 - RNA, 19 nt, Human
augcuuaucaucuaaagau

SEQ ID NO: 2429486 - RNA, 16 nt, Human
auggaacauaaaauac

SEQ ID NO: 2429487 - RNA, 14 nt, Human
augcuuauuuuaaa

SEQ ID NO: 2429488 - RNA, 15 nt, Human
auggaacaggcucag

SEQ ID NO: 2429489 - RNA, 16 nt, Human
augcuuauuuuaaaau

SEQ ID NO: 2429490 - RNA, 21 nt, Human
auggaaguacuauaauuuacc

SEQ ID NO: 2429491 - RNA, 23 nt, Human
auggaacccuuuuggcccccgag

SEQ ID NO: 2429492 - RNA, 16 nt, Human
auggaaggguuugugg

SEQ ID NO: 2429493 - RNA, 22 nt, Human
uuuagguuuuuguuuguuuccu

SEQ ID NO: 2429494 - RNA, 22 nt, Human
uuuagguguugauuuucuguug

SEQ ID NO: 2429495 - RNA, 22 nt, Human
uuuaggucaagaagaagaugga

SEQ ID NO: 2429496 - RNA, 16 nt, Human
uuuaguaaggcugugu

SEQ ID NO: 2429497 - RNA, 21 nt, Human
uuuaguaccugaaaaguaacu

SEQ ID NO: 2429498 - RNA, 15 nt, Human
uuuauauauacagua

SEQ ID NO: 2429499 - RNA, 13 nt, Human
uuuauauauacag

SEQ ID NO: 2429500 - RNA, 21 nt, Human
uuuagcugaugaacuuauucu

SEQ ID NO: 2429501 - RNA, 23 nt, Human
uuuagcugaugaacuuauucugu

SEQ ID NO: 2429502 - RNA, 19 nt, Human
uuuaggucucuuccccucu

SEQ ID NO: 2429503 - RNA, 20 nt, Human
uuuagcucaaacguggcuuu

SEQ ID NO: 2429504 - RNA, 16 nt, Human
uuuagccuucucuguu

SEQ ID NO: 2429505 - RNA, 23 nt, Human
uuuagcuacuauauaugugauga

SEQ ID NO: 2429506 - RNA, 15 nt, Human
uuuagccaccaucuu

SEQ ID NO: 2429507 - RNA, 18 nt, Human
uuuagccaaacccuuguc

SEQ ID NO: 2429508 - RNA, 15 nt, Human
uuuagccuaguucau

SEQ ID NO: 2429509 - RNA, 18 nt, Human
uuuagaguugauacuaca

SEQ ID NO: 2429510 - RNA, 13 nt, Human
uuuagauaauaca

SEQ ID NO: 2429511 - RNA, 23 nt, Human
uuuacuagggaucccucaucugu

SEQ ID NO: 2429512 - RNA, 18 nt, Human
uuuacuagggaucccuca

SEQ ID NO: 2429513 - RNA, 15 nt, Human
uuuacuaugccugug

SEQ ID NO: 2429514 - RNA, 23 nt, Human
uuuacuacuguggaaaaauauuu

SEQ ID NO: 2429515 - RNA, 20 nt, Human
uuuacuagaacacagaaagc

SEQ ID NO: 2429516 - RNA, 21 nt, Human
uuuacuacuguggaaaaauau

SEQ ID NO: 2429517 - RNA, 16 nt, Human
uuuagaucaaauacuu

SEQ ID NO: 2429518 - RNA, 17 nt, Human
uuuagaucaaauacuuu

SEQ ID NO: 2429519 - RNA, 15 nt, Human
uuuagccaaacccuu

SEQ ID NO: 2429520 - RNA, 12 nt, Human
uuuagcaugugu

SEQ ID NO: 2429521 - RNA, 16 nt, Human
uuuagcauaaaauuuu

SEQ ID NO: 2429522 - RNA, 20 nt, Human
uuuagcaugacaagccccag

SEQ ID NO: 2429523 - RNA, 23 nt, Human
uuuagcaugacaagccccaggca

SEQ ID NO: 2429524 - RNA, 15 nt, Human
uuuagauaauacacc

SEQ ID NO: 2429525 - RNA, 21 nt, Human
uuuacucaacccucucaggug

SEQ ID NO: 2429526 - RNA, 17 nt, Human
uuuacucaacccucuca

SEQ ID NO: 2429527 - RNA, 13 nt, Human
uuuacuauuuuac

SEQ ID NO: 2429528 - RNA, 18 nt, Human
uuuaugucuauuuaagcc

SEQ ID NO: 2429529 - RNA, 23 nt, Human
uuuauuaaacagauuuuuacaaa

SEQ ID NO: 2429530 - RNA, 15 nt, Human
uuuaugugaaacaug

SEQ ID NO: 2429531 - RNA, 14 nt, Human
uuuaugugaaacau

SEQ ID NO: 2429532 - RNA, 19 nt, Human
uuuaugucuaaagagcuuu

SEQ ID NO: 2429533 - RNA, 14 nt, Human
uuuaugucuaaaga

SEQ ID NO: 2429534 - RNA, 22 nt, Human
uuuaugucccuucacauaguuu

SEQ ID NO: 2429535 - RNA, 16 nt, Human
uuuaugguuucuccag

SEQ ID NO: 2429536 - RNA, 18 nt, Human
uuuauuaacaaauuaugu

SEQ ID NO: 2429537 - RNA, 12 nt, Human
uuuauuaacaaa

SEQ ID NO: 2429538 - RNA, 16 nt, Human
uuuauuacuguaagaa

SEQ ID NO: 2429539 - RNA, 19 nt, Human
uuuauuaaaugcccagccc

SEQ ID NO: 2429540 - RNA, 15 nt, Human
uuuauuaaauacaaa

SEQ ID NO: 2429541 - RNA, 21 nt, Human
uuuauuaaauacaaaacuucc

SEQ ID NO: 2429542 - RNA, 17 nt, Human
uuuauaucagccugagu

SEQ ID NO: 2429543 - RNA, 17 nt, Human
uuuauaucccauuuuua

SEQ ID NO: 2429544 - RNA, 13 nt, Human
uuuauauauuuau

SEQ ID NO: 2429545 - RNA, 15 nt, Human
uuuauauauuuauaa

SEQ ID NO: 2429546 - RNA, 15 nt, Human
uuuauaucacauguu

SEQ ID NO: 2429547 - RNA, 16 nt, Human
uuuauauauuuauaac

SEQ ID NO: 2429548 - RNA, 21 nt, Human
uuuauauauacaguaacuuua

SEQ ID NO: 2429549 - RNA, 13 nt, Human
uuuauauauguau

SEQ ID NO: 2429550 - RNA, 23 nt, Human
uuuauauauugguaacauccuuu

SEQ ID NO: 2429551 - RNA, 12 nt, Human
uuuauauauuua

SEQ ID NO: 2429552 - RNA, 17 nt, Human
uuuauaugcuucuguuu

SEQ ID NO: 2429553 - RNA, 14 nt, Human
uuuauaugaagaaa

SEQ ID NO: 2429554 - RNA, 21 nt, Human
uuuauaugaagaaaaucacuu

SEQ ID NO: 2429555 - RNA, 21 nt, Human
uuuaugguuucccccuucuac

SEQ ID NO: 2429556 - RNA, 20 nt, Human
uuuauaugcuuacugauaua

SEQ ID NO: 2429557 - RNA, 17 nt, Human
uuuauaugaagauaagu

SEQ ID NO: 2429558 - RNA, 19 nt, Human
uuuauaugaagauaagugu

SEQ ID NO: 2429559 - RNA, 22 nt, Human
uuuauguaaacugcauuagaaa

SEQ ID NO: 2429560 - RNA, 19 nt, Human
uuuauguaguaauugacau

SEQ ID NO: 2429561 - RNA, 24 nt, Human
uuuaaagcuuauuaaaacucauuu

SEQ ID NO: 2429562 - RNA, 17 nt, Human
uuuaaaggaaaaaaugu

SEQ ID NO: 2429563 - RNA, 15 nt, Human
uuuaaaggaaaaaau

SEQ ID NO: 2429564 - RNA, 12 nt, Human
uuuaaaggaaaa

SEQ ID NO: 2429565 - RNA, 17 nt, Human
uuuaaaggcccuaucug

SEQ ID NO: 2429566 - RNA, 16 nt, Human
augccggaugugcuuu

SEQ ID NO: 2429567 - RNA, 15 nt, Human
augccggaugugcuu

SEQ ID NO: 2429568 - RNA, 21 nt, Human
uuuaaaggaaaaaauguugga

SEQ ID NO: 2429569 - RNA, 14 nt, Human
augccggaugugcu

SEQ ID NO: 2429570 - RNA, 20 nt, Human
uuuaaagcaacugucuauuu

SEQ ID NO: 2429571 - RNA, 17 nt, Human
uuuaaagcaacugucua

SEQ ID NO: 2429572 - RNA, 23 nt, Human
uuuaaagcaacugucuauuucug

SEQ ID NO: 2429573 - RNA, 13 nt, Human
augcuaagugaaa

SEQ ID NO: 2429574 - RNA, 18 nt, Human
augcggcccagcccggcu

SEQ ID NO: 2429575 - RNA, 15 nt, Human
augcggcccagcccg

SEQ ID NO: 2429576 - RNA, 14 nt, Human
augcggcccagccc

SEQ ID NO: 2429577 - RNA, 13 nt, Human
augcggcccagcc

SEQ ID NO: 2429578 - RNA, 20 nt, Human
augcggcccaggauggcuuu

SEQ ID NO: 2429579 - RNA, 16 nt, Human
augcggcccaggaugg

SEQ ID NO: 2429580 - RNA, 22 nt, Human
augcgcccccuccgcccugcca

SEQ ID NO: 2429581 - RNA, 18 nt, Human
augcgcccccuccgcccu

SEQ ID NO: 2429582 - RNA, 13 nt, Human
augcgcccccucc

SEQ ID NO: 2429583 - RNA, 23 nt, Human
augcgcucagggccaugcugagg

SEQ ID NO: 2429584 - RNA, 15 nt, Human
augcgcucagggcca

SEQ ID NO: 2429585 - RNA, 12 nt, Human
augcggcccagc

SEQ ID NO: 2429586 - RNA, 18 nt, Human
augcggcaagaaggaauu

SEQ ID NO: 2429587 - RNA, 20 nt, Human
augccggugagaauaagaga

SEQ ID NO: 2429588 - RNA, 17 nt, Human
augccggaugugcuuuu

SEQ ID NO: 2429589 - RNA, 22 nt, Human
augccguggauugcacguggcc

SEQ ID NO: 2429590 - RNA, 15 nt, Human
augccucaaugugac

SEQ ID NO: 2429591 - RNA, 23 nt, Human
augcgcaggcuggcccugcccug

SEQ ID NO: 2429592 - RNA, 16 nt, Human
uuuaccugagaccagu

SEQ ID NO: 2429593 - RNA, 13 nt, Human
uuuaccugagacc

SEQ ID NO: 2429594 - RNA, 16 nt, Human
uuuaccugcaaaaaau

SEQ ID NO: 2429595 - RNA, 18 nt, Human
augcuacacacugcaugu

SEQ ID NO: 2429596 - RNA, 17 nt, Human
augcuacacacugcaug

SEQ ID NO: 2429597 - RNA, 21 nt, Human
augcuaauauaaguuucuuug

SEQ ID NO: 2429598 - RNA, 21 nt, Human
augcggcccagcccggcuccc

SEQ ID NO: 2429599 - RNA, 19 nt, Human
augcggccgcauucccuga

SEQ ID NO: 2429600 - RNA, 19 nt, Human
uuuaccuuuuuuauacaua

SEQ ID NO: 2429601 - RNA, 20 nt, Human
uuuaccuuuuuuauacauaa

SEQ ID NO: 2429602 - RNA, 14 nt, Human
uuuaccuuuuuuau

SEQ ID NO: 2429603 - RNA, 13 nt, Human
uuuaccuuguaua

SEQ ID NO: 2429604 - RNA, 21 nt, Human
uuuaccugugcguuacuaauu

SEQ ID NO: 2429605 - RNA, 15 nt, Human
uuuaccugugaaaua

SEQ ID NO: 2429606 - RNA, 16 nt, Human
uuuaccugugaaauag

SEQ ID NO: 2429607 - RNA, 14 nt, Human
uuuacuaauagaca

SEQ ID NO: 2429608 - RNA, 17 nt, Human
uuuacuaauagacaauu

SEQ ID NO: 2429609 - RNA, 19 nt, Human
uuuacuaauuuucuagauu

SEQ ID NO: 2429610 - RNA, 22 nt, Human
uuuacuaagccacaagaaauuu

SEQ ID NO: 2429611 - RNA, 21 nt, Human
uuuacuaagccacaagaaauu

SEQ ID NO: 2429612 - RNA, 20 nt, Human
uuuacuaagccacaagaaau

SEQ ID NO: 2429613 - RNA, 23 nt, Human
uuuacuaagaugacauugcuaag

SEQ ID NO: 2429614 - RNA, 21 nt, Human
uuuacuaagaugacauugcua

SEQ ID NO: 2429615 - RNA, 16 nt, Human
uuuacuaagaugacau

SEQ ID NO: 2429616 - RNA, 15 nt, Human
uuuacuaagaugaca

SEQ ID NO: 2429617 - RNA, 18 nt, Human
uuuacuaauagacaauuu

SEQ ID NO: 2429618 - RNA, 22 nt, Human
uuuacuaaagaaagauuacuua

SEQ ID NO: 2429619 - RNA, 17 nt, Human
uuuacuaaagaaagauu

SEQ ID NO: 2429620 - RNA, 15 nt, Human
uuuacuaaagaaaga

SEQ ID NO: 2429621 - RNA, 16 nt, Human
uuuaccuuuuaauuaa

SEQ ID NO: 2429622 - RNA, 18 nt, Human
uuuacgucugggagaaau

SEQ ID NO: 2429623 - RNA, 17 nt, Human
uuuacggacacccccuc

SEQ ID NO: 2429624 - RNA, 21 nt, Human
uuuaccuuuuuuauacauaaa

SEQ ID NO: 2429625 - RNA, 13 nt, Human
uuuacgcuuugau

SEQ ID NO: 2429626 - RNA, 18 nt, Human
uuuacgcuuugauucaua

SEQ ID NO: 2429627 - RNA, 13 nt, Human
uuuacggacaccc

SEQ ID NO: 2429628 - RNA, 15 nt, Human
uuuccuucagugccu

SEQ ID NO: 2429629 - RNA, 12 nt, Human
uuuccuucagug

SEQ ID NO: 2429630 - RNA, 13 nt, Human
uuuccuuaaucca

SEQ ID NO: 2429631 - RNA, 16 nt, Human
uuuccuuaauccagcu

SEQ ID NO: 2429632 - RNA, 11 nt, Human
uuuccuucagu

SEQ ID NO: 2429633 - RNA, 12 nt, Human
uuuccugugucu

SEQ ID NO: 2429634 - RNA, 17 nt, Human
augggccuccugugugu

SEQ ID NO: 2429635 - RNA, 23 nt, Human
uuuccuuaaacuguguggacugu

SEQ ID NO: 2429636 - RNA, 16 nt, Human
uuuccuuaaacugugu

SEQ ID NO: 2429637 - RNA, 19 nt, Human
uuuccuuaaauuaucuaaa

SEQ ID NO: 2429638 - RNA, 21 nt, Human
uuuccuucagugccuuaugga

SEQ ID NO: 2429639 - RNA, 18 nt, Human
uuuccuucagugccuuau

SEQ ID NO: 2429640 - RNA, 22 nt, Human
uuuccuucagugccuuauggaa

SEQ ID NO: 2429641 - RNA, 21 nt, Human
uuuccuucauucaacccaccu

SEQ ID NO: 2429642 - RNA, 19 nt, Human
uuuccuuccaucccuaccc

SEQ ID NO: 2429643 - RNA, 14 nt, Human
uuuccuuccauccc

SEQ ID NO: 2429644 - RNA, 15 nt, Human
uuuccuuccaucccu

SEQ ID NO: 2429645 - RNA, 16 nt, Human
uuuccuuccuucccug

SEQ ID NO: 2429646 - RNA, 15 nt, Human
uuuccuucucaucug

SEQ ID NO: 2429647 - RNA, 23 nt, Human
uuuccuucauucaacccaccugc

SEQ ID NO: 2429648 - RNA, 13 nt, Human
uuuccuucagugc

SEQ ID NO: 2429649 - RNA, 16 nt, Human
uuuccuuuuuuguuau

SEQ ID NO: 2429650 - RNA, 17 nt, Human
uuuccuuuuuuguuauu

SEQ ID NO: 2429651 - RNA, 15 nt, Human
uuuccuuuuuuaaaa

SEQ ID NO: 2429652 - RNA, 16 nt, Human
uuuccuuuuuuaaaaa

SEQ ID NO: 2429653 - RNA, 22 nt, Human
uuuccuuuuuuauacacauaau

SEQ ID NO: 2429654 - RNA, 18 nt, Human
uuuccuuuuuuauacaca

SEQ ID NO: 2429655 - RNA, 13 nt, Human
uuuccuuuuuuau

SEQ ID NO: 2429656 - RNA, 21 nt, Human
uuuccuuuuuuaaaaaugcaa

SEQ ID NO: 2429657 - RNA, 16 nt, Human
uuuccuuugucaucau

SEQ ID NO: 2429658 - RNA, 23 nt, Human
uuuccuuugucaucauuguauau

SEQ ID NO: 2429659 - RNA, 12 nt, Human
uuuccuuuggag

SEQ ID NO: 2429660 - RNA, 20 nt, Human
uuuccuuuccccagcccagg

SEQ ID NO: 2429661 - RNA, 14 nt, Human
uuuccuuucucacc

SEQ ID NO: 2429662 - RNA, 21 nt, Human
uuuccuuuuaaaacacuucca

SEQ ID NO: 2429663 - RNA, 19 nt, Human
uuuccuuuauauuuaguga

SEQ ID NO: 2429664 - RNA, 23 nt, Human
uuuccuuuaaaaaaauuuaagug

SEQ ID NO: 2429665 - RNA, 17 nt, Human
uuuccuuuccccagccc

SEQ ID NO: 2429666 - RNA, 16 nt, Human
uuuccuuuccccagcc

SEQ ID NO: 2429667 - RNA, 19 nt, Human
uuuccuuucauuuacugug

SEQ ID NO: 2429668 - RNA, 21 nt, Human
uuuccuuguccccacacuccu

SEQ ID NO: 2429669 - RNA, 22 nt, Human
uuuccuuuaaaaaaauuuaagu

SEQ ID NO: 2429670 - RNA, 21 nt, Human
uuuccuuuaaaaaaauuuaag

SEQ ID NO: 2429671 - RNA, 23 nt, Human
uuuccuuggcucccauucacucu

SEQ ID NO: 2429672 - RNA, 12 nt, Human
uuuccuugcuca

SEQ ID NO: 2429673 - RNA, 16 nt, Human
uuuccuuggcuggugc

SEQ ID NO: 2429674 - RNA, 18 nt, Human
uuuccuuggggcaggcag

SEQ ID NO: 2429675 - RNA, 19 nt, Human
uuuccuuguccccacacuc

SEQ ID NO: 2429676 - RNA, 19 nt, Human
uuuccuuggggcaggcagu

SEQ ID NO: 2429677 - RNA, 16 nt, Human
uuuccuucuugccuuc

SEQ ID NO: 2429678 - RNA, 13 nt, Human
uuuccuugaagcc

SEQ ID NO: 2429679 - RNA, 14 nt, Human
uuuccuugaagccg

SEQ ID NO: 2429680 - RNA, 18 nt, Human
uuuccuucucaucuguga

SEQ ID NO: 2429681 - RNA, 14 nt, Human
uuuccuucugaagu

SEQ ID NO: 2429682 - RNA, 18 nt, Human
uuuccuuccuucccuggc

SEQ ID NO: 2429683 - RNA, 19 nt, Human
uuucuaaaacuaaauagca

SEQ ID NO: 2429684 - RNA, 14 nt, Human
uuucuaaaaaacag

SEQ ID NO: 2429685 - RNA, 15 nt, Human
uuucuaaaacuaaau

SEQ ID NO: 2429686 - RNA, 12 nt, Human
uuucuaaaacua

SEQ ID NO: 2429687 - RNA, 13 nt, Human
uuucuaaacaaga

SEQ ID NO: 2429688 - RNA, 17 nt, Human
uuucuaaacaagauuuu

SEQ ID NO: 2429689 - RNA, 13 nt, Human
uuucguggggagg

SEQ ID NO: 2429690 - RNA, 21 nt, Human
uuucgucuguuuauaaacauu

SEQ ID NO: 2429691 - RNA, 21 nt, Human
uuucgugggucuguuuuccuu

SEQ ID NO: 2429692 - RNA, 14 nt, Human
uuucguuuguuugu

SEQ ID NO: 2429693 - RNA, 14 nt, Human
uuucguuucuguau

SEQ ID NO: 2429694 - RNA, 19 nt, Human
uuucgagaagcugcucugg

SEQ ID NO: 2429695 - RNA, 15 nt, Human
uuucgagaagcugcu

SEQ ID NO: 2429696 - RNA, 15 nt, Human
uuucgacuugcauuu

SEQ ID NO: 2429697 - RNA, 19 nt, Human
uuucgacuugcauuuuugc

SEQ ID NO: 2429698 - RNA, 18 nt, Human
uuucgcaggauucuuccu

SEQ ID NO: 2429699 - RNA, 22 nt, Human
uuucgcaggauucuuccucccu

SEQ ID NO: 2429700 - RNA, 19 nt, Human
uuucgccguugaagaggaa

SEQ ID NO: 2429701 - RNA, 22 nt, Human
uuucgauucguuaagagagcaa

SEQ ID NO: 2429702 - RNA, 21 nt, Human
auggcuauaggugcuacaaaa

SEQ ID NO: 2429703 - RNA, 17 nt, Human
auggccugagaagagag

SEQ ID NO: 2429704 - RNA, 17 nt, Human
auggacggugcuccagg

SEQ ID NO: 2429705 - RNA, 13 nt, Human
auggccuccuccc

SEQ ID NO: 2429706 - RNA, 23 nt, Human
auggcuauaggugcuacaaaaac

SEQ ID NO: 2429707 - RNA, 21 nt, Human
augggacauuugcucauggaa

SEQ ID NO: 2429708 - RNA, 22 nt, Human
augggacauuugcucauggaau

SEQ ID NO: 2429709 - RNA, 16 nt, Human
auggcuauaggugcua

SEQ ID NO: 2429710 - RNA, 19 nt, Human
auggcuauaggugcuacaa

SEQ ID NO: 2429711 - RNA, 20 nt, Human
auggccucauguggcuggaa

SEQ ID NO: 2429712 - RNA, 19 nt, Human
auggccucauguggcugga

SEQ ID NO: 2429713 - RNA, 18 nt, Human
auggccucauguggcugg

SEQ ID NO: 2429714 - RNA, 17 nt, Human
auggccucauguggcug

SEQ ID NO: 2429715 - RNA, 18 nt, Human
auggccucuucagaucuc

SEQ ID NO: 2429716 - RNA, 21 nt, Human
auggacccaauauuuaccaga

SEQ ID NO: 2429717 - RNA, 18 nt, Human
auggacccaaugcacaca

SEQ ID NO: 2429718 - RNA, 13 nt, Human
auggacccaaugc

SEQ ID NO: 2429719 - RNA, 14 nt, Human
auggaccugucacg

SEQ ID NO: 2429720 - RNA, 13 nt, Human
auggccucaugug

SEQ ID NO: 2429721 - RNA, 21 nt, Human
auggccucagcugccucacuu

SEQ ID NO: 2429722 - RNA, 18 nt, Human
auggccucagcugccuca

SEQ ID NO: 2429723 - RNA, 19 nt, Human
auggccucagcugccucac

SEQ ID NO: 2429724 - RNA, 15 nt, Human
auggccucagcugcc

SEQ ID NO: 2429725 - RNA, 15 nt, Human
auggacggugcucca

SEQ ID NO: 2429726 - RNA, 13 nt, Human
auggacggugcuc

SEQ ID NO: 2429727 - RNA, 16 nt, Human
auggccucagcugccu

SEQ ID NO: 2429728 - RNA, 17 nt, Human
auggccucagcugccuc

SEQ ID NO: 2429729 - RNA, 17 nt, Human
auggaauuuguaaguuu

SEQ ID NO: 2429730 - RNA, 15 nt, Human
auggaauuuguaagu

SEQ ID NO: 2429731 - RNA, 21 nt, Human
auggaauuuguaaguuuaugu

SEQ ID NO: 2429732 - RNA, 19 nt, Human
auggacaugaucuucuuua

SEQ ID NO: 2429733 - RNA, 17 nt, Human
auggaauuucucccagu

SEQ ID NO: 2429734 - RNA, 18 nt, Human
auggaauugauuugcauu

SEQ ID NO: 2429735 - RNA, 19 nt, Human
auggaauugauuugcauug

SEQ ID NO: 2429736 - RNA, 12 nt, Human
auggaauuugua

SEQ ID NO: 2429737 - RNA, 22 nt, Human
uuucccaucugcaccccuucuc

SEQ ID NO: 2429738 - RNA, 21 nt, Human
augggcaacccccagccugcu

SEQ ID NO: 2429739 - RNA, 19 nt, Human
augggcaacccccagccug

SEQ ID NO: 2429740 - RNA, 23 nt, Human
augggagcuccucuccuggagga

SEQ ID NO: 2429741 - RNA, 22 nt, Human
augggagcuccucuccuggagg

SEQ ID NO: 2429742 - RNA, 21 nt, Human
augggagcuccucuccuggag

SEQ ID NO: 2429743 - RNA, 20 nt, Human
augggagcuccucuccugga

SEQ ID NO: 2429744 - RNA, 19 nt, Human
augggagcuccucuccugg

SEQ ID NO: 2429745 - RNA, 15 nt, Human
augggagcuccucuc

SEQ ID NO: 2429746 - RNA, 14 nt, Human
augggagcuccucu

SEQ ID NO: 2429747 - RNA, 18 nt, Human
augggcaacccccagccu

SEQ ID NO: 2429748 - RNA, 13 nt, Human
augggacauuuuu

SEQ ID NO: 2429749 - RNA, 15 nt, Human
augggacuggccucu

SEQ ID NO: 2429750 - RNA, 23 nt, Human
augggagaguagauggugaaauu

SEQ ID NO: 2429751 - RNA, 13 nt, Human
augggagccccag

SEQ ID NO: 2429752 - RNA, 13 nt, Human
augggagcucaug

SEQ ID NO: 2429753 - RNA, 17 nt, Human
augggagccgggucugc

SEQ ID NO: 2429754 - RNA, 20 nt, Human
augggagccgggucugccuc

SEQ ID NO: 2429755 - RNA, 22 nt, Human
augggagccccagggucuuccc

SEQ ID NO: 2429756 - RNA, 23 nt, Human
augggcauggggugggccucugg

SEQ ID NO: 2429757 - RNA, 22 nt, Human
augggcauggggugggccucug

SEQ ID NO: 2429758 - RNA, 23 nt, Human
augggcacugcuggguggcccau

SEQ ID NO: 2429759 - RNA, 19 nt, Human
augggcaguuacaugcaua

SEQ ID NO: 2429760 - RNA, 14 nt, Human
augggcaguuacau

SEQ ID NO: 2429761 - RNA, 12 nt, Human
augggccaccgc

SEQ ID NO: 2429762 - RNA, 13 nt, Human
augggccaccgcc

SEQ ID NO: 2429763 - RNA, 15 nt, Human
augggccuccugugu

SEQ ID NO: 2429764 - RNA, 14 nt, Human
augggcagagcaga

SEQ ID NO: 2429765 - RNA, 13 nt, Human
augggcagagcag

SEQ ID NO: 2429766 - RNA, 15 nt, Human
augggcagagcagag

SEQ ID NO: 2429767 - RNA, 22 nt, Human
augggcacugcuggguggccca

SEQ ID NO: 2429768 - RNA, 18 nt, Human
augggcacugcugggugg

SEQ ID NO: 2429769 - RNA, 14 nt, Human
augggcagagccca

SEQ ID NO: 2429770 - RNA, 14 nt, Human
augggcacugcugg

SEQ ID NO: 2429771 - RNA, 24 nt, Human
augggagcuccucuccuggaggau

SEQ ID NO: 2429772 - RNA, 19 nt, Human
uuugaaaagcuauuagcca

SEQ ID NO: 2429773 - RNA, 18 nt, Human
uuugaaaagcuauuagcc

SEQ ID NO: 2429774 - RNA, 15 nt, Human
uuugaaaagcuauua

SEQ ID NO: 2429775 - RNA, 14 nt, Human
uuugaaaagcuauu

SEQ ID NO: 2429776 - RNA, 13 nt, Human
uuugaaaagcuau

SEQ ID NO: 2429777 - RNA, 16 nt, Human
uuucuuuucucuggua

SEQ ID NO: 2429778 - RNA, 22 nt, Human
uuucuuuucuggaauguaauca

SEQ ID NO: 2429779 - RNA, 14 nt, Human
uuucuuuucacaua

SEQ ID NO: 2429780 - RNA, 22 nt, Human
uuucuuuugcccuucacagugu

SEQ ID NO: 2429781 - RNA, 23 nt, Human
uuucuuuugguaaagacuggcuu

SEQ ID NO: 2429782 - RNA, 16 nt, Human
uuucuuuuguaaaugu

SEQ ID NO: 2429783 - RNA, 15 nt, Human
uuucuuuguguagcu

SEQ ID NO: 2429784 - RNA, 16 nt, Human
uuucuuuguuaucaaa

SEQ ID NO: 2429785 - RNA, 21 nt, Human
uuucuuuucuacccuagccau

SEQ ID NO: 2429786 - RNA, 13 nt, Human
uuucuuuguggcu

SEQ ID NO: 2429787 - RNA, 20 nt, Human
uuucuuuaagauaauaguuu

SEQ ID NO: 2429788 - RNA, 13 nt, Human
uuucuuuaaugcu

SEQ ID NO: 2429789 - RNA, 21 nt, Human
uuucuuuaguuuuugugaagu

SEQ ID NO: 2429790 - RNA, 14 nt, Human
uuucuuucaaaauu

SEQ ID NO: 2429791 - RNA, 20 nt, Human
uuucuuuagagcauugccau

SEQ ID NO: 2429792 - RNA, 18 nt, Human
uuucuuuaaugcuuuuau

SEQ ID NO: 2429793 - RNA, 13 nt, Human
uuucuuucaacuu

SEQ ID NO: 2429794 - RNA, 21 nt, Human
uuucuuuagagcauugccauu

SEQ ID NO: 2429795 - RNA, 19 nt, Human
uuucuuucaacuugcaucc

SEQ ID NO: 2429796 - RNA, 11 nt, Human
uuucuggaguc

SEQ ID NO: 2429797 - RNA, 22 nt, Human
uuucuggagguugauaacuuug

SEQ ID NO: 2429798 - RNA, 21 nt, Human
uuucuggagguugauaacuuu

SEQ ID NO: 2429799 - RNA, 17 nt, Human
uuucuggagguugauaa

SEQ ID NO: 2429800 - RNA, 21 nt, Human
uuucuggaauacaugaaauau

SEQ ID NO: 2429801 - RNA, 18 nt, Human
uuucuggaauguaaucaa

SEQ ID NO: 2429802 - RNA, 21 nt, Human
uuucuggacugaagccugcag

SEQ ID NO: 2429803 - RNA, 16 nt, Human
uuucuggagguugaua

SEQ ID NO: 2429804 - RNA, 23 nt, Human
uuucuggacugaagccugcagga

SEQ ID NO: 2429805 - RNA, 15 nt, Human
uuucuuuaaaagaau

SEQ ID NO: 2429806 - RNA, 20 nt, Human
uuucuuuaaaagaaugggca

SEQ ID NO: 2429807 - RNA, 16 nt, Human
uuucuuuaagaaagua

SEQ ID NO: 2429808 - RNA, 15 nt, Human
uuucuuuaagaaagu

SEQ ID NO: 2429809 - RNA, 14 nt, Human
uuucuuuaaaagaa

SEQ ID NO: 2429810 - RNA, 13 nt, Human
uuucuuuaaaaga

SEQ ID NO: 2429811 - RNA, 15 nt, Human
uuucuuuaaaaaaca

SEQ ID NO: 2429812 - RNA, 22 nt, Human
uuucugccuggaguguaugacu

SEQ ID NO: 2429813 - RNA, 14 nt, Human
uuucugccuggagu

SEQ ID NO: 2429814 - RNA, 15 nt, Human
uuucugccuuccuug

SEQ ID NO: 2429815 - RNA, 13 nt, Human
uuucugccuuccu

SEQ ID NO: 2429816 - RNA, 20 nt, Human
uuucugccuuccuugcuaau

SEQ ID NO: 2429817 - RNA, 20 nt, Human
uuucugcccuggcugcugcc

SEQ ID NO: 2429818 - RNA, 15 nt, Human
uuucugcccuggcug

SEQ ID NO: 2429819 - RNA, 14 nt, Human
uuucugccucucaa

SEQ ID NO: 2429820 - RNA, 13 nt, Human
uuucugccucuca

SEQ ID NO: 2429821 - RNA, 14 nt, Human
uuucugcccuggcu

SEQ ID NO: 2429822 - RNA, 13 nt, Human
uuucugcccuggc

SEQ ID NO: 2429823 - RNA, 12 nt, Human
uuucugcccugg

SEQ ID NO: 2429824 - RNA, 18 nt, Human
uuucuggaauacaugaaa

SEQ ID NO: 2429825 - RNA, 20 nt, Human
uuucuggaauacaugaaaua

SEQ ID NO: 2429826 - RNA, 15 nt, Human
uuucugcucagcuuc

SEQ ID NO: 2429827 - RNA, 18 nt, Human
uuucugcucagcuucucc

SEQ ID NO: 2429828 - RNA, 20 nt, Human
uuucugcugaauuuucacau

SEQ ID NO: 2429829 - RNA, 19 nt, Human
uuucugcucagcuucuccu

SEQ ID NO: 2429830 - RNA, 23 nt, Human
uuucugcugaauuuucacaugaa

SEQ ID NO: 2429831 - RNA, 21 nt, Human
uuucugcugaauuuucacaug

SEQ ID NO: 2429832 - RNA, 19 nt, Human
uuucugcuggaaacagacu

SEQ ID NO: 2429833 - RNA, 13 nt, Human
auggggcccugcc

SEQ ID NO: 2429834 - RNA, 14 nt, Human
auggggcccugccu

SEQ ID NO: 2429835 - RNA, 11 nt, Human
auggggaggga

SEQ ID NO: 2429836 - RNA, 15 nt, Human
auggggagaaaagac

SEQ ID NO: 2429837 - RNA, 18 nt, Human
augggcuuguuuucuugc

SEQ ID NO: 2429838 - RNA, 16 nt, Human
auggggaaggaggcug

SEQ ID NO: 2429839 - RNA, 14 nt, Human
uuugaaauauugac

SEQ ID NO: 2429840 - RNA, 23 nt, Human
augggcuggguucuacccaggug

SEQ ID NO: 2429841 - RNA, 15 nt, Human
augggcuucacugua

SEQ ID NO: 2429842 - RNA, 16 nt, Human
augggcuuagagcagu

SEQ ID NO: 2429843 - RNA, 20 nt, Human
augggcuucacuguauaaau

SEQ ID NO: 2429844 - RNA, 19 nt, Human
augggcuucacuguauaaa

SEQ ID NO: 2429845 - RNA, 23 nt, Human
augggcuuguuuucuugccaaug

SEQ ID NO: 2429846 - RNA, 19 nt, Human
uuugaaacacuuugcauaa

SEQ ID NO: 2429847 - RNA, 17 nt, Human
uuugaaacacuuugcau

SEQ ID NO: 2429848 - RNA, 16 nt, Human
uuugaaacaauacuca

SEQ ID NO: 2429849 - RNA, 14 nt, Human
uuugaaauaauaaa

SEQ ID NO: 2429850 - RNA, 19 nt, Human
uuugaaauagucuguguga

SEQ ID NO: 2429851 - RNA, 20 nt, Human
uuugaaauagucugugugaa

SEQ ID NO: 2429852 - RNA, 15 nt, Human
uuugaaacaaagaag

SEQ ID NO: 2429853 - RNA, 22 nt, Human
uuucucaacaaagcacaguguu

SEQ ID NO: 2429854 - RNA, 22 nt, Human
uuucucaaaguuuugaaaagcu

SEQ ID NO: 2429855 - RNA, 18 nt, Human
uuucucaaaguuuugaaa

SEQ ID NO: 2429856 - RNA, 16 nt, Human
uuucucaaaguuuuga

SEQ ID NO: 2429857 - RNA, 15 nt, Human
uuucucaaaguuuug

SEQ ID NO: 2429858 - RNA, 14 nt, Human
uuucucaaaguuuu

SEQ ID NO: 2429859 - RNA, 13 nt, Human
uuucucaaaguuu

SEQ ID NO: 2429860 - RNA, 20 nt, Human
uuucucagcucccauuucua

SEQ ID NO: 2429861 - RNA, 15 nt, Human
uuucucagcucccau

SEQ ID NO: 2429862 - RNA, 14 nt, Human
uuucucagcuccca

SEQ ID NO: 2429863 - RNA, 18 nt, Human
uuucucaugaaucugcaa

SEQ ID NO: 2429864 - RNA, 16 nt, Human
uuucucaguuuucaua

SEQ ID NO: 2429865 - RNA, 17 nt, Human
uuucucagauccuuguu

SEQ ID NO: 2429866 - RNA, 23 nt, Human
uuucucaccgcagucgucgcaca

SEQ ID NO: 2429867 - RNA, 19 nt, Human
uuucucagacuuuggaaaa

SEQ ID NO: 2429868 - RNA, 23 nt, Human
uuucucagauccuuguuucaaac

SEQ ID NO: 2429869 - RNA, 20 nt, Human
uuucucagauccuuguuuca

SEQ ID NO: 2429870 - RNA, 23 nt, Human
uuucucagccgcuucugacugcu

SEQ ID NO: 2429871 - RNA, 14 nt, Human
uuucuauuguuacu

SEQ ID NO: 2429872 - RNA, 13 nt, Human
uuucuauuguuac

SEQ ID NO: 2429873 - RNA, 16 nt, Human
uuucuauuguacagaa

SEQ ID NO: 2429874 - RNA, 13 nt, Human
uuucuauuguaca

SEQ ID NO: 2429875 - RNA, 17 nt, Human
uuucuauugaaaaauca

SEQ ID NO: 2429876 - RNA, 13 nt, Human
uuucuauuccaaa

SEQ ID NO: 2429877 - RNA, 14 nt, Human
uuucuauuccaaag

SEQ ID NO: 2429878 - RNA, 17 nt, Human
uuucuauuucuccucca

SEQ ID NO: 2429879 - RNA, 21 nt, Human
uuucuauuuucccucgcuggg

SEQ ID NO: 2429880 - RNA, 16 nt, Human
uuucugccgcagcccu

SEQ ID NO: 2429881 - RNA, 14 nt, Human
uuucugccgcagcc

SEQ ID NO: 2429882 - RNA, 19 nt, Human
uuucugcaguagucucugu

SEQ ID NO: 2429883 - RNA, 17 nt, Human
uuucugcauauguugaa

SEQ ID NO: 2429884 - RNA, 13 nt, Human
uuucugcauaugu

SEQ ID NO: 2429885 - RNA, 13 nt, Human
uuucugcauuuug

SEQ ID NO: 2429886 - RNA, 18 nt, Human
uuucugcauuuugcuauu

SEQ ID NO: 2429887 - RNA, 16 nt, Human
uuucugccagggagcu

SEQ ID NO: 2429888 - RNA, 17 nt, Human
uuucuccaauaucagug

SEQ ID NO: 2429889 - RNA, 11 nt, Human
uuucuccagcu

SEQ ID NO: 2429890 - RNA, 20 nt, Human
uuucuccaauaucagugcuc

SEQ ID NO: 2429891 - RNA, 22 nt, Human
uuucucauuugccaauaauaau

SEQ ID NO: 2429892 - RNA, 14 nt, Human
uuucugcaucagcu

SEQ ID NO: 2429893 - RNA, 12 nt, Human
uuucucccagcu

SEQ ID NO: 2429894 - RNA, 20 nt, Human
uuucucccaggccaggcucc

SEQ ID NO: 2429895 - RNA, 18 nt, Human
uuucuccagccagcaaug

SEQ ID NO: 2429896 - RNA, 12 nt, Human
uuucuccagcug

SEQ ID NO: 2429897 - RNA, 20 nt, Human
uuucuaugaaauauuauguu

SEQ ID NO: 2429898 - RNA, 14 nt, Human
uuucuaugaaauau

SEQ ID NO: 2429899 - RNA, 20 nt, Human
uuucuaucauuuuuguacag

SEQ ID NO: 2429900 - RNA, 15 nt, Human
uuucuauccucugua

SEQ ID NO: 2429901 - RNA, 14 nt, Human
uuucuaucacauau

SEQ ID NO: 2429902 - RNA, 13 nt, Human
uuucuaugaaaua

SEQ ID NO: 2429903 - RNA, 22 nt, Human
uuucuauuaaauuaaauuuugu

SEQ ID NO: 2429904 - RNA, 15 nt, Human
uuucuaugacacaug

SEQ ID NO: 2429905 - RNA, 21 nt, Human
uuucuaugacacaugcaaggu

SEQ ID NO: 2429906 - RNA, 19 nt, Human
uuucuaguggucuuuguaa

SEQ ID NO: 2429907 - RNA, 18 nt, Human
uuucuaguggucuuugua

SEQ ID NO: 2429908 - RNA, 17 nt, Human
uuucuaguggucuuugu

SEQ ID NO: 2429909 - RNA, 14 nt, Human
uuucuaguggucuu

SEQ ID NO: 2429910 - RNA, 21 nt, Human
uuucuaguggucuuuguaaga

SEQ ID NO: 2429911 - RNA, 20 nt, Human
uuucuaguggucuuuguaag

SEQ ID NO: 2429912 - RNA, 23 nt, Human
uuucuaguggucuuuguaagagu

SEQ ID NO: 2429913 - RNA, 20 nt, Human
uuucuaggccuacaugcuuu

SEQ ID NO: 2429914 - RNA, 14 nt, Human
uuucuagggaaaug

SEQ ID NO: 2429915 - RNA, 15 nt, Human
uuucuagggaaauga

SEQ ID NO: 2429916 - RNA, 18 nt, Human
uuucuagggaaaugaaag

SEQ ID NO: 2429917 - RNA, 18 nt, Human
uuucuaaagccuuaaguc

SEQ ID NO: 2429918 - RNA, 15 nt, Human
augagaggaaaucac

SEQ ID NO: 2429919 - RNA, 14 nt, Human
augagaggaaauca

SEQ ID NO: 2429920 - RNA, 16 nt, Human
augagaggaaaucacc

SEQ ID NO: 2429921 - RNA, 17 nt, Human
augagaguuuuggaugc

SEQ ID NO: 2429922 - RNA, 15 nt, Human
augagaguuuuggau

SEQ ID NO: 2429923 - RNA, 22 nt, Human
augagagcccagagguaacaga

SEQ ID NO: 2429924 - RNA, 18 nt, Human
augagagggcaguguuuc

SEQ ID NO: 2429925 - RNA, 19 nt, Human
augagagggcaguguuucc

SEQ ID NO: 2429926 - RNA, 18 nt, Human
augagaugccugaagcca

SEQ ID NO: 2429927 - RNA, 24 nt, Human
augagaugauacauccaaagcaga

SEQ ID NO: 2429928 - RNA, 23 nt, Human
augagaugauacauccaaagcag

SEQ ID NO: 2429929 - RNA, 22 nt, Human
augagaucuaggugaggauuga

SEQ ID NO: 2429930 - RNA, 13 nt, Human
augagauccuuua

SEQ ID NO: 2429931 - RNA, 22 nt, Human
augagaucuaagccuuuccaua

SEQ ID NO: 2429932 - RNA, 23 nt, Human
augagaucuaagccuuuccauaa

SEQ ID NO: 2429933 - RNA, 20 nt, Human
augagaguuuuggaugcagu

SEQ ID NO: 2429934 - RNA, 18 nt, Human
augagaguuuuggaugca

SEQ ID NO: 2429935 - RNA, 21 nt, Human
augagaguuuuggaugcagug

SEQ ID NO: 2429936 - RNA, 13 nt, Human
augagagucacuu

SEQ ID NO: 2429937 - RNA, 16 nt, Human
augagaucaggcucug

SEQ ID NO: 2429938 - RNA, 15 nt, Human
augagaucaggcucu

SEQ ID NO: 2429939 - RNA, 16 nt, Human
augagauauuaaacca

SEQ ID NO: 2429940 - RNA, 18 nt, Human
augagaucaggcucugcc

SEQ ID NO: 2429941 - RNA, 17 nt, Human
augagaucaggcucugc

SEQ ID NO: 2429942 - RNA, 20 nt, Human
augagaucaggcucugccuc

SEQ ID NO: 2429943 - RNA, 19 nt, Human
augagaucccgccucuucu

SEQ ID NO: 2429944 - RNA, 13 nt, Human
augagaggaaauc

SEQ ID NO: 2429945 - RNA, 12 nt, Human
augagaggaaau

SEQ ID NO: 2429946 - RNA, 20 nt, Human
augagagcccagagguaaca

SEQ ID NO: 2429947 - RNA, 18 nt, Human
augagagcccagagguaa

SEQ ID NO: 2429948 - RNA, 16 nt, Human
augagagcccagaggu

SEQ ID NO: 2429949 - RNA, 14 nt, Human
augagagcccagag

SEQ ID NO: 2429950 - RNA, 13 nt, Human
augagagcccaga

SEQ ID NO: 2429951 - RNA, 23 nt, Human
augacauguuauauauuuuuugu

SEQ ID NO: 2429952 - RNA, 17 nt, Human
augacauguuauauauu

SEQ ID NO: 2429953 - RNA, 16 nt, Human
augacauucaugccug

SEQ ID NO: 2429954 - RNA, 15 nt, Human
augacauguuauaua

SEQ ID NO: 2429955 - RNA, 18 nt, Human
augacaucucaggggcca

SEQ ID NO: 2429956 - RNA, 16 nt, Human
augacaucucaggggc

SEQ ID NO: 2429957 - RNA, 19 nt, Human
augacaucacuuguacaaa

SEQ ID NO: 2429958 - RNA, 20 nt, Human
augacaucacuuguacaaaa

SEQ ID NO: 2429959 - RNA, 24 nt, Human
augacaucuucaaagcuugaagau

SEQ ID NO: 2429960 - RNA, 14 nt, Human
augacaucacuugu

SEQ ID NO: 2429961 - RNA, 18 nt, Human
augacaucacuuguacaa

SEQ ID NO: 2429962 - RNA, 18 nt, Human
augacaucaccacaguuu

SEQ ID NO: 2429963 - RNA, 22 nt, Human
augacaguuauacugucgguuu

SEQ ID NO: 2429964 - RNA, 16 nt, Human
augagccucagcaucc

SEQ ID NO: 2429965 - RNA, 15 nt, Human
augagccucagcauc

SEQ ID NO: 2429966 - RNA, 12 nt, Human
augagccucagc

SEQ ID NO: 2429967 - RNA, 11 nt, Human
augagccagac

SEQ ID NO: 2429968 - RNA, 22 nt, Human
augagcaucaggccaggcccuc

SEQ ID NO: 2429969 - RNA, 15 nt, Human
augagcaucccagga

SEQ ID NO: 2429970 - RNA, 14 nt, Human
augagcaucccagg

SEQ ID NO: 2429971 - RNA, 14 nt, Human
augagccagacaaa

SEQ ID NO: 2429972 - RNA, 21 nt, Human
augagccaccgcgcccagccu

SEQ ID NO: 2429973 - RNA, 17 nt, Human
augagcauggagcuggc

SEQ ID NO: 2429974 - RNA, 15 nt, Human
augagcauggagcug

SEQ ID NO: 2429975 - RNA, 18 nt, Human
augagcauggagcuggcc

SEQ ID NO: 2429976 - RNA, 18 nt, Human
augagccaccgcgcccag

SEQ ID NO: 2429977 - RNA, 21 nt, Human
augagcaucaggccaggcccu

SEQ ID NO: 2429978 - RNA, 20 nt, Human
augagcaucaggccaggccc

SEQ ID NO: 2429979 - RNA, 19 nt, Human
augagcaucaggccaggcc

SEQ ID NO: 2429980 - RNA, 18 nt, Human
augagcaucaggccaggc

SEQ ID NO: 2429981 - RNA, 17 nt, Human
augagcaucaggccagg

SEQ ID NO: 2429982 - RNA, 16 nt, Human
augagcaucaggccag

SEQ ID NO: 2429983 - RNA, 15 nt, Human
augagcaucaggcca

SEQ ID NO: 2429984 - RNA, 22 nt, Human
augagauuguuuuaucaugaca

SEQ ID NO: 2429985 - RNA, 18 nt, Human
augagauuguuuuaucau

SEQ ID NO: 2429986 - RNA, 18 nt, Human
augagccucagcauccug

SEQ ID NO: 2429987 - RNA, 17 nt, Human
augagccucagcauccu

SEQ ID NO: 2429988 - RNA, 19 nt, Human
augagccuacgcugaagau

SEQ ID NO: 2429989 - RNA, 16 nt, Human
augagccuacgcugaa

SEQ ID NO: 2429990 - RNA, 23 nt, Human
augagccgcugugagccccuggu

SEQ ID NO: 2429991 - RNA, 20 nt, Human
augagccgcugugagccccu

SEQ ID NO: 2429992 - RNA, 14 nt, Human
augaggucccaggc

SEQ ID NO: 2429993 - RNA, 15 nt, Human
augaggucccaggca

SEQ ID NO: 2429994 - RNA, 16 nt, Human
augaggucccaggcag

SEQ ID NO: 2429995 - RNA, 17 nt, Human
augaggucccaggcaga

SEQ ID NO: 2429996 - RNA, 18 nt, Human
augaggucccaggcagag

SEQ ID NO: 2429997 - RNA, 19 nt, Human
augaggucccaggcagaga

SEQ ID NO: 2429998 - RNA, 20 nt, Human
augaggucccaggcagagaa

SEQ ID NO: 2429999 - RNA, 23 nt, Human
augagccuacgcugaagauggca

SEQ ID NO: 2430000 - RNA, 14 nt, Human
augaggucugaaau

SEQ ID NO: 2430001 - RNA, 17 nt, Human
augaggucugaaaugga

SEQ ID NO: 2430002 - RNA, 15 nt, Human
augaggucugaaaug

SEQ ID NO: 2430003 - RNA, 14 nt, Human
augaggugcuggga

SEQ ID NO: 2430004 - RNA, 22 nt, Human
augaggugggagguggaagaag

SEQ ID NO: 2430005 - RNA, 15 nt, Human
augaggugcugggag

SEQ ID NO: 2430006 - RNA, 16 nt, Human
augaggugcugggagg

SEQ ID NO: 2430007 - RNA, 17 nt, Human
augaggugcugggaggg

SEQ ID NO: 2430008 - RNA, 18 nt, Human
augaggugcugggaggga

SEQ ID NO: 2430009 - RNA, 21 nt, Human
augaguccuugaaaauauuuu

SEQ ID NO: 2430010 - RNA, 20 nt, Human
augaguccuugaaaauauuu

SEQ ID NO: 2430011 - RNA, 18 nt, Human
augaguccuugaaaauau

SEQ ID NO: 2430012 - RNA, 16 nt, Human
augaguccuugaaaau

SEQ ID NO: 2430013 - RNA, 14 nt, Human
augaggugggaggu

SEQ ID NO: 2430014 - RNA, 13 nt, Human
augaggugggagg

SEQ ID NO: 2430015 - RNA, 19 nt, Human
augaggugcugggagggau

SEQ ID NO: 2430016 - RNA, 14 nt, Human
augauaacuggaaa

SEQ ID NO: 2430017 - RNA, 18 nt, Human
uugucacacacuuuggcu

SEQ ID NO: 2430018 - RNA, 15 nt, Human
augauaaaacacaaa

SEQ ID NO: 2430019 - RNA, 21 nt, Human
augaguuuuugauagcuuuau

SEQ ID NO: 2430020 - RNA, 16 nt, Human
augagugaauaaaugu

SEQ ID NO: 2430021 - RNA, 15 nt, Human
augagugaauaaaug

SEQ ID NO: 2430022 - RNA, 17 nt, Human
augagugcgugcucagu

SEQ ID NO: 2430023 - RNA, 16 nt, Human
augagugcgugcucag

SEQ ID NO: 2430024 - RNA, 23 nt, Human
augagugcuucagaaugugauuu

SEQ ID NO: 2430025 - RNA, 17 nt, Human
augagugaauaaauguc

SEQ ID NO: 2430026 - RNA, 17 nt, Human
augaguggcuuuaauga

SEQ ID NO: 2430027 - RNA, 19 nt, Human
augaguuuuugauagcuuu

SEQ ID NO: 2430028 - RNA, 20 nt, Human
augaguuuuugauagcuuua

SEQ ID NO: 2430029 - RNA, 13 nt, Human
augaguuuuugau

SEQ ID NO: 2430030 - RNA, 13 nt, Human
augaguuuuuccc

SEQ ID NO: 2430031 - RNA, 12 nt, Human
uugucauuaaag

SEQ ID NO: 2430032 - RNA, 14 nt, Human
uugucauuaaaggu

SEQ ID NO: 2430033 - RNA, 15 nt, Human
uugucauuagccuga

SEQ ID NO: 2430034 - RNA, 14 nt, Human
uugucauuagccug

SEQ ID NO: 2430035 - RNA, 20 nt, Human
uugucauuagccugaguaga

SEQ ID NO: 2430036 - RNA, 19 nt, Human
uugucauuagccugaguag

SEQ ID NO: 2430037 - RNA, 18 nt, Human
uugucauuagccugagua

SEQ ID NO: 2430038 - RNA, 17 nt, Human
uugucauuagccugagu

SEQ ID NO: 2430039 - RNA, 15 nt, Human
uuguccccguggucu

SEQ ID NO: 2430040 - RNA, 15 nt, Human
uugucauuuucucca

SEQ ID NO: 2430041 - RNA, 12 nt, Human
uugucauuuucu

SEQ ID NO: 2430042 - RNA, 13 nt, Human
uugucauuuauaa

SEQ ID NO: 2430043 - RNA, 15 nt, Human
uugucauugcuguug

SEQ ID NO: 2430044 - RNA, 14 nt, Human
uugucauugcuguu

SEQ ID NO: 2430045 - RNA, 19 nt, Human
uugucacgcuucuucuuuu

SEQ ID NO: 2430046 - RNA, 18 nt, Human
uugucacgcuucuucuuu

SEQ ID NO: 2430047 - RNA, 23 nt, Human
uugucaucauuguauauaugugu

SEQ ID NO: 2430048 - RNA, 21 nt, Human
uugucaucuuucuucuauuuu

SEQ ID NO: 2430049 - RNA, 21 nt, Human
uugucaucauuguauauaugu

SEQ ID NO: 2430050 - RNA, 19 nt, Human
uugucaucuuucuucuauu

SEQ ID NO: 2430051 - RNA, 22 nt, Human
uugucacaugaaacauuugcaa

SEQ ID NO: 2430052 - RNA, 14 nt, Human
uugucgcucaugug

SEQ ID NO: 2430053 - RNA, 13 nt, Human
uugugaaauuauu

SEQ ID NO: 2430054 - RNA, 17 nt, Human
uuguccuuucccuucag

SEQ ID NO: 2430055 - RNA, 15 nt, Human
uuguccuuucccuuc

SEQ ID NO: 2430056 - RNA, 14 nt, Human
uuguccuugcuggu

SEQ ID NO: 2430057 - RNA, 15 nt, Human
uuguccuccccuugg

SEQ ID NO: 2430058 - RNA, 13 nt, Human
uuguccuccccuu

SEQ ID NO: 2430059 - RNA, 16 nt, Human
uuguccuaugggaguc

SEQ ID NO: 2430060 - RNA, 18 nt, Human
uuguccguguucauacau

SEQ ID NO: 2430061 - RNA, 16 nt, Human
uuguccgcuggguggu

SEQ ID NO: 2430062 - RNA, 15 nt, Human
uugucccugugccua

SEQ ID NO: 2430063 - RNA, 16 nt, Human
uugucccucugcuacg

SEQ ID NO: 2430064 - RNA, 17 nt, Human
uugucccucugccccau

SEQ ID NO: 2430065 - RNA, 18 nt, Human
uugucccugaagagaagg

SEQ ID NO: 2430066 - RNA, 21 nt, Human
uuguccccugccugugccugc

SEQ ID NO: 2430067 - RNA, 14 nt, Human
uuguccccucuuga

SEQ ID NO: 2430068 - RNA, 21 nt, Human
uuguccccuaagaguguuuaa

SEQ ID NO: 2430069 - RNA, 15 nt, Human
uugucccucugcccc

SEQ ID NO: 2430070 - RNA, 16 nt, Human
uugucccucugcccca

SEQ ID NO: 2430071 - RNA, 20 nt, Human
uuuaaaaaaauaaaacauuu

SEQ ID NO: 2430072 - RNA, 19 nt, Human
uuuaaaaaaauaaaacauu

SEQ ID NO: 2430073 - RNA, 18 nt, Human
uuuaaaaaaauaaaacau

SEQ ID NO: 2430074 - RNA, 17 nt, Human
uuuaaaaaaauaaaaca

SEQ ID NO: 2430075 - RNA, 20 nt, Human
uuuaaaaaagaaacauuugg

SEQ ID NO: 2430076 - RNA, 19 nt, Human
uuguuuuuuuuuuccacuu

SEQ ID NO: 2430077 - RNA, 15 nt, Human
uuuaaaaaaauaaaa

SEQ ID NO: 2430078 - RNA, 15 nt, Human
uuuaaacuguguaca

SEQ ID NO: 2430079 - RNA, 19 nt, Human
uuuaaacuguguacauaac

SEQ ID NO: 2430080 - RNA, 21 nt, Human
uuuaaacuguguacauaacug

SEQ ID NO: 2430081 - RNA, 22 nt, Human
uuuaaacuguguacauaacuga

SEQ ID NO: 2430082 - RNA, 20 nt, Human
uuuaaaaaauaacuaccaag

SEQ ID NO: 2430083 - RNA, 17 nt, Human
uuuaaaaaauuaaucug

SEQ ID NO: 2430084 - RNA, 19 nt, Human
uuguuuuucauucagucuu

SEQ ID NO: 2430085 - RNA, 12 nt, Human
uuguuuuuauga

SEQ ID NO: 2430086 - RNA, 13 nt, Human
uuguuuuuccuug

SEQ ID NO: 2430087 - RNA, 21 nt, Human
uuguuuuuccuuguauuuaaa

SEQ ID NO: 2430088 - RNA, 22 nt, Human
uuguuuuuccuuguauuuaaau

SEQ ID NO: 2430089 - RNA, 18 nt, Human
uuguuuuuuuuuuccacu

SEQ ID NO: 2430090 - RNA, 19 nt, Human
augcaccuggaauauauaa

SEQ ID NO: 2430091 - RNA, 18 nt, Human
augcaccuugugucugua

SEQ ID NO: 2430092 - RNA, 16 nt, Human
augcaccuugugucug

SEQ ID NO: 2430093 - RNA, 15 nt, Human
augcaccuugugucu

SEQ ID NO: 2430094 - RNA, 13 nt, Human
augaucccugugu

SEQ ID NO: 2430095 - RNA, 16 nt, Human
uuguuuuguuuuuugg

SEQ ID NO: 2430096 - RNA, 13 nt, Human
uuguuuuguuuua

SEQ ID NO: 2430097 - RNA, 14 nt, Human
uuguuuuguuuuaa

SEQ ID NO: 2430098 - RNA, 14 nt, Human
augcaaggucauuu

SEQ ID NO: 2430099 - RNA, 16 nt, Human
augcaaggucauuuuu

SEQ ID NO: 2430100 - RNA, 22 nt, Human
augcaaacuuuauuuuguguuu

SEQ ID NO: 2430101 - RNA, 16 nt, Human
augcaccuggaauaua

SEQ ID NO: 2430102 - RNA, 14 nt, Human
augcaccuggaaua

SEQ ID NO: 2430103 - RNA, 22 nt, Human
augcaaggucauuuuuuuuaag

SEQ ID NO: 2430104 - RNA, 18 nt, Human
augcaagggacugugugu

SEQ ID NO: 2430105 - RNA, 13 nt, Human
augcaagggacug

SEQ ID NO: 2430106 - RNA, 22 nt, Human
augcaaggaccaggacucccuc

SEQ ID NO: 2430107 - RNA, 15 nt, Human
augcaaagaaaauca

SEQ ID NO: 2430108 - RNA, 22 nt, Human
augcaaaccaucauugaaaucu

SEQ ID NO: 2430109 - RNA, 21 nt, Human
augcaaaccaucauugaaauc

SEQ ID NO: 2430110 - RNA, 20 nt, Human
augcaaaccaucauugaaau

SEQ ID NO: 2430111 - RNA, 19 nt, Human
augcaaaccaucauugaaa

SEQ ID NO: 2430112 - RNA, 18 nt, Human
augcaaaccaucauugaa

SEQ ID NO: 2430113 - RNA, 16 nt, Human
augcaaaccaucauug

SEQ ID NO: 2430114 - RNA, 15 nt, Human
augaucuucuuuaua

SEQ ID NO: 2430115 - RNA, 18 nt, Human
augaucuucuuuauaauu

SEQ ID NO: 2430116 - RNA, 20 nt, Human
uuguuccccuccuccacucu

SEQ ID NO: 2430117 - RNA, 19 nt, Human
uuguuccccuccuccacuc

SEQ ID NO: 2430118 - RNA, 18 nt, Human
uuguuccccuccuccacu

SEQ ID NO: 2430119 - RNA, 16 nt, Human
uuguuccccuccucca

SEQ ID NO: 2430120 - RNA, 23 nt, Human
uuguuccccuccuccacucuccc

SEQ ID NO: 2430121 - RNA, 14 nt, Human
uuguucccucuccc

SEQ ID NO: 2430122 - RNA, 16 nt, Human
uuguucuaguuuucag

SEQ ID NO: 2430123 - RNA, 15 nt, Human
uuguucuaguuuuca

SEQ ID NO: 2430124 - RNA, 16 nt, Human
uuguucgggugugcaa

SEQ ID NO: 2430125 - RNA, 17 nt, Human
uuguucgggugugcaau

SEQ ID NO: 2430126 - RNA, 13 nt, Human
uuguucucagcuc

SEQ ID NO: 2430127 - RNA, 14 nt, Human
uuguugaggugguc

SEQ ID NO: 2430128 - RNA, 21 nt, Human
uuguugagguggucugaaugu

SEQ ID NO: 2430129 - RNA, 20 nt, Human
uuguugauaaauuccacugg

SEQ ID NO: 2430130 - RNA, 10 nt, Human
uugugugugg

SEQ ID NO: 2430131 - RNA, 13 nt, Human
uugugugugggag

SEQ ID NO: 2430132 - RNA, 15 nt, Human
uuguguguaugugua

SEQ ID NO: 2430133 - RNA, 13 nt, Human
uugugugucuuaa

SEQ ID NO: 2430134 - RNA, 15 nt, Human
uuguuccccuccucc

SEQ ID NO: 2430135 - RNA, 14 nt, Human
uuguuccccuccuc

SEQ ID NO: 2430136 - RNA, 19 nt, Human
uuguuccccaucaucugug

SEQ ID NO: 2430137 - RNA, 13 nt, Human
uuguuccccuccu

SEQ ID NO: 2430138 - RNA, 16 nt, Human
uugugugugggagugu

SEQ ID NO: 2430139 - RNA, 19 nt, Human
uugugugucuuaauuauua

SEQ ID NO: 2430140 - RNA, 19 nt, Human
uugugugugggcugugagu

SEQ ID NO: 2430141 - RNA, 17 nt, Human
uugugaacuuuuuguag

SEQ ID NO: 2430142 - RNA, 23 nt, Human
uugugaacucagccaagcacagu

SEQ ID NO: 2430143 - RNA, 22 nt, Human
uugugaacucagccaagcacag

SEQ ID NO: 2430144 - RNA, 19 nt, Human
uugugaacucagccaagca

SEQ ID NO: 2430145 - RNA, 19 nt, Human
uugugaacaagucccugua

SEQ ID NO: 2430146 - RNA, 18 nt, Human
uugugaagcaaaauuuuu

SEQ ID NO: 2430147 - RNA, 13 nt, Human
uugugaaggcagg

SEQ ID NO: 2430148 - RNA, 11 nt, Human
uugugaagagg

SEQ ID NO: 2430149 - RNA, 19 nt, Human
uugugaagaaaaauaaagu

SEQ ID NO: 2430150 - RNA, 18 nt, Human
uugugaagguggaaauaa

SEQ ID NO: 2430151 - RNA, 17 nt, Human
uugugaagguggaaaua

SEQ ID NO: 2430152 - RNA, 18 nt, Human
uugugugguuuggcccuu

SEQ ID NO: 2430153 - RNA, 18 nt, Human
uugugaagacugggaagu

SEQ ID NO: 2430154 - RNA, 22 nt, Human
uugugaaguacccguucacauu

SEQ ID NO: 2430155 - RNA, 14 nt, Human
uugugaaguacaua

SEQ ID NO: 2430156 - RNA, 19 nt, Human
uuguugcaaguacugcugu

SEQ ID NO: 2430157 - RNA, 22 nt, Human
uuguugagguggucugaauguu

SEQ ID NO: 2430158 - RNA, 21 nt, Human
uuguugauaaauuccacugga

SEQ ID NO: 2430159 - RNA, 18 nt, Human
uuguugcuguugauguuu

SEQ ID NO: 2430160 - RNA, 13 nt, Human
uuguuggaaugaa

SEQ ID NO: 2430161 - RNA, 15 nt, Human
uuguuggaucuucaa

SEQ ID NO: 2430162 - RNA, 15 nt, Human
uuguuggagccugca

SEQ ID NO: 2430163 - RNA, 21 nt, Human
uuguuggaaaagaauacagaa

SEQ ID NO: 2430164 - RNA, 20 nt, Human
uuguuggaucuucaauggcu

SEQ ID NO: 2430165 - RNA, 13 nt, Human
augauauugcaua

SEQ ID NO: 2430166 - RNA, 18 nt, Human
augauauugcauaugcau

SEQ ID NO: 2430167 - RNA, 15 nt, Human
augaucacggcucac

SEQ ID NO: 2430168 - RNA, 19 nt, Human
augaucacggcucacugca

SEQ ID NO: 2430169 - RNA, 18 nt, Human
augaucacggcucacugc

SEQ ID NO: 2430170 - RNA, 23 nt, Human
augaucacggcucacugcagccu

SEQ ID NO: 2430171 - RNA, 22 nt, Human
augaucacuaauacuaauucau

SEQ ID NO: 2430172 - RNA, 18 nt, Human
augaucagcuguuuguca

SEQ ID NO: 2430173 - RNA, 19 nt, Human
augaucagcuguuugucau

SEQ ID NO: 2430174 - RNA, 16 nt, Human
augauccuaggcauuu

SEQ ID NO: 2430175 - RNA, 22 nt, Human
augauccggauuuaauuugaua

SEQ ID NO: 2430176 - RNA, 21 nt, Human
augauccggauuuaauuugau

SEQ ID NO: 2430177 - RNA, 20 nt, Human
augaucccuguguugucucu

SEQ ID NO: 2430178 - RNA, 18 nt, Human
augaucccuguguugucu

SEQ ID NO: 2430179 - RNA, 20 nt, Human
augaucagcuguuugucaua

SEQ ID NO: 2430180 - RNA, 15 nt, Human
augaucuacucagaa

SEQ ID NO: 2430181 - RNA, 14 nt, Human
augaucuacucaga

SEQ ID NO: 2430182 - RNA, 14 nt, Human
augaucucucugaa

SEQ ID NO: 2430183 - RNA, 23 nt, Human
augaucuaccagccucccuauuu

SEQ ID NO: 2430184 - RNA, 15 nt, Human
augauccuaaugaau

SEQ ID NO: 2430185 - RNA, 14 nt, Human
augaucuucuuuau

SEQ ID NO: 2430186 - RNA, 18 nt, Human
augaucuacucagaaauu

SEQ ID NO: 2430187 - RNA, 16 nt, Human
augaucuacucagaaa

SEQ ID NO: 2430188 - RNA, 22 nt, Human
augaucucuucuuuuggcuucc

SEQ ID NO: 2430189 - RNA, 21 nt, Human
augaucugagucccaggagcu

SEQ ID NO: 2430190 - RNA, 19 nt, Human
augaauuacauuuguauaa

SEQ ID NO: 2430191 - RNA, 18 nt, Human
augaauuacauuuguaua

SEQ ID NO: 2430192 - RNA, 18 nt, Human
augaacauguacuguucu

SEQ ID NO: 2430193 - RNA, 15 nt, Human
augaacauguuccug

SEQ ID NO: 2430194 - RNA, 21 nt, Human
augaacauauuguugaaaggu

SEQ ID NO: 2430195 - RNA, 13 nt, Human
augaaccacaucu

SEQ ID NO: 2430196 - RNA, 20 nt, Human
augaaccacaucuugcucug

SEQ ID NO: 2430197 - RNA, 23 nt, Human
uugggcagcgcccuuccucucca

SEQ ID NO: 2430198 - RNA, 21 nt, Human
uugggcagcgcccuuccucuc

SEQ ID NO: 2430199 - RNA, 19 nt, Human
uugggcagcgcccuuccuc

SEQ ID NO: 2430200 - RNA, 18 nt, Human
uugggcagcgcccuuccu

SEQ ID NO: 2430201 - RNA, 22 nt, Human
uugggcagcgcccuuccucucc

SEQ ID NO: 2430202 - RNA, 13 nt, Human
uugggccagacau

SEQ ID NO: 2430203 - RNA, 20 nt, Human
uugggccugcuccagaccug

SEQ ID NO: 2430204 - RNA, 21 nt, Human
uugggcagagcuggcucugag

SEQ ID NO: 2430205 - RNA, 17 nt, Human
uugggcagagcuggcuc

SEQ ID NO: 2430206 - RNA, 22 nt, Human
uugggcagagcuggcucugagc

SEQ ID NO: 2430207 - RNA, 19 nt, Human
uugggcagaagggagaagg

SEQ ID NO: 2430208 - RNA, 12 nt, Human
uugggcagagcu

SEQ ID NO: 2430209 - RNA, 20 nt, Human
uugggcagaagggagaagga

SEQ ID NO: 2430210 - RNA, 21 nt, Human
uugggcggcugagagccccag

SEQ ID NO: 2430211 - RNA, 18 nt, Human
uugggcggcugagagccc

SEQ ID NO: 2430212 - RNA, 16 nt, Human
uugggcggcugagagc

SEQ ID NO: 2430213 - RNA, 16 nt, Human
uugggcuccuuuuucu

SEQ ID NO: 2430214 - RNA, 15 nt, Human
uugggcuccuuuuuc

SEQ ID NO: 2430215 - RNA, 13 nt, Human
uugggcugagacu

SEQ ID NO: 2430216 - RNA, 22 nt, Human
uugggcugugcggaucucugga

SEQ ID NO: 2430217 - RNA, 19 nt, Human
uugggcuggaacagauuca

SEQ ID NO: 2430218 - RNA, 15 nt, Human
uugggcugagacugg

SEQ ID NO: 2430219 - RNA, 19 nt, Human
uuggggaagaacgaagcca

SEQ ID NO: 2430220 - RNA, 17 nt, Human
uugggguacccacugcu

SEQ ID NO: 2430221 - RNA, 15 nt, Human
uuggggucugacccc

SEQ ID NO: 2430222 - RNA, 14 nt, Human
uuggggucugaccc

SEQ ID NO: 2430223 - RNA, 16 nt, Human
uuggggucagccaggg

SEQ ID NO: 2430224 - RNA, 13 nt, Human
uuggggucagcca

SEQ ID NO: 2430225 - RNA, 18 nt, Human
uugguuaagucuguuuua

SEQ ID NO: 2430226 - RNA, 16 nt, Human
uuggggucugccacca

SEQ ID NO: 2430227 - RNA, 15 nt, Human
uuggggucagccagg

SEQ ID NO: 2430228 - RNA, 17 nt, Human
uuggggucuggcagccu

SEQ ID NO: 2430229 - RNA, 22 nt, Human
uugggguacccacugcucuggu

SEQ ID NO: 2430230 - RNA, 21 nt, Human
uugggguagcuagaggaacca

SEQ ID NO: 2430231 - RNA, 19 nt, Human
uugguuaggcauuguggga

SEQ ID NO: 2430232 - RNA, 16 nt, Human
uugguuaagucuguuu

SEQ ID NO: 2430233 - RNA, 17 nt, Human
uugguuuuguuccccuc

SEQ ID NO: 2430234 - RNA, 14 nt, Human
uugguuuuguuccc

SEQ ID NO: 2430235 - RNA, 15 nt, Human
uugguucauaaauga

SEQ ID NO: 2430236 - RNA, 14 nt, Human
uugguucauaaaug

SEQ ID NO: 2430237 - RNA, 14 nt, Human
uugguucauuaauu

SEQ ID NO: 2430238 - RNA, 20 nt, Human
uugguucauuaauucuauaa

SEQ ID NO: 2430239 - RNA, 20 nt, Human
uuguaacuaggcucagagau

SEQ ID NO: 2430240 - RNA, 11 nt, Human
uuguaagaaau

SEQ ID NO: 2430241 - RNA, 17 nt, Human
uuguaacuuggauguag

SEQ ID NO: 2430242 - RNA, 14 nt, Human
uuguaacuccacca

SEQ ID NO: 2430243 - RNA, 14 nt, Human
uuguaaggaaugau

SEQ ID NO: 2430244 - RNA, 22 nt, Human
uuguaagcaugcacaaauucug

SEQ ID NO: 2430245 - RNA, 13 nt, Human
uuguaagaaauac

SEQ ID NO: 2430246 - RNA, 14 nt, Human
uuguaagaaauacu

SEQ ID NO: 2430247 - RNA, 21 nt, Human
uuguaacguugcugugggaac

SEQ ID NO: 2430248 - RNA, 20 nt, Human
uuguaacguugcugugggaa

SEQ ID NO: 2430249 - RNA, 21 nt, Human
uuguaaaaacagcauugcuuu

SEQ ID NO: 2430250 - RNA, 19 nt, Human
uuguaacguugcuguggga

SEQ ID NO: 2430251 - RNA, 19 nt, Human
uuguaaaaacagcauugcu

SEQ ID NO: 2430252 - RNA, 20 nt, Human
uuguaaaaacagcauugcuu

SEQ ID NO: 2430253 - RNA, 23 nt, Human
uuguaaaaacagcauugcuuucu

SEQ ID NO: 2430254 - RNA, 23 nt, Human
uuguaaaaaaaaaugccuuugag

SEQ ID NO: 2430255 - RNA, 22 nt, Human
uuguaaaaaaaaaugccuuuga

SEQ ID NO: 2430256 - RNA, 21 nt, Human
uuguaaaaaaaaaugccuuug

SEQ ID NO: 2430257 - RNA, 20 nt, Human
uuguaaaaaaaaaugccuuu

SEQ ID NO: 2430258 - RNA, 19 nt, Human
uuguaaaaaaaaaugccuu

SEQ ID NO: 2430259 - RNA, 17 nt, Human
uuguaaaaaaaaaugcc

SEQ ID NO: 2430260 - RNA, 16 nt, Human
uuguaaaaaaaaaugc

SEQ ID NO: 2430261 - RNA, 18 nt, Human
uugguuuuuaaaacccag

SEQ ID NO: 2430262 - RNA, 18 nt, Human
uugguuuuguuccccucc

SEQ ID NO: 2430263 - RNA, 15 nt, Human
uuguaaaaaaaaaug

SEQ ID NO: 2430264 - RNA, 21 nt, Human
uuguauaagauuagaaugaaa

SEQ ID NO: 2430265 - RNA, 14 nt, Human
uuguauaacuucuu

SEQ ID NO: 2430266 - RNA, 17 nt, Human
uuguauaacagguuauu

SEQ ID NO: 2430267 - RNA, 16 nt, Human
uuguauaacagguuau

SEQ ID NO: 2430268 - RNA, 15 nt, Human
uuguauaacagguua

SEQ ID NO: 2430269 - RNA, 14 nt, Human
uuguauaacagguu

SEQ ID NO: 2430270 - RNA, 13 nt, Human
uuguauaacaggu

SEQ ID NO: 2430271 - RNA, 23 nt, Human
uuguauaaauuuauuuacugcua

SEQ ID NO: 2430272 - RNA, 21 nt, Human
uuguauauauguguguuuaaa

SEQ ID NO: 2430273 - RNA, 16 nt, Human
uuguauauaugugugu

SEQ ID NO: 2430274 - RNA, 15 nt, Human
uuguauauaugugug

SEQ ID NO: 2430275 - RNA, 14 nt, Human
uuguauauaugugu

SEQ ID NO: 2430276 - RNA, 19 nt, Human
uuguauauaucugcuucag

SEQ ID NO: 2430277 - RNA, 13 nt, Human
uuguauauaucug

SEQ ID NO: 2430278 - RNA, 11 nt, Human
uuguauauauc

SEQ ID NO: 2430279 - RNA, 20 nt, Human
uuguauaguugcuugccuga

SEQ ID NO: 2430280 - RNA, 13 nt, Human
uuguauaauugua

SEQ ID NO: 2430281 - RNA, 12 nt, Human
uuguauaauugu

SEQ ID NO: 2430282 - RNA, 19 nt, Human
uuguauaguugcuugccug

SEQ ID NO: 2430283 - RNA, 15 nt, Human
uuguauaguugcuug

SEQ ID NO: 2430284 - RNA, 14 nt, Human
uuguauaguugcuu

SEQ ID NO: 2430285 - RNA, 13 nt, Human
uuguauaaaauaa

SEQ ID NO: 2430286 - RNA, 17 nt, Human
uuguaguuuaccucuuu

SEQ ID NO: 2430287 - RNA, 13 nt, Human
uuguaguuuaccu

SEQ ID NO: 2430288 - RNA, 16 nt, Human
uuguauaaaaaaaaua

SEQ ID NO: 2430289 - RNA, 12 nt, Human
uuguauaaaaau

SEQ ID NO: 2430290 - RNA, 19 nt, Human
uuguauaaaauaauuuuua

SEQ ID NO: 2430291 - RNA, 12 nt, Human
uuguauaaauuu

SEQ ID NO: 2430292 - RNA, 19 nt, Human
uuguauaaauuuauuuacu

SEQ ID NO: 2430293 - RNA, 20 nt, Human
uuguauaaaaauagaagaau

SEQ ID NO: 2430294 - RNA, 23 nt, Human
uuguaguguuggagaagaacuga

SEQ ID NO: 2430295 - RNA, 14 nt, Human
uuguaaugucacca

SEQ ID NO: 2430296 - RNA, 15 nt, Human
uuguaauguuacuga

SEQ ID NO: 2430297 - RNA, 13 nt, Human
uuguaaugaaaac

SEQ ID NO: 2430298 - RNA, 14 nt, Human
uuguaaguuuaugu

SEQ ID NO: 2430299 - RNA, 12 nt, Human
uuguaaugaaaa

SEQ ID NO: 2430300 - RNA, 12 nt, Human
uuguaaguuuau

SEQ ID NO: 2430301 - RNA, 20 nt, Human
uuguaaggaaugauuaauua

SEQ ID NO: 2430302 - RNA, 22 nt, Human
augacacuuguccccaaauccg

SEQ ID NO: 2430303 - RNA, 13 nt, Human
augacagagccag

SEQ ID NO: 2430304 - RNA, 16 nt, Human
augacagauguugaau

SEQ ID NO: 2430305 - RNA, 15 nt, Human
augacagcugucccu

SEQ ID NO: 2430306 - RNA, 12 nt, Human
augacagagcga

SEQ ID NO: 2430307 - RNA, 16 nt, Human
augacagcugucccug

SEQ ID NO: 2430308 - RNA, 17 nt, Human
augacagcugucccugu

SEQ ID NO: 2430309 - RNA, 19 nt, Human
augacagcugucccuguca

SEQ ID NO: 2430310 - RNA, 23 nt, Human
augacaguaguaccaaaugcuuu

SEQ ID NO: 2430311 - RNA, 16 nt, Human
augacagguaaauuaa

SEQ ID NO: 2430312 - RNA, 21 nt, Human
augacagcugucccugucacc

SEQ ID NO: 2430313 - RNA, 20 nt, Human
augacacgaauauugcugau

SEQ ID NO: 2430314 - RNA, 18 nt, Human
augacaagccccaggcag

SEQ ID NO: 2430315 - RNA, 20 nt, Human
augacaagccccaggcaggc

SEQ ID NO: 2430316 - RNA, 19 nt, Human
augacacgaauauugcuga

SEQ ID NO: 2430317 - RNA, 15 nt, Human
augacaagccccagg

SEQ ID NO: 2430318 - RNA, 16 nt, Human
augacaagccccaggc

SEQ ID NO: 2430319 - RNA, 15 nt, Human
augacaacuuugcca

SEQ ID NO: 2430320 - RNA, 21 nt, Human
augaauuaguuuuauaugcuu

SEQ ID NO: 2430321 - RNA, 14 nt, Human
uuguauauucacuu

SEQ ID NO: 2430322 - RNA, 22 nt, Human
augaauuacauuuguauaaaau

SEQ ID NO: 2430323 - RNA, 13 nt, Human
uuguauauucacu

SEQ ID NO: 2430324 - RNA, 16 nt, Human
uuguauauuauuucua

SEQ ID NO: 2430325 - RNA, 21 nt, Human
uuguauauuauggaagauuuu

SEQ ID NO: 2430326 - RNA, 18 nt, Human
uuguauauuauggaagau

SEQ ID NO: 2430327 - RNA, 20 nt, Human
uuguauauuauggaagauuu

SEQ ID NO: 2430328 - RNA, 23 nt, Human
augaauuaguuuuauaugcuucu

SEQ ID NO: 2430329 - RNA, 17 nt, Human
augaauucuuaugcuua

SEQ ID NO: 2430330 - RNA, 23 nt, Human
augaauuuuuuucaucuucucug

SEQ ID NO: 2430331 - RNA, 22 nt, Human
augaauuuuuuucaucuucucu

SEQ ID NO: 2430332 - RNA, 19 nt, Human
augacaacuggaauaguuu

SEQ ID NO: 2430333 - RNA, 19 nt, Human
augacaacagaagcuucag

SEQ ID NO: 2430334 - RNA, 14 nt, Human
augacaacagaagc

SEQ ID NO: 2430335 - RNA, 18 nt, Human
augacaacuggaauaguu

SEQ ID NO: 2430336 - RNA, 19 nt, Human
augacaaaaauucaacuca

SEQ ID NO: 2430337 - RNA, 15 nt, Human
augacaaaaauucaa

SEQ ID NO: 2430338 - RNA, 23 nt, Human
augacaaaaauucaacucagacu

SEQ ID NO: 2430339 - RNA, 17 nt, Human
uuggaaagaguaggaag

SEQ ID NO: 2430340 - RNA, 18 nt, Human
uuggaaaccugcccugcc

SEQ ID NO: 2430341 - RNA, 17 nt, Human
uuggaaaccugcccugc

SEQ ID NO: 2430342 - RNA, 15 nt, Human
uuggaaaccugcccu

SEQ ID NO: 2430343 - RNA, 15 nt, Human
uugcuuuuucaccag

SEQ ID NO: 2430344 - RNA, 13 nt, Human
uugcuuuugugaa

SEQ ID NO: 2430345 - RNA, 20 nt, Human
uugcuuuuggcaaaacucua

SEQ ID NO: 2430346 - RNA, 15 nt, Human
uugcuuuuucugacu

SEQ ID NO: 2430347 - RNA, 13 nt, Human
uugcuuuuucuga

SEQ ID NO: 2430348 - RNA, 22 nt, Human
uugcuuuuucuaaugugguuau

SEQ ID NO: 2430349 - RNA, 15 nt, Human
uugcuuuuucuaaug

SEQ ID NO: 2430350 - RNA, 19 nt, Human
uugcuuuuccacugccugg

SEQ ID NO: 2430351 - RNA, 22 nt, Human
uugcuuuacugucaaaauaauu

SEQ ID NO: 2430352 - RNA, 16 nt, Human
uugcuuuaauuguuaa

SEQ ID NO: 2430353 - RNA, 18 nt, Human
uugcuuuaauuguuaaga

SEQ ID NO: 2430354 - RNA, 16 nt, Human
uugcuuuuaaaaucca

SEQ ID NO: 2430355 - RNA, 19 nt, Human
uugcuuuacugucaaaaua

SEQ ID NO: 2430356 - RNA, 16 nt, Human
uugcuuuacugucaaa

SEQ ID NO: 2430357 - RNA, 15 nt, Human
uugcuuuacugucaa

SEQ ID NO: 2430358 - RNA, 18 nt, Human
uugcugauggugcaauga

SEQ ID NO: 2430359 - RNA, 17 nt, Human
uugcugauggugcaaug

SEQ ID NO: 2430360 - RNA, 11 nt, Human
uugcugagccu

SEQ ID NO: 2430361 - RNA, 18 nt, Human
uugcugaauaggcgauca

SEQ ID NO: 2430362 - RNA, 18 nt, Human
uugcuugccugauauaaa

SEQ ID NO: 2430363 - RNA, 16 nt, Human
uugcuugccugauaua

SEQ ID NO: 2430364 - RNA, 16 nt, Human
uugcuugccucucugu

SEQ ID NO: 2430365 - RNA, 15 nt, Human
uugcuugccucucug

SEQ ID NO: 2430366 - RNA, 11 nt, Human
uugcuugccuc

SEQ ID NO: 2430367 - RNA, 22 nt, Human
uugcugagccucugcuccccag

SEQ ID NO: 2430368 - RNA, 14 nt, Human
uugcugagccucug

SEQ ID NO: 2430369 - RNA, 15 nt, Human
uugcugagccucugc

SEQ ID NO: 2430370 - RNA, 20 nt, Human
uugcuugcaguagauuuucu

SEQ ID NO: 2430371 - RNA, 15 nt, Human
uugcuugggaagggg

SEQ ID NO: 2430372 - RNA, 14 nt, Human
uugcuugggaaggg

SEQ ID NO: 2430373 - RNA, 19 nt, Human
uugcuuggcugcuuggccu

SEQ ID NO: 2430374 - RNA, 15 nt, Human
uugcuuggcugcuug

SEQ ID NO: 2430375 - RNA, 14 nt, Human
uugcuuggcugcuu

SEQ ID NO: 2430376 - RNA, 16 nt, Human
uugcuuggacuauuau

SEQ ID NO: 2430377 - RNA, 24 nt, Human
uugcuuguugggauuccugaccca

SEQ ID NO: 2430378 - RNA, 23 nt, Human
uugcuuguugggauuccugaccc

SEQ ID NO: 2430379 - RNA, 20 nt, Human
uugcuacuacuuaccuacca

SEQ ID NO: 2430380 - RNA, 17 nt, Human
uugcuaccucagucagu

SEQ ID NO: 2430381 - RNA, 13 nt, Human
uugcuaccucagu

SEQ ID NO: 2430382 - RNA, 19 nt, Human
aucuaauaccucugugugc

SEQ ID NO: 2430383 - RNA, 17 nt, Human
aucuaauaccucugugu

SEQ ID NO: 2430384 - RNA, 15 nt, Human
aucuaauaccucugu

SEQ ID NO: 2430385 - RNA, 20 nt, Human
uugcuaagugaggaugaaaa

SEQ ID NO: 2430386 - RNA, 14 nt, Human
uugcuaaucagugu

SEQ ID NO: 2430387 - RNA, 21 nt, Human
uugcuaaucagugucucacac

SEQ ID NO: 2430388 - RNA, 18 nt, Human
uugcuaaucagugucuca

SEQ ID NO: 2430389 - RNA, 16 nt, Human
uugcuaaucagugucu

SEQ ID NO: 2430390 - RNA, 15 nt, Human
uugcuaaucaguguc

SEQ ID NO: 2430391 - RNA, 11 nt, Human
uugcucaugga

SEQ ID NO: 2430392 - RNA, 15 nt, Human
uugcuaucuuaauuu

SEQ ID NO: 2430393 - RNA, 14 nt, Human
uugcuaucuuaauu

SEQ ID NO: 2430394 - RNA, 13 nt, Human
uugcuaucuuaau

SEQ ID NO: 2430395 - RNA, 12 nt, Human
uugcucauggaa

SEQ ID NO: 2430396 - RNA, 20 nt, Human
uugcuaugagcuggggaugu

SEQ ID NO: 2430397 - RNA, 18 nt, Human
uugcuaucuuaauuuugg

SEQ ID NO: 2430398 - RNA, 16 nt, Human
uugcuaucuuaauuuu

SEQ ID NO: 2430399 - RNA, 17 nt, Human
uugcuccuaauguugaa

SEQ ID NO: 2430400 - RNA, 14 nt, Human
uugcugaaagaucu

SEQ ID NO: 2430401 - RNA, 11 nt, Human
uugcugaaauu

SEQ ID NO: 2430402 - RNA, 16 nt, Human
uugcugaaauuuuaua

SEQ ID NO: 2430403 - RNA, 13 nt, Human
uugcuccgccucu

SEQ ID NO: 2430404 - RNA, 19 nt, Human
uugcugaauacagaggcaa

SEQ ID NO: 2430405 - RNA, 19 nt, Human
uugcugaaauuuuauaugc

SEQ ID NO: 2430406 - RNA, 11 nt, Human
uugcugaauag

SEQ ID NO: 2430407 - RNA, 15 nt, Human
uuggcugcugaaggc

SEQ ID NO: 2430408 - RNA, 11 nt, Human
uuggcugcuga

SEQ ID NO: 2430409 - RNA, 14 nt, Human
uuggcugcagggag

SEQ ID NO: 2430410 - RNA, 13 nt, Human
uuggcugcaggga

SEQ ID NO: 2430411 - RNA, 22 nt, Human
uuggcuagagguucaaagauau

SEQ ID NO: 2430412 - RNA, 22 nt, Human
uuggcuaggaccccuccaugug

SEQ ID NO: 2430413 - RNA, 21 nt, Human
uuggcuagagguucaaagaua

SEQ ID NO: 2430414 - RNA, 19 nt, Human
uuggcgcacccuccccucc

SEQ ID NO: 2430415 - RNA, 15 nt, Human
uuggcgcacccuccc

SEQ ID NO: 2430416 - RNA, 22 nt, Human
uuggccuucagaaccauccaua

SEQ ID NO: 2430417 - RNA, 22 nt, Human
uuggccugucucauccccaggg

SEQ ID NO: 2430418 - RNA, 21 nt, Human
uuggaaaccugcccugccuga

SEQ ID NO: 2430419 - RNA, 18 nt, Human
uuggaaagaguaggaaga

SEQ ID NO: 2430420 - RNA, 13 nt, Human
uuggacccuucca

SEQ ID NO: 2430421 - RNA, 14 nt, Human
uuggacccuuccau

SEQ ID NO: 2430422 - RNA, 19 nt, Human
uuggaccuaaauggccuca

SEQ ID NO: 2430423 - RNA, 16 nt, Human
uuggacccuuccaugg

SEQ ID NO: 2430424 - RNA, 23 nt, Human
uuggaccuaaauggccucaugug

SEQ ID NO: 2430425 - RNA, 21 nt, Human
uuggaccuaaauggccucaug

SEQ ID NO: 2430426 - RNA, 17 nt, Human
uuggaccuaauccaagc

SEQ ID NO: 2430427 - RNA, 13 nt, Human
uuggaccucugcu

SEQ ID NO: 2430428 - RNA, 12 nt, Human
uuggccuggagg

SEQ ID NO: 2430429 - RNA, 14 nt, Human
uuggccugcuguga

SEQ ID NO: 2430430 - RNA, 13 nt, Human
uuggccugcugug

SEQ ID NO: 2430431 - RNA, 21 nt, Human
uuggaccucugcucugaggcu

SEQ ID NO: 2430432 - RNA, 12 nt, Human
uuggccugcugu

SEQ ID NO: 2430433 - RNA, 16 nt, Human
uuggccuggagguggg

SEQ ID NO: 2430434 - RNA, 16 nt, Human
uuggccugucucaucc

SEQ ID NO: 2430435 - RNA, 23 nt, Human
uuggccugucucauccccagggg

SEQ ID NO: 2430436 - RNA, 16 nt, Human
uuggaccucugcucug

SEQ ID NO: 2430437 - RNA, 15 nt, Human
uuggaccucugcucu

SEQ ID NO: 2430438 - RNA, 14 nt, Human
uuggaccucugcuc

SEQ ID NO: 2430439 - RNA, 20 nt, Human
uuggaaaccugcccugccug

SEQ ID NO: 2430440 - RNA, 18 nt, Human
uuggaccucugcucugag

SEQ ID NO: 2430441 - RNA, 17 nt, Human
uuggaccucugcucuga

SEQ ID NO: 2430442 - RNA, 13 nt, Human
uuggacggccuga

SEQ ID NO: 2430443 - RNA, 19 nt, Human
uuggccugaucagaccacg

SEQ ID NO: 2430444 - RNA, 13 nt, Human
uuggacuauuaua

SEQ ID NO: 2430445 - RNA, 17 nt, Human
uuggccugaucagacca

SEQ ID NO: 2430446 - RNA, 21 nt, Human
uuggacggccugaugcucccu

SEQ ID NO: 2430447 - RNA, 17 nt, Human
uuggacggcugggcaca

SEQ ID NO: 2430448 - RNA, 16 nt, Human
aucuuuucacaaauaa

SEQ ID NO: 2430449 - RNA, 15 nt, Human
aucuuuucacaaaua

SEQ ID NO: 2430450 - RNA, 14 nt, Human
aucuuuucacaaau

SEQ ID NO: 2430451 - RNA, 13 nt, Human
aucuuuucacaaa

SEQ ID NO: 2430452 - RNA, 20 nt, Human
augaaagacuguacaaagua

SEQ ID NO: 2430453 - RNA, 23 nt, Human
augaaagauggcugugccucugc

SEQ ID NO: 2430454 - RNA, 20 nt, Human
augaaagauggcugugccuc

SEQ ID NO: 2430455 - RNA, 19 nt, Human
augaaagauggcugugccu

SEQ ID NO: 2430456 - RNA, 20 nt, Human
augaaauauuauguuaaaac

SEQ ID NO: 2430457 - RNA, 21 nt, Human
augaaauauuauguuaaaacu

SEQ ID NO: 2430458 - RNA, 18 nt, Human
augaaagaguaaaggaaa

SEQ ID NO: 2430459 - RNA, 13 nt, Human
augaaagaggagg

SEQ ID NO: 2430460 - RNA, 18 nt, Human
augaaaucuuacagcugg

SEQ ID NO: 2430461 - RNA, 14 nt, Human
augaaaugagguca

SEQ ID NO: 2430462 - RNA, 12 nt, Human
aucuuuccuguc

SEQ ID NO: 2430463 - RNA, 11 nt, Human
aucuuuccugu

SEQ ID NO: 2430464 - RNA, 19 nt, Human
aucuuucauuaaaggcuuc

SEQ ID NO: 2430465 - RNA, 20 nt, Human
aucuuucaucaaucauugua

SEQ ID NO: 2430466 - RNA, 20 nt, Human
aucuuucauuaaaggcuucu

SEQ ID NO: 2430467 - RNA, 17 nt, Human
aucuuucacacuuccac

SEQ ID NO: 2430468 - RNA, 22 nt, Human
aucuuucacacuuccaccagcc

SEQ ID NO: 2430469 - RNA, 12 nt, Human
aucuuucaggaa

SEQ ID NO: 2430470 - RNA, 14 nt, Human
aucuuuauuaauca

SEQ ID NO: 2430471 - RNA, 18 nt, Human
aucuuuauugagaaagag

SEQ ID NO: 2430472 - RNA, 17 nt, Human
aucuuuauugagaaaga

SEQ ID NO: 2430473 - RNA, 16 nt, Human
aucuuuauugagaaag

SEQ ID NO: 2430474 - RNA, 17 nt, Human
uuggcgcacccuccccu

SEQ ID NO: 2430475 - RNA, 22 nt, Human
aucuuuuacaacugccucgaaa

SEQ ID NO: 2430476 - RNA, 16 nt, Human
aucuuuguggccaagg

SEQ ID NO: 2430477 - RNA, 19 nt, Human
aucuuuguggccaaggagc

SEQ ID NO: 2430478 - RNA, 23 nt, Human
aucuuuguggccaaggagcugcu

SEQ ID NO: 2430479 - RNA, 11 nt, Human
aucuuuuacau

SEQ ID NO: 2430480 - RNA, 16 nt, Human
aucuuucuauuccaaa

SEQ ID NO: 2430481 - RNA, 23 nt, Human
aucuuucgcacagcaguuccgga

SEQ ID NO: 2430482 - RNA, 18 nt, Human
aucuuucgcacagcaguu

SEQ ID NO: 2430483 - RNA, 17 nt, Human
aucuuucgcacagcagu

SEQ ID NO: 2430484 - RNA, 16 nt, Human
aucuuucgcacagcag

SEQ ID NO: 2430485 - RNA, 14 nt, Human
aucuuuguggccaa

SEQ ID NO: 2430486 - RNA, 15 nt, Human
aucuuuguggccaag

SEQ ID NO: 2430487 - RNA, 13 nt, Human
aucuuuguggcca

SEQ ID NO: 2430488 - RNA, 18 nt, Human
auuuguauaaaauaauuu

SEQ ID NO: 2430489 - RNA, 15 nt, Human
auuuguauaaaauaa

SEQ ID NO: 2430490 - RNA, 19 nt, Human
auuuguauaaaauaauuuu

SEQ ID NO: 2430491 - RNA, 23 nt, Human
auuugugaagguggaaauaaacu

SEQ ID NO: 2430492 - RNA, 13 nt, Human
auuugaaggccag

SEQ ID NO: 2430493 - RNA, 16 nt, Human
auuugaagcaaagcac

SEQ ID NO: 2430494 - RNA, 19 nt, Human
auuugaagaaugaacaaau

SEQ ID NO: 2430495 - RNA, 23 nt, Human
auuugaaggucugcaagaaccug

SEQ ID NO: 2430496 - RNA, 14 nt, Human
auuugaaggucugc

SEQ ID NO: 2430497 - RNA, 20 nt, Human
auuugaaucuugucucaaug

SEQ ID NO: 2430498 - RNA, 18 nt, Human
auuugaaucuugucucaa

SEQ ID NO: 2430499 - RNA, 22 nt, Human
auuugaaucuugucucaaugcu

SEQ ID NO: 2430500 - RNA, 11 nt, Human
auuugaaugaa

SEQ ID NO: 2430501 - RNA, 16 nt, Human
auuugaaucuugucuc

SEQ ID NO: 2430502 - RNA, 15 nt, Human
auuugaaucuugucu

SEQ ID NO: 2430503 - RNA, 14 nt, Human
auuugaaucuuguc

SEQ ID NO: 2430504 - RNA, 13 nt, Human
auuuguuuucccg

SEQ ID NO: 2430505 - RNA, 15 nt, Human
auuuguuuucauggu

SEQ ID NO: 2430506 - RNA, 14 nt, Human
auuugugauacaau

SEQ ID NO: 2430507 - RNA, 22 nt, Human
auuugugacuaauuguauaaca

SEQ ID NO: 2430508 - RNA, 20 nt, Human
auuugugacuaauuguauaa

SEQ ID NO: 2430509 - RNA, 19 nt, Human
auuugugacuaauuguaua

SEQ ID NO: 2430510 - RNA, 18 nt, Human
auuugugacuaauuguau

SEQ ID NO: 2430511 - RNA, 16 nt, Human
auuugugacuaauugu

SEQ ID NO: 2430512 - RNA, 11 nt, Human
auuugugacua

SEQ ID NO: 2430513 - RNA, 13 nt, Human
auuugaaugaaaa

SEQ ID NO: 2430514 - RNA, 14 nt, Human
auuugaaugaaaaa

SEQ ID NO: 2430515 - RNA, 15 nt, Human
auuugaaugaaaaau

SEQ ID NO: 2430516 - RNA, 16 nt, Human
auuugaaugaaaaauu

SEQ ID NO: 2430517 - RNA, 22 nt, Human
auuuguuuuuguauuuuuaaug

SEQ ID NO: 2430518 - RNA, 17 nt, Human
auuuuaaaagaaugauu

SEQ ID NO: 2430519 - RNA, 18 nt, Human
auuuguuuugacggauga

SEQ ID NO: 2430520 - RNA, 19 nt, Human
auuuguuuucccgccaagc

SEQ ID NO: 2430521 - RNA, 21 nt, Human
auuuguuuugacggaugauug

SEQ ID NO: 2430522 - RNA, 13 nt, Human
auuuuaaacaaag

SEQ ID NO: 2430523 - RNA, 22 nt, Human
auuuuaaacaaagguugagaug

SEQ ID NO: 2430524 - RNA, 22 nt, Human
auuuuaaaccauaaaaagcuga

SEQ ID NO: 2430525 - RNA, 20 nt, Human
auuuuaaaccauaaaaagcu

SEQ ID NO: 2430526 - RNA, 21 nt, Human
auuuuaaugcaccugaauguu

SEQ ID NO: 2430527 - RNA, 14 nt, Human
auuuuaaagacaug

SEQ ID NO: 2430528 - RNA, 21 nt, Human
auuuuaaaccauaaaaagcug

SEQ ID NO: 2430529 - RNA, 19 nt, Human
auuuuaauuauuauucuuc

SEQ ID NO: 2430530 - RNA, 13 nt, Human
auuuuaauuauua

SEQ ID NO: 2430531 - RNA, 18 nt, Human
auuuuaauuaucuuuucu

SEQ ID NO: 2430532 - RNA, 22 nt, Human
auuuuaaaagaaugauuaugaa

SEQ ID NO: 2430533 - RNA, 18 nt, Human
auuuuaaaagaaugauua

SEQ ID NO: 2430534 - RNA, 19 nt, Human
auuuuaaaaagauuuguuu

SEQ ID NO: 2430535 - RNA, 17 nt, Human
auuuuaaaauuuuaucu

SEQ ID NO: 2430536 - RNA, 17 nt, Human
auuuuaaacaaaauaga

SEQ ID NO: 2430537 - RNA, 18 nt, Human
auuuuaaaauuuuaucuc

SEQ ID NO: 2430538 - RNA, 15 nt, Human
auuuuaauucaguug

SEQ ID NO: 2430539 - RNA, 24 nt, Human
auuuuaauucaucccaacugucuu

SEQ ID NO: 2430540 - RNA, 23 nt, Human
auuuuaauuauuauucuucauaa

SEQ ID NO: 2430541 - RNA, 12 nt, Human
auuuuaauucau

SEQ ID NO: 2430542 - RNA, 12 nt, Human
auuuuaauuuau

SEQ ID NO: 2430543 - RNA, 15 nt, Human
auuuuaccucuuauu

SEQ ID NO: 2430544 - RNA, 18 nt, Human
auuuuaccucuuauugca

SEQ ID NO: 2430545 - RNA, 16 nt, Human
auuuuacuuuuuccug

SEQ ID NO: 2430546 - RNA, 17 nt, Human
auuuuacuuuuuccugg

SEQ ID NO: 2430547 - RNA, 21 nt, Human
auuuuauuuuuuucugaauua

SEQ ID NO: 2430548 - RNA, 17 nt, Human
auuuuauuuuuuucuac

SEQ ID NO: 2430549 - RNA, 17 nt, Human
auuuuagccuucucugu

SEQ ID NO: 2430550 - RNA, 18 nt, Human
auuuuagccuucucuguu

SEQ ID NO: 2430551 - RNA, 19 nt, Human
auuuuagaagacucuacca

SEQ ID NO: 2430552 - RNA, 16 nt, Human
auuuuacuuuuauaau

SEQ ID NO: 2430553 - RNA, 14 nt, Human
auuuucaagaaacu

SEQ ID NO: 2430554 - RNA, 16 nt, Human
auuuucaagaaacuga

SEQ ID NO: 2430555 - RNA, 17 nt, Human
auuuucaagaaacugag

SEQ ID NO: 2430556 - RNA, 22 nt, Human
auuuucaagaaacugaggaauu

SEQ ID NO: 2430557 - RNA, 23 nt, Human
auuuucaagaaacugaggaauuu

SEQ ID NO: 2430558 - RNA, 24 nt, Human
auuuucaagaauaaucacgcuuuc

SEQ ID NO: 2430559 - RNA, 17 nt, Human
auuuucaaggcccucag

SEQ ID NO: 2430560 - RNA, 20 nt, Human
auuuucaacgcagcccugcu

SEQ ID NO: 2430561 - RNA, 13 nt, Human
auuuucaagaaac

SEQ ID NO: 2430562 - RNA, 18 nt, Human
auuuucaaauuguaucua

SEQ ID NO: 2430563 - RNA, 22 nt, Human
auuuucaaagcuuuuuccagag

SEQ ID NO: 2430564 - RNA, 18 nt, Human
auuuucaacgcagcccug

SEQ ID NO: 2430565 - RNA, 13 nt, Human
auuuucacuguag

SEQ ID NO: 2430566 - RNA, 14 nt, Human
auuuucacuuugug

SEQ ID NO: 2430567 - RNA, 21 nt, Human
auuuucaccuguuuuuaagcu

SEQ ID NO: 2430568 - RNA, 22 nt, Human
auuuucaccccacccuuccccu

SEQ ID NO: 2430569 - RNA, 22 nt, Human
auuuucacauucccaucuguca

SEQ ID NO: 2430570 - RNA, 17 nt, Human
auuuucacaugaacaua

SEQ ID NO: 2430571 - RNA, 16 nt, Human
auuuucacaugaacau

SEQ ID NO: 2430572 - RNA, 15 nt, Human
auuuucaccccaccc

SEQ ID NO: 2430573 - RNA, 16 nt, Human
auuuucaccccacccu

SEQ ID NO: 2430574 - RNA, 20 nt, Human
auuuucaaggcccucagcau

SEQ ID NO: 2430575 - RNA, 19 nt, Human
auuuucaaguaauugugaa

SEQ ID NO: 2430576 - RNA, 12 nt, Human
auuuucaaguaa

SEQ ID NO: 2430577 - RNA, 16 nt, Human
auuuucaaguaauugu

SEQ ID NO: 2430578 - RNA, 15 nt, Human
auuuucacauaaaau

SEQ ID NO: 2430579 - RNA, 20 nt, Human
auuuucacacaauacaauaa

SEQ ID NO: 2430580 - RNA, 18 nt, Human
auuuucagcaaacucuuu

SEQ ID NO: 2430581 - RNA, 19 nt, Human
auuuucagcaaacucuuuu

SEQ ID NO: 2430582 - RNA, 23 nt, Human
auuuucagcccauauuucaucgu

SEQ ID NO: 2430583 - RNA, 17 nt, Human
auuuucagcaaacucuu

SEQ ID NO: 2430584 - RNA, 17 nt, Human
auuuucagaaaauauua

SEQ ID NO: 2430585 - RNA, 14 nt, Human
auuuucagaaaaua

SEQ ID NO: 2430586 - RNA, 12 nt, Human
auuuucagaccc

SEQ ID NO: 2430587 - RNA, 22 nt, Human
auuuucaguuauuauauuuaca

SEQ ID NO: 2430588 - RNA, 20 nt, Human
auuuucauaaguauuucaaa

SEQ ID NO: 2430589 - RNA, 21 nt, Human
auuuucauaaguauuucaaau

SEQ ID NO: 2430590 - RNA, 22 nt, Human
auuuucauaaguauuucaaauu

SEQ ID NO: 2430591 - RNA, 12 nt, Human
auuuucaguauu

SEQ ID NO: 2430592 - RNA, 14 nt, Human
auuuucaguauuuu

SEQ ID NO: 2430593 - RNA, 21 nt, Human
auuuucaguagggcuacaaaa

SEQ ID NO: 2430594 - RNA, 22 nt, Human
auuuucaguagggcuacaaaac

SEQ ID NO: 2430595 - RNA, 11 nt, Human
auuuucaguau

SEQ ID NO: 2430596 - RNA, 19 nt, Human
auuuucaguauaauuuaac

SEQ ID NO: 2430597 - RNA, 21 nt, Human
auuuuccuaauaaaguucugu

SEQ ID NO: 2430598 - RNA, 12 nt, Human
auuuuccucccc

SEQ ID NO: 2430599 - RNA, 17 nt, Human
auuuuccaagugugcau

SEQ ID NO: 2430600 - RNA, 15 nt, Human
auuuuccaagugugc

SEQ ID NO: 2430601 - RNA, 17 nt, Human
auuuuccaaauguaaua

SEQ ID NO: 2430602 - RNA, 23 nt, Human
auuuuccacaagauucccagaga

SEQ ID NO: 2430603 - RNA, 20 nt, Human
auuuuccacaagauucccag

SEQ ID NO: 2430604 - RNA, 21 nt, Human
auuuuccacaagauucccaga

SEQ ID NO: 2430605 - RNA, 13 nt, Human
auuuuccucccca

SEQ ID NO: 2430606 - RNA, 14 nt, Human
auuuuccuccccag

SEQ ID NO: 2430607 - RNA, 15 nt, Human
auuuuccuccccagc

SEQ ID NO: 2430608 - RNA, 16 nt, Human
auuuuccuccccagca

SEQ ID NO: 2430609 - RNA, 13 nt, Human
auuuucaugacuu

SEQ ID NO: 2430610 - RNA, 22 nt, Human
auuuucauacagcauuacaaau

SEQ ID NO: 2430611 - RNA, 20 nt, Human
auuuucaugacuuuuccaug

SEQ ID NO: 2430612 - RNA, 19 nt, Human
auuuucaugacuuuuccau

SEQ ID NO: 2430613 - RNA, 17 nt, Human
auuuucauguauaugug

SEQ ID NO: 2430614 - RNA, 18 nt, Human
auuuucauguauaugugu

SEQ ID NO: 2430615 - RNA, 14 nt, Human
auuuuccaaaugua

SEQ ID NO: 2430616 - RNA, 14 nt, Human
auuuuccaaagagu

SEQ ID NO: 2430617 - RNA, 17 nt, Human
auuuucauuuucugcaa

SEQ ID NO: 2430618 - RNA, 15 nt, Human
auuuucauuuucugc

SEQ ID NO: 2430619 - RNA, 23 nt, Human
auuuucauuuucugcaagccugc

SEQ ID NO: 2430620 - RNA, 22 nt, Human
auuuuccaaaaguggccucuuu

SEQ ID NO: 2430621 - RNA, 15 nt, Human
auuuucauuauuccu

SEQ ID NO: 2430622 - RNA, 14 nt, Human
auuuucauuguaaa

SEQ ID NO: 2430623 - RNA, 15 nt, Human
auuuauuuaauguua

SEQ ID NO: 2430624 - RNA, 17 nt, Human
auuuauuuaauguuaug

SEQ ID NO: 2430625 - RNA, 13 nt, Human
auuuauucugcuc

SEQ ID NO: 2430626 - RNA, 23 nt, Human
auuuauuccauauucauguaaac

SEQ ID NO: 2430627 - RNA, 20 nt, Human
auuuauuccauauucaugua

SEQ ID NO: 2430628 - RNA, 19 nt, Human
auuuauuccauauucaugu

SEQ ID NO: 2430629 - RNA, 17 nt, Human
auuuauucauauuuucu

SEQ ID NO: 2430630 - RNA, 20 nt, Human
auuuauucagcuucauuugu

SEQ ID NO: 2430631 - RNA, 18 nt, Human
auuuauucagcuucauuu

SEQ ID NO: 2430632 - RNA, 19 nt, Human
auuuauucaauuccucugg

SEQ ID NO: 2430633 - RNA, 22 nt, Human
auuuauucaauaaaguauuuaa

SEQ ID NO: 2430634 - RNA, 18 nt, Human
auuuauucaauuccucug

SEQ ID NO: 2430635 - RNA, 17 nt, Human
auuuauuuuaauaaugu

SEQ ID NO: 2430636 - RNA, 14 nt, Human
auuuauuuauuauu

SEQ ID NO: 2430637 - RNA, 14 nt, Human
auuuauuuauuuaa

SEQ ID NO: 2430638 - RNA, 14 nt, Human
auuuauuuauuuau

SEQ ID NO: 2430639 - RNA, 17 nt, Human
auuuauuuauuaagaug

SEQ ID NO: 2430640 - RNA, 13 nt, Human
auuuauuuacaga

SEQ ID NO: 2430641 - RNA, 23 nt, Human
auuuauuuacagaugaauguauu

SEQ ID NO: 2430642 - RNA, 17 nt, Human
auuuauuuacugcuagu

SEQ ID NO: 2430643 - RNA, 24 nt, Human
auuuauuuacugagcuucucugug

SEQ ID NO: 2430644 - RNA, 13 nt, Human
auuuauuuauuau

SEQ ID NO: 2430645 - RNA, 14 nt, Human
auuuauuuauuaag

SEQ ID NO: 2430646 - RNA, 16 nt, Human
auuuauuuauuaagau

SEQ ID NO: 2430647 - RNA, 21 nt, Human
auuuauucaauaaaguauuua

SEQ ID NO: 2430648 - RNA, 18 nt, Human
auuuauucaauaaaguau

SEQ ID NO: 2430649 - RNA, 17 nt, Human
auuuauucaauaaagua

SEQ ID NO: 2430650 - RNA, 16 nt, Human
auuuauucaauaaagu

SEQ ID NO: 2430651 - RNA, 15 nt, Human
auuuauucaauaaag

SEQ ID NO: 2430652 - RNA, 14 nt, Human
auuuauucaauaaa

SEQ ID NO: 2430653 - RNA, 13 nt, Human
auuuauucaauaa

SEQ ID NO: 2430654 - RNA, 11 nt, Human
auuuauucaau

SEQ ID NO: 2430655 - RNA, 17 nt, Human
auuuauuauugaaauug

SEQ ID NO: 2430656 - RNA, 16 nt, Human
auuuauuauugaaauu

SEQ ID NO: 2430657 - RNA, 15 nt, Human
auuuauuauugaaau

SEQ ID NO: 2430658 - RNA, 11 nt, Human
auuuauuauuu

SEQ ID NO: 2430659 - RNA, 13 nt, Human
auuuauuauuuau

SEQ ID NO: 2430660 - RNA, 21 nt, Human
auuuauuauuuucaccuguuu

SEQ ID NO: 2430661 - RNA, 12 nt, Human
auuuauucaaga

SEQ ID NO: 2430662 - RNA, 14 nt, Human
auuuauucaagaaa

SEQ ID NO: 2430663 - RNA, 19 nt, Human
auuuauuauuuauuuauua

SEQ ID NO: 2430664 - RNA, 14 nt, Human
auuuauuauuuuca

SEQ ID NO: 2430665 - RNA, 12 nt, Human
auuucauuucuu

SEQ ID NO: 2430666 - RNA, 17 nt, Human
auuucauuguaugaugu

SEQ ID NO: 2430667 - RNA, 15 nt, Human
auuucauuguaugau

SEQ ID NO: 2430668 - RNA, 14 nt, Human
auuucauuguauga

SEQ ID NO: 2430669 - RNA, 12 nt, Human
auuucauuguau

SEQ ID NO: 2430670 - RNA, 20 nt, Human
auuucauuguaugauguguu

SEQ ID NO: 2430671 - RNA, 19 nt, Human
auuucauuguaugaugugu

SEQ ID NO: 2430672 - RNA, 18 nt, Human
auuucauuucaacuguuu

SEQ ID NO: 2430673 - RNA, 17 nt, Human
auuucaaauuggagcuu

SEQ ID NO: 2430674 - RNA, 16 nt, Human
auuucaaaaugcuuuu

SEQ ID NO: 2430675 - RNA, 16 nt, Human
auuucaaacggccuca

SEQ ID NO: 2430676 - RNA, 23 nt, Human
auuucaacaaguagcuaaagucu

SEQ ID NO: 2430677 - RNA, 14 nt, Human
auuucauucuucuc

SEQ ID NO: 2430678 - RNA, 20 nt, Human
auuuauuuuaauaauguuuc

SEQ ID NO: 2430679 - RNA, 19 nt, Human
auuuauuuuaauaauguuu

SEQ ID NO: 2430680 - RNA, 14 nt, Human
auuucaaaaugcuu

SEQ ID NO: 2430681 - RNA, 15 nt, Human
auuucaaaaugcuuu

SEQ ID NO: 2430682 - RNA, 21 nt, Human
auuucaaaaugcuuuuuauua

SEQ ID NO: 2430683 - RNA, 13 nt, Human
auuucaaaaugcu

SEQ ID NO: 2430684 - RNA, 13 nt, Human
auuucaaaauaua

SEQ ID NO: 2430685 - RNA, 20 nt, Human
auuuccagugaaaucaguua

SEQ ID NO: 2430686 - RNA, 17 nt, Human
auuuccagccagggcug

SEQ ID NO: 2430687 - RNA, 13 nt, Human
auuuccaguaccu

SEQ ID NO: 2430688 - RNA, 17 nt, Human
auuuccaguaccuuugu

SEQ ID NO: 2430689 - RNA, 20 nt, Human
auuuccaguaccuuugucac

SEQ ID NO: 2430690 - RNA, 18 nt, Human
auuuccagccagggcugc

SEQ ID NO: 2430691 - RNA, 14 nt, Human
auuuccagccaggg

SEQ ID NO: 2430692 - RNA, 10 nt, Human
auuuccagag

SEQ ID NO: 2430693 - RNA, 17 nt, Human
auuuccagccaaagccu

SEQ ID NO: 2430694 - RNA, 22 nt, Human
auuucauuugugccagaaugcu

SEQ ID NO: 2430695 - RNA, 19 nt, Human
auuucauuuuuacccuuac

SEQ ID NO: 2430696 - RNA, 21 nt, Human
auuucauuguaugauguguug

SEQ ID NO: 2430697 - RNA, 23 nt, Human
auuuccccagaccugagcucccc

SEQ ID NO: 2430698 - RNA, 17 nt, Human
auuuccccaccccagcu

SEQ ID NO: 2430699 - RNA, 15 nt, Human
auuuccccagaccug

SEQ ID NO: 2430700 - RNA, 20 nt, Human
auuuccccaggggaaaauga

SEQ ID NO: 2430701 - RNA, 21 nt, Human
auuuccccaggggaaaaugaa

SEQ ID NO: 2430702 - RNA, 19 nt, Human
auuuccccaacagugugaa

SEQ ID NO: 2430703 - RNA, 18 nt, Human
auuuccccaacaguguga

SEQ ID NO: 2430704 - RNA, 17 nt, Human
auuuccccaacagugug

SEQ ID NO: 2430705 - RNA, 16 nt, Human
auuuccccaacagugu

SEQ ID NO: 2430706 - RNA, 15 nt, Human
auuuccccaacagug

SEQ ID NO: 2430707 - RNA, 13 nt, Human
auuuccagucucc

SEQ ID NO: 2430708 - RNA, 17 nt, Human
auuuccagucuccacca

SEQ ID NO: 2430709 - RNA, 15 nt, Human
auuucccaucugcac

SEQ ID NO: 2430710 - RNA, 14 nt, Human
auuucccaucugca

SEQ ID NO: 2430711 - RNA, 13 nt, Human
auuucccaucugc

SEQ ID NO: 2430712 - RNA, 18 nt, Human
auuucuuuuuuaaaugaa

SEQ ID NO: 2430713 - RNA, 22 nt, Human
auuucuuuuuuaaaugaagaaa

SEQ ID NO: 2430714 - RNA, 19 nt, Human
auuucuaggaagaauuuua

SEQ ID NO: 2430715 - RNA, 17 nt, Human
auuucuaggaagaauuu

SEQ ID NO: 2430716 - RNA, 16 nt, Human
auuucuaggaagaauu

SEQ ID NO: 2430717 - RNA, 15 nt, Human
auuucuaggaagaau

SEQ ID NO: 2430718 - RNA, 22 nt, Human
auuucuaggaagaauuuuaaaa

SEQ ID NO: 2430719 - RNA, 20 nt, Human
auuucuaggaagaauuuuaa

SEQ ID NO: 2430720 - RNA, 14 nt, Human
auuugaaaauuuug

SEQ ID NO: 2430721 - RNA, 21 nt, Human
auuucuuuuuuaaaugaagaa

SEQ ID NO: 2430722 - RNA, 22 nt, Human
auuugaaaacauaaucugcaaa

SEQ ID NO: 2430723 - RNA, 14 nt, Human
auuugaaauauuga

SEQ ID NO: 2430724 - RNA, 18 nt, Human
auuugaaaauaauuguuc

SEQ ID NO: 2430725 - RNA, 17 nt, Human
auuugaaaauaauuguu

SEQ ID NO: 2430726 - RNA, 15 nt, Human
auuugaaauuuagcu

SEQ ID NO: 2430727 - RNA, 16 nt, Human
auuugaagaacaugug

SEQ ID NO: 2430728 - RNA, 11 nt, Human
auuugaaauuu

SEQ ID NO: 2430729 - RNA, 17 nt, Human
auuucuaccauuucaga

SEQ ID NO: 2430730 - RNA, 21 nt, Human
auuucuacucucccauggcuu

SEQ ID NO: 2430731 - RNA, 15 nt, Human
auuucuacucuccca

SEQ ID NO: 2430732 - RNA, 18 nt, Human
auuucuaccauuucagag

SEQ ID NO: 2430733 - RNA, 15 nt, Human
auuucuacugugacu

SEQ ID NO: 2430734 - RNA, 20 nt, Human
auuucuacucuuaaguuucu

SEQ ID NO: 2430735 - RNA, 21 nt, Human
auuucuacucuuaaguuucuc

SEQ ID NO: 2430736 - RNA, 17 nt, Human
auuucuacugugacuga

SEQ ID NO: 2430737 - RNA, 16 nt, Human
auuucuacugugacug

SEQ ID NO: 2430738 - RNA, 18 nt, Human
auuucuacuuugaaguca

SEQ ID NO: 2430739 - RNA, 18 nt, Human
auuucuacugugacugau

SEQ ID NO: 2430740 - RNA, 21 nt, Human
auuucuagaacaucccugcca

SEQ ID NO: 2430741 - RNA, 23 nt, Human
auuucuagaacaucccugccagc

SEQ ID NO: 2430742 - RNA, 15 nt, Human
auuuccguuaaaaua

SEQ ID NO: 2430743 - RNA, 16 nt, Human
auuuccguuaaaauac

SEQ ID NO: 2430744 - RNA, 23 nt, Human
auuucccuugaaauuuuaaacua

SEQ ID NO: 2430745 - RNA, 14 nt, Human
auuuauucugcuca

SEQ ID NO: 2430746 - RNA, 20 nt, Human
auuuagacaagagaugggaa

SEQ ID NO: 2430747 - RNA, 14 nt, Human
auuuagacaagaga

SEQ ID NO: 2430748 - RNA, 15 nt, Human
auuuagaaauauaau

SEQ ID NO: 2430749 - RNA, 14 nt, Human
auuuagaacuguau

SEQ ID NO: 2430750 - RNA, 22 nt, Human
auuuagaaagaagcccaauauu

SEQ ID NO: 2430751 - RNA, 14 nt, Human
auuuacuucuuaua

SEQ ID NO: 2430752 - RNA, 16 nt, Human
auuuacuucuuauaca

SEQ ID NO: 2430753 - RNA, 17 nt, Human
auuuacuucuuauacau

SEQ ID NO: 2430754 - RNA, 21 nt, Human
auuuacugcuagucuuaagaa

SEQ ID NO: 2430755 - RNA, 17 nt, Human
auuuaaauuuuuuuccu

SEQ ID NO: 2430756 - RNA, 13 nt, Human
auuuaacaagauc

SEQ ID NO: 2430757 - RNA, 19 nt, Human
auuuaaauuuuacccuuua

SEQ ID NO: 2430758 - RNA, 12 nt, Human
auuuaacagaaa

SEQ ID NO: 2430759 - RNA, 14 nt, Human
auuuaacagaaaug

SEQ ID NO: 2430760 - RNA, 21 nt, Human
auuuacugagcuucucuguga

SEQ ID NO: 2430761 - RNA, 18 nt, Human
auuuaaaaauauuuuugg

SEQ ID NO: 2430762 - RNA, 14 nt, Human
auuuaaaaauauuu

SEQ ID NO: 2430763 - RNA, 16 nt, Human
auuuaaaaauaagaaa

SEQ ID NO: 2430764 - RNA, 15 nt, Human
auuuaaaaaauaacu

SEQ ID NO: 2430765 - RNA, 13 nt, Human
auuuaaaaaauaa

SEQ ID NO: 2430766 - RNA, 16 nt, Human
auuuagucaugugacc

SEQ ID NO: 2430767 - RNA, 20 nt, Human
auuuaguaucuuuuuauuca

SEQ ID NO: 2430768 - RNA, 13 nt, Human
auuuaguguucau

SEQ ID NO: 2430769 - RNA, 15 nt, Human
auuuagugaacuacg

SEQ ID NO: 2430770 - RNA, 14 nt, Human
auuuagucauguga

SEQ ID NO: 2430771 - RNA, 20 nt, Human
auuuagugaaagcuagagau

SEQ ID NO: 2430772 - RNA, 13 nt, Human
auuuagauguaua

SEQ ID NO: 2430773 - RNA, 20 nt, Human
auuuagagaacuguggccgu

SEQ ID NO: 2430774 - RNA, 16 nt, Human
auuuagacaagagaug

SEQ ID NO: 2430775 - RNA, 16 nt, Human
auuuagagaggaaaag

SEQ ID NO: 2430776 - RNA, 17 nt, Human
auuuagagaugaauuaa

SEQ ID NO: 2430777 - RNA, 23 nt, Human
auuuagagaugaauuaaauuuaa

SEQ ID NO: 2430778 - RNA, 22 nt, Human
auuuagagaugaauuaaauuua

SEQ ID NO: 2430779 - RNA, 17 nt, Human
auuuagauugaaaacuu

SEQ ID NO: 2430780 - RNA, 18 nt, Human
auuuagauuguuaaaaua

SEQ ID NO: 2430781 - RNA, 23 nt, Human
auuuagcacauacuacacauuca

SEQ ID NO: 2430782 - RNA, 22 nt, Human
auuuagcaugacaagccccagg

SEQ ID NO: 2430783 - RNA, 13 nt, Human
auuuagcaaauaa

SEQ ID NO: 2430784 - RNA, 18 nt, Human
auuuagcaaauaauuucc

SEQ ID NO: 2430785 - RNA, 19 nt, Human
auuuaguuuuuguucuuaa

SEQ ID NO: 2430786 - RNA, 22 nt, Human
auuuauuaaaugcccagccccu

SEQ ID NO: 2430787 - RNA, 15 nt, Human
auuuauuaagaugga

SEQ ID NO: 2430788 - RNA, 16 nt, Human
auuuauuaagauggau

SEQ ID NO: 2430789 - RNA, 21 nt, Human
auuuauuaagauggauucuca

SEQ ID NO: 2430790 - RNA, 22 nt, Human
auuuauuaagauggauucucag

SEQ ID NO: 2430791 - RNA, 23 nt, Human
auuuauuaagauggauucucaga

SEQ ID NO: 2430792 - RNA, 22 nt, Human
auuuauaaaaauaaaaaacacu

SEQ ID NO: 2430793 - RNA, 17 nt, Human
auuuauaaaaauaaaaa

SEQ ID NO: 2430794 - RNA, 15 nt, Human
auuuaguuugauuau

SEQ ID NO: 2430795 - RNA, 22 nt, Human
auuuaguuugauuauucagugu

SEQ ID NO: 2430796 - RNA, 19 nt, Human
auuuaguuuuuguaauuua

SEQ ID NO: 2430797 - RNA, 20 nt, Human
auuuaguuuuuguaauuuau

SEQ ID NO: 2430798 - RNA, 16 nt, Human
auuuaguuuuuguucu

SEQ ID NO: 2430799 - RNA, 16 nt, Human
auucuuuuuaaaguau

SEQ ID NO: 2430800 - RNA, 18 nt, Human
auugaaaacuuuucucag

SEQ ID NO: 2430801 - RNA, 15 nt, Human
auugaaaaaucacca

SEQ ID NO: 2430802 - RNA, 13 nt, Human
auugaaaaggaca

SEQ ID NO: 2430803 - RNA, 21 nt, Human
auugaaaauaguaaaugcuuu

SEQ ID NO: 2430804 - RNA, 15 nt, Human
auugaaagagaacca

SEQ ID NO: 2430805 - RNA, 17 nt, Human
auugacauguacagaga

SEQ ID NO: 2430806 - RNA, 23 nt, Human
auugacauguacagagaacuaac

SEQ ID NO: 2430807 - RNA, 15 nt, Human
auugacauguacaga

SEQ ID NO: 2430808 - RNA, 18 nt, Human
auugaaagagaaccaguu

SEQ ID NO: 2430809 - RNA, 18 nt, Human
auugaaaggcauucucug

SEQ ID NO: 2430810 - RNA, 14 nt, Human
auugacauguacag

SEQ ID NO: 2430811 - RNA, 18 nt, Human
auugacccacaagaaaug

SEQ ID NO: 2430812 - RNA, 21 nt, Human
auugacauugcuuuacuguca

SEQ ID NO: 2430813 - RNA, 21 nt, Human
auuggguggggggcuucauac

SEQ ID NO: 2430814 - RNA, 18 nt, Human
auugggugggcaggaaaa

SEQ ID NO: 2430815 - RNA, 17 nt, Human
auugguccagcuugcuc

SEQ ID NO: 2430816 - RNA, 22 nt, Human
auuggguggggggcuucauaca

SEQ ID NO: 2430817 - RNA, 19 nt, Human
auuggguccugggucuuuc

SEQ ID NO: 2430818 - RNA, 20 nt, Human
auuggguggggggcuucaua

SEQ ID NO: 2430819 - RNA, 15 nt, Human
auuggggucccucua

SEQ ID NO: 2430820 - RNA, 22 nt, Human
auugggggcuggugccagccuu

SEQ ID NO: 2430821 - RNA, 19 nt, Human
auugggggcuggugccagc

SEQ ID NO: 2430822 - RNA, 20 nt, Human
auugggcagcgcccuuccuc

SEQ ID NO: 2430823 - RNA, 19 nt, Human
auugggcagcgcccuuccu

SEQ ID NO: 2430824 - RNA, 14 nt, Human
auugggcagcgccc

SEQ ID NO: 2430825 - RNA, 15 nt, Human
auugggccccugcca

SEQ ID NO: 2430826 - RNA, 16 nt, Human
auugggccccugccag

SEQ ID NO: 2430827 - RNA, 22 nt, Human
auugggcagcgcccuuccucuc

SEQ ID NO: 2430828 - RNA, 19 nt, Human
auuggggaagacuguggcu

SEQ ID NO: 2430829 - RNA, 18 nt, Human
auugggcaagugauugaa

SEQ ID NO: 2430830 - RNA, 21 nt, Human
auugggagcuugggaauggau

SEQ ID NO: 2430831 - RNA, 17 nt, Human
auugggcaagugauuga

SEQ ID NO: 2430832 - RNA, 14 nt, Human
auucuuauuuaaug

SEQ ID NO: 2430833 - RNA, 18 nt, Human
auucuuauuuaaugaaag

SEQ ID NO: 2430834 - RNA, 17 nt, Human
auucuuauuucaugaaa

SEQ ID NO: 2430835 - RNA, 15 nt, Human
auucuuacauguuuu

SEQ ID NO: 2430836 - RNA, 17 nt, Human
auucuuacauguuuucu

SEQ ID NO: 2430837 - RNA, 18 nt, Human
auucuuauaaauaugaag

SEQ ID NO: 2430838 - RNA, 16 nt, Human
auucuuauaaauauga

SEQ ID NO: 2430839 - RNA, 15 nt, Human
auucuuauaaauaug

SEQ ID NO: 2430840 - RNA, 14 nt, Human
auucuuauaaauau

SEQ ID NO: 2430841 - RNA, 19 nt, Human
auucuuaaaguacuuguua

SEQ ID NO: 2430842 - RNA, 12 nt, Human
auucuuauaaau

SEQ ID NO: 2430843 - RNA, 13 nt, Human
auucuuauuuaau

SEQ ID NO: 2430844 - RNA, 14 nt, Human
auucuuaugcuuau

SEQ ID NO: 2430845 - RNA, 20 nt, Human
auucuuauaaauaugaagcu

SEQ ID NO: 2430846 - RNA, 22 nt, Human
auucuuauguagcaggaaauaa

SEQ ID NO: 2430847 - RNA, 15 nt, Human
auucuucucuuccuu

SEQ ID NO: 2430848 - RNA, 15 nt, Human
auucuucucuagcug

SEQ ID NO: 2430849 - RNA, 13 nt, Human
auucuucuccacu

SEQ ID NO: 2430850 - RNA, 22 nt, Human
auucuuccucccucccucuuuc

SEQ ID NO: 2430851 - RNA, 13 nt, Human
auucuuccucccu

SEQ ID NO: 2430852 - RNA, 21 nt, Human
auucuuugauguuaacacauu

SEQ ID NO: 2430853 - RNA, 20 nt, Human
auucuuugauguuaacacau

SEQ ID NO: 2430854 - RNA, 19 nt, Human
auucuuugauguuaacaca

SEQ ID NO: 2430855 - RNA, 18 nt, Human
auucuuugauguuaacac

SEQ ID NO: 2430856 - RNA, 17 nt, Human
auucuuugauguuaaca

SEQ ID NO: 2430857 - RNA, 16 nt, Human
auucuuugauguuaac

SEQ ID NO: 2430858 - RNA, 21 nt, Human
auucuucucuuccuuuuauca

SEQ ID NO: 2430859 - RNA, 15 nt, Human
auucuuugauguuaa

SEQ ID NO: 2430860 - RNA, 13 nt, Human
auucuuuuaaaag

SEQ ID NO: 2430861 - RNA, 22 nt, Human
auucuuugauguuaacacauuu

SEQ ID NO: 2430862 - RNA, 18 nt, Human
auucuuuuaaaagacaag

SEQ ID NO: 2430863 - RNA, 22 nt, Human
auucuuuuaaaagacaagacuu

SEQ ID NO: 2430864 - RNA, 14 nt, Human
auucuuuuuaaagu

SEQ ID NO: 2430865 - RNA, 17 nt, Human
auucuuuuguaauuuaa

SEQ ID NO: 2430866 - RNA, 16 nt, Human
auucuuuuguaauuua

SEQ ID NO: 2430867 - RNA, 13 nt, Human
auucuuuuguaau

SEQ ID NO: 2430868 - RNA, 18 nt, Human
auucuguuuuagguuaaa

SEQ ID NO: 2430869 - RNA, 12 nt, Human
auucuguuucuu

SEQ ID NO: 2430870 - RNA, 22 nt, Human
auucuguguguuuucauaauaa

SEQ ID NO: 2430871 - RNA, 23 nt, Human
auucuguguguuuucauaauaaa

SEQ ID NO: 2430872 - RNA, 23 nt, Human
auucuuaaaauauauuucagaua

SEQ ID NO: 2430873 - RNA, 20 nt, Human
auucuuaaaauauauuucag

SEQ ID NO: 2430874 - RNA, 24 nt, Human
auucugucucuggauuauauuaug

SEQ ID NO: 2430875 - RNA, 17 nt, Human
auucuguggaacaagcc

SEQ ID NO: 2430876 - RNA, 14 nt, Human
auucugucuugaag

SEQ ID NO: 2430877 - RNA, 17 nt, Human
auucuguguguuuucau

SEQ ID NO: 2430878 - RNA, 21 nt, Human
auucuguguguuuucauaaua

SEQ ID NO: 2430879 - RNA, 19 nt, Human
auucugguuccaggguccc

SEQ ID NO: 2430880 - RNA, 18 nt, Human
auucugucgccuuagcau

SEQ ID NO: 2430881 - RNA, 21 nt, Human
auucugucgccuuagcauguu

SEQ ID NO: 2430882 - RNA, 20 nt, Human
auucugucgccuuagcaugu

SEQ ID NO: 2430883 - RNA, 19 nt, Human
auucugucgccuuagcaug

SEQ ID NO: 2430884 - RNA, 23 nt, Human
auucuccuucagcccucaccccu

SEQ ID NO: 2430885 - RNA, 13 nt, Human
auucugcagcaug

SEQ ID NO: 2430886 - RNA, 19 nt, Human
auucugauuuggaaaaaga

SEQ ID NO: 2430887 - RNA, 15 nt, Human
auucugcagcaugac

SEQ ID NO: 2430888 - RNA, 19 nt, Human
auucugcaagcacaucugc

SEQ ID NO: 2430889 - RNA, 22 nt, Human
auucugcaagcacaucugcauu

SEQ ID NO: 2430890 - RNA, 17 nt, Human
auucugcaguaaaucuu

SEQ ID NO: 2430891 - RNA, 18 nt, Human
auucugcaguaaaucuuu

SEQ ID NO: 2430892 - RNA, 20 nt, Human
auucugcaguaaaucuuuua

SEQ ID NO: 2430893 - RNA, 21 nt, Human
auucugcaguaaaucuuuuac

SEQ ID NO: 2430894 - RNA, 23 nt, Human
auucugcaguaaaucuuuuacaa

SEQ ID NO: 2430895 - RNA, 22 nt, Human
auucugcagcaugaccugugac

SEQ ID NO: 2430896 - RNA, 14 nt, Human
auucugccaggccc

SEQ ID NO: 2430897 - RNA, 16 nt, Human
auucugcccaaaaaua

SEQ ID NO: 2430898 - RNA, 23 nt, Human
auucugccaggcccccaagccug

SEQ ID NO: 2430899 - RNA, 16 nt, Human
auucugguuccagggu

SEQ ID NO: 2430900 - RNA, 17 nt, Human
auucuggccuagucccu

SEQ ID NO: 2430901 - RNA, 22 nt, Human
auucuggauggauuugaagcaa

SEQ ID NO: 2430902 - RNA, 21 nt, Human
auucuggauuuugucaagcag

SEQ ID NO: 2430903 - RNA, 23 nt, Human
auucuggccuagucccuuccaca

SEQ ID NO: 2430904 - RNA, 14 nt, Human
auucugcugucuca

SEQ ID NO: 2430905 - RNA, 19 nt, Human
auucugcccaaaaauaugg

SEQ ID NO: 2430906 - RNA, 18 nt, Human
auucugcccaaaaauaug

SEQ ID NO: 2430907 - RNA, 21 nt, Human
auucuggauaaagccacugaa

SEQ ID NO: 2430908 - RNA, 17 nt, Human
auucuggauaaagccac

SEQ ID NO: 2430909 - RNA, 14 nt, Human
auuuaaaacagaca

SEQ ID NO: 2430910 - RNA, 18 nt, Human
auugugucucuugguccu

SEQ ID NO: 2430911 - RNA, 15 nt, Human
auuguguauauucau

SEQ ID NO: 2430912 - RNA, 14 nt, Human
auugugucucuugg

SEQ ID NO: 2430913 - RNA, 23 nt, Human
auuguguaacaauuuuaaugcua

SEQ ID NO: 2430914 - RNA, 14 nt, Human
auuguggugccaca

SEQ ID NO: 2430915 - RNA, 14 nt, Human
auugugauuugacu

SEQ ID NO: 2430916 - RNA, 12 nt, Human
auugugauuuga

SEQ ID NO: 2430917 - RNA, 23 nt, Human
auugugauuucccguggccccag

SEQ ID NO: 2430918 - RNA, 16 nt, Human
auugugauuucccgug

SEQ ID NO: 2430919 - RNA, 14 nt, Human
auugugauuucccg

SEQ ID NO: 2430920 - RNA, 19 nt, Human
auugugauuugacuguuuu

SEQ ID NO: 2430921 - RNA, 18 nt, Human
auugugauuugacuguuu

SEQ ID NO: 2430922 - RNA, 17 nt, Human
auugugauuugacuguu

SEQ ID NO: 2430923 - RNA, 16 nt, Human
auugugauuugacugu

SEQ ID NO: 2430924 - RNA, 23 nt, Human
auugugauuugacuguuuuuacc

SEQ ID NO: 2430925 - RNA, 12 nt, Human
auuguggugcca

SEQ ID NO: 2430926 - RNA, 17 nt, Human
auugugccaauauguau

SEQ ID NO: 2430927 - RNA, 16 nt, Human
auugugccaauaugua

SEQ ID NO: 2430928 - RNA, 19 nt, Human
auugugcacauacuugaga

SEQ ID NO: 2430929 - RNA, 13 nt, Human
auugugauguguc

SEQ ID NO: 2430930 - RNA, 14 nt, Human
auugugaugugucc

SEQ ID NO: 2430931 - RNA, 18 nt, Human
auugugauucugccuuug

SEQ ID NO: 2430932 - RNA, 15 nt, Human
auugugauguguccu

SEQ ID NO: 2430933 - RNA, 16 nt, Human
auugugaccaaguuau

SEQ ID NO: 2430934 - RNA, 15 nt, Human
auugugaccaaguua

SEQ ID NO: 2430935 - RNA, 16 nt, Human
auugugaacugacagg

SEQ ID NO: 2430936 - RNA, 14 nt, Human
auugugaaguacau

SEQ ID NO: 2430937 - RNA, 15 nt, Human
auugugaaguacaua

SEQ ID NO: 2430938 - RNA, 23 nt, Human
auugugaucagaccauaauguua

SEQ ID NO: 2430939 - RNA, 16 nt, Human
auugugagccaccacg

SEQ ID NO: 2430940 - RNA, 21 nt, Human
auugugaugguucguucuguu

SEQ ID NO: 2430941 - RNA, 21 nt, Human
auugugaucuaucaauaguca

SEQ ID NO: 2430942 - RNA, 17 nt, Human
auugugaccaaguuaua

SEQ ID NO: 2430943 - RNA, 20 nt, Human
auuguccccgacccuugccg

SEQ ID NO: 2430944 - RNA, 19 nt, Human
auuguccccgacccuugcc

SEQ ID NO: 2430945 - RNA, 17 nt, Human
auuguccccgacccuug

SEQ ID NO: 2430946 - RNA, 18 nt, Human
auuguccaauccuauguu

SEQ ID NO: 2430947 - RNA, 13 nt, Human
auugucauuuaua

SEQ ID NO: 2430948 - RNA, 12 nt, Human
auugguguugac

SEQ ID NO: 2430949 - RNA, 14 nt, Human
auuggucuccucuc

SEQ ID NO: 2430950 - RNA, 17 nt, Human
auuggucuccucucagc

SEQ ID NO: 2430951 - RNA, 13 nt, Human
auuguauucagag

SEQ ID NO: 2430952 - RNA, 14 nt, Human
auuguauuuauuca

SEQ ID NO: 2430953 - RNA, 11 nt, Human
auuguauuuau

SEQ ID NO: 2430954 - RNA, 23 nt, Human
auuguauuaggugucauuuccau

SEQ ID NO: 2430955 - RNA, 20 nt, Human
auuguauuuauucaauaaag

SEQ ID NO: 2430956 - RNA, 19 nt, Human
auuguauuuauucaauaaa

SEQ ID NO: 2430957 - RNA, 18 nt, Human
auuguauuuauucaauaa

SEQ ID NO: 2430958 - RNA, 16 nt, Human
auuguauuuauucaau

SEQ ID NO: 2430959 - RNA, 14 nt, Human
auuguauuuauucc

SEQ ID NO: 2430960 - RNA, 23 nt, Human
auuguauuuauucaauaaaguau

SEQ ID NO: 2430961 - RNA, 23 nt, Human
auugucauuccuguauucacccg

SEQ ID NO: 2430962 - RNA, 18 nt, Human
auuguauuuauuccauau

SEQ ID NO: 2430963 - RNA, 19 nt, Human
auucuauaugaauuuaaau

SEQ ID NO: 2430964 - RNA, 17 nt, Human
auucuauaugaauuuaa

SEQ ID NO: 2430965 - RNA, 16 nt, Human
auucuauaugaauuua

SEQ ID NO: 2430966 - RNA, 15 nt, Human
auucuauaugaauuu

SEQ ID NO: 2430967 - RNA, 23 nt, Human
auucuauaugaauuuaaauauaa

SEQ ID NO: 2430968 - RNA, 15 nt, Human
auucuaucuauuccu

SEQ ID NO: 2430969 - RNA, 14 nt, Human
auucuauaugaauu

SEQ ID NO: 2430970 - RNA, 13 nt, Human
auucuauaugaau

SEQ ID NO: 2430971 - RNA, 22 nt, Human
auucuauugcaguuauagaaaa

SEQ ID NO: 2430972 - RNA, 14 nt, Human
auucuauuaacuuu

SEQ ID NO: 2430973 - RNA, 20 nt, Human
auucuauuuauauguacaug

SEQ ID NO: 2430974 - RNA, 18 nt, Human
auucuauaaguuuuaugu

SEQ ID NO: 2430975 - RNA, 15 nt, Human
auucuauaaggccau

SEQ ID NO: 2430976 - RNA, 17 nt, Human
auucuaguuuugucaaa

SEQ ID NO: 2430977 - RNA, 18 nt, Human
auucuaaaugaauguuua

SEQ ID NO: 2430978 - RNA, 17 nt, Human
auucuaaaugaauguuu

SEQ ID NO: 2430979 - RNA, 15 nt, Human
auucuaaaugaaugu

SEQ ID NO: 2430980 - RNA, 20 nt, Human
auucuccaccugccagggac

SEQ ID NO: 2430981 - RNA, 19 nt, Human
auucuccaccugccaggga

SEQ ID NO: 2430982 - RNA, 14 nt, Human
auucucaugccuca

SEQ ID NO: 2430983 - RNA, 15 nt, Human
auucucaugccucag

SEQ ID NO: 2430984 - RNA, 20 nt, Human
auucucagggucucugcugc

SEQ ID NO: 2430985 - RNA, 19 nt, Human
auucucagggucucugcug

SEQ ID NO: 2430986 - RNA, 21 nt, Human
auucucagggucucugcugcc

SEQ ID NO: 2430987 - RNA, 22 nt, Human
auucucagggucucugcugccg

SEQ ID NO: 2430988 - RNA, 18 nt, Human
auucucagggucucugcu

SEQ ID NO: 2430989 - RNA, 17 nt, Human
auucucagggucucugc

SEQ ID NO: 2430990 - RNA, 16 nt, Human
auucucagggucucug

SEQ ID NO: 2430991 - RNA, 21 nt, Human
auucucaaccuaccaccccuu

SEQ ID NO: 2430992 - RNA, 16 nt, Human
auucucaagcccugca

SEQ ID NO: 2430993 - RNA, 22 nt, Human
auucuauuuauauguacaugag

SEQ ID NO: 2430994 - RNA, 18 nt, Human
auucuauuugcugggcuu

SEQ ID NO: 2430995 - RNA, 15 nt, Human
auucuauuugcuggg

SEQ ID NO: 2430996 - RNA, 15 nt, Human
auucucaagcccugc

SEQ ID NO: 2430997 - RNA, 21 nt, Human
auucuauuuucauuuucugca

SEQ ID NO: 2430998 - RNA, 18 nt, Human
auucuauuuucauuuucu

SEQ ID NO: 2430999 - RNA, 15 nt, Human
auucucaaacacagu

SEQ ID NO: 2431000 - RNA, 17 nt, Human
auucuccugccucagcc

SEQ ID NO: 2431001 - RNA, 15 nt, Human
auucuccugccucag

SEQ ID NO: 2431002 - RNA, 19 nt, Human
auucuccugccucagccuc

SEQ ID NO: 2431003 - RNA, 20 nt, Human
auucuccugccucagccucc

SEQ ID NO: 2431004 - RNA, 22 nt, Human
auucuccuucagcccucacccc

SEQ ID NO: 2431005 - RNA, 18 nt, Human
auucuccuucagcccuca

SEQ ID NO: 2431006 - RNA, 17 nt, Human
auucuccuucagcccuc

SEQ ID NO: 2431007 - RNA, 16 nt, Human
auucuccuucagcccu

SEQ ID NO: 2431008 - RNA, 16 nt, Human
auucuccuuguguuac

SEQ ID NO: 2431009 - RNA, 15 nt, Human
auucuccuucagccc

SEQ ID NO: 2431010 - RNA, 14 nt, Human
auucuccuucagcc

SEQ ID NO: 2431011 - RNA, 14 nt, Human
auucuccugugcua

SEQ ID NO: 2431012 - RNA, 13 nt, Human
auucuccugugcu

SEQ ID NO: 2431013 - RNA, 13 nt, Human
auucuccuucagc

SEQ ID NO: 2431014 - RNA, 22 nt, Human
auucuccugccuguagcaguga

SEQ ID NO: 2431015 - RNA, 11 nt, Human
auucuccugga

SEQ ID NO: 2431016 - RNA, 18 nt, Human
auucuccugccucagccu

SEQ ID NO: 2431017 - RNA, 13 nt, Human
auucuccugccuc

SEQ ID NO: 2431018 - RNA, 14 nt, Human
auucuccugccuca

SEQ ID NO: 2431019 - RNA, 12 nt, Human
auucuccugccu

SEQ ID NO: 2431020 - RNA, 11 nt, Human
auucuccugcc

SEQ ID NO: 2431021 - RNA, 21 nt, Human
auucuccaccugccagggaca

SEQ ID NO: 2431022 - RNA, 24 nt, Human
auucucccagguaccagcugcgcu

SEQ ID NO: 2431023 - RNA, 22 nt, Human
auucucccagguaccagcugcg

SEQ ID NO: 2431024 - RNA, 21 nt, Human
auucucccagguaccagcugc

SEQ ID NO: 2431025 - RNA, 20 nt, Human
auucucccagguaccagcug

SEQ ID NO: 2431026 - RNA, 14 nt, Human
auucagagagcagc

SEQ ID NO: 2431027 - RNA, 13 nt, Human
auucagacaggca

SEQ ID NO: 2431028 - RNA, 14 nt, Human
auucagacaggcaa

SEQ ID NO: 2431029 - RNA, 23 nt, Human
auuauauagguugugcaaauuaa

SEQ ID NO: 2431030 - RNA, 20 nt, Human
auuauauagguugugcaaau

SEQ ID NO: 2431031 - RNA, 13 nt, Human
auuauauagguug

SEQ ID NO: 2431032 - RNA, 14 nt, Human
auucaggaagcuca

SEQ ID NO: 2431033 - RNA, 17 nt, Human
auucagaguugaugguu

SEQ ID NO: 2431034 - RNA, 15 nt, Human
auucaguaauaacuc

SEQ ID NO: 2431035 - RNA, 19 nt, Human
auucaguaauaacucuacc

SEQ ID NO: 2431036 - RNA, 23 nt, Human
auucagguauguugccuuuaugg

SEQ ID NO: 2431037 - RNA, 18 nt, Human
auucaguccuaagaaaga

SEQ ID NO: 2431038 - RNA, 19 nt, Human
auucaggaagcucagggcc

SEQ ID NO: 2431039 - RNA, 17 nt, Human
auucaggaagcucaggg

SEQ ID NO: 2431040 - RNA, 20 nt, Human
auucaggaagcucagggccu

SEQ ID NO: 2431041 - RNA, 20 nt, Human
auucagguauguugccuuua

SEQ ID NO: 2431042 - RNA, 18 nt, Human
auucagauauauuuuuca

SEQ ID NO: 2431043 - RNA, 21 nt, Human
auucagauauauuuuucacag

SEQ ID NO: 2431044 - RNA, 16 nt, Human
auucccucucucugac

SEQ ID NO: 2431045 - RNA, 15 nt, Human
auucccucucucuga

SEQ ID NO: 2431046 - RNA, 14 nt, Human
auucccucucucug

SEQ ID NO: 2431047 - RNA, 13 nt, Human
auucccucucucu

SEQ ID NO: 2431048 - RNA, 21 nt, Human
auucccuccugcuacucuguu

SEQ ID NO: 2431049 - RNA, 14 nt, Human
auucccuccugcua

SEQ ID NO: 2431050 - RNA, 13 nt, Human
auucccuggccuu

SEQ ID NO: 2431051 - RNA, 19 nt, Human
auucccuggccuuucauau

SEQ ID NO: 2431052 - RNA, 20 nt, Human
auucccucucucugacucuc

SEQ ID NO: 2431053 - RNA, 19 nt, Human
auucccucucucugacucu

SEQ ID NO: 2431054 - RNA, 22 nt, Human
auucccucucucugacucucaa

SEQ ID NO: 2431055 - RNA, 19 nt, Human
auucccugagucaccagga

SEQ ID NO: 2431056 - RNA, 20 nt, Human
auucccugagucaccaggaa

SEQ ID NO: 2431057 - RNA, 13 nt, Human
auucccugccugg

SEQ ID NO: 2431058 - RNA, 15 nt, Human
auucccaagcucugc

SEQ ID NO: 2431059 - RNA, 14 nt, Human
auucccaagcucug

SEQ ID NO: 2431060 - RNA, 16 nt, Human
auucccaagcucugcu

SEQ ID NO: 2431061 - RNA, 22 nt, Human
auucccaagcucuagugggaag

SEQ ID NO: 2431062 - RNA, 21 nt, Human
auuccaugaaucgcuucucuu

SEQ ID NO: 2431063 - RNA, 21 nt, Human
auucccuaucuuuuaguuuua

SEQ ID NO: 2431064 - RNA, 22 nt, Human
auucccuaucuuuuaguuuuag

SEQ ID NO: 2431065 - RNA, 16 nt, Human
auuccauauucaugua

SEQ ID NO: 2431066 - RNA, 15 nt, Human
auuccagcuccuccg

SEQ ID NO: 2431067 - RNA, 14 nt, Human
auuccaagacagua

SEQ ID NO: 2431068 - RNA, 17 nt, Human
auuccauauuuauucaa

SEQ ID NO: 2431069 - RNA, 18 nt, Human
auuccauauucauguaaa

SEQ ID NO: 2431070 - RNA, 17 nt, Human
auuccauauucauguaa

SEQ ID NO: 2431071 - RNA, 14 nt, Human
auuccauccauaua

SEQ ID NO: 2431072 - RNA, 13 nt, Human
auuccauauuuau

SEQ ID NO: 2431073 - RNA, 11 nt, Human
auuccauccuu

SEQ ID NO: 2431074 - RNA, 15 nt, Human
auuccaugaaucgcu

SEQ ID NO: 2431075 - RNA, 18 nt, Human
auuccauccauauacuuu

SEQ ID NO: 2431076 - RNA, 12 nt, Human
auuccaugaauc

SEQ ID NO: 2431077 - RNA, 19 nt, Human
auuccaugaaucgcuucuc

SEQ ID NO: 2431078 - RNA, 18 nt, Human
auuccaugaaucgcuucu

SEQ ID NO: 2431079 - RNA, 16 nt, Human
auuccaaccccaacuc

SEQ ID NO: 2431080 - RNA, 15 nt, Human
auuccaaccccaacu

SEQ ID NO: 2431081 - RNA, 11 nt, Human
auuccaaccuu

SEQ ID NO: 2431082 - RNA, 17 nt, Human
auuccaaccccaacucc

SEQ ID NO: 2431083 - RNA, 17 nt, Human
auuccagccccucuggu

SEQ ID NO: 2431084 - RNA, 13 nt, Human
auuccaagacagu

SEQ ID NO: 2431085 - RNA, 22 nt, Human
auuccaagacaugucuguucua

SEQ ID NO: 2431086 - RNA, 15 nt, Human
auuccaacagugagu

SEQ ID NO: 2431087 - RNA, 14 nt, Human
auuccaacagugag

SEQ ID NO: 2431088 - RNA, 14 nt, Human
auuccaacagcuca

SEQ ID NO: 2431089 - RNA, 20 nt, Human
auuccaacagcucaagucuu

SEQ ID NO: 2431090 - RNA, 15 nt, Human
auuccaacaaagggu

SEQ ID NO: 2431091 - RNA, 19 nt, Human
auuccaacaaaggguuuua

SEQ ID NO: 2431092 - RNA, 18 nt, Human
auuccaacaaaggguuuu

SEQ ID NO: 2431093 - RNA, 23 nt, Human
auuccaacaaaggguuuuaaugu

SEQ ID NO: 2431094 - RNA, 16 nt, Human
uuuuauuuuacuuuua

SEQ ID NO: 2431095 - RNA, 15 nt, Human
uuuuauuugacaaaa

SEQ ID NO: 2431096 - RNA, 15 nt, Human
uuuuauuugcaugug

SEQ ID NO: 2431097 - RNA, 15 nt, Human
uuuuauuuauuuuau

SEQ ID NO: 2431098 - RNA, 11 nt, Human
uuuuauuuuau

SEQ ID NO: 2431099 - RNA, 16 nt, Human
uuuucauauugugcca

SEQ ID NO: 2431100 - RNA, 14 nt, Human
uuuucauauugugc

SEQ ID NO: 2431101 - RNA, 13 nt, Human
uuuucauauugug

SEQ ID NO: 2431102 - RNA, 21 nt, Human
uuuucauagauugagaaguuu

SEQ ID NO: 2431103 - RNA, 18 nt, Human
uuuucauacuuuuaccuu

SEQ ID NO: 2431104 - RNA, 12 nt, Human
uuuucauaauaa

SEQ ID NO: 2431105 - RNA, 20 nt, Human
uuuucaguuucaauucagug

SEQ ID NO: 2431106 - RNA, 12 nt, Human
uuuucaguuuuc

SEQ ID NO: 2431107 - RNA, 14 nt, Human
uuuucaguuuucag

SEQ ID NO: 2431108 - RNA, 14 nt, Human
uuuuauuguuuuca

SEQ ID NO: 2431109 - RNA, 12 nt, Human
uuuuauuguuuu

SEQ ID NO: 2431110 - RNA, 20 nt, Human
uuuuauuguuuaaagcaacu

SEQ ID NO: 2431111 - RNA, 13 nt, Human
uuuuauuaugcau

SEQ ID NO: 2431112 - RNA, 19 nt, Human
uuuuauuaaugcacuuucu

SEQ ID NO: 2431113 - RNA, 14 nt, Human
uuuuauuaaugcac

SEQ ID NO: 2431114 - RNA, 19 nt, Human
uuuuaggcagggauuugag

SEQ ID NO: 2431115 - RNA, 18 nt, Human
uuuuaggcagggauuuga

SEQ ID NO: 2431116 - RNA, 20 nt, Human
uuuuaggccaaaaaaaugua

SEQ ID NO: 2431117 - RNA, 22 nt, Human
uuuuagguguugauuuucuguu

SEQ ID NO: 2431118 - RNA, 19 nt, Human
uuuuagguguugauuuucu

SEQ ID NO: 2431119 - RNA, 16 nt, Human
uuuuagguguugauuu

SEQ ID NO: 2431120 - RNA, 18 nt, Human
uuuuaggucucuuccccu

SEQ ID NO: 2431121 - RNA, 15 nt, Human
uuuucugagaaagac

SEQ ID NO: 2431122 - RNA, 18 nt, Human
uuuucugagaaagacuau

SEQ ID NO: 2431123 - RNA, 22 nt, Human
uuuucugagcccgggcugccug

SEQ ID NO: 2431124 - RNA, 16 nt, Human
uuuucugagcccgggc

SEQ ID NO: 2431125 - RNA, 12 nt, Human
uuuucugagccc

SEQ ID NO: 2431126 - RNA, 10 nt, Human
uuuucugagc

SEQ ID NO: 2431127 - RNA, 23 nt, Human
uuuucuggagguugauaacuuug

SEQ ID NO: 2431128 - RNA, 18 nt, Human
uuuucuggaauguaauca

SEQ ID NO: 2431129 - RNA, 15 nt, Human
uuuucugagcgauua

SEQ ID NO: 2431130 - RNA, 21 nt, Human
uuuucuggagguugauaacuu

SEQ ID NO: 2431131 - RNA, 16 nt, Human
uuuucucuaggaaaua

SEQ ID NO: 2431132 - RNA, 17 nt, Human
uuuucugaauaacauuu

SEQ ID NO: 2431133 - RNA, 14 nt, Human
uuuucucuaggaaa

SEQ ID NO: 2431134 - RNA, 13 nt, Human
uuuucuccuccca

SEQ ID NO: 2431135 - RNA, 14 nt, Human
uuuucuccucccag

SEQ ID NO: 2431136 - RNA, 19 nt, Human
uuuucuccucccaggaacu

SEQ ID NO: 2431137 - RNA, 17 nt, Human
uuuucucuaacucagaa

SEQ ID NO: 2431138 - RNA, 16 nt, Human
uuuucauuugccuauu

SEQ ID NO: 2431139 - RNA, 15 nt, Human
uuuucauuugccuau

SEQ ID NO: 2431140 - RNA, 13 nt, Human
uuuucauuugccu

SEQ ID NO: 2431141 - RNA, 13 nt, Human
uuuucauuguaaa

SEQ ID NO: 2431142 - RNA, 16 nt, Human
uuuucauuuucugcaa

SEQ ID NO: 2431143 - RNA, 17 nt, Human
uuuucauugauaugaaa

SEQ ID NO: 2431144 - RNA, 22 nt, Human
uuuucauggacacuuugaaaug

SEQ ID NO: 2431145 - RNA, 21 nt, Human
uuuuccaaaaaaauacugcca

SEQ ID NO: 2431146 - RNA, 22 nt, Human
uuuucauuuucugcaagccugc

SEQ ID NO: 2431147 - RNA, 18 nt, Human
uuuucauuuucugcaagc

SEQ ID NO: 2431148 - RNA, 15 nt, Human
uuuuccaaaauaauu

SEQ ID NO: 2431149 - RNA, 23 nt, Human
uuuuccaaaaguggccucuuugu

SEQ ID NO: 2431150 - RNA, 15 nt, Human
uuuuccaaaaaaaua

SEQ ID NO: 2431151 - RNA, 20 nt, Human
uuuuccaaaaguggccucuu

SEQ ID NO: 2431152 - RNA, 17 nt, Human
uuuucuccacuuuguug

SEQ ID NO: 2431153 - RNA, 20 nt, Human
uuuucauuuaggugaggaag

SEQ ID NO: 2431154 - RNA, 21 nt, Human
uuuucaugauuuugaaaccau

SEQ ID NO: 2431155 - RNA, 21 nt, Human
uuuucaugauuuugaaaucau

SEQ ID NO: 2431156 - RNA, 15 nt, Human
uuuucaucuguuguu

SEQ ID NO: 2431157 - RNA, 16 nt, Human
uuuucaucugggaaag

SEQ ID NO: 2431158 - RNA, 15 nt, Human
uuuucaucugggaaa

SEQ ID NO: 2431159 - RNA, 14 nt, Human
uuuucaucugggaa

SEQ ID NO: 2431160 - RNA, 21 nt, Human
uuuucaucuucucuggcgaca

SEQ ID NO: 2431161 - RNA, 19 nt, Human
uuuucauauugugccaaua

SEQ ID NO: 2431162 - RNA, 21 nt, Human
auguuuucaggcuagauguau

SEQ ID NO: 2431163 - RNA, 17 nt, Human
auguuuucaggcuagau

SEQ ID NO: 2431164 - RNA, 22 nt, Human
auguuuugauaaaguaguaaaa

SEQ ID NO: 2431165 - RNA, 21 nt, Human
auguuuugauaaaguaguaaa

SEQ ID NO: 2431166 - RNA, 16 nt, Human
auguuuuccagcuccu

SEQ ID NO: 2431167 - RNA, 20 nt, Human
auguuuugguaucuguucuu

SEQ ID NO: 2431168 - RNA, 17 nt, Human
auguuuugguaucuguu

SEQ ID NO: 2431169 - RNA, 15 nt, Human
auguuuugguaucug

SEQ ID NO: 2431170 - RNA, 23 nt, Human
auguuuugguaucuguucuuuaa

SEQ ID NO: 2431171 - RNA, 21 nt, Human
auguuuauauaaaugcuuuua

SEQ ID NO: 2431172 - RNA, 17 nt, Human
auguuuauauaaaugcu

SEQ ID NO: 2431173 - RNA, 16 nt, Human
auguuuauauaaaugc

SEQ ID NO: 2431174 - RNA, 14 nt, Human
auguuuauauaaau

SEQ ID NO: 2431175 - RNA, 13 nt, Human
auguuuauauaaa

SEQ ID NO: 2431176 - RNA, 19 nt, Human
auguuuauauaaaugcuuu

SEQ ID NO: 2431177 - RNA, 14 nt, Human
auguuuaugagcca

SEQ ID NO: 2431178 - RNA, 15 nt, Human
auguuuaugagccag

SEQ ID NO: 2431179 - RNA, 16 nt, Human
auguuuaugagccaga

SEQ ID NO: 2431180 - RNA, 20 nt, Human
auguuuaugagccagacaaa

SEQ ID NO: 2431181 - RNA, 21 nt, Human
auguuuaugagccagacaaau

SEQ ID NO: 2431182 - RNA, 15 nt, Human
auguuuucaggcuag

SEQ ID NO: 2431183 - RNA, 22 nt, Human
auguuuaugcaaggaaggaaag

SEQ ID NO: 2431184 - RNA, 18 nt, Human
auguuuaugcaaggaagg

SEQ ID NO: 2431185 - RNA, 20 nt, Human
auguuuaugcaaggaaggaa

SEQ ID NO: 2431186 - RNA, 17 nt, Human
auguuguuauuuaaaga

SEQ ID NO: 2431187 - RNA, 15 nt, Human
auguuguuauuuaaa

SEQ ID NO: 2431188 - RNA, 14 nt, Human
auguuguuauuuaa

SEQ ID NO: 2431189 - RNA, 13 nt, Human
auguuguuauuua

SEQ ID NO: 2431190 - RNA, 20 nt, Human
auguuguucauuauuggagg

SEQ ID NO: 2431191 - RNA, 17 nt, Human
auguuuaguaaucauau

SEQ ID NO: 2431192 - RNA, 17 nt, Human
uuuucugucucugccuc

SEQ ID NO: 2431193 - RNA, 15 nt, Human
uuuucugucucugcc

SEQ ID NO: 2431194 - RNA, 17 nt, Human
uuuucugugccugaaua

SEQ ID NO: 2431195 - RNA, 18 nt, Human
uuuucugugccugaauau

SEQ ID NO: 2431196 - RNA, 22 nt, Human
auguuguguuucuguucaccuu

SEQ ID NO: 2431197 - RNA, 12 nt, Human
auguuguuauuu

SEQ ID NO: 2431198 - RNA, 12 nt, Human
uuuucuguauuu

SEQ ID NO: 2431199 - RNA, 22 nt, Human
uuuucuggguguccaaaggaag

SEQ ID NO: 2431200 - RNA, 16 nt, Human
uuuucugguagauaga

SEQ ID NO: 2431201 - RNA, 19 nt, Human
uuuucugguagauagaaau

SEQ ID NO: 2431202 - RNA, 20 nt, Human
uuuucugguagauagaaaua

SEQ ID NO: 2431203 - RNA, 20 nt, Human
auuaaaaaucucaaauuucu

SEQ ID NO: 2431204 - RNA, 22 nt, Human
auuaaaaaucucaaauuucuaa

SEQ ID NO: 2431205 - RNA, 23 nt, Human
auuaaaacacaacaucuuuuucu

SEQ ID NO: 2431206 - RNA, 18 nt, Human
auguuuuuaaaaguuuca

SEQ ID NO: 2431207 - RNA, 16 nt, Human
auguuuuuaaaaguuu

SEQ ID NO: 2431208 - RNA, 15 nt, Human
auuaaaaaucucaaa

SEQ ID NO: 2431209 - RNA, 19 nt, Human
auuaaaaaucucaaauuuc

SEQ ID NO: 2431210 - RNA, 18 nt, Human
auguuuugugggaacaga

SEQ ID NO: 2431211 - RNA, 19 nt, Human
auguuuugugacuauauag

SEQ ID NO: 2431212 - RNA, 21 nt, Human
auguuuugugacuauauagag

SEQ ID NO: 2431213 - RNA, 17 nt, Human
auguuuugugacuauau

SEQ ID NO: 2431214 - RNA, 14 nt, Human
auguuuugugacua

SEQ ID NO: 2431215 - RNA, 21 nt, Human
auuaaacggauuauuuuuuca

SEQ ID NO: 2431216 - RNA, 20 nt, Human
auuaaacggauuauuuuuuc

SEQ ID NO: 2431217 - RNA, 19 nt, Human
auuaaacggauuauuuuuu

SEQ ID NO: 2431218 - RNA, 17 nt, Human
auuaaacggauuauuuu

SEQ ID NO: 2431219 - RNA, 16 nt, Human
auuaaacggauuauuu

SEQ ID NO: 2431220 - RNA, 15 nt, Human
auuaaacggauuauu

SEQ ID NO: 2431221 - RNA, 14 nt, Human
auuaaacggauuau

SEQ ID NO: 2431222 - RNA, 13 nt, Human
auuaaacggauua

SEQ ID NO: 2431223 - RNA, 19 nt, Human
auuaaacguaugcauguga

SEQ ID NO: 2431224 - RNA, 18 nt, Human
auuaaacguaugcaugug

SEQ ID NO: 2431225 - RNA, 23 nt, Human
auuaaacggauuauuuuuucaga

SEQ ID NO: 2431226 - RNA, 22 nt, Human
auuaaacggauuauuuuuucag

SEQ ID NO: 2431227 - RNA, 21 nt, Human
auuaaacguaugcaugugaag

SEQ ID NO: 2431228 - RNA, 20 nt, Human
auuaaacguaugcaugugaa

SEQ ID NO: 2431229 - RNA, 23 nt, Human
auuaaacucuucacaaaaucugu

SEQ ID NO: 2431230 - RNA, 15 nt, Human
auuaaaagaauauuu

SEQ ID NO: 2431231 - RNA, 14 nt, Human
auuaaaacugaauu

SEQ ID NO: 2431232 - RNA, 14 nt, Human
auuaaacccuggau

SEQ ID NO: 2431233 - RNA, 15 nt, Human
auuaaaacugaauug

SEQ ID NO: 2431234 - RNA, 22 nt, Human
auuaaaacugaagucugaaauu

SEQ ID NO: 2431235 - RNA, 21 nt, Human
auuaaaacugaagucugaaau

SEQ ID NO: 2431236 - RNA, 23 nt, Human
auuaaaagaaaauaaaaaaaaga

SEQ ID NO: 2431237 - RNA, 20 nt, Human
auuaaaacugaagucugaaa

SEQ ID NO: 2431238 - RNA, 19 nt, Human
auuaaaacugaagucugaa

SEQ ID NO: 2431239 - RNA, 18 nt, Human
auuaaaacugaagucuga

SEQ ID NO: 2431240 - RNA, 14 nt, Human
uuuuaauaauguuu

SEQ ID NO: 2431241 - RNA, 13 nt, Human
uuuuaauaauguu

SEQ ID NO: 2431242 - RNA, 15 nt, Human
uuuuaauaaacuuuu

SEQ ID NO: 2431243 - RNA, 14 nt, Human
uuuuaauaaacuuu

SEQ ID NO: 2431244 - RNA, 12 nt, Human
uuuuaauaaugu

SEQ ID NO: 2431245 - RNA, 14 nt, Human
uuuuaauaaacacu

SEQ ID NO: 2431246 - RNA, 18 nt, Human
uuuuaaguuguuugcaug

SEQ ID NO: 2431247 - RNA, 16 nt, Human
uuuuaaguuguuugca

SEQ ID NO: 2431248 - RNA, 19 nt, Human
auggggcugaacggggaga

SEQ ID NO: 2431249 - RNA, 20 nt, Human
auggggcccugccuccuuug

SEQ ID NO: 2431250 - RNA, 17 nt, Human
auggggcucccgcccgu

SEQ ID NO: 2431251 - RNA, 14 nt, Human
auggggccucuguu

SEQ ID NO: 2431252 - RNA, 12 nt, Human
auggggccucug

SEQ ID NO: 2431253 - RNA, 22 nt, Human
auggggcugaacggggagaaaa

SEQ ID NO: 2431254 - RNA, 14 nt, Human
uuuuaaguugcuga

SEQ ID NO: 2431255 - RNA, 16 nt, Human
uuuuaauaauguuuca

SEQ ID NO: 2431256 - RNA, 22 nt, Human
augugccagguuuuuggucuga

SEQ ID NO: 2431257 - RNA, 18 nt, Human
augugccgaaugugcagg

SEQ ID NO: 2431258 - RNA, 17 nt, Human
augugccgaaugugcag

SEQ ID NO: 2431259 - RNA, 22 nt, Human
augugccauuuuaaaaaaaaag

SEQ ID NO: 2431260 - RNA, 18 nt, Human
augugccauuuuaaaaaa

SEQ ID NO: 2431261 - RNA, 14 nt, Human
augugcccccagac

SEQ ID NO: 2431262 - RNA, 12 nt, Human
augugcccccag

SEQ ID NO: 2431263 - RNA, 14 nt, Human
augugccugggugg

SEQ ID NO: 2431264 - RNA, 20 nt, Human
augugccugauccagccucu

SEQ ID NO: 2431265 - RNA, 15 nt, Human
augugccugauccag

SEQ ID NO: 2431266 - RNA, 21 nt, Human
augugccguguuauuguauua

SEQ ID NO: 2431267 - RNA, 19 nt, Human
augugcuaguaauuggaaa

SEQ ID NO: 2431268 - RNA, 14 nt, Human
augugcgugugugc

SEQ ID NO: 2431269 - RNA, 15 nt, Human
augugcgugugugca

SEQ ID NO: 2431270 - RNA, 18 nt, Human
augugcgugugugcaagu

SEQ ID NO: 2431271 - RNA, 20 nt, Human
augugcgugugugcaagugu

SEQ ID NO: 2431272 - RNA, 20 nt, Human
auguggcuggaagauccugc

SEQ ID NO: 2431273 - RNA, 14 nt, Human
auguggcuggaaga

SEQ ID NO: 2431274 - RNA, 13 nt, Human
auguggcuggaag

SEQ ID NO: 2431275 - RNA, 17 nt, Human
auguggcugcagcagcg

SEQ ID NO: 2431276 - RNA, 15 nt, Human
auguggcugcagcag

SEQ ID NO: 2431277 - RNA, 11 nt, Human
augugugugca

SEQ ID NO: 2431278 - RNA, 16 nt, Human
augugugugcaagugu

SEQ ID NO: 2431279 - RNA, 19 nt, Human
augugugugcaagugugug

SEQ ID NO: 2431280 - RNA, 13 nt, Human
auguggcugcccc

SEQ ID NO: 2431281 - RNA, 20 nt, Human
auguggccccugaacaagaa

SEQ ID NO: 2431282 - RNA, 22 nt, Human
auguggccccugaacaagaauu

SEQ ID NO: 2431283 - RNA, 13 nt, Human
auguggcccuggc

SEQ ID NO: 2431284 - RNA, 14 nt, Human
auguggcccuggcc

SEQ ID NO: 2431285 - RNA, 15 nt, Human
auguggcccuggccu

SEQ ID NO: 2431286 - RNA, 16 nt, Human
auguggcccuggccug

SEQ ID NO: 2431287 - RNA, 19 nt, Human
auguggcccuggccugcug

SEQ ID NO: 2431288 - RNA, 20 nt, Human
auguggcccuggccugcugg

SEQ ID NO: 2431289 - RNA, 19 nt, Human
auguggccuguggccugug

SEQ ID NO: 2431290 - RNA, 19 nt, Human
auguggccuaaaaaugcaa

SEQ ID NO: 2431291 - RNA, 12 nt, Human
augugugugugc

SEQ ID NO: 2431292 - RNA, 15 nt, Human
auguguguguaugcu

SEQ ID NO: 2431293 - RNA, 16 nt, Human
auguguguguaugcua

SEQ ID NO: 2431294 - RNA, 19 nt, Human
auguguguguaugcuacua

SEQ ID NO: 2431295 - RNA, 21 nt, Human
auguguguguaugcuacuaca

SEQ ID NO: 2431296 - RNA, 10 nt, Human
augugugugu

SEQ ID NO: 2431297 - RNA, 22 nt, Human
augugugugguuuuuuuucuaa

SEQ ID NO: 2431298 - RNA, 15 nt, Human
augugugugcucagg

SEQ ID NO: 2431299 - RNA, 12 nt, Human
auguguguguau

SEQ ID NO: 2431300 - RNA, 13 nt, Human
auguguguguaug

SEQ ID NO: 2431301 - RNA, 23 nt, Human
auguguguuuuaaaaugagaaau

SEQ ID NO: 2431302 - RNA, 15 nt, Human
auguguguuuuaaaa

SEQ ID NO: 2431303 - RNA, 15 nt, Human
auguguguguauguu

SEQ ID NO: 2431304 - RNA, 21 nt, Human
auguguguguauguuugcaca

SEQ ID NO: 2431305 - RNA, 15 nt, Human
auguggaaguguggg

SEQ ID NO: 2431306 - RNA, 16 nt, Human
auguggaagugugggu

SEQ ID NO: 2431307 - RNA, 13 nt, Human
auguggaagugug

SEQ ID NO: 2431308 - RNA, 22 nt, Human
auguggaagugugggucugugu

SEQ ID NO: 2431309 - RNA, 23 nt, Human
auguggaagugugggucugugug

SEQ ID NO: 2431310 - RNA, 17 nt, Human
auguggaauauaaagau

SEQ ID NO: 2431311 - RNA, 15 nt, Human
auguggaauauaaag

SEQ ID NO: 2431312 - RNA, 14 nt, Human
augugcuacugauu

SEQ ID NO: 2431313 - RNA, 20 nt, Human
auguggaguucaucuugaau

SEQ ID NO: 2431314 - RNA, 16 nt, Human
auguggaguggggcag

SEQ ID NO: 2431315 - RNA, 19 nt, Human
auguggagaaacuguaguc

SEQ ID NO: 2431316 - RNA, 20 nt, Human
augugcuacugauuguuuca

SEQ ID NO: 2431317 - RNA, 24 nt, Human
auguggaguucaucuugaauugua

SEQ ID NO: 2431318 - RNA, 18 nt, Human
auguggccccugaacaag

SEQ ID NO: 2431319 - RNA, 18 nt, Human
auguggcaaggaaaaaca

SEQ ID NO: 2431320 - RNA, 23 nt, Human
auguggcaauaaauuuuuuuuaa

SEQ ID NO: 2431321 - RNA, 16 nt, Human
auguucaguguaauuu

SEQ ID NO: 2431322 - RNA, 14 nt, Human
auguucaguguaau

SEQ ID NO: 2431323 - RNA, 22 nt, Human
auguucagcacugucccuugcc

SEQ ID NO: 2431324 - RNA, 19 nt, Human
auguucagcacugucccuu

SEQ ID NO: 2431325 - RNA, 16 nt, Human
auguucagcacugucc

SEQ ID NO: 2431326 - RNA, 18 nt, Human
auguucaucaaugaauga

SEQ ID NO: 2431327 - RNA, 18 nt, Human
auguugcauagaauaaaa

SEQ ID NO: 2431328 - RNA, 17 nt, Human
auguugcauagaauaaa

SEQ ID NO: 2431329 - RNA, 15 nt, Human
auguugcauagaaua

SEQ ID NO: 2431330 - RNA, 21 nt, Human
auguucaguguaauuucuuug

SEQ ID NO: 2431331 - RNA, 18 nt, Human
auguucaguguaauuucu

SEQ ID NO: 2431332 - RNA, 22 nt, Human
auguucaguguaauuucuuugc

SEQ ID NO: 2431333 - RNA, 12 nt, Human
auguugcccagg

SEQ ID NO: 2431334 - RNA, 22 nt, Human
auguugccaguuuaaucauugc

SEQ ID NO: 2431335 - RNA, 16 nt, Human
auguugcccaggcagg

SEQ ID NO: 2431336 - RNA, 17 nt, Human
auguugcccaggcaggu

SEQ ID NO: 2431337 - RNA, 23 nt, Human
uuuuagaaagcauuugaaugcau

SEQ ID NO: 2431338 - RNA, 22 nt, Human
uuuuagaaagcauuugaaugca

SEQ ID NO: 2431339 - RNA, 21 nt, Human
uuuuagaaagcauuugaaugc

SEQ ID NO: 2431340 - RNA, 20 nt, Human
uuuuagaaagcauuugaaug

SEQ ID NO: 2431341 - RNA, 19 nt, Human
uuuuagaaagcauuugaau

SEQ ID NO: 2431342 - RNA, 18 nt, Human
uuuuagaaagcauuugaa

SEQ ID NO: 2431343 - RNA, 16 nt, Human
uuuuagaaagcauuug

SEQ ID NO: 2431344 - RNA, 14 nt, Human
uuuuagaaagcauu

SEQ ID NO: 2431345 - RNA, 15 nt, Human
uuuuaggaaaugaau

SEQ ID NO: 2431346 - RNA, 22 nt, Human
uuuuagcugguggcaauaaaua

SEQ ID NO: 2431347 - RNA, 21 nt, Human
uuuuagcugaugaacuuauuc

SEQ ID NO: 2431348 - RNA, 17 nt, Human
uuuuacuuuuaaacugu

SEQ ID NO: 2431349 - RNA, 22 nt, Human
uuuuacuugcauugaauauauu

SEQ ID NO: 2431350 - RNA, 18 nt, Human
uuuuacuuuuaaacugug

SEQ ID NO: 2431351 - RNA, 20 nt, Human
uuuuacuuuuaaacugugua

SEQ ID NO: 2431352 - RNA, 12 nt, Human
uuuuacuuuuau

SEQ ID NO: 2431353 - RNA, 15 nt, Human
uuuuacuuuuaaaug

SEQ ID NO: 2431354 - RNA, 19 nt, Human
uuuuacuuuuauaauaaaa

SEQ ID NO: 2431355 - RNA, 14 nt, Human
uuuuagaaaacagc

SEQ ID NO: 2431356 - RNA, 20 nt, Human
auguugcccuguugcugccu

SEQ ID NO: 2431357 - RNA, 20 nt, Human
auguugcccaggcaggucuu

SEQ ID NO: 2431358 - RNA, 19 nt, Human
auguuaaacuagcauaucu

SEQ ID NO: 2431359 - RNA, 15 nt, Human
auguuaaacuagcau

SEQ ID NO: 2431360 - RNA, 24 nt, Human
auguuaaacuagcauaucugccuu

SEQ ID NO: 2431361 - RNA, 17 nt, Human
auguuaaggaaacucuu

SEQ ID NO: 2431362 - RNA, 13 nt, Human
auguuaaggaaac

SEQ ID NO: 2431363 - RNA, 15 nt, Human
auguuaagcucuuua

SEQ ID NO: 2431364 - RNA, 13 nt, Human
auguuaagcucuu

SEQ ID NO: 2431365 - RNA, 23 nt, Human
auguuaaacuagcauaucugccu

SEQ ID NO: 2431366 - RNA, 21 nt, Human
auguuaaacuagcauaucugc

SEQ ID NO: 2431367 - RNA, 14 nt, Human
auguuaaaauguau

SEQ ID NO: 2431368 - RNA, 15 nt, Human
auguuaaaauguauu

SEQ ID NO: 2431369 - RNA, 14 nt, Human
auguguugugauag

SEQ ID NO: 2431370 - RNA, 17 nt, Human
auguguuuacuuuaugu

SEQ ID NO: 2431371 - RNA, 13 nt, Human
auguguugugaua

SEQ ID NO: 2431372 - RNA, 14 nt, Human
auguguugaaaaaa

SEQ ID NO: 2431373 - RNA, 19 nt, Human
auguuaaggaaacucuuau

SEQ ID NO: 2431374 - RNA, 18 nt, Human
auguuaaggaaacucuua

SEQ ID NO: 2431375 - RNA, 20 nt, Human
auguuaagggaagaauucca

SEQ ID NO: 2431376 - RNA, 23 nt, Human
auguuaaguuacuucacuuuaau

SEQ ID NO: 2431377 - RNA, 17 nt, Human
auguuaaguuacuucac

SEQ ID NO: 2431378 - RNA, 23 nt, Human
auguuaaggaaacucuuaucuca

SEQ ID NO: 2431379 - RNA, 15 nt, Human
auguuaaguuacuuc

SEQ ID NO: 2431380 - RNA, 13 nt, Human
auguuaauuucau

SEQ ID NO: 2431381 - RNA, 21 nt, Human
auguuaccuccuauaaacuua

SEQ ID NO: 2431382 - RNA, 13 nt, Human
auguuacugacca

SEQ ID NO: 2431383 - RNA, 14 nt, Human
auguuacugaccag

SEQ ID NO: 2431384 - RNA, 13 nt, Human
auguuacugauca

SEQ ID NO: 2431385 - RNA, 16 nt, Human
auguuacugaucaugc

SEQ ID NO: 2431386 - RNA, 17 nt, Human
auguuacuacaugcacu

SEQ ID NO: 2431387 - RNA, 23 nt, Human
auguuaauucagcacugauuuca

SEQ ID NO: 2431388 - RNA, 22 nt, Human
auguuaauucagcacugauuuc

SEQ ID NO: 2431389 - RNA, 23 nt, Human
auguuagaggaucccucucugga

SEQ ID NO: 2431390 - RNA, 22 nt, Human
auguuacugaucaugcauuguu

SEQ ID NO: 2431391 - RNA, 18 nt, Human
auguuacugaucaugcau

SEQ ID NO: 2431392 - RNA, 19 nt, Human
auguuacugaucaugcauu

SEQ ID NO: 2431393 - RNA, 20 nt, Human
auguuacugaucaugcauug

SEQ ID NO: 2431394 - RNA, 21 nt, Human
auguuacugaucaugcauugu

SEQ ID NO: 2431395 - RNA, 18 nt, Human
auguuaggaaaauuucac

SEQ ID NO: 2431396 - RNA, 21 nt, Human
auguuagagguuuuaaaguga

SEQ ID NO: 2431397 - RNA, 16 nt, Human
auguuagagguuuuaa

SEQ ID NO: 2431398 - RNA, 15 nt, Human
auguuagcaaagagu

SEQ ID NO: 2431399 - RNA, 20 nt, Human
auguucacuuuugacaaagg

SEQ ID NO: 2431400 - RNA, 22 nt, Human
auguucacuuuugacaaaggca

SEQ ID NO: 2431401 - RNA, 19 nt, Human
auguuaggaaaauuucaca

SEQ ID NO: 2431402 - RNA, 16 nt, Human
auguuagggugcucug

SEQ ID NO: 2431403 - RNA, 23 nt, Human
auguucagaagguugcucuagau

SEQ ID NO: 2431404 - RNA, 22 nt, Human
auguuagagguuuuaaagugau

SEQ ID NO: 2431405 - RNA, 20 nt, Human
auguucagauugcuuugauu

SEQ ID NO: 2431406 - RNA, 13 nt, Human
auuauauauauau

SEQ ID NO: 2431407 - RNA, 13 nt, Human
auuagugcuaagu

SEQ ID NO: 2431408 - RNA, 23 nt, Human
auuauagugauguaaucuugaau

SEQ ID NO: 2431409 - RNA, 15 nt, Human
auuagugcuaagugu

SEQ ID NO: 2431410 - RNA, 19 nt, Human
auuacuuaucauccacauu

SEQ ID NO: 2431411 - RNA, 18 nt, Human
auuaguauuuauuuaaug

SEQ ID NO: 2431412 - RNA, 23 nt, Human
auuaguauuuauuuaauguuaug

SEQ ID NO: 2431413 - RNA, 14 nt, Human
auuaguccuugcuu

SEQ ID NO: 2431414 - RNA, 13 nt, Human
auuaguccuugcu

SEQ ID NO: 2431415 - RNA, 23 nt, Human
auuagucauucaauaaauuguaa

SEQ ID NO: 2431416 - RNA, 14 nt, Human
auuagaauuauuua

SEQ ID NO: 2431417 - RNA, 16 nt, Human
auuacuuauuuuugac

SEQ ID NO: 2431418 - RNA, 17 nt, Human
auuacuuauuuuugaca

SEQ ID NO: 2431419 - RNA, 18 nt, Human
auuacuuauuuuugacag

SEQ ID NO: 2431420 - RNA, 19 nt, Human
auuacuuauuuuugacagu

SEQ ID NO: 2431421 - RNA, 23 nt, Human
auuacuuaucauccacauuguuu

SEQ ID NO: 2431422 - RNA, 15 nt, Human
auuacuuauuuuuga

SEQ ID NO: 2431423 - RNA, 15 nt, Human
auuacuuaucaucca

SEQ ID NO: 2431424 - RNA, 23 nt, Human
auuacuguuugucuucuccccag

SEQ ID NO: 2431425 - RNA, 22 nt, Human
auuacuguuugucuucucccca

SEQ ID NO: 2431426 - RNA, 18 nt, Human
auuacuaugacugcuccc

SEQ ID NO: 2431427 - RNA, 20 nt, Human
auuacuguuugucuucuccc

SEQ ID NO: 2431428 - RNA, 13 nt, Human
auuacuuagagga

SEQ ID NO: 2431429 - RNA, 20 nt, Human
auuacuacaaaauuugaaau

SEQ ID NO: 2431430 - RNA, 21 nt, Human
auuacuacaaaauuugaaauu

SEQ ID NO: 2431431 - RNA, 16 nt, Human
auuacgugagccaggu

SEQ ID NO: 2431432 - RNA, 14 nt, Human
auuacgugagccag

SEQ ID NO: 2431433 - RNA, 13 nt, Human
auuacgugagcca

SEQ ID NO: 2431434 - RNA, 20 nt, Human
auuacgugagccagguaaug

SEQ ID NO: 2431435 - RNA, 20 nt, Human
auuacuaaggaguaaucugu

SEQ ID NO: 2431436 - RNA, 15 nt, Human
auuacuacaaaauuu

SEQ ID NO: 2431437 - RNA, 20 nt, Human
auuaccuuuuuugauaaagu

SEQ ID NO: 2431438 - RNA, 20 nt, Human
auuacccccuccuucagaca

SEQ ID NO: 2431439 - RNA, 21 nt, Human
auuacccccuccuucagacac

SEQ ID NO: 2431440 - RNA, 17 nt, Human
auuaccgcguuguaaaa

SEQ ID NO: 2431441 - RNA, 16 nt, Human
auuaccgcguuguaaa

SEQ ID NO: 2431442 - RNA, 18 nt, Human
auuacccccuccuucaga

SEQ ID NO: 2431443 - RNA, 19 nt, Human
auuacccccuccuucagac

SEQ ID NO: 2431444 - RNA, 13 nt, Human
auuacccccuccu

SEQ ID NO: 2431445 - RNA, 15 nt, Human
auuacccaagcaaaa

SEQ ID NO: 2431446 - RNA, 22 nt, Human
auuacccccucauuguuuauua

SEQ ID NO: 2431447 - RNA, 13 nt, Human
auuacccaagcaa

SEQ ID NO: 2431448 - RNA, 13 nt, Human
auuaccauggaga

SEQ ID NO: 2431449 - RNA, 15 nt, Human
auuaccauggagaca

SEQ ID NO: 2431450 - RNA, 12 nt, Human
auuaccagggac

SEQ ID NO: 2431451 - RNA, 20 nt, Human
auuaccaugagaagagggcc

SEQ ID NO: 2431452 - RNA, 17 nt, Human
auuacauuuccaaauga

SEQ ID NO: 2431453 - RNA, 20 nt, Human
auuacauuuguauaaaauaa

SEQ ID NO: 2431454 - RNA, 18 nt, Human
auuacauuuguauaaaau

SEQ ID NO: 2431455 - RNA, 17 nt, Human
auuacauuuguauaaaa

SEQ ID NO: 2431456 - RNA, 19 nt, Human
auuacauguaaaacauuau

SEQ ID NO: 2431457 - RNA, 16 nt, Human
auuacauguaaaacau

SEQ ID NO: 2431458 - RNA, 15 nt, Human
auuacauuuccaaau

SEQ ID NO: 2431459 - RNA, 19 nt, Human
auuaauaaaaaauggaaag

SEQ ID NO: 2431460 - RNA, 22 nt, Human
auuaauaaaaaauggaaagaau

SEQ ID NO: 2431461 - RNA, 16 nt, Human
auuaauaaaaaaugga

SEQ ID NO: 2431462 - RNA, 13 nt, Human
auuaaguuguuaa

SEQ ID NO: 2431463 - RNA, 20 nt, Human
auuaaguuguuaauaaaagu

SEQ ID NO: 2431464 - RNA, 19 nt, Human
auuaaguuguuaauaaaag

SEQ ID NO: 2431465 - RNA, 14 nt, Human
auuaaguacuaugu

SEQ ID NO: 2431466 - RNA, 16 nt, Human
auuaaguacuauguau

SEQ ID NO: 2431467 - RNA, 14 nt, Human
auuaaguuguuaau

SEQ ID NO: 2431468 - RNA, 21 nt, Human
auuacauaaucuguacaauga

SEQ ID NO: 2431469 - RNA, 18 nt, Human
auuacauaaucuguacaa

SEQ ID NO: 2431470 - RNA, 15 nt, Human
auuacaucuuucaca

SEQ ID NO: 2431471 - RNA, 21 nt, Human
auuacauauuugcauauguau

SEQ ID NO: 2431472 - RNA, 16 nt, Human
auuacaucuuucacau

SEQ ID NO: 2431473 - RNA, 18 nt, Human
auuacaucuuucacauug

SEQ ID NO: 2431474 - RNA, 22 nt, Human
auuacaucuuucacauuggcua

SEQ ID NO: 2431475 - RNA, 13 nt, Human
auuaauagcuuuu

SEQ ID NO: 2431476 - RNA, 15 nt, Human
auuacagugggugcc

SEQ ID NO: 2431477 - RNA, 15 nt, Human
auuaauaauaaauuc

SEQ ID NO: 2431478 - RNA, 12 nt, Human
auuaauaaucuu

SEQ ID NO: 2431479 - RNA, 13 nt, Human
auuaauaaucuua

SEQ ID NO: 2431480 - RNA, 16 nt, Human
auuaauaaucuuauua

SEQ ID NO: 2431481 - RNA, 20 nt, Human
uuuuuauggcuuuugugcau

SEQ ID NO: 2431482 - RNA, 21 nt, Human
uuuuuauggcuuuugugcauu

SEQ ID NO: 2431483 - RNA, 22 nt, Human
uuuuuauggcuuuugugcauua

SEQ ID NO: 2431484 - RNA, 14 nt, Human
uuuuuaucuuuaua

SEQ ID NO: 2431485 - RNA, 12 nt, Human
uuuuuguacugu

SEQ ID NO: 2431486 - RNA, 16 nt, Human
uuuuuguaccugguga

SEQ ID NO: 2431487 - RNA, 18 nt, Human
uuuuuguacaguuugcug

SEQ ID NO: 2431488 - RNA, 13 nt, Human
uuuuuguaauuua

SEQ ID NO: 2431489 - RNA, 16 nt, Human
uuuuuguaaagugugg

SEQ ID NO: 2431490 - RNA, 13 nt, Human
uuuuuauuauuug

SEQ ID NO: 2431491 - RNA, 14 nt, Human
uuuuuauuauuugu

SEQ ID NO: 2431492 - RNA, 13 nt, Human
uuuuuauucauaa

SEQ ID NO: 2431493 - RNA, 23 nt, Human
uuuuuauugaaucuauuuaagua

SEQ ID NO: 2431494 - RNA, 19 nt, Human
uuuuugugaaaagcuccau

SEQ ID NO: 2431495 - RNA, 20 nt, Human
uuuuuguagagccagggucu

SEQ ID NO: 2431496 - RNA, 19 nt, Human
uuuuuguagagccaggguc

SEQ ID NO: 2431497 - RNA, 23 nt, Human
auuaaguaaugauaacuggaaac

SEQ ID NO: 2431498 - RNA, 21 nt, Human
auuaaguaaugauaacuggaa

SEQ ID NO: 2431499 - RNA, 12 nt, Human
uuuuugucauca

SEQ ID NO: 2431500 - RNA, 20 nt, Human
uuuuugugaaaaugucaaag

SEQ ID NO: 2431501 - RNA, 13 nt, Human
uuuuugucuuuuc

SEQ ID NO: 2431502 - RNA, 22 nt, Human
uuuuuguguuuuguucuuuaaa

SEQ ID NO: 2431503 - RNA, 14 nt, Human
uuuuuguacuguaa

SEQ ID NO: 2431504 - RNA, 15 nt, Human
uuuuuguguauuugu

SEQ ID NO: 2431505 - RNA, 19 nt, Human
uuuugugauuuagaacugu

SEQ ID NO: 2431506 - RNA, 18 nt, Human
uuuuguuaucagucaaua

SEQ ID NO: 2431507 - RNA, 17 nt, Human
uuuugugcauuaucuag

SEQ ID NO: 2431508 - RNA, 20 nt, Human
uuuugugcauuaucuagaua

SEQ ID NO: 2431509 - RNA, 13 nt, Human
uuuugcuggaaua

SEQ ID NO: 2431510 - RNA, 17 nt, Human
uuuugccuucauuaccu

SEQ ID NO: 2431511 - RNA, 13 nt, Human
uuuugccuucauu

SEQ ID NO: 2431512 - RNA, 17 nt, Human
uuuugcuauuguaaaua

SEQ ID NO: 2431513 - RNA, 21 nt, Human
uuuugcuauuagacuguagga

SEQ ID NO: 2431514 - RNA, 12 nt, Human
uuuugcuguaua

SEQ ID NO: 2431515 - RNA, 10 nt, Human
uuuugcuguu

SEQ ID NO: 2431516 - RNA, 13 nt, Human
uuuugcuguauau

SEQ ID NO: 2431517 - RNA, 21 nt, Human
uuuugugaugucccaacuugu

SEQ ID NO: 2431518 - RNA, 14 nt, Human
uuuugcuguagaag

SEQ ID NO: 2431519 - RNA, 13 nt, Human
uuuugcuguagaa

SEQ ID NO: 2431520 - RNA, 16 nt, Human
uuuuguucaaagccag

SEQ ID NO: 2431521 - RNA, 16 nt, Human
uuuugugauuuagaac

SEQ ID NO: 2431522 - RNA, 15 nt, Human
uuuuguuccacaagu

SEQ ID NO: 2431523 - RNA, 21 nt, Human
uuuuguuccacaaguuaaaua

SEQ ID NO: 2431524 - RNA, 22 nt, Human
uuuuguuugcuaucuuaauuuu

SEQ ID NO: 2431525 - RNA, 13 nt, Human
uuuuguuugcuau

SEQ ID NO: 2431526 - RNA, 15 nt, Human
uuuuguuucuuccaa

SEQ ID NO: 2431527 - RNA, 19 nt, Human
uuuuguuucauauugaugu

SEQ ID NO: 2431528 - RNA, 12 nt, Human
uuuuguuucaua

SEQ ID NO: 2431529 - RNA, 19 nt, Human
uuuuuauauuugaaauauu

SEQ ID NO: 2431530 - RNA, 23 nt, Human
uuuuuauacauaaacaagaccac

SEQ ID NO: 2431531 - RNA, 20 nt, Human
uuuuuaucgucacugcuuaa

SEQ ID NO: 2431532 - RNA, 12 nt, Human
uuuuuaucaugu

SEQ ID NO: 2431533 - RNA, 12 nt, Human
uuuuuauggcuu

SEQ ID NO: 2431534 - RNA, 13 nt, Human
uuuuuauacacau

SEQ ID NO: 2431535 - RNA, 17 nt, Human
uuuuuaucaugcauguc

SEQ ID NO: 2431536 - RNA, 17 nt, Human
uuuuuaucuugggacug

SEQ ID NO: 2431537 - RNA, 23 nt, Human
uuuuuaucuccccuucacaugca

SEQ ID NO: 2431538 - RNA, 14 nt, Human
uuuuguuugguauu

SEQ ID NO: 2431539 - RNA, 22 nt, Human
uuuuguuugguauuguauuuau

SEQ ID NO: 2431540 - RNA, 19 nt, Human
uuuuguuugguauuguauu

SEQ ID NO: 2431541 - RNA, 18 nt, Human
uuuuuacccauauccccu

SEQ ID NO: 2431542 - RNA, 11 nt, Human
uuuuuacuaau

SEQ ID NO: 2431543 - RNA, 15 nt, Human
uuuuuagaucaaaua

SEQ ID NO: 2431544 - RNA, 14 nt, Human
uuuuuagaucaaau

SEQ ID NO: 2431545 - RNA, 21 nt, Human
uuuuuagaucaaauacuuuaa

SEQ ID NO: 2431546 - RNA, 22 nt, Human
uuuuuagacagagucucacugu

SEQ ID NO: 2431547 - RNA, 12 nt, Human
uuuuuacugcca

SEQ ID NO: 2431548 - RNA, 14 nt, Human
uuuuuacugaacaa

SEQ ID NO: 2431549 - RNA, 13 nt, Human
uuuuuacugccac

SEQ ID NO: 2431550 - RNA, 20 nt, Human
uuuuuagaaagcauuugaau

SEQ ID NO: 2431551 - RNA, 19 nt, Human
uuuuuaccguuucuucccu

SEQ ID NO: 2431552 - RNA, 22 nt, Human
uuuuuaccuaccacagugucug

SEQ ID NO: 2431553 - RNA, 16 nt, Human
uuuuuacuacaguugu

SEQ ID NO: 2431554 - RNA, 22 nt, Human
uuuuuacccauauccccucucc

SEQ ID NO: 2431555 - RNA, 13 nt, Human
auuaagauuucca

SEQ ID NO: 2431556 - RNA, 20 nt, Human
auuaagauugaggccugccc

SEQ ID NO: 2431557 - RNA, 17 nt, Human
auuaagauugaggccug

SEQ ID NO: 2431558 - RNA, 16 nt, Human
auuaagauuuccaagu

SEQ ID NO: 2431559 - RNA, 17 nt, Human
auuaagccacuuaaaau

SEQ ID NO: 2431560 - RNA, 20 nt, Human
auuaagccacuuaaaauguu

SEQ ID NO: 2431561 - RNA, 24 nt, Human
auuaagauggauucucagauauuu

SEQ ID NO: 2431562 - RNA, 20 nt, Human
auuaaagcauuuacuuugaa

SEQ ID NO: 2431563 - RNA, 13 nt, Human
auuaaagacagag

SEQ ID NO: 2431564 - RNA, 15 nt, Human
auuaaagacuccagu

SEQ ID NO: 2431565 - RNA, 15 nt, Human
auuaaagcauuuacu

SEQ ID NO: 2431566 - RNA, 21 nt, Human
uuuugauaaaguuucucagau

SEQ ID NO: 2431567 - RNA, 19 nt, Human
uuuugauaaaguuucucag

SEQ ID NO: 2431568 - RNA, 23 nt, Human
uuuugauaaaguaguaaaaauua

SEQ ID NO: 2431569 - RNA, 20 nt, Human
uuuugauaaaguuucucaga

SEQ ID NO: 2431570 - RNA, 14 nt, Human
uuuugaguucuaca

SEQ ID NO: 2431571 - RNA, 22 nt, Human
uuuugauaaaguaguaaaaauu

SEQ ID NO: 2431572 - RNA, 18 nt, Human
uuuugauaaaguaguaaa

SEQ ID NO: 2431573 - RNA, 15 nt, Human
uuuugauagcaaagc

SEQ ID NO: 2431574 - RNA, 15 nt, Human
uuuugauagcuuuau

SEQ ID NO: 2431575 - RNA, 17 nt, Human
uuuugauccaagcuggu

SEQ ID NO: 2431576 - RNA, 17 nt, Human
uuuugagugccuuacac

SEQ ID NO: 2431577 - RNA, 14 nt, Human
uuuugaggcuuuca

SEQ ID NO: 2431578 - RNA, 18 nt, Human
uuuugaguggaugauguu

SEQ ID NO: 2431579 - RNA, 16 nt, Human
uuuugagcaacuuucu

SEQ ID NO: 2431580 - RNA, 11 nt, Human
uuuugagaaag

SEQ ID NO: 2431581 - RNA, 17 nt, Human
uuuugagacagaaucuc

SEQ ID NO: 2431582 - RNA, 22 nt, Human
uuuugagcugaaaugcugcauu

SEQ ID NO: 2431583 - RNA, 21 nt, Human
uuuugagcugaaaugcugcau

SEQ ID NO: 2431584 - RNA, 15 nt, Human
uuuugaggagcccca

SEQ ID NO: 2431585 - RNA, 17 nt, Human
uuuugagcaacuuucuu

SEQ ID NO: 2431586 - RNA, 13 nt, Human
uuuugcaccccuc

SEQ ID NO: 2431587 - RNA, 21 nt, Human
uuuugcaccccaugcuguuga

SEQ ID NO: 2431588 - RNA, 19 nt, Human
uuuugcaccccaugcuguu

SEQ ID NO: 2431589 - RNA, 18 nt, Human
uuuugcaccccaugcugu

SEQ ID NO: 2431590 - RNA, 17 nt, Human
uuuugcaccccaugcug

SEQ ID NO: 2431591 - RNA, 20 nt, Human
uuuugcacauguuuccucua

SEQ ID NO: 2431592 - RNA, 17 nt, Human
uuuugcaauggcuauau

SEQ ID NO: 2431593 - RNA, 10 nt, Human
uuuugcacag

SEQ ID NO: 2431594 - RNA, 23 nt, Human
uuuugcaagugaagguuuacaau

SEQ ID NO: 2431595 - RNA, 22 nt, Human
uuuugcaagugaagguuuacaa

SEQ ID NO: 2431596 - RNA, 17 nt, Human
uuuugcaaccucgcugg

SEQ ID NO: 2431597 - RNA, 21 nt, Human
uuuugcaaccucgcuggacuc

SEQ ID NO: 2431598 - RNA, 21 nt, Human
uuuugauuuguacugaaaaau

SEQ ID NO: 2431599 - RNA, 13 nt, Human
uuuugcaaaauuu

SEQ ID NO: 2431600 - RNA, 12 nt, Human
uuuugauugaag

SEQ ID NO: 2431601 - RNA, 18 nt, Human
uuuugauuauuguauuua

SEQ ID NO: 2431602 - RNA, 20 nt, Human
uuuugauuuaauguuuucag

SEQ ID NO: 2431603 - RNA, 20 nt, Human
uuuugauuuguacugaaaaa

SEQ ID NO: 2431604 - RNA, 15 nt, Human
uuuugauuuaugcau

SEQ ID NO: 2431605 - RNA, 20 nt, Human
uuuugauguuuguggccuca

SEQ ID NO: 2431606 - RNA, 22 nt, Human
uuuugauguuuguggccucaga

SEQ ID NO: 2431607 - RNA, 12 nt, Human
uuuugauuaugu

SEQ ID NO: 2431608 - RNA, 15 nt, Human
uuuugauuauuguau

SEQ ID NO: 2431609 - RNA, 23 nt, Human
uuuugaugaacaaaauuuccuaa

SEQ ID NO: 2431610 - RNA, 15 nt, Human
uuuugauguuugugg

SEQ ID NO: 2431611 - RNA, 16 nt, Human
uuuugaugaguuguga

SEQ ID NO: 2431612 - RNA, 15 nt, Human
uuuugccaacauugc

SEQ ID NO: 2431613 - RNA, 15 nt, Human
uuuugcauucaaauu

SEQ ID NO: 2431614 - RNA, 13 nt, Human
uuuugcauuuaug

SEQ ID NO: 2431615 - RNA, 19 nt, Human
uuuugcauuugaauaaagc

SEQ ID NO: 2431616 - RNA, 23 nt, Human
uuuugccauguuggccaggcugg

SEQ ID NO: 2431617 - RNA, 15 nt, Human
uuuugccauuaaacu

SEQ ID NO: 2431618 - RNA, 18 nt, Human
uuuugcccuucacagugu

SEQ ID NO: 2431619 - RNA, 13 nt, Human
uuuugcccuuuga

SEQ ID NO: 2431620 - RNA, 15 nt, Human
uuuugccucuuuucu

SEQ ID NO: 2431621 - RNA, 12 nt, Human
uuuugcacuuuu

SEQ ID NO: 2431622 - RNA, 17 nt, Human
uuuugcaccccucccau

SEQ ID NO: 2431623 - RNA, 16 nt, Human
uuuugcaccccuccca

SEQ ID NO: 2431624 - RNA, 13 nt, Human
uuuugcaggagca

SEQ ID NO: 2431625 - RNA, 21 nt, Human
uuuugcagcccagacaaaugu

SEQ ID NO: 2431626 - RNA, 14 nt, Human
uuuugcagcaguga

SEQ ID NO: 2431627 - RNA, 22 nt, Human
uuuugcaguagagucaucucca

SEQ ID NO: 2431628 - RNA, 18 nt, Human
uuuugcaucauuguuuua

SEQ ID NO: 2431629 - RNA, 13 nt, Human
uuuugcauucaaa

SEQ ID NO: 2431630 - RNA, 22 nt, Human
uuuugcauggcacuugcaucug

SEQ ID NO: 2431631 - RNA, 18 nt, Human
uuuugcauuuaaaacaga

SEQ ID NO: 2431632 - RNA, 19 nt, Human
uuuugcauggcacuugcau

SEQ ID NO: 2431633 - RNA, 16 nt, Human
uuuugcauggcacuug

SEQ ID NO: 2431634 - RNA, 12 nt, Human
uuuugcaugaaa

SEQ ID NO: 2431635 - RNA, 14 nt, Human
caauaggaaaaacu

SEQ ID NO: 2431636 - RNA, 14 nt, Human
caauguucucucuu

SEQ ID NO: 2431637 - RNA, 13 nt, Human
caauaauuuucua

SEQ ID NO: 2431638 - RNA, 14 nt, Human
caauaauuuucuac

SEQ ID NO: 2431639 - RNA, 19 nt, Human
caauacacuaguuguuucu

SEQ ID NO: 2431640 - RNA, 17 nt, Human
caauacacuaguuguuu

SEQ ID NO: 2431641 - RNA, 23 nt, Human
caauacaucccuuaccugggaaa

SEQ ID NO: 2431642 - RNA, 17 nt, Human
caauacaugcugcuaau

SEQ ID NO: 2431643 - RNA, 15 nt, Human
caauacaugcugcua

SEQ ID NO: 2431644 - RNA, 18 nt, Human
caauacaguacaggcagc

SEQ ID NO: 2431645 - RNA, 17 nt, Human
caauacaguacaggcag

SEQ ID NO: 2431646 - RNA, 19 nt, Human
caauacaguacaggcagca

SEQ ID NO: 2431647 - RNA, 12 nt, Human
caauaggaaaaa

SEQ ID NO: 2431648 - RNA, 19 nt, Human
caauacccaaauccucucc

SEQ ID NO: 2431649 - RNA, 13 nt, Human
caauaggaaaaac

SEQ ID NO: 2431650 - RNA, 18 nt, Human
caauagcuuuacccucag

SEQ ID NO: 2431651 - RNA, 21 nt, Human
caauagcuuuacccucaggca

SEQ ID NO: 2431652 - RNA, 20 nt, Human
caauauaaaacuguacuuca

SEQ ID NO: 2431653 - RNA, 23 nt, Human
caauagcuuuacccucaggcaua

SEQ ID NO: 2431654 - RNA, 22 nt, Human
caauauaaaaggcaaaugugua

SEQ ID NO: 2431655 - RNA, 22 nt, Human
caauauaaaacuguacuucacu

SEQ ID NO: 2431656 - RNA, 20 nt, Human
caaguuacagcugugacaau

SEQ ID NO: 2431657 - RNA, 16 nt, Human
caaguuauaaaucaau

SEQ ID NO: 2431658 - RNA, 20 nt, Human
caaguuauaaaucaauguca

SEQ ID NO: 2431659 - RNA, 18 nt, Human
caauaauaauaccucccu

SEQ ID NO: 2431660 - RNA, 14 nt, Human
caaguuagcucagg

SEQ ID NO: 2431661 - RNA, 16 nt, Human
caaguuagcucaggag

SEQ ID NO: 2431662 - RNA, 17 nt, Human
caaguuagcucaggagg

SEQ ID NO: 2431663 - RNA, 19 nt, Human
caaguuagcucaggaggcu

SEQ ID NO: 2431664 - RNA, 23 nt, Human
caagugugcauauuguacacuuu

SEQ ID NO: 2431665 - RNA, 21 nt, Human
caagugugcauauuguacacu

SEQ ID NO: 2431666 - RNA, 18 nt, Human
caagugugcauauuguac

SEQ ID NO: 2431667 - RNA, 19 nt, Human
caagugugcuuuagcuuga

SEQ ID NO: 2431668 - RNA, 22 nt, Human
caagugugcauauuguacacuu

SEQ ID NO: 2431669 - RNA, 16 nt, Human
caaguuagaaaacaua

SEQ ID NO: 2431670 - RNA, 13 nt, Human
caaguuagcucag

SEQ ID NO: 2431671 - RNA, 17 nt, Human
caauaauauauuuucug

SEQ ID NO: 2431672 - RNA, 16 nt, Human
caauaauauauuuucu

SEQ ID NO: 2431673 - RNA, 14 nt, Human
caauaauauauuuu

SEQ ID NO: 2431674 - RNA, 13 nt, Human
caauaauauauuu

SEQ ID NO: 2431675 - RNA, 20 nt, Human
caauaauauauuuucuguuu

SEQ ID NO: 2431676 - RNA, 18 nt, Human
caauaauggucccaucca

SEQ ID NO: 2431677 - RNA, 17 nt, Human
caauaauggucccaucc

SEQ ID NO: 2431678 - RNA, 18 nt, Human
caauaauauauuuucugu

SEQ ID NO: 2431679 - RNA, 20 nt, Human
caauaauggucccauccagg

SEQ ID NO: 2431680 - RNA, 19 nt, Human
caauaauggucccauccag

SEQ ID NO: 2431681 - RNA, 23 nt, Human
caauaauggucccauccaggcag

SEQ ID NO: 2431682 - RNA, 22 nt, Human
caauaauuucagguuuuguaaa

SEQ ID NO: 2431683 - RNA, 16 nt, Human
caauaauugcagaacu

SEQ ID NO: 2431684 - RNA, 14 nt, Human
caauaauuucaggu

SEQ ID NO: 2431685 - RNA, 14 nt, Human
caauauuguacagu

SEQ ID NO: 2431686 - RNA, 17 nt, Human
caauauugacuuugucu

SEQ ID NO: 2431687 - RNA, 17 nt, Human
caaucugacauucucag

SEQ ID NO: 2431688 - RNA, 16 nt, Human
caauauugacuuuguc

SEQ ID NO: 2431689 - RNA, 21 nt, Human
caauauuccugaaugaaauau

SEQ ID NO: 2431690 - RNA, 15 nt, Human
caauauugaacuuuu

SEQ ID NO: 2431691 - RNA, 14 nt, Human
caauauugacuuug

SEQ ID NO: 2431692 - RNA, 22 nt, Human
caauauaucuaaauugaauaau

SEQ ID NO: 2431693 - RNA, 21 nt, Human
caauauaucuaaauugaauaa

SEQ ID NO: 2431694 - RNA, 20 nt, Human
caauauaucuaaauugaaua

SEQ ID NO: 2431695 - RNA, 17 nt, Human
caauauucgcuguguca

SEQ ID NO: 2431696 - RNA, 14 nt, Human
caauauagaaacac

SEQ ID NO: 2431697 - RNA, 12 nt, Human
caauauagaaac

SEQ ID NO: 2431698 - RNA, 23 nt, Human
caauauaaaaggcaaauguguac

SEQ ID NO: 2431699 - RNA, 13 nt, Human
caauauagcaaga

SEQ ID NO: 2431700 - RNA, 19 nt, Human
caauauaucuaaauugaau

SEQ ID NO: 2431701 - RNA, 19 nt, Human
caauauagaaacacgaacu

SEQ ID NO: 2431702 - RNA, 12 nt, Human
caauauagcaag

SEQ ID NO: 2431703 - RNA, 23 nt, Human
caaugaccuuucaauaggaaaaa

SEQ ID NO: 2431704 - RNA, 18 nt, Human
caaucuguaaacugugua

SEQ ID NO: 2431705 - RNA, 18 nt, Human
caauauaaaacuguacuu

SEQ ID NO: 2431706 - RNA, 12 nt, Human
caaucuguaaac

SEQ ID NO: 2431707 - RNA, 15 nt, Human
caaucuguaaacugu

SEQ ID NO: 2431708 - RNA, 16 nt, Human
caaucuguaaacugug

SEQ ID NO: 2431709 - RNA, 17 nt, Human
caaucuguaaacugugu

SEQ ID NO: 2431710 - RNA, 19 nt, Human
caaucugacauucucagga

SEQ ID NO: 2431711 - RNA, 17 nt, Human
caaugacuuacuguaca

SEQ ID NO: 2431712 - RNA, 18 nt, Human
caaugacuuacuguacau

SEQ ID NO: 2431713 - RNA, 15 nt, Human
caaugacuuacugua

SEQ ID NO: 2431714 - RNA, 21 nt, Human
caaugaccuuucaauaggaaa

SEQ ID NO: 2431715 - RNA, 19 nt, Human
caaucuuaaggggcagcuu

SEQ ID NO: 2431716 - RNA, 19 nt, Human
caaugggcacugggaugag

SEQ ID NO: 2431717 - RNA, 17 nt, Human
caaugggcacugggaug

SEQ ID NO: 2431718 - RNA, 15 nt, Human
caaugggcacuggga

SEQ ID NO: 2431719 - RNA, 15 nt, Human
caaugggcaaugaca

SEQ ID NO: 2431720 - RNA, 21 nt, Human
caaugggagcugaggccacac

SEQ ID NO: 2431721 - RNA, 18 nt, Human
caaugggcacugggauga

SEQ ID NO: 2431722 - RNA, 22 nt, Human
caauggggauguuguguuucug

SEQ ID NO: 2431723 - RNA, 23 nt, Human
caauggguuuuucccuguacagu

SEQ ID NO: 2431724 - RNA, 17 nt, Human
caaugguguugcccuga

SEQ ID NO: 2431725 - RNA, 22 nt, Human
caaugguguucaccaucggcag

SEQ ID NO: 2431726 - RNA, 22 nt, Human
caaugguguugcccugagugga

SEQ ID NO: 2431727 - RNA, 23 nt, Human
caauguauuuauuuaaaagauuc

SEQ ID NO: 2431728 - RNA, 22 nt, Human
caauguauuuauuuaaaagauu

SEQ ID NO: 2431729 - RNA, 20 nt, Human
caauguauuuauuuaaaaga

SEQ ID NO: 2431730 - RNA, 18 nt, Human
caauguauuuauuuaaaa

SEQ ID NO: 2431731 - RNA, 14 nt, Human
caaugucacuuaaa

SEQ ID NO: 2431732 - RNA, 14 nt, Human
caaugucaggaaca

SEQ ID NO: 2431733 - RNA, 19 nt, Human
caaugucaggaacagaagg

SEQ ID NO: 2431734 - RNA, 22 nt, Human
caaugugacuuaaugccacuaa

SEQ ID NO: 2431735 - RNA, 17 nt, Human
caauguagaaagcuuug

SEQ ID NO: 2431736 - RNA, 15 nt, Human
caauguauuuauuua

SEQ ID NO: 2431737 - RNA, 20 nt, Human
caauguauugauaagagggc

SEQ ID NO: 2431738 - RNA, 19 nt, Human
caauguagaggggaaaaga

SEQ ID NO: 2431739 - RNA, 21 nt, Human
caaugcacuuuguucuggcuc

SEQ ID NO: 2431740 - RNA, 20 nt, Human
caaugcacuuuguucuggcu

SEQ ID NO: 2431741 - RNA, 22 nt, Human
caaugcacuuuguucuggcucu

SEQ ID NO: 2431742 - RNA, 23 nt, Human
caaugggagcugaggccacacuc

SEQ ID NO: 2431743 - RNA, 19 nt, Human
caaugggagcugaggccac

SEQ ID NO: 2431744 - RNA, 18 nt, Human
caaugaggucugaaaugg

SEQ ID NO: 2431745 - RNA, 17 nt, Human
caaugcacuuuguucug

SEQ ID NO: 2431746 - RNA, 17 nt, Human
caaugaggucugaaaug

SEQ ID NO: 2431747 - RNA, 14 nt, Human
caaugacucucugg

SEQ ID NO: 2431748 - RNA, 14 nt, Human
caauucuccugccu

SEQ ID NO: 2431749 - RNA, 15 nt, Human
caauucuccugccuc

SEQ ID NO: 2431750 - RNA, 22 nt, Human
caauuucuguguugccaagcuc

SEQ ID NO: 2431751 - RNA, 16 nt, Human
caauuugggagauaua

SEQ ID NO: 2431752 - RNA, 20 nt, Human
caauuaauuuuuuuauuguu

SEQ ID NO: 2431753 - RNA, 19 nt, Human
caauuaauuuuuuuauugu

SEQ ID NO: 2431754 - RNA, 13 nt, Human
caauuaauuuuuu

SEQ ID NO: 2431755 - RNA, 15 nt, Human
caauuaauaaaaaau

SEQ ID NO: 2431756 - RNA, 23 nt, Human
caauuaauuuuuuuauuguuuaa

SEQ ID NO: 2431757 - RNA, 22 nt, Human
caauuaauuuuuuuauuguuua

SEQ ID NO: 2431758 - RNA, 16 nt, Human
caauuacaggaaguac

SEQ ID NO: 2431759 - RNA, 13 nt, Human
caauucuccugcc

SEQ ID NO: 2431760 - RNA, 16 nt, Human
caauucgauauccgga

SEQ ID NO: 2431761 - RNA, 16 nt, Human
caauuccugggcccca

SEQ ID NO: 2431762 - RNA, 23 nt, Human
caauucucauuugucacacacuu

SEQ ID NO: 2431763 - RNA, 24 nt, Human
caauguuaaggaaacucuuaucuc

SEQ ID NO: 2431764 - RNA, 13 nt, Human
caauguucaucau

SEQ ID NO: 2431765 - RNA, 20 nt, Human
caauguuaaggaaacucuua

SEQ ID NO: 2431766 - RNA, 19 nt, Human
caauguuaaggaaacucuu

SEQ ID NO: 2431767 - RNA, 19 nt, Human
caauguuacuaucugcuuu

SEQ ID NO: 2431768 - RNA, 14 nt, Human
caauguucauccca

SEQ ID NO: 2431769 - RNA, 15 nt, Human
caauguucaucccau

SEQ ID NO: 2431770 - RNA, 12 nt, Human
caauguucauug

SEQ ID NO: 2431771 - RNA, 13 nt, Human
caauguucauugu

SEQ ID NO: 2431772 - RNA, 14 nt, Human
caauguucauugua

SEQ ID NO: 2431773 - RNA, 15 nt, Human
caauguucauuguaa

SEQ ID NO: 2431774 - RNA, 18 nt, Human
caauguucauuguaaugu

SEQ ID NO: 2431775 - RNA, 12 nt, Human
caauuaauuuuu

SEQ ID NO: 2431776 - RNA, 18 nt, Human
caauuaauaaaaaaugga

SEQ ID NO: 2431777 - RNA, 23 nt, Human
caauuaaggauuuuaugcuuuaa

SEQ ID NO: 2431778 - RNA, 22 nt, Human
caauguucauuguaauguuacu

SEQ ID NO: 2431779 - RNA, 23 nt, Human
caauguucauuguaauguuacug

SEQ ID NO: 2431780 - RNA, 15 nt, Human
caaugugauaaaacc

SEQ ID NO: 2431781 - RNA, 17 nt, Human
caaugugauaaaacccc

SEQ ID NO: 2431782 - RNA, 16 nt, Human
caaugucaggaacaga

SEQ ID NO: 2431783 - RNA, 18 nt, Human
caauguuaaggaaacucu

SEQ ID NO: 2431784 - RNA, 16 nt, Human
caauguuaaggaaacu

SEQ ID NO: 2431785 - RNA, 14 nt, Human
caauguuaaggaaa

SEQ ID NO: 2431786 - RNA, 12 nt, Human
caaugugcagug

SEQ ID NO: 2431787 - RNA, 15 nt, Human
caaugugauucuaau

SEQ ID NO: 2431788 - RNA, 11 nt, Human
caauguuaagg

SEQ ID NO: 2431789 - RNA, 19 nt, Human
caaccuucgccaccugggu

SEQ ID NO: 2431790 - RNA, 21 nt, Human
caacgcuuaaaggugucuucc

SEQ ID NO: 2431791 - RNA, 22 nt, Human
caacgcuuaaaggugucuuccu

SEQ ID NO: 2431792 - RNA, 21 nt, Human
caacggagagcgccugccccu

SEQ ID NO: 2431793 - RNA, 17 nt, Human
caaccuuagauguucua

SEQ ID NO: 2431794 - RNA, 18 nt, Human
caaccuuagauguucuaa

SEQ ID NO: 2431795 - RNA, 20 nt, Human
caaccuguucugcuuuccuc

SEQ ID NO: 2431796 - RNA, 22 nt, Human
caaccuguuaccuacuuugacu

SEQ ID NO: 2431797 - RNA, 23 nt, Human
caaccuguuaccuacuuugacuu

SEQ ID NO: 2431798 - RNA, 20 nt, Human
caaccuguuaccuacuuuga

SEQ ID NO: 2431799 - RNA, 14 nt, Human
caacgucugugcca

SEQ ID NO: 2431800 - RNA, 13 nt, Human
caacgucugugcc

SEQ ID NO: 2431801 - RNA, 16 nt, Human
caacgugcauugugcu

SEQ ID NO: 2431802 - RNA, 15 nt, Human
caacguagcuucuac

SEQ ID NO: 2431803 - RNA, 13 nt, Human
caacgugcauugu

SEQ ID NO: 2431804 - RNA, 17 nt, Human
caacugaccagccucca

SEQ ID NO: 2431805 - RNA, 15 nt, Human
caacugaccagccuc

SEQ ID NO: 2431806 - RNA, 22 nt, Human
caaccgccacacacacaggagc

SEQ ID NO: 2431807 - RNA, 22 nt, Human
caaccgaugcuccagccaaccc

SEQ ID NO: 2431808 - RNA, 21 nt, Human
caaccgguggauccucaaaca

SEQ ID NO: 2431809 - RNA, 19 nt, Human
caaccggggagcccccgcc

SEQ ID NO: 2431810 - RNA, 20 nt, Human
caaccggggagcccccgccc

SEQ ID NO: 2431811 - RNA, 14 nt, Human
caaccuccugggcu

SEQ ID NO: 2431812 - RNA, 18 nt, Human
caaccguuggaaacauaa

SEQ ID NO: 2431813 - RNA, 22 nt, Human
caaccuguaauaaauaugagug

SEQ ID NO: 2431814 - RNA, 21 nt, Human
caaccuguaauaaauaugagu

SEQ ID NO: 2431815 - RNA, 19 nt, Human
caaccuguaauaaauauga

SEQ ID NO: 2431816 - RNA, 18 nt, Human
caaccuguaauaaauaug

SEQ ID NO: 2431817 - RNA, 17 nt, Human
caaccuguaauaaauau

SEQ ID NO: 2431818 - RNA, 13 nt, Human
caaccucuggagc

SEQ ID NO: 2431819 - RNA, 16 nt, Human
caaccuguaauaaaua

SEQ ID NO: 2431820 - RNA, 15 nt, Human
caaccuccugggcua

SEQ ID NO: 2431821 - RNA, 13 nt, Human
caacccucagagc

SEQ ID NO: 2431822 - RNA, 18 nt, Human
caacccucccucagcccc

SEQ ID NO: 2431823 - RNA, 23 nt, Human
caacacuggugugaccugagggc

SEQ ID NO: 2431824 - RNA, 22 nt, Human
caacacuggugugaccugaggg

SEQ ID NO: 2431825 - RNA, 13 nt, Human
caacacugugccc

SEQ ID NO: 2431826 - RNA, 15 nt, Human
caacacugugcccug

SEQ ID NO: 2431827 - RNA, 14 nt, Human
caacacugugcccu

SEQ ID NO: 2431828 - RNA, 16 nt, Human
caacccgaggcccgca

SEQ ID NO: 2431829 - RNA, 17 nt, Human
caacccuggcacccagg

SEQ ID NO: 2431830 - RNA, 23 nt, Human
caacccugccccugccccgucac

SEQ ID NO: 2431831 - RNA, 13 nt, Human
caacccuggagag

SEQ ID NO: 2431832 - RNA, 22 nt, Human
caacccugccccugccccguca

SEQ ID NO: 2431833 - RNA, 19 nt, Human
caacccuggcauuaugucc

SEQ ID NO: 2431834 - RNA, 23 nt, Human
caacccuggagaguucaauggcu

SEQ ID NO: 2431835 - RNA, 14 nt, Human
caaccgaugcucca

SEQ ID NO: 2431836 - RNA, 17 nt, Human
caaccgaugcuccagcc

SEQ ID NO: 2431837 - RNA, 18 nt, Human
caaccgaugcuccagcca

SEQ ID NO: 2431838 - RNA, 21 nt, Human
caaccgaugcuccagccaacc

SEQ ID NO: 2431839 - RNA, 15 nt, Human
caacccuccuaucac

SEQ ID NO: 2431840 - RNA, 19 nt, Human
caacccuccuaucaccucc

SEQ ID NO: 2431841 - RNA, 22 nt, Human
caacccuccuaucaccuccccu

SEQ ID NO: 2431842 - RNA, 19 nt, Human
caacccucccucagccccu

SEQ ID NO: 2431843 - RNA, 20 nt, Human
caacccucccucagccccuc

SEQ ID NO: 2431844 - RNA, 21 nt, Human
caacccucccucagccccucu

SEQ ID NO: 2431845 - RNA, 22 nt, Human
caacccucccucagccccucuu

SEQ ID NO: 2431846 - RNA, 11 nt, Human
caacccugcaa

SEQ ID NO: 2431847 - RNA, 12 nt, Human
caacccugcaaa

SEQ ID NO: 2431848 - RNA, 22 nt, Human
caacccugcaaaggacuguuuu

SEQ ID NO: 2431849 - RNA, 11 nt, Human
caacccugccc

SEQ ID NO: 2431850 - RNA, 13 nt, Human
caacccugccccu

SEQ ID NO: 2431851 - RNA, 14 nt, Human
caacccugccccug

SEQ ID NO: 2431852 - RNA, 15 nt, Human
caacccugccccugc

SEQ ID NO: 2431853 - RNA, 16 nt, Human
caacccugccccugcc

SEQ ID NO: 2431854 - RNA, 22 nt, Human
caacacucauugaccugaggcc

SEQ ID NO: 2431855 - RNA, 20 nt, Human
caacacucauugaccugagg

SEQ ID NO: 2431856 - RNA, 18 nt, Human
caacacucauugaccuga

SEQ ID NO: 2431857 - RNA, 22 nt, Human
caacacucacauuuauucugcu

SEQ ID NO: 2431858 - RNA, 11 nt, Human
caaauuucaca

SEQ ID NO: 2431859 - RNA, 22 nt, Human
caaccccuucgcuccugugucu

SEQ ID NO: 2431860 - RNA, 18 nt, Human
caacacuggugugaccug

SEQ ID NO: 2431861 - RNA, 13 nt, Human
caacacuggugug

SEQ ID NO: 2431862 - RNA, 20 nt, Human
caacacugggaaacagaggc

SEQ ID NO: 2431863 - RNA, 15 nt, Human
caagaaaacaacuuc

SEQ ID NO: 2431864 - RNA, 13 nt, Human
caagaaauuugau

SEQ ID NO: 2431865 - RNA, 18 nt, Human
caagaaaacaacuucaau

SEQ ID NO: 2431866 - RNA, 22 nt, Human
caacuuuguggaugucuuccuu

SEQ ID NO: 2431867 - RNA, 20 nt, Human
caacuuuuccuuugaauccu

SEQ ID NO: 2431868 - RNA, 21 nt, Human
caacuuuguggaugucuuccu

SEQ ID NO: 2431869 - RNA, 22 nt, Human
caacugaggcagacagcagcuc

SEQ ID NO: 2431870 - RNA, 19 nt, Human
caacugaccagccuccaug

SEQ ID NO: 2431871 - RNA, 13 nt, Human
caacugaggcaga

SEQ ID NO: 2431872 - RNA, 14 nt, Human
caacugaggcagac

SEQ ID NO: 2431873 - RNA, 16 nt, Human
caacugaggcagacag

SEQ ID NO: 2431874 - RNA, 17 nt, Human
caacugaggcagacagc

SEQ ID NO: 2431875 - RNA, 20 nt, Human
caacugaggcagacagcagc

SEQ ID NO: 2431876 - RNA, 21 nt, Human
caacugaggcagacagcagcu

SEQ ID NO: 2431877 - RNA, 17 nt, Human
caagacgcugugcugcc

SEQ ID NO: 2431878 - RNA, 16 nt, Human
caagacgcugugcugc

SEQ ID NO: 2431879 - RNA, 18 nt, Human
caagaccuucuccuucac

SEQ ID NO: 2431880 - RNA, 17 nt, Human
caagaccuucuccuuca

SEQ ID NO: 2431881 - RNA, 16 nt, Human
caagaccuucuccuuc

SEQ ID NO: 2431882 - RNA, 14 nt, Human
caagaccuucuccu

SEQ ID NO: 2431883 - RNA, 20 nt, Human
caagaacuuuccaggaaggc

SEQ ID NO: 2431884 - RNA, 16 nt, Human
caagaaauuugauuuc

SEQ ID NO: 2431885 - RNA, 14 nt, Human
caagaacucugggc

SEQ ID NO: 2431886 - RNA, 15 nt, Human
caagagcccaggccu

SEQ ID NO: 2431887 - RNA, 14 nt, Human
caagagcccaggcc

SEQ ID NO: 2431888 - RNA, 13 nt, Human
caagagcccaggc

SEQ ID NO: 2431889 - RNA, 18 nt, Human
caagacucuuuggacacu

SEQ ID NO: 2431890 - RNA, 18 nt, Human
caagacgcugugcugccc

SEQ ID NO: 2431891 - RNA, 12 nt, Human
caagaagacaug

SEQ ID NO: 2431892 - RNA, 22 nt, Human
caagaagaaaugcuuuccaaaa

SEQ ID NO: 2431893 - RNA, 19 nt, Human
caagaagaagggcacccua

SEQ ID NO: 2431894 - RNA, 19 nt, Human
caagacgcugugcugcccu

SEQ ID NO: 2431895 - RNA, 18 nt, Human
caagaagacauggagacu

SEQ ID NO: 2431896 - RNA, 23 nt, Human
caagacgcugugcugcccugccc

SEQ ID NO: 2431897 - RNA, 22 nt, Human
caagacucccucgucgagcugg

SEQ ID NO: 2431898 - RNA, 15 nt, Human
caagacucugucuca

SEQ ID NO: 2431899 - RNA, 17 nt, Human
caagcaccuccugccuc

SEQ ID NO: 2431900 - RNA, 16 nt, Human
caagcaccuccugccu

SEQ ID NO: 2431901 - RNA, 15 nt, Human
caagagggcacuggu

SEQ ID NO: 2431902 - RNA, 14 nt, Human
caagagggcacugg

SEQ ID NO: 2431903 - RNA, 15 nt, Human
caagcaccuccugcc

SEQ ID NO: 2431904 - RNA, 14 nt, Human
caagaggcugcagc

SEQ ID NO: 2431905 - RNA, 16 nt, Human
caagaggcugcagcca

SEQ ID NO: 2431906 - RNA, 16 nt, Human
caagagcccaggccuc

SEQ ID NO: 2431907 - RNA, 17 nt, Human
caagagggacgccuggg

SEQ ID NO: 2431908 - RNA, 19 nt, Human
caagagggacgccuggggg

SEQ ID NO: 2431909 - RNA, 13 nt, Human
caagagggcacug

SEQ ID NO: 2431910 - RNA, 16 nt, Human
caagagggaauccccg

SEQ ID NO: 2431911 - RNA, 20 nt, Human
caagaggcuguucccaccag

SEQ ID NO: 2431912 - RNA, 17 nt, Human
caagugagagcugggug

SEQ ID NO: 2431913 - RNA, 15 nt, Human
caagugagagcuggg

SEQ ID NO: 2431914 - RNA, 14 nt, Human
caagugagagcugg

SEQ ID NO: 2431915 - RNA, 21 nt, Human
caaguccucuuuucugagagg

SEQ ID NO: 2431916 - RNA, 17 nt, Human
caagugauucucaugcc

SEQ ID NO: 2431917 - RNA, 18 nt, Human
caagugauucucaugccu

SEQ ID NO: 2431918 - RNA, 20 nt, Human
caagugauucucaugccuca

SEQ ID NO: 2431919 - RNA, 21 nt, Human
caagugauucucaugccucag

SEQ ID NO: 2431920 - RNA, 18 nt, Human
caagugagagcugggugu

SEQ ID NO: 2431921 - RNA, 15 nt, Human
caaguccugaagagg

SEQ ID NO: 2431922 - RNA, 14 nt, Human
caaguccugaagag

SEQ ID NO: 2431923 - RNA, 16 nt, Human
caaguccugaagaggc

SEQ ID NO: 2431924 - RNA, 18 nt, Human
caaguggacucagggcag

SEQ ID NO: 2431925 - RNA, 23 nt, Human
caaguggacucagggcagcgcca

SEQ ID NO: 2431926 - RNA, 23 nt, Human
caaguggcagagcuuggacugga

SEQ ID NO: 2431927 - RNA, 18 nt, Human
caaguggcagagcuugga

SEQ ID NO: 2431928 - RNA, 19 nt, Human
caaguggcucccacacccu

SEQ ID NO: 2431929 - RNA, 12 nt, Human
caaguggaccuu

SEQ ID NO: 2431930 - RNA, 21 nt, Human
caaguggaccuuaggccuucc

SEQ ID NO: 2431931 - RNA, 22 nt, Human
caaguggaccuuaggccuuccu

SEQ ID NO: 2431932 - RNA, 15 nt, Human
caaguggacucaggg

SEQ ID NO: 2431933 - RNA, 16 nt, Human
caaguggacucagggc

SEQ ID NO: 2431934 - RNA, 23 nt, Human
caaguggaccuuaggccuuccuc

SEQ ID NO: 2431935 - RNA, 19 nt, Human
caaguggaccuugagacca

SEQ ID NO: 2431936 - RNA, 14 nt, Human
caagugugaacaaa

SEQ ID NO: 2431937 - RNA, 15 nt, Human
caagugucuuccauc

SEQ ID NO: 2431938 - RNA, 19 nt, Human
caagugugaacaaaagaug

SEQ ID NO: 2431939 - RNA, 17 nt, Human
caagugugcauauugua

SEQ ID NO: 2431940 - RNA, 15 nt, Human
caagugugcauauug

SEQ ID NO: 2431941 - RNA, 14 nt, Human
caaguuaaauaaau

SEQ ID NO: 2431942 - RNA, 16 nt, Human
caaguguauaucagaa

SEQ ID NO: 2431943 - RNA, 18 nt, Human
caaguguauaucagaaaa

SEQ ID NO: 2431944 - RNA, 22 nt, Human
caaguguaugcacgugugcaca

SEQ ID NO: 2431945 - RNA, 14 nt, Human
caagugucuuccau

SEQ ID NO: 2431946 - RNA, 13 nt, Human
caagugucuucca

SEQ ID NO: 2431947 - RNA, 17 nt, Human
caagugucucaguccac

SEQ ID NO: 2431948 - RNA, 20 nt, Human
caagugucucaguccaccug

SEQ ID NO: 2431949 - RNA, 14 nt, Human
caaguguauaucag

SEQ ID NO: 2431950 - RNA, 23 nt, Human
caaguguaaaauauuuugaauca

SEQ ID NO: 2431951 - RNA, 21 nt, Human
caaguguaaaauauuuugaau

SEQ ID NO: 2431952 - RNA, 21 nt, Human
caagucccuguuuucugagcc

SEQ ID NO: 2431953 - RNA, 20 nt, Human
caagucccuguuuucugagc

SEQ ID NO: 2431954 - RNA, 19 nt, Human
caagucccuguuuucugag

SEQ ID NO: 2431955 - RNA, 23 nt, Human
caagucccuguuuucugagcccg

SEQ ID NO: 2431956 - RNA, 22 nt, Human
caagucccuguuuucugagccc

SEQ ID NO: 2431957 - RNA, 14 nt, Human
caaguccucuuuuc

SEQ ID NO: 2431958 - RNA, 11 nt, Human
caagucccugu

SEQ ID NO: 2431959 - RNA, 20 nt, Human
caagucccuguaauuguugu

SEQ ID NO: 2431960 - RNA, 20 nt, Human
caagguccucugucagucac

SEQ ID NO: 2431961 - RNA, 21 nt, Human
caagguccucugucagucaca

SEQ ID NO: 2431962 - RNA, 22 nt, Human
caagguccucugucagucacag

SEQ ID NO: 2431963 - RNA, 16 nt, Human
caaggucgguaaguug

SEQ ID NO: 2431964 - RNA, 14 nt, Human
caaggucauuuuuu

SEQ ID NO: 2431965 - RNA, 20 nt, Human
caaggucauuuuuuuuaaga

SEQ ID NO: 2431966 - RNA, 18 nt, Human
caaggguagggugggccu

SEQ ID NO: 2431967 - RNA, 21 nt, Human
caagggggaugacaugugacu

SEQ ID NO: 2431968 - RNA, 15 nt, Human
caagggggacugucu

SEQ ID NO: 2431969 - RNA, 14 nt, Human
caaggcuguugcau

SEQ ID NO: 2431970 - RNA, 18 nt, Human
caaggggcccaaauucuu

SEQ ID NO: 2431971 - RNA, 18 nt, Human
caaggcuguugcaugggc

SEQ ID NO: 2431972 - RNA, 17 nt, Human
caaggcugugcucccug

SEQ ID NO: 2431973 - RNA, 18 nt, Human
caaggcugugcucccugg

SEQ ID NO: 2431974 - RNA, 17 nt, Human
caaggggcccaaauucu

SEQ ID NO: 2431975 - RNA, 12 nt, Human
caaggcugcagu

SEQ ID NO: 2431976 - RNA, 15 nt, Human
caaggcugcagugag

SEQ ID NO: 2431977 - RNA, 23 nt, Human
caaggcugucaauuacaggaagu

SEQ ID NO: 2431978 - RNA, 21 nt, Human
caaggcugucaauuacaggaa

SEQ ID NO: 2431979 - RNA, 23 nt, Human
caaggcugaccaagagagaaaga

SEQ ID NO: 2431980 - RNA, 16 nt, Human
caagcaguagacaagc

SEQ ID NO: 2431981 - RNA, 15 nt, Human
caaggacugcaggga

SEQ ID NO: 2431982 - RNA, 16 nt, Human
caaggaagccacagcu

SEQ ID NO: 2431983 - RNA, 12 nt, Human
caaggaagucaa

SEQ ID NO: 2431984 - RNA, 18 nt, Human
caaggaaggaaagaaaga

SEQ ID NO: 2431985 - RNA, 23 nt, Human
caaggaaggaaagaaagaaggaa

SEQ ID NO: 2431986 - RNA, 19 nt, Human
caagcuggucccacucagu

SEQ ID NO: 2431987 - RNA, 12 nt, Human
caaggaaggaaa

SEQ ID NO: 2431988 - RNA, 13 nt, Human
caaggaaggaaag

SEQ ID NO: 2431989 - RNA, 16 nt, Human
caaggaaggaaagaaa

SEQ ID NO: 2431990 - RNA, 17 nt, Human
caaggaaggaaagaaag

SEQ ID NO: 2431991 - RNA, 22 nt, Human
caagcugggccccagcccaccc

SEQ ID NO: 2431992 - RNA, 20 nt, Human
caagcugggccccagcccac

SEQ ID NO: 2431993 - RNA, 19 nt, Human
caagcugggccccagccca

SEQ ID NO: 2431994 - RNA, 18 nt, Human
caagcugggccccagccc

SEQ ID NO: 2431995 - RNA, 17 nt, Human
caagcugggccccagcc

SEQ ID NO: 2431996 - RNA, 16 nt, Human
caagcugggccccagc

SEQ ID NO: 2431997 - RNA, 15 nt, Human
caagcugggccccag

SEQ ID NO: 2431998 - RNA, 12 nt, Human
caagcugggccc

SEQ ID NO: 2431999 - RNA, 17 nt, Human
caagcuggucccacuca

SEQ ID NO: 2432000 - RNA, 14 nt, Human
caaggagccaaaca

SEQ ID NO: 2432001 - RNA, 11 nt, Human
caaggagcugc

SEQ ID NO: 2432002 - RNA, 13 nt, Human
caaggagcugcua

SEQ ID NO: 2432003 - RNA, 15 nt, Human
caaggacuuugcagc

SEQ ID NO: 2432004 - RNA, 16 nt, Human
caaggacuugaaagca

SEQ ID NO: 2432005 - RNA, 18 nt, Human
caaggacuugaaagcauc

SEQ ID NO: 2432006 - RNA, 16 nt, Human
caaggacuuugcagcc

SEQ ID NO: 2432007 - RNA, 20 nt, Human
caaggacuugaaagcaucca

SEQ ID NO: 2432008 - RNA, 19 nt, Human
caaggacuuccuguccagc

SEQ ID NO: 2432009 - RNA, 21 nt, Human
caaggacuuccuguccagcuc

SEQ ID NO: 2432010 - RNA, 22 nt, Human
caaggacuuccuguccagcucc

SEQ ID NO: 2432011 - RNA, 23 nt, Human
caaggacuuccuguccagcucca

SEQ ID NO: 2432012 - RNA, 22 nt, Human
caaggacugcagggacugccag

SEQ ID NO: 2432013 - RNA, 14 nt, Human
caaggacuuccugu

SEQ ID NO: 2432014 - RNA, 14 nt, Human
caaggacugccgac

SEQ ID NO: 2432015 - RNA, 17 nt, Human
caaggcugauuaaacca

SEQ ID NO: 2432016 - RNA, 20 nt, Human
caaggcugaccaagagagaa

SEQ ID NO: 2432017 - RNA, 21 nt, Human
caaggcugaccaagagagaaa

SEQ ID NO: 2432018 - RNA, 17 nt, Human
caaggaggucugugcca

SEQ ID NO: 2432019 - RNA, 20 nt, Human
caaggagggugagugcaagg

SEQ ID NO: 2432020 - RNA, 22 nt, Human
caaggagcugcuauagccuggg

SEQ ID NO: 2432021 - RNA, 12 nt, Human
caaggaggaaaa

SEQ ID NO: 2432022 - RNA, 13 nt, Human
caaggaggaaaaa

SEQ ID NO: 2432023 - RNA, 14 nt, Human
caaggaggaaaaac

SEQ ID NO: 2432024 - RNA, 19 nt, Human
caaggaggcuggcuggggc

SEQ ID NO: 2432025 - RNA, 16 nt, Human
caaggaggcuggcugg

SEQ ID NO: 2432026 - RNA, 14 nt, Human
caaggaggcuggcu

SEQ ID NO: 2432027 - RNA, 20 nt, Human
caaggaggaaaaacagacaa

SEQ ID NO: 2432028 - RNA, 22 nt, Human
caaggaggcuggcuggggccua

SEQ ID NO: 2432029 - RNA, 21 nt, Human
caaggaggcuggcuggggccu

SEQ ID NO: 2432030 - RNA, 12 nt, Human
caaggagggaga

SEQ ID NO: 2432031 - RNA, 18 nt, Human
caaggaggggcuguaaaa

SEQ ID NO: 2432032 - RNA, 19 nt, Human
caaggagggugagugcaag

SEQ ID NO: 2432033 - RNA, 14 nt, Human
caagccuggcaagg

SEQ ID NO: 2432034 - RNA, 11 nt, Human
caagcugggcc

SEQ ID NO: 2432035 - RNA, 18 nt, Human
caagcuggaagcacaugu

SEQ ID NO: 2432036 - RNA, 22 nt, Human
caagcgauucuucugcuucagc

SEQ ID NO: 2432037 - RNA, 20 nt, Human
caagcgauucuucugcuuca

SEQ ID NO: 2432038 - RNA, 19 nt, Human
caagcgauucuucugcuuc

SEQ ID NO: 2432039 - RNA, 13 nt, Human
caagccugcaacu

SEQ ID NO: 2432040 - RNA, 23 nt, Human
caagccugcacaauaaaaauguu

SEQ ID NO: 2432041 - RNA, 22 nt, Human
caagccugcagucaucuugacc

SEQ ID NO: 2432042 - RNA, 14 nt, Human
caagccugccuagg

SEQ ID NO: 2432043 - RNA, 18 nt, Human
caagccguggcuucccgc

SEQ ID NO: 2432044 - RNA, 21 nt, Human
caagccugaccacgcuuucua

SEQ ID NO: 2432045 - RNA, 18 nt, Human
caagcaggacauggacaa

SEQ ID NO: 2432046 - RNA, 12 nt, Human
caagcagggagg

SEQ ID NO: 2432047 - RNA, 16 nt, Human
caagcaggaaguucaa

SEQ ID NO: 2432048 - RNA, 17 nt, Human
caagcaggaagcucaga

SEQ ID NO: 2432049 - RNA, 21 nt, Human
caagcaggaagcucagacugg

SEQ ID NO: 2432050 - RNA, 14 nt, Human
caagcaggacaugg

SEQ ID NO: 2432051 - RNA, 15 nt, Human
caagcaggaagcuca

SEQ ID NO: 2432052 - RNA, 16 nt, Human
caagcaggaagcucag

SEQ ID NO: 2432053 - RNA, 14 nt, Human
caagcaggaagcuc

SEQ ID NO: 2432054 - RNA, 16 nt, Human
caagccagaggcuggg

SEQ ID NO: 2432055 - RNA, 15 nt, Human
caagccagaggcugg

SEQ ID NO: 2432056 - RNA, 13 nt, Human
caagccagaggcu

SEQ ID NO: 2432057 - RNA, 22 nt, Human
caagccaccaacauacucccau

SEQ ID NO: 2432058 - RNA, 15 nt, Human
caagcagggcucugc

SEQ ID NO: 2432059 - RNA, 13 nt, Human
caagcagggagga

SEQ ID NO: 2432060 - RNA, 21 nt, Human
caagccagauuuuccugaaaa

SEQ ID NO: 2432061 - RNA, 17 nt, Human
caagccguggcuucccg

SEQ ID NO: 2432062 - RNA, 22 nt, Human
caagccagcgggaauggcagcu

SEQ ID NO: 2432063 - RNA, 17 nt, Human
caaauuguaagcaugca

SEQ ID NO: 2432064 - RNA, 18 nt, Human
caaauuauuuguguaaua

SEQ ID NO: 2432065 - RNA, 17 nt, Human
caaauuauuuguguaau

SEQ ID NO: 2432066 - RNA, 20 nt, Human
caaauuauuuguguaauaga

SEQ ID NO: 2432067 - RNA, 16 nt, Human
caaauuauuuguguaa

SEQ ID NO: 2432068 - RNA, 15 nt, Human
caaauuauuugugua

SEQ ID NO: 2432069 - RNA, 14 nt, Human
caaauuauuugugu

SEQ ID NO: 2432070 - RNA, 12 nt, Human
caaauuauuugu

SEQ ID NO: 2432071 - RNA, 17 nt, Human
caaauuauuaaugaaaa

SEQ ID NO: 2432072 - RNA, 15 nt, Human
caaauuauuaaugaa

SEQ ID NO: 2432073 - RNA, 18 nt, Human
caaauguccuccagaagc

SEQ ID NO: 2432074 - RNA, 19 nt, Human
caaauguccuccagaagcc

SEQ ID NO: 2432075 - RNA, 23 nt, Human
caaaugguuuaacuucugccugu

SEQ ID NO: 2432076 - RNA, 18 nt, Human
caaauguaauugaauaaa

SEQ ID NO: 2432077 - RNA, 18 nt, Human
caaaugucaucagaacuu

SEQ ID NO: 2432078 - RNA, 17 nt, Human
caaaugucaucagaacu

SEQ ID NO: 2432079 - RNA, 20 nt, Human
caaaugucagauacaaugua

SEQ ID NO: 2432080 - RNA, 19 nt, Human
caaaugucagauacaaugu

SEQ ID NO: 2432081 - RNA, 16 nt, Human
caaaugucagauacaa

SEQ ID NO: 2432082 - RNA, 21 nt, Human
caaauguaauugaauaaaguu

SEQ ID NO: 2432083 - RNA, 12 nt, Human
caaauuucuaaa

SEQ ID NO: 2432084 - RNA, 14 nt, Human
caaauuucuaaauc

SEQ ID NO: 2432085 - RNA, 11 nt, Human
caaauuucuaa

SEQ ID NO: 2432086 - RNA, 21 nt, Human
caaauuguaagcaugcacaaa

SEQ ID NO: 2432087 - RNA, 15 nt, Human
caaauugugugaaag

SEQ ID NO: 2432088 - RNA, 22 nt, Human
caaauuguaucuagugcagcug

SEQ ID NO: 2432089 - RNA, 18 nt, Human
caaauuguaucuagugca

SEQ ID NO: 2432090 - RNA, 19 nt, Human
caaauuguaucuagugcag

SEQ ID NO: 2432091 - RNA, 19 nt, Human
caaauaugcaaagcacuga

SEQ ID NO: 2432092 - RNA, 21 nt, Human
caaauaugcaaagcacugacu

SEQ ID NO: 2432093 - RNA, 17 nt, Human
caaauauguccuggggu

SEQ ID NO: 2432094 - RNA, 15 nt, Human
caaauauguccuggg

SEQ ID NO: 2432095 - RNA, 14 nt, Human
caaauauguccugg

SEQ ID NO: 2432096 - RNA, 13 nt, Human
caaauauguccug

SEQ ID NO: 2432097 - RNA, 19 nt, Human
caaauauuagaugugauuu

SEQ ID NO: 2432098 - RNA, 17 nt, Human
caaauauuagaugugau

SEQ ID NO: 2432099 - RNA, 16 nt, Human
caaauauuagauguga

SEQ ID NO: 2432100 - RNA, 15 nt, Human
caaauauuagaugug

SEQ ID NO: 2432101 - RNA, 23 nt, Human
caaauauuagaugugauuuaaua

SEQ ID NO: 2432102 - RNA, 20 nt, Human
caaauauuagaugugauuua

SEQ ID NO: 2432103 - RNA, 14 nt, Human
caaauggggccaga

SEQ ID NO: 2432104 - RNA, 15 nt, Human
caaauggggccagau

SEQ ID NO: 2432105 - RNA, 16 nt, Human
caaauggggccagauc

SEQ ID NO: 2432106 - RNA, 17 nt, Human
caaauggggccagaucc

SEQ ID NO: 2432107 - RNA, 18 nt, Human
caaauggggccagaucca

SEQ ID NO: 2432108 - RNA, 19 nt, Human
caaauggggccagauccag

SEQ ID NO: 2432109 - RNA, 20 nt, Human
caaauggggccagauccagc

SEQ ID NO: 2432110 - RNA, 23 nt, Human
caaauggggccagauccagccug

SEQ ID NO: 2432111 - RNA, 13 nt, Human
caaaugguaggca

SEQ ID NO: 2432112 - RNA, 15 nt, Human
caaaugguaggcauu

SEQ ID NO: 2432113 - RNA, 20 nt, Human
caaaugguaggcauuuccua

SEQ ID NO: 2432114 - RNA, 19 nt, Human
caaaggguaucaggugcug

SEQ ID NO: 2432115 - RNA, 19 nt, Human
caaagugcugggauuacag

SEQ ID NO: 2432116 - RNA, 23 nt, Human
caaagugcugggauuacaggugu

SEQ ID NO: 2432117 - RNA, 20 nt, Human
caaagugcugggauuacagg

SEQ ID NO: 2432118 - RNA, 13 nt, Human
caaaggcugggac

SEQ ID NO: 2432119 - RNA, 12 nt, Human
caaaggcuggga

SEQ ID NO: 2432120 - RNA, 22 nt, Human
caaagggggaggcuaaagccca

SEQ ID NO: 2432121 - RNA, 16 nt, Human
caaauacucaugugua

SEQ ID NO: 2432122 - RNA, 15 nt, Human
caaauacucaugugu

SEQ ID NO: 2432123 - RNA, 14 nt, Human
caaauacucaugug

SEQ ID NO: 2432124 - RNA, 18 nt, Human
caaauacucauguguaug

SEQ ID NO: 2432125 - RNA, 17 nt, Human
caaauacucauguguau

SEQ ID NO: 2432126 - RNA, 14 nt, Human
caaauacucuuagg

SEQ ID NO: 2432127 - RNA, 17 nt, Human
caaagccuugugucuac

SEQ ID NO: 2432128 - RNA, 18 nt, Human
caaagccuuaucaagugu

SEQ ID NO: 2432129 - RNA, 11 nt, Human
caaagccuuau

SEQ ID NO: 2432130 - RNA, 14 nt, Human
caaagcgaauuuua

SEQ ID NO: 2432131 - RNA, 19 nt, Human
caaagcgaauuuuaaaaga

SEQ ID NO: 2432132 - RNA, 17 nt, Human
caaagccuccuccagcc

SEQ ID NO: 2432133 - RNA, 18 nt, Human
caaagccuccuccagccg

SEQ ID NO: 2432134 - RNA, 20 nt, Human
caaagccagcguccuccucu

SEQ ID NO: 2432135 - RNA, 21 nt, Human
caaagccagcguccuccucug

SEQ ID NO: 2432136 - RNA, 23 nt, Human
caaagccagcguccuccucugug

SEQ ID NO: 2432137 - RNA, 22 nt, Human
caaagccagcguccuccucugu

SEQ ID NO: 2432138 - RNA, 18 nt, Human
caaagcccuuccaugucg

SEQ ID NO: 2432139 - RNA, 22 nt, Human
caaagccaacagucaaaacaga

SEQ ID NO: 2432140 - RNA, 22 nt, Human
caaagccaaagcuaggccuggc

SEQ ID NO: 2432141 - RNA, 12 nt, Human
caaagccagaac

SEQ ID NO: 2432142 - RNA, 11 nt, Human
caaagccagaa

SEQ ID NO: 2432143 - RNA, 13 nt, Human
caaagccagaagc

SEQ ID NO: 2432144 - RNA, 14 nt, Human
caaagccagaagcu

SEQ ID NO: 2432145 - RNA, 16 nt, Human
caaagccagaagcuga

SEQ ID NO: 2432146 - RNA, 18 nt, Human
caaagccagaagcugagc

SEQ ID NO: 2432147 - RNA, 14 nt, Human
caaagccagacagc

SEQ ID NO: 2432148 - RNA, 15 nt, Human
caaagccagacagca

SEQ ID NO: 2432149 - RNA, 14 nt, Human
caaacucagccuca

SEQ ID NO: 2432150 - RNA, 19 nt, Human
caaacucacugcucaagaa

SEQ ID NO: 2432151 - RNA, 18 nt, Human
caaacucacugcucaaga

SEQ ID NO: 2432152 - RNA, 16 nt, Human
caaacuggggccucca

SEQ ID NO: 2432153 - RNA, 19 nt, Human
caaacuggggccuccagaa

SEQ ID NO: 2432154 - RNA, 12 nt, Human
caaacuguaaau

SEQ ID NO: 2432155 - RNA, 17 nt, Human
caaacuggggccucccu

SEQ ID NO: 2432156 - RNA, 21 nt, Human
caaacuggggccuccagaacu

SEQ ID NO: 2432157 - RNA, 21 nt, Human
caaacuguaaauaaaaagaaa

SEQ ID NO: 2432158 - RNA, 14 nt, Human
caaacuguaaauaa

SEQ ID NO: 2432159 - RNA, 20 nt, Human
caaacuguaaauaaaaagaa

SEQ ID NO: 2432160 - RNA, 13 nt, Human
caaacuguugauu

SEQ ID NO: 2432161 - RNA, 16 nt, Human
caaacuacauguaauc

SEQ ID NO: 2432162 - RNA, 20 nt, Human
caaacuaagcccccgcugua

SEQ ID NO: 2432163 - RNA, 19 nt, Human
caaacuaagcccccgcugu

SEQ ID NO: 2432164 - RNA, 13 nt, Human
caaacuagggcca

SEQ ID NO: 2432165 - RNA, 18 nt, Human
caaacgcugccugcccac

SEQ ID NO: 2432166 - RNA, 13 nt, Human
caaacuaagcccc

SEQ ID NO: 2432167 - RNA, 14 nt, Human
caaacguauguaaa

SEQ ID NO: 2432168 - RNA, 17 nt, Human
caaacucaccugccccu

SEQ ID NO: 2432169 - RNA, 18 nt, Human
caaacuauuucuuauaua

SEQ ID NO: 2432170 - RNA, 14 nt, Human
caaacuauuucuua

SEQ ID NO: 2432171 - RNA, 19 nt, Human
caaacuagggccaagccca

SEQ ID NO: 2432172 - RNA, 20 nt, Human
caaagcgaauuuuaaaagau

SEQ ID NO: 2432173 - RNA, 19 nt, Human
caaagcuaggccuggccag

SEQ ID NO: 2432174 - RNA, 14 nt, Human
caaagcuaggccug

SEQ ID NO: 2432175 - RNA, 13 nt, Human
caaagcuaggccu

SEQ ID NO: 2432176 - RNA, 13 nt, Human
caaaggaagcaca

SEQ ID NO: 2432177 - RNA, 12 nt, Human
caaaggaagcac

SEQ ID NO: 2432178 - RNA, 19 nt, Human
caaagcugaugacaacuuc

SEQ ID NO: 2432179 - RNA, 23 nt, Human
caaagccuugugucuacagagaa

SEQ ID NO: 2432180 - RNA, 21 nt, Human
caaagccuugugucuacagag

SEQ ID NO: 2432181 - RNA, 21 nt, Human
caaagcuaggguggcccuugc

SEQ ID NO: 2432182 - RNA, 22 nt, Human
caaagcuaggguggcccuugca

SEQ ID NO: 2432183 - RNA, 23 nt, Human
caaagcucuauuaagauuuccaa

SEQ ID NO: 2432184 - RNA, 14 nt, Human
caaaggaagcacau

SEQ ID NO: 2432185 - RNA, 17 nt, Human
caaaggaagguggaugg

SEQ ID NO: 2432186 - RNA, 21 nt, Human
caaaggaaggacccugaggcc

SEQ ID NO: 2432187 - RNA, 20 nt, Human
caaaggcacagugaaggcug

SEQ ID NO: 2432188 - RNA, 22 nt, Human
caaaggaaucuccaguuuucag

SEQ ID NO: 2432189 - RNA, 19 nt, Human
caaaggaaucuccaguuuu

SEQ ID NO: 2432190 - RNA, 16 nt, Human
caaaggaagucuagga

SEQ ID NO: 2432191 - RNA, 18 nt, Human
caaaggguaucaggugcu

SEQ ID NO: 2432192 - RNA, 16 nt, Human
caaaggguaucaggug

SEQ ID NO: 2432193 - RNA, 13 nt, Human
caaaggcccccua

SEQ ID NO: 2432194 - RNA, 17 nt, Human
caaaggccccagcaucu

SEQ ID NO: 2432195 - RNA, 11 nt, Human
caaaggcuggg

SEQ ID NO: 2432196 - RNA, 23 nt, Human
caaaggcugagaacacugugaaa

SEQ ID NO: 2432197 - RNA, 14 nt, Human
caaaggcugagaac

SEQ ID NO: 2432198 - RNA, 23 nt, Human
caaaggcgcagugcuucucuaca

SEQ ID NO: 2432199 - RNA, 23 nt, Human
caaaggccauggagagcuggagc

SEQ ID NO: 2432200 - RNA, 21 nt, Human
caaaggccauggagagcugga

SEQ ID NO: 2432201 - RNA, 20 nt, Human
caaaggccauggagagcugg

SEQ ID NO: 2432202 - RNA, 19 nt, Human
caaaggccauggagagcug

SEQ ID NO: 2432203 - RNA, 13 nt, Human
caaaggccaugga

SEQ ID NO: 2432204 - RNA, 15 nt, Human
caaaggccaggguca

SEQ ID NO: 2432205 - RNA, 13 nt, Human
caaaggccagggu

SEQ ID NO: 2432206 - RNA, 12 nt, Human
caaacgcugccu

SEQ ID NO: 2432207 - RNA, 13 nt, Human
caaacgcugccug

SEQ ID NO: 2432208 - RNA, 14 nt, Human
caaacgcugccugc

SEQ ID NO: 2432209 - RNA, 15 nt, Human
caaacgcugccugcc

SEQ ID NO: 2432210 - RNA, 19 nt, Human
caaacguauguaaauguau

SEQ ID NO: 2432211 - RNA, 16 nt, Human
caaacgcugccugccc

SEQ ID NO: 2432212 - RNA, 17 nt, Human
caaacgcugccugccca

SEQ ID NO: 2432213 - RNA, 13 nt, Human
caaaccucuguuc

SEQ ID NO: 2432214 - RNA, 14 nt, Human
caaaccucuguuca

SEQ ID NO: 2432215 - RNA, 15 nt, Human
caaaccucuguucag

SEQ ID NO: 2432216 - RNA, 19 nt, Human
caaaccucuguucagugua

SEQ ID NO: 2432217 - RNA, 23 nt, Human
caaacgcuaaagagcccuugccu

SEQ ID NO: 2432218 - RNA, 22 nt, Human
caaacgcuaaagagcccuugcc

SEQ ID NO: 2432219 - RNA, 21 nt, Human
caaacgcuaaagagcccuugc

SEQ ID NO: 2432220 - RNA, 13 nt, Human
caaacgcuaaaga

SEQ ID NO: 2432221 - RNA, 14 nt, Human
caaacgccuccccu

SEQ ID NO: 2432222 - RNA, 17 nt, Human
caaacgccuccccugcc

SEQ ID NO: 2432223 - RNA, 20 nt, Human
caaacccuucagugccaaaa

SEQ ID NO: 2432224 - RNA, 14 nt, Human
caaacccuucagug

SEQ ID NO: 2432225 - RNA, 21 nt, Human
caaaccuccaaaacuccugcc

SEQ ID NO: 2432226 - RNA, 11 nt, Human
caaaccucugu

SEQ ID NO: 2432227 - RNA, 12 nt, Human
caaaccucuguu

SEQ ID NO: 2432228 - RNA, 20 nt, Human
caaaccuagccccuuagccc

SEQ ID NO: 2432229 - RNA, 15 nt, Human
caaaccuccucuucu

SEQ ID NO: 2432230 - RNA, 23 nt, Human
caaaccgccagcgaacuugacaa

SEQ ID NO: 2432231 - RNA, 21 nt, Human
caaaccgccagcgaacuugac

SEQ ID NO: 2432232 - RNA, 17 nt, Human
caaaccgccagcgaacu

SEQ ID NO: 2432233 - RNA, 13 nt, Human
caaacacauuaag

SEQ ID NO: 2432234 - RNA, 22 nt, Human
caaaauuuuuucucuaggaaau

SEQ ID NO: 2432235 - RNA, 21 nt, Human
caaaauuuuuucucuaggaaa

SEQ ID NO: 2432236 - RNA, 16 nt, Human
caaaauuuuuucucua

SEQ ID NO: 2432237 - RNA, 17 nt, Human
caaaauuuaguuuuugu

SEQ ID NO: 2432238 - RNA, 23 nt, Human
caaaauuguuuugagcuuuccau

SEQ ID NO: 2432239 - RNA, 22 nt, Human
caaaauuguuuugagcuuucca

SEQ ID NO: 2432240 - RNA, 20 nt, Human
caaaauuguuuugagcuuuc

SEQ ID NO: 2432241 - RNA, 22 nt, Human
caaaauugcaaaucuugaaauu

SEQ ID NO: 2432242 - RNA, 23 nt, Human
caaaauugggaaaggaguagaaa

SEQ ID NO: 2432243 - RNA, 22 nt, Human
caaacaauggaaacugaaugcu

SEQ ID NO: 2432244 - RNA, 21 nt, Human
caaacaauggaaacugaaugc

SEQ ID NO: 2432245 - RNA, 20 nt, Human
caaacaauggaaacugaaug

SEQ ID NO: 2432246 - RNA, 19 nt, Human
caaacaauggaaacugaau

SEQ ID NO: 2432247 - RNA, 15 nt, Human
caaacacaaaugcag

SEQ ID NO: 2432248 - RNA, 14 nt, Human
caaacacaaaugca

SEQ ID NO: 2432249 - RNA, 21 nt, Human
caaaauuuaguuuuuguucuu

SEQ ID NO: 2432250 - RNA, 20 nt, Human
caaaauuuaguuuuuguucu

SEQ ID NO: 2432251 - RNA, 24 nt, Human
caaacaauaguaauucucaggcca

SEQ ID NO: 2432252 - RNA, 17 nt, Human
caaacaauggaaacuga

SEQ ID NO: 2432253 - RNA, 15 nt, Human
caaacacauacagga

SEQ ID NO: 2432254 - RNA, 21 nt, Human
caaacacaguuacacuugugc

SEQ ID NO: 2432255 - RNA, 23 nt, Human
caaacacauuaagccuuccacac

SEQ ID NO: 2432256 - RNA, 16 nt, Human
caaaauugauguguuu

SEQ ID NO: 2432257 - RNA, 15 nt, Human
caaaauugauguguu

SEQ ID NO: 2432258 - RNA, 23 nt, Human
caaaauucgaccugauuuacagu

SEQ ID NO: 2432259 - RNA, 21 nt, Human
caaaauucgaccugauuuaca

SEQ ID NO: 2432260 - RNA, 13 nt, Human
caaaauucccagg

SEQ ID NO: 2432261 - RNA, 11 nt, Human
caaaauuccca

SEQ ID NO: 2432262 - RNA, 19 nt, Human
caaaauugacauugcuuua

SEQ ID NO: 2432263 - RNA, 17 nt, Human
caaaauugacauugcuu

SEQ ID NO: 2432264 - RNA, 13 nt, Human
caaaauugacauu

SEQ ID NO: 2432265 - RNA, 22 nt, Human
caaaauugauguguuuauuuau

SEQ ID NO: 2432266 - RNA, 16 nt, Human
caaaauugcaaaucuu

SEQ ID NO: 2432267 - RNA, 17 nt, Human
caaaauugcaaaucuug

SEQ ID NO: 2432268 - RNA, 16 nt, Human
caaaauuguuacaaau

SEQ ID NO: 2432269 - RNA, 17 nt, Human
caaaauguuggucauuu

SEQ ID NO: 2432270 - RNA, 18 nt, Human
caaaauguuggucauuuu

SEQ ID NO: 2432271 - RNA, 21 nt, Human
caaaauguuggucauuuuaug

SEQ ID NO: 2432272 - RNA, 20 nt, Human
caaaauuaccaaaaaucuug

SEQ ID NO: 2432273 - RNA, 15 nt, Human
caaaauuauuucaga

SEQ ID NO: 2432274 - RNA, 17 nt, Human
caaaauuauuucagaaa

SEQ ID NO: 2432275 - RNA, 16 nt, Human
caaaauuauuucagaa

SEQ ID NO: 2432276 - RNA, 12 nt, Human
caaaauaaaacu

SEQ ID NO: 2432277 - RNA, 23 nt, Human
caaaauaaaaagugacacagcag

SEQ ID NO: 2432278 - RNA, 22 nt, Human
caaaauaaaaagugacacagca

SEQ ID NO: 2432279 - RNA, 14 nt, Human
caaaauaaaacuuu

SEQ ID NO: 2432280 - RNA, 20 nt, Human
caaaaugauggacccaaugc

SEQ ID NO: 2432281 - RNA, 22 nt, Human
caaaaugaggaauguauauguu

SEQ ID NO: 2432282 - RNA, 18 nt, Human
caaaaugcucuagugccu

SEQ ID NO: 2432283 - RNA, 18 nt, Human
caaaaugcuuuuuauuuc

SEQ ID NO: 2432284 - RNA, 20 nt, Human
caaaaugcuuuuuauuucug

SEQ ID NO: 2432285 - RNA, 23 nt, Human
caaaaugcuuuuuauuucugcau

SEQ ID NO: 2432286 - RNA, 23 nt, Human
caaaauguaggcuuaguuugugu

SEQ ID NO: 2432287 - RNA, 22 nt, Human
caaaaugucuguagcuccucaa

SEQ ID NO: 2432288 - RNA, 13 nt, Human
caaaaugucugua

SEQ ID NO: 2432289 - RNA, 15 nt, Human
caaaauguaggguua

SEQ ID NO: 2432290 - RNA, 19 nt, Human
caaaaaucucaauauuuca

SEQ ID NO: 2432291 - RNA, 13 nt, Human
caaaaagcuuccc

SEQ ID NO: 2432292 - RNA, 14 nt, Human
caaaaagcuucccc

SEQ ID NO: 2432293 - RNA, 15 nt, Human
caaaaaguuuccaua

SEQ ID NO: 2432294 - RNA, 12 nt, Human
caaaaaguguuu

SEQ ID NO: 2432295 - RNA, 11 nt, Human
caaaaaguguu

SEQ ID NO: 2432296 - RNA, 20 nt, Human
caaaaagggaaacuauuguc

SEQ ID NO: 2432297 - RNA, 23 nt, Human
caaaaauauaaaauaugaagaca

SEQ ID NO: 2432298 - RNA, 12 nt, Human
caaaaauauaaa

SEQ ID NO: 2432299 - RNA, 15 nt, Human
caaaaauauaacuua

SEQ ID NO: 2432300 - RNA, 14 nt, Human
caaaaauauuuaua

SEQ ID NO: 2432301 - RNA, 22 nt, Human
caaaaauauuuauaaaacuucu

SEQ ID NO: 2432302 - RNA, 17 nt, Human
caaaaaguguuuauuuu

SEQ ID NO: 2432303 - RNA, 12 nt, Human
caaaaauaaaua

SEQ ID NO: 2432304 - RNA, 11 nt, Human
caaaaauauaa

SEQ ID NO: 2432305 - RNA, 17 nt, Human
caaaaaugaacugaagu

SEQ ID NO: 2432306 - RNA, 19 nt, Human
caaaaaugaaagcaugucu

SEQ ID NO: 2432307 - RNA, 17 nt, Human
caaaaauuagccgggca

SEQ ID NO: 2432308 - RNA, 15 nt, Human
caaaaauuagccggg

SEQ ID NO: 2432309 - RNA, 17 nt, Human
caaaaauuagccgggcg

SEQ ID NO: 2432310 - RNA, 20 nt, Human
caaaaauuagccgggcgugg

SEQ ID NO: 2432311 - RNA, 11 nt, Human
caaaaauuagg

SEQ ID NO: 2432312 - RNA, 16 nt, Human
caaaaauuagguauuu

SEQ ID NO: 2432313 - RNA, 18 nt, Human
caaaaauuagguauuuug

SEQ ID NO: 2432314 - RNA, 16 nt, Human
caaaaauucucaguuc

SEQ ID NO: 2432315 - RNA, 19 nt, Human
caaaaauucaacucagacu

SEQ ID NO: 2432316 - RNA, 17 nt, Human
caaaacaaaaauuaggu

SEQ ID NO: 2432317 - RNA, 19 nt, Human
caaaaauuugcuucacuca

SEQ ID NO: 2432318 - RNA, 18 nt, Human
caaaacaaaaauuaggua

SEQ ID NO: 2432319 - RNA, 22 nt, Human
caaaacaaaaauuagguauuuu

SEQ ID NO: 2432320 - RNA, 23 nt, Human
caaaacaaaaauuagguauuuug

SEQ ID NO: 2432321 - RNA, 21 nt, Human
caaaacucuccucugcugcug

SEQ ID NO: 2432322 - RNA, 20 nt, Human
caaaacucuccucugcugcu

SEQ ID NO: 2432323 - RNA, 22 nt, Human
caaaacucuccucugcugcugg

SEQ ID NO: 2432324 - RNA, 14 nt, Human
caaaacugugcaga

SEQ ID NO: 2432325 - RNA, 22 nt, Human
caaaacugccucaggaggcagg

SEQ ID NO: 2432326 - RNA, 21 nt, Human
caaaauaaaaagugacacagc

SEQ ID NO: 2432327 - RNA, 19 nt, Human
caaaauaaaaagugacaca

SEQ ID NO: 2432328 - RNA, 19 nt, Human
caaaagaacaagaauuucu

SEQ ID NO: 2432329 - RNA, 17 nt, Human
caaaauaaaaaugaggu

SEQ ID NO: 2432330 - RNA, 23 nt, Human
caaaacuucagacauagaauuaa

SEQ ID NO: 2432331 - RNA, 13 nt, Human
caaaacuuaacau

SEQ ID NO: 2432332 - RNA, 21 nt, Human
caaaagaaaaaaaaaagcacc

SEQ ID NO: 2432333 - RNA, 19 nt, Human
caaaaccccacuacacagu

SEQ ID NO: 2432334 - RNA, 18 nt, Human
caaaaccugauguuaaaa

SEQ ID NO: 2432335 - RNA, 21 nt, Human
caaaaccugauguuaaaauuc

SEQ ID NO: 2432336 - RNA, 13 nt, Human
caaaacccagacc

SEQ ID NO: 2432337 - RNA, 15 nt, Human
caaaacccagaccug

SEQ ID NO: 2432338 - RNA, 13 nt, Human
caaaacccaccuu

SEQ ID NO: 2432339 - RNA, 16 nt, Human
caaaaccacagcccug

SEQ ID NO: 2432340 - RNA, 18 nt, Human
caaaaccacagcccuguc

SEQ ID NO: 2432341 - RNA, 19 nt, Human
caaaaccacagcccuguca

SEQ ID NO: 2432342 - RNA, 21 nt, Human
caaaaccacagcccugucagu

SEQ ID NO: 2432343 - RNA, 19 nt, Human
caaaacacucggcauuuca

SEQ ID NO: 2432344 - RNA, 21 nt, Human
caaaacaaaugccacacauca

SEQ ID NO: 2432345 - RNA, 20 nt, Human
caaaacaaguuuuucuguca

SEQ ID NO: 2432346 - RNA, 13 nt, Human
caaaaccacagcc

SEQ ID NO: 2432347 - RNA, 22 nt, Human
caaaacaugucuccuauccugg

SEQ ID NO: 2432348 - RNA, 23 nt, Human
caaaacagcguuuaagacuguaa

SEQ ID NO: 2432349 - RNA, 19 nt, Human
caaaacagagaugugauaa

SEQ ID NO: 2432350 - RNA, 18 nt, Human
caaaacagcguuuaagac

SEQ ID NO: 2432351 - RNA, 17 nt, Human
auuuugguuguauucuu

SEQ ID NO: 2432352 - RNA, 16 nt, Human
auuuugguuguauucu

SEQ ID NO: 2432353 - RNA, 15 nt, Human
auuuugguuguauuc

SEQ ID NO: 2432354 - RNA, 14 nt, Human
auuuugguuguauu

SEQ ID NO: 2432355 - RNA, 20 nt, Human
auuuugguuguauucuuuga

SEQ ID NO: 2432356 - RNA, 19 nt, Human
auuuugguuguauucuuug

SEQ ID NO: 2432357 - RNA, 16 nt, Human
auuuugguuuuguucc

SEQ ID NO: 2432358 - RNA, 16 nt, Human
auuuuggugagaaaug

SEQ ID NO: 2432359 - RNA, 21 nt, Human
auuuuggugagaaaugggacu

SEQ ID NO: 2432360 - RNA, 14 nt, Human
auuuuggugagaaa

SEQ ID NO: 2432361 - RNA, 15 nt, Human
auuuuggugagaaau

SEQ ID NO: 2432362 - RNA, 18 nt, Human
auuuugguccaaguugug

SEQ ID NO: 2432363 - RNA, 23 nt, Human
auuuugguuuuguuccccuccuc

SEQ ID NO: 2432364 - RNA, 22 nt, Human
auuuugguuuuguuccccuccu

SEQ ID NO: 2432365 - RNA, 21 nt, Human
auuuugguuuuguuccccucc

SEQ ID NO: 2432366 - RNA, 17 nt, Human
auuuugguuuuguuccc

SEQ ID NO: 2432367 - RNA, 16 nt, Human
caaaaaaugcuugcuu

SEQ ID NO: 2432368 - RNA, 20 nt, Human
auuuugggguuguguuguca

SEQ ID NO: 2432369 - RNA, 15 nt, Human
auuuugggaaucuuu

SEQ ID NO: 2432370 - RNA, 16 nt, Human
auuuugggaaucuuuu

SEQ ID NO: 2432371 - RNA, 21 nt, Human
auuuugguauuacacuguauu

SEQ ID NO: 2432372 - RNA, 20 nt, Human
auuuugguauuacacuguau

SEQ ID NO: 2432373 - RNA, 15 nt, Human
auuuugguacuuuua

SEQ ID NO: 2432374 - RNA, 22 nt, Human
auuuugguaaaauacuucuuga

SEQ ID NO: 2432375 - RNA, 19 nt, Human
auuuuggguuuugggucuu

SEQ ID NO: 2432376 - RNA, 23 nt, Human
auuuugggguacccacugcucug

SEQ ID NO: 2432377 - RNA, 22 nt, Human
auuuugggguacccacugcucu

SEQ ID NO: 2432378 - RNA, 13 nt, Human
auuuuccugaaaa

SEQ ID NO: 2432379 - RNA, 15 nt, Human
auuuuccuugaagcc

SEQ ID NO: 2432380 - RNA, 14 nt, Human
auuuuccuugaagc

SEQ ID NO: 2432381 - RNA, 13 nt, Human
auuuuccuugaag

SEQ ID NO: 2432382 - RNA, 14 nt, Human
auuuuccuuuucaa

SEQ ID NO: 2432383 - RNA, 16 nt, Human
auuuuccuugaagccg

SEQ ID NO: 2432384 - RNA, 22 nt, Human
auuuuccuuuuuuauacacaua

SEQ ID NO: 2432385 - RNA, 21 nt, Human
auuuuccuuuuuuauacacau

SEQ ID NO: 2432386 - RNA, 20 nt, Human
auuuuccuuuuuuauacaca

SEQ ID NO: 2432387 - RNA, 18 nt, Human
auuuuccuuuuuuauaca

SEQ ID NO: 2432388 - RNA, 17 nt, Human
auuuuccuuuuuuauac

SEQ ID NO: 2432389 - RNA, 13 nt, Human
auuuuccuuuuuu

SEQ ID NO: 2432390 - RNA, 22 nt, Human
auuuuggagaguuuccugaaac

SEQ ID NO: 2432391 - RNA, 21 nt, Human
auuuuggagaguuuccugaaa

SEQ ID NO: 2432392 - RNA, 21 nt, Human
auuuugggguacccacugcuc

SEQ ID NO: 2432393 - RNA, 20 nt, Human
auuuuggagaguuuccugaa

SEQ ID NO: 2432394 - RNA, 19 nt, Human
auuuucuagacuuucuguu

SEQ ID NO: 2432395 - RNA, 14 nt, Human
auuuuggagaaauu

SEQ ID NO: 2432396 - RNA, 21 nt, Human
auuuuggagaaauuauuuaau

SEQ ID NO: 2432397 - RNA, 18 nt, Human
auuuucuagacuuucugu

SEQ ID NO: 2432398 - RNA, 16 nt, Human
auuuucuagacuuucu

SEQ ID NO: 2432399 - RNA, 21 nt, Human
auuuucuaccuggucucuccu

SEQ ID NO: 2432400 - RNA, 14 nt, Human
auuuucuacagugg

SEQ ID NO: 2432401 - RNA, 15 nt, Human
caaaaacacagcaag

SEQ ID NO: 2432402 - RNA, 17 nt, Human
caaaaacacagcaaggg

SEQ ID NO: 2432403 - RNA, 20 nt, Human
caaaaacauggccuuugcuu

SEQ ID NO: 2432404 - RNA, 20 nt, Human
caaaaacacaguguuuuugu

SEQ ID NO: 2432405 - RNA, 23 nt, Human
caaaaacacaguguuuuuguaaa

SEQ ID NO: 2432406 - RNA, 22 nt, Human
caaaaacacaguguuuuuguaa

SEQ ID NO: 2432407 - RNA, 13 nt, Human
caaaaacagccuc

SEQ ID NO: 2432408 - RNA, 14 nt, Human
caaaaacagccuca

SEQ ID NO: 2432409 - RNA, 13 nt, Human
caaaaacacagca

SEQ ID NO: 2432410 - RNA, 14 nt, Human
caaaaacacagcaa

SEQ ID NO: 2432411 - RNA, 10 nt, Human
auuuuguaaa

SEQ ID NO: 2432412 - RNA, 21 nt, Human
auuuugguuguauucuuugau

SEQ ID NO: 2432413 - RNA, 17 nt, Human
auuuuguaaacucaaaa

SEQ ID NO: 2432414 - RNA, 18 nt, Human
caaaaaauuagccgggcg

SEQ ID NO: 2432415 - RNA, 16 nt, Human
caaaaaauuagccggg

SEQ ID NO: 2432416 - RNA, 19 nt, Human
caaaaagaacaaaaaaauc

SEQ ID NO: 2432417 - RNA, 14 nt, Human
caaaaagaacaaaa

SEQ ID NO: 2432418 - RNA, 13 nt, Human
caaaaagaacaaa

SEQ ID NO: 2432419 - RNA, 12 nt, Human
caaaaagaacaa

SEQ ID NO: 2432420 - RNA, 15 nt, Human
caaaaagaccagacu

SEQ ID NO: 2432421 - RNA, 14 nt, Human
caaaaagaccagac

SEQ ID NO: 2432422 - RNA, 13 nt, Human
caaaaagaccaga

SEQ ID NO: 2432423 - RNA, 21 nt, Human
caaaaagaacaaaaaaaucug

SEQ ID NO: 2432424 - RNA, 16 nt, Human
caaaaagcaaaaucau

SEQ ID NO: 2432425 - RNA, 15 nt, Human
caaaaagcaaaauca

SEQ ID NO: 2432426 - RNA, 22 nt, Human
caaaaagcucuuacacuacauu

SEQ ID NO: 2432427 - RNA, 13 nt, Human
caaaaaggcagga

SEQ ID NO: 2432428 - RNA, 22 nt, Human
caaaaacagccucacagaagaa

SEQ ID NO: 2432429 - RNA, 15 nt, Human
caaaaacagccucac

SEQ ID NO: 2432430 - RNA, 16 nt, Human
caaaaacagccucaca

SEQ ID NO: 2432431 - RNA, 13 nt, Human
caaaaacuuguua

SEQ ID NO: 2432432 - RNA, 22 nt, Human
caaaaacuguauugaugacagu

SEQ ID NO: 2432433 - RNA, 23 nt, Human
caaaaacuuuggaguccccucac

SEQ ID NO: 2432434 - RNA, 17 nt, Human
caaaaaccucacccgag

SEQ ID NO: 2432435 - RNA, 16 nt, Human
caaaaacuacacauau

SEQ ID NO: 2432436 - RNA, 22 nt, Human
cacauaugcaccuugugucugu

SEQ ID NO: 2432437 - RNA, 21 nt, Human
cacauaugcaccuugugucug

SEQ ID NO: 2432438 - RNA, 20 nt, Human
cacauaugcaccuugugucu

SEQ ID NO: 2432439 - RNA, 19 nt, Human
cacauaugcaccuuguguc

SEQ ID NO: 2432440 - RNA, 13 nt, Human
cacauagcugucu

SEQ ID NO: 2432441 - RNA, 18 nt, Human
cacauaugcaccuugugu

SEQ ID NO: 2432442 - RNA, 16 nt, Human
cacauagcugucuaga

SEQ ID NO: 2432443 - RNA, 13 nt, Human
cacauaugagggg

SEQ ID NO: 2432444 - RNA, 16 nt, Human
cacaguuuucugagaa

SEQ ID NO: 2432445 - RNA, 17 nt, Human
cacaguuuucugagaaa

SEQ ID NO: 2432446 - RNA, 19 nt, Human
cacaguuuucugagaaaga

SEQ ID NO: 2432447 - RNA, 20 nt, Human
cacaguuuucugagaaagac

SEQ ID NO: 2432448 - RNA, 14 nt, Human
cacauaucugucau

SEQ ID NO: 2432449 - RNA, 15 nt, Human
cacauagagaucauc

SEQ ID NO: 2432450 - RNA, 18 nt, Human
cacauagcauguaauggu

SEQ ID NO: 2432451 - RNA, 20 nt, Human
cacauacgcaccacaucucu

SEQ ID NO: 2432452 - RNA, 16 nt, Human
cacauacuugagacug

SEQ ID NO: 2432453 - RNA, 19 nt, Human
cacauacccucuucaugga

SEQ ID NO: 2432454 - RNA, 22 nt, Human
cacauacccucuucauggaugg

SEQ ID NO: 2432455 - RNA, 15 nt, Human
cacauacccuccccc

SEQ ID NO: 2432456 - RNA, 13 nt, Human
cacauacccuccc

SEQ ID NO: 2432457 - RNA, 22 nt, Human
cacaguuccucgcccugggucu

SEQ ID NO: 2432458 - RNA, 22 nt, Human
cacagcuucauuuccugugucu

SEQ ID NO: 2432459 - RNA, 21 nt, Human
cacagcuucauuuccuguguc

SEQ ID NO: 2432460 - RNA, 14 nt, Human
cacagcuggccucc

SEQ ID NO: 2432461 - RNA, 20 nt, Human
cacagcugcuuucuguuguc

SEQ ID NO: 2432462 - RNA, 14 nt, Human
cacagcugcuuucu

SEQ ID NO: 2432463 - RNA, 20 nt, Human
cacagcugcuggagacuccu

SEQ ID NO: 2432464 - RNA, 15 nt, Human
cacagcugggcugug

SEQ ID NO: 2432465 - RNA, 14 nt, Human
cacagcugggcugu

SEQ ID NO: 2432466 - RNA, 17 nt, Human
cacagcuucagccagga

SEQ ID NO: 2432467 - RNA, 14 nt, Human
cacagcuucagcca

SEQ ID NO: 2432468 - RNA, 23 nt, Human
cacagcugggguggggaccucag

SEQ ID NO: 2432469 - RNA, 22 nt, Human
cacagcugggguggggaccuca

SEQ ID NO: 2432470 - RNA, 19 nt, Human
caauuugggagauauauuu

SEQ ID NO: 2432471 - RNA, 18 nt, Human
caauuugggagauauauu

SEQ ID NO: 2432472 - RNA, 19 nt, Human
caauuuguaaaaacagcau

SEQ ID NO: 2432473 - RNA, 15 nt, Human
cacagcugcuggaga

SEQ ID NO: 2432474 - RNA, 14 nt, Human
cacagcugcuggag

SEQ ID NO: 2432475 - RNA, 19 nt, Human
caauuuguuugugcuucua

SEQ ID NO: 2432476 - RNA, 12 nt, Human
cacagcugcugg

SEQ ID NO: 2432477 - RNA, 18 nt, Human
caauuuguuugugcuucu

SEQ ID NO: 2432478 - RNA, 16 nt, Human
caauuuguuugugcuu

SEQ ID NO: 2432479 - RNA, 23 nt, Human
caauuuguaauugcuuacauuuu

SEQ ID NO: 2432480 - RNA, 23 nt, Human
caauuuguaaaaacagcauugcu

SEQ ID NO: 2432481 - RNA, 15 nt, Human
cacaggagcauuugg

SEQ ID NO: 2432482 - RNA, 15 nt, Human
cacagcuuccccucu

SEQ ID NO: 2432483 - RNA, 19 nt, Human
cacagcuucagccaggagc

SEQ ID NO: 2432484 - RNA, 18 nt, Human
cacagcuucagccaggag

SEQ ID NO: 2432485 - RNA, 22 nt, Human
cacagcuucagccaggagcugg

SEQ ID NO: 2432486 - RNA, 14 nt, Human
cacagcuuccccuc

SEQ ID NO: 2432487 - RNA, 19 nt, Human
cacaggagggagggggaag

SEQ ID NO: 2432488 - RNA, 21 nt, Human
cacaggagggagggggaaggc

SEQ ID NO: 2432489 - RNA, 14 nt, Human
cacaggagggaggg

SEQ ID NO: 2432490 - RNA, 22 nt, Human
cacaggaggagaaaucucacuu

SEQ ID NO: 2432491 - RNA, 15 nt, Human
cacaggcagguccag

SEQ ID NO: 2432492 - RNA, 14 nt, Human
cacaggcaggucca

SEQ ID NO: 2432493 - RNA, 18 nt, Human
cacaggagugggaaaaca

SEQ ID NO: 2432494 - RNA, 11 nt, Human
cacaggcaggu

SEQ ID NO: 2432495 - RNA, 22 nt, Human
cacaguccuuaccagcagagca

SEQ ID NO: 2432496 - RNA, 21 nt, Human
cacaguccuuaccagcagagc

SEQ ID NO: 2432497 - RNA, 15 nt, Human
cacaguccuuaccag

SEQ ID NO: 2432498 - RNA, 13 nt, Human
cacaguccuuacc

SEQ ID NO: 2432499 - RNA, 21 nt, Human
cacagugagucgaggacaggg

SEQ ID NO: 2432500 - RNA, 22 nt, Human
cacagugagucgaggacaggga

SEQ ID NO: 2432501 - RNA, 14 nt, Human
cacagugauuuuuu

SEQ ID NO: 2432502 - RNA, 11 nt, Human
cacagugauuu

SEQ ID NO: 2432503 - RNA, 14 nt, Human
cacagugcaucuca

SEQ ID NO: 2432504 - RNA, 19 nt, Human
cacaguucgaccugcggcu

SEQ ID NO: 2432505 - RNA, 18 nt, Human
cacaguucuuugggccag

SEQ ID NO: 2432506 - RNA, 19 nt, Human
cacaguucuuugggccaga

SEQ ID NO: 2432507 - RNA, 20 nt, Human
cacaguucuuugggccagac

SEQ ID NO: 2432508 - RNA, 15 nt, Human
cacaguucucuccuu

SEQ ID NO: 2432509 - RNA, 14 nt, Human
cacaguucucuccu

SEQ ID NO: 2432510 - RNA, 16 nt, Human
cacaguuccucgcccu

SEQ ID NO: 2432511 - RNA, 19 nt, Human
cacaguuccucgcccuggg

SEQ ID NO: 2432512 - RNA, 20 nt, Human
cacaguuccucgcccugggu

SEQ ID NO: 2432513 - RNA, 19 nt, Human
cacagugguggcagggccu

SEQ ID NO: 2432514 - RNA, 17 nt, Human
cacagugguggcagggc

SEQ ID NO: 2432515 - RNA, 23 nt, Human
cacagugguggcagggccuagcu

SEQ ID NO: 2432516 - RNA, 15 nt, Human
cacagugguggcagg

SEQ ID NO: 2432517 - RNA, 19 nt, Human
cacagugggagccagggcu

SEQ ID NO: 2432518 - RNA, 18 nt, Human
cacagugggagccagggc

SEQ ID NO: 2432519 - RNA, 14 nt, Human
cacagugggagcca

SEQ ID NO: 2432520 - RNA, 13 nt, Human
cacagugucuggg

SEQ ID NO: 2432521 - RNA, 20 nt, Human
cacagugucugggcugacug

SEQ ID NO: 2432522 - RNA, 17 nt, Human
cacagugucugggcuga

SEQ ID NO: 2432523 - RNA, 16 nt, Human
cacagugucugggcug

SEQ ID NO: 2432524 - RNA, 14 nt, Human
cacagugucugggc

SEQ ID NO: 2432525 - RNA, 21 nt, Human
cacagugucugggcugacugg

SEQ ID NO: 2432526 - RNA, 18 nt, Human
cacagugucuguaucgga

SEQ ID NO: 2432527 - RNA, 14 nt, Human
cacugugcccuggu

SEQ ID NO: 2432528 - RNA, 21 nt, Human
cacugcacagagcucuccagc

SEQ ID NO: 2432529 - RNA, 19 nt, Human
cacugcacagagcucucca

SEQ ID NO: 2432530 - RNA, 16 nt, Human
cacugcacagagcucu

SEQ ID NO: 2432531 - RNA, 15 nt, Human
cacugcacagagcuc

SEQ ID NO: 2432532 - RNA, 14 nt, Human
cacugcacagagcu

SEQ ID NO: 2432533 - RNA, 13 nt, Human
cacugcacagagc

SEQ ID NO: 2432534 - RNA, 22 nt, Human
cacugcacacaccucagaggcu

SEQ ID NO: 2432535 - RNA, 19 nt, Human
cacugcacacaccucagag

SEQ ID NO: 2432536 - RNA, 18 nt, Human
cacugcacacaccucaga

SEQ ID NO: 2432537 - RNA, 19 nt, Human
cacugcaauccugucuuuc

SEQ ID NO: 2432538 - RNA, 16 nt, Human
cacugcaauccugucu

SEQ ID NO: 2432539 - RNA, 22 nt, Human
cacugcacagugcaucucagcc

SEQ ID NO: 2432540 - RNA, 21 nt, Human
cacugcacagugcaucucagc

SEQ ID NO: 2432541 - RNA, 19 nt, Human
cacugcacagugcaucuca

SEQ ID NO: 2432542 - RNA, 18 nt, Human
cacugcacagugcaucuc

SEQ ID NO: 2432543 - RNA, 20 nt, Human
cacugcaagagccuuggugu

SEQ ID NO: 2432544 - RNA, 17 nt, Human
cacugcaagagccuugg

SEQ ID NO: 2432545 - RNA, 18 nt, Human
cacugcaagagccuuggu

SEQ ID NO: 2432546 - RNA, 19 nt, Human
cacugcaagagccuuggug

SEQ ID NO: 2432547 - RNA, 13 nt, Human
cacugcaagagcc

SEQ ID NO: 2432548 - RNA, 15 nt, Human
cacugcaagagccuu

SEQ ID NO: 2432549 - RNA, 16 nt, Human
cacugcaagagccuug

SEQ ID NO: 2432550 - RNA, 17 nt, Human
cacugcaacuucugccu

SEQ ID NO: 2432551 - RNA, 14 nt, Human
cacugcaaccuucg

SEQ ID NO: 2432552 - RNA, 22 nt, Human
cacugcaaccuucgccaccugg

SEQ ID NO: 2432553 - RNA, 23 nt, Human
cacugcaaccuucgccaccuggg

SEQ ID NO: 2432554 - RNA, 16 nt, Human
cacugcaacuucugcc

SEQ ID NO: 2432555 - RNA, 16 nt, Human
cacugcaaccuccgcc

SEQ ID NO: 2432556 - RNA, 14 nt, Human
cacugcaaccuccg

SEQ ID NO: 2432557 - RNA, 23 nt, Human
cacugcaaccuccgccucuuggg

SEQ ID NO: 2432558 - RNA, 13 nt, Human
cacugcaaccucc

SEQ ID NO: 2432559 - RNA, 16 nt, Human
cacugauuuggagaua

SEQ ID NO: 2432560 - RNA, 14 nt, Human
cacugauuuggaga

SEQ ID NO: 2432561 - RNA, 13 nt, Human
cacugauuucaca

SEQ ID NO: 2432562 - RNA, 22 nt, Human
cacugauauuuuaccucuuauu

SEQ ID NO: 2432563 - RNA, 19 nt, Human
cacugauuucacaacagau

SEQ ID NO: 2432564 - RNA, 18 nt, Human
cacugauuucacaacaga

SEQ ID NO: 2432565 - RNA, 21 nt, Human
cacugauuucacaacagauca

SEQ ID NO: 2432566 - RNA, 24 nt, Human
cacugaugggcaacccccagccug

SEQ ID NO: 2432567 - RNA, 18 nt, Human
cacugaugggcaaccccc

SEQ ID NO: 2432568 - RNA, 14 nt, Human
cacugaugggcaac

SEQ ID NO: 2432569 - RNA, 19 nt, Human
cacugaugcugccccucau

SEQ ID NO: 2432570 - RNA, 15 nt, Human
cacugaugcuuagau

SEQ ID NO: 2432571 - RNA, 16 nt, Human
cacugaugcuuagaug

SEQ ID NO: 2432572 - RNA, 19 nt, Human
cacugauggacaaggaggu

SEQ ID NO: 2432573 - RNA, 14 nt, Human
cacugauccagccc

SEQ ID NO: 2432574 - RNA, 15 nt, Human
cacugauccagcccu

SEQ ID NO: 2432575 - RNA, 12 nt, Human
cacugaugcugc

SEQ ID NO: 2432576 - RNA, 17 nt, Human
cacugaugcugccccuc

SEQ ID NO: 2432577 - RNA, 16 nt, Human
cacugauccagcccug

SEQ ID NO: 2432578 - RNA, 20 nt, Human
cacugauauaucaugaguga

SEQ ID NO: 2432579 - RNA, 19 nt, Human
cacugauauuuuaccucuu

SEQ ID NO: 2432580 - RNA, 14 nt, Human
cacugagggccaca

SEQ ID NO: 2432581 - RNA, 13 nt, Human
cacugagggccac

SEQ ID NO: 2432582 - RNA, 18 nt, Human
cacugagggccacacuau

SEQ ID NO: 2432583 - RNA, 14 nt, Human
cacugagggcaguc

SEQ ID NO: 2432584 - RNA, 10 nt, Human
cacugagggc

SEQ ID NO: 2432585 - RNA, 18 nt, Human
cacugaggcagggaaguc

SEQ ID NO: 2432586 - RNA, 13 nt, Human
cacugagcagagu

SEQ ID NO: 2432587 - RNA, 15 nt, Human
cacugagcugucaug

SEQ ID NO: 2432588 - RNA, 17 nt, Human
cacugagcuccaugugc

SEQ ID NO: 2432589 - RNA, 12 nt, Human
cacugagcucca

SEQ ID NO: 2432590 - RNA, 16 nt, Human
cacugagcccccccaa

SEQ ID NO: 2432591 - RNA, 14 nt, Human
cacugagccccccc

SEQ ID NO: 2432592 - RNA, 13 nt, Human
cacugagcccccc

SEQ ID NO: 2432593 - RNA, 11 nt, Human
cacugagcccc

SEQ ID NO: 2432594 - RNA, 17 nt, Human
cacugaggaagaacggg

SEQ ID NO: 2432595 - RNA, 15 nt, Human
cacugaggaagaacg

SEQ ID NO: 2432596 - RNA, 14 nt, Human
cacugaggaagaac

SEQ ID NO: 2432597 - RNA, 13 nt, Human
cacugaggaagaa

SEQ ID NO: 2432598 - RNA, 13 nt, Human
cacugaggcaggg

SEQ ID NO: 2432599 - RNA, 14 nt, Human
cacugaggcaggga

SEQ ID NO: 2432600 - RNA, 16 nt, Human
cacugaggcagggaag

SEQ ID NO: 2432601 - RNA, 17 nt, Human
cacugaggcagggaagu

SEQ ID NO: 2432602 - RNA, 19 nt, Human
cacugaggcagggaagucc

SEQ ID NO: 2432603 - RNA, 20 nt, Human
cacugagaauguaagaacua

SEQ ID NO: 2432604 - RNA, 19 nt, Human
cacugagaauguaagaacu

SEQ ID NO: 2432605 - RNA, 19 nt, Human
cacugagaagauugugaau

SEQ ID NO: 2432606 - RNA, 21 nt, Human
cacugagaauguaagaacuac

SEQ ID NO: 2432607 - RNA, 23 nt, Human
cacugagacagcccgggcucugc

SEQ ID NO: 2432608 - RNA, 18 nt, Human
cacugagauaccagcgag

SEQ ID NO: 2432609 - RNA, 19 nt, Human
cacugagauaccagcgagg

SEQ ID NO: 2432610 - RNA, 23 nt, Human
cacugagauaccagcgaggaggc

SEQ ID NO: 2432611 - RNA, 14 nt, Human
cacugagcaaagca

SEQ ID NO: 2432612 - RNA, 22 nt, Human
cacugagacagcccgggcucug

SEQ ID NO: 2432613 - RNA, 19 nt, Human
cacugagacagcccgggcu

SEQ ID NO: 2432614 - RNA, 17 nt, Human
cacugagacagcccggg

SEQ ID NO: 2432615 - RNA, 14 nt, Human
cacugagacagccc

SEQ ID NO: 2432616 - RNA, 13 nt, Human
cacugagacagcc

SEQ ID NO: 2432617 - RNA, 12 nt, Human
cacugagacagc

SEQ ID NO: 2432618 - RNA, 21 nt, Human
cacugacuucuaaguaaaacc

SEQ ID NO: 2432619 - RNA, 18 nt, Human
cacugagaauguaagaac

SEQ ID NO: 2432620 - RNA, 16 nt, Human
cacugagaauguaaga

SEQ ID NO: 2432621 - RNA, 17 nt, Human
cacugagaagauuguga

SEQ ID NO: 2432622 - RNA, 14 nt, Human
cacugacuucuaag

SEQ ID NO: 2432623 - RNA, 15 nt, Human
cacugacuucuaagu

SEQ ID NO: 2432624 - RNA, 16 nt, Human
cacugacuucuaagua

SEQ ID NO: 2432625 - RNA, 20 nt, Human
cacugacuucuaaguaaaac

SEQ ID NO: 2432626 - RNA, 15 nt, Human
cacugacuacuggcu

SEQ ID NO: 2432627 - RNA, 22 nt, Human
cacugaccugucaugccccccu

SEQ ID NO: 2432628 - RNA, 23 nt, Human
cacugaccugucaugccccccuc

SEQ ID NO: 2432629 - RNA, 19 nt, Human
cacugacuacuggcucuca

SEQ ID NO: 2432630 - RNA, 18 nt, Human
cacugaccugucaugccc

SEQ ID NO: 2432631 - RNA, 23 nt, Human
cacugaccauccacucuacccuc

SEQ ID NO: 2432632 - RNA, 14 nt, Human
cacugaccagaacu

SEQ ID NO: 2432633 - RNA, 15 nt, Human
cacugaccagaacua

SEQ ID NO: 2432634 - RNA, 16 nt, Human
cacugaccauccacuc

SEQ ID NO: 2432635 - RNA, 17 nt, Human
cacugaccauccacucu

SEQ ID NO: 2432636 - RNA, 13 nt, Human
cacugaccagaac

SEQ ID NO: 2432637 - RNA, 20 nt, Human
cacugacagccucccacccc

SEQ ID NO: 2432638 - RNA, 16 nt, Human
cacugacagccuccca

SEQ ID NO: 2432639 - RNA, 17 nt, Human
cacugacagccucccac

SEQ ID NO: 2432640 - RNA, 13 nt, Human
cacugacagccuc

SEQ ID NO: 2432641 - RNA, 14 nt, Human
cacugacagccucc

SEQ ID NO: 2432642 - RNA, 15 nt, Human
cacugacagccuccc

SEQ ID NO: 2432643 - RNA, 23 nt, Human
cacugacauuguuggccaaagcc

SEQ ID NO: 2432644 - RNA, 19 nt, Human
cacucugucgcccagucug

SEQ ID NO: 2432645 - RNA, 16 nt, Human
cacucugucgcccagu

SEQ ID NO: 2432646 - RNA, 15 nt, Human
cacucugucgcccag

SEQ ID NO: 2432647 - RNA, 13 nt, Human
cacucuggccuca

SEQ ID NO: 2432648 - RNA, 16 nt, Human
cacucugggcuccaga

SEQ ID NO: 2432649 - RNA, 17 nt, Human
cacucugggcuccagag

SEQ ID NO: 2432650 - RNA, 19 nt, Human
cacucuggcagcucagaga

SEQ ID NO: 2432651 - RNA, 17 nt, Human
cacucuggcagcucaga

SEQ ID NO: 2432652 - RNA, 16 nt, Human
cacucuggcagcucag

SEQ ID NO: 2432653 - RNA, 15 nt, Human
cacucuggcagcuca

SEQ ID NO: 2432654 - RNA, 21 nt, Human
cacucuggcagcucagagagg

SEQ ID NO: 2432655 - RNA, 20 nt, Human
cacucuggcagcucagagag

SEQ ID NO: 2432656 - RNA, 23 nt, Human
cacucuggcagcucagagagggu

SEQ ID NO: 2432657 - RNA, 19 nt, Human
cacucuggcugguuuggaa

SEQ ID NO: 2432658 - RNA, 12 nt, Human
cacucuggccuc

SEQ ID NO: 2432659 - RNA, 14 nt, Human
cacucugggcucca

SEQ ID NO: 2432660 - RNA, 15 nt, Human
cacucugggcuccag

SEQ ID NO: 2432661 - RNA, 23 nt, Human
cacugcucccugaagccagccuu

SEQ ID NO: 2432662 - RNA, 22 nt, Human
cacugcucccugaagccagccu

SEQ ID NO: 2432663 - RNA, 21 nt, Human
cacugcucccugaagccagcc

SEQ ID NO: 2432664 - RNA, 20 nt, Human
cacugcucccugaagccagc

SEQ ID NO: 2432665 - RNA, 19 nt, Human
cacugcucccugaagccag

SEQ ID NO: 2432666 - RNA, 18 nt, Human
cacugcucccugaagcca

SEQ ID NO: 2432667 - RNA, 17 nt, Human
cacugcucccugaagcc

SEQ ID NO: 2432668 - RNA, 14 nt, Human
cacugcucccugaa

SEQ ID NO: 2432669 - RNA, 22 nt, Human
cacugcucaagaagacauggag

SEQ ID NO: 2432670 - RNA, 19 nt, Human
cacugcucaagaagacaug

SEQ ID NO: 2432671 - RNA, 23 nt, Human
cacugcuaggugggccagccccu

SEQ ID NO: 2432672 - RNA, 21 nt, Human
cacugcuaggcgagugccagg

SEQ ID NO: 2432673 - RNA, 20 nt, Human
cacugcuaggcgagugccag

SEQ ID NO: 2432674 - RNA, 21 nt, Human
cacugcggggcuuggcugaga

SEQ ID NO: 2432675 - RNA, 20 nt, Human
cacugcggggcuuggcugag

SEQ ID NO: 2432676 - RNA, 22 nt, Human
cacugcuaggcgagugccagga

SEQ ID NO: 2432677 - RNA, 16 nt, Human
cacugcuaggugggcc

SEQ ID NO: 2432678 - RNA, 17 nt, Human
cacugcuaggugggcca

SEQ ID NO: 2432679 - RNA, 22 nt, Human
cacugcuaggugggccagcccc

SEQ ID NO: 2432680 - RNA, 17 nt, Human
cacugcugcccagccuc

SEQ ID NO: 2432681 - RNA, 23 nt, Human
cacugcugcuucuccauggccac

SEQ ID NO: 2432682 - RNA, 22 nt, Human
cacugcugcaaggccuuucugu

SEQ ID NO: 2432683 - RNA, 16 nt, Human
cacugcugcugccuuu

SEQ ID NO: 2432684 - RNA, 19 nt, Human
cacugcugcaaggccuuuc

SEQ ID NO: 2432685 - RNA, 18 nt, Human
cacugcugcaaggccuuu

SEQ ID NO: 2432686 - RNA, 17 nt, Human
cacugcugcaaggccuu

SEQ ID NO: 2432687 - RNA, 15 nt, Human
cacugcugcccagcc

SEQ ID NO: 2432688 - RNA, 20 nt, Human
cacugcucugaugaagagga

SEQ ID NO: 2432689 - RNA, 16 nt, Human
cacugcugcaaggccu

SEQ ID NO: 2432690 - RNA, 12 nt, Human
cacugcucuggu

SEQ ID NO: 2432691 - RNA, 23 nt, Human
cacugccuucgcuucuugccucu

SEQ ID NO: 2432692 - RNA, 21 nt, Human
cacugccuucgcuucuugccu

SEQ ID NO: 2432693 - RNA, 19 nt, Human
cacugccuucgcuucuugc

SEQ ID NO: 2432694 - RNA, 18 nt, Human
cacugccuucgcuucuug

SEQ ID NO: 2432695 - RNA, 20 nt, Human
cacugccuucucaacuccaa

SEQ ID NO: 2432696 - RNA, 12 nt, Human
cacugccuuuga

SEQ ID NO: 2432697 - RNA, 19 nt, Human
cacugcggggcuuggcuga

SEQ ID NO: 2432698 - RNA, 22 nt, Human
cacugcggagaaccuugugccu

SEQ ID NO: 2432699 - RNA, 21 nt, Human
cacugcggagaaccuugugcc

SEQ ID NO: 2432700 - RNA, 20 nt, Human
cacugcggagaaccuugugc

SEQ ID NO: 2432701 - RNA, 18 nt, Human
cacugcuaagaauauuug

SEQ ID NO: 2432702 - RNA, 14 nt, Human
cacugccugcccac

SEQ ID NO: 2432703 - RNA, 15 nt, Human
cacugccugcccacc

SEQ ID NO: 2432704 - RNA, 18 nt, Human
cacugccucucccuggcc

SEQ ID NO: 2432705 - RNA, 19 nt, Human
cacugccucucccuggccc

SEQ ID NO: 2432706 - RNA, 22 nt, Human
cacugccugauggaccugucac

SEQ ID NO: 2432707 - RNA, 23 nt, Human
cacugccugcagaggucugugcu

SEQ ID NO: 2432708 - RNA, 22 nt, Human
cacugccugcagaggucugugc

SEQ ID NO: 2432709 - RNA, 13 nt, Human
cacugccugcaga

SEQ ID NO: 2432710 - RNA, 10 nt, Human
cacugccugc

SEQ ID NO: 2432711 - RNA, 22 nt, Human
cacugccuucgauacaccgggc

SEQ ID NO: 2432712 - RNA, 20 nt, Human
cacugccuucgauacaccgg

SEQ ID NO: 2432713 - RNA, 18 nt, Human
cacugcacuauagccuag

SEQ ID NO: 2432714 - RNA, 19 nt, Human
cacugcaccgggccacaga

SEQ ID NO: 2432715 - RNA, 18 nt, Human
cacugcaccgggccacag

SEQ ID NO: 2432716 - RNA, 16 nt, Human
cacugcaccgggccac

SEQ ID NO: 2432717 - RNA, 17 nt, Human
cacugcaccccgucuca

SEQ ID NO: 2432718 - RNA, 22 nt, Human
cacugcacccccuccugcugca

SEQ ID NO: 2432719 - RNA, 21 nt, Human
cacugcacccccuccugcugc

SEQ ID NO: 2432720 - RNA, 20 nt, Human
cacugcacccccuccugcug

SEQ ID NO: 2432721 - RNA, 19 nt, Human
cacugcacccccuccugcu

SEQ ID NO: 2432722 - RNA, 18 nt, Human
cacugcacccccuccugc

SEQ ID NO: 2432723 - RNA, 16 nt, Human
cacugcacccccuccu

SEQ ID NO: 2432724 - RNA, 15 nt, Human
cacugcacccccucc

SEQ ID NO: 2432725 - RNA, 14 nt, Human
cacugcacccccuc

SEQ ID NO: 2432726 - RNA, 13 nt, Human
cacugcacccccu

SEQ ID NO: 2432727 - RNA, 15 nt, Human
cacugcaccaccgag

SEQ ID NO: 2432728 - RNA, 22 nt, Human
cacugcacagagcucuccagcu

SEQ ID NO: 2432729 - RNA, 23 nt, Human
cacugcacagugcaucucagccc

SEQ ID NO: 2432730 - RNA, 15 nt, Human
cacugcaccgggcca

SEQ ID NO: 2432731 - RNA, 14 nt, Human
cacugcaccgggcc

SEQ ID NO: 2432732 - RNA, 18 nt, Human
cacugcccacccccucaa

SEQ ID NO: 2432733 - RNA, 17 nt, Human
cacugcccacccccuca

SEQ ID NO: 2432734 - RNA, 17 nt, Human
cacugcccauggacagg

SEQ ID NO: 2432735 - RNA, 18 nt, Human
cacugcccauggacaggc

SEQ ID NO: 2432736 - RNA, 21 nt, Human
cacugcccccagcucuucucc

SEQ ID NO: 2432737 - RNA, 15 nt, Human
cacugcccgagcugg

SEQ ID NO: 2432738 - RNA, 16 nt, Human
cacugcccgagcuggu

SEQ ID NO: 2432739 - RNA, 17 nt, Human
cacugcccgagcuggug

SEQ ID NO: 2432740 - RNA, 18 nt, Human
cacugcccgagcuggugc

SEQ ID NO: 2432741 - RNA, 19 nt, Human
cacugcccgagcuggugca

SEQ ID NO: 2432742 - RNA, 16 nt, Human
cacugcccacccccuc

SEQ ID NO: 2432743 - RNA, 15 nt, Human
cacugcccacccccu

SEQ ID NO: 2432744 - RNA, 14 nt, Human
cacugcccaccccc

SEQ ID NO: 2432745 - RNA, 21 nt, Human
cacugcccaaagugcuuccaa

SEQ ID NO: 2432746 - RNA, 20 nt, Human
cacugcccaaagugcuucca

SEQ ID NO: 2432747 - RNA, 22 nt, Human
cacugccauggaggcacacagc

SEQ ID NO: 2432748 - RNA, 19 nt, Human
cacugccauggaggcacac

SEQ ID NO: 2432749 - RNA, 17 nt, Human
cacugccauggaggcac

SEQ ID NO: 2432750 - RNA, 15 nt, Human
cacugccucagguuc

SEQ ID NO: 2432751 - RNA, 14 nt, Human
cacugccucagguu

SEQ ID NO: 2432752 - RNA, 13 nt, Human
cacugccucaggu

SEQ ID NO: 2432753 - RNA, 12 nt, Human
cacugccucagg

SEQ ID NO: 2432754 - RNA, 17 nt, Human
cacugccucagguuccu

SEQ ID NO: 2432755 - RNA, 16 nt, Human
cacugccucagguucc

SEQ ID NO: 2432756 - RNA, 21 nt, Human
cacugccucgggaaccucacu

SEQ ID NO: 2432757 - RNA, 15 nt, Human
cacugccuacugcau

SEQ ID NO: 2432758 - RNA, 16 nt, Human
cacugccuacugcauc

SEQ ID NO: 2432759 - RNA, 21 nt, Human
cacugcccgagcuggugcauu

SEQ ID NO: 2432760 - RNA, 16 nt, Human
cacugccucuuccucc

SEQ ID NO: 2432761 - RNA, 20 nt, Human
cacugccucucccuggcccu

SEQ ID NO: 2432762 - RNA, 16 nt, Human
cacugccucucccugg

SEQ ID NO: 2432763 - RNA, 23 nt, Human
cacugccucgggaaccucacucu

SEQ ID NO: 2432764 - RNA, 22 nt, Human
cacugccucgggaaccucacuc

SEQ ID NO: 2432765 - RNA, 21 nt, Human
cacugcuuccagugaggcucu

SEQ ID NO: 2432766 - RNA, 20 nt, Human
cacugcuuccagugaggcuc

SEQ ID NO: 2432767 - RNA, 19 nt, Human
cacugcuuccagugaggcu

SEQ ID NO: 2432768 - RNA, 18 nt, Human
cacugcuuccagugaggc

SEQ ID NO: 2432769 - RNA, 13 nt, Human
cacugcuugagga

SEQ ID NO: 2432770 - RNA, 14 nt, Human
cacugcuugaggaa

SEQ ID NO: 2432771 - RNA, 20 nt, Human
cacugcuugaggaaaacaag

SEQ ID NO: 2432772 - RNA, 20 nt, Human
cacugcuuuuggucugugug

SEQ ID NO: 2432773 - RNA, 22 nt, Human
cacugcuuccagugaggcucug

SEQ ID NO: 2432774 - RNA, 21 nt, Human
cacugcugugcugugcccaag

SEQ ID NO: 2432775 - RNA, 11 nt, Human
cacugcuguca

SEQ ID NO: 2432776 - RNA, 10 nt, Human
cacugcuguc

SEQ ID NO: 2432777 - RNA, 17 nt, Human
cacugcugugcugugcc

SEQ ID NO: 2432778 - RNA, 16 nt, Human
cacugcuuccagugag

SEQ ID NO: 2432779 - RNA, 15 nt, Human
cacugcuuccaguga

SEQ ID NO: 2432780 - RNA, 14 nt, Human
cacugcuuccagug

SEQ ID NO: 2432781 - RNA, 13 nt, Human
cacugcuuaacuu

SEQ ID NO: 2432782 - RNA, 23 nt, Human
cacugcuggguggcccauccccc

SEQ ID NO: 2432783 - RNA, 22 nt, Human
cacugcuggguggcccaucccc

SEQ ID NO: 2432784 - RNA, 20 nt, Human
cacugcuggguggcccaucc

SEQ ID NO: 2432785 - RNA, 19 nt, Human
cacugcuggguggcccauc

SEQ ID NO: 2432786 - RNA, 18 nt, Human
cacugcuggguggcccau

SEQ ID NO: 2432787 - RNA, 17 nt, Human
cacugcuggguggccca

SEQ ID NO: 2432788 - RNA, 14 nt, Human
cacugcuggguggc

SEQ ID NO: 2432789 - RNA, 13 nt, Human
cacugcugggugg

SEQ ID NO: 2432790 - RNA, 21 nt, Human
cacugcuggcugccuuagaac

SEQ ID NO: 2432791 - RNA, 16 nt, Human
cacugcuggcugccuu

SEQ ID NO: 2432792 - RNA, 15 nt, Human
cacugcuggcugccu

SEQ ID NO: 2432793 - RNA, 14 nt, Human
cacugcuggcugcc

SEQ ID NO: 2432794 - RNA, 13 nt, Human
cacugcuggcugc

SEQ ID NO: 2432795 - RNA, 12 nt, Human
cacugcuggcug

SEQ ID NO: 2432796 - RNA, 14 nt, Human
cacuggccaucccu

SEQ ID NO: 2432797 - RNA, 24 nt, Human
cacuggccaccaggcuggcgcagc

SEQ ID NO: 2432798 - RNA, 22 nt, Human
cacuggccaccaggcuggcgca

SEQ ID NO: 2432799 - RNA, 21 nt, Human
cacuggccaccaggcuggcgc

SEQ ID NO: 2432800 - RNA, 20 nt, Human
cacuggccaccaggcuggcg

SEQ ID NO: 2432801 - RNA, 19 nt, Human
cacuggccaccaggcuggc

SEQ ID NO: 2432802 - RNA, 18 nt, Human
cacuggccaccaggcugg

SEQ ID NO: 2432803 - RNA, 17 nt, Human
cacuggccaccaggcug

SEQ ID NO: 2432804 - RNA, 16 nt, Human
cacuggccaccaggcu

SEQ ID NO: 2432805 - RNA, 15 nt, Human
cacuggccaccaggc

SEQ ID NO: 2432806 - RNA, 14 nt, Human
cacuggccaccagg

SEQ ID NO: 2432807 - RNA, 12 nt, Human
cacuggccacca

SEQ ID NO: 2432808 - RNA, 10 nt, Human
cacuggccac

SEQ ID NO: 2432809 - RNA, 22 nt, Human
cacuggcauugucccugugccu

SEQ ID NO: 2432810 - RNA, 17 nt, Human
cacuggccacaguuguu

SEQ ID NO: 2432811 - RNA, 19 nt, Human
cacuggcauugucccugug

SEQ ID NO: 2432812 - RNA, 18 nt, Human
cacuggcauugucccugu

SEQ ID NO: 2432813 - RNA, 14 nt, Human
cacuggcauugucc

SEQ ID NO: 2432814 - RNA, 21 nt, Human
cacuggaugggcugcagcaga

SEQ ID NO: 2432815 - RNA, 16 nt, Human
cacuggcaaugaaaaa

SEQ ID NO: 2432816 - RNA, 15 nt, Human
cacuggaugcagaaa

SEQ ID NO: 2432817 - RNA, 23 nt, Human
cacuggaugcaaagaaaaucaga

SEQ ID NO: 2432818 - RNA, 22 nt, Human
cacuggaguuacauuaauguua

SEQ ID NO: 2432819 - RNA, 20 nt, Human
cacuggagugcagggaggag

SEQ ID NO: 2432820 - RNA, 19 nt, Human
cacuggaugcaaagaaaau

SEQ ID NO: 2432821 - RNA, 23 nt, Human
cacuggagugcagggaggagagg

SEQ ID NO: 2432822 - RNA, 18 nt, Human
cacuggagugcagggagg

SEQ ID NO: 2432823 - RNA, 17 nt, Human
cacuggagugcagggag

SEQ ID NO: 2432824 - RNA, 21 nt, Human
cacuggagguugaagccaagu

SEQ ID NO: 2432825 - RNA, 20 nt, Human
cacuggagguugaagccaag

SEQ ID NO: 2432826 - RNA, 16 nt, Human
cacuggagugcaggga

SEQ ID NO: 2432827 - RNA, 16 nt, Human
cacuggaguccagucu

SEQ ID NO: 2432828 - RNA, 18 nt, Human
cacuggagguugaagcca

SEQ ID NO: 2432829 - RNA, 22 nt, Human
cacuggaggagagaagaaugag

SEQ ID NO: 2432830 - RNA, 19 nt, Human
cacuggaggagagaagaau

SEQ ID NO: 2432831 - RNA, 18 nt, Human
cacuggaggagagaagaa

SEQ ID NO: 2432832 - RNA, 16 nt, Human
cacuggaggagagaag

SEQ ID NO: 2432833 - RNA, 15 nt, Human
cacuggagcccagga

SEQ ID NO: 2432834 - RNA, 11 nt, Human
cacuggagccc

SEQ ID NO: 2432835 - RNA, 12 nt, Human
cacuggagccca

SEQ ID NO: 2432836 - RNA, 13 nt, Human
cacuggagcccag

SEQ ID NO: 2432837 - RNA, 14 nt, Human
cacuggagcccagg

SEQ ID NO: 2432838 - RNA, 19 nt, Human
cacuggaacucagugugac

SEQ ID NO: 2432839 - RNA, 13 nt, Human
cacuggaacucag

SEQ ID NO: 2432840 - RNA, 24 nt, Human
cacuggaaaggggagagccugcug

SEQ ID NO: 2432841 - RNA, 23 nt, Human
cacuggaaaggggagagccugcu

SEQ ID NO: 2432842 - RNA, 22 nt, Human
cacuggaaaggggagagccugc

SEQ ID NO: 2432843 - RNA, 19 nt, Human
cacuggaaaggggagagcc

SEQ ID NO: 2432844 - RNA, 18 nt, Human
cacuggaaaggggagagc

SEQ ID NO: 2432845 - RNA, 16 nt, Human
cacuggaaaggggaga

SEQ ID NO: 2432846 - RNA, 17 nt, Human
cacuggaacacuaauga

SEQ ID NO: 2432847 - RNA, 15 nt, Human
cacuggaaaggggag

SEQ ID NO: 2432848 - RNA, 12 nt, Human
cacuggaaaggg

SEQ ID NO: 2432849 - RNA, 15 nt, Human
cacugcuugaggaaa

SEQ ID NO: 2432850 - RNA, 21 nt, Human
cacugcuuuuggucuguguga

SEQ ID NO: 2432851 - RNA, 16 nt, Human
cacuggagcaccaggc

SEQ ID NO: 2432852 - RNA, 17 nt, Human
cacuggagcaccaggca

SEQ ID NO: 2432853 - RNA, 20 nt, Human
cacuggagccaucucuuccu

SEQ ID NO: 2432854 - RNA, 21 nt, Human
cacuggagcaccaggcacgaa

SEQ ID NO: 2432855 - RNA, 19 nt, Human
cacuggacuccggcccucc

SEQ ID NO: 2432856 - RNA, 16 nt, Human
cacuggaccacugggc

SEQ ID NO: 2432857 - RNA, 15 nt, Human
cacuggacucaccuc

SEQ ID NO: 2432858 - RNA, 18 nt, Human
cacuggacucaccucccc

SEQ ID NO: 2432859 - RNA, 16 nt, Human
cacuggacuccggccc

SEQ ID NO: 2432860 - RNA, 15 nt, Human
cacuggacuccggcc

SEQ ID NO: 2432861 - RNA, 13 nt, Human
cacuugcagacuc

SEQ ID NO: 2432862 - RNA, 22 nt, Human
cacuugaggucaggaguuccua

SEQ ID NO: 2432863 - RNA, 16 nt, Human
cacuugaugugccauu

SEQ ID NO: 2432864 - RNA, 23 nt, Human
cacuugcacgcccaugugugagu

SEQ ID NO: 2432865 - RNA, 19 nt, Human
cacuugaugacccccaacc

SEQ ID NO: 2432866 - RNA, 18 nt, Human
cacuugaggucaggaguu

SEQ ID NO: 2432867 - RNA, 13 nt, Human
cacuugaguccag

SEQ ID NO: 2432868 - RNA, 19 nt, Human
cacuugacaucaacugcau

SEQ ID NO: 2432869 - RNA, 17 nt, Human
cacuugagaauuacccu

SEQ ID NO: 2432870 - RNA, 13 nt, Human
cacuugagaggau

SEQ ID NO: 2432871 - RNA, 15 nt, Human
cacuugaauccuagg

SEQ ID NO: 2432872 - RNA, 15 nt, Human
cacuucuuuuauaac

SEQ ID NO: 2432873 - RNA, 20 nt, Human
cacuugagaauuacccuuuu

SEQ ID NO: 2432874 - RNA, 20 nt, Human
cacuugaacccgggaggcag

SEQ ID NO: 2432875 - RNA, 21 nt, Human
cacuugaacccgggaggcaga

SEQ ID NO: 2432876 - RNA, 23 nt, Human
cacuugaacccgggaggcagagg

SEQ ID NO: 2432877 - RNA, 16 nt, Human
cacuugacaucaacug

SEQ ID NO: 2432878 - RNA, 18 nt, Human
cacuucuuguuccccacu

SEQ ID NO: 2432879 - RNA, 23 nt, Human
cacuucuucuuggucuuauuuau

SEQ ID NO: 2432880 - RNA, 22 nt, Human
cacuucugugagacccccacac

SEQ ID NO: 2432881 - RNA, 19 nt, Human
cacuucuggguggggcagu

SEQ ID NO: 2432882 - RNA, 20 nt, Human
cacuucugggcuucaucugg

SEQ ID NO: 2432883 - RNA, 18 nt, Human
cacuucuggguggggcag

SEQ ID NO: 2432884 - RNA, 19 nt, Human
cacuucuuacaauaauucu

SEQ ID NO: 2432885 - RNA, 20 nt, Human
cacuucugugagacccccac

SEQ ID NO: 2432886 - RNA, 21 nt, Human
cacuucugugagacccccaca

SEQ ID NO: 2432887 - RNA, 15 nt, Human
cacuuggucugugag

SEQ ID NO: 2432888 - RNA, 18 nt, Human
cacuuucuagccagagga

SEQ ID NO: 2432889 - RNA, 20 nt, Human
cacuuucuagccagaggaga

SEQ ID NO: 2432890 - RNA, 19 nt, Human
cacuuucuagccagaggag

SEQ ID NO: 2432891 - RNA, 11 nt, Human
cacuuggccaa

SEQ ID NO: 2432892 - RNA, 19 nt, Human
cacuuggcaucagcuggcg

SEQ ID NO: 2432893 - RNA, 17 nt, Human
cacuuggcaucagcugg

SEQ ID NO: 2432894 - RNA, 14 nt, Human
cacuuggcagcgcg

SEQ ID NO: 2432895 - RNA, 18 nt, Human
cacuuggacucuugcucu

SEQ ID NO: 2432896 - RNA, 17 nt, Human
cacuuggacucuugcuc

SEQ ID NO: 2432897 - RNA, 12 nt, Human
cacuuggagcca

SEQ ID NO: 2432898 - RNA, 22 nt, Human
cacuuggcccaaguggcagagc

SEQ ID NO: 2432899 - RNA, 19 nt, Human
cacuuggcccaaguggcag

SEQ ID NO: 2432900 - RNA, 20 nt, Human
cacuuggccaagcagggagg

SEQ ID NO: 2432901 - RNA, 18 nt, Human
cacuuggccaagcaggga

SEQ ID NO: 2432902 - RNA, 23 nt, Human
cacuuggcugcauaaauguggua

SEQ ID NO: 2432903 - RNA, 16 nt, Human
cacuuggccucuggau

SEQ ID NO: 2432904 - RNA, 22 nt, Human
cacuugcagacucuacagaggc

SEQ ID NO: 2432905 - RNA, 19 nt, Human
cacuugcagacucuacaga

SEQ ID NO: 2432906 - RNA, 18 nt, Human
cacuugcagacucuacag

SEQ ID NO: 2432907 - RNA, 14 nt, Human
cacuugcagacucu

SEQ ID NO: 2432908 - RNA, 24 nt, Human
cacuugcagacucuacagaggcca

SEQ ID NO: 2432909 - RNA, 12 nt, Human
cacuugcauuuc

SEQ ID NO: 2432910 - RNA, 13 nt, Human
cacuugcaucugu

SEQ ID NO: 2432911 - RNA, 14 nt, Human
cacuugauuccuug

SEQ ID NO: 2432912 - RNA, 18 nt, Human
cacuugccccuguuaccu

SEQ ID NO: 2432913 - RNA, 17 nt, Human
cacuugccucuuccuug

SEQ ID NO: 2432914 - RNA, 14 nt, Human
cacuugccucuucc

SEQ ID NO: 2432915 - RNA, 21 nt, Human
cacuugccucuuccuugaaga

SEQ ID NO: 2432916 - RNA, 13 nt, Human
cacuugccucuuc

SEQ ID NO: 2432917 - RNA, 12 nt, Human
cacuugccucuu

SEQ ID NO: 2432918 - RNA, 14 nt, Human
cacuugcccacacc

SEQ ID NO: 2432919 - RNA, 22 nt, Human
cacuugccgcgucgcccuccca

SEQ ID NO: 2432920 - RNA, 15 nt, Human
cacuucccugacacu

SEQ ID NO: 2432921 - RNA, 18 nt, Human
cacuucccucuguuucuc

SEQ ID NO: 2432922 - RNA, 17 nt, Human
cacuucccucuguuucu

SEQ ID NO: 2432923 - RNA, 16 nt, Human
cacuucccucuguuuc

SEQ ID NO: 2432924 - RNA, 15 nt, Human
cacuucccucuguuu

SEQ ID NO: 2432925 - RNA, 14 nt, Human
cacuucccucuguu

SEQ ID NO: 2432926 - RNA, 19 nt, Human
cacuucccucaucucuccu

SEQ ID NO: 2432927 - RNA, 21 nt, Human
cacuuccccuccuaccccucc

SEQ ID NO: 2432928 - RNA, 20 nt, Human
cacuucccugacacugcggg

SEQ ID NO: 2432929 - RNA, 19 nt, Human
cacuucccugggcaaauga

SEQ ID NO: 2432930 - RNA, 13 nt, Human
cacuucccugggc

SEQ ID NO: 2432931 - RNA, 11 nt, Human
cacuuccugcc

SEQ ID NO: 2432932 - RNA, 12 nt, Human
cacuuccugccu

SEQ ID NO: 2432933 - RNA, 17 nt, Human
cacuuccuacaagagca

SEQ ID NO: 2432934 - RNA, 23 nt, Human
cacuuccuacaagagcagccugu

SEQ ID NO: 2432935 - RNA, 14 nt, Human
cacuuccugccuaa

SEQ ID NO: 2432936 - RNA, 13 nt, Human
cacuuccugccua

SEQ ID NO: 2432937 - RNA, 12 nt, Human
cacuuccugucc

SEQ ID NO: 2432938 - RNA, 13 nt, Human
cacuuccugucca

SEQ ID NO: 2432939 - RNA, 14 nt, Human
cacuuccuguccag

SEQ ID NO: 2432940 - RNA, 17 nt, Human
cacuuccuguccagaga

SEQ ID NO: 2432941 - RNA, 24 nt, Human
cacuuccuguuugggccccucucc

SEQ ID NO: 2432942 - RNA, 18 nt, Human
cacuuccuguccagagag

SEQ ID NO: 2432943 - RNA, 20 nt, Human
cacuuccaccagccugcacu

SEQ ID NO: 2432944 - RNA, 20 nt, Human
cacuuccauaaucuggacuc

SEQ ID NO: 2432945 - RNA, 22 nt, Human
cacuucauugagaguuuugucu

SEQ ID NO: 2432946 - RNA, 14 nt, Human
cacuuccaccagcc

SEQ ID NO: 2432947 - RNA, 15 nt, Human
cacuuccaccagccu

SEQ ID NO: 2432948 - RNA, 16 nt, Human
cacuuccaccagccug

SEQ ID NO: 2432949 - RNA, 17 nt, Human
cacuuccaccagccugc

SEQ ID NO: 2432950 - RNA, 18 nt, Human
cacuuccaccagccugca

SEQ ID NO: 2432951 - RNA, 19 nt, Human
cacuuccaccagccugcac

SEQ ID NO: 2432952 - RNA, 15 nt, Human
cacuuccccuccuac

SEQ ID NO: 2432953 - RNA, 13 nt, Human
cacuuccccuccu

SEQ ID NO: 2432954 - RNA, 12 nt, Human
cacuuccccucc

SEQ ID NO: 2432955 - RNA, 23 nt, Human
cacuucccagguaagcaggagga

SEQ ID NO: 2432956 - RNA, 18 nt, Human
cacuuccauacagcucua

SEQ ID NO: 2432957 - RNA, 16 nt, Human
cacuucccuacaugga

SEQ ID NO: 2432958 - RNA, 17 nt, Human
cacuucuaaaugaagug

SEQ ID NO: 2432959 - RNA, 18 nt, Human
cacuucuaaaugaagugc

SEQ ID NO: 2432960 - RNA, 21 nt, Human
cacuucgcgugcccucgcugc

SEQ ID NO: 2432961 - RNA, 23 nt, Human
cacuucgugggaucugccccucc

SEQ ID NO: 2432962 - RNA, 17 nt, Human
cacuucuaaauagcaau

SEQ ID NO: 2432963 - RNA, 21 nt, Human
cacuucgggaggucgaggcag

SEQ ID NO: 2432964 - RNA, 23 nt, Human
cacuucgggaggucgaggcagga

SEQ ID NO: 2432965 - RNA, 18 nt, Human
cacuucugggcuucaucu

SEQ ID NO: 2432966 - RNA, 22 nt, Human
cacuucugccauauucuguugg

SEQ ID NO: 2432967 - RNA, 13 nt, Human
cacuucugaccac

SEQ ID NO: 2432968 - RNA, 19 nt, Human
cacuucugaccacacuucc

SEQ ID NO: 2432969 - RNA, 16 nt, Human
cacuucugaccacacu

SEQ ID NO: 2432970 - RNA, 20 nt, Human
cacuucaggcucuucuccuu

SEQ ID NO: 2432971 - RNA, 16 nt, Human
cacuucaggcucuucu

SEQ ID NO: 2432972 - RNA, 15 nt, Human
cacuucaggcucuuc

SEQ ID NO: 2432973 - RNA, 14 nt, Human
cacuucaggcucuu

SEQ ID NO: 2432974 - RNA, 12 nt, Human
cacuucagcuga

SEQ ID NO: 2432975 - RNA, 21 nt, Human
cacuucagcugacuuuucugu

SEQ ID NO: 2432976 - RNA, 22 nt, Human
cacuucaggguucuccucuccc

SEQ ID NO: 2432977 - RNA, 18 nt, Human
cacuucagagagcuggua

SEQ ID NO: 2432978 - RNA, 23 nt, Human
cacuucaggcucuucuccuuuca

SEQ ID NO: 2432979 - RNA, 18 nt, Human
cacuucaucuucucagcu

SEQ ID NO: 2432980 - RNA, 15 nt, Human
cacuucaucuucuca

SEQ ID NO: 2432981 - RNA, 13 nt, Human
cacuucaucuucu

SEQ ID NO: 2432982 - RNA, 16 nt, Human
cacuucauugagaguu

SEQ ID NO: 2432983 - RNA, 22 nt, Human
cacuucauucuugaaagcugug

SEQ ID NO: 2432984 - RNA, 14 nt, Human
cacuucauaaucca

SEQ ID NO: 2432985 - RNA, 15 nt, Human
cacuucauaauccag

SEQ ID NO: 2432986 - RNA, 18 nt, Human
cacuucaggucaggaguu

SEQ ID NO: 2432987 - RNA, 17 nt, Human
cacuuauuucauaaaca

SEQ ID NO: 2432988 - RNA, 21 nt, Human
cacuguugaaaauuauuuuaa

SEQ ID NO: 2432989 - RNA, 14 nt, Human
cacuuauuucauaa

SEQ ID NO: 2432990 - RNA, 22 nt, Human
cacuuauuggaacucugcuuga

SEQ ID NO: 2432991 - RNA, 17 nt, Human
cacuguugaauuuucuc

SEQ ID NO: 2432992 - RNA, 21 nt, Human
cacuuauuggaacucugcuug

SEQ ID NO: 2432993 - RNA, 16 nt, Human
cacuguugaaaauuau

SEQ ID NO: 2432994 - RNA, 14 nt, Human
cacuguugaaaauu

SEQ ID NO: 2432995 - RNA, 22 nt, Human
cacuguucccucugcuccugga

SEQ ID NO: 2432996 - RNA, 19 nt, Human
cacuguucugaaagugacu

SEQ ID NO: 2432997 - RNA, 18 nt, Human
cacuguugaaaauuauuu

SEQ ID NO: 2432998 - RNA, 17 nt, Human
cacuguugaaaauuauu

SEQ ID NO: 2432999 - RNA, 13 nt, Human
cacuguugaauuu

SEQ ID NO: 2433000 - RNA, 15 nt, Human
cacuucacagagugu

SEQ ID NO: 2433001 - RNA, 14 nt, Human
cacuucacagagug

SEQ ID NO: 2433002 - RNA, 14 nt, Human
cacuucacccugga

SEQ ID NO: 2433003 - RNA, 21 nt, Human
cacuucaagugaccaccagga

SEQ ID NO: 2433004 - RNA, 13 nt, Human
cacuucacagagu

SEQ ID NO: 2433005 - RNA, 18 nt, Human
cacuucacacacaggcaa

SEQ ID NO: 2433006 - RNA, 13 nt, Human
cacuucagagagc

SEQ ID NO: 2433007 - RNA, 15 nt, Human
cacuucagagagcug

SEQ ID NO: 2433008 - RNA, 16 nt, Human
cacuucagagagcugg

SEQ ID NO: 2433009 - RNA, 17 nt, Human
cacuucagagagcuggu

SEQ ID NO: 2433010 - RNA, 18 nt, Human
cacuucacuccagccugg

SEQ ID NO: 2433011 - RNA, 19 nt, Human
cacuucacagagugugcug

SEQ ID NO: 2433012 - RNA, 22 nt, Human
cacugugcugagucugaaggcu

SEQ ID NO: 2433013 - RNA, 21 nt, Human
cacugugcugagucugaaggc

SEQ ID NO: 2433014 - RNA, 20 nt, Human
cacugugcugagucugaagg

SEQ ID NO: 2433015 - RNA, 17 nt, Human
cacugugcugagucuga

SEQ ID NO: 2433016 - RNA, 15 nt, Human
cacugugcucagggc

SEQ ID NO: 2433017 - RNA, 13 nt, Human
cacugugcucagg

SEQ ID NO: 2433018 - RNA, 16 nt, Human
cacugugcucagggcu

SEQ ID NO: 2433019 - RNA, 17 nt, Human
cacugugcuuucuauug

SEQ ID NO: 2433020 - RNA, 23 nt, Human
cacugugcuuucuauuguacaga

SEQ ID NO: 2433021 - RNA, 22 nt, Human
cacugugcuuucuauuguacag

SEQ ID NO: 2433022 - RNA, 19 nt, Human
cacuguggguagacacaca

SEQ ID NO: 2433023 - RNA, 21 nt, Human
cacugugggaaggccagcugc

SEQ ID NO: 2433024 - RNA, 20 nt, Human
cacugugggaaggccagcug

SEQ ID NO: 2433025 - RNA, 17 nt, Human
cacugugggaaggccag

SEQ ID NO: 2433026 - RNA, 14 nt, Human
cacugugggaaggc

SEQ ID NO: 2433027 - RNA, 23 nt, Human
cacuguggacuuggucaccagcu

SEQ ID NO: 2433028 - RNA, 13 nt, Human
cacuguggacuug

SEQ ID NO: 2433029 - RNA, 24 nt, Human
cacuguggacuuggucaccagcuc

SEQ ID NO: 2433030 - RNA, 15 nt, Human
cacugugcugagucu

SEQ ID NO: 2433031 - RNA, 13 nt, Human
cacugugcugagu

SEQ ID NO: 2433032 - RNA, 16 nt, Human
cacugugcccuggugg

SEQ ID NO: 2433033 - RNA, 15 nt, Human
cacugugcccuggug

SEQ ID NO: 2433034 - RNA, 13 nt, Human
cacugugcccugg

SEQ ID NO: 2433035 - RNA, 12 nt, Human
cacugugcccug

SEQ ID NO: 2433036 - RNA, 18 nt, Human
cacugugcccugguggag

SEQ ID NO: 2433037 - RNA, 17 nt, Human
cacugugcccuggugga

SEQ ID NO: 2433038 - RNA, 21 nt, Human
cacugugcuaauaacagugca

SEQ ID NO: 2433039 - RNA, 19 nt, Human
cacugugcuaauaacagug

SEQ ID NO: 2433040 - RNA, 16 nt, Human
cacugugccaugugcc

SEQ ID NO: 2433041 - RNA, 15 nt, Human
cacugugccaugugc

SEQ ID NO: 2433042 - RNA, 18 nt, Human
cacugugccaugugccag

SEQ ID NO: 2433043 - RNA, 22 nt, Human
cacugugcccagcccggaccuu

SEQ ID NO: 2433044 - RNA, 17 nt, Human
cacugugcccagcccgg

SEQ ID NO: 2433045 - RNA, 22 nt, Human
cacugugcacaucugugucuug

SEQ ID NO: 2433046 - RNA, 20 nt, Human
cacugugcacaucugugucu

SEQ ID NO: 2433047 - RNA, 22 nt, Human
cacuguucucugcccuccaaga

SEQ ID NO: 2433048 - RNA, 21 nt, Human
cacuguucucugcccuccaag

SEQ ID NO: 2433049 - RNA, 19 nt, Human
cacuguucucugcccucca

SEQ ID NO: 2433050 - RNA, 17 nt, Human
cacuguucucugcccuc

SEQ ID NO: 2433051 - RNA, 16 nt, Human
cacuguucucugcccu

SEQ ID NO: 2433052 - RNA, 15 nt, Human
cacuguucucugccc

SEQ ID NO: 2433053 - RNA, 14 nt, Human
cacuguucucugcc

SEQ ID NO: 2433054 - RNA, 13 nt, Human
cacuguucucugc

SEQ ID NO: 2433055 - RNA, 24 nt, Human
cacuguggguagacacacaugaag

SEQ ID NO: 2433056 - RNA, 22 nt, Human
cacuguggguagacacacauga

SEQ ID NO: 2433057 - RNA, 15 nt, Human
cacuguggugucugu

SEQ ID NO: 2433058 - RNA, 12 nt, Human
cacuguguaagc

SEQ ID NO: 2433059 - RNA, 14 nt, Human
cacuguggugucug

SEQ ID NO: 2433060 - RNA, 16 nt, Human
cacugugggacucuuc

SEQ ID NO: 2433061 - RNA, 23 nt, Human
cacuguucuauucaucucaagga

SEQ ID NO: 2433062 - RNA, 20 nt, Human
cacuguucccucugcuccug

SEQ ID NO: 2433063 - RNA, 17 nt, Human
cacuguucccucugcuc

SEQ ID NO: 2433064 - RNA, 16 nt, Human
cacuguucccucugcu

SEQ ID NO: 2433065 - RNA, 14 nt, Human
cacuguucccucug

SEQ ID NO: 2433066 - RNA, 19 nt, Human
cacuguucccccugugcag

SEQ ID NO: 2433067 - RNA, 20 nt, Human
cacuguuccagccugcccuc

SEQ ID NO: 2433068 - RNA, 17 nt, Human
cacuguucccccugugc

SEQ ID NO: 2433069 - RNA, 23 nt, Human
cacuguuacuuucguacauuggc

SEQ ID NO: 2433070 - RNA, 15 nt, Human
cacuguuaucaaaac

SEQ ID NO: 2433071 - RNA, 12 nt, Human
cacuguguccug

SEQ ID NO: 2433072 - RNA, 15 nt, Human
cacuguguauuuaac

SEQ ID NO: 2433073 - RNA, 17 nt, Human
cacuguguccuggugcu

SEQ ID NO: 2433074 - RNA, 14 nt, Human
cacuguauaaauag

SEQ ID NO: 2433075 - RNA, 13 nt, Human
cacuguauaaaua

SEQ ID NO: 2433076 - RNA, 22 nt, Human
cacuguaguaaauggcaauucu

SEQ ID NO: 2433077 - RNA, 16 nt, Human
cacuguaugcuggacg

SEQ ID NO: 2433078 - RNA, 18 nt, Human
cacuguaugcuggacggc

SEQ ID NO: 2433079 - RNA, 18 nt, Human
cacuguauaaauaggaga

SEQ ID NO: 2433080 - RNA, 17 nt, Human
cacuguauaaauaggag

SEQ ID NO: 2433081 - RNA, 16 nt, Human
cacuguauaaauagga

SEQ ID NO: 2433082 - RNA, 15 nt, Human
cacuguauaaauagg

SEQ ID NO: 2433083 - RNA, 21 nt, Human
cacuguauaaauaggagagga

SEQ ID NO: 2433084 - RNA, 19 nt, Human
cacuguauaaauaggagag

SEQ ID NO: 2433085 - RNA, 23 nt, Human
cacuguauaaauaggagaggaug

SEQ ID NO: 2433086 - RNA, 18 nt, Human
cacuguacuugcucuuga

SEQ ID NO: 2433087 - RNA, 15 nt, Human
cacuguacuugcucu

SEQ ID NO: 2433088 - RNA, 19 nt, Human
cacuguacuugcucuugau

SEQ ID NO: 2433089 - RNA, 20 nt, Human
cacuguacaagguaccccuu

SEQ ID NO: 2433090 - RNA, 18 nt, Human
cacuguaaaaugaaauua

SEQ ID NO: 2433091 - RNA, 18 nt, Human
cacuguagaaugauuuca

SEQ ID NO: 2433092 - RNA, 21 nt, Human
cacuguagcauuacagugggu

SEQ ID NO: 2433093 - RNA, 15 nt, Human
cacuggcucuccaag

SEQ ID NO: 2433094 - RNA, 14 nt, Human
cacuggcucuccaa

SEQ ID NO: 2433095 - RNA, 12 nt, Human
cacuggcucucc

SEQ ID NO: 2433096 - RNA, 11 nt, Human
cacuggcucuc

SEQ ID NO: 2433097 - RNA, 23 nt, Human
cacuggcguagaaguuuuuguac

SEQ ID NO: 2433098 - RNA, 23 nt, Human
cacuggcgcaucauaugcaguga

SEQ ID NO: 2433099 - RNA, 17 nt, Human
cacuggccaucuccacc

SEQ ID NO: 2433100 - RNA, 20 nt, Human
cacuggccggagucagugcc

SEQ ID NO: 2433101 - RNA, 24 nt, Human
cacuggccccucaaaucguccagc

SEQ ID NO: 2433102 - RNA, 13 nt, Human
cacuggccccuca

SEQ ID NO: 2433103 - RNA, 17 nt, Human
cacuggccccugagauc

SEQ ID NO: 2433104 - RNA, 22 nt, Human
cacuggccccuagaaucagccu

SEQ ID NO: 2433105 - RNA, 18 nt, Human
cacuggcucucuccagga

SEQ ID NO: 2433106 - RNA, 17 nt, Human
cacuggcucucuccagg

SEQ ID NO: 2433107 - RNA, 16 nt, Human
cacuggcucucuccag

SEQ ID NO: 2433108 - RNA, 15 nt, Human
cacuggcucucucca

SEQ ID NO: 2433109 - RNA, 19 nt, Human
cacuggcucuccaagugcc

SEQ ID NO: 2433110 - RNA, 18 nt, Human
cacuggcucuccaagugc

SEQ ID NO: 2433111 - RNA, 17 nt, Human
cacuggcucuccaagug

SEQ ID NO: 2433112 - RNA, 16 nt, Human
cacuggcucuccaagu

SEQ ID NO: 2433113 - RNA, 22 nt, Human
cacuggcucuccaagugccaga

SEQ ID NO: 2433114 - RNA, 21 nt, Human
cacuggcucuccaagugccag

SEQ ID NO: 2433115 - RNA, 22 nt, Human
cacuguaagacucauucccuag

SEQ ID NO: 2433116 - RNA, 16 nt, Human
cacuguaaaaugaaau

SEQ ID NO: 2433117 - RNA, 17 nt, Human
cacuguaaaaugaaauu

SEQ ID NO: 2433118 - RNA, 13 nt, Human
cacuguaaaauga

SEQ ID NO: 2433119 - RNA, 21 nt, Human
cacuggcugagcggaugcauc

SEQ ID NO: 2433120 - RNA, 14 nt, Human
cacuguaaaaugaa

SEQ ID NO: 2433121 - RNA, 14 nt, Human
cacugucaagauga

SEQ ID NO: 2433122 - RNA, 16 nt, Human
cacugucacccuccac

SEQ ID NO: 2433123 - RNA, 14 nt, Human
cacuguauuuguau

SEQ ID NO: 2433124 - RNA, 20 nt, Human
cacugucacccuccaccucu

SEQ ID NO: 2433125 - RNA, 17 nt, Human
cacuguauuuguaucuc

SEQ ID NO: 2433126 - RNA, 16 nt, Human
cacugucacuguuucu

SEQ ID NO: 2433127 - RNA, 23 nt, Human
cacugucccucaaaugacccaaa

SEQ ID NO: 2433128 - RNA, 16 nt, Human
cacugucccucaaaug

SEQ ID NO: 2433129 - RNA, 20 nt, Human
cacugucacuuugcucuggg

SEQ ID NO: 2433130 - RNA, 19 nt, Human
cacugucacuuugcucugg

SEQ ID NO: 2433131 - RNA, 17 nt, Human
cacugucacuuugcucu

SEQ ID NO: 2433132 - RNA, 15 nt, Human
cacugucaggaagaa

SEQ ID NO: 2433133 - RNA, 18 nt, Human
cacugucacuguuucucu

SEQ ID NO: 2433134 - RNA, 19 nt, Human
cacugucacuguuucucug

SEQ ID NO: 2433135 - RNA, 16 nt, Human
cacugucacuuugcuc

SEQ ID NO: 2433136 - RNA, 13 nt, Human
cacugucacuuug

SEQ ID NO: 2433137 - RNA, 22 nt, Human
cacugucacuguuucucugcug

SEQ ID NO: 2433138 - RNA, 12 nt, Human
cacuguccuggg

SEQ ID NO: 2433139 - RNA, 11 nt, Human
cacuguccugg

SEQ ID NO: 2433140 - RNA, 21 nt, Human
cacuguccugcuccacagugu

SEQ ID NO: 2433141 - RNA, 20 nt, Human
cacuguccugcuccacagug

SEQ ID NO: 2433142 - RNA, 16 nt, Human
cacuguccugcuccac

SEQ ID NO: 2433143 - RNA, 15 nt, Human
cacuguccugcucca

SEQ ID NO: 2433144 - RNA, 13 nt, Human
cacuguccugcuc

SEQ ID NO: 2433145 - RNA, 12 nt, Human
cacuguccugcu

SEQ ID NO: 2433146 - RNA, 16 nt, Human
cacuguccugggcgcc

SEQ ID NO: 2433147 - RNA, 15 nt, Human
cacuguccugggcgc

SEQ ID NO: 2433148 - RNA, 14 nt, Human
cacuguccugggcg

SEQ ID NO: 2433149 - RNA, 13 nt, Human
cacuguccugggc

SEQ ID NO: 2433150 - RNA, 15 nt, Human
cacuguccugggccu

SEQ ID NO: 2433151 - RNA, 18 nt, Human
cacuguccugggccugca

SEQ ID NO: 2433152 - RNA, 17 nt, Human
cacugucccuugccuca

SEQ ID NO: 2433153 - RNA, 12 nt, Human
cacugucccuug

SEQ ID NO: 2433154 - RNA, 18 nt, Human
cacugucccuugccucaa

SEQ ID NO: 2433155 - RNA, 14 nt, Human
cacuguccuccaag

SEQ ID NO: 2433156 - RNA, 17 nt, Human
cacuguccuccaagcca

SEQ ID NO: 2433157 - RNA, 11 nt, Human
cacuguccugc

SEQ ID NO: 2433158 - RNA, 18 nt, Human
cacugucccucaaaugac

SEQ ID NO: 2433159 - RNA, 18 nt, Human
cacuguccuccaagccag

SEQ ID NO: 2433160 - RNA, 13 nt, Human
cacugugaaggac

SEQ ID NO: 2433161 - RNA, 14 nt, Human
cacugugaaggacc

SEQ ID NO: 2433162 - RNA, 13 nt, Human
cacugucuuuccu

SEQ ID NO: 2433163 - RNA, 13 nt, Human
cacugugaagaga

SEQ ID NO: 2433164 - RNA, 18 nt, Human
cacugucugagaguuuag

SEQ ID NO: 2433165 - RNA, 13 nt, Human
cacugucugagag

SEQ ID NO: 2433166 - RNA, 11 nt, Human
cacugucugag

SEQ ID NO: 2433167 - RNA, 10 nt, Human
cacugucuga

SEQ ID NO: 2433168 - RNA, 21 nt, Human
cacuguccugggcgcccugga

SEQ ID NO: 2433169 - RNA, 19 nt, Human
cacuguccugggcgcccug

SEQ ID NO: 2433170 - RNA, 23 nt, Human
cacuguccugggcgcccuggaag

SEQ ID NO: 2433171 - RNA, 12 nt, Human
cacugucucagu

SEQ ID NO: 2433172 - RNA, 23 nt, Human
cacugucugagaguuuaguugua

SEQ ID NO: 2433173 - RNA, 14 nt, Human
cacugucuucuuca

SEQ ID NO: 2433174 - RNA, 14 nt, Human
cacugucuugaaga

SEQ ID NO: 2433175 - RNA, 17 nt, Human
cacugugaaggacccuu

SEQ ID NO: 2433176 - RNA, 15 nt, Human
cacugugaaggaccc

SEQ ID NO: 2433177 - RNA, 14 nt, Human
cacugugaccccca

SEQ ID NO: 2433178 - RNA, 15 nt, Human
cacugugacccccag

SEQ ID NO: 2433179 - RNA, 19 nt, Human
cacugugacccccagcucc

SEQ ID NO: 2433180 - RNA, 20 nt, Human
cacugugacccccagcuccg

SEQ ID NO: 2433181 - RNA, 22 nt, Human
cacugugacccccagcuccggc

SEQ ID NO: 2433182 - RNA, 14 nt, Human
cacugugccaugug

SEQ ID NO: 2433183 - RNA, 23 nt, Human
cacugugacccccagcuccggcc

SEQ ID NO: 2433184 - RNA, 16 nt, Human
cacucccugcaaccug

SEQ ID NO: 2433185 - RNA, 13 nt, Human
cacucccugcaac

SEQ ID NO: 2433186 - RNA, 12 nt, Human
cacucccugcaa

SEQ ID NO: 2433187 - RNA, 13 nt, Human
cacucauuccugu

SEQ ID NO: 2433188 - RNA, 21 nt, Human
cacucccggcacuccaugcuu

SEQ ID NO: 2433189 - RNA, 22 nt, Human
cacucauugaccugaggcccuu

SEQ ID NO: 2433190 - RNA, 20 nt, Human
cacucauugaccugaggccc

SEQ ID NO: 2433191 - RNA, 19 nt, Human
cacucauugaccugaggcc

SEQ ID NO: 2433192 - RNA, 18 nt, Human
cacucauugaccugaggc

SEQ ID NO: 2433193 - RNA, 16 nt, Human
cacucaguccauagca

SEQ ID NO: 2433194 - RNA, 21 nt, Human
cacucaggaggcugaggcagg

SEQ ID NO: 2433195 - RNA, 19 nt, Human
cacucaggaggcugaggca

SEQ ID NO: 2433196 - RNA, 20 nt, Human
cacucaggaggcugaggcag

SEQ ID NO: 2433197 - RNA, 19 nt, Human
cacucaggccaacaagcca

SEQ ID NO: 2433198 - RNA, 22 nt, Human
cacucagcucuuggcuccacug

SEQ ID NO: 2433199 - RNA, 15 nt, Human
cacucauuccuguag

SEQ ID NO: 2433200 - RNA, 17 nt, Human
cacucaugcugaaagcc

SEQ ID NO: 2433201 - RNA, 15 nt, Human
cacucaugcugaaag

SEQ ID NO: 2433202 - RNA, 15 nt, Human
cacucauugaccuga

SEQ ID NO: 2433203 - RNA, 14 nt, Human
cacucaugcugaaa

SEQ ID NO: 2433204 - RNA, 13 nt, Human
cacucaugcugaa

SEQ ID NO: 2433205 - RNA, 12 nt, Human
cacucaugcuga

SEQ ID NO: 2433206 - RNA, 19 nt, Human
cacucagcuuccuacccac

SEQ ID NO: 2433207 - RNA, 16 nt, Human
cacucauccccucacu

SEQ ID NO: 2433208 - RNA, 22 nt, Human
cacuccuagagaacgcagcccu

SEQ ID NO: 2433209 - RNA, 21 nt, Human
cacuccuagagaacgcagccc

SEQ ID NO: 2433210 - RNA, 19 nt, Human
cacuccuagagaacgcagc

SEQ ID NO: 2433211 - RNA, 12 nt, Human
cacuccuagaga

SEQ ID NO: 2433212 - RNA, 14 nt, Human
cacuccuaccuggu

SEQ ID NO: 2433213 - RNA, 13 nt, Human
cacuccuaccugg

SEQ ID NO: 2433214 - RNA, 18 nt, Human
cacuccuacaccuaacuc

SEQ ID NO: 2433215 - RNA, 20 nt, Human
cacuccggccugaugacaga

SEQ ID NO: 2433216 - RNA, 22 nt, Human
cacuccggugugccugcagccc

SEQ ID NO: 2433217 - RNA, 21 nt, Human
cacucccuugguggcaagagc

SEQ ID NO: 2433218 - RNA, 19 nt, Human
cacuccgagaggugggcca

SEQ ID NO: 2433219 - RNA, 17 nt, Human
cacuccggugugccugc

SEQ ID NO: 2433220 - RNA, 19 nt, Human
cacuccggugugccugcag

SEQ ID NO: 2433221 - RNA, 20 nt, Human
cacuccggugugccugcagc

SEQ ID NO: 2433222 - RNA, 21 nt, Human
cacuccggugugccugcagcc

SEQ ID NO: 2433223 - RNA, 17 nt, Human
cacucccugcaaccuga

SEQ ID NO: 2433224 - RNA, 14 nt, Human
cacucccuccauca

SEQ ID NO: 2433225 - RNA, 15 nt, Human
cacucccuccaucaa

SEQ ID NO: 2433226 - RNA, 22 nt, Human
cacucccuucccaugacccagg

SEQ ID NO: 2433227 - RNA, 19 nt, Human
cacucccuucccauaagcu

SEQ ID NO: 2433228 - RNA, 23 nt, Human
cacucccuucuaccugccacuca

SEQ ID NO: 2433229 - RNA, 22 nt, Human
cacucccuucuaccugccacuc

SEQ ID NO: 2433230 - RNA, 13 nt, Human
cacucccuugggc

SEQ ID NO: 2433231 - RNA, 16 nt, Human
cacucccuugggcucc

SEQ ID NO: 2433232 - RNA, 20 nt, Human
cacucccuugggcucccugu

SEQ ID NO: 2433233 - RNA, 20 nt, Human
cacucccuucuaccugccac

SEQ ID NO: 2433234 - RNA, 19 nt, Human
cacucccuucuaccugcca

SEQ ID NO: 2433235 - RNA, 18 nt, Human
cacucccuucuaccugcc

SEQ ID NO: 2433236 - RNA, 17 nt, Human
cacucccuucuaccugc

SEQ ID NO: 2433237 - RNA, 12 nt, Human
cacuccucugac

SEQ ID NO: 2433238 - RNA, 13 nt, Human
cacuccucugacu

SEQ ID NO: 2433239 - RNA, 18 nt, Human
cacuccuccuagccaccc

SEQ ID NO: 2433240 - RNA, 13 nt, Human
cacuccuccuagc

SEQ ID NO: 2433241 - RNA, 15 nt, Human
cacuccuccaaagga

SEQ ID NO: 2433242 - RNA, 20 nt, Human
cacuccugagaccccuggcc

SEQ ID NO: 2433243 - RNA, 16 nt, Human
cacuccugagaccccu

SEQ ID NO: 2433244 - RNA, 14 nt, Human
cacuccugagaccc

SEQ ID NO: 2433245 - RNA, 20 nt, Human
cacuccucugacucagggcu

SEQ ID NO: 2433246 - RNA, 21 nt, Human
cacuccucugacucagggcuc

SEQ ID NO: 2433247 - RNA, 23 nt, Human
cacuccucugacucagggcuccu

SEQ ID NO: 2433248 - RNA, 21 nt, Human
cacuccuucacagaugggugc

SEQ ID NO: 2433249 - RNA, 14 nt, Human
cacuccuucacaga

SEQ ID NO: 2433250 - RNA, 22 nt, Human
cacuccugagaccccuggccuc

SEQ ID NO: 2433251 - RNA, 21 nt, Human
cacuccugagaccccuggccu

SEQ ID NO: 2433252 - RNA, 13 nt, Human
cacuccugccaag

SEQ ID NO: 2433253 - RNA, 14 nt, Human
cacuccugccaagg

SEQ ID NO: 2433254 - RNA, 23 nt, Human
cacuccugagaccccuggccucc

SEQ ID NO: 2433255 - RNA, 14 nt, Human
cacucuggcagcuc

SEQ ID NO: 2433256 - RNA, 13 nt, Human
cacucuggcagcu

SEQ ID NO: 2433257 - RNA, 12 nt, Human
cacucuggcagc

SEQ ID NO: 2433258 - RNA, 15 nt, Human
cacucugcuucucug

SEQ ID NO: 2433259 - RNA, 14 nt, Human
cacucugcuucucu

SEQ ID NO: 2433260 - RNA, 13 nt, Human
cacucugcuucuc

SEQ ID NO: 2433261 - RNA, 12 nt, Human
cacucugcuucu

SEQ ID NO: 2433262 - RNA, 12 nt, Human
cacucugcugcu

SEQ ID NO: 2433263 - RNA, 11 nt, Human
cacucugcugc

SEQ ID NO: 2433264 - RNA, 14 nt, Human
cacucugcugcuua

SEQ ID NO: 2433265 - RNA, 21 nt, Human
cacucugcucugcccuuguuc

SEQ ID NO: 2433266 - RNA, 16 nt, Human
cacucugcucugcccu

SEQ ID NO: 2433267 - RNA, 15 nt, Human
cacucugcucugccc

SEQ ID NO: 2433268 - RNA, 19 nt, Human
cacucugcuucucugacuu

SEQ ID NO: 2433269 - RNA, 18 nt, Human
cacucugcuucucugacu

SEQ ID NO: 2433270 - RNA, 17 nt, Human
cacucugcuucucugac

SEQ ID NO: 2433271 - RNA, 16 nt, Human
cacucugcuucucuga

SEQ ID NO: 2433272 - RNA, 21 nt, Human
cacucugcuucucugacuucu

SEQ ID NO: 2433273 - RNA, 16 nt, Human
cacucugcuuguuauu

SEQ ID NO: 2433274 - RNA, 19 nt, Human
cacucugcuuugacugagc

SEQ ID NO: 2433275 - RNA, 21 nt, Human
cacucugcuuugacugagcag

SEQ ID NO: 2433276 - RNA, 20 nt, Human
cacucucugaagaugaucau

SEQ ID NO: 2433277 - RNA, 14 nt, Human
cacucucugaagau

SEQ ID NO: 2433278 - RNA, 13 nt, Human
cacucucugaaga

SEQ ID NO: 2433279 - RNA, 23 nt, Human
cacucucugaagaugaucauuug

SEQ ID NO: 2433280 - RNA, 19 nt, Human
cacucugacuggcacaguc

SEQ ID NO: 2433281 - RNA, 12 nt, Human
cacucugcucug

SEQ ID NO: 2433282 - RNA, 18 nt, Human
cacucugcucgccuuagc

SEQ ID NO: 2433283 - RNA, 15 nt, Human
cacucugcucgccuu

SEQ ID NO: 2433284 - RNA, 20 nt, Human
cacucugccucugccugcau

SEQ ID NO: 2433285 - RNA, 15 nt, Human
cacucugccucugcc

SEQ ID NO: 2433286 - RNA, 17 nt, Human
cacucugccucugccug

SEQ ID NO: 2433287 - RNA, 19 nt, Human
cacucugccucugccugca

SEQ ID NO: 2433288 - RNA, 23 nt, Human
cacucugagacucgcgacaaugc

SEQ ID NO: 2433289 - RNA, 12 nt, Human
cacucugagacu

SEQ ID NO: 2433290 - RNA, 12 nt, Human
cacucuccuugg

SEQ ID NO: 2433291 - RNA, 20 nt, Human
cacucuccuugcuacccaga

SEQ ID NO: 2433292 - RNA, 17 nt, Human
cacucuccuugcuaccc

SEQ ID NO: 2433293 - RNA, 21 nt, Human
cacucuccuugcuacccagaa

SEQ ID NO: 2433294 - RNA, 14 nt, Human
cacucuacuuagca

SEQ ID NO: 2433295 - RNA, 18 nt, Human
cacucuacccucccaccc

SEQ ID NO: 2433296 - RNA, 19 nt, Human
cacucuacccucccacccc

SEQ ID NO: 2433297 - RNA, 17 nt, Human
cacucuacccuauacaa

SEQ ID NO: 2433298 - RNA, 15 nt, Human
cacucuacccuccca

SEQ ID NO: 2433299 - RNA, 16 nt, Human
cacucuacccucccac

SEQ ID NO: 2433300 - RNA, 17 nt, Human
cacucuacccucccacc

SEQ ID NO: 2433301 - RNA, 19 nt, Human
cacucuaggggucaggcuc

SEQ ID NO: 2433302 - RNA, 17 nt, Human
cacucuaggggucaggc

SEQ ID NO: 2433303 - RNA, 22 nt, Human
cacucuaggggucaggcuccau

SEQ ID NO: 2433304 - RNA, 19 nt, Human
cacucuagggcaguggagu

SEQ ID NO: 2433305 - RNA, 15 nt, Human
cacucuagggcagug

SEQ ID NO: 2433306 - RNA, 15 nt, Human
cacucuagccugggc

SEQ ID NO: 2433307 - RNA, 13 nt, Human
cacucuagccugg

SEQ ID NO: 2433308 - RNA, 21 nt, Human
cacucuacccucccacccccu

SEQ ID NO: 2433309 - RNA, 17 nt, Human
cacucucauuccccagg

SEQ ID NO: 2433310 - RNA, 20 nt, Human
cacucucccccacccccucc

SEQ ID NO: 2433311 - RNA, 18 nt, Human
cacucucccccacccccu

SEQ ID NO: 2433312 - RNA, 16 nt, Human
cacucucccccacccc

SEQ ID NO: 2433313 - RNA, 21 nt, Human
cacucuccccacacuaaccug

SEQ ID NO: 2433314 - RNA, 18 nt, Human
cacucucauuccccaggu

SEQ ID NO: 2433315 - RNA, 12 nt, Human
cacucuccccac

SEQ ID NO: 2433316 - RNA, 14 nt, Human
cacucuccccacac

SEQ ID NO: 2433317 - RNA, 15 nt, Human
cacucuccccacacu

SEQ ID NO: 2433318 - RNA, 19 nt, Human
cacucuaaaagguucaggg

SEQ ID NO: 2433319 - RNA, 18 nt, Human
cacucuaaaagguucagg

SEQ ID NO: 2433320 - RNA, 20 nt, Human
cacucuaaaagguucaggga

SEQ ID NO: 2433321 - RNA, 22 nt, Human
cacucgggaggcugagacagga

SEQ ID NO: 2433322 - RNA, 22 nt, Human
cacucggcauuucaaaugugcu

SEQ ID NO: 2433323 - RNA, 18 nt, Human
cacucgggaggcugagac

SEQ ID NO: 2433324 - RNA, 16 nt, Human
cacucgcuucccccau

SEQ ID NO: 2433325 - RNA, 20 nt, Human
cacucgcuucccccauagcc

SEQ ID NO: 2433326 - RNA, 22 nt, Human
cacucgcccgcccacuguccug

SEQ ID NO: 2433327 - RNA, 18 nt, Human
cacucgcccgcccacugu

SEQ ID NO: 2433328 - RNA, 17 nt, Human
cacucgcccgcccacug

SEQ ID NO: 2433329 - RNA, 16 nt, Human
cacucgcccgcccacu

SEQ ID NO: 2433330 - RNA, 23 nt, Human
cacucgcccgcccacuguccugg

SEQ ID NO: 2433331 - RNA, 13 nt, Human
cacucgcuucccc

SEQ ID NO: 2433332 - RNA, 15 nt, Human
cacucgcccgcccac

SEQ ID NO: 2433333 - RNA, 15 nt, Human
cacuccuuccugcca

SEQ ID NO: 2433334 - RNA, 17 nt, Human
cacuccuuccugccacc

SEQ ID NO: 2433335 - RNA, 18 nt, Human
cacuccuuccugccaccu

SEQ ID NO: 2433336 - RNA, 21 nt, Human
cacuccuuccugccaccugcu

SEQ ID NO: 2433337 - RNA, 24 nt, Human
cacuccuuccugccaccugcugcu

SEQ ID NO: 2433338 - RNA, 19 nt, Human
cacuccuggggccucuugg

SEQ ID NO: 2433339 - RNA, 13 nt, Human
cacuccuguacac

SEQ ID NO: 2433340 - RNA, 18 nt, Human
cacuccuguuacuuaccu

SEQ ID NO: 2433341 - RNA, 11 nt, Human
cacuccuuccu

SEQ ID NO: 2433342 - RNA, 11 nt, Human
cacuccugggg

SEQ ID NO: 2433343 - RNA, 12 nt, Human
cacuccuggggc

SEQ ID NO: 2433344 - RNA, 10 nt, Human
cacuccuggg

SEQ ID NO: 2433345 - RNA, 17 nt, Human
cacuaagagagaaugag

SEQ ID NO: 2433346 - RNA, 11 nt, Human
cacuaacuaga

SEQ ID NO: 2433347 - RNA, 20 nt, Human
cacuaacuagagcagcccug

SEQ ID NO: 2433348 - RNA, 18 nt, Human
cacuaaccacgcuggacc

SEQ ID NO: 2433349 - RNA, 14 nt, Human
cacuaaccugaccg

SEQ ID NO: 2433350 - RNA, 13 nt, Human
cacuaaccugacc

SEQ ID NO: 2433351 - RNA, 20 nt, Human
cacuaacguugagccccugg

SEQ ID NO: 2433352 - RNA, 19 nt, Human
cacuaacgacuucagggca

SEQ ID NO: 2433353 - RNA, 12 nt, Human
cacuaaggggcc

SEQ ID NO: 2433354 - RNA, 13 nt, Human
cacuaaggggccc

SEQ ID NO: 2433355 - RNA, 23 nt, Human
cacuaaggggcccggccagccau

SEQ ID NO: 2433356 - RNA, 14 nt, Human
cacuaaguuauagu

SEQ ID NO: 2433357 - RNA, 18 nt, Human
cacuaaggugugcucuga

SEQ ID NO: 2433358 - RNA, 13 nt, Human
cacuaagcagagg

SEQ ID NO: 2433359 - RNA, 14 nt, Human
cacuaagcagagga

SEQ ID NO: 2433360 - RNA, 15 nt, Human
cacuaagcagaggag

SEQ ID NO: 2433361 - RNA, 16 nt, Human
cacuaagcagaggagg

SEQ ID NO: 2433362 - RNA, 17 nt, Human
cacuaagcagaggaggg

SEQ ID NO: 2433363 - RNA, 18 nt, Human
cacuaagcagaggagggg

SEQ ID NO: 2433364 - RNA, 20 nt, Human
cacuaagcagaggaggggcc

SEQ ID NO: 2433365 - RNA, 21 nt, Human
cacuaagcagaggaggggccg

SEQ ID NO: 2433366 - RNA, 17 nt, Human
cacuaaggugugcucug

SEQ ID NO: 2433367 - RNA, 16 nt, Human
cacuaaccacgcugga

SEQ ID NO: 2433368 - RNA, 15 nt, Human
cacuaaccacgcugg

SEQ ID NO: 2433369 - RNA, 14 nt, Human
cacuaaccacgcug

SEQ ID NO: 2433370 - RNA, 21 nt, Human
cacuaaauugacacuuaaaaa

SEQ ID NO: 2433371 - RNA, 16 nt, Human
cacuaacaugauuugg

SEQ ID NO: 2433372 - RNA, 22 nt, Human
cacuaaaguauguaaaguaugu

SEQ ID NO: 2433373 - RNA, 16 nt, Human
cacuaaaguauguaaa

SEQ ID NO: 2433374 - RNA, 15 nt, Human
cacuaaaguauguaa

SEQ ID NO: 2433375 - RNA, 13 nt, Human
cacuaaagcagug

SEQ ID NO: 2433376 - RNA, 19 nt, Human
cacuauaucuguauauaaa

SEQ ID NO: 2433377 - RNA, 14 nt, Human
cacuauaucuguau

SEQ ID NO: 2433378 - RNA, 23 nt, Human
cacuauauaggcaucacauuuuu

SEQ ID NO: 2433379 - RNA, 14 nt, Human
cacuauacagauuc

SEQ ID NO: 2433380 - RNA, 19 nt, Human
cacuauaaaugguguuuuu

SEQ ID NO: 2433381 - RNA, 21 nt, Human
cacuauagccuaggugacaga

SEQ ID NO: 2433382 - RNA, 14 nt, Human
cacuauagccuagg

SEQ ID NO: 2433383 - RNA, 18 nt, Human
cacuauaauguaagcucu

SEQ ID NO: 2433384 - RNA, 19 nt, Human
cacuaguauuucuaugaaa

SEQ ID NO: 2433385 - RNA, 14 nt, Human
cacuaguauuucua

SEQ ID NO: 2433386 - RNA, 14 nt, Human
cacuauaauguaag

SEQ ID NO: 2433387 - RNA, 15 nt, Human
cacuagugcaaauca

SEQ ID NO: 2433388 - RNA, 17 nt, Human
cacuaaguuauaguaua

SEQ ID NO: 2433389 - RNA, 12 nt, Human
cacuaguuuugu

SEQ ID NO: 2433390 - RNA, 16 nt, Human
cacuagugcaaaucau

SEQ ID NO: 2433391 - RNA, 17 nt, Human
cacuaguuuugugccag

SEQ ID NO: 2433392 - RNA, 12 nt, Human
cacuauaaaugg

SEQ ID NO: 2433393 - RNA, 19 nt, Human
cacuauguugcccaggcag

SEQ ID NO: 2433394 - RNA, 18 nt, Human
cacuauguugcccaggca

SEQ ID NO: 2433395 - RNA, 17 nt, Human
cacuauguugcccaggc

SEQ ID NO: 2433396 - RNA, 16 nt, Human
cacuauguugcccagg

SEQ ID NO: 2433397 - RNA, 18 nt, Human
cacuaucccggcugcccu

SEQ ID NO: 2433398 - RNA, 19 nt, Human
cacuaucccggcugcccuu

SEQ ID NO: 2433399 - RNA, 14 nt, Human
cacuaugaagaugu

SEQ ID NO: 2433400 - RNA, 17 nt, Human
cacuaucugggugcaug

SEQ ID NO: 2433401 - RNA, 11 nt, Human
cacuaucuggg

SEQ ID NO: 2433402 - RNA, 21 nt, Human
cacuaugaagauguuucaaaa

SEQ ID NO: 2433403 - RNA, 15 nt, Human
cacuauguugcccag

SEQ ID NO: 2433404 - RNA, 17 nt, Human
cacuaugguauuugagu

SEQ ID NO: 2433405 - RNA, 13 nt, Human
cacuauggugcca

SEQ ID NO: 2433406 - RNA, 14 nt, Human
cacuaugaaucuau

SEQ ID NO: 2433407 - RNA, 18 nt, Human
cacuaucugggugcauga

SEQ ID NO: 2433408 - RNA, 17 nt, Human
cacuaugaagcuaccuc

SEQ ID NO: 2433409 - RNA, 17 nt, Human
cacucagaagacacuga

SEQ ID NO: 2433410 - RNA, 16 nt, Human
cacucagaagacacug

SEQ ID NO: 2433411 - RNA, 14 nt, Human
cacucacuccugag

SEQ ID NO: 2433412 - RNA, 12 nt, Human
cacucacuccug

SEQ ID NO: 2433413 - RNA, 22 nt, Human
cacucacuaggcccccacuugc

SEQ ID NO: 2433414 - RNA, 17 nt, Human
cacucacuaggccccca

SEQ ID NO: 2433415 - RNA, 16 nt, Human
cacucacuaggccccc

SEQ ID NO: 2433416 - RNA, 12 nt, Human
cacucagaagac

SEQ ID NO: 2433417 - RNA, 20 nt, Human
cacucacauuuauucugcuc

SEQ ID NO: 2433418 - RNA, 19 nt, Human
cacucacauuuauucugcu

SEQ ID NO: 2433419 - RNA, 21 nt, Human
cacucacccaugugccaaggu

SEQ ID NO: 2433420 - RNA, 16 nt, Human
cacucacccaugugcc

SEQ ID NO: 2433421 - RNA, 21 nt, Human
cacucaccaguguccccucca

SEQ ID NO: 2433422 - RNA, 14 nt, Human
cacucaccgaagcc

SEQ ID NO: 2433423 - RNA, 22 nt, Human
cacucacccaugugccaaggug

SEQ ID NO: 2433424 - RNA, 17 nt, Human
cacucaccgaagccacu

SEQ ID NO: 2433425 - RNA, 23 nt, Human
cacucacagaccuggagccccug

SEQ ID NO: 2433426 - RNA, 19 nt, Human
cacucacagaccuggagcc

SEQ ID NO: 2433427 - RNA, 18 nt, Human
cacucaccaguguccccu

SEQ ID NO: 2433428 - RNA, 19 nt, Human
cacucagaagacacugaug

SEQ ID NO: 2433429 - RNA, 18 nt, Human
cacucagaagacacugau

SEQ ID NO: 2433430 - RNA, 17 nt, Human
cacucacugcggagaac

SEQ ID NO: 2433431 - RNA, 15 nt, Human
cacucacuccugaga

SEQ ID NO: 2433432 - RNA, 22 nt, Human
cacucagaagacacugaugggc

SEQ ID NO: 2433433 - RNA, 12 nt, Human
cacucagaccug

SEQ ID NO: 2433434 - RNA, 12 nt, Human
cacucagcacaa

SEQ ID NO: 2433435 - RNA, 13 nt, Human
cacucagcacaag

SEQ ID NO: 2433436 - RNA, 15 nt, Human
cacucagcacaaggc

SEQ ID NO: 2433437 - RNA, 22 nt, Human
cacucagcacaaggccaucugg

SEQ ID NO: 2433438 - RNA, 21 nt, Human
cacuauguugcccaggcaggu

SEQ ID NO: 2433439 - RNA, 20 nt, Human
cacuauguugcccaggcagg

SEQ ID NO: 2433440 - RNA, 14 nt, Human
cacuauuuccuuua

SEQ ID NO: 2433441 - RNA, 13 nt, Human
cacuauuuccuuu

SEQ ID NO: 2433442 - RNA, 22 nt, Human
cacuauuggcugggaguggugg

SEQ ID NO: 2433443 - RNA, 22 nt, Human
cacuauggugccaauggaaccu

SEQ ID NO: 2433444 - RNA, 15 nt, Human
cacuauggugccaau

SEQ ID NO: 2433445 - RNA, 19 nt, Human
cacuauuuaucugugcaaa

SEQ ID NO: 2433446 - RNA, 17 nt, Human
cacuauuuuuauuuaua

SEQ ID NO: 2433447 - RNA, 13 nt, Human
cacuauuuuaugc

SEQ ID NO: 2433448 - RNA, 17 nt, Human
cacuauuuccuuuauaa

SEQ ID NO: 2433449 - RNA, 14 nt, Human
cacuauuuuaugca

SEQ ID NO: 2433450 - RNA, 22 nt, Human
cacuauuuuuauuuauauuuuu

SEQ ID NO: 2433451 - RNA, 15 nt, Human
cacucaaaagcuggg

SEQ ID NO: 2433452 - RNA, 17 nt, Human
cacucaaaagcugggca

SEQ ID NO: 2433453 - RNA, 18 nt, Human
cacucaaaagcugggcag

SEQ ID NO: 2433454 - RNA, 19 nt, Human
cacucaaaagcugggcagg

SEQ ID NO: 2433455 - RNA, 20 nt, Human
cacucaagaagcaggcuaca

SEQ ID NO: 2433456 - RNA, 19 nt, Human
cacucaagaagcaggcuac

SEQ ID NO: 2433457 - RNA, 23 nt, Human
cacucaagaagcaggcuacacug

SEQ ID NO: 2433458 - RNA, 12 nt, Human
cacucaagccaa

SEQ ID NO: 2433459 - RNA, 17 nt, Human
cacucaaugcagccaga

SEQ ID NO: 2433460 - RNA, 15 nt, Human
cacucaagccaagca

SEQ ID NO: 2433461 - RNA, 16 nt, Human
cacucaagccaagcag

SEQ ID NO: 2433462 - RNA, 13 nt, Human
cacucaagcuugg

SEQ ID NO: 2433463 - RNA, 18 nt, Human
cacucaagccaagcagcc

SEQ ID NO: 2433464 - RNA, 16 nt, Human
cacucacagaccugga

SEQ ID NO: 2433465 - RNA, 22 nt, Human
cacucacacaggacccccuucc

SEQ ID NO: 2433466 - RNA, 21 nt, Human
cacucacacaggacccccuuc

SEQ ID NO: 2433467 - RNA, 14 nt, Human
cacucacacaggac

SEQ ID NO: 2433468 - RNA, 13 nt, Human
cacucacacagga

SEQ ID NO: 2433469 - RNA, 12 nt, Human
cacucacacagg

SEQ ID NO: 2433470 - RNA, 23 nt, Human
cacucacacagccaggugccuug

SEQ ID NO: 2433471 - RNA, 22 nt, Human
cacucacacagccaggugccuu

SEQ ID NO: 2433472 - RNA, 22 nt, Human
cacucaaugcagccagaccuau

SEQ ID NO: 2433473 - RNA, 18 nt, Human
cacucacacagccaggug

SEQ ID NO: 2433474 - RNA, 16 nt, Human
cacucacacagccagg

SEQ ID NO: 2433475 - RNA, 15 nt, Human
cacucacacagccag

SEQ ID NO: 2433476 - RNA, 16 nt, Human
cacucaaaucaagaaa

SEQ ID NO: 2433477 - RNA, 20 nt, Human
cacucaaaagcugggcaggu

SEQ ID NO: 2433478 - RNA, 20 nt, Human
cacucaaauuaaucuuucuu

SEQ ID NO: 2433479 - RNA, 19 nt, Human
cacucaaauuaaucuuucu

SEQ ID NO: 2433480 - RNA, 16 nt, Human
cacucaaauuaaucuu

SEQ ID NO: 2433481 - RNA, 17 nt, Human
cacucaagaagcaggcu

SEQ ID NO: 2433482 - RNA, 15 nt, Human
cacucaagaagcagg

SEQ ID NO: 2433483 - RNA, 14 nt, Human
cacucaagaagcag

SEQ ID NO: 2433484 - RNA, 14 nt, Human
cacucaacaugagu

SEQ ID NO: 2433485 - RNA, 23 nt, Human
cacuauuuuuauuuauauuuuug

SEQ ID NO: 2433486 - RNA, 23 nt, Human
cacguccugucagugccgccgcc

SEQ ID NO: 2433487 - RNA, 19 nt, Human
cacguccugucagugccgc

SEQ ID NO: 2433488 - RNA, 17 nt, Human
cacguccugucagugcc

SEQ ID NO: 2433489 - RNA, 16 nt, Human
cacguccugucagugc

SEQ ID NO: 2433490 - RNA, 16 nt, Human
cacgucugacccucuc

SEQ ID NO: 2433491 - RNA, 17 nt, Human
cacgucugacccucucc

SEQ ID NO: 2433492 - RNA, 18 nt, Human
cacgucugacccucucca

SEQ ID NO: 2433493 - RNA, 14 nt, Human
cacgucugucuuca

SEQ ID NO: 2433494 - RNA, 16 nt, Human
cacgucuuccuucugc

SEQ ID NO: 2433495 - RNA, 15 nt, Human
cacgucuuccuucug

SEQ ID NO: 2433496 - RNA, 15 nt, Human
cacgucugucuucac

SEQ ID NO: 2433497 - RNA, 23 nt, Human
cacgucuuccuucugccugagcu

SEQ ID NO: 2433498 - RNA, 18 nt, Human
cacgucuuccuucugccu

SEQ ID NO: 2433499 - RNA, 13 nt, Human
cacgugacagccg

SEQ ID NO: 2433500 - RNA, 16 nt, Human
cacgugcagcucaagg

SEQ ID NO: 2433501 - RNA, 20 nt, Human
cacgugagaaucccuggcaa

SEQ ID NO: 2433502 - RNA, 18 nt, Human
cacgugacagugccuggg

SEQ ID NO: 2433503 - RNA, 21 nt, Human
cacgugagaaucccuggcaaa

SEQ ID NO: 2433504 - RNA, 13 nt, Human
cacgugccaggcc

SEQ ID NO: 2433505 - RNA, 14 nt, Human
cacgugccaggccc

SEQ ID NO: 2433506 - RNA, 15 nt, Human
cacgugccaggcccg

SEQ ID NO: 2433507 - RNA, 18 nt, Human
cacguggccucuugagca

SEQ ID NO: 2433508 - RNA, 17 nt, Human
cacguggccucuugagc

SEQ ID NO: 2433509 - RNA, 13 nt, Human
cacguggccucuu

SEQ ID NO: 2433510 - RNA, 12 nt, Human
cacguggccucu

SEQ ID NO: 2433511 - RNA, 23 nt, Human
cacguggccucuugagcaguggc

SEQ ID NO: 2433512 - RNA, 20 nt, Human
cacguggccucuugagcagu

SEQ ID NO: 2433513 - RNA, 21 nt, Human
cacgugggaaccccccuccca

SEQ ID NO: 2433514 - RNA, 22 nt, Human
cacguggcauguggccuguggc

SEQ ID NO: 2433515 - RNA, 15 nt, Human
cacgugggaaccccc

SEQ ID NO: 2433516 - RNA, 16 nt, Human
cacgugccaggcccgg

SEQ ID NO: 2433517 - RNA, 13 nt, Human
cacguggagagcu

SEQ ID NO: 2433518 - RNA, 15 nt, Human
cacguggagagcugg

SEQ ID NO: 2433519 - RNA, 23 nt, Human
cacguggagagcuggugcccgga

SEQ ID NO: 2433520 - RNA, 20 nt, Human
cacguggcauguggccugug

SEQ ID NO: 2433521 - RNA, 19 nt, Human
cacguggcauguggccugu

SEQ ID NO: 2433522 - RNA, 18 nt, Human
cacguggcauguggccug

SEQ ID NO: 2433523 - RNA, 21 nt, Human
cacguggaggagcagugcagg

SEQ ID NO: 2433524 - RNA, 20 nt, Human
cacguggaggagcagugcag

SEQ ID NO: 2433525 - RNA, 18 nt, Human
cacguggaggagcagugc

SEQ ID NO: 2433526 - RNA, 19 nt, Human
cacgugcuacccccaugcu

SEQ ID NO: 2433527 - RNA, 20 nt, Human
cacguggaggaaugcucccc

SEQ ID NO: 2433528 - RNA, 16 nt, Human
cacguaaugaaacuug

SEQ ID NO: 2433529 - RNA, 19 nt, Human
cacguaaugaaacuuggau

SEQ ID NO: 2433530 - RNA, 14 nt, Human
cacguacacacaca

SEQ ID NO: 2433531 - RNA, 19 nt, Human
cacguacacacacauacac

SEQ ID NO: 2433532 - RNA, 18 nt, Human
cacguacacacacauaca

SEQ ID NO: 2433533 - RNA, 20 nt, Human
cacgucccccuggggcuucu

SEQ ID NO: 2433534 - RNA, 17 nt, Human
cacgucccccuggggcu

SEQ ID NO: 2433535 - RNA, 16 nt, Human
cacgucccccuggggc

SEQ ID NO: 2433536 - RNA, 15 nt, Human
cacgucccccugggg

SEQ ID NO: 2433537 - RNA, 14 nt, Human
cacguccugucagu

SEQ ID NO: 2433538 - RNA, 17 nt, Human
cacgucaucuaguuuua

SEQ ID NO: 2433539 - RNA, 13 nt, Human
cacgucccccugg

SEQ ID NO: 2433540 - RNA, 16 nt, Human
cacguccagaauuuuu

SEQ ID NO: 2433541 - RNA, 14 nt, Human
cacgucaugggagg

SEQ ID NO: 2433542 - RNA, 17 nt, Human
cacgucauguuucuuca

SEQ ID NO: 2433543 - RNA, 23 nt, Human
cacguaguagggucaggccacgg

SEQ ID NO: 2433544 - RNA, 21 nt, Human
cacguaguagggucaggccac

SEQ ID NO: 2433545 - RNA, 20 nt, Human
cacguaguagggucaggcca

SEQ ID NO: 2433546 - RNA, 19 nt, Human
cacguaguagggucaggcc

SEQ ID NO: 2433547 - RNA, 15 nt, Human
cacguacaaaaucca

SEQ ID NO: 2433548 - RNA, 19 nt, Human
cacgguuugaagccuggaa

SEQ ID NO: 2433549 - RNA, 20 nt, Human
cacgguuugaagccuggaac

SEQ ID NO: 2433550 - RNA, 16 nt, Human
cacguacuuaaaugaa

SEQ ID NO: 2433551 - RNA, 23 nt, Human
cacguagcccccaggcugcugga

SEQ ID NO: 2433552 - RNA, 17 nt, Human
cacguaguagggucagg

SEQ ID NO: 2433553 - RNA, 19 nt, Human
cacgugguccuaaucuucu

SEQ ID NO: 2433554 - RNA, 16 nt, Human
cacgugguccuaaucu

SEQ ID NO: 2433555 - RNA, 16 nt, Human
cacguguccuguaguu

SEQ ID NO: 2433556 - RNA, 15 nt, Human
cacguguccuguagu

SEQ ID NO: 2433557 - RNA, 19 nt, Human
cacguguggccuguucuuc

SEQ ID NO: 2433558 - RNA, 16 nt, Human
cacgugggcucauaug

SEQ ID NO: 2433559 - RNA, 20 nt, Human
cacguguaacugucagccgg

SEQ ID NO: 2433560 - RNA, 16 nt, Human
cacguguuugugcugu

SEQ ID NO: 2433561 - RNA, 22 nt, Human
cacguguuuuauuccuguaugu

SEQ ID NO: 2433562 - RNA, 23 nt, Human
cacguguuuuauuccuguauguu

SEQ ID NO: 2433563 - RNA, 13 nt, Human
cacguuauggugu

SEQ ID NO: 2433564 - RNA, 11 nt, Human
cacguguguga

SEQ ID NO: 2433565 - RNA, 12 nt, Human
cacgugugugac

SEQ ID NO: 2433566 - RNA, 16 nt, Human
cacgugugugacucag

SEQ ID NO: 2433567 - RNA, 22 nt, Human
cacguucuuacuaguuucccuu

SEQ ID NO: 2433568 - RNA, 19 nt, Human
cacguucucacacccaccg

SEQ ID NO: 2433569 - RNA, 18 nt, Human
cacguucucacacccacc

SEQ ID NO: 2433570 - RNA, 20 nt, Human
cacguuccuucccccgcaau

SEQ ID NO: 2433571 - RNA, 18 nt, Human
cacguuaugguguuucuc

SEQ ID NO: 2433572 - RNA, 19 nt, Human
cacguuccuuacugcagaa

SEQ ID NO: 2433573 - RNA, 13 nt, Human
cacguucaccccu

SEQ ID NO: 2433574 - RNA, 12 nt, Human
cacguuucuaaa

SEQ ID NO: 2433575 - RNA, 14 nt, Human
cacguuucuaaagg

SEQ ID NO: 2433576 - RNA, 23 nt, Human
cacguuucuaaaggcuaccuuug

SEQ ID NO: 2433577 - RNA, 22 nt, Human
cacguucucacacccaccgucc

SEQ ID NO: 2433578 - RNA, 13 nt, Human
cacuaaacaaaga

SEQ ID NO: 2433579 - RNA, 17 nt, Human
cacuaaacagacuauuu

SEQ ID NO: 2433580 - RNA, 12 nt, Human
cacuaaagcagu

SEQ ID NO: 2433581 - RNA, 22 nt, Human
cacuaaacuuuacccaaaaacu

SEQ ID NO: 2433582 - RNA, 18 nt, Human
cacgguuugaagccugga

SEQ ID NO: 2433583 - RNA, 17 nt, Human
cacgguuugaagccugg

SEQ ID NO: 2433584 - RNA, 14 nt, Human
cacggugggccuug

SEQ ID NO: 2433585 - RNA, 16 nt, Human
cacggugggccuugcu

SEQ ID NO: 2433586 - RNA, 17 nt, Human
cacggugccuuuuuuca

SEQ ID NO: 2433587 - RNA, 15 nt, Human
cacggugccuuuuuu

SEQ ID NO: 2433588 - RNA, 15 nt, Human
cacgguagugccuga

SEQ ID NO: 2433589 - RNA, 21 nt, Human
cacggucgccaccuggcauuc

SEQ ID NO: 2433590 - RNA, 14 nt, Human
cacgguagugccug

SEQ ID NO: 2433591 - RNA, 14 nt, Human
cacggucuguucuu

SEQ ID NO: 2433592 - RNA, 15 nt, Human
cacgggggccaagga

SEQ ID NO: 2433593 - RNA, 22 nt, Human
cacgggggcagcugauacaaau

SEQ ID NO: 2433594 - RNA, 15 nt, Human
cacgggggcagcuga

SEQ ID NO: 2433595 - RNA, 15 nt, Human
cacgggguauuuuag

SEQ ID NO: 2433596 - RNA, 20 nt, Human
cacggcucuagguggggcgg

SEQ ID NO: 2433597 - RNA, 13 nt, Human
cacggcugcugag

SEQ ID NO: 2433598 - RNA, 12 nt, Human
cacggcugcuga

SEQ ID NO: 2433599 - RNA, 15 nt, Human
cacgggagauuucuu

SEQ ID NO: 2433600 - RNA, 20 nt, Human
cacggcucacugcagccuca

SEQ ID NO: 2433601 - RNA, 19 nt, Human
cacggcucacugcagccuc

SEQ ID NO: 2433602 - RNA, 17 nt, Human
cacggcucacugcagcc

SEQ ID NO: 2433603 - RNA, 16 nt, Human
cacggcucacugcagc

SEQ ID NO: 2433604 - RNA, 14 nt, Human
cacgcuccuuccuc

SEQ ID NO: 2433605 - RNA, 17 nt, Human
cacgcuggaccuugaac

SEQ ID NO: 2433606 - RNA, 20 nt, Human
cacgcuggaccuugaacugg

SEQ ID NO: 2433607 - RNA, 17 nt, Human
cacgccuguaaucccag

SEQ ID NO: 2433608 - RNA, 18 nt, Human
cacgccuguaaucccagc

SEQ ID NO: 2433609 - RNA, 19 nt, Human
cacgccuguaaucccagca

SEQ ID NO: 2433610 - RNA, 23 nt, Human
cacgccugcaaacgcugccugcc

SEQ ID NO: 2433611 - RNA, 16 nt, Human
cacgccuguaauccca

SEQ ID NO: 2433612 - RNA, 21 nt, Human
cacgccugcaaacgcugccug

SEQ ID NO: 2433613 - RNA, 22 nt, Human
cacgccugcaaacgcugccugc

SEQ ID NO: 2433614 - RNA, 14 nt, Human
cacgccuguaaucc

SEQ ID NO: 2433615 - RNA, 19 nt, Human
cacgccuguaauccuagca

SEQ ID NO: 2433616 - RNA, 20 nt, Human
cacgccuguaauccuagcac

SEQ ID NO: 2433617 - RNA, 24 nt, Human
cacgcccuccccuccccugcugca

SEQ ID NO: 2433618 - RNA, 20 nt, Human
cacgcccuccccuccccugc

SEQ ID NO: 2433619 - RNA, 16 nt, Human
cacgcccuccccuccc

SEQ ID NO: 2433620 - RNA, 21 nt, Human
cacgcccuccccuccccugcu

SEQ ID NO: 2433621 - RNA, 18 nt, Human
cacgccuaugaucccagc

SEQ ID NO: 2433622 - RNA, 19 nt, Human
cacgccuaugaucccagca

SEQ ID NO: 2433623 - RNA, 21 nt, Human
cacgccuaugaucccagcacu

SEQ ID NO: 2433624 - RNA, 22 nt, Human
cacgccuaugaucccagcacuu

SEQ ID NO: 2433625 - RNA, 16 nt, Human
cacgccucccacuggg

SEQ ID NO: 2433626 - RNA, 15 nt, Human
cacgccucccacugg

SEQ ID NO: 2433627 - RNA, 14 nt, Human
cacgccucccacug

SEQ ID NO: 2433628 - RNA, 13 nt, Human
cacgccucccacu

SEQ ID NO: 2433629 - RNA, 18 nt, Human
cacgccucccacuggggu

SEQ ID NO: 2433630 - RNA, 17 nt, Human
cacgccucccacugggg

SEQ ID NO: 2433631 - RNA, 17 nt, Human
cacgccugcaaacgcug

SEQ ID NO: 2433632 - RNA, 22 nt, Human
cacgccucccacugggguccag

SEQ ID NO: 2433633 - RNA, 23 nt, Human
cacgcuccucccucugaggcugu

SEQ ID NO: 2433634 - RNA, 18 nt, Human
cacgcuccucccucugag

SEQ ID NO: 2433635 - RNA, 21 nt, Human
cacgcuccccgccuguucccc

SEQ ID NO: 2433636 - RNA, 20 nt, Human
cacgcuccccgccuguuccc

SEQ ID NO: 2433637 - RNA, 19 nt, Human
cacgcuccccgccuguucc

SEQ ID NO: 2433638 - RNA, 18 nt, Human
cacgcuccccgccuguuc

SEQ ID NO: 2433639 - RNA, 16 nt, Human
cacgcuccccgccugu

SEQ ID NO: 2433640 - RNA, 15 nt, Human
cacgcuccccgccug

SEQ ID NO: 2433641 - RNA, 23 nt, Human
cacgcgugcacacaccagagccc

SEQ ID NO: 2433642 - RNA, 22 nt, Human
cacgcuaaucccgauucacccu

SEQ ID NO: 2433643 - RNA, 20 nt, Human
cacgccuguaaucccagcag

SEQ ID NO: 2433644 - RNA, 21 nt, Human
cacgccuguaaucccagcagu

SEQ ID NO: 2433645 - RNA, 21 nt, Human
cacgcgugcacacaccagagc

SEQ ID NO: 2433646 - RNA, 16 nt, Human
cacgcgugcacacacc

SEQ ID NO: 2433647 - RNA, 15 nt, Human
cacgcgugcacacac

SEQ ID NO: 2433648 - RNA, 12 nt, Human
cacgccugugca

SEQ ID NO: 2433649 - RNA, 22 nt, Human
cacgccuguaaucccagcacuu

SEQ ID NO: 2433650 - RNA, 21 nt, Human
cacgccuguaaucccagcacu

SEQ ID NO: 2433651 - RNA, 20 nt, Human
cacgccuguaaucccagcac

SEQ ID NO: 2433652 - RNA, 17 nt, Human
cacgaaauguuauuuuu

SEQ ID NO: 2433653 - RNA, 22 nt, Human
caccuugaagaaccucucacuu

SEQ ID NO: 2433654 - RNA, 18 nt, Human
caccuugacagggcacac

SEQ ID NO: 2433655 - RNA, 16 nt, Human
caccuugacagggcac

SEQ ID NO: 2433656 - RNA, 15 nt, Human
caccuugacagggca

SEQ ID NO: 2433657 - RNA, 13 nt, Human
caccuuccucacu

SEQ ID NO: 2433658 - RNA, 14 nt, Human
caccuucccaugcc

SEQ ID NO: 2433659 - RNA, 13 nt, Human
caccuucccaugc

SEQ ID NO: 2433660 - RNA, 17 nt, Human
caccuucccagcucucc

SEQ ID NO: 2433661 - RNA, 19 nt, Human
caccuucccagcucucccu

SEQ ID NO: 2433662 - RNA, 21 nt, Human
caccuucccagcucucccucu

SEQ ID NO: 2433663 - RNA, 22 nt, Human
caccuucccagcucucccucug

SEQ ID NO: 2433664 - RNA, 20 nt, Human
caccuuccucacuuccauac

SEQ ID NO: 2433665 - RNA, 14 nt, Human
caccuuccucacuu

SEQ ID NO: 2433666 - RNA, 21 nt, Human
caccuucguuuacuaugccug

SEQ ID NO: 2433667 - RNA, 22 nt, Human
caccuucguuuacuaugccugu

SEQ ID NO: 2433668 - RNA, 23 nt, Human
caccuucguuuacuaugccugug

SEQ ID NO: 2433669 - RNA, 13 nt, Human
caccuugacaggg

SEQ ID NO: 2433670 - RNA, 19 nt, Human
cacgaccucggcucacugc

SEQ ID NO: 2433671 - RNA, 13 nt, Human
cacgacugucucc

SEQ ID NO: 2433672 - RNA, 16 nt, Human
cacgacugucuccaug

SEQ ID NO: 2433673 - RNA, 17 nt, Human
cacgacugcccggcagg

SEQ ID NO: 2433674 - RNA, 22 nt, Human
cacgaauuugcuggggaaucuc

SEQ ID NO: 2433675 - RNA, 18 nt, Human
cacgaaguguugcaugga

SEQ ID NO: 2433676 - RNA, 18 nt, Human
cacgaauuugcuggggaa

SEQ ID NO: 2433677 - RNA, 16 nt, Human
cacgacugcccggcag

SEQ ID NO: 2433678 - RNA, 22 nt, Human
cacgaauauugcugauggugca

SEQ ID NO: 2433679 - RNA, 19 nt, Human
cacgaauauugcugauggu

SEQ ID NO: 2433680 - RNA, 16 nt, Human
cacgaauauugcugau

SEQ ID NO: 2433681 - RNA, 14 nt, Human
cacgaacccaccug

SEQ ID NO: 2433682 - RNA, 16 nt, Human
cacgaacccaccugcu

SEQ ID NO: 2433683 - RNA, 18 nt, Human
cacgaacccaccugcuga

SEQ ID NO: 2433684 - RNA, 16 nt, Human
cacgaaguguugcaug

SEQ ID NO: 2433685 - RNA, 15 nt, Human
cacgaaguguugcau

SEQ ID NO: 2433686 - RNA, 19 nt, Human
cacgaacuuuagcugcauc

SEQ ID NO: 2433687 - RNA, 22 nt, Human
cacgaacccaccugcugagaga

SEQ ID NO: 2433688 - RNA, 19 nt, Human
caccuuagacagucccugc

SEQ ID NO: 2433689 - RNA, 18 nt, Human
caccuuagacagucccug

SEQ ID NO: 2433690 - RNA, 16 nt, Human
caccuuagacaguccc

SEQ ID NO: 2433691 - RNA, 14 nt, Human
caccuuagacaguc

SEQ ID NO: 2433692 - RNA, 11 nt, Human
caccuguuacu

SEQ ID NO: 2433693 - RNA, 23 nt, Human
caccugugcagcgaagcuuagcg

SEQ ID NO: 2433694 - RNA, 19 nt, Human
caccugugcuucgggcccu

SEQ ID NO: 2433695 - RNA, 20 nt, Human
caccuguuuuuaagcuguuu

SEQ ID NO: 2433696 - RNA, 19 nt, Human
caccuguugcuuacaauuu

SEQ ID NO: 2433697 - RNA, 16 nt, Human
caccuguugcuuacaa

SEQ ID NO: 2433698 - RNA, 19 nt, Human
caccuguuuuuaagcuguu

SEQ ID NO: 2433699 - RNA, 20 nt, Human
caccugugaguuuaaagcaa

SEQ ID NO: 2433700 - RNA, 19 nt, Human
caccugugaguuuaaagca

SEQ ID NO: 2433701 - RNA, 23 nt, Human
caccuuagacagucccugccaau

SEQ ID NO: 2433702 - RNA, 21 nt, Human
caccuuagacagucccugcca

SEQ ID NO: 2433703 - RNA, 19 nt, Human
caccuuaccaacuuucugu

SEQ ID NO: 2433704 - RNA, 18 nt, Human
caccuuaccaacuuucug

SEQ ID NO: 2433705 - RNA, 20 nt, Human
caccuguugcuuacaauuuu

SEQ ID NO: 2433706 - RNA, 17 nt, Human
caccuuaccaacuuucu

SEQ ID NO: 2433707 - RNA, 13 nt, Human
caccuuagcuggc

SEQ ID NO: 2433708 - RNA, 22 nt, Human
caccuuagccugcccuccuuuc

SEQ ID NO: 2433709 - RNA, 13 nt, Human
caccuuaggcagg

SEQ ID NO: 2433710 - RNA, 14 nt, Human
caccuuaggcaggg

SEQ ID NO: 2433711 - RNA, 17 nt, Human
caccuuaggcagggaag

SEQ ID NO: 2433712 - RNA, 15 nt, Human
caccuuaguggcuuu

SEQ ID NO: 2433713 - RNA, 18 nt, Human
caccuuaggcagggaagu

SEQ ID NO: 2433714 - RNA, 15 nt, Human
caccuuauauuuacg

SEQ ID NO: 2433715 - RNA, 17 nt, Human
caccuucaauuccuggg

SEQ ID NO: 2433716 - RNA, 18 nt, Human
caccuucaauuccugggc

SEQ ID NO: 2433717 - RNA, 19 nt, Human
caccuucaauuccugggcc

SEQ ID NO: 2433718 - RNA, 18 nt, Human
caccuuccagcuccugua

SEQ ID NO: 2433719 - RNA, 16 nt, Human
caccuuccagcuccug

SEQ ID NO: 2433720 - RNA, 12 nt, Human
caccuucccagc

SEQ ID NO: 2433721 - RNA, 13 nt, Human
caccuucccagcu

SEQ ID NO: 2433722 - RNA, 15 nt, Human
caccuucccagcucu

SEQ ID NO: 2433723 - RNA, 15 nt, Human
caccuuccagcuccu

SEQ ID NO: 2433724 - RNA, 14 nt, Human
caccuuccagcucc

SEQ ID NO: 2433725 - RNA, 19 nt, Human
cacgagcaggcuacuguca

SEQ ID NO: 2433726 - RNA, 20 nt, Human
cacgagcaggcuacugucag

SEQ ID NO: 2433727 - RNA, 17 nt, Human
cacgagcaggcuacugu

SEQ ID NO: 2433728 - RNA, 13 nt, Human
cacgagagcccgg

SEQ ID NO: 2433729 - RNA, 23 nt, Human
cacgagcaaagugaagacacugg

SEQ ID NO: 2433730 - RNA, 12 nt, Human
cacgaugaaaaa

SEQ ID NO: 2433731 - RNA, 20 nt, Human
cacgauaaauaaucggccca

SEQ ID NO: 2433732 - RNA, 15 nt, Human
cacgaugaaaaacuu

SEQ ID NO: 2433733 - RNA, 14 nt, Human
cacgauguggcccu

SEQ ID NO: 2433734 - RNA, 15 nt, Human
cacgauguggcccug

SEQ ID NO: 2433735 - RNA, 16 nt, Human
cacgauguggcccugg

SEQ ID NO: 2433736 - RNA, 17 nt, Human
cacgauguggcccuggc

SEQ ID NO: 2433737 - RNA, 18 nt, Human
cacgauguggcccuggcc

SEQ ID NO: 2433738 - RNA, 22 nt, Human
cacgauguggcccuggccugcu

SEQ ID NO: 2433739 - RNA, 22 nt, Human
cacgagcaggcuacugucagcu

SEQ ID NO: 2433740 - RNA, 20 nt, Human
cacgagcuguuuacuaggga

SEQ ID NO: 2433741 - RNA, 15 nt, Human
cacgcacgcacacac

SEQ ID NO: 2433742 - RNA, 14 nt, Human
cacgcacgcacaca

SEQ ID NO: 2433743 - RNA, 13 nt, Human
cacgcacgcacac

SEQ ID NO: 2433744 - RNA, 12 nt, Human
cacgcacgcaca

SEQ ID NO: 2433745 - RNA, 13 nt, Human
cacgcaccugggu

SEQ ID NO: 2433746 - RNA, 16 nt, Human
cacgcaccugccucag

SEQ ID NO: 2433747 - RNA, 17 nt, Human
cacgcacuucgggaggu

SEQ ID NO: 2433748 - RNA, 12 nt, Human
cacgcaccugcc

SEQ ID NO: 2433749 - RNA, 15 nt, Human
cacgcaccugccuca

SEQ ID NO: 2433750 - RNA, 22 nt, Human
cacgcacacacacacacaggag

SEQ ID NO: 2433751 - RNA, 14 nt, Human
cacgcaccucccau

SEQ ID NO: 2433752 - RNA, 15 nt, Human
cacgcaccucccauc

SEQ ID NO: 2433753 - RNA, 19 nt, Human
cacgcaccucccauccuaa

SEQ ID NO: 2433754 - RNA, 12 nt, Human
cacgcaccuccc

SEQ ID NO: 2433755 - RNA, 15 nt, Human
cacgcacacacacac

SEQ ID NO: 2433756 - RNA, 20 nt, Human
cacgcacacacacacacagg

SEQ ID NO: 2433757 - RNA, 12 nt, Human
cacgauuucugu

SEQ ID NO: 2433758 - RNA, 14 nt, Human
cacgauuucuguuu

SEQ ID NO: 2433759 - RNA, 16 nt, Human
cacgauuucuguuuag

SEQ ID NO: 2433760 - RNA, 12 nt, Human
cacgcacacaca

SEQ ID NO: 2433761 - RNA, 21 nt, Human
cacgauguggcccuggccugc

SEQ ID NO: 2433762 - RNA, 15 nt, Human
cacgcacacacacaa

SEQ ID NO: 2433763 - RNA, 13 nt, Human
cacgcacacacac

SEQ ID NO: 2433764 - RNA, 14 nt, Human
cacgcacacacaca

SEQ ID NO: 2433765 - RNA, 15 nt, Human
cacgcccccacuggu

SEQ ID NO: 2433766 - RNA, 13 nt, Human
cacgcccccacug

SEQ ID NO: 2433767 - RNA, 23 nt, Human
cacgccagauucuuuccugaggc

SEQ ID NO: 2433768 - RNA, 14 nt, Human
cacgcccaugugug

SEQ ID NO: 2433769 - RNA, 15 nt, Human
cacgcccauguguga

SEQ ID NO: 2433770 - RNA, 23 nt, Human
cacgcccaugugugagugugugc

SEQ ID NO: 2433771 - RNA, 14 nt, Human
cacgccacugcacu

SEQ ID NO: 2433772 - RNA, 22 nt, Human
cacgccacugcacuccagccug

SEQ ID NO: 2433773 - RNA, 18 nt, Human
cacgcccccacuggugac

SEQ ID NO: 2433774 - RNA, 17 nt, Human
cacgcccccacugguga

SEQ ID NO: 2433775 - RNA, 19 nt, Human
cacgcccguccugccugug

SEQ ID NO: 2433776 - RNA, 16 nt, Human
cacgcccguccugccu

SEQ ID NO: 2433777 - RNA, 15 nt, Human
cacgcccguccugcc

SEQ ID NO: 2433778 - RNA, 14 nt, Human
cacgcccguccugc

SEQ ID NO: 2433779 - RNA, 21 nt, Human
cacgcccguccugccuguggc

SEQ ID NO: 2433780 - RNA, 20 nt, Human
cacgcccguccugccugugg

SEQ ID NO: 2433781 - RNA, 15 nt, Human
cacgcccuccccucc

SEQ ID NO: 2433782 - RNA, 13 nt, Human
cacgcccuccccu

SEQ ID NO: 2433783 - RNA, 22 nt, Human
cacgccagauucuuuccugagg

SEQ ID NO: 2433784 - RNA, 20 nt, Human
cacgccagauucuuuccuga

SEQ ID NO: 2433785 - RNA, 19 nt, Human
cacgccagauucuuuccug

SEQ ID NO: 2433786 - RNA, 15 nt, Human
cacgccacugcacua

SEQ ID NO: 2433787 - RNA, 13 nt, Human
cacgccacugcac

SEQ ID NO: 2433788 - RNA, 16 nt, Human
cacgcacgcacacaca

SEQ ID NO: 2433789 - RNA, 17 nt, Human
cacgcaggaacucccag

SEQ ID NO: 2433790 - RNA, 16 nt, Human
cacgcaggaacuccca

SEQ ID NO: 2433791 - RNA, 13 nt, Human
cacgcaggaacuc

SEQ ID NO: 2433792 - RNA, 20 nt, Human
cacgcaggaacucccagcaa

SEQ ID NO: 2433793 - RNA, 19 nt, Human
cacgcaggaacucccagca

SEQ ID NO: 2433794 - RNA, 16 nt, Human
cacgccagauucuuuc

SEQ ID NO: 2433795 - RNA, 20 nt, Human
caccuggccucugcacuccc

SEQ ID NO: 2433796 - RNA, 19 nt, Human
caccuggccucugcacucc

SEQ ID NO: 2433797 - RNA, 18 nt, Human
caccuggccucugcacuc

SEQ ID NO: 2433798 - RNA, 17 nt, Human
caccuggccucugcacu

SEQ ID NO: 2433799 - RNA, 21 nt, Human
caccuggcugagguuccucug

SEQ ID NO: 2433800 - RNA, 20 nt, Human
caccuggcugagguuccucu

SEQ ID NO: 2433801 - RNA, 19 nt, Human
caccuggcugagguuccuc

SEQ ID NO: 2433802 - RNA, 19 nt, Human
caccuggcugagccuggcu

SEQ ID NO: 2433803 - RNA, 23 nt, Human
caccuggcugagguuccucugcc

SEQ ID NO: 2433804 - RNA, 22 nt, Human
caccuggcugagguuccucugc

SEQ ID NO: 2433805 - RNA, 11 nt, Human
caccugggcac

SEQ ID NO: 2433806 - RNA, 23 nt, Human
caccuggccucugcacuccccug

SEQ ID NO: 2433807 - RNA, 15 nt, Human
caccuggccucugca

SEQ ID NO: 2433808 - RNA, 14 nt, Human
caccuggccucugc

SEQ ID NO: 2433809 - RNA, 13 nt, Human
caccuggccucug

SEQ ID NO: 2433810 - RNA, 12 nt, Human
caccuggccucu

SEQ ID NO: 2433811 - RNA, 15 nt, Human
caccuggccaccuga

SEQ ID NO: 2433812 - RNA, 14 nt, Human
caccuggccaccug

SEQ ID NO: 2433813 - RNA, 13 nt, Human
caccuggccaccu

SEQ ID NO: 2433814 - RNA, 12 nt, Human
caccuggccacc

SEQ ID NO: 2433815 - RNA, 11 nt, Human
caccuggccac

SEQ ID NO: 2433816 - RNA, 18 nt, Human
caccuggcacugcugugc

SEQ ID NO: 2433817 - RNA, 23 nt, Human
caccuggcaucgcaccauucuga

SEQ ID NO: 2433818 - RNA, 17 nt, Human
caccuggcacugcugug

SEQ ID NO: 2433819 - RNA, 20 nt, Human
caccuggccccaugucucuc

SEQ ID NO: 2433820 - RNA, 22 nt, Human
caccuggccccaugucucucag

SEQ ID NO: 2433821 - RNA, 21 nt, Human
caccuggccaccugagguggg

SEQ ID NO: 2433822 - RNA, 20 nt, Human
caccuggccaccugaggugg

SEQ ID NO: 2433823 - RNA, 19 nt, Human
caccuggccaccugaggug

SEQ ID NO: 2433824 - RNA, 17 nt, Human
caccuggccaccugagg

SEQ ID NO: 2433825 - RNA, 11 nt, Human
caccuggcccc

SEQ ID NO: 2433826 - RNA, 14 nt, Human
caccuggccccaug

SEQ ID NO: 2433827 - RNA, 15 nt, Human
caccuggccccaugu

SEQ ID NO: 2433828 - RNA, 16 nt, Human
caccuggccccauguc

SEQ ID NO: 2433829 - RNA, 19 nt, Human
caccugucucagccuccca

SEQ ID NO: 2433830 - RNA, 14 nt, Human
caccugucccagaa

SEQ ID NO: 2433831 - RNA, 15 nt, Human
caccugucucagccu

SEQ ID NO: 2433832 - RNA, 17 nt, Human
caccugucucagccucc

SEQ ID NO: 2433833 - RNA, 18 nt, Human
caccugucucagccuccc

SEQ ID NO: 2433834 - RNA, 15 nt, Human
caccugucccagaaa

SEQ ID NO: 2433835 - RNA, 14 nt, Human
caccugucaggccu

SEQ ID NO: 2433836 - RNA, 23 nt, Human
caccugucaaacaaagccagaag

SEQ ID NO: 2433837 - RNA, 18 nt, Human
caccuguagcacuuacug

SEQ ID NO: 2433838 - RNA, 17 nt, Human
caccuguacucuuccga

SEQ ID NO: 2433839 - RNA, 15 nt, Human
caccuguacucuucc

SEQ ID NO: 2433840 - RNA, 23 nt, Human
caccuguacucaggaggcugagg

SEQ ID NO: 2433841 - RNA, 15 nt, Human
caccuguacucagga

SEQ ID NO: 2433842 - RNA, 16 nt, Human
caccuguacucaggag

SEQ ID NO: 2433843 - RNA, 22 nt, Human
caccuguacucaggaggcugag

SEQ ID NO: 2433844 - RNA, 15 nt, Human
caccuguagcagcca

SEQ ID NO: 2433845 - RNA, 22 nt, Human
caccuguagcacuuacugguag

SEQ ID NO: 2433846 - RNA, 15 nt, Human
caccuguagucccag

SEQ ID NO: 2433847 - RNA, 16 nt, Human
caccuguagucccagc

SEQ ID NO: 2433848 - RNA, 18 nt, Human
caccuguacucuuccgaa

SEQ ID NO: 2433849 - RNA, 18 nt, Human
caccuguagucccagcua

SEQ ID NO: 2433850 - RNA, 20 nt, Human
caccuguagucccagcuacu

SEQ ID NO: 2433851 - RNA, 19 nt, Human
caccuguagucccagcuac

SEQ ID NO: 2433852 - RNA, 13 nt, Human
caccugucaaaca

SEQ ID NO: 2433853 - RNA, 20 nt, Human
caccugucaaacaaagccag

SEQ ID NO: 2433854 - RNA, 21 nt, Human
caccugucaaacaaagccaga

SEQ ID NO: 2433855 - RNA, 15 nt, Human
caccuggggcugcug

SEQ ID NO: 2433856 - RNA, 14 nt, Human
caccuggggcugcu

SEQ ID NO: 2433857 - RNA, 23 nt, Human
caccuggggcagucaccugccca

SEQ ID NO: 2433858 - RNA, 10 nt, Human
caccuggggu

SEQ ID NO: 2433859 - RNA, 18 nt, Human
caccuggggugugggagg

SEQ ID NO: 2433860 - RNA, 22 nt, Human
caccuggggugugggaggcccg

SEQ ID NO: 2433861 - RNA, 14 nt, Human
caccuggggagugg

SEQ ID NO: 2433862 - RNA, 15 nt, Human
caccuggggaguggg

SEQ ID NO: 2433863 - RNA, 17 nt, Human
caccuggggagugggac

SEQ ID NO: 2433864 - RNA, 22 nt, Human
caccuggggagugggacagagu

SEQ ID NO: 2433865 - RNA, 14 nt, Human
caccuggggcaguc

SEQ ID NO: 2433866 - RNA, 15 nt, Human
caccuggggcaguca

SEQ ID NO: 2433867 - RNA, 19 nt, Human
caccuggggcagucaccug

SEQ ID NO: 2433868 - RNA, 20 nt, Human
caccuggggcagucaccugc

SEQ ID NO: 2433869 - RNA, 19 nt, Human
caccugggcuuaagaaauc

SEQ ID NO: 2433870 - RNA, 16 nt, Human
caccugggcuuaagaa

SEQ ID NO: 2433871 - RNA, 12 nt, Human
caccugggcacc

SEQ ID NO: 2433872 - RNA, 15 nt, Human
caccugggcaccugg

SEQ ID NO: 2433873 - RNA, 19 nt, Human
caccugggcaccuggggag

SEQ ID NO: 2433874 - RNA, 20 nt, Human
caccuggggugugggaggcc

SEQ ID NO: 2433875 - RNA, 15 nt, Human
caccugguggccucu

SEQ ID NO: 2433876 - RNA, 17 nt, Human
caccugguggccucugc

SEQ ID NO: 2433877 - RNA, 23 nt, Human
caccugguuccggaauccugucc

SEQ ID NO: 2433878 - RNA, 21 nt, Human
caccugguuccggaauccugu

SEQ ID NO: 2433879 - RNA, 20 nt, Human
caccugguuccggaauccug

SEQ ID NO: 2433880 - RNA, 16 nt, Human
caccugguuccggaau

SEQ ID NO: 2433881 - RNA, 15 nt, Human
caccuguaaaccuga

SEQ ID NO: 2433882 - RNA, 16 nt, Human
caccuguaaaccugag

SEQ ID NO: 2433883 - RNA, 14 nt, Human
caccuguaaaccug

SEQ ID NO: 2433884 - RNA, 21 nt, Human
caccuguaaucccagcuacuu

SEQ ID NO: 2433885 - RNA, 16 nt, Human
caccuguaaucccagc

SEQ ID NO: 2433886 - RNA, 18 nt, Human
caccuguaaucccagcac

SEQ ID NO: 2433887 - RNA, 19 nt, Human
caccucucucacuccuuga

SEQ ID NO: 2433888 - RNA, 18 nt, Human
caccucucucacuccuug

SEQ ID NO: 2433889 - RNA, 17 nt, Human
caccucucucacuccuu

SEQ ID NO: 2433890 - RNA, 15 nt, Human
caccucucucacucc

SEQ ID NO: 2433891 - RNA, 18 nt, Human
caccucugcacaagcugc

SEQ ID NO: 2433892 - RNA, 19 nt, Human
caccucugcacaagcugca

SEQ ID NO: 2433893 - RNA, 22 nt, Human
caccucugaccuaucacuucca

SEQ ID NO: 2433894 - RNA, 22 nt, Human
caccucugaaaacggcccucuu

SEQ ID NO: 2433895 - RNA, 16 nt, Human
caccucucuccuuugc

SEQ ID NO: 2433896 - RNA, 23 nt, Human
caccucucccucaacaagggaga

SEQ ID NO: 2433897 - RNA, 13 nt, Human
caccucugccaga

SEQ ID NO: 2433898 - RNA, 12 nt, Human
caccucugccag

SEQ ID NO: 2433899 - RNA, 19 nt, Human
caccucugccagaagaucc

SEQ ID NO: 2433900 - RNA, 13 nt, Human
caccucugccuca

SEQ ID NO: 2433901 - RNA, 19 nt, Human
caccucugcggaccccagc

SEQ ID NO: 2433902 - RNA, 18 nt, Human
caccucugcggaccccag

SEQ ID NO: 2433903 - RNA, 12 nt, Human
caccucugcgga

SEQ ID NO: 2433904 - RNA, 14 nt, Human
caccucugccucaa

SEQ ID NO: 2433905 - RNA, 21 nt, Human
caccucugcggaccccagcug

SEQ ID NO: 2433906 - RNA, 20 nt, Human
caccucugcggaccccagcu

SEQ ID NO: 2433907 - RNA, 22 nt, Human
caccucugcggaccccagcugu

SEQ ID NO: 2433908 - RNA, 13 nt, Human
caccucuggacug

SEQ ID NO: 2433909 - RNA, 17 nt, Human
caccucuggacuggcua

SEQ ID NO: 2433910 - RNA, 18 nt, Human
caccucuggacuggcuag

SEQ ID NO: 2433911 - RNA, 19 nt, Human
caccucugugaccucaggc

SEQ ID NO: 2433912 - RNA, 18 nt, Human
caccucugugaccucagg

SEQ ID NO: 2433913 - RNA, 17 nt, Human
caccucugugaccucag

SEQ ID NO: 2433914 - RNA, 15 nt, Human
caccucugugaccuc

SEQ ID NO: 2433915 - RNA, 14 nt, Human
caccucugugaccu

SEQ ID NO: 2433916 - RNA, 13 nt, Human
caccucugugacc

SEQ ID NO: 2433917 - RNA, 19 nt, Human
caccucuggacuggcuaga

SEQ ID NO: 2433918 - RNA, 22 nt, Human
caccucuuaaagaaaacccacc

SEQ ID NO: 2433919 - RNA, 20 nt, Human
caccucugugaccucaggca

SEQ ID NO: 2433920 - RNA, 22 nt, Human
caccucugugaccucaggcacu

SEQ ID NO: 2433921 - RNA, 20 nt, Human
caccucuucaccccccacuc

SEQ ID NO: 2433922 - RNA, 14 nt, Human
caccucuucacccc

SEQ ID NO: 2433923 - RNA, 18 nt, Human
caccucuucucuuccugu

SEQ ID NO: 2433924 - RNA, 17 nt, Human
caccucuucucuuccug

SEQ ID NO: 2433925 - RNA, 19 nt, Human
caccucuuuguguuuuauu

SEQ ID NO: 2433926 - RNA, 22 nt, Human
caccucuucucuuccuguaaca

SEQ ID NO: 2433927 - RNA, 15 nt, Human
caccugaagacucau

SEQ ID NO: 2433928 - RNA, 14 nt, Human
caccugaagacuca

SEQ ID NO: 2433929 - RNA, 23 nt, Human
caccugaagacucauucuucugu

SEQ ID NO: 2433930 - RNA, 16 nt, Human
caccugauguguacau

SEQ ID NO: 2433931 - RNA, 15 nt, Human
caccugauucaacua

SEQ ID NO: 2433932 - RNA, 16 nt, Human
caccugauucaacuaa

SEQ ID NO: 2433933 - RNA, 17 nt, Human
caccugauucaacuaaa

SEQ ID NO: 2433934 - RNA, 18 nt, Human
caccugauucaacuaaaa

SEQ ID NO: 2433935 - RNA, 19 nt, Human
caccugauucaacuaaaaa

SEQ ID NO: 2433936 - RNA, 21 nt, Human
caccugauucaacuaaaaaaa

SEQ ID NO: 2433937 - RNA, 19 nt, Human
caccugagucacccuaccu

SEQ ID NO: 2433938 - RNA, 23 nt, Human
caccugagucacccuaccugugc

SEQ ID NO: 2433939 - RNA, 15 nt, Human
caccugauguguaca

SEQ ID NO: 2433940 - RNA, 11 nt, Human
caccugaugug

SEQ ID NO: 2433941 - RNA, 24 nt, Human
caccugaggugggcccaggaccag

SEQ ID NO: 2433942 - RNA, 23 nt, Human
caccugcacuuaaggcacucugu

SEQ ID NO: 2433943 - RNA, 22 nt, Human
caccugcaccuccccccacugc

SEQ ID NO: 2433944 - RNA, 17 nt, Human
caccugcaccucccccc

SEQ ID NO: 2433945 - RNA, 19 nt, Human
caccugcaccuccccccac

SEQ ID NO: 2433946 - RNA, 11 nt, Human
caccugcaccu

SEQ ID NO: 2433947 - RNA, 13 nt, Human
caccugcaccucc

SEQ ID NO: 2433948 - RNA, 14 nt, Human
caccugcaccuccc

SEQ ID NO: 2433949 - RNA, 15 nt, Human
caccugcaccucccc

SEQ ID NO: 2433950 - RNA, 16 nt, Human
caccugagcaggaccu

SEQ ID NO: 2433951 - RNA, 19 nt, Human
caccugagcaggaccucug

SEQ ID NO: 2433952 - RNA, 20 nt, Human
caccugagcaggaccucuga

SEQ ID NO: 2433953 - RNA, 21 nt, Human
caccugagcaggaccucugaa

SEQ ID NO: 2433954 - RNA, 23 nt, Human
caccugacucugaaaucugaaga

SEQ ID NO: 2433955 - RNA, 20 nt, Human
caccugacucugaaaucuga

SEQ ID NO: 2433956 - RNA, 15 nt, Human
caccugacucugaaa

SEQ ID NO: 2433957 - RNA, 15 nt, Human
caccugaggugggcc

SEQ ID NO: 2433958 - RNA, 21 nt, Human
caccugagcccggaugcuucu

SEQ ID NO: 2433959 - RNA, 23 nt, Human
caccugagcccggaugcuucucc

SEQ ID NO: 2433960 - RNA, 19 nt, Human
caccugaggugggcccagg

SEQ ID NO: 2433961 - RNA, 18 nt, Human
caccugaggugggcccag

SEQ ID NO: 2433962 - RNA, 17 nt, Human
caccugaggugggccca

SEQ ID NO: 2433963 - RNA, 21 nt, Human
caccugaggugggcccaggac

SEQ ID NO: 2433964 - RNA, 20 nt, Human
caccugaggugggcccagga

SEQ ID NO: 2433965 - RNA, 18 nt, Human
caccugagguuaggaguu

SEQ ID NO: 2433966 - RNA, 20 nt, Human
caccuggaauauauaaccag

SEQ ID NO: 2433967 - RNA, 22 nt, Human
caccugcuggccccucaccugg

SEQ ID NO: 2433968 - RNA, 13 nt, Human
caccugcuggccc

SEQ ID NO: 2433969 - RNA, 14 nt, Human
caccugcuggcccc

SEQ ID NO: 2433970 - RNA, 15 nt, Human
caccugcuggccccu

SEQ ID NO: 2433971 - RNA, 16 nt, Human
caccugcuggccccuc

SEQ ID NO: 2433972 - RNA, 17 nt, Human
caccugcuggccccuca

SEQ ID NO: 2433973 - RNA, 18 nt, Human
caccugcuggccccucac

SEQ ID NO: 2433974 - RNA, 20 nt, Human
caccugcuggccccucaccu

SEQ ID NO: 2433975 - RNA, 14 nt, Human
caccugcucuucua

SEQ ID NO: 2433976 - RNA, 18 nt, Human
caccugcugagagaccca

SEQ ID NO: 2433977 - RNA, 19 nt, Human
caccugcugagagacccaa

SEQ ID NO: 2433978 - RNA, 22 nt, Human
caccugcugagagacccaagga

SEQ ID NO: 2433979 - RNA, 13 nt, Human
caccugcugcugc

SEQ ID NO: 2433980 - RNA, 15 nt, Human
caccugcuggaguga

SEQ ID NO: 2433981 - RNA, 23 nt, Human
caccugcggugcuaucuccccca

SEQ ID NO: 2433982 - RNA, 23 nt, Human
caccugcugagaaaacaugccuc

SEQ ID NO: 2433983 - RNA, 14 nt, Human
caccugcucccagg

SEQ ID NO: 2433984 - RNA, 13 nt, Human
caccugcucccag

SEQ ID NO: 2433985 - RNA, 19 nt, Human
caccugcucccaggccagu

SEQ ID NO: 2433986 - RNA, 18 nt, Human
caccugcagguugggcca

SEQ ID NO: 2433987 - RNA, 23 nt, Human
caccugcagguugggccauacug

SEQ ID NO: 2433988 - RNA, 22 nt, Human
caccugcagguugggccauacu

SEQ ID NO: 2433989 - RNA, 22 nt, Human
caccugcauccguaguucccug

SEQ ID NO: 2433990 - RNA, 20 nt, Human
caccuccacaguucaguggc

SEQ ID NO: 2433991 - RNA, 18 nt, Human
caccuccacaguucagug

SEQ ID NO: 2433992 - RNA, 14 nt, Human
caccuccacaguuc

SEQ ID NO: 2433993 - RNA, 13 nt, Human
caccuccacaguu

SEQ ID NO: 2433994 - RNA, 22 nt, Human
caccucaugcccacccccugcc

SEQ ID NO: 2433995 - RNA, 21 nt, Human
caccucaugcccacccccugc

SEQ ID NO: 2433996 - RNA, 20 nt, Human
caccucaugcccacccccug

SEQ ID NO: 2433997 - RNA, 19 nt, Human
caccucaugcccacccccu

SEQ ID NO: 2433998 - RNA, 14 nt, Human
caccucauggaauu

SEQ ID NO: 2433999 - RNA, 12 nt, Human
caccucauggaa

SEQ ID NO: 2434000 - RNA, 11 nt, Human
caccucaugga

SEQ ID NO: 2434001 - RNA, 17 nt, Human
caccuccacauccucca

SEQ ID NO: 2434002 - RNA, 16 nt, Human
caccuccacauccucc

SEQ ID NO: 2434003 - RNA, 10 nt, Human
caccucccag

SEQ ID NO: 2434004 - RNA, 21 nt, Human
caccuccccacgcccuccccu

SEQ ID NO: 2434005 - RNA, 19 nt, Human
caccuccccacgcccuccc

SEQ ID NO: 2434006 - RNA, 17 nt, Human
caccuccccacgcccuc

SEQ ID NO: 2434007 - RNA, 14 nt, Human
caccuccccacgcc

SEQ ID NO: 2434008 - RNA, 16 nt, Human
caccuccccagcauuc

SEQ ID NO: 2434009 - RNA, 14 nt, Human
caccuccccagcau

SEQ ID NO: 2434010 - RNA, 11 nt, Human
caccucccagg

SEQ ID NO: 2434011 - RNA, 12 nt, Human
caccucccagga

SEQ ID NO: 2434012 - RNA, 13 nt, Human
caccuccccacgc

SEQ ID NO: 2434013 - RNA, 9 nt, Human
caccucccc

SEQ ID NO: 2434014 - RNA, 13 nt, Human
caccucccauccu

SEQ ID NO: 2434015 - RNA, 16 nt, Human
caccucccauccuaau

SEQ ID NO: 2434016 - RNA, 10 nt, Human
caccucccuc

SEQ ID NO: 2434017 - RNA, 10 nt, Human
caccucccug

SEQ ID NO: 2434018 - RNA, 15 nt, Human
caccuccccuccuug

SEQ ID NO: 2434019 - RNA, 23 nt, Human
caccuccccuccuugccuccugu

SEQ ID NO: 2434020 - RNA, 19 nt, Human
caccuccccuauccaccca

SEQ ID NO: 2434021 - RNA, 20 nt, Human
caccuccccuauccacccag

SEQ ID NO: 2434022 - RNA, 11 nt, Human
caccuccccuc

SEQ ID NO: 2434023 - RNA, 14 nt, Human
caccuccccuccuu

SEQ ID NO: 2434024 - RNA, 14 nt, Human
caccuccccccacu

SEQ ID NO: 2434025 - RNA, 15 nt, Human
caccuccccccacug

SEQ ID NO: 2434026 - RNA, 16 nt, Human
caccuccccccacugc

SEQ ID NO: 2434027 - RNA, 17 nt, Human
caccuccccccacugca

SEQ ID NO: 2434028 - RNA, 18 nt, Human
caccuccccccacugcag

SEQ ID NO: 2434029 - RNA, 21 nt, Human
caccuccccccacugcaggcc

SEQ ID NO: 2434030 - RNA, 22 nt, Human
caccuccccccacugcaggccc

SEQ ID NO: 2434031 - RNA, 20 nt, Human
caccucccccucccccuucu

SEQ ID NO: 2434032 - RNA, 23 nt, Human
caccuccccccacugcaggcccc

SEQ ID NO: 2434033 - RNA, 16 nt, Human
caccucccccugcccc

SEQ ID NO: 2434034 - RNA, 13 nt, Human
caccuccccuauc

SEQ ID NO: 2434035 - RNA, 14 nt, Human
caccuccccuaucc

SEQ ID NO: 2434036 - RNA, 18 nt, Human
caccuccccuauccaccc

SEQ ID NO: 2434037 - RNA, 14 nt, Human
caccucccccaucu

SEQ ID NO: 2434038 - RNA, 21 nt, Human
caccucccccaucucuucugg

SEQ ID NO: 2434039 - RNA, 15 nt, Human
caccuccccaggccg

SEQ ID NO: 2434040 - RNA, 14 nt, Human
caccuccccaggcc

SEQ ID NO: 2434041 - RNA, 14 nt, Human
caccuccccagccu

SEQ ID NO: 2434042 - RNA, 21 nt, Human
caccuccccaggccguggcug

SEQ ID NO: 2434043 - RNA, 11 nt, Human
caccuccugcc

SEQ ID NO: 2434044 - RNA, 13 nt, Human
caccuccugccuc

SEQ ID NO: 2434045 - RNA, 14 nt, Human
caccuccugccucg

SEQ ID NO: 2434046 - RNA, 14 nt, Human
caccucccugaccc

SEQ ID NO: 2434047 - RNA, 13 nt, Human
caccucccugccu

SEQ ID NO: 2434048 - RNA, 14 nt, Human
caccucccugccuc

SEQ ID NO: 2434049 - RNA, 15 nt, Human
caccucccugccucc

SEQ ID NO: 2434050 - RNA, 17 nt, Human
caccucccugccuccag

SEQ ID NO: 2434051 - RNA, 14 nt, Human
caccuccucaugua

SEQ ID NO: 2434052 - RNA, 12 nt, Human
caccucccugcc

SEQ ID NO: 2434053 - RNA, 12 nt, Human
caccucccuccc

SEQ ID NO: 2434054 - RNA, 16 nt, Human
caccucccucccggca

SEQ ID NO: 2434055 - RNA, 19 nt, Human
caccucccugaaccauccc

SEQ ID NO: 2434056 - RNA, 16 nt, Human
caccucuccaagggcu

SEQ ID NO: 2434057 - RNA, 15 nt, Human
caccucuccaagggc

SEQ ID NO: 2434058 - RNA, 13 nt, Human
caccucuccaagg

SEQ ID NO: 2434059 - RNA, 12 nt, Human
caccucuccaag

SEQ ID NO: 2434060 - RNA, 11 nt, Human
caccucuccaa

SEQ ID NO: 2434061 - RNA, 12 nt, Human
caccuccuucuc

SEQ ID NO: 2434062 - RNA, 17 nt, Human
caccucucccuuggauu

SEQ ID NO: 2434063 - RNA, 14 nt, Human
caccucucccuugg

SEQ ID NO: 2434064 - RNA, 13 nt, Human
caccucucccuug

SEQ ID NO: 2434065 - RNA, 13 nt, Human
caccucucccuca

SEQ ID NO: 2434066 - RNA, 12 nt, Human
caccucucccuc

SEQ ID NO: 2434067 - RNA, 22 nt, Human
caccucuccaagggcuucugca

SEQ ID NO: 2434068 - RNA, 18 nt, Human
caccucuccaagggcuuc

SEQ ID NO: 2434069 - RNA, 19 nt, Human
caccucucccucaacaagg

SEQ ID NO: 2434070 - RNA, 14 nt, Human
caccucucccucaa

SEQ ID NO: 2434071 - RNA, 19 nt, Human
caccucucccugacccugu

SEQ ID NO: 2434072 - RNA, 16 nt, Human
caccggcuggccuggc

SEQ ID NO: 2434073 - RNA, 15 nt, Human
caccggcuggccugg

SEQ ID NO: 2434074 - RNA, 14 nt, Human
caccggcuggccug

SEQ ID NO: 2434075 - RNA, 15 nt, Human
caccggauccugggu

SEQ ID NO: 2434076 - RNA, 21 nt, Human
caccggauccuggguggucug

SEQ ID NO: 2434077 - RNA, 22 nt, Human
caccggauccuggguggucugc

SEQ ID NO: 2434078 - RNA, 18 nt, Human
caccggcuggccuggccc

SEQ ID NO: 2434079 - RNA, 17 nt, Human
caccggcuggccuggcc

SEQ ID NO: 2434080 - RNA, 20 nt, Human
caccggcuggccuggccccu

SEQ ID NO: 2434081 - RNA, 14 nt, Human
caccgggcacucag

SEQ ID NO: 2434082 - RNA, 22 nt, Human
caccgccgacuuuguacccccc

SEQ ID NO: 2434083 - RNA, 19 nt, Human
caccgccgacuuuguaccc

SEQ ID NO: 2434084 - RNA, 22 nt, Human
caccgccauggcuuccaaggug

SEQ ID NO: 2434085 - RNA, 16 nt, Human
caccgccauggcuucc

SEQ ID NO: 2434086 - RNA, 23 nt, Human
caccgccauggcuuccaaggugg

SEQ ID NO: 2434087 - RNA, 13 nt, Human
caccgccauggcu

SEQ ID NO: 2434088 - RNA, 18 nt, Human
caccgccacauggcuucc

SEQ ID NO: 2434089 - RNA, 21 nt, Human
caccgccacaauaaagaucgc

SEQ ID NO: 2434090 - RNA, 22 nt, Human
caccgcaugcccccucgugcca

SEQ ID NO: 2434091 - RNA, 19 nt, Human
caccgcaugcccccucgug

SEQ ID NO: 2434092 - RNA, 18 nt, Human
caccgcaugcccccucgu

SEQ ID NO: 2434093 - RNA, 16 nt, Human
caccgcaugcccccuc

SEQ ID NO: 2434094 - RNA, 15 nt, Human
caccgcaugcccccu

SEQ ID NO: 2434095 - RNA, 21 nt, Human
caccgcagacaggaccaggga

SEQ ID NO: 2434096 - RNA, 14 nt, Human
caccgcaugccccc

SEQ ID NO: 2434097 - RNA, 19 nt, Human
caccgcagucgucgcacag

SEQ ID NO: 2434098 - RNA, 13 nt, Human
caccgcagucguc

SEQ ID NO: 2434099 - RNA, 21 nt, Human
caccgagaguagccgagagcc

SEQ ID NO: 2434100 - RNA, 13 nt, Human
caccgcuccccag

SEQ ID NO: 2434101 - RNA, 17 nt, Human
caccgccuccuacagcc

SEQ ID NO: 2434102 - RNA, 23 nt, Human
caccgcuuccggcuccugugcuu

SEQ ID NO: 2434103 - RNA, 22 nt, Human
caccggagcuuucaaagaagga

SEQ ID NO: 2434104 - RNA, 22 nt, Human
caccgcugccuaaguggcugcu

SEQ ID NO: 2434105 - RNA, 22 nt, Human
caccgcuuccggcuccugugcu

SEQ ID NO: 2434106 - RNA, 19 nt, Human
caccgcugccuaaguggcu

SEQ ID NO: 2434107 - RNA, 14 nt, Human
caccgcuccccagc

SEQ ID NO: 2434108 - RNA, 16 nt, Human
caccgcuccccagccc

SEQ ID NO: 2434109 - RNA, 17 nt, Human
caccgcuccccagccca

SEQ ID NO: 2434110 - RNA, 18 nt, Human
caccgcuccccagcccag

SEQ ID NO: 2434111 - RNA, 20 nt, Human
caccgcuccccagcccaggg

SEQ ID NO: 2434112 - RNA, 21 nt, Human
caccgcuccccagcccagggu

SEQ ID NO: 2434113 - RNA, 12 nt, Human
caccgcugccua

SEQ ID NO: 2434114 - RNA, 13 nt, Human
caccgcugccuaa

SEQ ID NO: 2434115 - RNA, 15 nt, Human
caccggggccucgga

SEQ ID NO: 2434116 - RNA, 13 nt, Human
caccgggccugga

SEQ ID NO: 2434117 - RNA, 18 nt, Human
caccgggccacagagaaa

SEQ ID NO: 2434118 - RNA, 15 nt, Human
caccgggccacagag

SEQ ID NO: 2434119 - RNA, 22 nt, Human
caccgggcacucagaagacacu

SEQ ID NO: 2434120 - RNA, 15 nt, Human
caccgggcacucaga

SEQ ID NO: 2434121 - RNA, 17 nt, Human
caccgugggcucccuga

SEQ ID NO: 2434122 - RNA, 18 nt, Human
caccgugggcucccugac

SEQ ID NO: 2434123 - RNA, 13 nt, Human
caccgugggcucc

SEQ ID NO: 2434124 - RNA, 15 nt, Human
caccgugggcaggga

SEQ ID NO: 2434125 - RNA, 23 nt, Human
caccucaggccaggugcaguggc

SEQ ID NO: 2434126 - RNA, 15 nt, Human
caccguguaaaccaa

SEQ ID NO: 2434127 - RNA, 11 nt, Human
caccucaguuc

SEQ ID NO: 2434128 - RNA, 17 nt, Human
caccucaguucccuugg

SEQ ID NO: 2434129 - RNA, 18 nt, Human
caccucaguucccuuggc

SEQ ID NO: 2434130 - RNA, 19 nt, Human
caccucaguucccuuggcc

SEQ ID NO: 2434131 - RNA, 20 nt, Human
caccucaguucccuuggccu

SEQ ID NO: 2434132 - RNA, 21 nt, Human
caccucaguucccuuggccuc

SEQ ID NO: 2434133 - RNA, 22 nt, Human
caccucaguucccuuggccuca

SEQ ID NO: 2434134 - RNA, 18 nt, Human
caccucaugcccaccccc

SEQ ID NO: 2434135 - RNA, 17 nt, Human
caccucaugcccacccc

SEQ ID NO: 2434136 - RNA, 16 nt, Human
caccucaugcccaccc

SEQ ID NO: 2434137 - RNA, 15 nt, Human
caccucaugcccacc

SEQ ID NO: 2434138 - RNA, 14 nt, Human
caccucaugcccac

SEQ ID NO: 2434139 - RNA, 12 nt, Human
caccucaugccc

SEQ ID NO: 2434140 - RNA, 23 nt, Human
caccucaguucccuuggccucag

SEQ ID NO: 2434141 - RNA, 19 nt, Human
caccguccgcccugcuccu

SEQ ID NO: 2434142 - RNA, 18 nt, Human
caccguccgcccugcucc

SEQ ID NO: 2434143 - RNA, 15 nt, Human
caccguggaccuucc

SEQ ID NO: 2434144 - RNA, 20 nt, Human
caccgugccuggccacgccc

SEQ ID NO: 2434145 - RNA, 19 nt, Human
caccguggaccuuccugcc

SEQ ID NO: 2434146 - RNA, 18 nt, Human
caccguggaccuuccugc

SEQ ID NO: 2434147 - RNA, 17 nt, Human
caccguggaccuuccug

SEQ ID NO: 2434148 - RNA, 16 nt, Human
caccguggaccuuccu

SEQ ID NO: 2434149 - RNA, 23 nt, Human
caccguggaccuuccugccacca

SEQ ID NO: 2434150 - RNA, 20 nt, Human
caccguggaccuuccugcca

SEQ ID NO: 2434151 - RNA, 17 nt, Human
caccguggaggaggaag

SEQ ID NO: 2434152 - RNA, 15 nt, Human
caccguggcuaagag

SEQ ID NO: 2434153 - RNA, 15 nt, Human
caccgugccuggcca

SEQ ID NO: 2434154 - RNA, 16 nt, Human
caccguccgcccugcu

SEQ ID NO: 2434155 - RNA, 15 nt, Human
caccguccgcccugc

SEQ ID NO: 2434156 - RNA, 14 nt, Human
caccguccgcccug

SEQ ID NO: 2434157 - RNA, 19 nt, Human
caccgucauggcuuaaugu

SEQ ID NO: 2434158 - RNA, 15 nt, Human
caccgucauggcuua

SEQ ID NO: 2434159 - RNA, 23 nt, Human
caccgucauggcuuaauguuuau

SEQ ID NO: 2434160 - RNA, 14 nt, Human
caccguacugugga

SEQ ID NO: 2434161 - RNA, 20 nt, Human
cacauauugauuuccguuaa

SEQ ID NO: 2434162 - RNA, 13 nt, Human
cacauauugauuu

SEQ ID NO: 2434163 - RNA, 20 nt, Human
caccccucaacaccucugca

SEQ ID NO: 2434164 - RNA, 17 nt, Human
caccccucacucuggcc

SEQ ID NO: 2434165 - RNA, 12 nt, Human
caccccucacuc

SEQ ID NO: 2434166 - RNA, 15 nt, Human
caccccuaaagagau

SEQ ID NO: 2434167 - RNA, 13 nt, Human
caccccucccauu

SEQ ID NO: 2434168 - RNA, 12 nt, Human
caccccucccau

SEQ ID NO: 2434169 - RNA, 10 nt, Human
caccccuccc

SEQ ID NO: 2434170 - RNA, 13 nt, Human
caccccuccagga

SEQ ID NO: 2434171 - RNA, 17 nt, Human
caccccucccauuagga

SEQ ID NO: 2434172 - RNA, 13 nt, Human
caccccuccccau

SEQ ID NO: 2434173 - RNA, 15 nt, Human
caccccuccccugcc

SEQ ID NO: 2434174 - RNA, 15 nt, Human
caccccucccuuucu

SEQ ID NO: 2434175 - RNA, 22 nt, Human
caccccuccccugcccuagagc

SEQ ID NO: 2434176 - RNA, 18 nt, Human
caccccucccuuucuccc

SEQ ID NO: 2434177 - RNA, 12 nt, Human
caccccuccuuc

SEQ ID NO: 2434178 - RNA, 14 nt, Human
caccccuccuuccu

SEQ ID NO: 2434179 - RNA, 18 nt, Human
caccccugcccccacuuc

SEQ ID NO: 2434180 - RNA, 14 nt, Human
caccccugccccca

SEQ ID NO: 2434181 - RNA, 13 nt, Human
caccccugccccc

SEQ ID NO: 2434182 - RNA, 15 nt, Human
caccccucucugcau

SEQ ID NO: 2434183 - RNA, 11 nt, Human
caccccugccc

SEQ ID NO: 2434184 - RNA, 12 nt, Human
caccccucucug

SEQ ID NO: 2434185 - RNA, 23 nt, Human
caccccuccuuccuugaccagca

SEQ ID NO: 2434186 - RNA, 18 nt, Human
caccccugccuccacccu

SEQ ID NO: 2434187 - RNA, 16 nt, Human
caccccugccuccacc

SEQ ID NO: 2434188 - RNA, 15 nt, Human
caccccugccuccac

SEQ ID NO: 2434189 - RNA, 14 nt, Human
caccccugccucca

SEQ ID NO: 2434190 - RNA, 22 nt, Human
caccccugccuccacccucuga

SEQ ID NO: 2434191 - RNA, 20 nt, Human
caccccugccuccacccucu

SEQ ID NO: 2434192 - RNA, 23 nt, Human
caccccugccuccacccucugag

SEQ ID NO: 2434193 - RNA, 18 nt, Human
caccccugcccccagccc

SEQ ID NO: 2434194 - RNA, 21 nt, Human
caccccugcccccacuuccug

SEQ ID NO: 2434195 - RNA, 19 nt, Human
caccccugcccccagcccc

SEQ ID NO: 2434196 - RNA, 15 nt, Human
caccccugcccuggg

SEQ ID NO: 2434197 - RNA, 13 nt, Human
caccccugccucc

SEQ ID NO: 2434198 - RNA, 12 nt, Human
caccccugccuc

SEQ ID NO: 2434199 - RNA, 16 nt, Human
caccccugcccuggga

SEQ ID NO: 2434200 - RNA, 24 nt, Human
caccccugcccugggauguccaca

SEQ ID NO: 2434201 - RNA, 14 nt, Human
cacccgacuccuca

SEQ ID NO: 2434202 - RNA, 15 nt, Human
cacccgacuccucaa

SEQ ID NO: 2434203 - RNA, 16 nt, Human
cacccgacuccucaaa

SEQ ID NO: 2434204 - RNA, 12 nt, Human
cacccgaggcug

SEQ ID NO: 2434205 - RNA, 15 nt, Human
cacccgaggcugccc

SEQ ID NO: 2434206 - RNA, 16 nt, Human
cacccgaggcugccca

SEQ ID NO: 2434207 - RNA, 19 nt, Human
cacccgaugcugcuuuccc

SEQ ID NO: 2434208 - RNA, 18 nt, Human
cacccgaugcugcuuucc

SEQ ID NO: 2434209 - RNA, 16 nt, Human
cacccgaugcugcuuu

SEQ ID NO: 2434210 - RNA, 15 nt, Human
cacccgaugcugcuu

SEQ ID NO: 2434211 - RNA, 14 nt, Human
cacccgaugcugcu

SEQ ID NO: 2434212 - RNA, 13 nt, Human
cacccgaugcugc

SEQ ID NO: 2434213 - RNA, 17 nt, Human
cacccgaggcugcccac

SEQ ID NO: 2434214 - RNA, 18 nt, Human
cacccgaggcugcccacu

SEQ ID NO: 2434215 - RNA, 13 nt, Human
cacccgaccacac

SEQ ID NO: 2434216 - RNA, 19 nt, Human
caccccuugcucucaaccc

SEQ ID NO: 2434217 - RNA, 21 nt, Human
caccccuucucuccuccccaa

SEQ ID NO: 2434218 - RNA, 18 nt, Human
caccccuucucuccuccc

SEQ ID NO: 2434219 - RNA, 12 nt, Human
caccccuucucu

SEQ ID NO: 2434220 - RNA, 22 nt, Human
caccccuuccugucccaccucu

SEQ ID NO: 2434221 - RNA, 16 nt, Human
caccccuuccuguccc

SEQ ID NO: 2434222 - RNA, 14 nt, Human
caccccuuccuguc

SEQ ID NO: 2434223 - RNA, 13 nt, Human
caccccuuccugu

SEQ ID NO: 2434224 - RNA, 14 nt, Human
caccccuuccccac

SEQ ID NO: 2434225 - RNA, 15 nt, Human
caccccuuccccacu

SEQ ID NO: 2434226 - RNA, 12 nt, Human
caccccuuccug

SEQ ID NO: 2434227 - RNA, 18 nt, Human
caccccuuccccacugcc

SEQ ID NO: 2434228 - RNA, 13 nt, Human
caccccugugcuc

SEQ ID NO: 2434229 - RNA, 12 nt, Human
caccccugugcu

SEQ ID NO: 2434230 - RNA, 13 nt, Human
caccccugucucu

SEQ ID NO: 2434231 - RNA, 23 nt, Human
caccccuguccucacugcucccu

SEQ ID NO: 2434232 - RNA, 21 nt, Human
caccccuguccucacugcucc

SEQ ID NO: 2434233 - RNA, 20 nt, Human
caccccuguccucacugcuc

SEQ ID NO: 2434234 - RNA, 18 nt, Human
caccccuguccucacugc

SEQ ID NO: 2434235 - RNA, 17 nt, Human
caccccuguccucacug

SEQ ID NO: 2434236 - RNA, 12 nt, Human
caccccuggggg

SEQ ID NO: 2434237 - RNA, 14 nt, Human
caccccugggggcu

SEQ ID NO: 2434238 - RNA, 18 nt, Human
caccccugggggcucuca

SEQ ID NO: 2434239 - RNA, 18 nt, Human
caccccugguucucaucu

SEQ ID NO: 2434240 - RNA, 17 nt, Human
caccccugguucucauc

SEQ ID NO: 2434241 - RNA, 19 nt, Human
caccccuuauccaggacuc

SEQ ID NO: 2434242 - RNA, 18 nt, Human
caccccuuauccaggacu

SEQ ID NO: 2434243 - RNA, 17 nt, Human
caccccuuauccaggac

SEQ ID NO: 2434244 - RNA, 16 nt, Human
caccccuuauccagga

SEQ ID NO: 2434245 - RNA, 23 nt, Human
caccccugugcuccgugccucca

SEQ ID NO: 2434246 - RNA, 22 nt, Human
caccccugugcuccgugccucc

SEQ ID NO: 2434247 - RNA, 21 nt, Human
caccccugugcuccgugccuc

SEQ ID NO: 2434248 - RNA, 17 nt, Human
caccccugugcuccgug

SEQ ID NO: 2434249 - RNA, 15 nt, Human
caccccuuccaugug

SEQ ID NO: 2434250 - RNA, 14 nt, Human
caccccuuccaugu

SEQ ID NO: 2434251 - RNA, 11 nt, Human
caccccuucca

SEQ ID NO: 2434252 - RNA, 20 nt, Human
caccccuuauccaggacucu

SEQ ID NO: 2434253 - RNA, 16 nt, Human
caccccuuccaugugg

SEQ ID NO: 2434254 - RNA, 11 nt, Human
caccccuuccc

SEQ ID NO: 2434255 - RNA, 12 nt, Human
caccccuucccc

SEQ ID NO: 2434256 - RNA, 13 nt, Human
caccccuucccca

SEQ ID NO: 2434257 - RNA, 21 nt, Human
cacccggccccugcugguuca

SEQ ID NO: 2434258 - RNA, 18 nt, Human
cacccggccccugcuggu

SEQ ID NO: 2434259 - RNA, 17 nt, Human
cacccggccccugcugg

SEQ ID NO: 2434260 - RNA, 16 nt, Human
cacccggccccugcug

SEQ ID NO: 2434261 - RNA, 14 nt, Human
cacccggccccugc

SEQ ID NO: 2434262 - RNA, 13 nt, Human
cacccggccccug

SEQ ID NO: 2434263 - RNA, 19 nt, Human
cacccgcuaagagggaggg

SEQ ID NO: 2434264 - RNA, 12 nt, Human
cacccggccccu

SEQ ID NO: 2434265 - RNA, 16 nt, Human
cacccgccuuuuauaa

SEQ ID NO: 2434266 - RNA, 14 nt, Human
cacccgccucuccc

SEQ ID NO: 2434267 - RNA, 13 nt, Human
cacccgccucucc

SEQ ID NO: 2434268 - RNA, 23 nt, Human
cacccgaugcugcuuuccccugu

SEQ ID NO: 2434269 - RNA, 21 nt, Human
cacccggcugcagaggccaga

SEQ ID NO: 2434270 - RNA, 15 nt, Human
cacccggcugcagag

SEQ ID NO: 2434271 - RNA, 23 nt, Human
cacccgggcucagggaccacagc

SEQ ID NO: 2434272 - RNA, 13 nt, Human
cacccgggcucag

SEQ ID NO: 2434273 - RNA, 16 nt, Human
cacccguggagauggg

SEQ ID NO: 2434274 - RNA, 18 nt, Human
cacccguucugcuggccu

SEQ ID NO: 2434275 - RNA, 17 nt, Human
cacccguggagauggga

SEQ ID NO: 2434276 - RNA, 20 nt, Human
cacccguucugcuggccugg

SEQ ID NO: 2434277 - RNA, 19 nt, Human
cacccguucugcuggccug

SEQ ID NO: 2434278 - RNA, 21 nt, Human
cacccguucugcuggccugga

SEQ ID NO: 2434279 - RNA, 12 nt, Human
cacccuaccugu

SEQ ID NO: 2434280 - RNA, 16 nt, Human
cacccuaccuguucag

SEQ ID NO: 2434281 - RNA, 14 nt, Human
cacccuaccuguuc

SEQ ID NO: 2434282 - RNA, 16 nt, Human
cacccuaccugugccu

SEQ ID NO: 2434283 - RNA, 16 nt, Human
cacccuagucccuucc

SEQ ID NO: 2434284 - RNA, 17 nt, Human
cacccuagucccuuccc

SEQ ID NO: 2434285 - RNA, 20 nt, Human
cacccugucccccagcucug

SEQ ID NO: 2434286 - RNA, 19 nt, Human
cacccugucccccagcucu

SEQ ID NO: 2434287 - RNA, 18 nt, Human
cacccugucccccagcuc

SEQ ID NO: 2434288 - RNA, 16 nt, Human
cacccugucccccagc

SEQ ID NO: 2434289 - RNA, 23 nt, Human
cacccugucccccagcucuggug

SEQ ID NO: 2434290 - RNA, 22 nt, Human
cacccugucccccagcucuggu

SEQ ID NO: 2434291 - RNA, 17 nt, Human
cacccugucuaaaaaac

SEQ ID NO: 2434292 - RNA, 18 nt, Human
cacccucagcaccccuuc

SEQ ID NO: 2434293 - RNA, 15 nt, Human
cacccugucccccag

SEQ ID NO: 2434294 - RNA, 17 nt, Human
cacccucagcaccccuu

SEQ ID NO: 2434295 - RNA, 16 nt, Human
cacccucagcaccccu

SEQ ID NO: 2434296 - RNA, 12 nt, Human
cacccucacacu

SEQ ID NO: 2434297 - RNA, 17 nt, Human
cacccuaguuucccuga

SEQ ID NO: 2434298 - RNA, 16 nt, Human
cacccuaguuucccug

SEQ ID NO: 2434299 - RNA, 18 nt, Human
cacccucaaccucuucug

SEQ ID NO: 2434300 - RNA, 18 nt, Human
cacccuagucccuucccc

SEQ ID NO: 2434301 - RNA, 20 nt, Human
cacccuagucccuuccccuc

SEQ ID NO: 2434302 - RNA, 23 nt, Human
cacccugugauggggcccugccu

SEQ ID NO: 2434303 - RNA, 22 nt, Human
cacccugugauggggcccugcc

SEQ ID NO: 2434304 - RNA, 21 nt, Human
cacccugugauggggcccugc

SEQ ID NO: 2434305 - RNA, 20 nt, Human
cacccugugauggggcccug

SEQ ID NO: 2434306 - RNA, 18 nt, Human
cacccugugauggggccc

SEQ ID NO: 2434307 - RNA, 15 nt, Human
cacccugugaugggg

SEQ ID NO: 2434308 - RNA, 12 nt, Human
cacccugugaug

SEQ ID NO: 2434309 - RNA, 11 nt, Human
cacccugugau

SEQ ID NO: 2434310 - RNA, 14 nt, Human
cacccuuggacuug

SEQ ID NO: 2434311 - RNA, 13 nt, Human
cacccuuggacuu

SEQ ID NO: 2434312 - RNA, 23 nt, Human
cacccuugcccaccccaccccca

SEQ ID NO: 2434313 - RNA, 12 nt, Human
cacccuugccca

SEQ ID NO: 2434314 - RNA, 21 nt, Human
cacccuucuuuccucuucccc

SEQ ID NO: 2434315 - RNA, 20 nt, Human
cacccuucuuuccucuuccc

SEQ ID NO: 2434316 - RNA, 19 nt, Human
cacccuucuuuccucuucc

SEQ ID NO: 2434317 - RNA, 18 nt, Human
cacccuucuuuccucuuc

SEQ ID NO: 2434318 - RNA, 16 nt, Human
cacccuucuuuccucu

SEQ ID NO: 2434319 - RNA, 15 nt, Human
cacccuucuuuccuc

SEQ ID NO: 2434320 - RNA, 13 nt, Human
cacccuucuuucc

SEQ ID NO: 2434321 - RNA, 16 nt, Human
cacccuuggacuugag

SEQ ID NO: 2434322 - RNA, 17 nt, Human
cacccuuggaggcuguc

SEQ ID NO: 2434323 - RNA, 19 nt, Human
cacccuuggaggcugucuu

SEQ ID NO: 2434324 - RNA, 20 nt, Human
cacccuuggaggcugucuuc

SEQ ID NO: 2434325 - RNA, 21 nt, Human
cacccuuggaggcugucuucu

SEQ ID NO: 2434326 - RNA, 12 nt, Human
cacccuuggccu

SEQ ID NO: 2434327 - RNA, 13 nt, Human
cacccuuggccug

SEQ ID NO: 2434328 - RNA, 15 nt, Human
cacccuuggccuguc

SEQ ID NO: 2434329 - RNA, 18 nt, Human
cacccuuggccugucuca

SEQ ID NO: 2434330 - RNA, 16 nt, Human
cacccuuaccaugugc

SEQ ID NO: 2434331 - RNA, 20 nt, Human
cacccuucacauacccuccc

SEQ ID NO: 2434332 - RNA, 22 nt, Human
cacccuucacauacccuccccc

SEQ ID NO: 2434333 - RNA, 13 nt, Human
cacccuuccccuc

SEQ ID NO: 2434334 - RNA, 14 nt, Human
cacccuuccccucc

SEQ ID NO: 2434335 - RNA, 22 nt, Human
cacccuuccccuccuucucccu

SEQ ID NO: 2434336 - RNA, 23 nt, Human
cacccuuccccuccuucucccuu

SEQ ID NO: 2434337 - RNA, 18 nt, Human
caccgcagacaggaccag

SEQ ID NO: 2434338 - RNA, 17 nt, Human
caccgcagacaggacca

SEQ ID NO: 2434339 - RNA, 15 nt, Human
caccgcagacaggac

SEQ ID NO: 2434340 - RNA, 14 nt, Human
caccgcagacagga

SEQ ID NO: 2434341 - RNA, 13 nt, Human
caccgcagacagg

SEQ ID NO: 2434342 - RNA, 12 nt, Human
caccgcagacag

SEQ ID NO: 2434343 - RNA, 18 nt, Human
caccgacgcgucuccugu

SEQ ID NO: 2434344 - RNA, 17 nt, Human
caccgacgcgucuccug

SEQ ID NO: 2434345 - RNA, 23 nt, Human
caccgaaguggacuggccccugg

SEQ ID NO: 2434346 - RNA, 22 nt, Human
caccgaaguggacuggccccug

SEQ ID NO: 2434347 - RNA, 19 nt, Human
caccgacgcgucuccuguu

SEQ ID NO: 2434348 - RNA, 12 nt, Human
caccgagugggg

SEQ ID NO: 2434349 - RNA, 17 nt, Human
caccgagggcgaccccg

SEQ ID NO: 2434350 - RNA, 13 nt, Human
caccgagaauguu

SEQ ID NO: 2434351 - RNA, 18 nt, Human
caccgagaguagccgaga

SEQ ID NO: 2434352 - RNA, 18 nt, Human
caccgaaaacguggcugc

SEQ ID NO: 2434353 - RNA, 15 nt, Human
caccgaaaacguggc

SEQ ID NO: 2434354 - RNA, 22 nt, Human
cacccuuugcugugaggcuguc

SEQ ID NO: 2434355 - RNA, 20 nt, Human
cacccuuugcugugaggcug

SEQ ID NO: 2434356 - RNA, 15 nt, Human
cacccuuuuccagcu

SEQ ID NO: 2434357 - RNA, 17 nt, Human
cacccuuuuccagcugg

SEQ ID NO: 2434358 - RNA, 22 nt, Human
cacccuuggaggcugucuucuc

SEQ ID NO: 2434359 - RNA, 21 nt, Human
cacccuuggccugucucaucc

SEQ ID NO: 2434360 - RNA, 23 nt, Human
cacccuuggccugucucaucccc

SEQ ID NO: 2434361 - RNA, 21 nt, Human
caccgaaaacguggcugcuuc

SEQ ID NO: 2434362 - RNA, 19 nt, Human
caccgaaaacguggcugcu

SEQ ID NO: 2434363 - RNA, 22 nt, Human
caccgaaaacguggcugcuuca

SEQ ID NO: 2434364 - RNA, 21 nt, Human
caccgaaguggacuggccccu

SEQ ID NO: 2434365 - RNA, 21 nt, Human
cacccuuuuccagcuggauga

SEQ ID NO: 2434366 - RNA, 22 nt, Human
cagaggcagccccauucugccu

SEQ ID NO: 2434367 - RNA, 20 nt, Human
cagaggcagccccauucugc

SEQ ID NO: 2434368 - RNA, 19 nt, Human
cagaggcagccccauucug

SEQ ID NO: 2434369 - RNA, 18 nt, Human
cagaggcagccccauucu

SEQ ID NO: 2434370 - RNA, 15 nt, Human
cagaggcagccccau

SEQ ID NO: 2434371 - RNA, 14 nt, Human
cagaggcagcccca

SEQ ID NO: 2434372 - RNA, 13 nt, Human
cagaggcagcccc

SEQ ID NO: 2434373 - RNA, 12 nt, Human
cagaggcagccc

SEQ ID NO: 2434374 - RNA, 20 nt, Human
cagaggccagaggcccccag

SEQ ID NO: 2434375 - RNA, 14 nt, Human
cagaggccauggca

SEQ ID NO: 2434376 - RNA, 21 nt, Human
cagaggccaugggccuccugu

SEQ ID NO: 2434377 - RNA, 20 nt, Human
cagaggccaugggccuccug

SEQ ID NO: 2434378 - RNA, 16 nt, Human
cagaggccaugggccu

SEQ ID NO: 2434379 - RNA, 19 nt, Human
cagaggccaugggccuccu

SEQ ID NO: 2434380 - RNA, 23 nt, Human
cagaggcagccccauucugccug

SEQ ID NO: 2434381 - RNA, 22 nt, Human
cagaggauggccagugucuguc

SEQ ID NO: 2434382 - RNA, 19 nt, Human
cagaggauggccagugucu

SEQ ID NO: 2434383 - RNA, 21 nt, Human
cagaggauugcugccccauca

SEQ ID NO: 2434384 - RNA, 19 nt, Human
cagagggagugacagaggc

SEQ ID NO: 2434385 - RNA, 18 nt, Human
cagagggagugacagagg

SEQ ID NO: 2434386 - RNA, 16 nt, Human
cagagggagugacaga

SEQ ID NO: 2434387 - RNA, 14 nt, Human
cagagggagugaca

SEQ ID NO: 2434388 - RNA, 23 nt, Human
cagaggcugccucucccaucacu

SEQ ID NO: 2434389 - RNA, 14 nt, Human
cagaggcugcccca

SEQ ID NO: 2434390 - RNA, 13 nt, Human
cagaggcuggagg

SEQ ID NO: 2434391 - RNA, 17 nt, Human
cagaggcuaauucugca

SEQ ID NO: 2434392 - RNA, 14 nt, Human
cagaggcuggaggc

SEQ ID NO: 2434393 - RNA, 16 nt, Human
cagaggcuggaggcag

SEQ ID NO: 2434394 - RNA, 17 nt, Human
cagaggcuggaggcagg

SEQ ID NO: 2434395 - RNA, 18 nt, Human
cagaggcuggaggcaggg

SEQ ID NO: 2434396 - RNA, 13 nt, Human
cagaggcuggguu

SEQ ID NO: 2434397 - RNA, 12 nt, Human
cagaggcugggu

SEQ ID NO: 2434398 - RNA, 19 nt, Human
cagaggcuggaggcagggc

SEQ ID NO: 2434399 - RNA, 20 nt, Human
cagaggcuggaggcagggcc

SEQ ID NO: 2434400 - RNA, 14 nt, Human
cagaggcuggguuc

SEQ ID NO: 2434401 - RNA, 21 nt, Human
cagaggcuggaggcagggccu

SEQ ID NO: 2434402 - RNA, 15 nt, Human
cagaggcuucuucag

SEQ ID NO: 2434403 - RNA, 16 nt, Human
cagaggcuucuucaga

SEQ ID NO: 2434404 - RNA, 20 nt, Human
cagaggcuucuucagaucag

SEQ ID NO: 2434405 - RNA, 23 nt, Human
cagagggaaaguaaauauuucag

SEQ ID NO: 2434406 - RNA, 19 nt, Human
cagagggaagaaaagagcu

SEQ ID NO: 2434407 - RNA, 17 nt, Human
cagaggcgcacugugac

SEQ ID NO: 2434408 - RNA, 14 nt, Human
cagaggccugcccg

SEQ ID NO: 2434409 - RNA, 13 nt, Human
cagaggccugccc

SEQ ID NO: 2434410 - RNA, 23 nt, Human
cagaggcgcaugaauuugugaag

SEQ ID NO: 2434411 - RNA, 18 nt, Human
cagaggcgcacugugacc

SEQ ID NO: 2434412 - RNA, 20 nt, Human
cagaggcuauuauuuucacu

SEQ ID NO: 2434413 - RNA, 13 nt, Human
cagaggcugccuc

SEQ ID NO: 2434414 - RNA, 22 nt, Human
cagaggcccccagcccagggcu

SEQ ID NO: 2434415 - RNA, 19 nt, Human
cagaggcccccagcccagg

SEQ ID NO: 2434416 - RNA, 17 nt, Human
cagaggcccccagccca

SEQ ID NO: 2434417 - RNA, 16 nt, Human
cagaggcccccagccc

SEQ ID NO: 2434418 - RNA, 13 nt, Human
cagaggccccagc

SEQ ID NO: 2434419 - RNA, 14 nt, Human
cagaggccccagcc

SEQ ID NO: 2434420 - RNA, 16 nt, Human
cagaggccccagccuc

SEQ ID NO: 2434421 - RNA, 17 nt, Human
cagaggccccagccucc

SEQ ID NO: 2434422 - RNA, 24 nt, Human
cagaggcccccagcccagggcucc

SEQ ID NO: 2434423 - RNA, 23 nt, Human
cagaggcccccagcccagggcuc

SEQ ID NO: 2434424 - RNA, 19 nt, Human
cagaggcccucgcugccag

SEQ ID NO: 2434425 - RNA, 20 nt, Human
cagaggccuauaaugaagcu

SEQ ID NO: 2434426 - RNA, 20 nt, Human
cagaggcccucgcugccagc

SEQ ID NO: 2434427 - RNA, 16 nt, Human
cagaggccuauaauga

SEQ ID NO: 2434428 - RNA, 23 nt, Human
cagagggagugacagaggcagcc

SEQ ID NO: 2434429 - RNA, 22 nt, Human
cagagggagugacagaggcagc

SEQ ID NO: 2434430 - RNA, 21 nt, Human
cagagggagugacagaggcag

SEQ ID NO: 2434431 - RNA, 20 nt, Human
cagagggagugacagaggca

SEQ ID NO: 2434432 - RNA, 19 nt, Human
cagagggccugcaagggag

SEQ ID NO: 2434433 - RNA, 15 nt, Human
cagagggccugcaag

SEQ ID NO: 2434434 - RNA, 14 nt, Human
cagagggcacucug

SEQ ID NO: 2434435 - RNA, 19 nt, Human
cagagggacuuuguauaga

SEQ ID NO: 2434436 - RNA, 22 nt, Human
cagagggaggaaucgaggaacc

SEQ ID NO: 2434437 - RNA, 23 nt, Human
cagagggaggaaucgaggaacca

SEQ ID NO: 2434438 - RNA, 16 nt, Human
cagagggcagaggcug

SEQ ID NO: 2434439 - RNA, 17 nt, Human
cagagggcagaggcugg

SEQ ID NO: 2434440 - RNA, 18 nt, Human
cagagggcagaggcugga

SEQ ID NO: 2434441 - RNA, 13 nt, Human
cagagggcccagg

SEQ ID NO: 2434442 - RNA, 15 nt, Human
cagagggcccaggca

SEQ ID NO: 2434443 - RNA, 16 nt, Human
cagagggcccaggcag

SEQ ID NO: 2434444 - RNA, 18 nt, Human
cagagggcccaggcaggc

SEQ ID NO: 2434445 - RNA, 21 nt, Human
cagagucucacuguugcccag

SEQ ID NO: 2434446 - RNA, 20 nt, Human
cagagucucacuguugccca

SEQ ID NO: 2434447 - RNA, 19 nt, Human
cagagucucacuguugccc

SEQ ID NO: 2434448 - RNA, 17 nt, Human
cagagucucacuguugc

SEQ ID NO: 2434449 - RNA, 14 nt, Human
cagaguccaggccc

SEQ ID NO: 2434450 - RNA, 15 nt, Human
cagaguccaggcccc

SEQ ID NO: 2434451 - RNA, 16 nt, Human
cagaguccaggcccca

SEQ ID NO: 2434452 - RNA, 22 nt, Human
cagagggcccaggcaggccacc

SEQ ID NO: 2434453 - RNA, 15 nt, Human
cagagucagcagaac

SEQ ID NO: 2434454 - RNA, 15 nt, Human
cagaguccuuuccaa

SEQ ID NO: 2434455 - RNA, 14 nt, Human
cagaguccuuucca

SEQ ID NO: 2434456 - RNA, 13 nt, Human
cagagucucacug

SEQ ID NO: 2434457 - RNA, 18 nt, Human
cagagugagacucugucu

SEQ ID NO: 2434458 - RNA, 17 nt, Human
cagagugagacucuguc

SEQ ID NO: 2434459 - RNA, 16 nt, Human
cagagugagacucugu

SEQ ID NO: 2434460 - RNA, 17 nt, Human
cagagugagacccagcc

SEQ ID NO: 2434461 - RNA, 20 nt, Human
cagagugagacccagcccuc

SEQ ID NO: 2434462 - RNA, 15 nt, Human
cagagugagacccug

SEQ ID NO: 2434463 - RNA, 19 nt, Human
cagagugagacccugucuc

SEQ ID NO: 2434464 - RNA, 23 nt, Human
cagagucucacuguugcccaggc

SEQ ID NO: 2434465 - RNA, 22 nt, Human
cagagucucacuguugcccagg

SEQ ID NO: 2434466 - RNA, 18 nt, Human
cagagucuugcuaccuca

SEQ ID NO: 2434467 - RNA, 20 nt, Human
cagagucuggugaagcucac

SEQ ID NO: 2434468 - RNA, 14 nt, Human
cagagugagaccca

SEQ ID NO: 2434469 - RNA, 15 nt, Human
cagagugagacccag

SEQ ID NO: 2434470 - RNA, 23 nt, Human
cagagucggaacggagaaaggug

SEQ ID NO: 2434471 - RNA, 15 nt, Human
cagagucggaacgga

SEQ ID NO: 2434472 - RNA, 18 nt, Human
cagagucggaacggagaa

SEQ ID NO: 2434473 - RNA, 23 nt, Human
cagagucucgcucuguugcccag

SEQ ID NO: 2434474 - RNA, 15 nt, Human
cagaguggccuggcc

SEQ ID NO: 2434475 - RNA, 16 nt, Human
cagaguggccuggcca

SEQ ID NO: 2434476 - RNA, 17 nt, Human
cagaguggccuggccag

SEQ ID NO: 2434477 - RNA, 18 nt, Human
cagaguggccuggccagg

SEQ ID NO: 2434478 - RNA, 21 nt, Human
cagaguggccuggccaggagc

SEQ ID NO: 2434479 - RNA, 22 nt, Human
cagaguggccuggccaggagcu

SEQ ID NO: 2434480 - RNA, 23 nt, Human
cagaguggccuggccaggagcuc

SEQ ID NO: 2434481 - RNA, 15 nt, Human
cagaguggucuuucu

SEQ ID NO: 2434482 - RNA, 14 nt, Human
cagaguggaaugcu

SEQ ID NO: 2434483 - RNA, 12 nt, Human
cagaguggccug

SEQ ID NO: 2434484 - RNA, 13 nt, Human
cagaguggccugg

SEQ ID NO: 2434485 - RNA, 15 nt, Human
cagagugcccagaac

SEQ ID NO: 2434486 - RNA, 13 nt, Human
cagagugcccaga

SEQ ID NO: 2434487 - RNA, 14 nt, Human
cagagugcccagaa

SEQ ID NO: 2434488 - RNA, 20 nt, Human
cagagugcaagccccugcuc

SEQ ID NO: 2434489 - RNA, 20 nt, Human
cagagugagacucugucuca

SEQ ID NO: 2434490 - RNA, 19 nt, Human
cagagugagacucugucuc

SEQ ID NO: 2434491 - RNA, 20 nt, Human
cagagugagacccugucucu

SEQ ID NO: 2434492 - RNA, 18 nt, Human
cagagugcaagccccugc

SEQ ID NO: 2434493 - RNA, 23 nt, Human
cagagugcaagccccugcuccag

SEQ ID NO: 2434494 - RNA, 16 nt, Human
cagauaacuguuauuu

SEQ ID NO: 2434495 - RNA, 19 nt, Human
cagauaacuguuauuuaua

SEQ ID NO: 2434496 - RNA, 14 nt, Human
cagauaacuguuau

SEQ ID NO: 2434497 - RNA, 17 nt, Human
cagauaaccagcuguaa

SEQ ID NO: 2434498 - RNA, 20 nt, Human
cagauaacuguuauuuauaa

SEQ ID NO: 2434499 - RNA, 21 nt, Human
cagauaacuguuauuuauaau

SEQ ID NO: 2434500 - RNA, 20 nt, Human
cagauaagcaagagagaugu

SEQ ID NO: 2434501 - RNA, 22 nt, Human
cagauaagcaagagagauguuu

SEQ ID NO: 2434502 - RNA, 19 nt, Human
cagauaagaaugcugguuu

SEQ ID NO: 2434503 - RNA, 21 nt, Human
cagauaagaaugcugguuuuc

SEQ ID NO: 2434504 - RNA, 13 nt, Human
cagauaaugugaa

SEQ ID NO: 2434505 - RNA, 14 nt, Human
cagauaaugugaaa

SEQ ID NO: 2434506 - RNA, 14 nt, Human
cagauacaauguau

SEQ ID NO: 2434507 - RNA, 13 nt, Human
cagauacaaugua

SEQ ID NO: 2434508 - RNA, 16 nt, Human
cagauaaugugaaaau

SEQ ID NO: 2434509 - RNA, 14 nt, Human
cagauaaucagugu

SEQ ID NO: 2434510 - RNA, 19 nt, Human
cagauaaucagccucuuaa

SEQ ID NO: 2434511 - RNA, 14 nt, Human
cagauaaucacaau

SEQ ID NO: 2434512 - RNA, 15 nt, Human
cagauaaucagccuc

SEQ ID NO: 2434513 - RNA, 16 nt, Human
cagauaaucagccucu

SEQ ID NO: 2434514 - RNA, 17 nt, Human
cagauaaucagccucuu

SEQ ID NO: 2434515 - RNA, 18 nt, Human
cagauaaucagccucuua

SEQ ID NO: 2434516 - RNA, 23 nt, Human
cagauaaauaguuuaugauucca

SEQ ID NO: 2434517 - RNA, 22 nt, Human
cagauaaagguucaugcaaacu

SEQ ID NO: 2434518 - RNA, 14 nt, Human
cagauaaacaguag

SEQ ID NO: 2434519 - RNA, 16 nt, Human
cagauaaaauuauaga

SEQ ID NO: 2434520 - RNA, 15 nt, Human
cagaguuuuuaugua

SEQ ID NO: 2434521 - RNA, 21 nt, Human
cagauaaaauuauagauggga

SEQ ID NO: 2434522 - RNA, 15 nt, Human
cagaguuguuacauu

SEQ ID NO: 2434523 - RNA, 18 nt, Human
cagaguuguuacauuuuu

SEQ ID NO: 2434524 - RNA, 19 nt, Human
cagaguuguuacauuuuua

SEQ ID NO: 2434525 - RNA, 23 nt, Human
cagaguuuagaggaaaaaaauga

SEQ ID NO: 2434526 - RNA, 22 nt, Human
cagaguuuguguguugucuuga

SEQ ID NO: 2434527 - RNA, 19 nt, Human
cagaguuuguguguugucu

SEQ ID NO: 2434528 - RNA, 17 nt, Human
cagaguuuguguguugu

SEQ ID NO: 2434529 - RNA, 23 nt, Human
cagaguugugcacauggcuuagu

SEQ ID NO: 2434530 - RNA, 20 nt, Human
cagaguugaagacagagcua

SEQ ID NO: 2434531 - RNA, 19 nt, Human
cagaguugaagacagagcu

SEQ ID NO: 2434532 - RNA, 18 nt, Human
cagaguugaagacagagc

SEQ ID NO: 2434533 - RNA, 17 nt, Human
cagaguugaagacagag

SEQ ID NO: 2434534 - RNA, 23 nt, Human
cagaguuguaaauauauaaauau

SEQ ID NO: 2434535 - RNA, 20 nt, Human
cagaguuguaaauauauaaa

SEQ ID NO: 2434536 - RNA, 19 nt, Human
cagaguuguaaauauauaa

SEQ ID NO: 2434537 - RNA, 18 nt, Human
cagaguuguaaauauaua

SEQ ID NO: 2434538 - RNA, 17 nt, Human
cagaguuguaaauauau

SEQ ID NO: 2434539 - RNA, 16 nt, Human
cagaguuguaaauaua

SEQ ID NO: 2434540 - RNA, 14 nt, Human
cagaguuguaaaua

SEQ ID NO: 2434541 - RNA, 13 nt, Human
cagaguuguaaau

SEQ ID NO: 2434542 - RNA, 14 nt, Human
cagaguuguuacau

SEQ ID NO: 2434543 - RNA, 12 nt, Human
cagaguuguaaa

SEQ ID NO: 2434544 - RNA, 20 nt, Human
cagaguugcugggagcugaa

SEQ ID NO: 2434545 - RNA, 19 nt, Human
cagaguugcugggagcuga

SEQ ID NO: 2434546 - RNA, 15 nt, Human
cagaguugcugggag

SEQ ID NO: 2434547 - RNA, 20 nt, Human
cagaguugacaugagauuua

SEQ ID NO: 2434548 - RNA, 20 nt, Human
cagaguugcugcaaaccuga

SEQ ID NO: 2434549 - RNA, 22 nt, Human
cagaguugaagacagagcuaca

SEQ ID NO: 2434550 - RNA, 16 nt, Human
cagaguugaagacaga

SEQ ID NO: 2434551 - RNA, 15 nt, Human
cagaguugaagacag

SEQ ID NO: 2434552 - RNA, 15 nt, Human
cagaguucugcucua

SEQ ID NO: 2434553 - RNA, 22 nt, Human
cagaguuccugcggagugaaga

SEQ ID NO: 2434554 - RNA, 23 nt, Human
cagaguuccugcggagugaagag

SEQ ID NO: 2434555 - RNA, 17 nt, Human
cagaguuccugcggagu

SEQ ID NO: 2434556 - RNA, 24 nt, Human
cagaguuccccaugcagacaugag

SEQ ID NO: 2434557 - RNA, 18 nt, Human
cagaguuccccaugcaga

SEQ ID NO: 2434558 - RNA, 16 nt, Human
cagaguuccccaugca

SEQ ID NO: 2434559 - RNA, 14 nt, Human
cagaguugaagaca

SEQ ID NO: 2434560 - RNA, 12 nt, Human
cagaguucacua

SEQ ID NO: 2434561 - RNA, 14 nt, Human
cagaguucacuaua

SEQ ID NO: 2434562 - RNA, 20 nt, Human
cagaguucacuauaaauggu

SEQ ID NO: 2434563 - RNA, 16 nt, Human
cagagugugcuggagg

SEQ ID NO: 2434564 - RNA, 15 nt, Human
cagagugugcuggag

SEQ ID NO: 2434565 - RNA, 18 nt, Human
cagagugugcuggaggac

SEQ ID NO: 2434566 - RNA, 22 nt, Human
cagaguggucuuucuggagagg

SEQ ID NO: 2434567 - RNA, 12 nt, Human
cagagugugcug

SEQ ID NO: 2434568 - RNA, 21 nt, Human
cagaguggucuuucuggagag

SEQ ID NO: 2434569 - RNA, 23 nt, Human
cagaguguggccuucggacaacu

SEQ ID NO: 2434570 - RNA, 19 nt, Human
cagagugugggaagggaga

SEQ ID NO: 2434571 - RNA, 20 nt, Human
cagagugugggaagggagag

SEQ ID NO: 2434572 - RNA, 22 nt, Human
cagauacaggaaaagcugcuga

SEQ ID NO: 2434573 - RNA, 13 nt, Human
cagauccuggaaa

SEQ ID NO: 2434574 - RNA, 21 nt, Human
cagauacaggaaaagcugcug

SEQ ID NO: 2434575 - RNA, 20 nt, Human
cagauacaggaaaagcugcu

SEQ ID NO: 2434576 - RNA, 14 nt, Human
cagauccuggaaau

SEQ ID NO: 2434577 - RNA, 18 nt, Human
cagauccuuguuucaaac

SEQ ID NO: 2434578 - RNA, 16 nt, Human
cagauccuuguuucaa

SEQ ID NO: 2434579 - RNA, 15 nt, Human
cagauccuuguuuca

SEQ ID NO: 2434580 - RNA, 14 nt, Human
cagauccuuguuuc

SEQ ID NO: 2434581 - RNA, 17 nt, Human
cagauacaauguauuua

SEQ ID NO: 2434582 - RNA, 13 nt, Human
cagauccuuguuu

SEQ ID NO: 2434583 - RNA, 20 nt, Human
cagaucucuaacuucaccau

SEQ ID NO: 2434584 - RNA, 19 nt, Human
cagaucuaccccuuacuua

SEQ ID NO: 2434585 - RNA, 14 nt, Human
cagaucuccuggca

SEQ ID NO: 2434586 - RNA, 18 nt, Human
cagaucggaucuguugca

SEQ ID NO: 2434587 - RNA, 19 nt, Human
cagauccuuguuucaaaca

SEQ ID NO: 2434588 - RNA, 22 nt, Human
cagaucugacaugauuccuucc

SEQ ID NO: 2434589 - RNA, 23 nt, Human
cagaucugacaugauuccuuccu

SEQ ID NO: 2434590 - RNA, 14 nt, Human
cagaucuggaaccu

SEQ ID NO: 2434591 - RNA, 15 nt, Human
cagaucuggaaccuc

SEQ ID NO: 2434592 - RNA, 18 nt, Human
cagaucuggaaccucagc

SEQ ID NO: 2434593 - RNA, 19 nt, Human
cagaucuggaaccucagcc

SEQ ID NO: 2434594 - RNA, 20 nt, Human
cagaucuggaaccucagccu

SEQ ID NO: 2434595 - RNA, 21 nt, Human
cagaucuggaaccucagccug

SEQ ID NO: 2434596 - RNA, 22 nt, Human
cagaucuggaaccucagccugg

SEQ ID NO: 2434597 - RNA, 23 nt, Human
cagaucuggaaccucagccuggc

SEQ ID NO: 2434598 - RNA, 24 nt, Human
cagaucugacaugauuccuuccug

SEQ ID NO: 2434599 - RNA, 17 nt, Human
cagaucuggucccuugc

SEQ ID NO: 2434600 - RNA, 18 nt, Human
cagaucuggucccuugca

SEQ ID NO: 2434601 - RNA, 13 nt, Human
cagaucugucuga

SEQ ID NO: 2434602 - RNA, 12 nt, Human
cagaucugugcc

SEQ ID NO: 2434603 - RNA, 13 nt, Human
cagaucugugccc

SEQ ID NO: 2434604 - RNA, 14 nt, Human
cagaucugugcccc

SEQ ID NO: 2434605 - RNA, 15 nt, Human
cagaucugugcccca

SEQ ID NO: 2434606 - RNA, 15 nt, Human
cagaugaauguauuu

SEQ ID NO: 2434607 - RNA, 19 nt, Human
cagaugaauguauuuauuu

SEQ ID NO: 2434608 - RNA, 20 nt, Human
cagaugacaaaaauucaacu

SEQ ID NO: 2434609 - RNA, 19 nt, Human
cagaugaaugauaaacucu

SEQ ID NO: 2434610 - RNA, 23 nt, Human
cagaugaauguauuuauuuggga

SEQ ID NO: 2434611 - RNA, 14 nt, Human
cagaugaaugauaa

SEQ ID NO: 2434612 - RNA, 20 nt, Human
cagaugaacucuuagaaaug

SEQ ID NO: 2434613 - RNA, 17 nt, Human
cagaugaaugccgugga

SEQ ID NO: 2434614 - RNA, 18 nt, Human
cagaucugucugauagga

SEQ ID NO: 2434615 - RNA, 18 nt, Human
cagaucugugccccaugc

SEQ ID NO: 2434616 - RNA, 20 nt, Human
cagaucugugccccaugccu

SEQ ID NO: 2434617 - RNA, 21 nt, Human
cagaucugugccccaugccug

SEQ ID NO: 2434618 - RNA, 23 nt, Human
cagaucugugccccaugccuguc

SEQ ID NO: 2434619 - RNA, 16 nt, Human
cagaugaguaaaggag

SEQ ID NO: 2434620 - RNA, 17 nt, Human
cagaugagaaacucuug

SEQ ID NO: 2434621 - RNA, 12 nt, Human
cagaugagcugu

SEQ ID NO: 2434622 - RNA, 16 nt, Human
cagaugcaaagaggca

SEQ ID NO: 2434623 - RNA, 14 nt, Human
cagaugauccauga

SEQ ID NO: 2434624 - RNA, 23 nt, Human
cagaugaugccaaccucuggagc

SEQ ID NO: 2434625 - RNA, 17 nt, Human
cagaugcaaagaggcaa

SEQ ID NO: 2434626 - RNA, 18 nt, Human
cagaugcaaagaggcaag

SEQ ID NO: 2434627 - RNA, 23 nt, Human
cagaugcaaagaggcaagaggcu

SEQ ID NO: 2434628 - RNA, 19 nt, Human
cagaugagaaacucuugag

SEQ ID NO: 2434629 - RNA, 18 nt, Human
cagaugaccccuccccua

SEQ ID NO: 2434630 - RNA, 14 nt, Human
cagaugaccccucc

SEQ ID NO: 2434631 - RNA, 13 nt, Human
cagaugaccccuc

SEQ ID NO: 2434632 - RNA, 13 nt, Human
cagaugcagggca

SEQ ID NO: 2434633 - RNA, 14 nt, Human
cagaugcagggcag

SEQ ID NO: 2434634 - RNA, 18 nt, Human
cagaugcagagagccauu

SEQ ID NO: 2434635 - RNA, 16 nt, Human
cagaugcagagagcca

SEQ ID NO: 2434636 - RNA, 20 nt, Human
cagaugcagagagccauuuu

SEQ ID NO: 2434637 - RNA, 22 nt, Human
cagaugcaccagcccuuagcag

SEQ ID NO: 2434638 - RNA, 17 nt, Human
cagaugcaccagcccuu

SEQ ID NO: 2434639 - RNA, 16 nt, Human
cagaugcaccagcccu

SEQ ID NO: 2434640 - RNA, 14 nt, Human
cagaugcaccagcc

SEQ ID NO: 2434641 - RNA, 13 nt, Human
cagaugcaccagc

SEQ ID NO: 2434642 - RNA, 15 nt, Human
cagaugcaaugugcu

SEQ ID NO: 2434643 - RNA, 21 nt, Human
cagaugcaaugugcuacugau

SEQ ID NO: 2434644 - RNA, 14 nt, Human
cagaugcaaugacu

SEQ ID NO: 2434645 - RNA, 16 nt, Human
cagagaccaucccuga

SEQ ID NO: 2434646 - RNA, 14 nt, Human
cagagaccaucccu

SEQ ID NO: 2434647 - RNA, 19 nt, Human
cagagacauuccuccgagc

SEQ ID NO: 2434648 - RNA, 13 nt, Human
cagagacauuccu

SEQ ID NO: 2434649 - RNA, 13 nt, Human
cagagaccauccc

SEQ ID NO: 2434650 - RNA, 17 nt, Human
cagagacauacuugaag

SEQ ID NO: 2434651 - RNA, 19 nt, Human
cagagacauacuugaaggg

SEQ ID NO: 2434652 - RNA, 20 nt, Human
cagagacauacuugaagggc

SEQ ID NO: 2434653 - RNA, 21 nt, Human
cagagacauacuugaagggcc

SEQ ID NO: 2434654 - RNA, 23 nt, Human
cagagacauacuugaagggccag

SEQ ID NO: 2434655 - RNA, 23 nt, Human
cagagacaggcccaagagaugaa

SEQ ID NO: 2434656 - RNA, 15 nt, Human
cagagacauacuuga

SEQ ID NO: 2434657 - RNA, 16 nt, Human
cagagacauacuugaa

SEQ ID NO: 2434658 - RNA, 22 nt, Human
cagagacaggaagucuucaggg

SEQ ID NO: 2434659 - RNA, 14 nt, Human
cagagacaggccca

SEQ ID NO: 2434660 - RNA, 19 nt, Human
cagagacaggcccaagaga

SEQ ID NO: 2434661 - RNA, 13 nt, Human
cagagacaggaaa

SEQ ID NO: 2434662 - RNA, 14 nt, Human
cagagacaggaaaa

SEQ ID NO: 2434663 - RNA, 15 nt, Human
cagagacaggaaaau

SEQ ID NO: 2434664 - RNA, 21 nt, Human
cagagacaggaaaauccucug

SEQ ID NO: 2434665 - RNA, 22 nt, Human
cagagacaggaaaauccucugg

SEQ ID NO: 2434666 - RNA, 23 nt, Human
cagagacaggaaaauccucuggc

SEQ ID NO: 2434667 - RNA, 15 nt, Human
cagagacacaagccu

SEQ ID NO: 2434668 - RNA, 14 nt, Human
cagagacacaagcc

SEQ ID NO: 2434669 - RNA, 13 nt, Human
cagagaauuucua

SEQ ID NO: 2434670 - RNA, 15 nt, Human
cagagaauuucuacc

SEQ ID NO: 2434671 - RNA, 16 nt, Human
cagagaauuucuacca

SEQ ID NO: 2434672 - RNA, 22 nt, Human
cagagaauuucuaccauuucag

SEQ ID NO: 2434673 - RNA, 23 nt, Human
cagagaauuucuaccauuucaga

SEQ ID NO: 2434674 - RNA, 17 nt, Human
cagagacacaagccuuc

SEQ ID NO: 2434675 - RNA, 16 nt, Human
cagagacacaagccuu

SEQ ID NO: 2434676 - RNA, 13 nt, Human
cagagacaccugc

SEQ ID NO: 2434677 - RNA, 14 nt, Human
cagagacaccugca

SEQ ID NO: 2434678 - RNA, 15 nt, Human
cagagacaccugcac

SEQ ID NO: 2434679 - RNA, 16 nt, Human
cagagacaccugcacc

SEQ ID NO: 2434680 - RNA, 17 nt, Human
cagagacaccugcaccu

SEQ ID NO: 2434681 - RNA, 18 nt, Human
cagagacaccugcaccuc

SEQ ID NO: 2434682 - RNA, 20 nt, Human
cagagacaccugcaccuccc

SEQ ID NO: 2434683 - RNA, 22 nt, Human
cagagacaccugcaccuccccc

SEQ ID NO: 2434684 - RNA, 16 nt, Human
cagagacagagaggac

SEQ ID NO: 2434685 - RNA, 14 nt, Human
cagagacagagagg

SEQ ID NO: 2434686 - RNA, 21 nt, Human
cagagaaugaaagggcccaga

SEQ ID NO: 2434687 - RNA, 20 nt, Human
cagagaaugaaagggcccag

SEQ ID NO: 2434688 - RNA, 11 nt, Human
cagagaauaua

SEQ ID NO: 2434689 - RNA, 11 nt, Human
cagagaaguuc

SEQ ID NO: 2434690 - RNA, 19 nt, Human
cagagaaucauacuuagca

SEQ ID NO: 2434691 - RNA, 14 nt, Human
cagagaauucuuag

SEQ ID NO: 2434692 - RNA, 21 nt, Human
cagagaauugcugauucuuga

SEQ ID NO: 2434693 - RNA, 15 nt, Human
cagagaauucucuua

SEQ ID NO: 2434694 - RNA, 24 nt, Human
cagagaagugacagggaagcuaca

SEQ ID NO: 2434695 - RNA, 23 nt, Human
cagagaagugacagggaagcuac

SEQ ID NO: 2434696 - RNA, 22 nt, Human
cagagaagugacagggaagcua

SEQ ID NO: 2434697 - RNA, 21 nt, Human
cagagaagugacagggaagcu

SEQ ID NO: 2434698 - RNA, 20 nt, Human
cagagaagugacagggaagc

SEQ ID NO: 2434699 - RNA, 19 nt, Human
cagagaagugacagggaag

SEQ ID NO: 2434700 - RNA, 18 nt, Human
cagagaagugacagggaa

SEQ ID NO: 2434701 - RNA, 17 nt, Human
cagagaagugacaggga

SEQ ID NO: 2434702 - RNA, 19 nt, Human
cagagaaugaaagggccca

SEQ ID NO: 2434703 - RNA, 16 nt, Human
cagagaagugacaggg

SEQ ID NO: 2434704 - RNA, 15 nt, Human
cagagaagugacagg

SEQ ID NO: 2434705 - RNA, 14 nt, Human
cagagaagugacag

SEQ ID NO: 2434706 - RNA, 13 nt, Human
cagagaagugaca

SEQ ID NO: 2434707 - RNA, 20 nt, Human
cagagaaggcaggaaugugu

SEQ ID NO: 2434708 - RNA, 13 nt, Human
cagagaaggcagg

SEQ ID NO: 2434709 - RNA, 14 nt, Human
cagagaaggcagga

SEQ ID NO: 2434710 - RNA, 17 nt, Human
cagagaaggcaggaaug

SEQ ID NO: 2434711 - RNA, 18 nt, Human
cagagaacuaacacuauu

SEQ ID NO: 2434712 - RNA, 19 nt, Human
cagagaaaggggagcccac

SEQ ID NO: 2434713 - RNA, 22 nt, Human
cagagaacuaacacuauuuuau

SEQ ID NO: 2434714 - RNA, 21 nt, Human
cagagaacuaacacuauuuua

SEQ ID NO: 2434715 - RNA, 20 nt, Human
cagagaacuaacacuauuuu

SEQ ID NO: 2434716 - RNA, 23 nt, Human
cagagaacuaacacuauuuuaug

SEQ ID NO: 2434717 - RNA, 23 nt, Human
cagagaagagaguauuggguaga

SEQ ID NO: 2434718 - RNA, 20 nt, Human
cagagaagccaaaagauugg

SEQ ID NO: 2434719 - RNA, 18 nt, Human
cagagaagccccuucccc

SEQ ID NO: 2434720 - RNA, 17 nt, Human
cagagaagccccuuccc

SEQ ID NO: 2434721 - RNA, 24 nt, Human
cagagaagccccuuccccauggga

SEQ ID NO: 2434722 - RNA, 15 nt, Human
cagagaagccccuuc

SEQ ID NO: 2434723 - RNA, 21 nt, Human
cagagaagcuauaaauuccuc

SEQ ID NO: 2434724 - RNA, 23 nt, Human
cagagaagcuauaaauuccucuu

SEQ ID NO: 2434725 - RNA, 20 nt, Human
cagagaccaucccugaaggc

SEQ ID NO: 2434726 - RNA, 19 nt, Human
cagagaccaucccugaagg

SEQ ID NO: 2434727 - RNA, 18 nt, Human
cagagaccaucccugaag

SEQ ID NO: 2434728 - RNA, 17 nt, Human
cagagaccaucccugaa

SEQ ID NO: 2434729 - RNA, 15 nt, Human
cagagacccucugcc

SEQ ID NO: 2434730 - RNA, 14 nt, Human
cagagaccauugca

SEQ ID NO: 2434731 - RNA, 21 nt, Human
cagagaccaucccugaaggcc

SEQ ID NO: 2434732 - RNA, 19 nt, Human
cagagaccguccucacccc

SEQ ID NO: 2434733 - RNA, 18 nt, Human
cagagaccguccucaccc

SEQ ID NO: 2434734 - RNA, 17 nt, Human
cagagaccguccucacc

SEQ ID NO: 2434735 - RNA, 16 nt, Human
cagagaccguccucac

SEQ ID NO: 2434736 - RNA, 13 nt, Human
cagagaccguccu

SEQ ID NO: 2434737 - RNA, 20 nt, Human
cagagacccucugccaccag

SEQ ID NO: 2434738 - RNA, 19 nt, Human
cagagacccucugccacca

SEQ ID NO: 2434739 - RNA, 18 nt, Human
cagagaccuccugccucc

SEQ ID NO: 2434740 - RNA, 20 nt, Human
cagagaccguccucaccccu

SEQ ID NO: 2434741 - RNA, 19 nt, Human
cagagacucagggccccag

SEQ ID NO: 2434742 - RNA, 19 nt, Human
cagagacuccugcaggcag

SEQ ID NO: 2434743 - RNA, 18 nt, Human
cagagacuccugcaggca

SEQ ID NO: 2434744 - RNA, 17 nt, Human
cagagacuccugcaggc

SEQ ID NO: 2434745 - RNA, 16 nt, Human
cagagacuccugcagg

SEQ ID NO: 2434746 - RNA, 15 nt, Human
cagagacuccugcag

SEQ ID NO: 2434747 - RNA, 14 nt, Human
cagagacuccugca

SEQ ID NO: 2434748 - RNA, 13 nt, Human
cagagacuccugc

SEQ ID NO: 2434749 - RNA, 20 nt, Human
cagagacucagggccccagc

SEQ ID NO: 2434750 - RNA, 21 nt, Human
cagagacucagggccccagca

SEQ ID NO: 2434751 - RNA, 22 nt, Human
cagagacucagggccccagcac

SEQ ID NO: 2434752 - RNA, 23 nt, Human
cagagacucagggccccagcacu

SEQ ID NO: 2434753 - RNA, 16 nt, Human
cagagcaccuuagaca

SEQ ID NO: 2434754 - RNA, 18 nt, Human
cagagcaagucugcaggu

SEQ ID NO: 2434755 - RNA, 18 nt, Human
cagagcacagcagccccu

SEQ ID NO: 2434756 - RNA, 14 nt, Human
cagagcaagugaga

SEQ ID NO: 2434757 - RNA, 20 nt, Human
cagagcaagugagacccugu

SEQ ID NO: 2434758 - RNA, 23 nt, Human
cagagauuggaaugggcagcuca

SEQ ID NO: 2434759 - RNA, 22 nt, Human
cagagauuggaaugggcagcuc

SEQ ID NO: 2434760 - RNA, 21 nt, Human
cagagauuggaaugggcagcu

SEQ ID NO: 2434761 - RNA, 16 nt, Human
cagagaugugcaccca

SEQ ID NO: 2434762 - RNA, 14 nt, Human
cagagcaaaauaau

SEQ ID NO: 2434763 - RNA, 16 nt, Human
cagagcaaaauaauuu

SEQ ID NO: 2434764 - RNA, 20 nt, Human
cagagcaagacucugucuca

SEQ ID NO: 2434765 - RNA, 18 nt, Human
cagagcaagauccugucu

SEQ ID NO: 2434766 - RNA, 20 nt, Human
cagagcaagauccugucuuu

SEQ ID NO: 2434767 - RNA, 17 nt, Human
cagagcaagucugcagg

SEQ ID NO: 2434768 - RNA, 16 nt, Human
cagagcaagucugcag

SEQ ID NO: 2434769 - RNA, 15 nt, Human
cagagcaagucugca

SEQ ID NO: 2434770 - RNA, 14 nt, Human
cagagaugugcacc

SEQ ID NO: 2434771 - RNA, 23 nt, Human
cagagaugggacugggagggccc

SEQ ID NO: 2434772 - RNA, 19 nt, Human
cagagaugggacugggagg

SEQ ID NO: 2434773 - RNA, 22 nt, Human
cagagaugggacugggagggcc

SEQ ID NO: 2434774 - RNA, 21 nt, Human
cagagauggagguucucucgg

SEQ ID NO: 2434775 - RNA, 23 nt, Human
cagagauggagguucucucggag

SEQ ID NO: 2434776 - RNA, 15 nt, Human
cagagaugggacugg

SEQ ID NO: 2434777 - RNA, 18 nt, Human
cagagaugggacugggag

SEQ ID NO: 2434778 - RNA, 21 nt, Human
cagagaugcaccaccaagcca

SEQ ID NO: 2434779 - RNA, 20 nt, Human
cagagaugcaccaccaagcc

SEQ ID NO: 2434780 - RNA, 21 nt, Human
cagagauccaaaagaagcccc

SEQ ID NO: 2434781 - RNA, 23 nt, Human
cagagauccaaaagaagccccca

SEQ ID NO: 2434782 - RNA, 13 nt, Human
cagagaugccucc

SEQ ID NO: 2434783 - RNA, 14 nt, Human
cagagaugccucca

SEQ ID NO: 2434784 - RNA, 15 nt, Human
cagagaugccuccac

SEQ ID NO: 2434785 - RNA, 16 nt, Human
cagagaugccuccacc

SEQ ID NO: 2434786 - RNA, 18 nt, Human
cagagaugccuccaccgc

SEQ ID NO: 2434787 - RNA, 19 nt, Human
cagagaugccuccaccgcu

SEQ ID NO: 2434788 - RNA, 21 nt, Human
cagagaugccuccaccgcugc

SEQ ID NO: 2434789 - RNA, 19 nt, Human
cagagaguccucuggaugg

SEQ ID NO: 2434790 - RNA, 18 nt, Human
cagagaguccucuggaug

SEQ ID NO: 2434791 - RNA, 17 nt, Human
cagagaguccucuggau

SEQ ID NO: 2434792 - RNA, 16 nt, Human
cagagaguccucugga

SEQ ID NO: 2434793 - RNA, 15 nt, Human
cagagaguccucugg

SEQ ID NO: 2434794 - RNA, 14 nt, Human
cagagaguccucug

SEQ ID NO: 2434795 - RNA, 23 nt, Human
cagagagucccacugccucaggu

SEQ ID NO: 2434796 - RNA, 16 nt, Human
cagagaccuccugccu

SEQ ID NO: 2434797 - RNA, 14 nt, Human
cagagaguggcucc

SEQ ID NO: 2434798 - RNA, 13 nt, Human
cagagaguggcuc

SEQ ID NO: 2434799 - RNA, 18 nt, Human
cagagaguggcuccuccc

SEQ ID NO: 2434800 - RNA, 15 nt, Human
cagagaguggcuccu

SEQ ID NO: 2434801 - RNA, 19 nt, Human
cagagauccaaaagaagcc

SEQ ID NO: 2434802 - RNA, 20 nt, Human
cagagauccaaaagaagccc

SEQ ID NO: 2434803 - RNA, 22 nt, Human
cagagauaguggggagacuucu

SEQ ID NO: 2434804 - RNA, 16 nt, Human
cagagcccacgccccc

SEQ ID NO: 2434805 - RNA, 20 nt, Human
cagagcccaccuuggcucaa

SEQ ID NO: 2434806 - RNA, 19 nt, Human
cagagcccaccuuggcuca

SEQ ID NO: 2434807 - RNA, 17 nt, Human
cagagcccaccuuggcu

SEQ ID NO: 2434808 - RNA, 15 nt, Human
cagagcccaccuugg

SEQ ID NO: 2434809 - RNA, 23 nt, Human
cagagccaggggggugaggagcu

SEQ ID NO: 2434810 - RNA, 17 nt, Human
cagagccaugcugggaa

SEQ ID NO: 2434811 - RNA, 11 nt, Human
cagagccaugg

SEQ ID NO: 2434812 - RNA, 14 nt, Human
cagagccauggacu

SEQ ID NO: 2434813 - RNA, 22 nt, Human
cagagcagugggccuggccagc

SEQ ID NO: 2434814 - RNA, 23 nt, Human
cagagcagggguccuugguguga

SEQ ID NO: 2434815 - RNA, 18 nt, Human
cagagcauuacgugagcc

SEQ ID NO: 2434816 - RNA, 22 nt, Human
cagagcauuacgugagccaggu

SEQ ID NO: 2434817 - RNA, 21 nt, Human
cagagcauuacgugagccagg

SEQ ID NO: 2434818 - RNA, 20 nt, Human
cagagcauuacgugagccag

SEQ ID NO: 2434819 - RNA, 19 nt, Human
cagagcauuacgugagcca

SEQ ID NO: 2434820 - RNA, 23 nt, Human
cagagcauuacgugagccaggua

SEQ ID NO: 2434821 - RNA, 21 nt, Human
cagagcauuuccaacaccaca

SEQ ID NO: 2434822 - RNA, 22 nt, Human
cagagccaccccuaaagagaua

SEQ ID NO: 2434823 - RNA, 15 nt, Human
cagagcagugggccu

SEQ ID NO: 2434824 - RNA, 17 nt, Human
cagagcagugggccugg

SEQ ID NO: 2434825 - RNA, 20 nt, Human
cagagcagugggccuggcca

SEQ ID NO: 2434826 - RNA, 21 nt, Human
cagagcagugggccuggccag

SEQ ID NO: 2434827 - RNA, 15 nt, Human
cagagcaggaggccc

SEQ ID NO: 2434828 - RNA, 14 nt, Human
cagagcaggaggcc

SEQ ID NO: 2434829 - RNA, 14 nt, Human
cagagcaggacugc

SEQ ID NO: 2434830 - RNA, 20 nt, Human
cagagcagcagugaaaacaa

SEQ ID NO: 2434831 - RNA, 21 nt, Human
cagagcaggaagcauucagag

SEQ ID NO: 2434832 - RNA, 23 nt, Human
cagagcaggaggccccuggccca

SEQ ID NO: 2434833 - RNA, 19 nt, Human
cagagcaggaggccccugg

SEQ ID NO: 2434834 - RNA, 18 nt, Human
cagagcaggaggccccug

SEQ ID NO: 2434835 - RNA, 17 nt, Human
cagagcaggaggccccu

SEQ ID NO: 2434836 - RNA, 14 nt, Human
cagagcaggggcag

SEQ ID NO: 2434837 - RNA, 15 nt, Human
cagagcaggggcagg

SEQ ID NO: 2434838 - RNA, 13 nt, Human
cagagcagcagug

SEQ ID NO: 2434839 - RNA, 21 nt, Human
cagagcagaugcagagagcca

SEQ ID NO: 2434840 - RNA, 20 nt, Human
cagagcagaugcagagagcc

SEQ ID NO: 2434841 - RNA, 19 nt, Human
cagagcagaugcagagagc

SEQ ID NO: 2434842 - RNA, 16 nt, Human
cagagcagaugcagag

SEQ ID NO: 2434843 - RNA, 15 nt, Human
cagagcagaugcaga

SEQ ID NO: 2434844 - RNA, 14 nt, Human
cagagcagaugcag

SEQ ID NO: 2434845 - RNA, 13 nt, Human
cagagcagaugca

SEQ ID NO: 2434846 - RNA, 21 nt, Human
cagagcagagaccaucccuga

SEQ ID NO: 2434847 - RNA, 19 nt, Human
cagagcagagaccaucccu

SEQ ID NO: 2434848 - RNA, 18 nt, Human
cagagcagagaccauccc

SEQ ID NO: 2434849 - RNA, 17 nt, Human
cagagcagagaccaucc

SEQ ID NO: 2434850 - RNA, 15 nt, Human
cagagcagagaccau

SEQ ID NO: 2434851 - RNA, 14 nt, Human
cagagcagagacca

SEQ ID NO: 2434852 - RNA, 13 nt, Human
cagagcagagacc

SEQ ID NO: 2434853 - RNA, 22 nt, Human
cagagcaccuuagacagucccu

SEQ ID NO: 2434854 - RNA, 21 nt, Human
cagagcaccuuagacaguccc

SEQ ID NO: 2434855 - RNA, 19 nt, Human
cagagcaccuuagacaguc

SEQ ID NO: 2434856 - RNA, 18 nt, Human
cagagcaccuuagacagu

SEQ ID NO: 2434857 - RNA, 12 nt, Human
cagagcagagac

SEQ ID NO: 2434858 - RNA, 11 nt, Human
cagagcagaga

SEQ ID NO: 2434859 - RNA, 23 nt, Human
cagagcaccuuagacagucccug

SEQ ID NO: 2434860 - RNA, 20 nt, Human
cagagcacuggguugcaggg

SEQ ID NO: 2434861 - RNA, 20 nt, Human
cagaggaaagcaaaggagau

SEQ ID NO: 2434862 - RNA, 19 nt, Human
cagaggaacuguccagaga

SEQ ID NO: 2434863 - RNA, 17 nt, Human
cagaggaacuguccaga

SEQ ID NO: 2434864 - RNA, 13 nt, Human
cagagccugcagu

SEQ ID NO: 2434865 - RNA, 13 nt, Human
cagaggaaggaga

SEQ ID NO: 2434866 - RNA, 16 nt, Human
cagaggaaggggccag

SEQ ID NO: 2434867 - RNA, 14 nt, Human
cagaggaagagcag

SEQ ID NO: 2434868 - RNA, 15 nt, Human
cagaggaagagcagg

SEQ ID NO: 2434869 - RNA, 21 nt, Human
cagaggaacuguccagagagc

SEQ ID NO: 2434870 - RNA, 20 nt, Human
cagaggaacuguccagagag

SEQ ID NO: 2434871 - RNA, 22 nt, Human
cagaggaacuguccagagagca

SEQ ID NO: 2434872 - RNA, 12 nt, Human
cagaggaagagc

SEQ ID NO: 2434873 - RNA, 19 nt, Human
cagagccgugguccuuugg

SEQ ID NO: 2434874 - RNA, 20 nt, Human
cagagccgugguccuuuggg

SEQ ID NO: 2434875 - RNA, 12 nt, Human
cagagccugcag

SEQ ID NO: 2434876 - RNA, 21 nt, Human
cagagcccacgcccccacugg

SEQ ID NO: 2434877 - RNA, 20 nt, Human
cagagcccacgcccccacug

SEQ ID NO: 2434878 - RNA, 19 nt, Human
cagagcccacgcccccacu

SEQ ID NO: 2434879 - RNA, 17 nt, Human
cagagcccacgccccca

SEQ ID NO: 2434880 - RNA, 11 nt, Human
cagagcccagc

SEQ ID NO: 2434881 - RNA, 13 nt, Human
cagagcccagcuc

SEQ ID NO: 2434882 - RNA, 23 nt, Human
cagagcccacgcccccacuggug

SEQ ID NO: 2434883 - RNA, 14 nt, Human
cagagcccagcucc

SEQ ID NO: 2434884 - RNA, 13 nt, Human
cagagccccacac

SEQ ID NO: 2434885 - RNA, 16 nt, Human
cagagccccacacgga

SEQ ID NO: 2434886 - RNA, 23 nt, Human
cagagccccacacggaggcaucu

SEQ ID NO: 2434887 - RNA, 20 nt, Human
cagagccccacacggaggca

SEQ ID NO: 2434888 - RNA, 22 nt, Human
cagaggacaguauuugugggga

SEQ ID NO: 2434889 - RNA, 23 nt, Human
cagaggacagaucaauggcgcag

SEQ ID NO: 2434890 - RNA, 13 nt, Human
cagaggacagauc

SEQ ID NO: 2434891 - RNA, 18 nt, Human
cagaggaaggggccagag

SEQ ID NO: 2434892 - RNA, 19 nt, Human
cagaggaaggggccagagg

SEQ ID NO: 2434893 - RNA, 20 nt, Human
cagaggaaggggccagaggc

SEQ ID NO: 2434894 - RNA, 21 nt, Human
cagaggaaggggccagaggcu

SEQ ID NO: 2434895 - RNA, 23 nt, Human
cagaggaaucacucuuguggaug

SEQ ID NO: 2434896 - RNA, 18 nt, Human
cagaggaaucacucuugu

SEQ ID NO: 2434897 - RNA, 16 nt, Human
cagaggaagagcaggc

SEQ ID NO: 2434898 - RNA, 19 nt, Human
cagaggagagaggaccccc

SEQ ID NO: 2434899 - RNA, 15 nt, Human
cagaggagagaggac

SEQ ID NO: 2434900 - RNA, 13 nt, Human
cagaggagagagg

SEQ ID NO: 2434901 - RNA, 22 nt, Human
cagaggacucacuugcccacac

SEQ ID NO: 2434902 - RNA, 15 nt, Human
cagaggaugagcucu

SEQ ID NO: 2434903 - RNA, 17 nt, Human
cagaggaugagcucuac

SEQ ID NO: 2434904 - RNA, 19 nt, Human
cagaggaugagcucuaccc

SEQ ID NO: 2434905 - RNA, 21 nt, Human
cagaggaugagcucuacccag

SEQ ID NO: 2434906 - RNA, 14 nt, Human
cagaggaggggccg

SEQ ID NO: 2434907 - RNA, 19 nt, Human
cagaggaggggccgcugcc

SEQ ID NO: 2434908 - RNA, 17 nt, Human
cagaggaguacagguga

SEQ ID NO: 2434909 - RNA, 20 nt, Human
cagaggaggggccgcugcca

SEQ ID NO: 2434910 - RNA, 22 nt, Human
cagaggagggcagcagaagggg

SEQ ID NO: 2434911 - RNA, 13 nt, Human
cagaggaggggcc

SEQ ID NO: 2434912 - RNA, 18 nt, Human
cagaggauggccaguguc

SEQ ID NO: 2434913 - RNA, 17 nt, Human
cagaggauggccagugu

SEQ ID NO: 2434914 - RNA, 16 nt, Human
cagaggauggccagug

SEQ ID NO: 2434915 - RNA, 15 nt, Human
cagaggauggccagu

SEQ ID NO: 2434916 - RNA, 13 nt, Human
cagaggauggcca

SEQ ID NO: 2434917 - RNA, 21 nt, Human
cagaggaguacaggugaagca

SEQ ID NO: 2434918 - RNA, 23 nt, Human
cagaggaugagcucuacccaggg

SEQ ID NO: 2434919 - RNA, 11 nt, Human
cagaggcagcc

SEQ ID NO: 2434920 - RNA, 23 nt, Human
cagaggagagucccagagcagga

SEQ ID NO: 2434921 - RNA, 18 nt, Human
cagaggagggcagcagaa

SEQ ID NO: 2434922 - RNA, 14 nt, Human
cagaggagggcagc

SEQ ID NO: 2434923 - RNA, 20 nt, Human
cagaggagagaggacccccu

SEQ ID NO: 2434924 - RNA, 22 nt, Human
cagaggagagucccagagcagg

SEQ ID NO: 2434925 - RNA, 20 nt, Human
cagaggagagucccagagca

SEQ ID NO: 2434926 - RNA, 16 nt, Human
cagacaacaaaccugu

SEQ ID NO: 2434927 - RNA, 18 nt, Human
cagaaaauguugagaauc

SEQ ID NO: 2434928 - RNA, 23 nt, Human
cagaaaauguugagaaucccaaa

SEQ ID NO: 2434929 - RNA, 16 nt, Human
cagaaaauugcacaau

SEQ ID NO: 2434930 - RNA, 18 nt, Human
cagaaacaaaaacacuaa

SEQ ID NO: 2434931 - RNA, 20 nt, Human
cagaaacaaaaacacuaaaa

SEQ ID NO: 2434932 - RNA, 19 nt, Human
cagaaaauauuauguguuu

SEQ ID NO: 2434933 - RNA, 14 nt, Human
cagaaaauguugag

SEQ ID NO: 2434934 - RNA, 23 nt, Human
cagaaaauggaagacagcucuua

SEQ ID NO: 2434935 - RNA, 22 nt, Human
cagaaaauggaagacagcucuu

SEQ ID NO: 2434936 - RNA, 21 nt, Human
cagaaaauggaagacagcucu

SEQ ID NO: 2434937 - RNA, 20 nt, Human
cagaaaauggaagacagcuc

SEQ ID NO: 2434938 - RNA, 16 nt, Human
cagaaaauggaagaca

SEQ ID NO: 2434939 - RNA, 14 nt, Human
cagaaaauauacug

SEQ ID NO: 2434940 - RNA, 15 nt, Human
cagaaaauauacugu

SEQ ID NO: 2434941 - RNA, 16 nt, Human
cagaaaauauacugua

SEQ ID NO: 2434942 - RNA, 17 nt, Human
cagaaaauauacuguaa

SEQ ID NO: 2434943 - RNA, 12 nt, Human
cagaaaauauac

SEQ ID NO: 2434944 - RNA, 13 nt, Human
cagaaaauauacu

SEQ ID NO: 2434945 - RNA, 11 nt, Human
cagaaaauaua

SEQ ID NO: 2434946 - RNA, 18 nt, Human
cagaaaauauacuguaaa

SEQ ID NO: 2434947 - RNA, 19 nt, Human
cagaaaauauacuguaaag

SEQ ID NO: 2434948 - RNA, 20 nt, Human
cagaaaauauacuguaaaga

SEQ ID NO: 2434949 - RNA, 21 nt, Human
cagaaaauauacuguaaagaa

SEQ ID NO: 2434950 - RNA, 18 nt, Human
cagaaaagggaaguugug

SEQ ID NO: 2434951 - RNA, 17 nt, Human
cagaaaagggaaguugu

SEQ ID NO: 2434952 - RNA, 14 nt, Human
cagaaaaggacaga

SEQ ID NO: 2434953 - RNA, 13 nt, Human
cagaaaaggacag

SEQ ID NO: 2434954 - RNA, 15 nt, Human
cagaaaagcaccugc

SEQ ID NO: 2434955 - RNA, 16 nt, Human
cagaaaagcaccugcc

SEQ ID NO: 2434956 - RNA, 17 nt, Human
cagaaaagcaccugccg

SEQ ID NO: 2434957 - RNA, 19 nt, Human
cagaaaagcaccugccgac

SEQ ID NO: 2434958 - RNA, 14 nt, Human
cagaaaagcaccug

SEQ ID NO: 2434959 - RNA, 20 nt, Human
cagaaaacgguuaaaacugu

SEQ ID NO: 2434960 - RNA, 19 nt, Human
cagaaagcagaacagugau

SEQ ID NO: 2434961 - RNA, 16 nt, Human
cagaaagcauuacauu

SEQ ID NO: 2434962 - RNA, 18 nt, Human
cagaaagcauaaaauucu

SEQ ID NO: 2434963 - RNA, 21 nt, Human
cagaaagauggaugugcuuug

SEQ ID NO: 2434964 - RNA, 22 nt, Human
cagaaagccugggugacauuug

SEQ ID NO: 2434965 - RNA, 19 nt, Human
cagaaagccugggugacau

SEQ ID NO: 2434966 - RNA, 14 nt, Human
cagaaagcugccug

SEQ ID NO: 2434967 - RNA, 15 nt, Human
cagaaagcugccugg

SEQ ID NO: 2434968 - RNA, 22 nt, Human
cagaaagccuaucaaagaccuu

SEQ ID NO: 2434969 - RNA, 16 nt, Human
cagaaagccuaucaaa

SEQ ID NO: 2434970 - RNA, 14 nt, Human
cagaaagccuauca

SEQ ID NO: 2434971 - RNA, 18 nt, Human
cagaaccagaugaguaaa

SEQ ID NO: 2434972 - RNA, 18 nt, Human
cagaacaucauuagaaca

SEQ ID NO: 2434973 - RNA, 17 nt, Human
cagaacaucauuagaac

SEQ ID NO: 2434974 - RNA, 15 nt, Human
cagaacaucauuaga

SEQ ID NO: 2434975 - RNA, 16 nt, Human
cagaacaucauuagaa

SEQ ID NO: 2434976 - RNA, 23 nt, Human
cagaacagugauuaccagggacu

SEQ ID NO: 2434977 - RNA, 16 nt, Human
cagaacaguuuguaca

SEQ ID NO: 2434978 - RNA, 18 nt, Human
cagaaagcagaacaguga

SEQ ID NO: 2434979 - RNA, 20 nt, Human
cagaaagacugagcucaagg

SEQ ID NO: 2434980 - RNA, 19 nt, Human
cagaaagauggaugugcuu

SEQ ID NO: 2434981 - RNA, 24 nt, Human
cagaaagaaguggggacagagcag

SEQ ID NO: 2434982 - RNA, 15 nt, Human
cagaaaccaguuaug

SEQ ID NO: 2434983 - RNA, 23 nt, Human
cagaaacaucaguuacucugaag

SEQ ID NO: 2434984 - RNA, 15 nt, Human
cagaaacagugaguu

SEQ ID NO: 2434985 - RNA, 13 nt, Human
cagaaaccaguua

SEQ ID NO: 2434986 - RNA, 20 nt, Human
cagaaacuugugaaguggaa

SEQ ID NO: 2434987 - RNA, 20 nt, Human
cagaaacgaaguagaaaggg

SEQ ID NO: 2434988 - RNA, 14 nt, Human
cagaaaccaguuau

SEQ ID NO: 2434989 - RNA, 19 nt, Human
cagaaacuguucccaccug

SEQ ID NO: 2434990 - RNA, 20 nt, Human
cagaaacacccucacacugg

SEQ ID NO: 2434991 - RNA, 21 nt, Human
cagaaacacccucacacuggg

SEQ ID NO: 2434992 - RNA, 18 nt, Human
cagaaacacccucacacu

SEQ ID NO: 2434993 - RNA, 22 nt, Human
cagaaacacccucacacuggga

SEQ ID NO: 2434994 - RNA, 23 nt, Human
cagaaacacccucacacugggac

SEQ ID NO: 2434995 - RNA, 18 nt, Human
cagaaacaggugcaucug

SEQ ID NO: 2434996 - RNA, 22 nt, Human
cagaaacaggugcaucugggga

SEQ ID NO: 2434997 - RNA, 17 nt, Human
cagaaacaucaguuacu

SEQ ID NO: 2434998 - RNA, 19 nt, Human
cagaaacaucaguuacucu

SEQ ID NO: 2434999 - RNA, 22 nt, Human
cagaaacaucaguuacucugaa

SEQ ID NO: 2435000 - RNA, 22 nt, Human
cacuuuuguucuugguuuguaa

SEQ ID NO: 2435001 - RNA, 22 nt, Human
cacuuuugguuaagucuguuuu

SEQ ID NO: 2435002 - RNA, 20 nt, Human
cacuuuuucauuugccuauu

SEQ ID NO: 2435003 - RNA, 19 nt, Human
cacuuuuucauuugccuau

SEQ ID NO: 2435004 - RNA, 14 nt, Human
cacuuuuguucuug

SEQ ID NO: 2435005 - RNA, 16 nt, Human
cacuuuuccucccuca

SEQ ID NO: 2435006 - RNA, 17 nt, Human
cacuuuugacaaaggca

SEQ ID NO: 2435007 - RNA, 18 nt, Human
cacuuuugacaaaggcaa

SEQ ID NO: 2435008 - RNA, 12 nt, Human
cacuuuucucca

SEQ ID NO: 2435009 - RNA, 18 nt, Human
cacuuuuauuuagcacca

SEQ ID NO: 2435010 - RNA, 13 nt, Human
cacuuuucaguga

SEQ ID NO: 2435011 - RNA, 21 nt, Human
cacuuuguuucguggggaggu

SEQ ID NO: 2435012 - RNA, 20 nt, Human
cacuuuguuucguggggagg

SEQ ID NO: 2435013 - RNA, 17 nt, Human
cacuuuuaauaaacuuu

SEQ ID NO: 2435014 - RNA, 14 nt, Human
cacuuuguucuuua

SEQ ID NO: 2435015 - RNA, 20 nt, Human
cacuuugucgcccaggcugg

SEQ ID NO: 2435016 - RNA, 18 nt, Human
cacuuuguucuuuaggag

SEQ ID NO: 2435017 - RNA, 12 nt, Human
cacuuuguucuu

SEQ ID NO: 2435018 - RNA, 19 nt, Human
cacuuugggaggccaagga

SEQ ID NO: 2435019 - RNA, 21 nt, Human
cagaaaaauaacuucaagcaa

SEQ ID NO: 2435020 - RNA, 16 nt, Human
cagaaaaacucuggga

SEQ ID NO: 2435021 - RNA, 19 nt, Human
cagaaaaacguguugccuu

SEQ ID NO: 2435022 - RNA, 19 nt, Human
cagaaaaacucugggaaau

SEQ ID NO: 2435023 - RNA, 18 nt, Human
cagaaaacauuguuccag

SEQ ID NO: 2435024 - RNA, 16 nt, Human
cagaaaacauuguucc

SEQ ID NO: 2435025 - RNA, 14 nt, Human
cagaaaacauuguu

SEQ ID NO: 2435026 - RNA, 13 nt, Human
cagaaaacauugu

SEQ ID NO: 2435027 - RNA, 12 nt, Human
cagaaaacauug

SEQ ID NO: 2435028 - RNA, 11 nt, Human
cagaaaacauu

SEQ ID NO: 2435029 - RNA, 16 nt, Human
cagaaaacauguuucc

SEQ ID NO: 2435030 - RNA, 14 nt, Human
cagaaaaccccagc

SEQ ID NO: 2435031 - RNA, 19 nt, Human
cagaaaacgguuaaaacug

SEQ ID NO: 2435032 - RNA, 14 nt, Human
cacuuuuuuccaca

SEQ ID NO: 2435033 - RNA, 12 nt, Human
cacuuuuuucca

SEQ ID NO: 2435034 - RNA, 21 nt, Human
cacuuuuuuggggauaugcuu

SEQ ID NO: 2435035 - RNA, 21 nt, Human
cacuuuuuugaguggaugaug

SEQ ID NO: 2435036 - RNA, 16 nt, Human
cacuuuuuuuuuccaa

SEQ ID NO: 2435037 - RNA, 14 nt, Human
cacuuuuuuuuucc

SEQ ID NO: 2435038 - RNA, 23 nt, Human
cacuuuuuuuuuccaaaaaaaua

SEQ ID NO: 2435039 - RNA, 23 nt, Human
cacuuuguucuggcucuuccagg

SEQ ID NO: 2435040 - RNA, 16 nt, Human
cacuuuguucuggcuc

SEQ ID NO: 2435041 - RNA, 14 nt, Human
cacuuuguucuggc

SEQ ID NO: 2435042 - RNA, 13 nt, Human
cacuuuguucugg

SEQ ID NO: 2435043 - RNA, 12 nt, Human
cacuuugggagg

SEQ ID NO: 2435044 - RNA, 13 nt, Human
cacuuugggaggc

SEQ ID NO: 2435045 - RNA, 16 nt, Human
cacuuugggaggccaa

SEQ ID NO: 2435046 - RNA, 19 nt, Human
cacuuugguacauggccag

SEQ ID NO: 2435047 - RNA, 20 nt, Human
cacuuugguacauggccagu

SEQ ID NO: 2435048 - RNA, 14 nt, Human
cacuuugggaggcc

SEQ ID NO: 2435049 - RNA, 23 nt, Human
cacuuugggaggccaaggagggc

SEQ ID NO: 2435050 - RNA, 17 nt, Human
cacuuugcacagcucuc

SEQ ID NO: 2435051 - RNA, 19 nt, Human
cacuuugcacugauauauc

SEQ ID NO: 2435052 - RNA, 14 nt, Human
cacuuugcacagcu

SEQ ID NO: 2435053 - RNA, 12 nt, Human
cacuuugcauaa

SEQ ID NO: 2435054 - RNA, 22 nt, Human
cacuuugcacugauauaucaug

SEQ ID NO: 2435055 - RNA, 19 nt, Human
cacuuugcucuggguggaa

SEQ ID NO: 2435056 - RNA, 12 nt, Human
cacuuugcucug

SEQ ID NO: 2435057 - RNA, 13 nt, Human
cacuuugcucugg

SEQ ID NO: 2435058 - RNA, 22 nt, Human
cacuuucuagccagaggagaga

SEQ ID NO: 2435059 - RNA, 20 nt, Human
cacuuucuauccucuguaaa

SEQ ID NO: 2435060 - RNA, 16 nt, Human
cacuuucuauagcaga

SEQ ID NO: 2435061 - RNA, 16 nt, Human
cacuugggucuucccu

SEQ ID NO: 2435062 - RNA, 20 nt, Human
cacuuugaaauguguuucug

SEQ ID NO: 2435063 - RNA, 19 nt, Human
cacuuugaaauguguuucu

SEQ ID NO: 2435064 - RNA, 17 nt, Human
cacuuugaaauguguuu

SEQ ID NO: 2435065 - RNA, 15 nt, Human
cacuuugaaaugugu

SEQ ID NO: 2435066 - RNA, 19 nt, Human
cacuuucucaguuuucaua

SEQ ID NO: 2435067 - RNA, 14 nt, Human
cagaacccuuggcu

SEQ ID NO: 2435068 - RNA, 19 nt, Human
cagaacccuuggcuugccc

SEQ ID NO: 2435069 - RNA, 12 nt, Human
cagaaccucuuc

SEQ ID NO: 2435070 - RNA, 14 nt, Human
cagaaccucuuccc

SEQ ID NO: 2435071 - RNA, 15 nt, Human
cagaaccucuucccc

SEQ ID NO: 2435072 - RNA, 16 nt, Human
cagaaccucuucccca

SEQ ID NO: 2435073 - RNA, 18 nt, Human
cagaaccucuuccccaga

SEQ ID NO: 2435074 - RNA, 15 nt, Human
cagaaccauccauag

SEQ ID NO: 2435075 - RNA, 23 nt, Human
cagaaccccuacaugaaacagaa

SEQ ID NO: 2435076 - RNA, 10 nt, Human
cagaaccagg

SEQ ID NO: 2435077 - RNA, 23 nt, Human
cagaaccccuggcuccaggccag

SEQ ID NO: 2435078 - RNA, 22 nt, Human
cagaacccuuggagccaaugga

SEQ ID NO: 2435079 - RNA, 19 nt, Human
cagaacuagaauuugauua

SEQ ID NO: 2435080 - RNA, 13 nt, Human
cagaacuagaauu

SEQ ID NO: 2435081 - RNA, 19 nt, Human
cagaacuaaacucauuuau

SEQ ID NO: 2435082 - RNA, 20 nt, Human
cagaacuaaacucauuuaua

SEQ ID NO: 2435083 - RNA, 19 nt, Human
cagaacguggcucugcugg

SEQ ID NO: 2435084 - RNA, 18 nt, Human
cagaacguggcucugcug

SEQ ID NO: 2435085 - RNA, 17 nt, Human
cagaacuaaacucauuu

SEQ ID NO: 2435086 - RNA, 18 nt, Human
cagaacuaaacucauuua

SEQ ID NO: 2435087 - RNA, 16 nt, Human
cagaaccuuguuauuu

SEQ ID NO: 2435088 - RNA, 17 nt, Human
cagaaccuuguuauuuc

SEQ ID NO: 2435089 - RNA, 18 nt, Human
cagaaccuuguuauuucu

SEQ ID NO: 2435090 - RNA, 21 nt, Human
cagaaccuuguuauuucucag

SEQ ID NO: 2435091 - RNA, 15 nt, Human
cagaacguggcucug

SEQ ID NO: 2435092 - RNA, 13 nt, Human
cagaacguggcuc

SEQ ID NO: 2435093 - RNA, 21 nt, Human
cagaacggagccccaggccuc

SEQ ID NO: 2435094 - RNA, 12 nt, Human
cagaaccuggag

SEQ ID NO: 2435095 - RNA, 21 nt, Human
cagaaccucuuccccagaaag

SEQ ID NO: 2435096 - RNA, 20 nt, Human
cagaaccuggagggcuagaa

SEQ ID NO: 2435097 - RNA, 13 nt, Human
cagaaccuggagg

SEQ ID NO: 2435098 - RNA, 21 nt, Human
cagaaccuggagggcuagaac

SEQ ID NO: 2435099 - RNA, 14 nt, Human
cagaaccuguccuu

SEQ ID NO: 2435100 - RNA, 15 nt, Human
cagaacuagaauuug

SEQ ID NO: 2435101 - RNA, 20 nt, Human
cagaacucaaauggggccag

SEQ ID NO: 2435102 - RNA, 21 nt, Human
cagaacucaaauggggccaga

SEQ ID NO: 2435103 - RNA, 22 nt, Human
cagaacucaaauggggccagau

SEQ ID NO: 2435104 - RNA, 15 nt, Human
cagaacucacugggg

SEQ ID NO: 2435105 - RNA, 18 nt, Human
cagaacucacuggggccu

SEQ ID NO: 2435106 - RNA, 14 nt, Human
cagaacucuuucaa

SEQ ID NO: 2435107 - RNA, 15 nt, Human
cagaacucuuucaaa

SEQ ID NO: 2435108 - RNA, 16 nt, Human
cagaacucuuucaaaa

SEQ ID NO: 2435109 - RNA, 21 nt, Human
cagaacugaaccggcuuuacc

SEQ ID NO: 2435110 - RNA, 22 nt, Human
cagaacugaaccggcuuuacca

SEQ ID NO: 2435111 - RNA, 13 nt, Human
cagaacugagcuc

SEQ ID NO: 2435112 - RNA, 15 nt, Human
cagaacugagcuccu

SEQ ID NO: 2435113 - RNA, 16 nt, Human
cagaacugagcuccuc

SEQ ID NO: 2435114 - RNA, 17 nt, Human
cagaacugagcuccucu

SEQ ID NO: 2435115 - RNA, 20 nt, Human
cagaacugagcuccucuggg

SEQ ID NO: 2435116 - RNA, 23 nt, Human
cagaacugagcuccucugggcag

SEQ ID NO: 2435117 - RNA, 24 nt, Human
cagaacugagcuccucugggcagg

SEQ ID NO: 2435118 - RNA, 13 nt, Human
cagaacuggacuc

SEQ ID NO: 2435119 - RNA, 18 nt, Human
cagaacuggacucaggau

SEQ ID NO: 2435120 - RNA, 11 nt, Human
cagaagcccag

SEQ ID NO: 2435121 - RNA, 17 nt, Human
cagaagccaggagcaaa

SEQ ID NO: 2435122 - RNA, 16 nt, Human
cagaagccaggagcaa

SEQ ID NO: 2435123 - RNA, 15 nt, Human
cagaagccaggagca

SEQ ID NO: 2435124 - RNA, 14 nt, Human
cagaagcauuaacu

SEQ ID NO: 2435125 - RNA, 16 nt, Human
cagaagcaggcuggag

SEQ ID NO: 2435126 - RNA, 15 nt, Human
cagaagcaggcugga

SEQ ID NO: 2435127 - RNA, 23 nt, Human
cagaagcaguugagucgucauca

SEQ ID NO: 2435128 - RNA, 12 nt, Human
cagaagcccaga

SEQ ID NO: 2435129 - RNA, 14 nt, Human
cagaagcccagaau

SEQ ID NO: 2435130 - RNA, 19 nt, Human
cagaagccaggagcaaaug

SEQ ID NO: 2435131 - RNA, 20 nt, Human
cagaagccucacugcaagca

SEQ ID NO: 2435132 - RNA, 22 nt, Human
cagaagccuccccagcucaccc

SEQ ID NO: 2435133 - RNA, 18 nt, Human
cagaagccuccccagcuc

SEQ ID NO: 2435134 - RNA, 13 nt, Human
cagaagccucugg

SEQ ID NO: 2435135 - RNA, 19 nt, Human
cagaagcaacccaaauguu

SEQ ID NO: 2435136 - RNA, 20 nt, Human
cagaagcaacccaaauguuc

SEQ ID NO: 2435137 - RNA, 14 nt, Human
cagaagcagcucuu

SEQ ID NO: 2435138 - RNA, 14 nt, Human
cagaagcaggcugg

SEQ ID NO: 2435139 - RNA, 14 nt, Human
cagaagcaggauag

SEQ ID NO: 2435140 - RNA, 13 nt, Human
cagaagcagcucu

SEQ ID NO: 2435141 - RNA, 23 nt, Human
cagaagauccccucaggacugca

SEQ ID NO: 2435142 - RNA, 11 nt, Human
cagaagaaaga

SEQ ID NO: 2435143 - RNA, 14 nt, Human
cagaagaaggcagc

SEQ ID NO: 2435144 - RNA, 20 nt, Human
cagaagaauauucaggacuu

SEQ ID NO: 2435145 - RNA, 19 nt, Human
cagaagaauauucaggacu

SEQ ID NO: 2435146 - RNA, 18 nt, Human
cagaagaauauucaggac

SEQ ID NO: 2435147 - RNA, 17 nt, Human
cagaagaauauucagga

SEQ ID NO: 2435148 - RNA, 17 nt, Human
cagaagaauugaaccca

SEQ ID NO: 2435149 - RNA, 19 nt, Human
cagaagaauugaacccagg

SEQ ID NO: 2435150 - RNA, 20 nt, Human
cagaagaauugaacccagga

SEQ ID NO: 2435151 - RNA, 21 nt, Human
cagaagaauugaacccaggag

SEQ ID NO: 2435152 - RNA, 16 nt, Human
cagaagaauauucagg

SEQ ID NO: 2435153 - RNA, 15 nt, Human
cagaagaauauucag

SEQ ID NO: 2435154 - RNA, 14 nt, Human
cagaagaauauuca

SEQ ID NO: 2435155 - RNA, 12 nt, Human
cagaagaauauu

SEQ ID NO: 2435156 - RNA, 18 nt, Human
cagaagaauaugacagcu

SEQ ID NO: 2435157 - RNA, 15 nt, Human
cagaagaaggcagca

SEQ ID NO: 2435158 - RNA, 21 nt, Human
cagaagacacugaugggcaac

SEQ ID NO: 2435159 - RNA, 19 nt, Human
cagaagacaccagagcaga

SEQ ID NO: 2435160 - RNA, 18 nt, Human
cagaagacaccagagcag

SEQ ID NO: 2435161 - RNA, 17 nt, Human
cagaagacaccagagca

SEQ ID NO: 2435162 - RNA, 16 nt, Human
cagaagacaccagagc

SEQ ID NO: 2435163 - RNA, 15 nt, Human
cagaagacaccagag

SEQ ID NO: 2435164 - RNA, 14 nt, Human
cagaagacaccaga

SEQ ID NO: 2435165 - RNA, 22 nt, Human
cagaagaauugaacccaggagg

SEQ ID NO: 2435166 - RNA, 21 nt, Human
cagaagaccacaaaaauugac

SEQ ID NO: 2435167 - RNA, 21 nt, Human
cagaagacaccagagcagaug

SEQ ID NO: 2435168 - RNA, 20 nt, Human
cagaagacaccagagcagau

SEQ ID NO: 2435169 - RNA, 19 nt, Human
cagaagacacugcaaaggc

SEQ ID NO: 2435170 - RNA, 21 nt, Human
cagaagagaugggcuuguuuu

SEQ ID NO: 2435171 - RNA, 19 nt, Human
cagaagauccccucaggac

SEQ ID NO: 2435172 - RNA, 18 nt, Human
cagaagauccccucagga

SEQ ID NO: 2435173 - RNA, 15 nt, Human
cagaagauccccuca

SEQ ID NO: 2435174 - RNA, 22 nt, Human
cagaagauaacuugagcaccgu

SEQ ID NO: 2435175 - RNA, 15 nt, Human
cagaagauaacuuga

SEQ ID NO: 2435176 - RNA, 20 nt, Human
cagaagagaugggcuuguuu

SEQ ID NO: 2435177 - RNA, 20 nt, Human
cagaagauagcuucacccca

SEQ ID NO: 2435178 - RNA, 18 nt, Human
cagaaggaagacuucauc

SEQ ID NO: 2435179 - RNA, 17 nt, Human
cagaaggaagacuucau

SEQ ID NO: 2435180 - RNA, 16 nt, Human
cagaaggaagacuuca

SEQ ID NO: 2435181 - RNA, 12 nt, Human
cagaagcuucca

SEQ ID NO: 2435182 - RNA, 19 nt, Human
cagaagcugagcaccaggg

SEQ ID NO: 2435183 - RNA, 21 nt, Human
cagaagcugagcaccagggga

SEQ ID NO: 2435184 - RNA, 16 nt, Human
cagaagcugagcacca

SEQ ID NO: 2435185 - RNA, 18 nt, Human
cagaagccugaugcugac

SEQ ID NO: 2435186 - RNA, 19 nt, Human
cagaagccugaggcuggga

SEQ ID NO: 2435187 - RNA, 14 nt, Human
cagaagccugaggc

SEQ ID NO: 2435188 - RNA, 15 nt, Human
cagaagccugaggcu

SEQ ID NO: 2435189 - RNA, 16 nt, Human
cagaagccucuggguc

SEQ ID NO: 2435190 - RNA, 19 nt, Human
cagaagccucuggcuagag

SEQ ID NO: 2435191 - RNA, 14 nt, Human
cagaagccucuggc

SEQ ID NO: 2435192 - RNA, 15 nt, Human
cagaagccucuggcu

SEQ ID NO: 2435193 - RNA, 18 nt, Human
cagaagcgggacgagacc

SEQ ID NO: 2435194 - RNA, 20 nt, Human
cagaaggaaaaauguguaau

SEQ ID NO: 2435195 - RNA, 19 nt, Human
cagaaggaaaaauguguaa

SEQ ID NO: 2435196 - RNA, 17 nt, Human
cagaaggaaaaaugugu

SEQ ID NO: 2435197 - RNA, 14 nt, Human
cagaagcuucagaa

SEQ ID NO: 2435198 - RNA, 16 nt, Human
cagaagcuucugccca

SEQ ID NO: 2435199 - RNA, 19 nt, Human
cagaaggaagacuucaucc

SEQ ID NO: 2435200 - RNA, 21 nt, Human
cagaaggaagggcauccuucu

SEQ ID NO: 2435201 - RNA, 14 nt, Human
cagaaggaccuccu

SEQ ID NO: 2435202 - RNA, 14 nt, Human
cagaaggagaagga

SEQ ID NO: 2435203 - RNA, 18 nt, Human
cagaaggagaaggaagga

SEQ ID NO: 2435204 - RNA, 20 nt, Human
cagaaggagaaggaaggaga

SEQ ID NO: 2435205 - RNA, 18 nt, Human
cagaaggccaagaggcug

SEQ ID NO: 2435206 - RNA, 14 nt, Human
cagaaggccaagag

SEQ ID NO: 2435207 - RNA, 20 nt, Human
cagaaggcaaaugacuuugg

SEQ ID NO: 2435208 - RNA, 23 nt, Human
cagaaggcauaucagucucugag

SEQ ID NO: 2435209 - RNA, 13 nt, Human
cagaaggcaggga

SEQ ID NO: 2435210 - RNA, 18 nt, Human
cagaaggccaagaaucaa

SEQ ID NO: 2435211 - RNA, 14 nt, Human
cagaaggccaagaa

SEQ ID NO: 2435212 - RNA, 13 nt, Human
cagaaggccaaga

SEQ ID NO: 2435213 - RNA, 18 nt, Human
cagaaggcaaaugacuuu

SEQ ID NO: 2435214 - RNA, 19 nt, Human
cagaaggcaaaugacuuug

SEQ ID NO: 2435215 - RNA, 18 nt, Human
cagaaggcaaacccauca

SEQ ID NO: 2435216 - RNA, 17 nt, Human
cagaaggaugaaugagg

SEQ ID NO: 2435217 - RNA, 13 nt, Human
cagaaggaggagg

SEQ ID NO: 2435218 - RNA, 14 nt, Human
cagaaggaggagga

SEQ ID NO: 2435219 - RNA, 16 nt, Human
cagaagucaagcccag

SEQ ID NO: 2435220 - RNA, 17 nt, Human
cagaaucucaaauaacu

SEQ ID NO: 2435221 - RNA, 18 nt, Human
cagaaucucaaauaacua

SEQ ID NO: 2435222 - RNA, 16 nt, Human
cagaaucuaaagccag

SEQ ID NO: 2435223 - RNA, 15 nt, Human
cagaaucuaaagcca

SEQ ID NO: 2435224 - RNA, 17 nt, Human
cagaaucuaaagccagu

SEQ ID NO: 2435225 - RNA, 16 nt, Human
cagaagucaugaagcc

SEQ ID NO: 2435226 - RNA, 17 nt, Human
cagaagucaugaagccc

SEQ ID NO: 2435227 - RNA, 22 nt, Human
cagaagggguuuggucugggac

SEQ ID NO: 2435228 - RNA, 20 nt, Human
cagaagggguuuggucuggg

SEQ ID NO: 2435229 - RNA, 21 nt, Human
cagaaggggguggugucucca

SEQ ID NO: 2435230 - RNA, 20 nt, Human
cagaaggggguggugucucc

SEQ ID NO: 2435231 - RNA, 19 nt, Human
cagaaggggguggugucuc

SEQ ID NO: 2435232 - RNA, 15 nt, Human
cagaagguauuccuu

SEQ ID NO: 2435233 - RNA, 23 nt, Human
cagaagguugcucuagauugaga

SEQ ID NO: 2435234 - RNA, 16 nt, Human
cagaagguugugauga

SEQ ID NO: 2435235 - RNA, 15 nt, Human
cagaaggggagggga

SEQ ID NO: 2435236 - RNA, 20 nt, Human
cagaaggggaggggagacag

SEQ ID NO: 2435237 - RNA, 14 nt, Human
cagaaggggguggu

SEQ ID NO: 2435238 - RNA, 18 nt, Human
cagaagggggccaugagg

SEQ ID NO: 2435239 - RNA, 17 nt, Human
cagaagggggagaccaa

SEQ ID NO: 2435240 - RNA, 14 nt, Human
cagaagggggccau

SEQ ID NO: 2435241 - RNA, 15 nt, Human
cagaagggggccaug

SEQ ID NO: 2435242 - RNA, 16 nt, Human
cagaagggggccauga

SEQ ID NO: 2435243 - RNA, 15 nt, Human
cagaagggaggcugg

SEQ ID NO: 2435244 - RNA, 12 nt, Human
cagaagggaggc

SEQ ID NO: 2435245 - RNA, 14 nt, Human
cagaaggcucuucu

SEQ ID NO: 2435246 - RNA, 12 nt, Human
cagaaggcucuu

SEQ ID NO: 2435247 - RNA, 10 nt, Human
cagaagggag

SEQ ID NO: 2435248 - RNA, 17 nt, Human
cagaaggcucuucugac

SEQ ID NO: 2435249 - RNA, 19 nt, Human
cagaagggacuucacgaag

SEQ ID NO: 2435250 - RNA, 15 nt, Human
cagaagggagaagga

SEQ ID NO: 2435251 - RNA, 15 nt, Human
cagacggcacccacc

SEQ ID NO: 2435252 - RNA, 16 nt, Human
cagacggcacccaccc

SEQ ID NO: 2435253 - RNA, 17 nt, Human
cagacggcacccaccca

SEQ ID NO: 2435254 - RNA, 17 nt, Human
cagacgguucaccagcc

SEQ ID NO: 2435255 - RNA, 17 nt, Human
cagacguaggggagggg

SEQ ID NO: 2435256 - RNA, 19 nt, Human
cagacgguucaccagccuc

SEQ ID NO: 2435257 - RNA, 20 nt, Human
cagacguaugcuuauuuuaa

SEQ ID NO: 2435258 - RNA, 15 nt, Human
cagacgucccuccac

SEQ ID NO: 2435259 - RNA, 23 nt, Human
cagacuagaauucuagugcugcu

SEQ ID NO: 2435260 - RNA, 22 nt, Human
cagacuagaauucuagugcugc

SEQ ID NO: 2435261 - RNA, 18 nt, Human
cagacuauuuaacuugag

SEQ ID NO: 2435262 - RNA, 22 nt, Human
cagacuaguuuaguuaaaugag

SEQ ID NO: 2435263 - RNA, 19 nt, Human
cagacuauuuaacuugagg

SEQ ID NO: 2435264 - RNA, 22 nt, Human
cagacucaaaugcucagaccag

SEQ ID NO: 2435265 - RNA, 23 nt, Human
cagacucaaaugcucagaccagc

SEQ ID NO: 2435266 - RNA, 19 nt, Human
cagacucacaaccugaacc

SEQ ID NO: 2435267 - RNA, 22 nt, Human
cagaccuggagccccugggugg

SEQ ID NO: 2435268 - RNA, 21 nt, Human
cagaccuggagccccugggug

SEQ ID NO: 2435269 - RNA, 20 nt, Human
cagaccuggagccccugggu

SEQ ID NO: 2435270 - RNA, 19 nt, Human
cagaccuggagccccuggg

SEQ ID NO: 2435271 - RNA, 18 nt, Human
cagaccuggagccccugg

SEQ ID NO: 2435272 - RNA, 17 nt, Human
cagaccuggagccccug

SEQ ID NO: 2435273 - RNA, 16 nt, Human
cagaccuggagccccu

SEQ ID NO: 2435274 - RNA, 15 nt, Human
cagaccuggagcccc

SEQ ID NO: 2435275 - RNA, 17 nt, Human
cagaccuguccuccugg

SEQ ID NO: 2435276 - RNA, 13 nt, Human
cagaccuguccuc

SEQ ID NO: 2435277 - RNA, 12 nt, Human
cagaccuguccu

SEQ ID NO: 2435278 - RNA, 23 nt, Human
cagaccuggagccccuggguggg

SEQ ID NO: 2435279 - RNA, 19 nt, Human
cagaccuguuagcagacag

SEQ ID NO: 2435280 - RNA, 20 nt, Human
cagaccuguuagcagacagg

SEQ ID NO: 2435281 - RNA, 17 nt, Human
cagacgcacgugggucu

SEQ ID NO: 2435282 - RNA, 19 nt, Human
cagaccuuguucacacucu

SEQ ID NO: 2435283 - RNA, 21 nt, Human
cagaccuucuaggacgccacc

SEQ ID NO: 2435284 - RNA, 15 nt, Human
cagaccuuugaggau

SEQ ID NO: 2435285 - RNA, 16 nt, Human
cagacgccugaggaac

SEQ ID NO: 2435286 - RNA, 13 nt, Human
cagaccuuuuauc

SEQ ID NO: 2435287 - RNA, 23 nt, Human
cagacgccggggacagaggccug

SEQ ID NO: 2435288 - RNA, 22 nt, Human
cagaccuccccagccccuagcc

SEQ ID NO: 2435289 - RNA, 21 nt, Human
cagaccuccccagccccuagc

SEQ ID NO: 2435290 - RNA, 19 nt, Human
cagaccuccccagccccua

SEQ ID NO: 2435291 - RNA, 18 nt, Human
cagaccuccccagccccu

SEQ ID NO: 2435292 - RNA, 16 nt, Human
cagaccuccccagccc

SEQ ID NO: 2435293 - RNA, 15 nt, Human
cagaccuccccagcc

SEQ ID NO: 2435294 - RNA, 14 nt, Human
cagaccuccccagc

SEQ ID NO: 2435295 - RNA, 12 nt, Human
cagaccucccca

SEQ ID NO: 2435296 - RNA, 13 nt, Human
cagaccugauccu

SEQ ID NO: 2435297 - RNA, 14 nt, Human
cagaccugauccug

SEQ ID NO: 2435298 - RNA, 23 nt, Human
cagaccuccccagccccuagccc

SEQ ID NO: 2435299 - RNA, 12 nt, Human
cagaccugagcu

SEQ ID NO: 2435300 - RNA, 17 nt, Human
cagaccugagcucccca

SEQ ID NO: 2435301 - RNA, 17 nt, Human
cagaccugauccuggag

SEQ ID NO: 2435302 - RNA, 20 nt, Human
cagaccugauccuggaggcc

SEQ ID NO: 2435303 - RNA, 22 nt, Human
cagaccugauccuggaggccca

SEQ ID NO: 2435304 - RNA, 23 nt, Human
cagaccugauccuggaggcccag

SEQ ID NO: 2435305 - RNA, 14 nt, Human
cagaccuggagccc

SEQ ID NO: 2435306 - RNA, 13 nt, Human
cagaccuggagcc

SEQ ID NO: 2435307 - RNA, 22 nt, Human
cagaccugagcuccccaccacc

SEQ ID NO: 2435308 - RNA, 16 nt, Human
cagaccugccucuucc

SEQ ID NO: 2435309 - RNA, 13 nt, Human
cagaccugccucu

SEQ ID NO: 2435310 - RNA, 20 nt, Human
cagacuuugcuucccauugu

SEQ ID NO: 2435311 - RNA, 21 nt, Human
cagacuuuacaugacacagcu

SEQ ID NO: 2435312 - RNA, 20 nt, Human
cagacuuuacaugacacagc

SEQ ID NO: 2435313 - RNA, 19 nt, Human
cagacuuuggaaaaugcau

SEQ ID NO: 2435314 - RNA, 22 nt, Human
cagacuuuggaaaaugcauugu

SEQ ID NO: 2435315 - RNA, 23 nt, Human
cagacuuuggaaaaugcauugua

SEQ ID NO: 2435316 - RNA, 20 nt, Human
cagacuucuccagacccacc

SEQ ID NO: 2435317 - RNA, 15 nt, Human
cagacuuuaaagaau

SEQ ID NO: 2435318 - RNA, 24 nt, Human
cagacuuccuugagacacggagcc

SEQ ID NO: 2435319 - RNA, 13 nt, Human
cagacuucuccag

SEQ ID NO: 2435320 - RNA, 14 nt, Human
cagacuucuccaga

SEQ ID NO: 2435321 - RNA, 15 nt, Human
cagacuucuccagac

SEQ ID NO: 2435322 - RNA, 16 nt, Human
cagacuucuccagacc

SEQ ID NO: 2435323 - RNA, 15 nt, Human
cagacuuccuugaga

SEQ ID NO: 2435324 - RNA, 21 nt, Human
cagacuucccugaauguauug

SEQ ID NO: 2435325 - RNA, 15 nt, Human
cagacuucacacugc

SEQ ID NO: 2435326 - RNA, 14 nt, Human
cagacuucacacug

SEQ ID NO: 2435327 - RNA, 16 nt, Human
cagacucaguuuguca

SEQ ID NO: 2435328 - RNA, 14 nt, Human
cagacucaauaaaa

SEQ ID NO: 2435329 - RNA, 17 nt, Human
cagacucaguuugucag

SEQ ID NO: 2435330 - RNA, 18 nt, Human
cagacucaguuugucaga

SEQ ID NO: 2435331 - RNA, 14 nt, Human
cagacucagacauu

SEQ ID NO: 2435332 - RNA, 21 nt, Human
cagacucacaaccugaaccua

SEQ ID NO: 2435333 - RNA, 20 nt, Human
cagacucacaaccugaaccu

SEQ ID NO: 2435334 - RNA, 17 nt, Human
cagacucccauuccuga

SEQ ID NO: 2435335 - RNA, 18 nt, Human
cagacucccauuccugaa

SEQ ID NO: 2435336 - RNA, 14 nt, Human
cagacucccauucc

SEQ ID NO: 2435337 - RNA, 18 nt, Human
cagagaaagaagagacag

SEQ ID NO: 2435338 - RNA, 15 nt, Human
cagagaaagaagaga

SEQ ID NO: 2435339 - RNA, 20 nt, Human
cagacuuuuuuuaaauagua

SEQ ID NO: 2435340 - RNA, 23 nt, Human
cagagaaaguacuucuccacccu

SEQ ID NO: 2435341 - RNA, 19 nt, Human
cagagaaaguacuucucca

SEQ ID NO: 2435342 - RNA, 17 nt, Human
cagagaaagaggaagcu

SEQ ID NO: 2435343 - RNA, 15 nt, Human
cagagaaagaggaag

SEQ ID NO: 2435344 - RNA, 13 nt, Human
cagagaaagagga

SEQ ID NO: 2435345 - RNA, 23 nt, Human
cagagaaagaagagacaggaggg

SEQ ID NO: 2435346 - RNA, 22 nt, Human
cagagaaagaagagacaggagg

SEQ ID NO: 2435347 - RNA, 21 nt, Human
cagagaaagaagagacaggag

SEQ ID NO: 2435348 - RNA, 20 nt, Human
cagagaaagaagagacagga

SEQ ID NO: 2435349 - RNA, 19 nt, Human
cagagaaagaagagacagg

SEQ ID NO: 2435350 - RNA, 18 nt, Human
cagagaaagaggaagcuu

SEQ ID NO: 2435351 - RNA, 18 nt, Human
cagagaaaggggagccca

SEQ ID NO: 2435352 - RNA, 21 nt, Human
cagacccugcccugugggccc

SEQ ID NO: 2435353 - RNA, 17 nt, Human
cagacccugcccugugg

SEQ ID NO: 2435354 - RNA, 16 nt, Human
cagacccugcccugug

SEQ ID NO: 2435355 - RNA, 15 nt, Human
cagacccugcccugu

SEQ ID NO: 2435356 - RNA, 19 nt, Human
cagaccuauuccuccuggg

SEQ ID NO: 2435357 - RNA, 18 nt, Human
cagaccuauuccuccugg

SEQ ID NO: 2435358 - RNA, 22 nt, Human
cagaccuaggauuucaugauuu

SEQ ID NO: 2435359 - RNA, 15 nt, Human
cagaccuaaugcucc

SEQ ID NO: 2435360 - RNA, 16 nt, Human
cagaccuaaugcuccu

SEQ ID NO: 2435361 - RNA, 17 nt, Human
cagaccuaaugcuccuu

SEQ ID NO: 2435362 - RNA, 18 nt, Human
cagaccuaaugcuccuug

SEQ ID NO: 2435363 - RNA, 21 nt, Human
cagaccgaacuguuguauaaa

SEQ ID NO: 2435364 - RNA, 22 nt, Human
cagacccugcccugugggcccc

SEQ ID NO: 2435365 - RNA, 18 nt, Human
cagacccuaccccaccac

SEQ ID NO: 2435366 - RNA, 15 nt, Human
cagacccuaccccac

SEQ ID NO: 2435367 - RNA, 16 nt, Human
cagacccuaccccacc

SEQ ID NO: 2435368 - RNA, 17 nt, Human
cagacccuaccccacca

SEQ ID NO: 2435369 - RNA, 22 nt, Human
cagaccccuggcuuuucacugc

SEQ ID NO: 2435370 - RNA, 21 nt, Human
cagaccccuggcuuuucacug

SEQ ID NO: 2435371 - RNA, 23 nt, Human
cagaccccuggcuuuucacugcu

SEQ ID NO: 2435372 - RNA, 16 nt, Human
cagaccccuucagcca

SEQ ID NO: 2435373 - RNA, 22 nt, Human
cagaccccucuggccaggaugg

SEQ ID NO: 2435374 - RNA, 14 nt, Human
cagacccggcugcg

SEQ ID NO: 2435375 - RNA, 12 nt, Human
cagacccggcug

SEQ ID NO: 2435376 - RNA, 14 nt, Human
cagacccugcccug

SEQ ID NO: 2435377 - RNA, 13 nt, Human
cagacccugcccu

SEQ ID NO: 2435378 - RNA, 12 nt, Human
cagacccugccc

SEQ ID NO: 2435379 - RNA, 16 nt, Human
cagacccggcugcgug

SEQ ID NO: 2435380 - RNA, 18 nt, Human
cagaccccuggcuuuuca

SEQ ID NO: 2435381 - RNA, 16 nt, Human
cagaccccuggcuuuu

SEQ ID NO: 2435382 - RNA, 15 nt, Human
cagaccccuggcuuu

SEQ ID NO: 2435383 - RNA, 14 nt, Human
cagaccccuggcuu

SEQ ID NO: 2435384 - RNA, 13 nt, Human
cagaccccuggcu

SEQ ID NO: 2435385 - RNA, 17 nt, Human
cagaccccucuggccag

SEQ ID NO: 2435386 - RNA, 18 nt, Human
cagaccccucuggccagg

SEQ ID NO: 2435387 - RNA, 20 nt, Human
cagaccccucuggccaggau

SEQ ID NO: 2435388 - RNA, 21 nt, Human
cagaccccucuggccaggaug

SEQ ID NO: 2435389 - RNA, 15 nt, Human
cagacccccuggaga

SEQ ID NO: 2435390 - RNA, 18 nt, Human
cagacccccagcaacccu

SEQ ID NO: 2435391 - RNA, 13 nt, Human
cagaccccucugg

SEQ ID NO: 2435392 - RNA, 16 nt, Human
cagaccccucuggcca

SEQ ID NO: 2435393 - RNA, 12 nt, Human
cagacccagugg

SEQ ID NO: 2435394 - RNA, 12 nt, Human
cagaccccagcg

SEQ ID NO: 2435395 - RNA, 14 nt, Human
cagaccccagcggc

SEQ ID NO: 2435396 - RNA, 16 nt, Human
cagaccccagcggcug

SEQ ID NO: 2435397 - RNA, 15 nt, Human
cagaccccagcggcu

SEQ ID NO: 2435398 - RNA, 13 nt, Human
cagacccccaccc

SEQ ID NO: 2435399 - RNA, 14 nt, Human
cagacccccacccc

SEQ ID NO: 2435400 - RNA, 15 nt, Human
cagacccccaccccu

SEQ ID NO: 2435401 - RNA, 17 nt, Human
cagacccccaccccuuc

SEQ ID NO: 2435402 - RNA, 18 nt, Human
cagacccccaccccuucc

SEQ ID NO: 2435403 - RNA, 19 nt, Human
cagacccccaccccuuccc

SEQ ID NO: 2435404 - RNA, 20 nt, Human
cagacccccaccccuucccc

SEQ ID NO: 2435405 - RNA, 21 nt, Human
cagacccccaccccuucccca

SEQ ID NO: 2435406 - RNA, 22 nt, Human
cagacccccaccccuuccccac

SEQ ID NO: 2435407 - RNA, 23 nt, Human
cagacccccaccccuuccccacu

SEQ ID NO: 2435408 - RNA, 13 nt, Human
cagacccccacuc

SEQ ID NO: 2435409 - RNA, 14 nt, Human
cagacccccacucu

SEQ ID NO: 2435410 - RNA, 16 nt, Human
cagacccccacucuca

SEQ ID NO: 2435411 - RNA, 13 nt, Human
cagacccccagca

SEQ ID NO: 2435412 - RNA, 17 nt, Human
cagacccccagcaaccc

SEQ ID NO: 2435413 - RNA, 19 nt, Human
cagacauuguuuugccaac

SEQ ID NO: 2435414 - RNA, 15 nt, Human
cagacauuguuuugc

SEQ ID NO: 2435415 - RNA, 13 nt, Human
cagacauuguuuu

SEQ ID NO: 2435416 - RNA, 21 nt, Human
cagacauugucagcaaauuaa

SEQ ID NO: 2435417 - RNA, 17 nt, Human
cagacauugucagcaaa

SEQ ID NO: 2435418 - RNA, 15 nt, Human
cagacauugucagca

SEQ ID NO: 2435419 - RNA, 11 nt, Human
cagacauuguu

SEQ ID NO: 2435420 - RNA, 14 nt, Human
cagacauugucagc

SEQ ID NO: 2435421 - RNA, 11 nt, Human
cagacauuguc

SEQ ID NO: 2435422 - RNA, 14 nt, Human
cagacauuggcacc

SEQ ID NO: 2435423 - RNA, 14 nt, Human
cagaccacaaaacu

SEQ ID NO: 2435424 - RNA, 20 nt, Human
cagaccacaaaacuuuucua

SEQ ID NO: 2435425 - RNA, 22 nt, Human
cagaccacgcccguccugccug

SEQ ID NO: 2435426 - RNA, 22 nt, Human
cagaccaccccgccugcccuca

SEQ ID NO: 2435427 - RNA, 19 nt, Human
cagaccaccccgccugccc

SEQ ID NO: 2435428 - RNA, 15 nt, Human
cagaccaccccgccu

SEQ ID NO: 2435429 - RNA, 13 nt, Human
cagaccaccccgc

SEQ ID NO: 2435430 - RNA, 22 nt, Human
cagacauuguuuugccaacauu

SEQ ID NO: 2435431 - RNA, 20 nt, Human
cagacauuguuuugccaaca

SEQ ID NO: 2435432 - RNA, 20 nt, Human
cagaccacaucuuuaucugu

SEQ ID NO: 2435433 - RNA, 24 nt, Human
cagaccacgcccguccugccugug

SEQ ID NO: 2435434 - RNA, 23 nt, Human
cagaccacgcccguccugccugu

SEQ ID NO: 2435435 - RNA, 13 nt, Human
cagaccacggcuc

SEQ ID NO: 2435436 - RNA, 16 nt, Human
cagaccauaauguuac

SEQ ID NO: 2435437 - RNA, 13 nt, Human
cagaccagcucuu

SEQ ID NO: 2435438 - RNA, 22 nt, Human
cagacaccuugacagggcacac

SEQ ID NO: 2435439 - RNA, 20 nt, Human
cagacaccuugacagggcac

SEQ ID NO: 2435440 - RNA, 14 nt, Human
cagacacccucaac

SEQ ID NO: 2435441 - RNA, 15 nt, Human
cagacacccucaacc

SEQ ID NO: 2435442 - RNA, 21 nt, Human
cagacacccucaaccucuucu

SEQ ID NO: 2435443 - RNA, 15 nt, Human
cagacaccgccacau

SEQ ID NO: 2435444 - RNA, 19 nt, Human
cagacaccuugacagggca

SEQ ID NO: 2435445 - RNA, 16 nt, Human
cagacacucugcucug

SEQ ID NO: 2435446 - RNA, 14 nt, Human
cagacacucugcuc

SEQ ID NO: 2435447 - RNA, 13 nt, Human
cagacacucugcu

SEQ ID NO: 2435448 - RNA, 12 nt, Human
cagacacucugc

SEQ ID NO: 2435449 - RNA, 21 nt, Human
cagacacuaaguuauaguaua

SEQ ID NO: 2435450 - RNA, 18 nt, Human
cagacacuaaguuauagu

SEQ ID NO: 2435451 - RNA, 12 nt, Human
cagacacuaagu

SEQ ID NO: 2435452 - RNA, 11 nt, Human
cagacacuaag

SEQ ID NO: 2435453 - RNA, 22 nt, Human
cagacacggaucugagaaucuu

SEQ ID NO: 2435454 - RNA, 17 nt, Human
cagacacggaucugaga

SEQ ID NO: 2435455 - RNA, 14 nt, Human
cagacaccuuggac

SEQ ID NO: 2435456 - RNA, 18 nt, Human
cagacaccuuggacaucc

SEQ ID NO: 2435457 - RNA, 20 nt, Human
cagacaguuaagagaaauga

SEQ ID NO: 2435458 - RNA, 14 nt, Human
cagacacucuggcu

SEQ ID NO: 2435459 - RNA, 13 nt, Human
cagacacucuggc

SEQ ID NO: 2435460 - RNA, 20 nt, Human
cagacacucugcucugcccu

SEQ ID NO: 2435461 - RNA, 19 nt, Human
cagacacucugcucugccc

SEQ ID NO: 2435462 - RNA, 21 nt, Human
cagacacuuuuuugaguggau

SEQ ID NO: 2435463 - RNA, 17 nt, Human
cagacauagaauuaaca

SEQ ID NO: 2435464 - RNA, 19 nt, Human
cagacauagaauuaacaca

SEQ ID NO: 2435465 - RNA, 19 nt, Human
cagacauacuaaccagcag

SEQ ID NO: 2435466 - RNA, 21 nt, Human
cagacacugaccauccacucu

SEQ ID NO: 2435467 - RNA, 19 nt, Human
cagacauccauguuuguaa

SEQ ID NO: 2435468 - RNA, 17 nt, Human
cagacaucucugcaccc

SEQ ID NO: 2435469 - RNA, 15 nt, Human
cagacaucucugcac

SEQ ID NO: 2435470 - RNA, 23 nt, Human
cagacauccauguuuguaaaacu

SEQ ID NO: 2435471 - RNA, 22 nt, Human
cagacauccauguuuguaaaac

SEQ ID NO: 2435472 - RNA, 18 nt, Human
cagacaugccacaaggac

SEQ ID NO: 2435473 - RNA, 18 nt, Human
cagacauguggugggaca

SEQ ID NO: 2435474 - RNA, 12 nt, Human
cagacauguuuu

SEQ ID NO: 2435475 - RNA, 22 nt, Human
cagacauguggugggacaggga

SEQ ID NO: 2435476 - RNA, 18 nt, Human
cagacauguuuuccguga

SEQ ID NO: 2435477 - RNA, 22 nt, Human
cagacauguuuuccgugaaaac

SEQ ID NO: 2435478 - RNA, 13 nt, Human
cagacauucugcc

SEQ ID NO: 2435479 - RNA, 16 nt, Human
cagacauucugccagg

SEQ ID NO: 2435480 - RNA, 21 nt, Human
cagacauucugccaggccccc

SEQ ID NO: 2435481 - RNA, 23 nt, Human
cagacacaggcccggcuccaggc

SEQ ID NO: 2435482 - RNA, 22 nt, Human
cagacacaggcccggcuccagg

SEQ ID NO: 2435483 - RNA, 21 nt, Human
cagacacaggcccggcuccag

SEQ ID NO: 2435484 - RNA, 18 nt, Human
cagacacaggcccggcuc

SEQ ID NO: 2435485 - RNA, 17 nt, Human
cagacacaggcccggcu

SEQ ID NO: 2435486 - RNA, 15 nt, Human
cagacacaggcccgg

SEQ ID NO: 2435487 - RNA, 14 nt, Human
cagacacaggcccg

SEQ ID NO: 2435488 - RNA, 13 nt, Human
cagacacaggccc

SEQ ID NO: 2435489 - RNA, 21 nt, Human
cagacacagggacuugaaguu

SEQ ID NO: 2435490 - RNA, 20 nt, Human
cagacacagggacuugaagu

SEQ ID NO: 2435491 - RNA, 18 nt, Human
cagacacagggacuugaa

SEQ ID NO: 2435492 - RNA, 17 nt, Human
cagacacagggacuuga

SEQ ID NO: 2435493 - RNA, 13 nt, Human
cagacacccaccc

SEQ ID NO: 2435494 - RNA, 22 nt, Human
cagacacagggacuugaaguug

SEQ ID NO: 2435495 - RNA, 12 nt, Human
cagacacccagg

SEQ ID NO: 2435496 - RNA, 13 nt, Human
cagacacccagga

SEQ ID NO: 2435497 - RNA, 14 nt, Human
cagacacccaggac

SEQ ID NO: 2435498 - RNA, 15 nt, Human
cagacacccaggacu

SEQ ID NO: 2435499 - RNA, 17 nt, Human
cagacacccaggacuua

SEQ ID NO: 2435500 - RNA, 23 nt, Human
cagacacauguccaagaagccca

SEQ ID NO: 2435501 - RNA, 22 nt, Human
cagacacauguccaagaagccc

SEQ ID NO: 2435502 - RNA, 21 nt, Human
cagacacauguccaagaagcc

SEQ ID NO: 2435503 - RNA, 17 nt, Human
cagacacauguccaaga

SEQ ID NO: 2435504 - RNA, 14 nt, Human
cagacacaugucca

SEQ ID NO: 2435505 - RNA, 15 nt, Human
cagacacaggcccuc

SEQ ID NO: 2435506 - RNA, 18 nt, Human
cagacacaggcccucccu

SEQ ID NO: 2435507 - RNA, 14 nt, Human
cagacacaggcccu

SEQ ID NO: 2435508 - RNA, 14 nt, Human
cagacacagaagag

SEQ ID NO: 2435509 - RNA, 18 nt, Human
cagacacacgcacacaca

SEQ ID NO: 2435510 - RNA, 22 nt, Human
cagacacacacacgcacgcaca

SEQ ID NO: 2435511 - RNA, 21 nt, Human
cagacacacacacgcacgcac

SEQ ID NO: 2435512 - RNA, 18 nt, Human
cagacacacacacgcacg

SEQ ID NO: 2435513 - RNA, 17 nt, Human
cagacacacacacgcac

SEQ ID NO: 2435514 - RNA, 16 nt, Human
cagacacacacacgca

SEQ ID NO: 2435515 - RNA, 15 nt, Human
cagacacacacacgc

SEQ ID NO: 2435516 - RNA, 14 nt, Human
cagacacacacacg

SEQ ID NO: 2435517 - RNA, 13 nt, Human
cagacacacacac

SEQ ID NO: 2435518 - RNA, 11 nt, Human
cagacacacac

SEQ ID NO: 2435519 - RNA, 14 nt, Human
cagacacacacaca

SEQ ID NO: 2435520 - RNA, 12 nt, Human
cagacacacaca

SEQ ID NO: 2435521 - RNA, 16 nt, Human
cagacaagguagcccu

SEQ ID NO: 2435522 - RNA, 23 nt, Human
cagacaagguagcccuggccaga

SEQ ID NO: 2435523 - RNA, 23 nt, Human
cagacaagcaacagguuuuauaa

SEQ ID NO: 2435524 - RNA, 19 nt, Human
cagacaagcaacagguuuu

SEQ ID NO: 2435525 - RNA, 21 nt, Human
cagacaaaguaauuccucuca

SEQ ID NO: 2435526 - RNA, 17 nt, Human
cagacaacagaagucau

SEQ ID NO: 2435527 - RNA, 22 nt, Human
cagacaacagaagucaugaagc

SEQ ID NO: 2435528 - RNA, 22 nt, Human
cagacaaagcgugguggacaug

SEQ ID NO: 2435529 - RNA, 22 nt, Human
cagacaaaugugguuacacacu

SEQ ID NO: 2435530 - RNA, 17 nt, Human
cagacaaaccagaagca

SEQ ID NO: 2435531 - RNA, 22 nt, Human
cagacaaaaacagccucacaga

SEQ ID NO: 2435532 - RNA, 20 nt, Human
cagacaacaaaccuguuucu

SEQ ID NO: 2435533 - RNA, 13 nt, Human
cagacaacagaag

SEQ ID NO: 2435534 - RNA, 14 nt, Human
cagacaacagaagu

SEQ ID NO: 2435535 - RNA, 15 nt, Human
cagacaacagaaguc

SEQ ID NO: 2435536 - RNA, 16 nt, Human
cagacaacagaaguca

SEQ ID NO: 2435537 - RNA, 20 nt, Human
cagaauuucccaaagcagug

SEQ ID NO: 2435538 - RNA, 19 nt, Human
cagaauuucccaaagcagu

SEQ ID NO: 2435539 - RNA, 18 nt, Human
cagaauuucccaaagcag

SEQ ID NO: 2435540 - RNA, 17 nt, Human
cagaauuucccaaagca

SEQ ID NO: 2435541 - RNA, 19 nt, Human
cagaauuuggguucugccu

SEQ ID NO: 2435542 - RNA, 24 nt, Human
cagaauuucccaaagcagugcaug

SEQ ID NO: 2435543 - RNA, 12 nt, Human
cagacaaagcgu

SEQ ID NO: 2435544 - RNA, 18 nt, Human
cagacaaaaacagccuca

SEQ ID NO: 2435545 - RNA, 19 nt, Human
cagacaaaaacagccucac

SEQ ID NO: 2435546 - RNA, 20 nt, Human
cagacaaaaacagccucaca

SEQ ID NO: 2435547 - RNA, 21 nt, Human
cagacaaaaacagccucacag

SEQ ID NO: 2435548 - RNA, 23 nt, Human
cagaauuggauacauacaccagc

SEQ ID NO: 2435549 - RNA, 18 nt, Human
cagaauugugucugcagg

SEQ ID NO: 2435550 - RNA, 17 nt, Human
cagaauugugucugcag

SEQ ID NO: 2435551 - RNA, 16 nt, Human
cagaauugugucugca

SEQ ID NO: 2435552 - RNA, 14 nt, Human
cagaauuucccaaa

SEQ ID NO: 2435553 - RNA, 13 nt, Human
cagaauugaucau

SEQ ID NO: 2435554 - RNA, 21 nt, Human
cagaauucugcuaccucacug

SEQ ID NO: 2435555 - RNA, 23 nt, Human
cagaauucugcuaccucacuggg

SEQ ID NO: 2435556 - RNA, 15 nt, Human
cagaauuccuuuucu

SEQ ID NO: 2435557 - RNA, 13 nt, Human
cagaauucugcua

SEQ ID NO: 2435558 - RNA, 14 nt, Human
cagaauucugcuac

SEQ ID NO: 2435559 - RNA, 15 nt, Human
cagaauucucuaguu

SEQ ID NO: 2435560 - RNA, 18 nt, Human
cagaauucucuaguuuga

SEQ ID NO: 2435561 - RNA, 15 nt, Human
cagaauuaacuccau

SEQ ID NO: 2435562 - RNA, 11 nt, Human
cagaauucuca

SEQ ID NO: 2435563 - RNA, 16 nt, Human
cagaaugagugcuuca

SEQ ID NO: 2435564 - RNA, 18 nt, Human
cagaaugaggaauaauaa

SEQ ID NO: 2435565 - RNA, 21 nt, Human
cagaaugcuagcucugagcca

SEQ ID NO: 2435566 - RNA, 17 nt, Human
cagaaugcuagcucuga

SEQ ID NO: 2435567 - RNA, 18 nt, Human
cagaaugcugcaggacuu

SEQ ID NO: 2435568 - RNA, 14 nt, Human
cagaaugaggcugc

SEQ ID NO: 2435569 - RNA, 15 nt, Human
cagaaugaggcugcu
